United States Patent 11,260,081 (ENGINEERED PARASITES FOR DELIVERING PROTEIN TO THE CENTRAL NERVOUS SYSTEM (CNS)) - sequence listing, part 3

SEQ ID NO: 2158 - DNA, 1207 bp, Toxoplasma gondii
agacatgaagtgatgcacgaaggcgaaacccgagtaaaaatcagagaggacgaaagaggagagacaagcgggaaagggcaagaagatgtttacgaaggaagcgaagaggaggaagagacgaaagtgccccctccactttgtggagcactatgtccctgaggattcagatgaagtttcatttgccactgttgagtgttcgagaagtcgcgtctgtgcgtgatgattcagagggcgagtcccagctttcttgcgaaggatcacgcgacagcagtgcgggatccgtggaactgcgctagaaaacgtcccagccagagagagggtgtgaagcgacgccaggaaacacgacaaaaggaaacagcgaggacagacgaatgacgaaacgaaggaggcggtcgaagaaaagaaggaagggggaaacgcatccttttggaggagagagaatcgtggtaaaacgagacggagggagtggacgaaaggcgaagaatggaggccagaggattcgagagggaagtgccgaaggacagagtagaacgccgctaaagtgtgggcaagcagaacggaaaggtgaaactccaacaagagagaaggcccacggaacgagtctgtctgcattcagcgaggagcggagggcagacaagaaacgcaaaaggagcacctgggtagacaaaggcgggactaagttacctgcgcaccctttggcgacgctgtgcttgtcaaggacggaggcaatgcagagatgtgcgtgttctttgttctggtgatttgcggctgctcagagagaatcgaaacaatcgatgagaatcgacacaccttcagctgtatgatagcgcataggtctcttcaaacagatgcagcgcggctggacctaagagggaacgagtgcgctgctgcatgtgcgattcagtcttaatcggtatgaccgcgcttcccctttatcttccagcccgagaggcaaagttccgctccgctggcttgttctctctcttctcgctatcgtttcgtggggcctgtatcgcatgtctgctggctgcatgcgcttgtgtcgccggttgcatgctgcacggccgcgacagaattcgccgtgagacggctcctgaaacgaacggaggcctagcccttgtgtttttccgtcgccaaaactggatcatgtctcactgaccggtcggctctcccgtgcgcgcacgctgcggtatgcattcgtagcgga

SEQ ID NO: 2159 - DNA, 4344 bp, Toxoplasma gondii
atatgcgaacgggacgcatcgacgattagagtgtactcatacaagaagtgactgtcggctcggaattccgtttctccgtcatgtgaaaattttcggtaaaaggggaggccctcgagcgtcttgggtgaaccagaagcgcatggcggtgtgcagcggttggattccatctttttgcaaatacgacgcagtgccattccgcagttggaggaaaggagaaacgcagatgtgaggaagagcggcacggctcactcttgagcctctgttaactcgctaaacaagaagcgaactctagaacaaatgaagaccaagtgcgtgaacgtttcaggtatatacccttccggcacagaccgatctggcaacttacaacttactggcttatttccaccgtttgtgattttgttctagttcatttaatgatgctggtatcgcttattttgagcaagcctctcgcggttttacacagagtagtgacagcatttcggatattcacggcagcccgtcctcgaaaaagaagtttcgcctcttatgaaaaaagcgttcactgatgctttcagaaagctacagggaatcaggtgcaaacatggtagctggggatgttggttgtagtcgagttttagcgatatagaggcaaaggatcgcgggacggtcttcaatccccgatcggttatcatacagttgacagcaggtgtgtaggtaaagaacagcagacgctgaacgacggcaaagcagaagaacgtgttgaaatatataccgaaacgcttgcggagtcctcagcaggctccctaaatgtccgcatgcgtggatcgtcgaaaggattggtctagaacttgttcgtaaaatgcgaaactttctacattacctttgccccgacgagactctacgttcgctctgtggcgatacgactgtctagaaaaagccgctatgggacgtgagtgtttgtctgtgattccccaaggaggcaagtgactcggacttgtttcagcatgtacgaatggatcaggtccgtctgaacgtggttctcgtggcactcgtttccctgcagagcagctgtcctccctggagggtggataactatttgtcaatgaggctgtttgactcggccgaagctgcccttcagctacacaggtgtgttttcttgacagtgcgcaggcaaggcaacctgctggtgactgttgtgtgcctcgacgatctgttccatactttctaattcggctggctgaagaagctactatgccttcaccacacagatgtccaggaaaatggggtagactggcaaccctccctcgagcacgtttctctgaagccgcaccaccaacggtagcgctctgtgtctccctgccccgtccttgcggcacatcatcagtaccgcctttgtcagtcttgtcaagcggcgaatgtgtttgagaaccgctgttaccagggggcgacctggttttgtcactcgccctcttcaacccttccagctgggtgtcagaccgggtacgccggccacacgctggctgaggagcgccttcatctggagcgtgcatgcagtgatttctgcacgcgagccttggacagcctcgatcgtcaatgtacatgagacggacctgtgaactgctgcctgttcgtcctgcgcgattcggcgttggaaacctgtcgggaatctcccgtaacagctggttccaacccccctcgaccctttccggcgctctggaaggaagccgatctgactgccgcccagtgctcgattgtaaaacggatgttttcgcaagtttttccgaattggtcgtgctcgagacaaagtaagaagatgtagctccgtcgggggccaaagctggcttttttggtgccccatctgccggcttcggtgcgagattcgcaccagaatgaccttcttggtggtcgctgcgatggtctaccgtttcagcgatgggtgatgtaggtactttttgtggcaacgctcgcgtttggaaagaactgtcaatactggtggcaggcgagaggtcctgccccgtgatgattcgcgtcggcgaccgtgacgggatggatagtttctgcgtgctccacaaacctgcaagttgctgctgtctcgattcctgcacaatccatccgggggatttgaaaaactcttctgattctttgttcaagaagactgttcgcctgatggccgtttcatgagtttcgaagaggtcaagtatgcatggagggatgtcttgttgcggtcctgggcatgtgaaggttgcagtagctgtcgtgttcagcgttttccctccaaaagatgaccgttccccgccatcagagagcccgacacgttgcttcctggctcggggctgcgtccgtacgttgagcatacacttgctgtgtcccctggaaaacggtatctctgctgcagaggtcggtggatgagactgggaaggagagagaggaaaacccgtgtttttcgtcacagctacaaactctcccaggtcccgacttcccggcgactgttgcttagcactcgcagccctgccctgtttgtttcccactaaaaattgttgaaggttggagcttggcacaggagggcggacgcgtcctcgcttgccgccacttgcaagagttcttcgagattgtgatggggcatggatttttcgcggattggtcgtttttgcagaggcagtgcaactcaggaactctcgctccctccgtccagcctccaggtcaccgacgaacttgcctgctcctgcagtggccagcagcagagatgcttccttattatacaaacgcacccgagctttgcggaaacgggtattgatacgctgcagagtcctgaaacctttggcgatctcgtcctgtgtgccctctatcgtctccatttgaggaagcagtgatcgttgaagaagactggttgtagcgatgcctcctgtcacgtcgaatgaatagggaccgctaattcacaagaaaggcttaactgcggcacacagttactttcttgcttccctctttattcatgtctcggcctacctccacaaaactggagtgtcagcccgtggcacggacaaaggaactttttcttggtggtttgccttctattctgaggcccaattctcatttaccttctgtgcggtacccttgtccccgatctctgaaagaaatggcaccatctcatgaactggaaaagtgctggagagtcgacgttatcggaggtcgctggcgctgggcgtgtcttttgctgtcggcgaaggcttcagctataagatgggtttttatggacgtgtgatgctactgggtgacaagattagaaaaacagtttttctgtgcgtacgcgtagacgctgcgggggttctgcaaatggtgaccgttgcgcaggtgggcgttttctaccgaaggagagggtgattcgttttcacgcgttggcacaatgaccgcaacggctacgtatacaagttccgtgcacacacattttcagtatgttcgggcgtcgccagagactgtgcgatgcgctgtttccgagacactgaatgagggaactgtttccctcgctggaatcttctgccactaaagagaaacgagaagggtcctcacattttcgcaagcatttaccccagagcctacaaaacactctgctttgcgctgttgaaatacgagacaattcctctttcgagtacttgatgctttaaacccatcatggtgatggaagggcggctttggctgaaggcctaaatcgagacgcagttcgaactggtgtattaagttacaccccatgatgcttggatgagagaaagttcatcatccgatccgtggtttccacaagaccttctgggagtgtgtgtgcaccgtgatcgatgggctggtgccgagcacgccgtaccacgtagtccatcagcttaaagaaaagcgatggagcccggccccacatctagggctgcagccaacgaactggacaggaagttttgttgggagttgtgaaagaaaaagtcggtgatgaagagccgaaatggacctttcacagtagccgactgacgctgccttcactcttccgcttgagaaagtccccttggcaactgtgtgtaagcctgtagaaattttgaaagcatagccccctgttatctacaccgactctgcgcgaacgagggacggcatcatctggagccattccattttaaaaacatctggcaaaaggagctcgtgatccttccgttgcacagacgataaagccgcctttgcaatgcgccactgctggatacacaagccccaatacagctgtgtgaaagtatccagcgataatcctcgtgtcaagtggtagctgtaggcactcttggcgccttgctcccagccggtgtcatccgttgagttgttttttgctctgcgggaagattgacaaga

SEQ ID NO: 2160 - DNA, 4960 bp, Toxoplasma gondii
tgttttggcaaggagctcgtgagttgaccctcaaagctatgcgtgcccgcttttagttcctgcgtcggtgggtggcagcttcgtagtatataagatgcatgcgtgtatagactatacccttgcaacactaaatgttttgaaaagggtaccctctaccgcgcaccgctccagaacagtccgcggcgcggtgctctggttgagaatgcgtgttgggcagcgttacatcaaaggtgcatacttatctatgaatccttgcattctgcagtgtagatatcacaactgggactatgtgctgaagcgatccgcaggcgccgagcatcgatgtgatatctggcgacacgcatcgtaagcggtgcgcatctttctgcgttgtcacttatttacaccaggcagtagctgcctttgcacgtagtcagcatgttgcatctcgtggcagagaacttgctgcattcctcggtgccaaccttgtccaaacactgataatgacctgagctactgagtgaattgggaaatccagctgaacagcggagcaaacgtccgatggactttgtggcaacatgggcactagcatccgttagacgagtaccaacaaacgacacaggaggtttatggtaaaaggcgtaacttcgtacatgcagccttgatccatctgggaactcatcgagtgcagtatcgcgaagtggcggtctgatgcagaagcgaactccatcaacagacacaacgtcgctatagcaaacaagaccccaaaatcggcgtcacgtgatttgcaaggaacccggaaattgtagtcctgcgatatttccagaacacgggtcgaacagagggtcgctatgccacccgtttcaaggcacgaggcaattccgccgtcgctgggggatcgctcgcattgcatgctcgtgtatttccgctgcgcctcgcagagcaggtatgtgggagcttttttgttatgtacgaggtagacgtatgctccgatagttgtagggtcttcaccattttttgcggagatgcagggaaataattgcactacgtgatacgcatttcagtgtaattccattgtgaaagtgacgcgagaagttttgttcattgaagcatcaggaatcagaaaaccttgaatttacattgcgattggggcgcgacatgacgagcaaacggctagtgaacaccagagtcgtcgtagcatttttttccagtttggaggtggggggcccaaaacagcgcgtagtttaaggtggagtgaacttatatgtctgcttcgatttgtcctgtgaagcctattcataaaaccgaaaccgcagctggcaagagctatttttcacgaggtgctcgcgaagtccactggggccctcgtcccacgccaaacaagcgacgagctcgttccgtaaagttgcttttggtgtgttttaccctcgaggcacaaagtgtttcctgaactgcttttgccgtgacattgttcaaaaggacggacaaacacccagtcaacgcgcacttgaacgaaaatgtgtcatcttcctagaaaacatagggacgacaagatcggcttcataccgagggaagaccttgaaactacaaggacccaggatccaagcgagcaaagacccgcgtgaatgagttgattaagattcatagagaccacgcaaaccacattctaccgttggcttctctcttgaccctcgtgcaacatttccctggtgtgttcaggggatatcaggtgacattcagacacgaatgcgggtctttacttggaaatgaaacgtattcgtgaaccaatgtttgcgggttcagatgatataaggcaacggtgtagtgatattggctccaaggacgggtgtgggttgttttctgtctctggaatgcaaatgcatgcttaaatgctatagaacgttgaggccggtcgcttcctcagcaccctcgaatgatgactgaagagaaacgcaacaaagccatctactgctagaacggggaaaagtcaatcctgaaatccaggttgcgtgtgtggttatgtgcaaactgtgttcagtatacgtctcggtgtctgattccatacgtacacagaacgcagtgatcaccaatctgttctctttacgatggacatacttagaagcctttttctgtcatttggaagataaacagttacgctctctgcgtcgttcgaggcagctctcacacggtttgtgtgacggaacaaaagtgtagtccttcttttgttcgcccgtgaaacaaagcgactttcccgctcttctcttcttgccatgaccgacttggcatccagttgactatcttctttgccggaggctatagaagcattttgtacaaaccatgaagtatgcttgttgccgctgtttagttacctcgcaagaccatcaccgatttgtccatgcaactcctacggagtccctgagggatgcgtaacatgccctggcctttgagggatctaccctgcagaagcacggccaaacctcatcggcagtctgtatcgccaaccctattttgcccattctggatctgcagggggtactatccgaggctgttagagaacatgtgttttccaaagagctgaaaaatgggaactgaagcagaagactatctgggtgctcacagacggcacgccctctacgtcaccccagagagcccctccgccgacctctggagcactgtgtttggatgcattcaagacaatgattttgaaggtttcgtgaaggtaaaaaaataatcaacagggccttcttcaccggaagagaacggtctttccaacaagaatgtcggcaactgtttcacaggaaccacatgggtgggcgcagaccctctgtggcggccagccctctggaagaagtctagctgacgaaaaaccgctttttaaaacaggatggtgttgtggcgtgtcggaccacgcccccaaaagtctggcacaagcagaacgcatagtccttccaattttctgtgtctgtgtctagttttgggaagttaccacaagatgacatgaatcctggcttcccgaaacaaggtactctgattcttcaagaaaaagcaatatttcgacatcgatatagaccagggtctcgaattgaatagtttccttcttccgaataccgttttcacttcttagcctttgccaaaaatccaagcaaatatggggtgtggtgcgttgtgtgtgggtgtgtaatattttgtagtccctggagcttgctatagcagcggaagacgataacactgcaaagcaacctaactccgagagatcgtccgacacagaccagccagaacctccgcgaccagctgaagtcgagatctttggatgccagtcgatcctcgcgcatgctgcagccttttccgagaaatgtctcgaatatcttgtcgagacgtgctgtagcgacgttaatatacggagctcaggttagaagtccgttgatgttagatgtcccttgagacgatcgttaaataagacaaggaaaccttttatacgctcatacgcgtgacaacagtaatacatacattacgcctagaatataaccgatgtggaatttctggggtgctacagtcattcccaaccttaatgtcggaggatattgaaattgaacacttttagctgtgaaagtttgtccgagtgttcgcatgtcatttatctgaaacttttaaaaatagaactatatttgcatatcccccccatcgaaacggttcgacggttagaccaagggcatctgacccatagttctgtctggtgtcccggcatttgttctcgaaaactatcatgcgttctcatgtgttggcatctcactgttctctcctattcgcctgaggacccgcaaaccacagctgtgtcgcaaagaagggtcaccggctgacgtttctcatgcacaacagaaggaccatgtttgcatttccacttgtctcggctgaatgaaatatataaagcacgtaaacccacgacgcactggcctgcgggcctctcgatagaacatgagtttttcaaagaaggtccagattgtcccatttcttatccaccactgctgcagccttctcagtgcagcctatcctattagatatacttctcgatttgcgtactgtctaaaacctctgtgaagtgtctgcttcactcacaaattttacccaaaaatgccgcgattctttgcctaggcacacaagaccgaactgcactttttaatgcgcgaggaagatgcattgcgtatctgctctctcgaggagcggatcagtatgctcgaaatgtcgaaggcgacacagccttgacctccgccatcaagcgacatgattacgaccaggtccgcattctgaaaacctttgtctctcaacattcttttgagtgaaaactgacgagttcaaagggacctccctggccccctgatgcattcacatggactgtgttgtgcgaattgttggacgggaaaacaacaaagttttcacagcgattcgcacgccgattgcactacgtagattacgaaagaaatcggaaatccctccttagctaagctgctgtcaagcacagccggcacgcagcgtgtggtagtaacgaacctgatcccctgtaacactcaggcttctgcaagaggcggcctctgtctgggttgcacagggctcgccggattagtttgagagcattggacttttgagttctacattgtggcgcgtcgaaaaggaaaaaccgtctgttgccttcacttgtgccagagggctttacccaaaacagacactgcaagtagtcctcgaataaaatgtcggctctcattcctcgaaaggcaggtgctgcctctcgtctacgtcattcagatggcccagggaggggaccatcggtcctcttctgccggtacatggctgtatcacggacatagttctgcgctacaaagcacggatgtgcacactacagagctggtttacgtggaggcaattgtgttattccttattttccttcttccgaactgttcataggcagtcgacttccttcagttcggca

SEQ ID NO: 2161 - DNA, 2190 bp, Toxoplasma gondii
taggaatcgctcatcttggcagtgctgatggtctttccacctcttttgcccttgcaaagtccggcgccggccttcacagtgcccttgcctggagcggcggaggcgcccttggagatcgccggctggggaggccgaacggccgacggagctcccgcgctgagtcgcggagcagccgctcccgagactctcttcatggcgggcaagagaaaaatgaggaggaaaatacaagagataaagaaaaaaagagaaagaaaaaagagaaagaaaaaagcgaaagaagaaaaagcagaaaaaagagataactggggggaaaagaggagagctgtgggaagagagagagaaagacgaacaggcagagagaggaagacgaacagacagagagaggaagacgaacagacagagagaaggccctctgataagaaaggctcccctagacgaaaaacgacgtagaccgtcctccagagagacgttttgataagaaaacgtagggtggcactgccgcggcaaagaacgccgtaaaagacgagagagagtgaaacggaagacgaaggggaaacgaacaagaactcagcgagagtggagagagaatcgttttgaggcaaaggaacgacaagagacagacagcgaacgaacgagaacagccagagagctagcgccgaagagagagaaagcgaaaaggaccaagagagctggaagaagagacaagtcgcaggacggagaccagctgagaaagccgagcgcgcggaagtgacgcgtcagcgaggacgcgaaggcaattgcgaaggaagagccccgtaaacgtacagaggaaagcgaagacacggcagaggaagcgtgagaagcggatgagtgaaaaggcgaagctggagaagaagacgaagctggagaagaagacgaagtcgtgaggcgaaggcgagagccatatagaagagggggggaaggcgacgaaggctgtctacagaagctgcagaggtgagaaaagcgatgacgaaagggactccgaaaaaagagagaccccagacagttagcttccgacagacttccagtctctttcacttctcctcgccctctcgtcgcctccgtctttccctctcatcttctcttgcttctttctttcattctctgtctctcttcctctgtttctctcctcgttcttctccctctgcttctcagacttgttctcttctcgctcttcacggaagcttgtgtcgtctctctgtggcaccttggcgctgcgaaagtcgcgacacaaccgaggccgcgtttggagtcttgcggcggagattcacagtggaacaagcagagccgactcctctcgcggagaggcgagaaggcgacgaaaaaatctgaaattttgcccgcgtaaaaagaactgagcaccgttcctcgcctcagcgctccgccggcgcttgcttactcagcagcccagcgggagagcgagagaacaaggacgaacgcagctcaaagactgggacctttgagaaggagaaacgcaggaagaaagcctgacggagaggcgaaatgttctgcctttcacagggaccgctgatctctctttttccttcctttctttgtgtgcatgcgagcacctgcaccccgccggtttcgcctgtcgcgacagcagacacgcgccatggagagaaagtcttttgtctcgcttgcttccagtttctttctcgcctcttttttctcctcgcgcttctctcctggtctcgacaagtttttcgtttctcttcctctctgacggcactacgccgcctgcaggctctgtctccttcgcgggtgatcgtcttgcctcgcgcgtcgagcgccaacctcctttcttctcctacacgtttcgttgtcgttctgcacattcttctccccgtatccctctttccatctttccatctttccatctttccatcttcgtccaccgctctctgtttggtcctttccttctttcttttcttctttcttcccctctttctgtttttcctcttcctgtctgtgtctctttcgcgacctccgtccatgtatccttgcatcttgtacgcttattattggaggcgacagcacctgcgaagtcctttcttcagaggacgcagcgaacctcctctgaaactttgtgtcagcgctaagtctgagaagcagcgaaccgtggggaagacaaagcatttgctccgagaggcgcgagaccgaaacgcacca

SEQ ID NO: 2162 - DNA, 3885 bp, Toxoplasma gondii
ttgttttctcacatcagacacagaagctcagaaaagctcgaagaaacggcgcgttaaggcaatcaaggcccagcagcaattggaaatggcagagaaagatgcggacgaacgtgcgaaagcttggcaaaaattcaacaaacgcgtaagtagtcggcgaaaggaagtcacctttcaatcttgcgtcttcagaggacgccgtgcagaatcaggcggtattacatcgttgtctgcagtgtcaagagcgttgtacagagttgtgcgtgatcccctttcttgtctttagcaacaccgcattgcaggcaaaattgtaatgctgcatttctcgaaaagaagcagaacagctcgaggatgccggtttctagcgctgtagaaactgcgacaccgccgtcatcgtgttttgtggtgtgatgcaaatgctggattattcgtacatagtcgaaacagtcatgtggggcgcagggtcgcaaacaggaatgacatgtcattgggcttttttcgtcggtggtgctcgattgaagcggtgttgctgcggaaccacgcggtacttgtcacgtctgtattttgtagccggctgcaaagcatctcaaattctgtttatgagttgctgtttaggctgggtgtacagacgtgtgctgtgtgatggttcgccgtgagtggcagcggttcatttgatagttctgtttttgcgtgtctgtgcaggccatcaacaaacgtatggcggggtacatgtctggacgtggccacgaatcaatgttttctggccacgaagtgaagaccacagttagcatcagtgtcctgagttcgcagcgaactacggtgaattcgtttgttccccgccgcaaacatgatgtagatgaagaactgattactgatgactgatgcgtgtgcgttaatttcctcgtaaggtactgtgcacaaactgtaaccctcaaggctttgaaatttcatcatctttgcgagcaagcgagtagatcctctagtaccgtctctcatgtgctagagttacgcgtacatagacctgcaggagaaaagcattaccgtcttctgcgcaagacgctcgtgacgtctcttaagcgtaggtagtggcgttcacttctgagcatcttactggtgcaagacagattgcggtaaattactaaacgtgggcaacccacaggcagcataaaaaagcctaaactcatacatcaccctgaacaagtgacaactaatgcactgcgtacaccacgatccggtgactccgcgactacggagcatcttcagcgtgtttgttgaaaccgtcgtacaaaaacacatcactattccggtattataagtttctgctctttgaatctgctcgtagaaacttatttcgattggtctcctgcatatgatatgggtgggccgacgtggccggtttcctctcatcaacggtacgtctgtgcgccttgtgtgcgaatcaggccacggccttcggcatatttaactgtaatggatcaaagtcgcgtgcaacccgcctcgcacaatcactggtttgagtatgtgctcgacaaaaaaggtccttgcccttcatgttatcacgaggcacacctctacgcaccacaacgatcatcacgcaacctccctcggtatctgtccgacgagcgattacaccaacacattttcttccaacgtgcaacacgctctgacaatgacgtctgccgtctgccacaagggatacagacgacacgtccaaccgtgcctgtatcgatcgatacatgctccgctacacgcactaaatcctcacgctgagacaacaaagagccgagcaacacagtgccccttactcttcctcggcaacttcttcctcttccgcggttgcagactccttgctctcttcttgaatcgcgcgtctcctcctccttctcaacaatcgcagtagtgacacaacggccaccacagctgcagcaagtcccactgcagtcctcactggatgtccagtcaccgctgctcttcccctttcgaataacgatcggtcttcactttgtccgtgttgttgtacctgttgttgttcacccccccaagcaccttcggagtcatccccgcctgaccctgtgtcacgcgttgaaccggcaacgcccacaaaaattaaagccagcacgttcacgatcattaccgccacaacgacgcgttttacagacgccattttgttacttcacgaaaatcgcaataaaaaacagtgaaccatacacacagttagagtgaacacacgcgcgatgatatctgcaaaaaccaaaataaaattgactgacggtaggatcgagtgccgatcgacgtcaaccgtcagtgcgtctctgcacaaaccaaaccgacacggaacagcccacacgtctgattccacaacctggcaggacctttatccaaacgtgtctcgttgccaccccgtcccgcgctctggcacgcgtcgcgcgccgagggatctgaggtttctccgctaaccacctgagggagtcatgcgtcccaaatcctgtctcgatgattgctgcatggcgtactgtatcatcatttcggcacctttcttgccggaacaagcggatggtggcagcctgatcctgcttagttgtagtggcggcttaaggaaactggttccatcttgaagtactggctggataccttgtctcgtgttacatgtaacgtcgtttggtggcagggctgagagacagaaattccccttctatatagcagcatcagtttctcacagcttggaatttgttagcaacttgtacagttttttcaccagtccgtgaacagggaggcaaggccaggatttttcatgtaacatgtttgagtgcgtcccaaaacctggtgggggtgggaaagggggggttgcattgtttttttcatatgcgatgttgcggcagtcagcacgaatgccgcggtacatgcgcccaagactccgccacatagagttacaggctgtaaaattactggtgttcatcagacatagattgcatcactgaagtatgaagagtatgtaggggggcactttgcagcaactggcatttagttactttgaaacgtactttttattgcaacgtgtagagaaccagaaatttcggttagtgcggaaacggatggggttggcatgaacttctagagttctgtgtggtagattccggttcccaccagacgacgaaagcccgttggaggcatttgccgtcttttgcgatgtttcggacaccaggacgtggagttgagaccggtgtcgtgtggtacacagcgggaacaacaaatgccgtttggtggaagcctgtaatgtcgtgactacgtgcttccggcacgtcaggtggtggtgcacacaggaatgagatgaagggaacgtatcaacagagctctgaagcgaaagaacgaacgatctgtgtagctgatggcaacccgccgtttggggttgcactacagtggacagcagtgatgtctcatatagtcacttcgaagtaaggaaagagtaatgtgagtttttcctcaaagccgttgtatatgcttgcaccagtacacgataaggtcgaggaacatgaaaaatcgttgggtagtcggtcgaggcattctttcggagcaccggcgacgcgcaagagtatcagtgtggtacaagcgatagaggcaaaaacgtcacctcgaaaaagagaccgtttctgctgcacttgagcatggccccctggaagcgtttgttgccatgatgtcaactcaacgcttacgccgtctgtacacaggagctggcaccgttggcgccgcggctgctgaacaagagtttgaattcgatgtgttgcggatttactcacccacaaagtacaacgcctcagtacatttcgcggagaaccagctagatcaaagttcgacaagcatttcacaacttatctgatttcttccttgcta

SEQ ID NO: 2163 - DNA, 1467 bp, Toxoplasma gondii
ccaatccgatagttatgcctgttcacatgctcacccatgtatatacgcatatacaggtgactgtgtaactaagtcctcacgcactctctacacatatgcatgctgcgtacaatatatatatatatatatatacgttttcctctccactgtctcttcagtggagagtggagagaatgctggagtaacggttccctgaataccactttcggtgtgtgttctttatttgggtggaggacagttatgtttttcggcattttggggaagaactcggtgtcacacttacagcgtgtattgccactgggcaagagttccaatttctcaaactgtgcccatttaaatttgcaagcgataaacacctccacggacgcccacttgagtgatcgaccatcacaaacagctgcggccgcgtcgtgggcatcgtttcgtaccacactccgcggcacctggcacagtcctccttcaggcttttcctctctaaagtagtagaaaccgttgtcttctgcaagcagatctttcgcagaacaaggctcaccacggaccttttccgacaagacacacttcgctgcgtctagttccctccactcgccctttcagcaggaaatccatgtgcacagaacagcaacgaatttcggttgtcagcaactaggtcagacggtaccgtctgaggatagaaatcgataaaatcgggcacttgccagcatttcgctgctgtttgtggggtcccgtgcttgcttcccacaggtcgatggtccactcccacttgtcgatgcttgtgtcgtgacacgcgcagaacagaaagtttgatagtacttccgaaaacgcatcaacagcagttctttaaaggccgacgcatcgaagaagagccagcgcgtgtctaaagaagaaggagcagtggggaacccaatcggttttcgagttccgtcaacggtcacttccgcgcctgccggatgcctagtaaccatttctttgaaactacaactagacatggggggctttagcttttccgtgtacgaatgaaacttctaacacgcgtcaaaggcatttgcgcttgcctgacaaacatttggcttttctttgtttcacccatttgatagtggacagccctcactggcaccgcatgcctcgcagcttgtcgggggaccaaccattaccgtagattttccagttcacacgtgtcgcggcagtgactgcctgataccacaactgttgcggcttcgcattgctcgctgctttgattcctgtttctcacaacgcttgcaaactagacgggagaaagcgagcgcctccacagcttaggctgatctacggcgcaaatcgtcgatgagttatattgattttgtggtgagttactccattgttgagaaaaacaaaagatctccctatccgcattcgtgtccacgtccacgaaatgtacacaggaaagtatctagaggcgacacagttcgtttccaactttctgttccgata

SEQ ID NO: 2164 - DNA, 2260 bp, Toxoplasma gondii
tctcgccatcagtctctccgtgtctttcgcgacagttccgagagtctccgcaaggagctctgtggcctgtgcaaccatcgtgactcgggccgaaagctcctggacgccttgaacggggacgatgaggcagttctgcggatcggcgctcctcgacgaagcctttcgccacttggcaaggagggcggcgccctcgactggattctgcaccgcaaaggactgcagctggttctccaacagcgcgttcttgtgcgtcgctgcatgcgccgggtcgaactggtacaagaagttcaccatcgaccggttctggtcagacaagagcgtctctgtctgctgagtgcggcgactaatggcctctacgtactgctgctggtgaagcgggagagaggagagcgaagaggagggcgaagaggacagcgcggaggcagcggctagcgaggaagaagacgagaagaggccgacagatgcagaagacgcaggtgcctgggcagacgacgcggaagaaaacagactcccggccgtccccgaggaagagctgaggaatcccgtcgacgacggctgagtctgtggcttcaccccaaacagcgacatggttcagtcgtcacacagaggggaagaagaagaagaaagagcacctgcttctcacggagagagcaaggcgacagacgcggaaggaaaacgaagtggaagggaaggaacaaggggacaagccctcatctccccgtctgtcacctccctgagatagtacacacgagaaacagatgcacccgagtcctggtctgtagtttttcttgcggcagcgaagaaaatttcccctctaaaacggttcgtgcacttggcgagtttctcatcgaaacgtccacagtgacgacgtaaatacgtttgactttcgagtttaacagcagttttttgtttactctgcgtactccacctgcagaaggcttagcctcgagtcgacagctgttcagacgcaaactgcactctgggtgtttctgcacatgggtggacggacagctgtgctggcacaggtggatttgtcgagttcgaaaggaggcctgggaggcgtcccagaagggaggagccacaagacgccggaaaactgggggagaagccacacaaatgcgagcaaggtagaaaggaaagactcagaagagcggaacaagtggcaaatgaacgacggcgttccggggctgagaacgaaacccgctggagacaaggtggctcccctctgaggacgcagagctgtggacgagcagagccgagaaagggagaaaaagcagaaagaagaaagcatcaagttttttcggacggcgacctgtgtttcaccttgacaaagactgaagagaagggcacaggcttccacgagacgttatcatctcgagtgtgcatgcagagacggctgcttgggcatgtgaacgaaatgaatgctgtcaagagtgcagtgtggaacttcgagccagagttcatgatgtctttgaaaggaatcagtgaggcgttttccccgtcggaagagttttttcctggtcgcgagggagagacgccgccattccctgtttctcgttctctctacaaacaggtgtaacggttttgttcatctcctgcctgttctctgaaaccggcgcacagagtagcgcatctgggtgcccctttctgctcttctagtgaaaacgatatcgctttgttgcgtcttccttcacagatgctttcgtatcgccttcggttttctgaggcccgacttttctctcctctctcctgctcgcctccccatgtcttgagtacgccgtttttcgtcggtgtgctttcgagagtttggtttcgtggtgagcctttcagccggtttcgcttgagtttgtcgcgcattctcttgcctttttcaggtcttctgaatcgtctctctccccgtcctgttgccgggtgttggccgagcatccatcacgcgtaggcttcattctcccttgagacattctccgtttcgttttctctcccttcggcacacgtgtcatctgctcaccactttgaaaccagcctatttttccagcagaacagaaaaagaagacgaccttgacgtcttttctggctgcaaacgtcccgcgttttgcggggtcagttcccggcgcgtctgtgggtctcgcccgctggggctttgccttgccgaggcgcgtctgcttcttgctgaacttctttgcgtcaagttcttggtggacagtgtctcctaacctttttcctctccaaagtctcacaagcacatgcagggaaaaaaaca

SEQ ID NO: 2165 - DNA, 1754 bp, Toxoplasma gondii
tttctgcattttccgtacataccgctgtgtgcatttgtgagcaagatgctttgcgtcgctgcctgcgtgtttcccggtacactgcgccttatgcttgatcttgctcacacggttgagacagagtgtgacgcagtgtttgtgccaatgtgtaggtcgcctactagggtgacaacgcgcaggagttgaacatttgcatgtgcatgcggcagtctcgcctgactgctgtgtttatagcattttgtgcataggcctggccgtgcaaattcgtcgccttttcgtgttcatgtttggaaaaaacattccacatcaatgtgtgtgtgcatgcacgcttgtggctgtggtgaggcactcgcgtctgcatcggtctgggaactctgattgaacctgcgtgtgggtaaacggggaagtatgttcctaccttcgtgggcagatgcatgcgcagaaacaaacaccgaagattcagtgcgtaaatccgacaactacgggtctttcttccaggggtctctgtgctcccagtgggtgctttttcttgtggatttcgtttccgcgcttcgctcagccgacgcgtcggtctgtactcgctgtgtgcgctttctggcctcagacatcatattcatctgttacctctatcagcgttggatttacaaagtggacaagagccgcaccctgggggctgcccctgctccaaccgccgagcttcagcagttgcacagggacgacgatcttcagcagcctggttctgaggagaagaacgaagaagagacacgtgccaaggaagatggtaacgagagtccaacagcttccgcttcggcgctggctggtgcctcgaggtcgtccggcaagacgcccggtgccgcatgcaaacgcaactatagaccacaggaaacgccaacagacgtaatgtgaattcggggcaagaaagaaggaagaaaataaagacgagcgagcacgcggactcctcggttccctcgttcgagctagcgactgcgggagaaccacatctttggcccgagattcgaaacgcggaagtaactcgagtcgatgcctcgctagatggcgaccagaaaagaaaacgagtgaactcttgaaagcagcaccctgaggagacagccaggaaagaagggacaggaagaaactcgagagaagcggcaggagactgtcacagctcgtcgaccacacagctaaactgcccgccctctttcattaagtcccgtgtttgaacgacgtccgggagtgcctttttcttttcgtttcccgacgtagcagcgaacctagctgaatattccagtttcgctttgagttcataactccttcgttctctctcttccgcccgtcagttcccttccctggtgtcttcgtgacattttattaagttctatcgcgccactcggactttgttcctggcacccttttgtagctaggactccttgacgagtcagtcagattgacgaggtcggctagctaggactccttgacgcgtcagtcagattgacgaggccggctagctaggactccttgacgcgtcagtcagattgacgaggccggctagccacgctatgcacctcttgcatacaattgttgtagacagcatggtggtgtgcgagacactgcagtcaaatgcctcacccaacgccgcgtctcattcttccaaaaacctgtccgtgtcttcgacagattgatacagccgttgacaaagcaataccatattttacagttttgtactcaccccagtccagtttgtgtgaaagttgtga

SEQ ID NO: 2166 - DNA, 2215 bp, Toxoplasma gondii
ctttttctccaccctctaggcgacttgagctttcttcgcgctgcggggtacgtacactcatcatttcctctccggcgatgatccgcatggccgtcgactcgcctccaggaatgacaagcgcgtcgatctcctccaagtctgcaggcttcttcacctgcagacacagaaggcgaagcatcgacggcagcagatcacacagagaagcccagtcgacaaaaagcctgcctatgcagatgcatgtccatgcatttccattaaaacgcaagtgtgagaacatcagaataggcgtggtgaaacatacggaggaagcgaaagaccttgcggatgcccaggcatgcgtagtacgggaaacatcttcacataaacaagtagatagaaatgcgtctctgttgcgtctgtgcgttgcgaatacgtctggatttgggcagatcctgggccgaaactccacccttggcaccgcgactcctttttctatctcggtgtgagtcgagcgtctctgcatgcaacgcaagatgggcaaggagaaacgtttcggaaggcaggcgcgacgcgcgtttcagagcgagcagaggagagaacgaagaaaaggcccccaaagctcgatgtctcaccagagtgaggcgaagccttgtgcccaagttgaggcgcttgaacgactttatgtgatcgaagaaggcgccctggagcgcgaggacgccgagacaaactggacgttcttctcccatctttgccttcgtccaggaaaagatttcctctccacactcgcagggaaaccgtcgcacctgcagcctccaaaaggagcaaagcggagggcggaaaaaaaacgaaaaacagaaaagaaaaggaacaaacagaaaggacgaaaacagaagagcacagaggaggagtcgaggcggccacagagacgaagacgaagactcggtttttgagtagatggtgaattgaaggctggctggcgagagaagaaatgtcaagagtatctcaaaggcgaaggccagaaagtgagacaagaccgttcatctggccttggggcttggttcagcgagagacgcgcattgcctgatgaagaggctggtttgctttttcagttccctgttcaaggaaagatcgatctcgctcctctgtccgcgaaattcttgctctttcttttgtctttttgtgtgttttctttcctctttcctttcctcttcgtagaggggtctcctggcggatgtctctgcagggtcgccgcgcgccctcgcgctccgaggcgacctgtcagctttcctccacacgaaaaccgcggggaaaccttatttctcgagagcgaagagaaccttcttcttttgcaagaaagaactgacgagcagtggctgacgcgctgtctctgagctgtctccttttcggcgttttgtctcgttctgtcttctcgtttttgcgtagggtcacgaggcctgctgaagtctgtgcatgcactttcgcgtcgagcaaagtcgccctcctcacatagtcgcggcactcttttcgaagtttctcgatagacctcgtctttttccgtggaagggagaatctgagagcacaggagaagcgaagtctcgggcctgctttctgtcgacgcatcctttttcgtcttctttgtctctctcccctcgggtgtgtgcggcgaccgcaaacgagcacaggcttgcgcgtcgcagacagcgcgagcgcgagtgtgcagaatatcgttggtgctctggattttctgtttgcagtctttctcgtttcttgcttgcctttgaatcgcctgtagccgcggcgagttgcgagagcgtttgctctcttttccaacctttttttcgcttcttcagagcggggcaggcatgcgcttccacccccctggagggcgagctagacagagagcaggcgaaaaggagagacgccgacaccctgtagctggttttttaaagcggtgaagaaagctgaatttccgctcatttgactcttctccagaggcgcaaaatgcagacttcaaacggacgtttgactccacaccgagtgacgcggctcgtcgagaaggcttcggtttttccgagaggctcgagacagtgctgacgagcatctcggtctcggtacgccccccgcccaccaaaaccgcgagaaaaaaacgctggatcaagcaaacgcgcctctcaaaggctgaaccttacagtgtaacgagaggagaagaagagtagaagaaaagaggcacaagaga

SEQ ID NO: 2167 - DNA, 2736 bp, Toxoplasma gondii
tcttggagcagaacggcttggcactgtacgcccttgaatccatgttcggctcagctggggccctagggttcggaggtccgtgtggccaatggaagcagcaaggcgaacactctaaggaggaaggcgaagggccttgtaacgaggagccatgtgacaaagatggccggagtgtcgcgggcaaatgtgcgagggggaagtcaggagatacgggacaccaagaaaagagacaacagatactgaatcgaggtatgattacatgaatgtcgtcgcttgtagcaggtctctgttctgcgaaataaggaaaaaatcattaaggtagtgtagccagagtgccaggaacgcgcttagaacggtggtccccactaagtactccggtaccgacgccctaatcactcgcaccttgagcgttgttttccgtacctgttgactgtgacctcatctccatcattgacactgagggacaggaatgccacctggggtcaaacggcaacaaacagtaaggtctcaggcttgcattcccgtgcacgtatagcgtttcaactcagccgtgcaaaggggtctgtgcccaatgagtatcgtccctgtttgcttgcacattctggctgcttgattcaaccgtatgcttgctatgcaggtttctttgcagcgtgcggttttccggcagaaggtacgcaccctttcggagcctctcttctctctttcctgaagcctcggatgatgttgtcaggcccccctgtcgttacccagcccggtgaaggcgtggctgccagttgtcagtcgaattcccgttcccgcctgtctctgattcctcgcgactacgccatcatcaatattcccgtggaggtcgctctccatcctgtcgtttttcaaacggtgtgttccttggcagagacactgcgacgttttgaacggacgctcatgctaactgccaccacggctgcaactgcgttggcgcttggaatcgccttaccaaagattcttcagaatcgtgacggtggatggaatgttcaggcggccacagctgtggctgttctgctccttcctatgttcgttgcaatgcggtgtacctatgccgctgcccagtagagagccacagaagaaccagacttcaaagggcggctcttgaatgttagaaaatgtagcgtgtgcgtttacttttaaaacaaaatgagactctgttcagacagtatcgacacacgcgtccatatgcgtggagccgtttttaaacgctgatgcgtgtgttcgcctctggtgtagaaactacctagactgtgtaagaatggaaaaatatgaatccggggagaattggcgagctgtccgggaacattcgaatgcctggtgttgctcaagaaagtgtccttataaaaagaatgtccagtctatggtattcgtcgagaggctgctgcgttccggtttgcgcatctcttgcggtgctggcgagaccccagctcctacttatcattatgtatacaatccgggtaagcgcccggatgtgtagtctcacttcagacttcatcggtagcattaccacaaaagacagtttccggccagcttgagtgacgctcagtgtgtgatgctgttgacggacgtctattgcacttttgttggctgccttgtgcgtgaaacgggacacttctacgaagcgattctgcttcacagtaggcacacaactgggactagcgcacttcttgtgaaaacacttatgcgatttagagcacgaggtggaaacgaatgtcatattcctcagattagcggttccacacagagagaggtcacagatgcgtgagtgccaagagggacacattcactaggaactccgcgcactcaataacgcacactgcgtggcaaacatctactgcccttccgtttccgggacagctctgttccaccgttttttgtgcattacgtccgccactccatagtttcttgcaagaggctgcacgaatacttgagtgtgtgagatacatgttgagctgccgtcagactaccgggtgaccgatcgcctgtggtcgggaggacgtgcttgacaagttcaatttagagctccttacgatctgccacagtcaacgacagaaatgcctgtagaacagcttgccttgctttgcacctgacatctcgaatggtgatgaatccatgtgtggcctcgtctctgaacgaccagagagatcgtccgggtacaatgtgcgccaccagatgaaagaacacctgtctactccaccaccgtcataatctgcgtgagctatttctgtcaccgtctacgataacgcagatacggcaccgacgacggggtgcgctaggcctggtcggctaccgaagtagttaagaaacactgggcgtgctaggcgatcggttgtgtttctagttgggctgatcggccccgcactacgcgtggtggtcatacggctgtcgcattgcgcctttggacaacagactccaatagtcattatgtgtccattttcgttgttgcgttcattccttatgtgatgtgtagtcgctgttcatgttttccaaaacattcggaacgcgatactgcatcgaacgagtatgtcatcacgtagacttgccctaacttgtgcttgctgttcgttcttttcttccgagggcggtgaccaggcagaagctacgcgaagagcagtcggttgtgccgttcgaagcgcgcgacgttgagccggagggcttctccatcctgccgtaccatcagcatatttggtgattcctaagttgagtttgcgagaa

SEQ ID NO: 2168 - DNA, 1456 bp, Toxoplasma gondii
gaccgtgtcaaagccaacatcaaccttgcaacactggcatgcacctgaaggaaaaaagccaaattaatttgcggtccttgtcgcatacccgacacgtaggtgccgtgtttgacggcttgtgaagaaaagtgagggacgagctgcccgaacagcggagcatggggagtgtcaggcgaccttatttactcgtgtccatacggatatgtatgaaaaagccagagtgcctttggaaaacaggcctttctgccagtcgccctgggttccgcacacgcggcgactgcgaaagtgaagaccaacaaaaaggaccagacgtgtttgggtaagcagggacatttagaggagcaacggaaacaagtcctttgcgtcttttctagaatggttcgcacgagagcgcattttgtttcctcacggtgactcctgcctctacggttctgagcaagagcataacgcggtggttcgtcatccggatttccggccactcctacagacggtcacgcctgactgtgaacctgtcctgtctgaaggggcgattcgcgtagtctagaaggtagtggagaaatgtgtgactgaatatgggatttattaccacacttcatcctcaagagtaaggcatcatgttccagataacggcgagacgactggcacatggctgcacacattagcgggaatctgtgtcagctttgaagttgtacatgtattgtaggatacctgaggggactataagggtgaaaggtagttgagtgccccgtaggactgttttgaagcaccaagatatgctgcccaaaacattcccgtgtcgacagcgctgaaaacgtgccagaggggtgaagctgtgcttccgcagtatagaatttagattctggcgtttttactttcctacaattcgttcgacagcggatttgaaaagcgagcaggggggctttgtgagttcggtcctacgtcgtcgtgccggacattaccgcgtgaagcgacgggacactccacgttacacgggaacattactttctttcgaggacaatctgcgctagtagcatgacagcaaaaggttcagaagctgaatatcttagctcaaatgatatcataagctcgagcgaggcgccttttcgcttacacatcctcagaggaaaaaagtgtgcgacccgcctgcagggctgcggggccccccgtcggtctttcgatagagtcacatacaacgcacatccgtttcattccacgtgcgtattgaaaataaaccctttggcttcgattgtccgtcacggtttcggtaccccacgtcggcgatggttcgaggtgagtgatgacacgaagaagaagttcggtaaatgctcatttctatcctatgacagtaaaagaagccttttcacgcctcgtcgagcaaccaaaactggaacatttttgctgacatttatccagttctcaactggcagcgtgctgcggaacaggctgcgaatcgcaa

SEQ ID NO: 2169 - DNA, 4592 bp, Toxoplasma gondii
gctatgcaaaagatcttcgttccttggcacacttacatcggcagtatatcgcgctgctcgccgtagagtgtctgttgtggaccgtagaagtgcgaggcccgccattttcacttcggcaaggcctctggcccaagaaatgaagacgccggcagggaacaccagaccagctgtcctggcgtagcgagaaagatgtcggatgacgacgacagagacaacacgcaacgtgtatcacctggattcccactagaagacgcaatcaagtaaacagggaagaaagagcaacgcaaagcgaggtctcgcctcgttatcggttgacctcaaggctgagaggcggtgccacggtgtacaggcacggggctctttagcagagccaccagtggaagcaggggacgagcaggcgcccagggtaaggcggctctttcgcctacttcaccgtaaaagtccgagttctcggtgttggaaaagagaagctaacgaagacgcgtgacgccacggaacggggagaagtgcgaatgcaaaacgaactttcctgacctggaaaggatgcagcgactacgcattctgcccgcacacctgatacagagagtactgtccggtattaggtcccttttcaaaagatgtcgaatttggggaagtgggggaaggaacagaagtttcatgcttctttcagttacgttgaaatttgcgtgagtcaaatataaccatgcttcggccgcattttgatccgatgctcataatgtggcgcaccggcagtggacggagaaaatagggcacaaaagaacgtattgatagtgctcattcctggcggaaacgccatagtagggcgtgtggcgccgagtggtcgcatacacaaatcgtcgcgagatgaaccggtcgtgtcacgggctagacgcagcgcatcccattcccgatgataatagcgaaggaagcctctggcacggaaatacgcaataatacttcagtagcataaggtgagcatggcgatgggcagtctgacaggaagagggatcggggcatccgctcgcaaaatggggccgccgcagataacagcacccggcaaaagtgaggagacaacacgggcgatactttagagctgcgttgaagcgaaagctcctcagacacggaacgaactgctttctttcaaaagaagtgcaagcgatggaaaaagcgacgatatctaagcaacaagcgcgctccgcacacgctacaggacaggatagagaaacgagtcacagagcacgaaaatcctcagcttttcctctcgaaccggaacagaccggctgttgagctagcagtttccctgggtgttaatgaagagagaacaacacgaagaacaaactctagaattgatagatacacactaacctgctaacacgatgtctaccgcaatttttgtcgaggttcagcgtgtctctgcttcctacactcaagaacagccagcgtcgcgagccgagttgctgcgatcagcactacggacgggcatgctgcatgccgcggaaaggtggcaccgtacacgtatctggttcttctgagcaagacaccaccgaagaaattagagagtttttttacatctcttcgtctgtgcaaaggacgatgggaggaggagagcgcagccattcctgtgacggtcatccttaagccagtgtggcacaccgaacactggcagttggttggtcgcagtagagaagatgcctctcaggtggatcgatagattcctggagagatgagtacaattatatgctgctttatcatggcacagtcaccgttcgttactgcagaatagctacatcaagaaaaaaaggggcgtgtgggctacagctaccatgtatggttcgcgtccatcagcgtgcaaggcagacgcccaccgccacaaagacttgtggtaacacagttgtggaaagaacattgttctgccggatgcaaacagaagacatggcagttcagttgcacaagagaagtgggagaagaggaggggacaaaaggtaagaccaaaagagcacctcacctcacaagacaggcgtgacgctatcgcataatgcccggagaacagagaaatctgtccgatgatacgcggttgcatcagactggttgtgattatctcgaaatatgactatttacaagctgtttctgaatagtgtatgctacgagttggactactggtgtagaccgtgaatgtcgttgaatagcggatccaagttgtatttgagttagcacagcatattcaagataattattgtagaaacagacccaactgaataccacaaatcagtatacttcacgcctctattatctgaaggagctttcatgcgtagtcgaccatgctggcccaaaactacgccagccagttcgcgagtgcgaaggatatgactcagattcctaaggcggagacgattctcgcgaaaatcaaagcattattttagcgtgtggccagtagagaccaaacgtttttcctctgtagtcgttgccgggccttctacccactctatcgatctacccagaaagcactgcctgttccaggcacttgtgcatgttttcactttcccgcttggagctcaagcatgccccctcctttctacaggccagcgagtcttcacaagtgtacaaaagtagagagactctactgtgccatcgttgcccattcgctccgcacagtgactctacaaaggcgatatgtttgagctcttcatcaagtttctgaaaatattcatgcgcagttctctgccttactgccgatgccttcttatgcaggaaggagaccttgattgccgcactgattaaaaaaaatttaaatttgtggccagtgacgccaagagaacatggagtctggtccagcgaactcaagaagatctatgtcgcaaaggcaatcaacacaaatctttcagttgatcccttgaaagcaactgtgtgtagtccatgcattatgcagacagggctaaatcggagaagtcggcgtcggagtcttgcaaccctgctgcctcacaaaatagccagatggctacgtagttcttagtcctctctgcttcacgtgcaggcctgccctttgaatggggtcctactagacctgtccgaaatgtagagggtgcgaggtcctgttagccggaacaatcactaggtagaccgacccacggtgtctggaggcaccaaaagcaatgacgatacacgccatgcagaaaaaaagaccaacgaagggtgcgtgagtgttcgaacacgagtgtgaacagcataggcgccgagattccctagtgcgaatgacgaacatgcgtggaaaacccggaatcaacatgcagtcagacaaagaatcctgtgtgcggctttacgggtgcgtttcgtgacagattagtgtcccctccatgctctgtgccaatctgattgacacagagctgtcacggcaacagtataaagtgatgatcttgagcccccttttggggccgaacttcacctcgtttagtacctgccagccccagcttgtctggccctcgataggaatcgtttaccgagcgccatgtgacctccccccgtcaccgcagacacaggttgtttgccttcaggacgaggtcttatctagagtctttgcgggtgcgtgttgaaatgatgttaccaggaggacgtttaatgcaaggattggtgaaaatgcacttgacgaagcagaaaccttcgtccgcgacgcgcctcacgagcttcgattatcacttcgtttcaactgcgttgcagcccaggggttcgcttttatatcttagtatgccaattgaaaggaaatgtcccttacaagctaaatacatgacaggttgggaagaatgctcactttctgtcaaaagaagctgctgctgtacatctgcgccacgatggcttcggtcacttcatagcgccctcccccgcttgctgatgcgtcctcctgtacccctattttttccacgagtttgcaaatatttgtgcgccttggaaaccttcgtgagtgttctagtttcggtaatacacgtgaatgaaaaagcgtgtggcgagaagcgaagtcggatgtgaaaggacatgcgcctggtacgcgagaatcctcttcgtctgcgcagctttgcatcccgactcctagaacctctccaggtcgagcgtcgctcatcgtgaggcacttcgtgccaaccccccttgcaggaaccttataataaaacagaaagcagagacgcccaaatttccccttttttcgggaaacaatcggcaacagaggcatgtgttatctcggttccgtcaacagatgtttccccggtacggctcactgccaacatcgcttccgtcggaacgctgagtttcgcagtattcgagtgtgacgttcagcttttcccgattggacatagtttttctgtgaatcacgaagcctgcacgcggttggggggtttttattcacgttactgcaaatttgtgtgcttgtctgtcgttgactccgtgcgcttcgtgtgcaatatcgatccggcgtcgcctgaggtgtccttcaccatgtccgctacctcgggcgagtgcacgcgcccggaaggcgacaaggaaaaagaagaaacacaagcttcagtgcaaccgggacacagtgaataccatcatccgttcgctggaga

SEQ ID NO: 2170 - DNA, 2320 bp, Toxoplasma gondii
tttgcgtctctctgaatatatgcatagactggtgcggtagagaaacgcgggcctggctcgacttcccgttatttcagaacaaaagatccgtacagactgacacgcagaaggagactaccgaagtgaatagggaagaagggggggatttgtctggctggacgctgtagatacattcgtgggggtgtctgctgaaatttatggagctcgtaggaaaacgtgtgttgctgggtcttttttggttcgattttcaactgtttttgtgtaactgtcgatctgctggacggcactgaatctcgtatgattttgaaagcgcaaggcgctgtcttttgttccattgacctgcctgtcaatcggtttccacactgaactcttattccttcgagatatgcgtaccgccttcgctagtcagtttttatctatctttacaaagagacgtcaaaactgcgagagcaaaacgagcagatcactgaaacgtgtacaagatgtttcctggatggcttgtaaaaacgagagatcgctttgttgcgcgtccgaagatgcggctgatttccttcacttggcaaaaaagttttgtcaagcgaaaatcaaagacttcacgctcttctctcgttctacgaaacgaaccgtgtggctacacagaagagaagagtataggtaatggtgaccatttatccactgacttctgtgtgttgacgaacgcgcgtccggggagtccgagcgcgaatctcagcgcctggattcatctgcgggctgacatgaggcaaatgccactcaacctcgcgaactggtgtttcccattgaactaatctgcttggcagaacgggcgtccgttgtgccaccgtgaaatgcataagacacagtcccaggagaaacaattttaacttcccaaagaggcgatttttatgcaaatgtgtgaggcgcgaaaagcggtcatgacagtcctgaacagagcttttcagcagcaactgtggaaaccacaggaacaccggaccacggcgtcaacactaacgatccatggaaatcaccaatttcacgatgctgacattcctggacactgcgtgaagcctttgtgttggattcttggggtttcggtctgaacacagccctgtgttaattgctactgagtccacgaaaaagtgagaaatcaccaagtgcagcgcacccggacgcaagcaagggccggctttttcgttcaagaacaagtggaaagaagacgcacgttgaagtcgaacgagagatctggaaatcccctgttggtcgaggacggttttgaggggggatctgcgtcgttcgaccgcgcccaaaagttgcagagacagacggttcgcaggggctcgagttttgtttcgtctcacgtctaaaactgtcattctagagaagcccactgaacccaaaagtagcggaacagcacgtttcgcattttcaaacatacacagttgaaaacactcgtcgttcgggacgcacgaccccttgttttgccttttccctctcctttgcctcaacaccgacgcagttatcgctttgacgctcgcttgacgtgcgccgcccgtctgtgttcccgaagttcattcagattttaaagctttcatccatagagatccccattcaccctttcatttactcttcgttgggtttttacatgatgcaaatccacttgcttgtctacactaacaaacaggacacgcgcgtcctcttcccgggggtcctgccggtgtcgctacggttttggacgcgtttgctttggaatttctgcacagtgcctcaccattaaagatctttctgtcacgccgcctcatctattggtgccgacgaaatgaaaaacagcaaccctccacctccaactctgaaaactgcaacgtgccccccccccggccaatggtttatgcccccggctttcctagctgcacacccagagactcaaattgagtttgcagacccaccatcgatttcttgcagcagctctgacgattgtgagtcctccagtgggtctgctccggttttgtgtgcgtcgtactttcgttcatgactatgtttgtcgcgttcttcagtctgaagaatggattatttctccgagcaaaacttccatatctgtttcccagtgtttgtcagagccgacacttgagagaggagagggattgctcgacgagaaagaacgatgggtacggagtttcgaacttcactttaatcaactgaattgaataatacagggttggaaacggtggaccatcacgaacgcgtcgcattctgccagttttgcagagcgacttgccgttgtttcgacccgtgcccttcttggcggttttccttcaaaaaggcacca

SEQ ID NO: 2171 - DNA, 4707 bp, Toxoplasma gondii
tctttctgttgcctctccataaacgaggaactggagagtcctctttgcgtctcatctcacctttcctccgaccccgaacacggcgaatgcccggcgaagttgatcgcgccgccttctgggtctccatgcgtcggatcctgggtgcctcgtcgctagtctttcgtccaccttcttcttctgtttcgctgtcttcgcataagtcgtcgatccagaagctgctgaactcgaggcgatttagagtgtctcgacagtggtcaacgagtgttgccggcgccgagggaaaagcgaagaatgcatccttcttccctgttggatctcgaccttcagcaaaggcgttttcttgtcttgtcttgtcacaggccaggcgcgtttccctcgggatctttgcgcgctcgctgttttcgtcatctcctgtttccgagcaagcctcgagcgtcgtttccatgaaatctctgcatcttcgccggcggcggtgacggtctgcgtcgcctccctgggcgttctccagcttttcgccagtcttcgcatcctggtgaagcacagatttttctgttcttcctccgtgactgaagcccagctcctgcgacttggctgcagcaggccctccagagtgtcttctgccgtcttctccgtctcgttgcccgcctggcagtttcacagagaaacgcggagaggagagaaacgcggcggaggcaggctcggaagagaagcgaaagtcaaaccactcaagaagggcgtcgtttcggtcgagaatgacgaggcgaatggaggggaggagccggcggcggagactctcacgcaaagacagacacagttcccgaatgtacgacgaaaccgctttcgcatgactccaccagacgaactggccgaaaaggcggacgcgacgaaagagagaagagggatacacaccacgaagacacagcagatgatggagacaagcttccagaaaagagacgagtgtatcgacgaactctaaacacacggccgacatgggaggcatggaaaagcgagggacgagggaagcgcctcactgaaggtttacacatgggaagggttccacagagagacgcacggtgagagaaaacgaccatgctcagctcgaaaaaggaagtcgaagacagcgatgatggagacacggttcctgtgactggcgggggggtcaccgttctgtcttgtcttgaaaagggggaaacctttgcaaagaggaaatactgcagatacatgtgcgcacctgtgtagagcgtcgactcatgagagatcagaatttatttaccgtgtgcatatgcgaaggtttgacgacccaaggccgtgggcatggccggctggcggcgcaacgaccgcagaaaacctgaaacgtggatggactgtgcagagacatagatttcggtttcgcatgtaaatctaacggaagcaaaaccaattcgtctgctgcgacagggaaagtcaatactcacatgggaaggaagaagcggaaaaactcagatttgcaattggtcgaactacctttgaacatgcaacactcgatgggcgcgttagttgcatgcattctcagtcgagagctcttgctttgcgtgtcagcggtgccgaacttgctggaagcgccttcttctcgttgatgcccgttgcttttcacgtttctccctttccacatgaatgtcctcgactttgcgcttgaccggcctctctgttctgttgcaattgcatccgtaccgggacactgacgatggtttcttcttcggccacggagtgaaatgagcaacagtaaaacttggggccaaggattttctgcagccgacagatgaacttttctgtctaccaacagtccagatttgcccacgtagggaagaaacagctttcccggtgaagtgtcggtacaccgcagcaaagcccctagcctggtgaccctgccttattcatgccctgagaacagaggaaaaaggacagattaaccgctattgaaaccgctacttatatttctgcacttaccgtatttgtagatttacgctgattctccagttcgacttttacatgacaaggcttgatagtaccaccctgtgtacctaatctgaagtcgcagcactcgcgggaagactcaacaagacacgaggctgctggtgatcagaccgaatagccgacgacactgccagaagagttcactttctttgttgacgcagcacgcgggagggacattttgcgacgtccacacatgcaacagcaatgacaattttggaaacggtctgccttccctgtaaaggagcgaggaaggcaggtgcgacctgagtgcctctttttgacgatgagtttttcccacatcgtcatcaccgttgacacgtctgtcagcggcgattcgccatgaataaccaaaaaaggcttggtcaacgcgtctgcgaaactcggcggggaacagcagtgtttgcgcaaagcaaacggttggatctcaagcatgagcgagtaacactagtacgcagataattgggtcgtttctgtcccaaatcgcttagcgataaaaaggcgcgctcttctgtctcccgttctcttatatgtgcatcatactggtgacgtcatgttgccgtcgtcagctttgcggctaccacgtcctcatcagctctttgacaatcgacgggggaagactatcgacgcgtgtttggtttctcgcatgtccaccgtgtacaaacacaacgacctaatccatgtgctggaccgcgattttcagtgtgattctttcttccctctcagttatttgtcttctctgttccttgacggtgtggcggtggtttcgcctgagacaccagacgcactaacctgtcgaggaggccgccatctcacacttgttcggcctctctcttttccgcctcgtggaaaacacccgctgcttgtgaatccacgtcagaaaaacaatgcagagatccagtatttccgccgagcaagccgaggatgtgcccccgtcccgcgcgaatgttcgtatctggttgctgaatcaaagcatccccaacacagcgttctgataatgtgcggactaagacaacccgcctgagtctgtcgctgggagtgagcgttagtgtctacctttttgcagaaaaaaatgtctactcaggaacccgcatcccggggtaagcaagttccctcttgcagattaggcactggcgcttgagtgtgaacgcggaaagccgccttcagacaaacaacctcacacctgtccctactctctgacagttcaccgcgtccggctaccttgcgctaagattcttcttaaaactgttccatccatatgaaaggaagatgctccatcatcaagtgattcgcctttgctacgtatacaacgattatcagctcgtgacctgcttgtttttcgctcaggtagtcgacagtgccactacacacaagatgccgcggttcccctttcacacacgaactcgcgacagagcgtaatgctgaaggacctcttaagatacagtaaaaaaagtagcttgcaacatcggcatcaaaaccctcaaggaactcgatattcctcgtccattcacatccgtacgaaactttgtgtccaccctctgaatgctgaacctctcattcactgcaaggagtaaataggtgcacgttccgctggaagcgtgcttcccttaattctcctgtttctgtacacatgcagtctcagtcactttcattttggttccagtcgcttcgagagagatctatctagacagcagcaacgaccggagggttttctatgcgagtattctctatcctcaggtgtcttctgtttattgaaaagtgaagcatcatgttgactaaactcacccttccggtgcctaggccttgtttgtggatggacaaaaccaaccaagtatggcgacgaggtaacccgggaaattcagtgtgcccagagaaaggattcgacggtgcatgcggctttttttaggtctgctgcatgccgttgacgttctgccagcgtccggcctgagaagtggaaatcaagccgcagagagaactgttttttcgcttgaacttcagaccgaaggttatttaatatgcggatctccgtgatttactatcaccggaaatttcttcaaaacttgcaaggtatgcatgcacttggtttttcgtgtcgttgaggagactgccctaggccacgcggcacaccggttctgacgcattactgtcgctctgttctcggttgtcgttatatattcagttattcgaatcagccacactggctgatacgttgtaaaaggcgaggctgtgctctccctacacagtttcctggcttggtgtgacggtcggcgttttcttgtcttgtgcattcggccttctgggatctcatcttgtttgctgctggtgaccctttcttccagagaacttgcacacttgcctattttacttgcctttcctctccctgtccgctttgtggtattcctactctgttcctcgtcctaggtttctgtcttcgcgtcttttaccccgtatgcttgcctgccccaagcctgtctttgctggctctgattgacatttggccgctcatacacagtcacccaagatacatttgtctctcttcctctctcttgtcccgcgtcagcatttcgtccgttgcaccgactaggaggagggaagccgcgcaacgcgacccgaagagaggctcagacagaggaatgccggagccgcacagcgctcgcaagtagacaagccacgaagacagaggacgcgccatcaaaa

SEQ ID NO: 2172 - DNA, 2096 bp, Toxoplasma gondii
gggaaatcccagtgcggtggagctgcttcacctcgttaacgtaggggcaggggtagccagctgggtctcgattttgagtgagaagcttttggggcttgcgattctgaacgagtttttcgctgaacggctactgtctgccgttcacactgcgggcagatattgtggcggcgctcatatgtgggcgcccagagaaagttgagctcttagaacagacagccgactctacacggtgaggagaaacaggcgtttcctctcgtgtctttcttttgtgtcgtgcactagagtgtctctaagcataatgtactccgacttcgatggaaaaaatcgatgtcattcaaacagcaatcagatgtgggtgctttcttcgagacaccaaccgagacttacatctgggagcccctctttgaggcagagagtctgccgtctggatgatattcgcaacattggtttacggtgggaggaaataccgcacgacggaagtctacgtggtggaaagacactgaagaagcaatgtcggtagcctgatgtgtccgtttgaaccgtagaattggaaaaataggggatcaccttcttccggttgctccagccagtttgttacgtggggagagttcgccgacagaagagacatttcgaggttcacggcttcatgcaggccgttctgtcgacggagtgtgaatctctgcactgaattgttcacgatggactaccgacgctttcttttgtaagtggaagcagtgcctaccaacgaactcgacgtggttcagaagtaccagataaattaagagatactggagtcttctcagtgtctgtttgttgatacactcttctgccggtggtaggctcacacgcaatgggcagcaaacgttgcaagtggaacacatgagcgttatgacaatcaccgagtcgctcttctgtctcgccgtgtttcggcaaaccagtaaatctttcgttccgtttcactccagtgtaaaagcacgcatttgacatcatgcaaaggcttcctcgtttgacagtaccatcgtacatgtataatgttcagtggcaccacctgtaacggagtacaccatacaagagtcaagtgtcatccgcaggtaccacaggcgaagaatctacctcaaaattcttgtcgggacgcccctccctccataccggtcacgaagaacttacggactggttcgtgaccgaccagaagctgttgagcaagttcttagcagtttttcgggtggatcccttgctccgcttttacagaggttggaacggtcatccacgatcgcgtatgaacatccaggttccctaaacgagttgtcctccgcgtacgacgcgtttttcactcgacaaagatgcttacaagggacacccacagcaccagccttgtcggaataagggagtgcgtcaagaatggcagggagtaacgaaggaattttccttggtggaacctgcggctggaacagcccgcttgcgcgcatgcatgcaaattctaaaagcgttgcccgtgtctcaccacatgcagcggcatttgttcgtctgtgccaccagtatgctgcaaaatcgtttaccacagctgctcgtttttcttttcggtcgacaaacgacgcatctggcgggacggaaagaactggtttcccgctctggtcgttccacggctgtgggaaaactgcgatgtctgtttctgccacacgtcgcctgcgaggattttatgaagtgtactttctcgcgactgcggtattttcagtcgacgcatcttcacctggaagtcgacttcttcgcttctgttttccttctcgcttcttcgactcagatttgccttccctcgagcttgcctcgctccgtcacgacggcctaccgccgtgatccagaccaaaaacctcgcctaggaaggcgacgaggctcgcaatcaccggaggaaaactcgttcaaagacacggtttgtgttgcaagaccgtcctgcctgactcctctcgcacctggtgcatgcatcgattctgtccatccgtgtatctgagttgacatgcggttgtagatgctggatgctgtctgctctggaggctgcagactcggaccagtgcatgtttaaaaagcgaagaaactgctcacca

SEQ ID NO: 2173 - DNA, 3911 bp, Toxoplasma gondii
ctgccggcggatggattgctttgatatcttagaggaaccatctgaggtttgtttggttcattagaatcttttgacctgccggatattctgtcattccgttggcagtgaactgtggaaatatctttgacgaagtcgcgagaatgctgattctactgcgatcggcgtagggatccctaaggatgtgtaatgctgtcagtgtgttaactgttactagtgtgactcacgtcccaggtgcacgggccgctgatcctcgcaagcgagactgttgtggttgagcgtcttctggagtcactggagacgggttggtcagtcccatgcctgaaaggagtcaggttgtaaagtgatgactcgcaacattctggaactcctagaggcgggtgcttctcttcttgcagtggttggtcagtaccgctagaagagaaatctctcacagtctgtagctgaactgccgattgttaggttgttcttcacagggcacgtaacgtgcgttcaacaaagaggcgttgcccgtacagagcgcatcagcgataattcgagcgttaccgtgatgcagagagtggcttttacttgtgtgtagaagacaagcacgatgcggacgaagctgctgaattcggcgggaggcttgcctctctaatgcgagaattacacatctcctgtgcttttcggaaaagacaacacaaatctgaagtctagcagcgagcggatcgggtaaatggctcacttcacagaattgtgcattcagatggtctcatcccttttccacaagagttcgctatacgcattcgggcgaagcctcaaagtgtttctcgtaggacgccgtcgtagagagaccgtcttctccaagaagaaccctgtgtcctttcgatgtggatttacccaatgccggaggaaatgcggctctggaagagctgcacgagttccaaatcacaaatggcggtcctgcacacgtcgcttctggaaatcagtttcctcgtattctcgcaccttccgggggtgatgggtccaagcactgacactcagtcgaccgaggccatcgatccctgttagagatgacgggcatctgtgctgcaaaggaaatccgtttctccaggaaaaacaccattaaggctgcttagtctaggggtatgattctcgcttcgggtgcgagaggtcccgggttcgaatcccggagcagcccacggtcttctcttctgcagaacgagagaatgtacccatgccgctgttttgtcttattttgtttatggatcacggtcagcagctgatactagcttatctggaccctggaacctccacattcaggtaagagtgtggcatgttctatccgagcttcaggctcaagtcgcaaaatgcgcgtgatgtactatctcctcgaatcaactagacatcaccgtttccttataaaatgtctggtttattagcacaacctttaactatttcccctgttgcagtgtttgttcatacgtcgcagcgtatcccctcttgttcacttcgcgacaaaaaaggagagggcttgttcgaaaacgtgaattcggagctgcggtggtaactcgtattcgccaccgcccctgcctggtgcacaccatcaaaatcgccgattcaaattatctgtgctgctcgttgagcactttctggacttagatatatttttcggatgcctgtgtattatactcccttattaacccttttcctctctctgtgttgaaaaaaagcccagtgattatctcaagcttctgctgcgctggcaggttccaagcccaaggatctgcagctgttgtttccaaattcagttctgtctctctgaaaggaagacgatacatcggagggaatcgatctttttgtgacgtgaccaagcgctagtgccgacggcaaccgcctacagcaacagagcatcactgttatattcgctctagaacacaccacggtgcgcaccctgaaattcttcgacaagagggccagggagaaagaaacaatcaaaagtcgtggctataaaatgtgtcttcggtcttttttattctgtgcatcgcataaagcaatttctgtcttctctctaacttgtcgagtttatcgatatcgagcacataagcccacattggttaggggggaatcgtgatgtgcctcaatttgcatctcgctccactcgcggtccgtaaacgctatcctccaccattagtgcacgaaacgccctgacactacatttcttgtatagaccacaatctcgctattatataaacagtctcgccctcagaaggtcgcgtgtggtggctaaaataaatagatttgccacaagaaggccacgttttgtatgcacgacccgcgtaagatacgtgaatcctttctccctaagcccggaaggatgtgctagcaacttacagctacggcatctcaaaagtacagacagtgtcgagtaggacaatgagccaaaacaacttccctatcggaagtgacagtctatctttagattaagtgctctatctattttaaataattttaaacagcccgattggtgtttttatgaattacctgaatctgcctggcgcgtagcaaaaccccgatcctaggtttgaatcagaagagctgaatgcccgctatcggggcatagtgatggaagatgacggaaagctctcttcagttatttctcagacacgtggcggaccgccctctcttttcttgcatcccgaatacaagagcactggggcacaggctacatgaccttagtcacatgacacaccgcgtccggtgaatgaggtacagctctttcactctttcacgtgttaagagtcagaggcgacactcctccttctgctagctcctgagttgctgcgttataggagagcagcagtgctcctttctttgttgaacaagtggcgatattccgcgagcgtatcgaaacgctaccagggggagggcgaaggtataaaaaacacacaagttccgacagacagttgccacgcccggccgcaagcttgaattgaggtcaactagttttcgtggaaaagaatcctaactagcggcatgttcctctgtgtatggacgaggagcttggcagaaacatgcaggcagttaccttgaccaccttgaccaattccgactgcaaaaacggggtgaccctgcgttttccccagcacggccctcgcgccatctgggtggctgtatccccctctggtaactggtatctgcgcacggatctgtggcgttctggctcgctggcatttgccgtctcgccgagtagtccgtcgctgctggcaaccagggtgagctgtgcttcggcattttggggagtactgggagagcaacagagaaaaccggcatttttcctagtgacctggactgaatccaggaacaaataagtgaaccgctactgccgcttggaagccggtagggcatgcgcgggttgcagcgtctagctctacgcgagtcttggtcaggtttgcgtaccttgctcttggtgtctagataatcccgaagagatgtaaatgagatactttgagtagatgtcagatacaaacccccttgttttctagccgcgaggcaatagtccccccgtcccgtcgcagtctacgaaggagcgtgtcaccgcgtccgtgtccctacaaccacagtggcgtgcgcttgcagaccgctcgagccgcatcattgtttttcgtgctcccgttgtcgcattttttaaccactcgtgtatctgtcacttcttctctagcggagggggacggcttgccctcgctccgcgtttgttgtcgactagccgcgtgctccacacctcctttcgcagtgccgccctgattacgatctgcaggtgttcttacttccgtgtcctgttggagcttcgtgcggacccgccgtgtctgcccctgttacgtgctgcctcgtgtctctacggtcggctcgtgcactgtgccctcgaccggtcaaga

SEQ ID NO: 2174 - DNA, 1696 bp, Toxoplasma gondii
ggatttagaaacaaagtcgggtggccaaaaagagccgcaagcttgcaaatcaagtagaggccgagctgcataccaacaaggcgcttggaggtcggacttctctccttttctgtctggttactttgcacaggcactggacgaggcgccggaggcgttgcgtacacgcgaattcctgaggggacggcgtcagtcattgcaactcgcacttgaggtccagtttccagaaaggacgggacggcactcgaaccgcggggatccgtggttgacgtcgcatgcatttccaggagagaaagctcgacggactgagagactgaccagcgagcagcatcgctgcccctctgttggacatagctattcgcgacttcgtacattttcgcggggttgctgcggctctcgtactcctcgtggagaacctcgcggaaattcaccggaagttgccgcagattgtgcagaacggccacggggcaccccttttccgcggccctcactgagaacaaaagacagaagaccacacataacggacagaaaaagctggagacgcgtcagggcatctaaccgtgcaccgtgtttcagctggaactgtgtgagtctctctatttcaaccacacgcgtccgcttacgctgaacagcctcgatcaaaccctcgtcgcgaagcattctcttcaactggagaagattccgttcgggcaaactcggcgtttcggtgtctggcacccagccgaaactgatttgagaaccccccgtggtctgcacttccggaggggttccgctccaagaccaggaaccgtgcggcagaggcccgccggcggtgaggacggacaaagtaaagccttcctgtcggcctccggcatttctgacttcgaatgtacgagacgaagatccgcgtgtcgacgcggtgtaaactttgaggtcttcgggtaactcttcatcgacagttttcacctcgattcgctgataccccgtaggccggaaagtgcgtgggctgggttgcggccgcagacccggggtggcgtccgagtcaggttctgcagcgtctgtgaaaagaacggaagaaaagagttggagagcagagcggggaaagctagagaagaagagtgaatccgctgcagatagaagaatcaggacaagaaatgccctgcccaagggcaggccagcgcgtttagtcatggtgacgtctggaaggccgcgaactgttgaaagcgaaaaaaaaaaacaagagctctcgtccttcgcctcagagtctgcgtggtgggagcaaacgagagaaaaaagaggcgcttgctaaaacgagtgcagcgcagtacaagtcattttgagaagccagctgtagctgcctggcgagcgcaaattccctgcttgtgaaattggatggatggaacgccagaagaaaggcctcatttatatcgtttgaacaaggcaaacgaaccgccgttctgcccccaccgggtggcgccgctcgtcgaaacaagacaaatggtagaagttttcgaaagtacacttgcaagacaaggtagcttttcccggagaggagctgaccaggtctggaatggagacgcaggtcacaaacttgcggacaacaaaaaagacatgaaaaggcatttacggacgaggggccatcgcacgcagagccgagggccgttaaaaagacaaggaagaaaaaccacgcgcgaaacagagaaaccccctggcaaagcta

SEQ ID NO: 2175 - DNA, 4918 bp, Toxoplasma gondii
tcttccagaaggaaccacacggtatttccggagacgctggagaagagctgtatcgatgtctccctgcgcagtgctggccccagacgctgccggcgtgagctcctcttttccggttgtctggcacctcggacttccatgtggcgcggcactggctgtttgggcgtcttgcgatttgtgtcctgcgttcggcttctcgtcgagaagcactggaggctccccgacatgtcggaacagcagcagtcccgactcgtgcttcgctgcgccctcgtactctcccctcactttctgctgcttagctgcgggcgcgtttccctctcctcgatgttgaagcagacacaggaagggtggaacatcctcctctctatgtcgtttcaagcgaacatacagaggagcgtttcgttctccttgtacgggacgcacgaactgtccgcagaaactcccatttgccggtgaggaagaggaaaaacaggaggcacgcagaggagtcctttcaaggaaaaaggacgcatcgttccggtccatccggctgagaccggacgttagtggtgactcctggcgcgcgaaagtccgtgtgggggtctgaggtttctcaacactgcgttcctctggaagcggggactctgccgagcgattcaaagaagtcattttgatcagcgaaagaccgtcccggagcaattcagatcacagacaacagtggtgtggtggtggctgtaacgatgtcactgggcctcgaaagaacgcctcctcaagaaacaagaagttgatgtcaacgggcggaagtcagttcttagtttgagaccgcagggaaataaaagagctttcactgatttcacatttgtggcacgtgagcgttcacggtgctagcaggatcccgtcggcaactacccacgagtctaccccaacacacggttttccatgcattccagcgtctctccagcctcttcgagcagttcctggagaatgttgaaagtgaaaaacgcctgaactttcaaggagcaggacggacaggaagcctcaacttccagttctcgatccccgagacgacctgtttcctcggacgactccgctttctcgtgagttcgcccggtcgactctgcctcgcacttcttttcaaactgggtaggtcttcgcaggtctccactctgtcggcccgttatttcctgcacctttccttgaatggtttccagagaaacttcaaaaagatccccacaagggcaggggtagaagaaagttcgactcgacacgtcgaactcgaattcacgcagacacacgcgttcgtagtacagctcgcctccgacttcgtccagaacgcgattttcgtcctttcccgcaccacccagaagttggtcgacgctggtgaggtcgggccgttccctgtgttcttcctccctctgtgctgtcacctcctcaactctctctttcgaaacctcctgcgcttgcgggcaaatctggaggttgccaggtgccggcggccgttcagagtcaggaccttccccgcgaccagttcgatcctccacctcggacaaaacacctctcgccactcgcagaccccgaaactgactcacaatggcaggggtgaagaaagaacttccggaagagctcccccttccccgtggtacgctcgtttccccagagccgccggcgaacgtacttgcttcctcttgaacggcctctccgctctgctcgacactctgtccaccagaatagcacggacgcctttccgcagagttttccgttgcggaattcacgtcataaaccgactcggaaacttccagcagtaaagtgacagtcgctgcagttcgagttcctgccgtcgtcgtcgagctggtgccccgggttgacaaggaactcaccatcctggcttcttgcggaggaaaatcccaacacgagtttgtggaaaagaaatcgattcccgaatcccggcgcgcggcgggagaggctcagagatgcgttttcgatcgcttgtcgccagcgtgagacacaacggacttcccgcaagcgtaccgctgccacgtgcaactttcccgcagtcccgatgcctggtgtctctgacacgttgtcccgatcttaaccttttgccgacaggtgcgactactaagtgactctttgatgcaggattcgttacttcgcaaaacgatatcacaaagataaaataacccgcgatttcgtgtcaattcgtccccccccccactcgggttttaggcttgaccagctggccgccttaagcaccgtccatcttgacggctgtttttttgtgtctcacctaaataaatcccgtacactgactacatttaagcgtggcaggcttccataccgaagttccacgtgaaactgaaggagtaatttgaagaggttgaaacttttctgtcggcatgcgagatggtgcacttctcataagcggccgagatgatgccatgggttaggttttgcaaaaggcacacttcagtgaacagtagagattctgtgctgggttggaaacaatctgcaaacggaaagaagcttggcttcagatggttctattcaacacttagctgcaagcatatcgagttttcagcttgtacacacagagagacgatataaccggtaggtgtgaaaaaacaggccgaaaactgtgaggacctcttctaatgtgctctcgcgtgtgtcgaaaccttttgcccgtcgactggtgaaggatcaacagatgttgtacgttttagcttactggataggaagccccatccttcgagatcgtgttcatgcacgcgaggccttgttgtcgctatacgttcaaaaatagtccagagattcatctgtactcttctgaacggccctgtttgcgatactcttgcaatgtgagggaccgaattttgagggtcactcacgcctccggcgtcggcagagaaaaaagtgtggaaatggcaccacttagcgtactgcacaagagacatcgatagatccaggaaacagtccgccagatacggcagacgcaggagacatctaaactgaacagatgcgaacaaactggtgaacggaggtgcgtcttccctgaagaagaaggcaaataatcggtgaacctgacgggtgagagtagcgacacacaagtcaaagccaccagaaacagtctgcattaacaaggtggcgacttgacaatgcttttgtggctacagagcgtcttcttcctacactaaatacattgctagttcaggcgacggtggtgatacggatctcatttgcacatcgaacggtgcttgtaatgagtaagaagctatccttgagctgatatgcgtagccttcaaaacaccctcttcccgcaccttgctatgcgggaagcttaaagtttcttatgacggtgcttgcacaggacctcagcacggagcttctaggaaacactattccaccttttttcagcattcccaacgttcgttgactacatctggtgtccactaagactacttggtaaaaaagcaacgccttgcgaagttgagtgaacaggtttatcgggtgtcgccgagacggacagcggctaagtggttgcccctggttcaaaactaatgagagaacaccagaaaaaagtgtaaaaggaggcgttatacccccagaagacgggcatcttgcagaaagccggagagaagcgtgtttatatgtaatgccgtagagccaaaacaaaggtctcaacacacatgagaacgtttctccaggtaactctccgcgttaacacatacagttccccccgctttcacctctagttttaaagactccggagacatcgccttcctgtcgcttcgctgttcctccagttgcccgttaggaaactactttgtttttgctcatactctcagttgtgtgcggtgtgtttaagattagtttgcatgtgcccatctgagtacggagtttatttgtaagctggaggacgaatccttattaggcccagggaagcattaactgccctgttgcacatggctgggagatcagagagaaggctcttttcagtattcaagggtaaaaagtgccacagcgaaaccgaacacctctgtgctgatgattcttgccagaggatgaggaacacgggatttaacggcaaccctgtggtctgcgtcttgtgacaccaaacttttcttcgttccactaaaaagacacccgtgtgacgcgcatgaggtgaatgagattggacaagaaaactctgaaacgttttcattatgtatacctgttctcgacggaaggcattacgaagaacgaagcagccattgcagcacaggcgtcgatttgggcgcatgcgacagcgtgtggcacactttgtcgagttccacgcctctcaaccggtcaaggcaaacgcttgcgatcgaatgcccatttccttgtcgctttttgttgaaacagactcggtttcttcttctgtgtttcagtgacattctgtcgtgtttattgataggcggttcttctttgacaaagagtttttgtttgatgttcaaagccaacgacagctgctgcagcagcaccccccacctccaaccctcgcggtgtctttgtcatggcgttgtatatggtggcattgcaattttctaggcgcggttctacacggaattcctccatccgctcgaatcgataggaggcgataggatcgagacagagcgttttccgggttcctttaaagggagtgtttgccttgcacaccttccttggtttcctcccagcagagcgttttcctggagttcgcgcggggccccagatgcttttgccaaaacgacggagctaccctttcctcttttcctcattagttggtcctgcacggaagtctcccttctctccctttgaaatcctctctctccccacttaaccctctatgccgttaatctcgacgactttctcgctttgtgtggctgggaagccagccccccaggcgagttttaagtggtttgtttccttatagtttccagga

SEQ ID NO: 2176 - DNA, 1928 bp, Toxoplasma gondii
aaaacgtagggtgtcttgtcttcggctttcacttctggagtgggcgcgccgggagaagaaggcagaggcagaggagggacgagcaggcgcaagcagaactctcgaggcttgaactcacaagccaggatgtcttgaggggttagatgtttgacgaaaaaggtgaggccgagacgttctccactctgcatccattcaaacctgcgtgtggaggggaaatgttcagaaacgcagcaagacagaagccagtcaagatttcaccagttttcgcgagcttggacattcaaccttagtgcacaccagacatattcagaatggtgccttctctaccgccgagccacgctgcgctctgaacgcaaggttttcaagaggagtgaagcctcgtgagagttcgaatactgggagcgtgctcaggatcggatctcccgcttccagatcccaaagacagaatcgcacacagataagacgatagaaaacagctactttgatgttcaaatagcgttcaggcgccagtttctcgggcagagcccaaaaaccgaaaacctaccgaggagtttgtgtccggtgtgccggtcccgacgcggcactttctcctgccttcgacgcgggtgcgcagttactcaccgacatcctgtaaaagcaactgagtgactctacaagagacttcagctggatgtagttcctggaaatccggttcaggcaccgtcagacggctggggtttccctgtggcactgcttggaaagggatgctactgatctggtgcccgtctaggcgacatatgacgaggattatgcacgaggctcgagaggggggcgacgagactgcggacagctactctgaaggagaagcagggatcgacctcgctaccttcacctgatgataacctgccctacttgctacgctggaaatctgctaactggtggagcagatgctactggtagaaaagttgcacggtattttcacataacgtgcatgtcagtaattggatgtgcactggtgctgaagaagcgaagcgggctgggctacagttgccgagaacaagcaatgagttcacgcagacgagacaacgcgcgccttggggggctccgtgtgtcattccaccactgccttgcaccaagtctcataggagccgtgcatgtaccctcaagacatggcagagcagaaacagaggcacttcgtatgcgagagatgcttaagttggaacaacacagtcaaagaatcaaggtacacaaggggaatacgcaaagagagagtgatgaacgtcatttgagacagacacgcgagcgccagacagacgaaatgtgttacggctgccagcacgcgcaaagtcacagcgcaaggttgaatggtaaagtttcaaacctgagcagcacaagatcaggacgcatgcgtgggatcgtttacgacaactgtttatgagtgttaggtcacacgttattggccgcagccgacggaaaacgctgtcctagcatgcgaaaaaaactgtccactttgatacgcgctcgtgtgtacgtacgtttgcccgttggcaggctacctgcagttcgtcgccacttttgttttattgtagtctgttctcaaggactgtctaaccgaacacgattcttgtgttgctgttcgctgtcattgttgtggctcactacttggctcgcccctcagccacgttcttcctggactcgagcgaggcctcttgccgttctggtacccctttcttcattcgcgcaacaaatgcgagtcagcgtctcatccgactgcgcctagaaccagcccctacgaaatctcagaagaagccaatcgcccccctgagcggtggccacctgtgtgtcgatttttccgccggtctcgtctctgccgtagtggctttgagagttaccgagcagttcaatcatttcgacccctctgacgtggcggattactggcgcttccacaa

SEQ ID NO: 2177 - DNA, 3343 bp, Toxoplasma gondii
caagcacggacatccttctcctcggagtgctggaggttggccttctcgtccggccgcgccgcatccaccttggaatccgagagaggtcggcagagacgaagtcggcagagacgaagtcgactcaacaggagacagtctcgaaatatggaggacgcacgcgctctcgtccgcggctctcggggaaccccgcggctccgcagagggagtcctcgctccgcagcctctctctggactcgaacggtgtctttcagcaaacagcgaggccgcgctcggcaccgcaagtctcagctgctccctctctgcgggaacgtcgagttcctcctcgctttcttcatggcgccgcttccgcttctggagcgacactacaacagtcggcttctcaagggtctcagagtcaaccgacgaagcggatgaagacgagaagacggagacgcactttccaggaaggcgcaaagggaagtaaaccgagagagaagccgcgggagtcgtcaggccacccgagtccttcttcgccatgcgctgcacctgatcccaagacttggtgtacaagaactgctttcgccgccggagtctcgcagagtgaggagtcactccctcgccctggggaggttgaggaagacttgccgtcttcgcgtcgccagacacggcggggagggtccgcagcttttctccgcagcttcccggcgcttcctcgctccttcgatccgaggacggacgcccggaagacggtaccgacatcaggaaagccttcccctcggccttcgaatcaacagacaccccactgcccgagagctcaaccgccgacccttggccaggtgtacgtacacccgacggctgagacgcgacgacggcaggcacgcagcgcacgcgcggcggcggcgagcggtcgcagcgagcctcgcatgcgctctcttctgcggatttctgggaggaaagaatgtcgcgataagatacgatttttgagtctggtctcgcggcttctccgacggcgctggagcgcgaagcggaagagggagagacgggagccgaaaccgcgtccgacgacgcggtgaaggtccctagatctccctcctcggaaggctgctgcaagacgcgttgccacatggcggcgaggctgatactgaggcaaatagagacatggaatcgaagaaagggtctcggacttggcagaggctctatcactcgctgcgatgctgaattccctctctctcctcttcagtctaacaaggtcagcggggaaacgggtcggcttctcgcgtgcggttttgcggtattggagaggctcgaccgaacgaagtagaggaaacgcctctctggagtcctcggcggtactcccaagtgtatatacacctcgactcggaagcggaaactcggtggatgtcgtccatctgaaaagccgctgcagtaaagtgccacgacagcaaaggagcgcctacaaaaaccgcagcggacgaaccgtgtttgcgttgatttgaggcaggtgctcccgcagactgctacagggcaaggcgggcagacgccatttgagtttttcctcacaatgaaaggctaaagaactttatcgaattcgttgccaaaacgcctttctgcgcctgcagaaacagctcaaaaacctcgcagagagagccgccggctctgcggagtcaacgcgcctaaaagcgcctgaggtcaatggacgggcaggacacagcagggcacaattcatggctcgtaagcgtaggacagaccttgaaacgaggcccaagacttcgttcaatcgagtaccctagtaccgttcggaacgaatcgcacctcttcgcgaaacgcacgatcctcagtagttgccggaaatcctcaaaggcatccagtctcctcgctcgaactcgactgcaggaccgttctccgccgaggtctgattgtttcttgccaaaggtaatcgaagttcctctagagacgcacaatgcacagtctggctcgaatccgcacagagacgtcaggtgcaggggcattaaagagaagcgggagtgagaggttgaacgtgtagagaaaaggggaagaattgagttttccaagagccggaacagttcggtgctactctcgagaggactggcaaggcagcgagggacgaggcggcgacctggggtggcggctgaccagtgaagagcagccggacggattgcacagcacgaggccttctcagagcgactttgccaagcggttgacaaggagtggaaatgagaaaaaagaattgaaggcaacggaaggaaccctaagaaagctcaaaacttgcgctagacgggaagaacggtgagctggagaagaggcgccagccgacgaaaaggagcacggcgactaaccgcgaaaacactagccacggagagagtggaatctcaggagaagatgaagacaaagcattttagaagaactcgaagaaaaagaggtctagctcgtgagcagaaaacgggaacaaggaagctcactcgatatgttgtgctgtgccagaagacacttttcgaaggggagcaatttccggtgtacgtccactggaggtggggacccgcgtctgctttacatgcaactttttcctcaaaaacaagcgagtccttctatgagagatccctttttggaaaaggaaaaccaacggccaagcgtcaagagcagcgccgcgacccgaggcctcttcggacgtccttggctctcggcgtccaccctcgcgggaggcgggcgccccctcgctccctcggtatcgggaaaaagcgccgtttcgagaggcgcttccattttctggactctggctacagtggttttcttccgcgcttctcgagactcccttttctcgagaggaacgcggctttaaaccgctagaattccagctgcctgtcctacgtgtcctcccgcctctctcgcgtctagcgaggagtctgtgcccccagctgttcgcgggagaggcagggaggcgagcgtttgcctctccttcttggttaaaagaccattcttgtctcgaaaaaaaggaggacatttgaaggggacattgacggcgcctccggctccgtgtgcagcggccttctgcttgcctcgtgactgaagaaaaggtagacctcttcccgtctccagactcaacaagggggaagcgtagtccagtctcaaagaagccagcaagtccgcaaacgcgcgctcctcgccggtggcgccagtgaagacaagcgtactggaggcggcggtttcaggaggggggttgctgtcagttttctgacgcccttgcttcttccggatgacacgaacgagaaaagacacaaagttctgctctctgggcgttttcgagtccagtttttatctgcctttcgagacgcagactgttcagaaa

SEQ ID NO: 2178 - DNA, 3201 bp, Toxoplasma gondii
tctgtatctggacagatccttttctggtgggctctggatgacaagttgcgagggacgtcgaaaacgtttcctcatcgttctttcgtgatggtgaaacgaaactcatggtgccaattgcttcccgcagaccggtttgctcgtcctagaggcggagagggaaccgctggggaatctggaagcgggaagtgcgactaatgcgtcgaatctgcatgcatgtttctgtctacaaaatctaaacgtgaggactgaagtgaggacatcaactgcagcaaaacatccctcccagaaaagagtgtagatactagtatacggacacaaaacatcaagcgaaggtaccttgtgcgttgagtggctgttctccatccgcagagaggagacaaatctgtctactttacgttttcttctcgcatgtggaggtttcgagtgtaatatgagggggtcgagaggaatgaaagagaactggttacaactttttgtgtttgttacgttttccttcacctctgaacaagagtcaggggatctgcctgccgccgcaataaaaagtaaggaggcgtttacgtcgaggtgatcattgcttgcctccaaaggaaatgcgtgtggatggccttttttatgctcccaatttttctctgtgcctcggttttgaagagtactcacacacaccgaagcgctaaatataggtgattttttttgctagactgcgagcggcagacgctgcactttgatttttctcgttgatatttgcacttgcttaattttccaattgtcttcgatcaatcgcacacgggttatcatttttgtcctcaagagattcgaacgcattgtgcccgggcggcagaggaaaagatgccatcagctactcgcgatttctcagtagctccatcaaggtggaaacgcagctccttctagtcgtcgtttccgccttgatgcgtcggactcaattgggtattcgttgagcgcatgtgaggactcttcagcacatcgcttgccagaaaacagccacccgtagaaactgtctctcccgagtcgtatgaaattatctctggcgacatcggtcaggcgaaatgcatttctgtgcacccgtgctgtagtatctcgatattcaaaagcgcacaaatgcactgctaccagccttgcacacaaatcagtgccaccagccttgtcaactgctgcggcgcatgtcatgcttaggtaagctccggaattttgggaaagactggcattgcgacccgaccagtagcaagctctgctcgagaggcaatttgtagagatgttttgagcagtttgatggtgtgtgagaagaggacacggttggggtcctctgtcattcgagaacacgatccagcccttagaaagcatgacttatgtcggcggcgccccctttcctcgggtacctgttttgtccccaggatgagcaagcaccgcttgttacactcggcagatttgaagtgggcagtcacgagaaaactgatgtggccagtacgctccaccatgttactgcactctcatcacccgcgattctctgcaagaacagattcagagggtcccacaattccctattccacgacacactctcgcagcagtgccacaagcacaaaagggtttgtttcgacgcatgaaatagaccgcccctccagagaaaacctgtattggtgcagccattcaaagcatagcggggcatgatcaacgactgcctgctgcattttcggagttggggctcttcaaaacaaacgacgtgagatggctttgccacaagatagtgctaaatgcctgtttttccatacgaggttcgttacaccgacttcggtgtcgccctgcaaaatgctgaccgcttcccgcattgtctatgatcctgccagaatggagtcaccctcatgcccccacttcccctcgcgagtgacagggcagctcgaggtttgacatgaatggcagaagagttcactttccgaacgcccactcaagattacgccatccatctgccacaaaatattacgcgcctccgcttccactgaagtgctgcttgcggtgtcgcctaagccctgaagtttgcgttttctggtgcttcttctgtcacgagggtgatgatgtaagactggtcctttgcctttgagtcctctatcgcctcgcatctgaacgagaatgtttttgaaacagggacattttccggcacgttgagtacagcaggttcttttatgccgtcaccccccgtccaccattggtgcgagtccggcacaccaggaaagagggcttggagagtcttcttactcgtgcaactactgccttttccctcacaaaccagctttttgaagtcttcagggacccagttcttggcattgttgcattcgatcgccaccttccatccaggatacacataagcgatgttctcagtgcccgtcccgcggatggaactgaaccacacgatgttgtactgtccaaacggaaactgctgctcctttcgtgcattcttgaaaaactttggggcggtagcttggtctgcgtccattgcagaggcataggcaaatatggaaagaagcattgctaccgaagcgagcttcattttgtcaagcagagccaggaagcctggaacaatgaggttggccagagaagacaacctactgacgttggtagagagagctcaacaacactactgcatgcaagaaaaagatgcacgttcctcccactcaaacatcactggaacttttgtaatgccaggcagcagactcacaagaatcgatgttggtgccccgtgcagggaaagatcagtcacccgcgtatgcgggtaggttggctactaagacagcgaagacgaatgcccatgagagtggattttcccggactcaaggacagcggcttgtctgaaacgaggcacatgaaagaacaaaattcgacggcaactgtgcgtgtccggagagtcagcaaaaagttcgactctccagcgtatacctgcattaccctgcgctcttggtcacctcggctagccgcctttctgcttcgtgtgtggctctccccgttcttgtgccgctgcagtcgttgatccagagaggtgtcacctgtgcttcagcgcgggggtgtacacttggtgtgagtttggaagccttacgtaaaagtggggtccaaagtgcattgatccatggattaccaaacgagtcgtaaaacccccgtctttgccgtgcgttccccgtccgcgcgttttagattcga

SEQ ID NO: 2179 - DNA, 4625 bp, Toxoplasma gondii
gtctttcccaatcctcagtgagttggctagcggttctgtccctttaaggtccgacataggatgggaatcaaaacgcgtacgaatcagcgttgtgtaaccccacggacgtgcatttgatcccgctttgtacttagctagcgcttgaggggttgggtcgacccaacagaaactaaggcgcgcgacgtttgaaaagccaccaagagcagaaaggatataaattttcgttttggtagctcgacagagcacagttgtggccgctgctgcagaacgggcacatttttagaccttcaggagtacagaggaaaggggttgagcgagcacccacgcctgcggtcgtaactgcaggactgacagcctgctggcgcgcactctccgaacaaagaatacaactgtccccactggttgtcttcgcccctctctttcacgtggaacggccaaccgttttacagcgaacgggggttctttgaccgagcaatgagcaacagttcaagttttgaggaacgcggtcagggaacagcgtcgctgcgtgcaaaagatctaatcattgctcactcaggagagcaccaactgtactgcaagcagatattgccttaaaatatcgttctccatgcacataaacaggtacatgtggagtcgccgggaaacgggccgcatccagccttcccatggaacaacgatcgattgcatttgagtttcgactaaatggaaaaaaagaggcacgagccacacagcgcaataaggggggcgaagagtcttcgaaaacttaactcaatggggtcacacagcttttccatccattagcaactcactgttatgtgggagcattaacagtgttgctcgacagctgttctgaaatatatcaatcgctagaaaggcttttttttgctctgatgtttgggacacgaaaagggagcagataatcttcatgcgatgtaggattcaactgaaggcatagatggtgaagaagccgaacactctctgtggcccgttgtgaacggagtcaaagcaaccattcctaaagagtgaagctgtagctattaagagttggtttggcaaaagcattaaaccaatccggtagtaaggtataatatagtagctaaaccatcaattcattgtagaatgctcacaatttttagtgaattggttagagtaagtaagcctgaatttttaccaaatgaatcaagtactctccaacttatttttttctctgtcaagagacccatacactgcctgctgcaagtgtctgtctctgaggtggcataaaggacgaaagggaagcatttggccatttcctagtaacttctttttcttcatggctgagtatctctcagaacattctcagtcactcctcgttctggatgcgtccgtagaaagcatcttgcttgtcatttctttgtcgagtaagcgaaacggctacggccggtgcgcaaatcacagagcaaagttaccgaattattgcagagtttttaactcagcagaacatgcattcactggcatgatctaggtgaaacgacagaaaagggtccggcagctcatctgtcgcttaaagggcgtcacacatgcaaagtccaaaacaaccgggatcagaacgaaaacggtaatggcttttagcggaaagaaattattcacgaacctctgaaaccagagaaacagaacgctatagttgtcctctgtacgagtctatcgcgcgagctcgaggcaagacggaccgcgaacacgctgtcagttcgattttgccgatggcgctgtacaaaacataatcagcccggaggccttagacggggccagacggagatgagagcatacccacgctccgtgtaaatgggcaagctcattttccaaaccttttatgcctgctagtgcagctgacgccgcactccaacccgggctggtacaaataatctcagtatgctgcaactgtacaggagtcgagcatgccggagagcacctatacatttcccaggggtcgtcttcagcagacagccggacggcccgagaagattttggtcgtcagccgtaggagaaacgaaacttacagggtgtttgggcagtccatgctcctcgtgcaacacaaggttgtttgctttgaggtgaactaccagaaaacaccagggtacggtcactccagtgatcgtatgtctccttgagactcttacgctgtagcgctcctgagtcgacagcatgcagttcagaggacaattatgtggattgctcgccgccgggacactggaacatctacggtatcacagtttcagacacctcaacaagggccacaacgcagccgacacgaggaaaatatcttacttggctttctcgatatagctcagagcgtcctggacggtggcgatcttggacgcttcctcatcgggaatgctgacaccaaacttctcttcaaatgccatgaccagctcaacgctgtccaggctgtctgcatccagatcctgtacatgtccgagcacgcacagaaagcaaaccgaagttcatcgaggatccaccctggtaggcaccatggggagacatcttacgcatccctcgttgtgcgtaaccgttcattgagagcacttaccttgataaagtttgactcgggattgatccttgcacgatccacaccgagctggtcagcaacaacgtcctttactctctcaagaaggggccgatcatcagaactcgcctcgtcggcagcgaatagcgcagaagagggactgccgatgacatttgcgctaacacttcgaaacggtcctgggcggcgtgcaacagttcctgcgggttgccccaaagttccgagggacgccgtcgacggtgtggcacaaactccagaagacatgttggggcaagtgccatatcggtaattaaacctgatcaggcctggtgacacaaaacctgtaccggaacacgcgcagaagacacacaattcgagaagctctggttaaccaactgggttgttcaacgaggcagcctacgttacaacagttcacattcttccgttacagacgctatcgacatgatttgctcgattgcaactcagtatcacacgaacaaacacgtgataatggtggccactcggaccggggtcctcctcaacgcagccgcatcttactgccaggcagacacacattgggctgcagcgttgaaagtaggaccacaaggataaatcgtctgcgttacatagtctcgctaaccctgaactctttgcagcggaacactcacacacatggcccctttgggacctcacaccagaccgtcgaggcccgaaaacaccttccagggagaaaaacattcgtgagacggcgcattatcgtcatcgtgtacgaagtgtgcggatatattatacgtaggtcaggcacgtgcacccataagtggcattctaatgcacagcagagacacagaacaacattgtcgacttgcaacgactccgtccgagacaccgttgtcttaacggagacagctactgtctcgtcaaactgggttccacaactcacatactttcgtcgcacccgcagcacaagacgcctttaaaagacttaaaagtgaactatgcatactcaccgtaggaagaagcaatggatgtcgccataaacagggccagggcaaggagtgttttcctgccggcgttgcggggatgcatctccatagttctggtgtgagaggtgtgcagtccagtcggaaaacgacgtgaaatttggagacaaaaaccaaaagagcagtctacagtgccgagacaaaagcaagacgctgcattgactttaagaggaaaggacagttatgaaacgagacaagacaatcaatgaacacggatgccagacatcgcagtcgtggaggtaggacaatgtcgatttctgaacgaccccaggctccccgtccaacacgctgacgtggtgaactaagcgttacggccctgccccctgagtgcgcccgggagagcaccgaggtttgaagaagtgaaagtgactatctgaacagttttactcgtgttttttttatcagcctgaagatttcagttgtttcgttgatatgtggaagggcgtctgcagtgtatgcagccttcctgactgcaaacagaaaagtctgctcggggcgatgccactgatacggagtaaggacacaaccgcgggccaccaccacactctgtcgtgtatttagatggctggcagtctatagagaaagacccaaccatgactgtcgcagagccctgacttatttccatcaatttacagcacgacgccgattgcacacaactccggcatgagcggcaactcacaattctgtacagaagcacgttcgtccctcgtcactcagtaacaacagagttcttcgatatactaagcctcgattcgaaggtagggggcgaaacaaacgcgtactcgtctgcacgcagctttcgcagtaagcataacatccacttcaatttctgggttcgccgccgacagcagcaaattctctgacaaataaacactccgttctgtgcttaggttccttcctgcctggtagaggcaatgctgcagtgattcgctgtgtacgtacagcggacgcgccgggtggcacactccaccagaagctgccgtcaactgttcttcactataacaaggctctgttggaactatcctcctgaaaaagtcgggaatcga

SEQ ID NO: 2180 - DNA, 1977 bp, Toxoplasma gondii
catcgctggccactgcatgcgaatgaggtcggttttgaagttcttcgagagagtctcttcttggcttttttcctcctcgaactgcgcgccgcgctgcgaggcaaacgccgcgcacccagctcgagagaagacagccgagccgctccacgagagaggcgaggaggcacccgacgactgcagaacggaactcgagaaacgcgggggagagaaggaacagacagaaggccgaggactgaagtgtgtggaagtacagagacgagggtctctccaacttgccgagggcgtcgcgtcgcaggttgcggggcgttcacgagacgtcaaaaacggccggggagcagagagaccgcccagcgcatatgaagagagagagacacagccagcgccgagagagggggagtccgaacagtttcttgagcgcccagttcgctgacgcacggccctggcttccttctgaggctccgcgcgaggacagaggagacacccagctgtctccgacgcaagcagcgccacagcagaagcgacgctcggccctccacgagaagaggaaaactccgtctgtggccatgtacaggaatcggtggaagggagggcagacgcggccggcgaggagtgaccattgcatgcgtaggaggacgaggagaacgaggagatcgaggagagcgaggagatcgaggagagcgaggagatcgaggagagcgaggagatcgaggagatcgaggagaacgaggagagcgaggagatcgaggagagcgaggagatcgaggacagacgaggcgacgaaaacgctagcgaagccacgggcgccagccgccatcccgcgacctgcgaggccggcagacgaccgacgccagacaccacggcgcgcgacatcattgaaagcgagtaggaagaggtagagcaagagcgaggacagagagaagaaggaaacagtgaacaagacgaagaatacgacggagaacagaacggagaacaaaagaagagcaagagcgagaacagagagaagaagagggaggccaagacaaagaacgcgaggacgaaccagagggagaagaaggaagagaaacgtgagggaagaagaacaacgtgaggaggaagaggaagaacgcaaaggacaacaagaagaggatggaataactggaataactctgtgaagtccgatatggagagaggagaacggagaaaaagattccagtgtcgcgaggctgaccgccgcggattccgaaggagcgaggaaatgcgccttcctcgtttaatgttcctccccctcatagggagaaaaaaggacttgtggtatcgtcattgtcgtgagttcttcactgaagaaaaacaggaactgtcgcacatgcagtgttgagctgcatgcgtcgctccgctggaaaaaaacgcagcaagcaacagagacccggcacatgcgcgtgcttgactgtttttcctttcctccttgtttgtctttttttcctttttttcttgtttttttctttctttctcttttttccttcccctttgtgaagcagtgcatgaatgcgagctgggtgggagaggcgggtgcgacagtgaaaaggcatcgcacaagtcccgatgcagagagttcttgacgaagagaagaaaagcaagaaaaagttcctttttcggggagtgcgtccccaagctggagatgcaagaagaaggcgcgaacttctttcttgtctctcctgttgtgcatgtgggtaccgcagagaagagacgagataaagtcggtgttaccaacggccctcatggcgaatttcgctgctttccactggcgaccatttcgctgtttcgccccgcctctcgatcttgtcaaatgaaagtttcctcgtcttctctctctccctttctctctcttctcccccttcttccttttgctcgctccggttccttcgcttgctgacttttctttctttcacctagcacaaggctgcctgtctggcccccctctcccttgtcttcttgcagcca

SEQ ID NO: 2181 - DNA, 1689 bp, Toxoplasma gondii
agagagaaaggtaggcgactgaggaggaggtggacgaagagaaggaagtcggagttttgcgtccgctttttggcaatggcaaagtttcttcggcttccgagaattcgactcttgttcttctttcgcttcctcgaaacagtcgcacagagaagacgcaggggtccccgaggaaagagagaagcagtcaggaccagcagagacacagagagaagaacgcggagagaacgcagacgaaggaggtgaacgcgaggaaggacgagaggaagaaggaagaaagagagacaaagtattcgatttttcacctgctgtgtggggagagaaggagccgcctgtgagggaaaggacgtctgtggcgacagcagagtctcccatctttgcctccacttcttctcctcaaatcttcttcccttctcccttttctctctcctttttccagcgcctttgtgcgtcgccgagagaagttgccaaggaggaacggaacctccaggcgcgaggactagagcgactttgaaaagagagagagaaacaaaagaaagacaaagaggagacaaaagagagacaaagacgagacaaaagagagacaaagacgagacaaagaggagacaaagagaagacaacgaagagacaatgggggtgggcgacgggggcgctaaggtctgctactggagaccggtggagcacgacggagctttgaggactggtgtgaaggaagaaagagacaggcggagtcagagagaaaagcgccttcacaactctttcagagagaagacaattttccagcgtttttcttttttcgcgacgctcttttctagactgcacatgcgtgtgtcggcgcagaagaaaacgctcttttttcgcttgtctcaaagcgctcgagcatgtcaaatgtctccctagagatctttctcggagagatcttcggcgacaagaggagcgaaagaagttgaaaaaggagaccgcggtgcaagccgggtgtctccggcaacgtctggcatgggactgtcggccaccggcgacgacagcacgaggcactcttggctccgcgtcatttctcggcgtttcttcgaaaaaatgaagcagctcgagagatgtattcatcgagagagagagaggagaaggaaaaacgcgcaaagagacagagaacgagtacacaaacgctggccgagcctcagaactcgaaaagcagctgcgaaaagcgggcgcatgcagagcaagcgctcgcggcgctcgggtgtctcgacagccgagcgacgctgtgtggggctcaaggcggcgatgcagagagaacaaatcatttttccctctcctcattttttcgttttttgcggtggatttctcgagaacgcgcgcctgtagcctggggagctccacgagcgagaggaggggcagaagccgcgcagcgagcagcttcaacgcttgcgggtccttgagtctttttccggtgctgtgctttcgcggttttctttgcagaaacgcggccgtctcctttaactaaaaagaggacaccgagagaagatagatataaagtctggagaaaaggaggacagttgagggcagacgaaaaggagggaagaagagaaagcgacggtgaaaggaaagagggagaacaagaagaccaagaagtagccagcagagcagcaagaagaagaacaagaagaagaacaagaaggagaacaagaagaagagaga

SEQ ID NO: 2182 - DNA, 3203 bp, Toxoplasma gondii
gaaggcgctcgttcgtgagatttctccgacgcagaaacattctttccgtcaaccctccgggagatccaaggtcgcctgtcggacgacagcgtacgcgggctcgcttcttgactcttcaccatcttgagagaatcgagatgtacggtttaggtgtcagaactgtgttgtgaatctttgggggtaacctgcggatacacttcatcaccctgtaaaagaagctggaaaattcgcccgcaacttgcgcgccgcagtggctgtcctctttgagggagcaactcaacgtctgctgttaagcggttgagctctcaaaacgttcaacggatacgttctaagagggacgacttctgacgcgaaaatggcggggaaccgtggggacggagggcaggctcgcgagtgtgtcgagggcacgaccaccacattttttgtctctgtatgaactgtggaagcaacacatctgtaaggtagaccacactgatctcgccttcaaagagagagcccggctgaaagcgaacccgctgggaatgcaaccaaaaactcaggattcgtgcgaggaagtgcgtgctctctcccggcacgtgtgcacacagcagctcgccgatacagacggctgaaccttggggacctaaagggcggaggcgagtagcgggaaactgcggagaaaaaacatcgatacagatcgtgaacggctgacgatcttttgatcgagaacagagagtcgaaactttacacagcatccaggggaaagttcgggcgacaccagcaggttccacttccacaagaaggcgaccttcggcttggttcgacgcaggagctgcctcgctttgcagaataagagtgatgagatgaaaagatacgcggagacagagaacgagagtaaatggagaccaaggagaactcagttctgcaggacatgttggctttggaaaggctggcgagtcgctgtctcatcggcgtgcctcgattttctcagtcagcgtagtgcctccccccatggagaggcagtgttcaagaaggtgaaaccaatttcttgtgagaaagagaaaaagatgagaacatacaaagaatttcaaggtgcagtggttcagaagttactggctcttccaagcgcgcatgtctgctgatgtcgctatcgcacacgcccttccccccacccccccgtgtaaagaaccctgcaggacactgctgtggctcgcgcacatccttggttagcaaattaaacgttgacagaaactcttcatgctaaactgtgtataaccgtaaccatgtgtgcgtatgcatgcgttttttgggaactttacgggctgatgtcatcggtgcaaagtctcccagtaaggagaggttgctgtgttttcctttcgtttgtttcgtgccacacgggcgtgcaacccagacacacgttggggggaggtccctcgtctcgtcctctttttcttctgttagctgttgcactacagccgatctccatcttctctgttaaaggaaaaagacaactcgaggcggggcggcaagccaataaagtctcaggtaatttctgtattgaggaccctccagcctttatgtgtaagattgccgctcgacaacgtacctcagcaaagactacactccctaatacacgcagcaaaaaattggaaactgttggcacgcgctgcggcagctgcacagcaggacacctggtatccgaataacgctacgcgatcaccacaaaacggggagcagtggaaaaaaacagtgaggatcccttgacgggttataacgctaggaagggacgggactgttctgaactgacgaagctgctaaactgcacagtccatgtggatcaaatacgttcaaccacgcattctacagagaaatttttctgaaagctgtagaacacagaaagaatgaaaacaaatgcccggatttattggaaggagaaccgtactcccgagaagtgcgacggccttcgatataacgcttctaaaccaagcaatgcattctactccacgtcaagacagagacgcacatcactgtgtggtagctatcaagtgtgaaagcttgctagtccatacacgggtgacaaccagatcttttcgaattcttgtgctcaagaggtgtacgagaaaaagccccgaggaagggcacatttgcagataagatgccacccgtcagggatgtccttgaaacaatgatgttcggcggtcaaaacaaggatgaatacagcgcttgcctcagttcacgcggtttgcggcgatagagtgttcggagtctactcgtacaacgcatgtgaatcgctacttctattccttctgaaagaatctgtcgaagctatactcacgaacaaaagttcaataagggcacctccccagttctccctacctagcgagaagaatcggactcagcaagtcatgttgagacagccaacggcactgcgctgcatagcagcgtcaccctagacatacttagtctagctataagattggaaatcctgcggccaatatacctatcagagtctactaaatactgacgtcgtccccgatcatttgcatagtctgtagtcagcaactccttcacgaaactacctgtgccttgtatgtggcgtctacagtagtgtgacagagctatttgtagcttgcaacgataatgtgggcacgttgtcatcctaccttttctaaaaggaaaacaaacctccaatcctcaatgcaaaagagaactccacatgggcgctcatccaggaatttctgtttcagagtagcgcgtggctagctgggcttccgaaaacagacacagctagtggtctgcccgactgaatccgtttctgtttctcgagacactgaatgaggctaggccacagacctaggcacagattcaagtcatgctccctgtccatcaggagatatgcggtcagttgttgctgccacttttttttaagttgaccaaagtgcctcagcggaaaactttgtgaaaagtcaaccagttgcatgttcaaatcatattgtggtaatctttgcatcaaccgaggtgacagccggctgaaggctgtgaggaccaggttgcgacttgttttagctagttgaaaagcgcagtgttgatacgtaaagtctgttgatttggttgtagtcggcttacggccgcagaatagctactgggatcggaagcatctcctagcattttctgtgaggtttttcagcgacctgtggtacgtctgcgcgtccacatacgcaaga

SEQ ID NO: 2183 - DNA, 2267 bp, Toxoplasma gondii
ccttcttattcgccatgccgagaacgcgcaatttgtcaccaccgggccgcggtgcccggacgccgactgcggggggggggacgacgggggcggctttcgcggtgactcctggcgctttgggaaggtcttctctctgcccgccgacgcccgcctccttcggtcgcttcgcctgcgcaaggagagacggcggaggtttcaggcgaccgtcacgctgaggctgagaaggtcctccaccaccgacgcctggagagtctcccggccccccagcggagacgggaagagacactcccgagcctggggaccaggcgcggagagccggttgggcgacgaagatgtcgcgaggaggcgagacgcgcgatcctgcatggacggacgtctccagcagggtgtggggagagtcctcgctgcctccgatactggagaccagcgcagggcctccgccggcctcgctcgcgggggcgatggagaccggcgcgccggcgagcgaggccggcggcggagccgagccgggagctgaggaagcagacttctggaggcgcgcgcgaagcgcatgcaaacgactcagcttctcgccgacaaacgccccctcgggcgccggcggggcgcgctgaggcgccgcaggtccccgtgcatgcagcgccggagcggcgccggggacggaggagaaggaagaagaaaacagaggcggaggcggaaaggacgaagcgtctgcagaagctgggaagggggcagacggagggaagtgagggagtccagcgttgaacgacaagggagcaacgccctccccagcgccacccgcggcaggcgcgccctcacgcggcctcatcgtgaaacagagtggatcgaagcgacgagagcagagtgagaagaaaagaagactgtgaggaggcaacgcgcggagaaacggttgaggaaaacgaagagaaaagagcaaactgcggagaagcgagacaacccaactgtggagataatcgagggaagaaggagaaaggcctggggaaagaggagaaggagaaaggcctggggaaagaggagaaggagaaaggcctggggaaagaggagaaggagaaaggcctggggagagagacaatacagcaggatgggggagaaagggagagaaaaaaagactgtggaggaagaagaagaaatgacgtgagtgacatatcgaggatggtcgagtgcccccttgttccttcagttctcagacaagctgcggtgagcaaagacaggaggaactgaagggagtgtgaagacgcgtcttctccttttttttcgcgagagaagagacgagacagaagagagaccagcctcgccctcgccccccttcagttccttttttctcgaccttcctcgttcttttcctctctttccgttccgcgttcttctccggaactacacggcgcggcggggaagaaaacgtctgcgtcagtgtgcgtgagagagtctcgacactcacggcgagagtctggcgaactttcacccgttccgtttgttggttttgatgttctttctggaaaaaaccatccggaaaaacgacgtgctctagctgtctgccagagcagcaaatccccgaagaatccacggaagtcagggccaccgcagcgaagaaagaagacgccgaacgaaagcgcgcaaactccaggaattcgttttcttctggaccatcttcattgtttccacgcgcgcggccattttttgctctgccgttcgtgagaaacagcgctcgctgtccgcgttcaaacctgagagtcttcgccagctttctgtcgccagctttttcgtttcttcgcgcggcgcgcgctgcggccctcatgcttcttgtgtgtctcatcctggaatttgcgtgaaaaattgagacaaaatgttgagagccggcgagaaacccaagacacagctctcgaagcagcctgattgtggcgagattttctcaatttacaaagacgaaaatcaagcgtctaccttgccttgtagcgtttgtatactccaggatatacggtgagagccgcgcgtacactggcgttgctgcacacagagacagcacccccccccctttcatgagcagagaggcgacgcatcctcgccatcatcggctttattctcttcgttttgtctgtgcgcccgatccctggagtcgcgcgagtgaaggctttcttctcggaggaagagaagagaagagaagaagcggtttcgagaggaccggaggaggcaagaagattgtcttgcgctggagaaggccgagggaagaagatggccccaagagcctcgca

SEQ ID NO: 2184 - DNA, 1571 bp, Toxoplasma gondii
tgcatgtaaaatagggccacagacagtcatagcgtccgtggtaaactcacgttgcagacgctgctttggacagcaacgagaaagctactcgagcgctcgttattgctcgagcacactcgtcttcgttcacgaggacgatcaatcagcattggacctgggcggctaatggaaattgtttggggtgcgggaggtctttgttatatagcgctatgcaaagtgttctgttttgagagggaagctgacagtaggcaaaatcttgcgatatttcctccccgccccacaatgaaggcggcacgctgcacatcatcacctgcgttcaaatgcgtcgaagtggcactttgtgtgcgttctcgaccagatctcatggctggttatactgttgtaacacattcatattagcgactacatattgtctcctatcgctacagactgcatcgaggcgttttcgccatacagctctctgaggtctccaaactggtgacgagcaaatatcttaagatgccacgcaaaaccattttctcagtgccaaattcttgcactgtcgcattgccatgcgtccgtctgcgggaaggaacccgcttgccactgaaacacggttcattgggtacttactgccatagaaacaactgagtatcctaaatgaatcaccttcgttccctcttcaggttaactaggacaaaggtagtacccacgttgctttgttacctgttagtgtcgttggtcagctggcggcagaagggccagaggggcaccatcacaacactataagaaacacacagggttggagcgttgttgggtacaggaaatagaagtagcaatagacactttttgcagagcagttcgcctcttgtatgttgtgtaccatcgttgacgccagagaaagacggcaaaagtctcgtcattccagctgtagcgtggaaactgccacaggtggagcccggtagcccgcgcaagtgggtgaggccagacccgtgatacagcactctaaaaattttccttttgcaaaataatgcggaaagatgttgctgtgcgtctttgtgctgaaggaaatcttttcggccagctaggtgtgacaccccgcgcgactgagttggcactattgtctctatccagaaggcctgcgcattgggtcgtcgcccacactttattcttcattgatcgtgactgcggcgtacgtggcacgtcgtttaaatcgactcggactgttttttccaggacaaacaggaactacgagcgcatggtattcagcgcattcggattcgaggaccgcgagacagccgcatgcagtccaccttgtcctcagtcccaatgcatgtttttccagtttgcgtgagcgtttgaaagtagccagaagcagaactacagcatcccagtgacacagtctgcgcggaaactaggcctctggaaatggtaccagggattttgtcgtccttttctgcgagccttgtcacaacggggcgtgacgcagccgctgtacaaatttcaacccttgtctactcctttggagatcgaatatgcgtgtaaggaactagaagaagtttaaagcttctcttttccgccagtctgcttca

SEQ ID NO: 2185 - DNA, 2439 bp, Toxoplasma gondii
ctaaatgcaatgccgacgaatgccacgaaatgtgcagcgcagagaaactccgtccagaaggctcgtacatgagcagacgtttgagagacatgatgatccgaccgctggcaaaggggtccggcgggataatccgcttttgccttgcgagaagtgagcgctgtccgaaaatcagatgctgaagaaactcgctgttccacgcgctctcaaaaagactcataaaagtgatacatccaaagcaaaaggtccagtcctagcgtcagaacacatctgcgaggagggtcccgcgacgcgacttcttagaaacgctcccgcaaaataggagacaacgtacgcgagaaacatcgctgcacaaggcgatacaccgaaacacacagaaggccgaattctcgcagaggtccatcaactgaggagaagctgtgaacgcttgggcgttcgtgccgacccgctgaacacacgggacaacctgattcatgcagtttcctctcactccgacaggctctcagggtttgcgtttttcgctgctttccagagaaacgcgtttttcaactgtgcagaacggaagacgaaaccttctattctgacaatctcatgaggaccaccacctcttttaaagagcgcatgcacgagcgcgtatatttgagagtttcggttcaaagatagaggggtgtgtgtgtcaaggagcgcctacgcaagaaagccgtttcatacatgtctgaaactgtgtgtactcgcccagagggaaaaggttcgctactccgtcttttccccgttatttaactgtccgctgtacctgagaaaagaaaagctggagaggaacttgaggcctgggtactgcgctgaaagtgggctgcgtgtgggaatcaggtggctgaaacgaaatgcagattgctttcgcggagtcgtaaacacagaagggggaaccaaggaggaaaaccggccgaagaaagacttcgcggaagtcagtgtttttgcaaggaaaaacgacccggagaagcagtggaatttctcttttccatgcgcgccgagccactttttgccgtgaccagcagtccgtttatttgtccgccaaaaagcgcgaccgtacaacgcccccaaacatgtagccaagcaaagacgcggcagcactgggcaagacaggcactcctgtccgagatacatctgagaagacgcgcagagaggaagcatttgcgcttgagaggctctcgaaatcgggtccaaccgtcgcagcgtatcccaaacgcctgctttcgtcgcaatccaaggacgtctgcccgtcccgccacgaacagcactctgcactgagaacacaaactgccagcggatctgccagctttcttctcggtctgacagtcacgtcggtctccctctttccccaaatgaagaagcatagaacctcagacaacctgcgcactcaacacgcccgttttcaacaagggcgctctgcccaccgtaagacgactcgcgaaaaacgcattggttcttgccacggaaagacgcacacgcctagaaagccgagacagacagaaaataccgtgaatatgggtgccgaaccagccttttcaagtgccctgttactcgtgtgtgctgtgagctgggaaacgggtcggcgttcgtcatcgtcaaaaagggattatttttcgaggctttttcgcagcgcatgtgacttgtccacagcgcacagacgagtagatgcaacactggcgaaacgcctcgtctaggccctttgcgggagaaaaggcatgctagagattccccaaagcgcacaataaataacgccagacacttcagcagacaagaggtatctttctgtgtctagcagcggttccatgaagtcacttgcagatcttgtgggaagtcccagggtcgccgagtcgccgctcgcgggctttttgagtgtgcagccccgaaagagcctcgattttcgttgacttcccgccggccttttcttcgccttctgcttctgcttttgatttattttcttctgttggtatctctgtcgcctttgcatgctgctcgctgtctcttcggcttcgatggagttctgaaaaccccgcgacgaccgagtcctcggccccttcgacagcgttgcacatttcgacgaacacacgagctgtgtctcccctctcttcgctcaaagcgacccccatttcgtcgcctgctgtttcgcccccgtttctccttgtctgtcgacttgcaccatgtgaacacgcaagactactgggagttggacgatctgctgagcgtgactatgccagtcgtcaccaaagaattcggtagctaaaactgtggaatcaaggaggcgccaaccgtcccgagggcgagtattccctgtctgtgcatcggacactctgttttcgatttcttctgtcttcctcgcgcgtagtagagagccccagatgcgatgagaagcatctccctttcacctctgcgtcctgcgaa

SEQ ID NO: 2186 - DNA, 1570 bp, Toxoplasma gondii
aaagtagtcccacaacgagtagtctcttcctggctttacagtgacaggcatcgtgccgaataggtcctctcagttgtatcaacattgcaaataacgggcgcacttacggggaacgtccgcagcaccacacgaaaaagggtatgtactcggcagcaggtggctctctgatcgtgctccagcttctacagtggttgcagcctgtcacaagacactccttaagcgtctggcatattctacatgttctagttacttcatcgtgcaacattgctacgcctcactaagtagacaatgcagcgactcgacgtgacttaagcagcacatcgtacatgtgcacgaagcctgtctctgaaagcgatgggaatgcaccgggcattcaagagcaacatatttattttttttcactgttagttcattctagacaaagaagttgatgacacatctttgtcgcagtcaccaaaacacatttttcgaacacgtacaaggaagtctaccagcagttaactgtcctgagccatgccactttaattttagtgcatcaaaagaaagatgacactcgataatagccttcggactcgtcagcagagtcgaagagaccgggggtgtaggtctgcatagtgtctgtcatggtgcctgataacatactgcgatctatcaccgcagtgcagcagcgaaagaccgacttggaaactgtcttgtccgcgataaacgagatcatcaagccacgaactgctgaagtcgtgccggtagaaggcgcgaccccctcccacagattcgttgaactgatacgtcaccggcgacgtacattgcctgccaaagaataggtagaaagtagcttctacgttgcccttcattctgcaaagacaaacacagtcgtcaccaatgaagtgattgaaaggtatgctgcggcagatacagccacattttttacgcaacactttagtttcctcctgaagagctctacccgtggcaatgtcatcgttcttgttggccggcccgccactcaacaagtggacacacgactttcctaatctgcactgccgattctgctggtcagcgggaattcctgttaaacattattggtagtgtcataatgcgataaccccagcatcatcttaaatgctattgctgcagaggttattttcaaaagcaaagcaaggtcaggctacactcaccggacgagcaaagccgggcaggcttttctgcgggtgctaccggtgtgacttttcccagcgacggcttcgcggtgtttgtgttttgtcccaaacgggtacaggataaactgcagttggcagcttcttctattttcgcttcgcaaccatggactcacgatccgacgtggcagcttgccctctcgagcaagtaatgctagattcggtaccacccagcagatcatgtctgtctcatacaggccagtaactattgtcggttgcctgtcgatcagtagggccagtgacgtgtgcaggagcatgttgtcgtgaagcagatgagcgttcagtgatgtcagcttctgtacttttcgatttctctgaacgttgatacggcaagaattcacaagcaggacgagagggtt

SEQ ID NO: 2187 - DNA, 2421 bp, Toxoplasma gondii
gtccaggagatggagggttttcacagaaacgcgtttttcgagattcgcgccggcgccagtgtttagacagctcaaggaatacgagaagtgagtcgtcaggtggacctcgtctctgcgtcgtcgtgggtggactgatgatcaagaggtctgaggagacttgactttcttcagaagcgttttgagcactgtttaggaaagaaaaagaggcaggtagcctgttgtgtacaacgcctgccgcggggagcttggcagtacgggcgaggcagtctgctgtgggacagatatccccggaacgcgtttcttgtcttttcgaggaagacgctcgacaaacgtttgggggttcaaaggcgatttccttctttcagactcaggacaatgaagggaaaagaacaaggaagtaggaatcgtatgaactgacttaaccaacgacagaggcgcgcatcgtgcagttgtaaccgctttcgtttactccactgcgagacatatagcgtcaaggaaagcaccagccttccttttctttctactttgaaccaacagaatctctctgggagacgtaggagacgcccgtgtatgcaggcgccgacaagccggtaacacaaagacactccgagaacgcgaaaaatggatcctgttttcttgtggtcgcgatttcctacagaaatttccagggaaatttgaccatccacgcgtacaccgacatgtgtaggagcatgcggattgtcgcaacgggcaagccagttgacagtgttgtttttcaccttccgccggcattcatgtttgcttggcagttgtcatcaacaactgtggctccgtttgaacacagttctcgtgaccagggagtttgttccagtgtggacggacgccttctcttcttcttgcccgaggatcaaaacattgcaccctccttcttcagggtgtcgctcatgctggccttcttttcagtatcgaaggcatccatctccacgctcgtatgcaagaggtctgtctctccataactgtggatatacagatagagacgcatttcaagatattaaacatgcatagatatcgaatcgcaaatatatcggtagatcggtagacgtacgaagtgatggagacagacgtaaggacccattttcacctgcgttcttatctgtatgtataggggcgcctgacggcgcaggtgaacgcagtgctctctgaatttacttctctctataaagatatggcgctagatgaatgtaaaaatatgtttccaacttggtgaagcatacgtggatcgtcaacatcgatttccgatcacgtgaggtgcactggaacaagacgcttgaggacggcacggtgttggacagcgcgcatgcacagagaaagagctttgaaaaacagagagaatcctttctgcttctcgatgccatccattcagaacgcctgcatcctgtaaaccgcgtttttcgccgcgaaaaacgccgcttgtctcaaatgcggttcaagcgtctgggtctccctgcctcaaagttgccgagaagagacgtgccatccatctcaacagcgcgagtggaggtcaagacagctgcggatttcttggtttctcgcagcgtttttctcttcactaaaaacgaacgagcttgtttcctatttcacagaaaggcgttctttctcgttctttccttgccatgcagccagccgtccccgccgtctcccggttgcgtggcgcgggcgctgtgtctccagtgtctccaggagacaccggaaaggagacagcagtggggtttcgccagtgtttcggtatttctcgccgttggcttctcattcgattgttctgagacgcgttctactgtctgtggcgtctttttcgggcagagaggcacctcgttcgtgacttctgcctctctcactctcgtcgaaaaatcggctttctccgaggtccccccggcagatgtcttttcaaggtctcgcgatggtgcagaccctgcggtccagagaaaaacggcttgcgtctctctcctcggttttctctttcttttcatttctacttttctatcttcaaaaacatacatgccatgcacgtaaaactacgcagctgcatttgtttggggatgccggtgtcgccggctgtctgcatgaacgcatggtagctctgtgagtgccgatctgtctctgtctctctttcatggtctgcctctgaccaccgcgttcgtcgatctcctccttctctttcttccttctttcccctgtctgtgtctctctcgcctttctaccgtcttctcgctgtctctctccccccctcccccccccgcccgccctcgtcccccccccccccagtcgtctctctggattgttctgtctgttctgacgaagaggtcttttttcctgtccaaaccgtcgttcgaagtccttgacttttcttctcccgtcgcgtctctccccttcgcctcgtcctca

SEQ ID NO: 2188 - DNA, 1254 bp, Toxoplasma gondii
taacaggagttggtggcatgtctccaggcctggtatgtctaggcatgcatccatcatggcagcgatggtgcgaaatgcttttcgtaaaacatgaaccacctggcttacagatgtatttgcacgtatcactgtcgctaacagcacgcagcgtgttcattccatctttcgagtcaggatgcgagagtggatggacgcaggtcaaagctgttttctgttgaatgcgccagcgtggaatgtccttctcggcttgtttcaggacgagcacccaggcatatgggctacaatgtgcggctgcgggggacggcaaggaaaaaacggaaccgaggttgtagaagtagtcgacgcgggtaaagcggagctgaaccctgctcaagcttcttaggatacacatcaaactcgccacaaagaggcagagtctgcaccggctgccgtgccgaccggtaaatcaccggacacgggggatgtgtttggatttcttttagtaatattggcgtttaaccgatggtcttaagcttttgtgctttcgcaagagcgttcattcgctagtgaacttgtcaataccgttggttggttcgtggtctttcctcgtttgagagtttttcgtacgcccgacgggagtgcaccgcaaaggccaaaacaaagatttgtcgctcgcctgaacgaagtatgaagagtcagtcgaggcggttgtgcacgggaaactggtgctggctcttacagtgcatcgtacggccctgcctacggaaacctagagttgttaagttctaaagagaccacctcaactacttctgcgtggcggttgaaagctgtcaaagactcaagcagtttcctgccccctagggcctggcgcccaacgcaagccaattttgcgtgcggaatactgactcagtgttgcagagtgtacctctcgaaaaaggtgtctgcgattatcaagaaacccgctggtataaattatgtgtctcagctcttttttgcaccctgtttcaagcagggcaaccttcatgtgaaaggatgccttgcggcactctacgacagcgaagacatgaaacacgcaggaagctgatcagctgcgattaacgttcggtgtatgtacagctacttcattgtgtcccaagagtggccttgctgagatgatccacagttgtggttaaagcattaatgtgcaaacacaccgagactgtttttgataccgctgtggacagcccgtagctgcaacttgataacctggaagtttgcttgtcctaagtggggcga

SEQ ID NO: 2189 - DNA, 4229 bp, Toxoplasma gondii
ccattgagcattcaacgtcggttgcaggtcttgtcttgaccaccgaaggcatgatggttgaggaggaggagccagagaagcattcacgtgatgtaccagacatgccaatggcatgatgttcaaataccgcagttaacgagattgtcctgcctgacagggcttttttgtatgcttatgaggtgcagctgaaaggttcgttttcatcgaatgtaaatctcgatcccggacacctgacaggtgtgtgtcatttctgctgcgaaaaggaaagaatgactgaggtgactcactccccaagattgatcgaagggatcatcttcttgtatctgaatagtttttgaacttcactttcgtccccgggctctacctaacttgccgcttaccgtgctccccaagcctacagttacatattcttgactgtgcaacacagcaacatcaatcggtgctgcaaatttcccttctccaacagctcctacgaagaattcggacgtaacctgactgcacaacgtcatgtgacgcgtcatctaacctccacagacatttacggcctcctgttccatgtcctgcgaatggctgatgggtcgtttcatcctctgtagaaaaccaaatacacacaggtttggtgtgctttaccgctctgcccaaacgtgagtgagctgtccatgttcgcctggtcaggaggttgctgatgtaaatccgctggaccaacgcaaaacggtaaggatacattaccaatgtccagccgcatgaaacccgtttctccagcctaacatcgttggagaattcccggcagccgacaggaaaatacgtttcctcacttacccatgcatcaataaagtggaaagtagctttgacacgcaattcagtatgaggtggcagtcttccgaacttctttgtaacttcgccctacactggagtggtaaaagtttgcttttagatgaaattggaatttcgtaatacccttgcaaattttccgaagccacccagcatggttattccagcacatttcgatacgatatctctggatgctggtgaaaagcatttatctcgaaggatcatttgccaaaacagcaactgacacaccagtgttatcccagccggttgcttctcctgaggagagatcctccctcgcagcgatacgaaactgcttaaccccgttgacatgcaagtcgcccctcaagtcaagagatcttgaaaataattgtaatggaggtctgctgtggagaggtagcagatcgtgcatgattcttacgaggcagcgaagttcgtggcagtcaccgtcatgttatcttccgaatcgacctccagaagaggagatctactactttctacaacgaaacgtccagaagaatccatgccaattgcatagtacgtctcttcagatccaacgatgatctgggaaggctggccgtcagctgatccgactcgcaacacagatacggtcattccgctttgaactgtcggggccaccacagcagaaaccggtggtgcccaggcaaacaacaggcagaggcctgtcaccgtagtcagcttcattttgatgttttacacggggattctaactctgcattcgctcccgtgacaactgctctaactacaggcaaggatgatctcgagacaacggtttccacggcaagagacggagacagcagggagtacgtacacacaggttgtgccagtctacgcttggccactctctccgaggctttcgcacacaatcggctgaccccaaagacgcatcatgttaacaaaaaaaatcaacatgtgtctgagagcattgtctgcggcgtttttctcatttgttctctgcgtcagcaccgtcaccgctgatgttcgaccgaaattcatacaggtaaattccttaaccgtcttgttcaccgccaacctaatcctttagacgtaattttacacagatttcccctgcctttggtgctcggaatcctcccccgtacaccgtcgttaatattgtcgcggaggctcggctgccttcggtatagtgacctcacctcttcccgctccagtcggagtattcatttgttgtgcgttaggattttcttgaaggtatgcatctcagttgaacgatttccaggcggatgcaacgtgactgaatgctgacttgctcagaaatgaagcttgtcgaagaggtaagatttgaaagaagtacgccggagctagattgcataccacatgcctatcaagagaaaggcccagagtcgttttcttgcggatgttgaccagtgagcaaatacaaggaaaagctatcgtgggtgcttgcaaacacagaagataccttccaggaaggcaaaagaagcctctcaagtctttcgttcactaaagatagacaggcaacggatctccagtgaggcacttttccccgtttgccgactactacggaaatgcgtatgtccttgtgtcaggaaccttggatgccatcaggtctcaagtgctgaattagatctgctcatccttccagttgtaacgaatctggatcccagccacatgatcaggaaagttagttctctcagactgcaatcacaaggggatttggtgaggtttgcctgagaccatttcacggatgtcacgattagacaaagcggctagtggctgatgactgctcaaacttcccgctttcctcctttcgacgagagattcccaggggagtttgagtctccaaacgcagcttgaaacattatgtagcagatggagaagtgaatgcgtttgttcttgtgacactcatgctgaatttaagttgccatgaacggtttgacaagtgatgttttcttagggtacctttatcagtcgttgactctttgaaaggtccaaactgactcaggcacactggataaaccgagttcatttcgtgtagcagtgttctgcgattccactcacatttgcagctcaactgtttttcttggcagcccaatttgcatttgggtgtatcactacaggacagggggagaatatgagtccatagaaagcttaaagagcaacaacaggaaaggatagccccctgggtcgtcccccaacttctgaatctaggggatttttttctctctcaacgacctggactgggatgagcatatacgtgggcctgcggtactatcatgccttccgtggagctctctttgtttcgctctagtgcgtgccagggctgggaatctaattcgtcaagcagtattcatagctaatgctttatcttcttccgtttcctcgagggtattgcctagaatttcttcggtcgcacaaaccatctcgatgcttctttgttctgtgcctctgtctgcttggtaaaaagaatgttcagtgtcgaggcctatggcatcgactcgatgtttcacccaatcatactataatctcactgggaggaaatcccttcaccgaatgtagacattgggtggcggctgcagagagcaatcacatttttggaaaagggtgagtggtcgtagatgctgagagtgcaagttaagcgtgtcaccgatcaagcacactgtccatgtgacttcttcctctgcggacttgaagcgtagctcaccctgctgatggcgccggaagatacgttagtcaagtacttcccacgacacagtataatgagtactgctgttcgtgtggcatcctttaaagcacaatctctggacaaggaaagctctttgcctttaaaaaaactattccctttttaagtcctgtcgtattagtttccggaggcgggcgggcactcgtgaaatttctcctgtcttggcggtagagtcgtcacacaaaagcaactagccggtctaagacgaccaccgatcatccttgtgaacctcagtcttcggatttcatgaaacgaatttacaaacctatcggtagagggactagctgtttttagatggacgcgaccataggcattgatccgcgatcgatgctagttactttccctcttcacatgtgtctgcgaaccccccaaccccttccccgcttccggatgcccggggctgtcttgcgactgtcttccgcttcagtggcatgcaacttgtcatgtggctggccccgttgtcctgcgtcgcacttccttgtaacatttccttttaggtttcctacttttttgaagttcgtctgtagagtttcgtctccaagggactgggcagctctacgcagtgaaggcctctcctgggttcataggagggttgaccttgcctcaactagtcaatcggactaacttaccctcacctcttcagcgttttaaataggcaata

SEQ ID NO: 2190 - DNA, 1870 bp, Toxoplasma gondii
acacaccagtagatacatcttgacagatacagtcatgaacaaatgcatgtatcggtgtgatttgaggacggagaggcgccggcgttgatggaggtgtgtagcaagcgagagagaggaggatgtaagtgcagagaggaaagaaaattccgagagggtctggagaaatccgaagagagaaaattcacttatgcagcacagagaatcactcaccgatctccacatctcccgagtcgtcgagagacggctctgctctctcgcctgcagagctgcggcgtctcctgctctcctccatggccgagagagaagcggtaaaagccagagaaaagacaaaggaaggaacaaggaacacagacacgctagggaagaacaagaaagacgagaagaaagagacaacagcgagttgggaggaaaggggaaagcaggagatagaggagagacagagaagagagaacgaggcgactgagagaagtggagactggacggtcttgacgaaaagtagacgagacagctaggtttgtttacaagcagccggagctgaaggaggttgtgaagtcgccgaggaaagttcactcagaacaaacgagacgaacgctttgtctggaagagactttcgagcgttactctcaccgtcaaaaaagcaagacacgaggagagagagcagggcattcagaggaacgacaggacctgagatggcgctctttactaaaacgagttgcaccgagccggtgcgcaggaaacgcagaagaaaggtctcttctactttctggaaagaagagaagacggagagagaaacggagaaaagaacacgaggccaaccacgctggctcgccagctcgcagctctgcgtgtgcatgtccacgcggcattcgagagaaagaggaaatctctttcgtcctcgccatggttgggcggaggactgtcagatgaacaaacgtgagtagagttctctgcaaaagtgcctgccggagtctcgccgtgtgtgcgtcctttcttctctcttctgtcgctgcatgcaaggactgcgtggactgcatgcgcgcgagtgatccttcggatctgactcaaagcgtggaggttcaggtgctctgtttgaacttcaagtatttctcgccgtccatcactctcttcgaacctccatgtgagctgagtcgcgaacacacacagctggcgaccgaaatcctggctcaaagttagactttctcgcgttaggacgtgagtggagggatcacagcagtcagaaatgcgcagaaaggaagttccgccttttcctgtttcgtttggagagcgaaccgagaagaggcaactggacttgtttcctggggggagaggggaggcgcgagcgccgcggctccaacgcacggcgcaccgaacacggagaaaagtcgcgcttctgtgttttcttcggagattctcctccgtgaaatccagatcgcgcttttccggtgttttctggactcttcaagcaactggggcctaaagacgacgtttgtcgatgtctttccgcgggatacacaacagcggcgtgtctctcagctcaacagacaacgacgcgtagctttcgattccccttattccatcccttcgttttcttaaagtcacttttgcgacttctgtctcgaggtcgtgaatgaagaaggacgccaggcgccgtcgcagggaacacaatggcagggactcctcacagtccgaaacgagactccgcgtcgatcggcggagacaagtcccacagacagacgtttttcagtgagaatcactcatccgtactctaatgcaacagctgtggccgtcatcttgtgcaagaacctggactcctcagagaggaaggcgtttgcttaaggaaacggaagagaattcttcccggtgattgtcg

SEQ ID NO: 2191 - DNA, 2162 bp, Toxoplasma gondii
ttctttcgccttttgtgagtagcgcgactcatgcttacgtctcttactcgagggtttcgatggcgcgttccagatttcacgaagaccgcgtggactggttgcgagcaggcagggaaaaggcaacagctgcgccgaatgcgatgacgcgcggcttttatttgtggccattcagtgggtttctttgtgaacagagtgtacggctgagatgtaagtcgatagcaacaaattaagaaagatttctctgacgttttgagcgcgctgatcgttccgctcatagcgtgagggatccgcaacgcatgaagatactcggggacatgaaagcgttagccttgccagtgtactgagaacaattttctggtgcatcgggtgttattacccttcttcccctccgggaagtggaacggaaccagaaaggaagagcttcccgtcccaacaggtcgacacactcctccttgtagaagcttttgcatgtgaatctcaagaactcaaggcttttcgagcacgtcgagactgtctgcgcgtgttcgtttccggagatatttttgaggttgatattccagtgccagttgccgttgccaaggtccgttgacccatcgcgcccaagccagaaatttgcaccccttgtgaaggtgattattcggccttccagtcgctcagtattacacctgaccacgaggactcccttttaatttgccatacagtaaagaaaggacagaaaatcaacgaattcactagagacgtcagactgaagatccacctcaccgccaatcagcttcatttgttagttgatctcggaggggaaggaatctcgctcttcaccttccaacaaaatcgctggagtcgataaagcctctaacttactttggtgggcgcttttcctgagaacagcaaaattttattcccaagagtttgtgcgacttcgaaccccagcgacgagacagacgcgcaaagtgtatatcccaggtaaggaaaacagatttgttaggctcaaagcactgtaacacacgcctgctatacctaggtaatggtaagtgacgtcacttttaatatggtttctgaagttgcgcgggatttctgggcactgtagcaggccagacgatcgcagtggcgaacgcgtcagcagaaaatgtgttcgcgcgtgattcctggagctggcggagccataccattacaagcggcgcattcgtagacttatccaaaactttaccccttggcgacgtccctgttgaaatgtgacggtacaagtagttttactacgccagtacagctaaaacactaaggctagtctcccaaaaaatgaatgcgtatagtagagaacaccggtgttagtcgttataacacgtccactaatgcagcagcagaaatcacaacagcatctacatcgtttcccgttcacagtgtgctgagtcgatggcttagagacggaaacatgttgacagcagcaaacgctgttaaattccgcatcccttaagaatgctgcagtgtcgcgagtaggaagttcaccgttttgtgttttcattgtcagataaaaagaattccgagtcccagtgtaggttcgccagaatactcacccttgttcggcgagtacacactgtgacgcagtgatttttttttgtgggagcggcagcagcagcagcagctttacacaccagataagttccccgggtttcccgccgttttcattaactgttattctttggattatttttccatagtgtgctctaaagctatctttcccgtgaggaacgcggaaaccaaacttgctgaaaggccaggcgagtggtcaaccgtatttcgttggcattgttcccggagacagagacacggtggcacatgcaaagaatccaccgtcctcaggttcatgcggtttatgggaaaacagaagagttcgtcgcctgtgtgtatgttggtttcatgggactgcaatgttctacgcttctccggttcactggtgaaattggaatctgcggaggagtgacatgaacccgttttctcaatttcttcggtagaagccagttttcccctttctttgctgctaggatgtcagcaaggaggtctcgcacgttgtttcgcgtcctacgtttttagtgcatagaacaagtgacctgtttgcagcattctcactgcgtttattcttctctttgccctagttcaaggaacaa

SEQ ID NO: 2192 - DNA, 3244 bp, Toxoplasma gondii
cccgccagcaacccacagaacgcgttctttccagcgaaagcaactcccctcttgcttcacatgcatgtcacaggtccttggaatgaagtcacatgcattgctggattgttttgtacgaagtgccaacgctttcggaggacatttgggcgctcggggtgccaccgaaatggcagtgcgcctttttttgaggtggtgacaagcgaacgcgaacttcgatcaggcaccacagtcccgatcgcaaccaacagttcacttcccttttctccttgtcgaatgcatgcgcgctgagttgaatctgtctctcagacgatccccttaactgcgttccactatttctatctttgaatccttacaaggtattcgttgccttaagcatggtcggcaaacggaagagaacttggactgaggaaagaagcagaaaaacccgaaaaacgcttgtcaataatcctgtttcacgaaggccgctttccgtacgacgggtctattcacagccgcatctgtttccttccacccccgcttctcgcgtctgaagacatgaaagccatttctttttgggaaatgcctgaggcaaaccatgaagcagaaaagacgtcttctacgaaaggggtcacctctctccagaccacaacttcacaagcaaacaccaccccactgggaggtccagatgactggcaagaaatcacacaagtcgagttgctaagtcttcttcagctgctcatacaccgccgttcacaacaatcacactcaaatcgggacttgtcgcaacacatagatttacttttggcttgaaaatatgtccacgtacttaagatgcatgcaaatattcggtctatatcggttttggaaaatgacagcgtcacagcagttttctatacggtaacaatatcagctttccatgtcgaacccgttctcttgcggaaatcagcgtcttcggtgaaagaactagttccatcagaaaaagctcagaaaaccgacgagagacggatcgccctctggcctcagcatatacacggaagaaatggaagtcgttcttgtgtggcaggcatatccatttagaaagctttttaacactgacgttcgaagcaggatacgcattcatagctacacatgcttaatatgttatacatatatatatatatgttatataaatacatgcatacgtatatgtgagtatatatgccctcgattgcagtgtcttgaacggagagttttcaggcgatgactagcggtctttgcgtctttttcatttccttatgtttctctacagcttaaggaacaggccgtttgccgagaggaagcgagcaattcgagatcgaattcgtctctccagaagttagatactccagatatttccgtggtcgagctgttcagtaaaccgatcctctctttttaagatggtccttttcaatactgttgattattctgtccttgagctcttagacaaagctgtcgtgtctccagaaaaaacctcgaaataatgctaattaccccagcctcccgcttcgacaaaacaaagacttcgccgaaaaaccactgaaatcctctttacatcccccggttttcggcttcgcaaaagactccgctggaggtacaccggagaatcgtacaggtcgtcgctgcgcaagcgcacaactttaaaaggctgctgttcgtgaaaaaagggagtgtgtcttagtttctgtctggagagtctttttcttctggagtcagtgagagtcttcgttttacctcgattgcacctcgtcctcgtaaaaagccatcagtcccgcagtcgccgagaagttgactttctcccgtccagaacgcagaagatttggaaacgaaaaacacgaacggagaaggcaaggagacaaagaaaaggagacaagactggaagactcaaaaacagagcagtcttctgttctggggggcgacgacaccgtttgtcctctcgccgcgcgaggtcgagtgtagtggtgtgtctctctttttctcgaattgcatgcgctcgacggcgctactttgttgcaaagaccagagaagcccgagagccactctttcaaacgccggtttctgccttttcttctctctttccatggagaaagtctctcttccgttttctcgcattttccacgcgcgttcgtcaggtgtacgtacagctggcggtggactctaactccagaggggaaagcagtggtttttctgcggccggtgtggccggtcttggttttccatcgtttttttcggaggaacgctgaaaagagttgcattttgtgtgaaacgtttctcttctctcgtgtcttcttgtccgtccggtcgcaccacagtcgagagaaacgcctccgtttgtagcaacctccagggtgttctttcccgatcatcttctgccctctctcctctccctcgtttctgctcctcgagcgttcccctgcatcggagaaaagacctttttcctattctgcgtcctcttctctgcacagtgagttgcagagacgcctccagagagagacagttatctctttgtcatctaaaggccgatctccagcgagagaccgagaatgttctcgagagtgccgaaccgactttcttcttgttcgctgtgtcatcagtttttcctttctttgcgtcttccttagcgttatcttgcagtctgcaggacatcttctctctggcggcctcctcgcgttgattccatttctcgcgcattcatccaaaaagtctcgattgttcacatcatctgacagtgtgtcctctctgtaaacctcccgtgtgctgtcgctctggcggccaaaaaatacaaaggaaagacatcgtttctctgcaaaaacatctgcagagctctcgagcgttgtagagcgagaagactctcggttcttatctcttttttgagacccgcaccggcctctcttttcgtcatccccgcaaaagcgagcgttcacctcgctgtgtacacgaggaaacgttttctgctcctactctgtggataaaccgccgagtagttcccagtgtcgactgatgtcctgcgtactgtgtgctctgctgcggagctgctagcctcgttcgctccctcagggtcgcaactttctttcttgttcgtcattttcagccgtgctgttgccggcgtttttcacccccatgctgtgtgtcaactggctgcgacgacctctcgctgttgtgacagagcatacatctcgtttgtctgggaaggtgtcaaggtctcttcgttagtggcggtggcctggcttttcctccaaacgcttcgcaa

SEQ ID NO: 2193 - DNA, 1340 bp, Toxoplasma gondii
tggattggtacaaaggagttaccatatcctccgtaaacacctcaagaacataaagatcagagctgggtcatgtactgggagcagcatttggtttacacgtgtaggcatatgctgagaaagtcctcagtctctgtaatgtgtatgcatctttacagtgaagggtcgaggagaacgtggaggggagtaggaggcgatggtgcaaaacctttgtgcgaagagggttcttcagcgacgttgcctattccgatcagaagtcgggaaccagacccctgaaaagcaccctgtgtccctcggtggagagttaacgcttatatcagaaatgggagttccccctaacatcgcatttgtttttctcccattgcaatgcaacgtggtgtgaatgtaccgccagtgcgagaacctcctgcgattgaagtctttggtctgttgctctgcataacgatagtgggtttgatactggtttgtttatacttgctggcatgcgttcaagtctgcccgttggcagaccggctatgctatcccagaagagcgcgaaaccgtgttatattggaaaaacaacgctctgaaagaatgcagcaatagcgcttggggttcattttgcacagcagcacagtggctgcgttgagcagtaccagctacatgtccatttagctcgatggatatccggtagcagttcatggtaactttgaaacactattccctctcgtgtgaagttctttttttgagtacttcagcagaacctgaaaagcaaccctcttacggaaagtgttgatttatctcgttttttcgtggcttgaaccagctgcagggcagttgcaaccgctttcctacgtctggagcctctgtgcaacttttgagaaaactgaagcgacatttaactggtatctttctctacatttgccaccagttgcttaccccgttttcccttctatagcggcttccgattatctagattttgtcgccttgcttgctgttgtgatatactcgtagcgcagtttagctttctttgcgccattctgaggtcatcatgaacggaggaattttcgcgaagctcgttgtctctcggtgcggaagcccaagcccaacacatcggaaatcgttattgcgcgcgcctgagaaacgtaaatctggtggaggaaggcagagaatggtttcgtcgaatccagatatacttctgagactctataagcttcagtcgtgccccaggcgcttgggctcagagacaagagagacggggcagctcgtagtgtaaaggatgttttcgcgagactggaaaaagaggtgtggggacatcggcgaaagggccgagggggcgtagagaaggcggcgcgagcgtcgca

SEQ ID NO: 2194 - DNA, 3277 bp, Toxoplasma gondii
aaacatctgcagtgcctctgcaggtgcgttaagtgttcaaccaaacgttctgcacctctctccttcacttagtcacaaagcgccactcccgctatggttcattatccttctgaggcacactgaatggatacgattggatgttgagtacgtgaagaaaccttacactcgaacgcgatgtattttcgttcttgttaaaagacctggtcttacctggtccgagttttcgctcgcgttcgcgctctttctctgccgctgctagggcggcttcgtcgaccggcctgcagcgagaaatgcccagaagagaccaacagccaaaaccagtaactcacgtcgcgtcacaagatccacttgctccccgagctgccttccgtgatcaaggtatcttccttctagtaagacacaaacagaaaacagtcgttttccggaacgccgttccctcaagtgtgccagcatagcagatatacaaaaaacgcatcggcgaatcagggacacgaatgggagcagcgaaaaagagccttcctagtggcgttcactctaaccagtgtgtcacttctgtacattcgcaaacgagaactacccaggcaagccaagttcggaatcgagaagcgcaccacaaatacgccagcgcacctctgcaggtcgacaaaatacggaacatgggaaacacgaagctgaaccccacagacagttggaatgtatcggaaaaataaagtaccaaacgacaaactagacaacaacactaatgacccaacttccgccctcgggcgcctgcaccgcttctccgtctgcccagtctccagtggatgtacactggacactgtcccgtacgtcgcttgaagcaacgaactcgtgtcagtgttctgtccgcccgcccccccccccgacagaaatcagctaaattccgtcaaagagacagaaaaatccagaagagttgtgtgcgagtgtttttaagcgccattctccgtttgtcccctgtttctgtcgtgcgatcaacgccagtgacagataacccgtcccttcgacagcaccgctgttcatgataacctctactgtctaagtccccaacacgttaggagcagcgacactggcacgcgcgcagaggtggagacgctcagaaagaaggacgaagtccccgatgcgggaaacgcgacgctgttcaactcacttcggcgcagacgggagaagtgtcacaccgacgcccatctcacgctggaggtcgcgcaggttgacggaaatgcctttcttcttgggcgccattttgcagggatgaaaaaaaagctccttccagccagtgaaaggaacttggagacagctgcagagcgttccgtcgtgggaggcggggctacatgcaacagtgcgggaaagtacgggagagccggtgacacatggatggggagaagtgtgcgcttttgtgcacgcaaagaaggaaggccgagcgacagagaaattttcaacacgatgaattccggggacgcacaagagtagggagctgccggggaaacgcagaaaagggaaggcagttccgccgcggaggagtggaaacaacagaaaaaacggtaaaaatcagcggaacaccaaaagggaaggcaagcggggaactgtcctgctcttcatggaaaggtgtgcctgagcaacctgctccaccaaacgagaagaacggagtgggcaacaggaaaaaaagtgaggtgaaaaaaagtcagattggtgagtggtccaacgaaaacgaggttttcgtgttttctcggcaaagcagagagcaaagatacaccacctttcgtcttttcgaaaatcggcagggaagtcgacgaacgctccactcgtagtccccctcaaatactctacagaggtcggcgggaaacccttgctcgattccttttcgatgtctctgccaagacgcttaggacgcgccccctttgtcgaaaaagttgcacgcgggcgtctgtgcgctttgatggcaccttactattctccccatccctcaaaactagacactgtggcacaccgtgtgagagggggtccgagcgaccaagtcggtcaatgtggcctggaaagacgccctccagctgcggaaaatcaactgtttaagccttccttttccttctgtactcagagcatggtaaaccaagcatcagcaatccgaagctagacttcctgttcggcattctaaactgagattcccaccgtcatcgagactttgtctccccttgcctcgcgaccctccagcactcgcggcaccccgtttcttaaataagccgaccacccgggcgagcgttttctccgttcatggttcgtacttttcactcgacttccacacgctcgcggaagaaacaagcgaaaaaactggagcgctaaatgtcctcagagaggaggaaaactgccttgctggccccagaagctctgagggaaaattcacgcagacgagaacgagcaagacatcggcgaagccgctgttgacgggggaaatcgtttcacggccaggcagccaccgcgagcgcggctgtaaaacacccgcaaaatcgggcgaactggtggttttttgtcttgcagaacgaacgccttttgctggcacttgagtggaagccgaagaagcggaaataggaatttcgtttcctcttggtgttttgttccagacaactcgcttctcaattgtctgtcatggcactggaatcgcttgtggcggccatcttcttttggtggttccttccagcctagctaccgcaatttaaagcctttttgctgatagcttcccgtcgagagagcttgtttcccgagtccaccgagcaaatatccacctccttcccgtggtctggagcttcttgccacctcctctggcgcgttttctccttcatcttcgtccccctactccgtccccgcctactgtcttccatcctctttgcttccgagtcgttttttcgccgacttcgctggccttcttccctcttacgctccgatcctgctctcttacctctccacattcgtctcaatcacttacagtttcgtagatttgtctcgtcttttctcgagtgtttcctgtgcgctgtctcctccgattgttcactgtcgggtttccggtatcctctttgatcaactttttccgtgtgacgcctccagcgtctcgtaatctccgacagatgcggcttctccgtcgatacgggaccttaggaaacggttgcctgcctctacgaaagacgaaagggagggttcgccgcggtagcttttgagggtctcaggatttccaggggattcccacctctcctcagattctttggtgtccgga

SEQ ID NO: 2195 - DNA, 1698 bp, Toxoplasma gondii
cagtcggtgaaccgagcttctttatcaagtcacgccatttctggttcgcacatgatacacttcgagcattctccactagaagtctctaccctggtttcgccactacagagtctcgggctttttcctcgtactctgaacctcgctcaaaaagccgctgcacgcattgcttgaatgcaacacgcagtcagccgggaactagaagataggaagacgcacggacaacgctggcaatgttgcagtttccgaagctcgcacactcgcacgggtagggaacctatccatggattgtcaaaatggttttgaagtagatgtctcgccaacgtgtaagatctctggttgagacgtgccaggcagttcctctaggaagcagcagttaacatagttctgacgtttgtcactacagggtgctactgcgaattcatggtagtgaggctactagagattacttgagttttgcgactttctttttctggattcgtcgacagtgccaaggaggccacgcctggctcagaagcctcaaccgtccccagaacttcttgagctaaatcgggatgttgtccgttctagaacacttggaataactgaatcttcctacagcgaaagctctctaaaaacgtgacactgggctcatccccgtcgtctggattcaactgcgtgaataggtcttcaagtttgagggtcaacttcagctaccgtgtgctgacaacgagcgctcgctgtgaatgcgacctgtggacggctcgtaagattgccgagtctgacagaaggcggaagataaccgcaacgagcgtgtgctgtgtccaaaatatcagagaatctgtcgacaacaatcgctaaaacctaagtccattcacgacctgggcaaatcgtctttttctgctcagaggcgttcgctgccggggcgacggcaggcacactcggtgacgacagaggtggcacaagtttaacgcaatcttcgggcgttttttcctcttggtaaacttttctctcgaatacaggattgtcctgcttcgtcttcatgtgtgcattcctcttcaggggctaatgtcgttctcacgcgtcaaaagcctcgtaaccccggcgaaaagtcgcaccgctcgcggataaacgggaaatgctcatccacttccagagtacaatgacaacgttacttgcgcgagagatgacgaggaaagggggaagaaaaactcctgatggcaaagagaacgggcaactcgaaaagcagaaaacgccttttcggtacgcaacctccccaaagtcacgacgctctcctagcgacatggcatgcgccagaccagaagcgggaggcacctgacgaaacccgggcgtttccttgtgccttcactggaaaactgctaagttgtcacatctatccactaacttctgttttagacgccttaaatcgtcgttccgggcggcaaaccactgccaccacgccttgagcgcgcaaccctcgtgaggcgctgtcgctgccgcgttcttagctccctttccaatctcatgtctctcggaatgtttttttctcaattggcacgcgcaatcgacaacaatgtcatgaattctcatgcggtttgagccgccgtaccttcctcagcaccgtggtttggaacgggatcgggtattgaactcgccaggcggccgtatctcgcggccgaatcccacgcaaacttcggcttcccgcctttttcagagttacca

SEQ ID NO: 2196 - DNA, 2491 bp, Toxoplasma gondii
atactcgacccgtcagcaaagaatagatcaagtatatcccaagcaagatgaatcgattgacgccacagggcgtcggctggaggcgggcggccatcatcgcggatgtggtgtgagccctggggaagaatttgttgcgcagtcgctcacagagccctgaaaacccgagtttcggatcttccgtcgctttttccacttgaccttcaggaatgcctgcatcttcttgctcttcatcctgaggtgtcacttcacctcctcctccagacgcatctagatagttggcggagagacgagagttctgtcgggcgagctctgcagccaccttcagcgtaagctcgggaggaacatcttctacacggcaaatttcgctctcgcggactggagcagtcggaaagtattccagagctgatgacacgcgccgttcgcggtggaacaggtcaagatactcatccaccgtaagtcggcgagatagcgcgggggctacacggactccaccccgacccctctgtggatttctttcctccacctttgaccccgaagtggaaaggtctgtagtgcaggttcgctccatactgtcggacagaggcaacgcacaaccaggccaagaggaactttccgtaacaccgaactcctccaagcgcacagagccggtgagttcgtctcaacaccgtcaagacgtcacaaaggagaaaccataaacagaacgctgctttacgtacaactgtccatgaactctcttttagaggaccaagttctttgaccgacggagaccccacttgtggggggagcacttcaggcgcctatttgtaatagttcggccaaccggaggcgtctctggtgtgcaacacctccacgatgtgttctatattcacgaccgcagcggcgcgggagaaaacaagtcagtcaatcttcaggactaaggcctcgcggtctagcgacagtaactgcgcaaaaagcggaagatgtcgtgctgcccggtcaccgaaaatgccatacacaagctgtattgctgggcacaccaaactcgctgcgtttggcaaacactgaataagaataaaaagaggggatttggcactcggatgaccggcaacaccagggatcagttagactgccgcacatacacatgttcaaggctcccatgaccctgcaggagtatcaccacaagaacgttcccgtttgaagcgggaacgagacggctatgttggagaagaaacgggggatctgtgcaggaactgtgaagcagtagctccactgaccacctcctttctaccgtagtagtaccaacattttaccccaaacgtacgctgaagaattctggtaaaatccggagacatcaggcaaaaattctgaagacagcagcattctccacgacacgcatgccgtgacaagagccggacaccaaccgagctgccgcgattctgtgcgcaaaagaacactcaacgctgacggaagcttatcggcgggaacagaataacagcggggctgcttttcgccgaaaaaatttttaagcagtttcccctttcaagaatcaccgacacaaacgaacaacaacttggcagaaatggcaagacaaattcttcgcggaacggcgaagtaaccgtggacaacactccgtgccgatacccacaagcggcgggtccgtggaatgatgaggcgctctggcctcattctcttgctgcttcgcattttgccacgtctgccaccaggtgaatttttggaggtgaacatcaaccccacagaacataattctcggagttaaagaaacgttctaaagtcgttggccccgtagtaccaaagccttcaagcgtacgtgttgcgtcactgcgtcaccgtccgcactgcgctttgcctgcgagacccaaatcttgggaggcctcaggactgaaccaggaatgaagttgtgcagtttggagcctgcgaagttgcccatagaggaggggaacggcgtttgcctaccatggttaaggatgaaagcttatgggatctagggcccgactgtaaaaaagttcataaaaatctccctttagaaaaagaggcaagtcgggcttggatcagggtttacgaggagagagttgtgtaccagtgtggaagcactgacagcccgaccgcagcggttatgctttatatagttcaaggactggggagtgagggatggagcgaaggtggtaggatgccgaatgaatatgaaatctttttagccgggtggcttttgacataaatggaagcatgccaaggaggcacgctcactcacctctacatcacactgtgccatcataaggtaatgcgtgatcaggcgcagtgtgctgtccaggcgtgacgaagctgatgaaccaacggcgattcgtctcatggccaagatcaattaatggtaccacagtacaagttactactcgcgcgcgcgcaggctcacagacatttcaggacactggtttcaatttgccgtgtttcttgtcgtagggcgtcgcatccgtttgcagtagtactggccgtgcca

SEQ ID NO: 2197 - DNA, 3771 bp, Toxoplasma gondii
tcgactttgagaattttgtgtacaggttcgtcgatctacgcgcttaaatggcgttcagaaatgtagctgggaaactgaatcgtggattatgagaagcactctgaattgcccttcaagatgcgtgaaacaggtcgctataacacagccagtttgctgccgatgcacatttccgttgtgatattgaaaacacctcttttcccacgcagaacgaccactgaaaacagtcgggagtccctgttcgccggtatggtgcggaagcgacacgattctgacatattgttccaacaactgcgatttctgatgtgttgtttcgtcagggttttacgcgactagacgatggctcgtccatttttctggctgcggcagggatgaaaggcactaccaaagtgaatacgatgacaattgtgcagcttgaatagacacgctggtttttcgaaaatacgctgaataccgctaatcttaatgcgcacttacactgggttccgacagtttacggtgcatagctgtgtagaaaacgcatctacgctccacggtctggcttcacgcaaaaaagtttaaaatgtcttgtgtgggaagcttttttgacagaccctgacgacctagccatgtgccttgcgaaagcaggatgttctttttcacaggacggtcggaacggttgcgaaatattacttgtatggacttcttttgcgctcgaactcttgtggtacactgacaggttcaggtccgatatgtggcggttccacctgtgccgctgctttttgaactccgttaacaggcaccgttaattttccggttcactgatccactcttcgtgtttttgagctgggattcgtgttactgacctttcgcgcgaatgaagaggatctttcaggcttttgccacaacgttcaaatctggcgtataatactgataacagacaagggagggcattcgtctcggttggcgttttgagccaagcctccgtaaatcgcacagttgataacagacaaggaagggcattcgtctcggttggcgttttgaaccgagcctccgtaaatcgcacatctcgtcgcagtgtgatacttacctaggcgaagcacgagacgttcacaatttcgacttgggaaaatgtgacgtgtctctgctacacaaatcgtcgcgttctgtcagacgccgcgcttcattcacattgtgtgtggttaagaatgaagaaacaccatttaaagagtcattttatcgtcctatgtgcgaaagagtgacaggctgttagagtattgtcactgcgaacccagtgccctccctgcagccggacgtgacgcgtctcttggtaatagacctagtgaagaaacaccaacttatcacaaagttggtttttgcttttgcagccgtacctctcatgtctagttctctttgctgtcgatgcgatgccaagagcaaatacggctgataagttaacctaactttttctcattctgtttagtagcaccccatcttgtctcactagcccacagttttggcacagctatgcagggcagtacgacactgcaaattggcgaacttcacccgcaatgccgaagcagcaggagacaaatgtgtgagtaaggctctcgtcctcagcgactttgcgccatcacctggttaacttgtttcggcatgcttgtacgattattgcctcaatgtattaccaacgaaggtatgcagcacttccgaggatcactgacatagttgtccaaattaaatcgactaattctatcaatgaatccgtctcgtagggttcttcgatttcctcgggtcttcgacagggctacgaactcgcatcgtctaactctttcggtgaattcggaaccaaggtggctagcgtgtccaacgctccctaacagagctctcaaatggcaccgtgtacgcctctcttgcactacaaattaagctgcgtagtattttctgtgctcgtaacaccgcaatttataatatatggtacatgaacggtagcttctagctcgtaactgtctgtcagtaactagtggattgtttgtacgaagactgtatcaatgcattaccgattagggcgtttcgcatctcctatggtcatttgtatgacagcaatctattcatatcgtacgaacgaagtcgacgatcaggttggttcccccggaatcgtcgttgaagctaccagtacgcacaagcaatttcgctggattgacaaacgactagaaagaagagacgatttgcacgcccatttgtaaacgctctcttttctgcgccaatccggtacggctaggttagtccctctcctgcgattggttaccaagaaactcgctggtaggtcgagagcccggtttgacaaggtggaagaagtcagattaaccgtgccacgtcctgtgtgcgaatttttcgtctgcatctgaggagaggtacgaaccccccagaaacaggagtttcctgtctcgacaatcggttggtagctcgtctcagaaagaccagaagctgggctagctttcagttttctaacttttgcggcgctcgcagtttcgtggtaggcacagcccaccagctcgctgcctccatctcccccccccctctgggaactagacggcgcgcacgctgtcctggaaatcggcgcgttttcacgctgctgtcggaaatcgactagacgtctggggaattttagacttttctggaggtccattcaagcaaagcaactttttgcgtcgttccagagatttttttcgaaaggactgcggccttgtgcccgttccatctatccacagattgcagacacgcgtgtccctgctgtctctgctgctgaatgctgaggtgtgccgagaggcgacttaacctgccacctgaccattttcccgcctctgctatttgaagaaaagatgtcacaagtgtcaagggttccattttcatttaaagagccgacggaaatgcccgagctcctcaactgccctgtacaacttgctagccgacggcggttcgtatctttgcacaggcgacccgttcttacttccaggagtttctgcgaagtcttgtacttttctctgcaagcgtcgtttcgcgttgccatctctgacgagcattcacatgcttcgtagctctgactccagtccttacacacccagtcgtccttctcaatgcgaagtcaaaggcggtgctccacgcgcgcgccacaaacgctgtccgtctgttcctgccgggcgaggacctttttcgtcgcagaagcttccgctctgccgcgcatattcccgcaaacgtctgacagactgcaatgcagccacggcagcatcctcccagtcggactcaggttgaagtatactctgagaagcattggccgctcggtgttccaccttccttccccatctctgcggagactccgcacggactgttccccgggagatctgtcgcaaggaacacgatttatcgtttttttctgtgagaggaagcgggtatgtgctttcaagggctcccggaccttcgagacaccaccggaacgccctctcctctggcttttcaagagttcgtatgtctgtccagttgccgcaatgtcaaaacactctcatgctgggttttaaatattactcacccaaattttgttcactaaaacgcttcgcgtttcggtgtagttggttcaggggtcgcctcgcggcgttccaccctgtagcgccacccctatccgacatttccacacgtttgtttttcgccgcctttccccgagttctgcacaccttgtttgcgtctcatttcattcggaaagtgactgctttcccacagagtcgccggtagtcgcgagaa

SEQ ID NO: 2198 - DNA, 2357 bp, Toxoplasma gondii
tttctccgccagttcgccgttccgagggattctcgacgaagtcgaagggggagagatgcagaggcgttcggcatgtctctgccgcagaaccatgggcgagtggagtgtgccggcgcccccacaggtttggcgcctgagaagacccgcgcagatgatggacggaagcctccgcgggggtggtgccaacagctgctgtggagaggagcgaagacttgcggtgatggcatcgctgcgcctccggagacactcgcgaaagcgggagagacgactcgttcgtcgtccctgagagccgcctgtcgctgcctgcgggggtcgaaaacaggcttgttcctcgtctaggaaaaagagcagaagaagcctgaacgctggccctcgacaacctcccagagcctgcctccacttgccacaggcgcggatccattggcgctgcctgtgacggttccctgcccagggaggcggcgccgccaaggaaacgcatgcagcccggtctggaagggagaaaagactccgggggacaagacagcatcgacgcaagtgcgacggctcaacaaatcgaagtgcagtcagcagttccgtcgcgccttggctgtagactgtggtcttctcgcgaggaaggacgaagagggagagagagaggacagggaggacgatggagaagcgagagagggggcgcgtcagtctagcgggggggaggggggggagcggcggcggcagggtcagacaggagcgtcgaaaacaaataagaaatcatctgcgaacgcgtcttggttggtccatgaagcgaggagctcgggaacgagggcaagacgagatgccatcaggactccctctgtccctagctcctcgtccaccgctctaaggacagagacgcccgatgtagagctctgtcttccgagagagtccccccgcccctacaggagcatcttcatatatgcgcatgcacatcgacatttatatttatacacagagggaggtgtagggagagtcagagaggtcggatgcagcagacggagagcaagtatcgcgtagttgtggttcccgttggcagcagtgcgcagcgagaaagcgaaggtaatcttgcaaaggacggtcacctggagttcgagaagcaagacggaagagcattgcggtctcgagcgagagcggaaaacaccgacagcaaaacggatgtcttccggttcgttgggccgttccgagcagacacaccagagggacttccgtaccagacaggttcgcgcgtggatttcccgatcgcaagttctgcacgcaactcatgtagaaagaagtagcagcgtaggccgatcgatgctgaagtcgaagaagcgcggaatttctcagagcccatgaagactcccgaaaagggtctctctgcgtagcagaccatgaacttgggtcgatctcggagttgaaagggagtccggcttccaaggagtgcacttcaaaaaacgagacgagacttccagaacagagtccagcgtttcaactcccgacggttttcacgggaaagcggccactctttgggcttgcagacatcgcgaacagatcgcatctaccgatcggacagaggcaggaattccgatgtgtgttgtcgtggcgaatgcctcgaagcggctccccagttgcttcgctaaaaaagagaacgacctgtttcctctcagacccaaggtggactgttcgataaagctctcgcccgataaaagtgggtctggccgtgcaccgaggcagagggggaaaccgagagaggcagagaggaccgcggaaactccgcagagaggaaaaacacagaggaacgctaagcgttgcgagaagcagaaatcagctgcgatgcatgtacatttacgccggggaacattcttctggcagactcccagctgcggacagactcagaagacacacacttgcgtgtgcttttcttgttcgcgccctccttttctcagcaccattttcctgtccgtcgcctttgcaccttgactcgctcccgccgttgcctttccatagacggcgtctgtcgacgacgagaggagagaaaacgcgaaggcgaggggacaaaggtagcgaaaggagaaatttcacagactggagtgaatctgtggtaaggttgtcttggcagaaaccagcgtccggcaaacgcgtgccacacagctaatctggaacggcgcagttgacagcctacccagttcgagtggagcaggcccagagaagcgagtgaccaaacaaccgatggaaaggcagtctgaatctcaatgacgctcaagcaatttccgctcttcacagtgaaatcgatacgtcgacttctcgttctctctcgcctcggccgtccgttcggggcgggcaacagaggaatttcctcactccag

SEQ ID NO: 2199 - DNA, 2823 bp, Toxoplasma gondii
tgttgtcgacaccggagagcgacgaatcgtggagaggtcgtgaaggcagtgcaactccggggagcaacggagaacggacagaaaaaagcatccagaaagcagcagatgccagcacatgtgctcgagatgcacaactttcagtgggagggcaccaacgttgttccaggttacacagagctctctttaccccgacaacttggtgcctcgtccactgtcgatcgatttttgaggagcgcatgaacctaaacatgagttgtgatgagcttttgggtccttactagggcaacctgtgcgtccgtaaaccgatccgtgtctcgccctaacagctctctgacgcctggcgggaacctgaccagtttaattgctgagcggaaagcgagcgtgacgcagctttctcacacgtttgtctccctcgttattgtgagctgcgaaaaacatggataactttttcgctagctactagtccatcacagtgagagacggatagctcggcgcagtgttttttgtccctagttgacctaagagcaggagcgccgtgaccaccaccactctcttccatggactgtctacttcacttaccagagacgaactttgacgttcatacgttgctccttaatgcacctagttagagctttgtttcctctgcatgcagagagcagagagagtgcagagtgccccaaaacggacagcatggcggggttgcttcgtgcgggccggtgaatatctgactgaacgcggaggcaacacgactggacgcagtagcgtgccatccacgaactggcgtccacagtttagggttctggggcaaaggttagtgtcgctttcaatttgtatgtacacactcactgtctctcagggtggaaggaaagtcctactgttgtcctgttcggagcaaccagttcggtctgctcgagaacgatcaccggggcgtacttttccaaaagcactgtgaaggtccgtatctccacatacatgtggactcagacacggatatgcatttacgagtatctagaaggtggtgtcgacccgagctagattcctagggggtcctcaaacgttccctgtcgctcaagatcttttcccctagcagtcccgcacgtgcgccattctggcctaaatgcgtaccgcgaggagaggcgcgcttctcacaaaaaacatttcagagtggcatcacacagatgaccacgctctcgcataaaatctgcttaaaccagctgccctgggacagatgaccacgctctcgcataaaatctgcttaaaccagctgccctgggctcctgtgtgaaaaggcggagctattacctgttttcagtgggttcgttctacctccctgggcgacggctgccagtatattcacataaataggagaccatctctggcctaacaacatttgggcattcctcttgccatgttcctttcgagggcgcttgctccttcccagccgatcaccttgtacctccccgttctttttcagtgtcgttttcgttcggccccgggctcttgtccgtgagcctttctgctaggttatgaatgatcggcaccgctttctgagaaggcagaggagagactttgttgtcgtacgtagcggggcattgttatcagctgggattcgtctttttttatcaacacattttcagttaacgagtcttcgttgcccaacagccactgcatagccccacaaagaggggttactgctgcgctcccccgccgtgttgtctcgactacgagaggcgcgagaaagcggtgcaagaaaacagccgcggccgcatgtttcttccattgtgccatatcacctctgcaattcgattaaacacgtgagcgtagtgatttgacacttcgatctaaacaatcggggcttttcgtttaatatgacggccattttggtcctgtccaagtacgcttgcgcatcgcttctacgagggcttgttcggttgcataagggtctggcgctgtttgaatcgttgggaaactttcagacacgaagatccgttccccccttttggatctgttcttcaagaaggaaatgtgtttcacactaacttgtggggcagtcatcacgtggttgtcgtactcgatcttgtatatgatttttgccgccggctttaccgctggagcctcacggtcgctgtcgccaaatggcttgtcacggtcatactataaggcttgttgctgacttaattttccgcgtggcgcgtttttcctgactcctagtggattcaccgtagctcttctccttccgtaaccgttgcgtcttgagtcgttttcctccacctttccatctttacccgtcgctcccggtgtgcccacgtgccttctgtccctcagtgccttgttttagcagagacttttcacctcatgcctgacccggcaattccatcagtttttgtccgtcagcttcagagttgaatgaataccctctcggaatcaagattttgattttcgtccctgctggggactgaaaacaagcacctcgatgtgcacgggcctaggtggtcgaatggcacgaaacacccaccgaaacgccaaggtacatcgtcaccgtttgtggggtctcgcaaggcttcggtgagcgtcttttgcccggacccgctgccccgtcttcctttcgcctgtaaggcaacgctcgttaggctcgtgagtttacatccccgtcgtgactcagttctcggctctaggggagtggcagacacagcagacagaagaaggcaacattttttgctttcctcaagttccgtccctcttccatctcattctatccactgtcaaaaggcctcggtaggggaccgaccttcggttgattgcatgtagatggtcacgctacca

SEQ ID NO: 2200 - DNA, 2144 bp, Toxoplasma gondii
tgtcttttcatccactctcctgtaaccttctgggtttcgtctcacctgacacacccaagctgtgaagctggtgccgtagtgcatgcctagccacttctcaacgactgctccagcggcgacgcgcgccaaagtctcccgcgcgctgctccgaccgcccccgcttttcgcgtgaatgtggtactttgcatggtaggtgaaatccccgtgacctggacgcgggactgtcgcgagggcgtggtagtcctggggccgccggtcttcattccagacgagcatcgccaggggagtacctgcagacggatcccggtgacacgaacgagaaggcgaagcagaaaaaaatgattttttggaagggacgcgaggatcacggtagacggccagtccacgatgccagatggcgcaggccacgagcgccgggcacttttgcaccctccaatttcccatcgaaaccacgaggccatcttcggaacaaagcagcgttccgaagcctgcagcaggtaaactcggatccggtatttctacggagtggcgcgtgtgttttgtcacctccgaaaactcgccacgtgcaagacacttttcggcttcgcttgtgtccaacacactgtgtggataaaagagaacgtttggatacggtactttcgagctattaactgcggtttctgaagcttagccggcagaacttgtgccagggcttccgtttccccagggccttctccaaaagcgccacagggcgaataagaatacaccgacagccattttcaatatcatcctctgcttaactatacacacaaaatacacatctgtatatgtatatatatatatatatatatatgaatctgcagttatgtgctggcacaggcacgtgacgtctgtagtttcttccctcaccgagtgtatatccgtcttcaacaccggagagtatgttgactcgatctttctctctccgctgcgtcgagagaggcccttggccgggtcttctgcgatttaattgaggctgaacatcttcgacagaaagagggaggcgaggaggcagcccgtcgattatacacccaacggctgagccgtgagattcaccgaaagtgtgtatgcgcagagcggctccataggaagacatctgactgcaagaaatgtgaggagatgcagcggaacgagcgggatgtgtgacagctggagggaaaacaggactgtgaggaaaggcgtgagcggaggagattcttgttgcgacgaccgtctctcacacaggcactcaaagaaaagtgaaaccgagaagatgagaaccatgctgcgtcgaaaagtcgttttaccagcgtacagtaaaaagagcgaaaaggggagacacgcgtccgcgtcgtctccgtaggccccgggagtcaaaggtgtgcgtctctaaccccatcgcagactcgttagctctaccgtggatgcgcgcgagtggcggccggtgcaggttgtgtgtcacgccgccgagtgacgcaagcgctgcgtcgcaaatacctacgggtagtgggcagccatatattcgagagaactgcagaattcgcgcaccgctgcggctcaccctcaagtttgtcccgtgcctgacgccctcacgcaagcaggagtgaacagcgaagttcggcgtctctttcgtgaacccagaaaggctagccgagtattcccatgtgagttctctagttttccgtggcgaaagaaagagggccagcgcgcgatgatgttttccctctgcttcgactgtgccactgcgagaattattgggcgaccgtttgaatccaacaactgtgcacaggtagacttgggaagagcgaggccacagttcgggtggccgcatcagtcacgtaaccgttacgcactttctgatttttgccgttcttcaggtgtattttggcgttgtgaactgtcgtaattcgtcgaggtttatccgcagttctcaatcaacaaccgggacctgctgccgcagctgtcactcgggcgagggccctcgtctgtcgtggagtttacacttttacgacgattcgaaaaggaattgccaggtgggaatcatcttcgcttaaggcttccgttagcgctcactacactgggtgcaagaggtagccgtgccgctcactgagctttcgggcaagcaaggtaagcagatctctctaaga

SEQ ID NO: 2201 - DNA, 2776 bp, Toxoplasma gondii
gctctgtgtcactaagcgggcacatgtttctggaaaaggagtcttcaggcataaataacaattgggtttcagtgttgtaggtctccagaggcaagagtgacagttcacgtgttgttttcgttgtttatctcggtgtcgttcgcccttgggaagaaatggaagcagagcgaggaacacccacgttgtttgtatacgcagttcgtctctctttgtcttgtaaaccgcttcacgtaaacgcgtgcgcatacgcctttctctccggagacagcggcttctcgctttttgtttgaaacaataacgcaaacgggagagcaccccgtgcccgcgagaaaatgggagctgcagcaaaatttcggatgcgaccaaacttacttttccggaatcgttttacatacacgattcctttgcatgttgaagaattgaaggtgcatgccaaagaattgcgggtcgttgttcgttcccagatgtagacacaaactggcagtcgtacaaaaaagcaagggagcagtttgacttcactggggagaaaacctgctctcatcgctggcggttcctacggtgaactggcgcatattcagcaaacagccctgttcgaaatagcgagatcaggagtggcacttgagaaggatgtttcgtttttgcatgagctgaacaaacgaaagagcccgatactcccgaactgggcaaaactcataaacgcgcttcaggaatagcgcgacttccgtacagctttcgtcgcctttttttcctaaacatccaacagcaacaaagacacagacttgcggagaaaaaacatcttccctagtcctgcatttcaagttctattttcattcccacttgtaaatgaagccccactgcaccaaaaaagaactaaatcctcggacatggtgctgagagcgctgtgtaggtgcttttgctttgctgcgaggcgccggacataacggtgtacagagaaccaaccaagggtatcgcatttgcctccaatcccatcacacgtctacatggaaaaacggagttatgaggctaaccgaagcagctacaattttgagatgggggtattcgagggtagcgcagcgtgtcgactctctccaattttctccgcgtttctgtggatgcggataattctgtagatacatggggctacaacagagcctctgttccaccttcttgtgcaggcctgtacccgcttgctttttcacgggattttctctttttgaaacgcgccgcctcacatacgggagttccatgggcattcttatcaggatttgcagcctgttgcctgtcaactctcaacccatgctcctctcccatcacggagaggcttgtcccttgcaggttcctctgtgtagaaatgcttcacgaaatgtgtctccttttctgcatttccgggctgtctgtgcacccgcaagtcacacaccgcagagcgcgcgaacgcagacgatcctcggtgacaagctctctttcagtctcgtttcagagggacctgcaaaacgtccacactactcgcgtactcaaagattaagcgcggaaaagagtgaacctctttacaaaagaagtttgatgaccggtggatctcgttcagatctttgagaaaagcattgcgtcgacttcgcatgctgcacctgccctccgtcttcagcaagcggtcgcatccaagcggtttgtaggagttctcggtttcgaagaagaaccgattatcttgtctctcgtcagtttcttttgagctttttgcgggagatattcttgtataccattttcagaaggcggaaaaggaaggatccattttccgtctggaaagtccaaactcgtaccaggggaccgccggcggggccctcgagaaccccgcttctggcggttgcgccttcgatgttcttgtctctctttcatcgatgatctgcctcgattttgaattcctcacgaaaaacctgcagctttctgtgtgtttcgacggtgaaacggcttgacatttcacgttcatgcggtgtaattcacccagcatgtagtgagctgctcatcctcgtcgtttgctcaggggcagaatttgcacaatggtagtgccccgtcgtgaactgtgtgttgcttcatttaaaaagagggttttgtaaaacagcgacagcttacatcagcgataattgaacgcgagggctacgaatctatatgccgcaagcaggatatccgtttgtttcccttttttttccaggcctttcgactcagtcggctacggcacaccctgtctcgctccaagatataaccgaacgcattccgatttccctgcaggccaaggagccgcttcaaccttgcgttttaacgtaacaatttagcatgttatatgtagtgtgacgcggctgcttcagaacgtccatttgtaacatctgtctcacgctcactctctagccgcgtagcaccgcttcaccaccggggtttctttccgccctctcatttgaacacagaggaacgcgttggatttgtcgactctctgttggcaaggatggaacaagttgcgttctagccggtgggaacgtggcagtcacccggttctcacggatacgttgatgaacacttaaatgcccggggccgggttcaagcgcagcgacatccttggactcagtttttgtcaccccggatggagacgcttctttctgcgggaacgttggatccggaagtgccattcgagtgttttatttcgaagttaaagagacgagatgtgcgtgggtgttcctctcaactctgctaaggctgcgagcgccatagtcgggcgtacctttgtagggacgaa

SEQ ID NO: 2202 - DNA, 1764 bp, Toxoplasma gondii
tcgtgttgccagcaacagctggtgtggcatccgacattgcatgcacaagccgcgaaagaaggccctgggatccgaagctcgaggataagaaaaaagagaagaccggtgagaaatgggtacttggggggccgctgaggacgcggggggggccagagtagagggagacacgcgagaagcgtcagaacaagagagagaaggagaaatgaagaaagaactacactgcctctggattcccatcaccgctatctttttcggattcgcgtcaccgccgccttgcttcccagacggcgtgacggaaagctccgctgccgccattttgccgaggacaccgcgtgtggtgcttagagaagctcggaagaaagacagacacacattgctctttccaccgaactccacagcgtctctgttttgcgaaggaagtcgttcacgagatacaaaagataaaagtcaatggaggaagaggggacacagcttcaagaaatcttggatcttgcaggaggtttttaccgcgacctctggactcaaaaacaagcagcactgggggagagccgaatggtacacgcaccttgaaaaactgacggggaaaaccgctctcgacttcttcgtcgttctggctagaaaaaatccgaaggcgtccccggcctcgacatgtcctcccatgcagaggtcactcgaggcccagaactgaaaaacctttgaagcctgcgcaataccgtaatggcacccgcgactcgccctaggttttagagctttcgctcgaagaatttccttcttgcaagcgttcaacaaggccatttccacccaatcccaggtgattttgccgagttttaatccctttcgcctcgcgttgccccgacgctcgaatccgagaccgctctcgttctaggcggcccctcacaatgggacgttgaacgcaaggcgaagcaagaaattgcacacgctgaggctcccacactcgctccttgaaaagacaacaaaccagcaggaaaggaaagacaaaaatgaagaggggcagaaacttcttctcaggtctctatgtggaactttctttgccaaatctgcatgcaacgagctgccgtccagcgcgtgcgcaaatcgcattccgagagagacgccgtgactgaagcatgtggaggcctctcgatcggcgaatcgacctttctttcagcggcaaaaatggccgcttcggttttcttttctctgtagttcaatgaacggatgccaatgtctctcggggtgtctccagagctcgtttgaaacaattttcccagtcctttccccagacagatgccaggcagacagcgtctgacttcatgagttgacgcgatcaacatcaaaagataacagagaaaacagaacaatctcttcaggagaagtcttcgttttcgacgaagtgttgtcttccttggtgccccttcaatgtctgtggcctgcatctttgttcctctctttcgccttcgttccctcttccaagaagtggaatttcgaaagtttctgcatgcaccggactctcccctcggcgggcccctgcgtttcctgctttccactcgcctccttctcctcgatgccactcatctctccctctcgtttctttctcctagggcgttctcggcttctcgtctatcgcttacccccgctttcacgttcttcctttccaagaccgtcctgtcacgttcgcgctcaagactcacggggaacagccgttctctctccttttttggccgcagcacagagtcgccagagcgtttgttcgtcgcatcggaa

SEQ ID NO: 2203 - DNA, 2605 bp, Toxoplasma gondii
taaagtcgtctgtgctctgagctccgatgaccatcaactgtctggtgttaccgcggaggcgggagccaggcaagaagtttccagttgagactcttctgaagagtcaggtagaaggggaaaatgagtttcactgtctgtggaagcgtttcgttgacatttgtaaggacgtagaatccgtatagggtggtctgcgctaggggcgttccatggacagtgttttcgggttattactgaaacacatctaagagtggaggtaacgctggggagcagttttgaatcgcggcgggtgttgaccgacgtgaacacaagacactcactttctcgacgtgtttgtccagtcgtctgctgcacaatggtgcaagagtttgcggaaatcaggaggggaaactcacggataaatttcagtcaccgtcaaaagagttgccctttcatttgcacactctgttgcttacagcaggtctcttgtcacacaagcggccctgaccttgaaaagtgggaagtctgtgacagacggagaagcgggccacttgaaatacccgttgtaaatgttctttctgcgggtagcctctcggcagctgttagttttccaacgcggatcggagtcgaagaagtcgttacgtgaccagaggcatgtagacgacctgtttccatacgctttttctaaccttttgaactaaaactattgggtcgccatgccacctgcgggtgagttttcaatgggtatcagctggaagttgtatcggtcctcgaaaacactggctgggagttagatacccgttgcttaacgtcggattccgctcttcaagagacgcgtccaacagaacatagcctgtgagaagctgacaattttcgccgcctatcctgacggttctctgaagaccgctgggagggctgaggcataaactaggaatacctgttttctttgctgataccgtggatacctgttcatggctagagaacatccgatcccattctgttcaccccgtgcatacatggaaggaatatccggattctcagctctgaaagaaaaggagaagcacggtacaagcagcaatttacctggtttttccccgtagaactgtagacagggcccagaagcagtcgacaaaccgtgagttctttttgactgtttttttgccagtgtttggtgtatggttgctacacgaaactgactctttcctctcgcacgtctactttttcatgcgcgggttttccagagaaacgtggtggagtacaagcgtagaatcccccaagctattgtggcttccatcatgtgcattcgcgattctccagcttctggtgtgatttaaccaaattgtcaacagcatcttccagtgaggtggtccgaaaaaacatacttcacctgtgcgcatcctgatcgattctgcatgaagcgacaccaaggatgagaaagcgtatcctgtctctggctggtgacctggtcgcattcaacagacggccgttcgtgtatcaggcattgccaacagaggcataacccccactttggaaacactttttctttgagtctatgaacgggcttggcatttgaaccatttttcagcgctttcgctttggaaggcatgcatgagtgctactaagtttctatgacttcgtggaaaatggtaccccgctgcttggtgacaagcccctgctgacagctcagcgatttgcagaaagttacggtcttcaccaaatgaggcagcgttaaaattaactccatcaaggtctggcgttttactaatgcgtatgttgccccttattaatcctggactattatctgtaatgtctcctggaacagtcgaccgactagatttgccctatacgttagacctatgttcggcggtgctctaaatctattccatatgaacacagggtcttcaccaacgaaactcgctatgaagggtcacatttcttcctgtcacttatcggcgcgttctcttcttttattgcctccagggtgctcgtccccttgcacctgtggacgatgttgcgacaaatgctgattccaagctcggctgtctgaaggatctagatttgtgagcctctactaacttgcactacagaaagacaaatgctattatgtcaaaagtcgatggttcaaaaggaagcgtgacaaaataagttagagatccgctcacggctcccgagttctctttcccttcccggcatcgaccgcactatatgagcatgcagttcggcgctgtttgctagccatcgctacccgtcgccaaggtgtcggagctgatcgcgcaaacaccgtcaaatttgtagtttttaaaggatccttttcgcaataatttgtagagagaagacgtcggcgttactcgtgtatgtccttttttgagccaggaattcttcggtttcctcctagcatcctcctctgtctatgcccgaccgcctctcactatctcttcagagccctctcttaaaaatcgctccgctgactacgcgaaaaaccgtccccacacaacgttgcttagttaaaaccctttttgtatttttttgctcgtatctgtctcttggctactcattctgctgcgccgtgcgtgaagatatgcttgaaaaagcctgtctctgtgcgaccttttttttgtacttgtgacga

SEQ ID NO: 2204 - DNA, 1988 bp, Toxoplasma gondii
gccgtgcttcaaaccattttcgcaaagggtgcacagataagagcaacagagaagcagatccgtttcctcaaggtgtgcagccagtggctcgatggccctctaggcagagaggatggcctcgcagaactggatgaaccatgggattcagcgaagaacgcgttcaggagtggaggacaaaagcccaacgcatccaccaccgaagacctgcgctggaagctctcgtcctttccagtgctggggtagtcgacgagcagaaggaaaacagtcgggagaagcaagaaagcaacagcgagtctaccacagttgatgcaggctgcttgcggagcagcactctgcgtggacctaacagtgcgccgcacagggcttgaggtgccgacaggcctacagagaagcacaggggagatgatggagagaaatggcgactcgaggctctccaccttgtcggaaaaagctttgaagggatctttagacgtcaggaggaaaaggaggaagccggcaggagtgccgaatgccaggcaccgcagagagaggcaaccgtctcggacggtaggggagagctgaagaatggagaggtcggcggcgctctgcctcgaactgggtgaaagagagtaaagacaaaagggaaggaaaaggagaagtagaacgcctcaagagggcaggaacacctggaaacagcacgttcaacgcgagagaagagttgtgagaaacatacacacacacagaggcagcggacgcaccgcaagacactggcccgaagctgacagaggaaacggctttttagaggagagactgactcaagaaaagatggactgtggaagaagtcacgacaggcaaaaaagctggaggagcaaaagggtgactgagacaaagaaaacaaggaactttgaggctctgacgcttcagtttagtgacaagacgcgtgaagagtcactcgacgtgactttgcctaattcttttcccccaacatatagacatctatagagctctacttagatagggaagtgtatcgtggacatacacacaaacggtttctttcttttcgctctatcagtttgaacttctcacgaaaaaagcgctcttcaccgctctgcatgcataccccagcgcaatacgctttctcgcttgtcacgcgctactcaacttgcgcgatcaacgctctttctcggcactggaccgttctgtgtagagccgctgagacaggcagatacacacgatttctcgagcttgtccctttaggggcgccttctcaggtttgcgcgagtcttttgatgtctcgcgccttctttgccgaaaaacactccacttcttccctgtggcggagctagcgcgacgagagcgcgagctgcacatgagaccgtcaccgtttcgaacaggtggaggagaagagagacattttcttatcgatgcggtgcatcatgcatgcaccactcagatttgacttgtgtagggtgctgacacacgccaacaacagacagctcgctcgccccccaattcaacaggctgtctggagacgcgctgccagtctcgtggttcgcggaaaagggaagcgaagaaagatagagaaggccaacactacggtgcttccaactctcaaggtttttagcaaagagacaacgagaccgtcgcacacagctgcacggctccgtgcctgcccccccgacatccggtgacttttgatgctggcgccctctcgctgcttcctctctcttttatgtctatctcgctcctctctttctctgcgggtgtctgccctgtccctcttctttaggccttttctggtcgactctcgctttctgctccactcgtccttgtgacgtttctctctcacctcttcccttccatgtctgcccctgtcgcaccttcctctcccctctcttcttctctttcgcttctgtctcctggttttccccgttttctcgagtttcgcgccttccccttcgcttcgtcgcgtctttcttcgtgaaggcgcactgggaatgcaagcgcca

SEQ ID NO: 2205 - DNA, 2321 bp, Toxoplasma gondii
gccggcacctctgtgaccagacttcccgattgctttggcctcttcggctagtaacttgagtgaggggtccagtggcctgtccctgatgcacatgggcgttggcaatcccgtgggtacgcgtatcatgcctttcccacctcgaggaaggcgtaagcagaaagtcaagcgaaacctttgaacacacttcccttccgcacccaagacacgtcagacaccggcgagtggtgcagataaaaaaatcgcgtcatgcgcgactttcccagtttatgttaccttttgaacaaagatacagcagttgaacttgtctttctggagcgccgttctgtacaaaaacccgtcacggcggatcagcaaagtacgagtgtttccggcggcaagcctagatctattcgtcaaaccaaccgccaggccactcgctaccgctttccgagactccaatccctcactatcccctctgacggagtatgcgaactattcagggacaccgtctcgcggtcagctgggtaaatgcctttaccaccttggacggaaagcaccctacctcggagactctgtacatggaagcgagtgctcagttccacaaatcggcacatccgtacgagcagcccacaaggtacaccatgccgagagaaacagcttttcttccactcgccacgggccctcagcctgcacctgtccgcgacaatcggtggtgacaatcacctgtttaagtttctctcaaagaaacgccgctctcgtggactgttgcccgttcaggcaacccagtgttcccttcgagaagaggggaatcttcaacggagggagaaagtgacgttgaaacgaaacaggaactgccaatcctgctgctgaagaacagtttgacgcgggcacaaacggatgcgttacggatcgccggaactgggcctgcgatggggcaaccgtcgtgggacagaaggagcacggggacaaatgtgagggatcatcaacgttttcacgattgaaacaaagagtattcctcacaaaagaccaatctagaaaaaaaaaatcattcaggcggtgctccccgcgggcaaagccatgcaaaaaaggggttgcctcttccgggctgtcaccaggaacagtctgtacgcagactttttttcgctggttctctaccaaaattaaggctctgtctatgtctagttcgtgaaggatgccccctcccataaacacagagaaaaacacgttgccttgagatccatcaaccaagcttttcgcttgcgtccctcgattctggctggtgagtagtaagagacgaggacatccccaccatcgttttcgcaagcgtcctgctacagaaagagaaagtgacgccggccaggcaatccgacccccccagcgaagaccaacgttgcgctttaacgaagggcgcagaaaaccactgaagtacgtgcaggggacagaagttcaccgcagggaggcgtctcacccgcatgcagcggcttcaacgcggaccgagtaaggaggcgtcactctccaccacaatacaggctctgcctggcgcaacgtcccagcagaaaccggacggcttcgcacccagaaagcacagcgtgcgcgccgttgtaaggaggtgtcaaccgcgtggcactgtaggcacacgaaatacggaagaaagtcaattccgcgccacaaatatgtcatcaggcagatgaggcacgttcccattccctgtgaaaaagggaaaatctccggaaaatgcggcgtctagtacagttacagaccgagtgtcgaagaaaaatctttcccggccacgccgtccacgtcgacttcagcgaggtccggtgcgacttcaagtccagaaccaacggcagcagtagctgatccagaaccacaatatatgtgcatgtatattaaaaagtatagaatatcgcgattcgcccatgtagagccaactttttatatctagcgtgttttgttcagcgaaactacgcaaggtgtctgccgcggtggtaaccatcgtccaggtatacgcaatccacaaccagacaaaaattggacgcgcgtggacgatgatggtgtccgggaaatccgtaagtgcttcggagaacaagctacttacacgccatgttcgagcaaaatggatgttacatatagagagtgacacacaatcttggcgagaggtcttctctcaatgaactgcgagagtaaagagtgtgaaacaagaagctggaactaccagaaaggagtggtgtgtcaacattgctgtccgtatgcgagtgacacacaaaaaacgacttgcagccacttggaaagcagctgtctctatctgccaccaacggatcattcgacatttgtcacgctaa

SEQ ID NO: 2206 - DNA, 2804 bp, Toxoplasma gondii
caacgtcctgggagccgccgtggaaacgtgggtattcactggctattttttcagtaagggagctttgtgacaggaacataagggacagaagggagacacctaagcgtatctggggcttacgagttatgtcagggtgtgggagttaaaagaaaaccaagcaaccgtgatttctttaatgcaaacagattttaattgaggctgtcacatcggtttccaaaaactgtaccgtcatctggggaaaaatcacataagaggatcgcagggcggggtttggcgtggtatgcggcattggcgacatggaagtaactcacaaatcccgcacatgcttcgatatgcctttcctgaacaaggaaggagaacaagaacagcgtcatcatcgaattgaagcatggccttgcgtaggcccgctcagctttcactacgctgccttcgttcacagattgacatgccacggccagcatgagttgggttttctacaaatggaaaaaaacacatcgcaaatggagcgtttgcgatgcagttagttccatggactttctacgtgtgcttccacttttccaagatatttgggaagcttcctttcacccagaaatgctccgaagtcagtcgtacaacgcaactgcctcttcttttgtaggtatactttgtcctcaaattccgaaattaagccaccagtgctcaggacgcatcatacaagagaacaagattacctttgttgagactcaaggcatttcctctcgacaagcctacatcccttttgacacataggcactaatttgtatgatagactaatatgatctgcagtctccccgatgcctctggccacacaggagtaggattctgcgattttgattggaaatttgtcatccatctgagtactacgatacggaaggcaacagcggcaaacgtaattccctcatcgctattcacggaagacctatacactgtccgcggttcggcattcatatgtatctgtgaaagtatggttgatgttactgcttttgcattgagttgctgctcccttggcaggcggatctctacggacatcgcacactagttctggtttggagcttggtagtatttgagaggtaacatggtaatggagcaagtctgagacactctctcgccacggtgtcttcgtttcaacactctgtggagatttgtaaatggtgcggcacgcgcacgtgttgagaaaaccagcatttttgctcatcatggtgctcagtgtgtggcatcatgtgatcaagcaagctctttactgaggaaacccttcccacatcagaaaggaaaatggtggcttgttcgtttgcgtaaccccgccagaatgtaagttacgtgcctagataccgccactgatgcatcactggggcagaagcatcatcaccccatcaagtgcacagaaaaaatggttgcggtacagaataatgcggctttatgaagcgcgggcagcgaaataagtctttgttcagttatagtcgccgcgtttcgactaattctgtcatctgtgacgcgaactgcgtcacagacctgctgcaccgcgctggttggagggtcatcaccttagagcaagtagagtaagccattttaatgaagcacataattttcagaagaattcatcttagtctgagtcgtcctcactattgcgataacctgatctgcacaaagagatctctgtactagctggttgttgtctcccccaacagacatcttgccttaaaacaagaagtgtctgtatttaaagctcaaacaaccgattgatgcaagtagcagggtcgagtttttttccagacacaagaggtggttcttagataccgttttaagactaactatggtataaacgcgcagactagttgttatgtccccgtgtctctattccagtcacggtctcaccacactgctggtgcgttggcaaaaccagagagtacgatgtggctctcttacttgtttgtctactcatttaacctcattcgtaacgggcgatgcttcttgttagtttgtgccttcaggagaagtaagtcttaatctgtcaacatatttctgcgttgtttgtgtgcggagccttgatggctatagggctgcttctacatctgcatgcccgtttgcttaaggggggcagtagtttccgaacatctttctcagccgagagacaggaaagtcttgaaaaggtcgcttgcccgtactatatctggcatgatcgtgcagtagcggcttctttaagtacgaccaacaggtgatggcgcatcagactctcgctgtgggggacgtgtaagtcgccaagcgcgattgcttttcagtcatcgcttttgtcggtgtccgattgctttttcctgtctgagcacaaaacgaacatgcccccgtatgttccaaacgtctgtgtcgtatcgtcgtaatagtgactcaaagcacgtagcagtaatttctcactggctcaaacaggagccacccgtttttccacttctttagtcgacaggataacttttttggggtgatgcatgtgtctattatcagcagtccgaattatgtttgtctcatttacaaatgtttgcttgtactggcagcaccctctccgaacgaacactgcaatactgtttgtgtgatatcaggtagccgcccctctcaaactgccgaactgttcattctggtttcatagcgggttcgtcaacggctagaaaatggtcgtaggtgttgtctttttccgtgcaacacgaagaatcaagatatctcactcaataggggaaacactattggctctcttcgccgcgacttcatcttgcctacgccctcgtgaggagggttccctcaca

SEQ ID NO: 2207 - DNA, 2799 bp, Toxoplasma gondii
tgtctgaattgtgggacttccctgcaaaatgaaactgaaacgccgaatcgtgtagcggcggtggggtacggcctgcattccatagtggatatcgctgcgaagttcagtgaacgaactgtgcaccgctgagcatggcatagtgcggctcaaaccacgccgacaatcgcgcatgcctctacggaaccactggaagaaagcctcgtccgagtcttcgatcgctcagtggctccgcgaatgccgtcagcatccgaggcactcagtggggctcagcccttcaatagatgagaatttaatgcagctcaatgcacattctgtggacgtatccaggtaacctttgtgtgcgactgagctgccacttgattccatttgcggagtgttgcgtcgctacaaacccgcaatatagttttcgacctaagcgtctaacaaaggttgacgagttccgggagcgaggccgtttatggctctgtgttccccaagtaatcaactgagccttttccgactactgaaggagtctaggatgaaaatggctgagcaacacgaccaaagtttgtccagctgaatactacggggatatacgtgcctttctagtaggcagctgtcggaagtgacagcagtggtgctgtacgacaagaacgttttccgtcccggaacacacgtgttaagcggacgttgcgaatgcgagtgtctgtaagcttcgtttcccccgccaccgggcgggatgcacacggtggagtagaaacttgccttggtacaatccataagggggagtacacacacattcgtgaattctaaaaaatgcacttttttttgacccaccggaaccacacacactcagatggcgctacgtctcacaacttgagatcggcaagcaccaacaggagagtgatttgcatgggagcgtgagacacgtccaaccctaaacatagttgtgttgcgcgaccagcctttggggttacagtaccacgatgaatcttcttcatcaatggaatctttctttgtagagcaaaatgacggccttcgtacattgcttcacagtaaacaaacaaagttcctccactgtttgccgaagtagcggagtggctgcggtaaccacatgcgaaacgacggggagccaacagaagcactatgcatttatggttcgtcgagaccttggccagtgtacactatgatcagcgttaccttctattggaagaacctaatagtttagttttgaatggagaaccaaacacttctagaactgcatgaattgtgtgatagctgtagcgtttagttttaccagagctgctacgcgtgaaagttgaatgccaacagagcatcccccccaggcgcagaagcgtgacacctgtagttgtagtcctaattaaattatccatcgctttcaccagaacagcgccggactctaaggaaagtcagacagaacggaattgcaggcctgctgcagaagaggcggctgccaccggttcggacggtccgttccttcccacaagaccgacagaataacgaaaacctattctcgtcccgtgcggtgcaatgagtcaagtttcccgaacgaaattgggaggcactcgtccacaactaaaggggtgccacccattccatagttgttttcaaaaaggcgccggatactggattataccgccgtctcttgatatgtcaaggaatgcacggagtgaacgtagaatcaagacagtcagttaccgactacccaaaacttctctgttgcagaaaccacgtcgtgcgcacacgaacacacgcgctttctcacgatgttacgtggtaggcattccggcaaagacaggacgatttcagtggacgagctgccatcctttcggaattcaacctgaccaacaaacgggacacaggacatcgtgcggcagatgtacgcggctggcttgcacattcggcgtatcacgtggttggaagcgtaaccttatgagtgagacctgatcagtgtatgcgctgggtctgaacaacatgatacttcgtatgaagcgaagccgaccacaagtactcgagacacgattggaccgtaaaaccgattgacagtgctataggaggccatttcctaacacgaaaatacagtggtttgatgtcttcacgtaggcaacaaccacactgcgtaccagtgtgaaaagttctttttttaatgacccaactgaccccgccagcgtcgcggcggactcggcagcgccttttcagtccgcagtgctgttgaagcacacgcgaaaacaatctcctcacactttccaaatatattcagttaccgtgttcattcatgacggagtggagccacgaggtccataaagtttacttgacgtacccagttctcaatagaggatcttgtgtcctcagactctatctatttctgatgaggtaatactggtacgcaacggatcatacatctttatgttcgtaatgtcagctgtgcacggaaaattaaggaagaagaatccgcatacttgactgacacgttgtgttctgtcgacgaaaagtgttgccattgaggctcttcagtgtctggccctttgcagtcgcactatacgcggcaagatggcggcagccgcggcaccggtttgtcatcagctgttagctgtgatttttcgtcggaaaaattgcatgcacgacgaccgatccgggatgctcggcacctcggcatcccccggcgagctgacaagggaggttgtgaacgcgcgaggctttcagttcaaaagcatttgcctttgaggtttattcgctaccattttcattctcgattgtgtcttcgcttcgccattgttttcgtccgcttccccaacacaa

SEQ ID NO: 2208 - DNA, 2409 bp, Toxoplasma gondii
ccgaacctggacatgcgcaactcgcgtttttctgttgctgctcaagttcctggcgatgagccagagagcgccggtacgcttgcgtggcttcgaggcgggccgcaatgtcctccgacttgagctgttcggccattcgctggtggtagtcccgaccccctgtcagcgacgaagaactcagctggtggaccagactgtcgagggcgctctcgatggaagccgccgcctcaccctgacctgcggcacccgcggaggagcctgcagcaggggcatcagactccttctgcggattcgaagcggcgactccgtccggtcgaggaacttcaatgatttccccttcttctggcgcagccacagcgtcgaggctggcggccgtggatcccggcgcaccggtccccaggaactctggagaccccacagccgccccaggccggcctgtcaacgtgagagagagaggaccggatcccgaggcggcgccagacgagaaggccgaggttgccgacatggtggagagtgagaaagagacagacaggcaagaggcgcctccaggaagcgacggtctccgtgggagactcgagagttgcctcggaagacgaacaagaactctgtgaagcgtggagcccgcggcggacgcgccgacttcaccacttcacatggtgggcctcgcaaacgcttgagtcgaggagagcgcggaagatcgcgtctgacacacagcgaacgggtcctcacagcgaagagtccggtctgtggagttcaagagggcgacgcgtggagaatgggtgtgaaggcaagcgagacagaggagacgacgagagagactgcagacagatacgccccggaaagagacggggtcggacacaacagacaggcatgtgactgtgacaagacgcggagaacttggactcggatagacttctgccgcagagaaggtggagaactggagtggctttccagtggcagcgtttctgacaggcgagaaacacacagcggacgcaaggaaagaggccttcttcgcgggtgagccagctgaacagacagctcgcagagagcctttttaacatgtggacgacgacagaaaggactgtcgcttcgccgcgcgcgcgagaaagagagctctggacgaggtggaaacgagggtggactgcgagcgtgatggacggggagaggagagggaaatgccaaggaacggcacacctgttaagacgcgtttctcgccagtcacagacaacgcagacaagcctcgcgaacttggcaaggcgaaagagacaaccacgaatgacactctgaagcaagctggtgggcacgggggcgtggacccagattcggagtttcgcaggcgtctgcccagacaaaaaagcggggccggaaacgcgacggagagtcgcacagactgcagagagaagtggcgcggtgcagcctcgcgggcagcgaaaacggaaactgacgggaaaaagaaaagaagggagcgagagaaaccctccgagacttggttttttcgctgccgcagctatcgagctgtacaaacacacgtggtcacatgcgctaagaagcgcctcgccctccggcttctccgaagagaaatggaaaagagttctcgcagctcaggagcgcggaatcgaagaaacgcagacagacccagcaagcctgcgacagccagcaccgagaacgaagttggaagaagccccttggcgaagaactgaagaagaccggctcggtaacacccaggggacgtagaggacaacagagtagcagcgcgcgaagcgaaccatcttttcctcccggtgttgcatgagcggggaaaagagcactcccggcgccaggaagctgaaacctcagacggcagcaagtggactagtgtgccgtggccgtctttaaaagaagattttcgatcgacaaaaacgacgctccttcgcatacacacgatgccagactccgatgacgcgcagacatccccagccgcagagaggaggggagtctcacacgagtgccggcaccacctctctccacccgcgccttcgacgtcgtgctctgactctccacaaagagctgtagacacaggcgggcagcagttatggagggtgaacgggggcctcccgcgaaaaggcgcactctagaatttcctgcaccgtgagtctccacaaaacgcagaacggacctttcccgagtccgagagccggggaaacgaggcttcagactcctacacgcactcgcttcgcgcagaaaaagcgggggaaccctcttgctcgggcaccaggagcttaaaagagagaaaagaagctgcatcgaaagccggaagccagcgcaatgtcgcgcgcgggacacttggcagtgtatgtacacctcgtgaaaatcctgccaggtgactgcagaccgcgcagtcgcgtttgccttcccctctttcgcttccgctca

SEQ ID NO: 2209 - DNA, 3848 bp, Toxoplasma gondii
aacacacacatgcagatatgcacacaaatcccagacacatgcgtatgtgtaagtatatttgtatatacatacacatatatgcatatttatatgacatacatatatatatatatatatatatatttctgtatacgacatgtatatgtatatatatatatatatggagaggaagaagcgcaagatgggaaggagagaagactgcgagggaagaaggcccacctgcagacaaacgcggatccggtagttgatccactgttgaaggcgagcgtttttcgacggcattttggagaacttgtttctgaggagacgaagaagccgatccggcgcagagagagagagagtccacgcagtcgcaagtggaggcggaacgagttcccgagacagaggaaacgaaagagagtcgtggttcgacgcagactgagagaagaaggacggagaacgcacaaggaaactgccgagtggactgcagctcgaggagaacggagggagaaaggagcgacgaggaaaggagacagacaagactcgagccgcgaagcgagaggggaagaagagaaccgaggcgtgacggcgagaaacacccgagaacgttgctggacgcgagagggtcaggagaaaatggagaaattggagaggaccgagttgacagaggcggcgacgagcagggataacaagatgcggtgcggtcacaaacgaacggaaaggacttcgcgcttggagcagtgaatgtgcagactcttcgggaagatgcagaggcaggaaccgagaagcaaccgcttggtgcttttctctctctcaagccgaaaaagcagaaaaaacggcgacagtcaacgcctgcttctcccgtctggagatccactactgcgatgcggtggagtttgcgaggaaagagaacgtggagaagagggcgggcaggcaatcggagacgggtgcatgccttccatcagaagagcgacgaaaagaaaagcgcagcgccttctgcgaaagttgaacgtcgcggaaaacagaaaccgcgcagagccgccgtcacccgagtgtctgtacaccccactagaaacgcttctttgcgtcacgctcttttctcccagctgcatgcgcgcagagaggctggcggccgcgccgttcgctcgcgagaggaccgaggaagaaagaaaaccaggtggctctctcgagttgccgagcgttttcggagctaaatgatcgaaagaagatgacgcactctccccttttgttcgtctacacacagcctagtcgcgacagctccacgagatagggggaagactgaagcagtgcctttcttacacagggacctgcgggaggcgagaggaaaggacaaacagtaactcagatcacggagccacggttttctgtgctcttctcaatggagtttagagctaacacgacagagtcacgggttactctctctagaaagcggtggttgttctgtcctacagtggccggaaggagagtgcctcggcttatattcggagaacaccgcagtagtgcaccgaaagggtgaagacgcgcgaccagacgtcgcagctctgccctttttacgctgtgaggctccaaatctgctcaggagatgaactctgtttttgtcgactgttgcgcactggcggtcggctctcgcttgtgcgactctgagttccccaggaagtctacgcggcagaagagacttggcagcgttactggaggcaactgacacacacagtccacgcaggagcaatcgacgacacagcagtcggactttctgagatgaggcagagtctccttgcgtctgcgtcgcagaactcaggaagggtgtggacagtcttaagcgacagaggcgcgagcgtgagaagcgcagtcagttcttcggtgttacttagagctgcggggattttacaagcaccacggttttaggaaggaaactcgtagcgcggcaagactggtgtacaggcagctgctcagcgtccgtcgctcgaggagcctcagggacagcagcttcgagctgcgttcgctgctgttcagaccctgcagaacggcgacctgcggacggagaattcttcgcagaacggacaagcagctcaagcgctcggagtgcagatgcctgcgcgacgagacggatggacagagaggcgacgcgggagagagtgagaggagagcaggaggaagaccgagagagacggaatacgcagagggaaggatggaagcgacgatctatgggagcgccggaggcagacagacgagatacggcagcaagtacaagggagagagtggaacggagaacaagagtggaagcaacggagatgagttgagagagactatgaaagcggttttaggttttctttctgtgttctctgcatcagcggtgcggcagagacgagcacgcagctcgagtcgacttcgttttcttctctggtgtcggtcgatttaaggcgacctccgttcggcgtagggagttgaaaactgagagaagcaaggagactgcagctgttgctgtggagcggaaccggagaacggcgttcactttatcgttgttctcccgccactgacctctcttctgtccccactgaaaagaactggtcctggcctcgcagccgggcgagagcgtcgttgcgttccgtcctgtttcttttcgtaacgacgcgagtgtgtgtcatctctccggcagcaccctcgacgaaaaggtcgaatggcgctcagaagattctccctctcccgtcctccccatcccccgcgttgcgtttttccgcgccgtccaccctctcccctcctctccggttcacaccccccgatgtctcggtaaaggatgaccacccaacagtcgagagagcgacacagcggctcaagcgcgattttctcgcgggtgcggatcgcgcggggagtctgttttcaacgagtgcagagccgcgtttctcttcgcgtgatgacagggtcgacagaaaagtcggaaaacgcgacagctggatgcgcgtctccgcacagctcctgcacgggagggtgggagccgaagaacggtcgccagtgttcccgctgtgccggggtgtctgtagactggaaaaggcgttttctcgattttttattcgcagaaagtctgcgttcgcacaccacacacactctgcgtcgcgttcgcaacgctcggctgagcctggagcggagacttcctcatgtttctccactccgcggggggtcggctgttttcgcagcacacctcttcggagcccagccgggtgggcgagtgaaaccaagtccaaggcgagacttcgcgcatttccttctgaactcttcggtgccttttctccgcggaaattgccccgcaaaaaaaacgattggcggactcgcgctccccgcggagagtcgtctccctctcacgtcgccattctccgcatctcgagagagaaacttcggtgtgtgttaccggtgtgacgcctctggggaaccggctggtgcttgtcttcatctcgacttgtgtctcccgtcctttctctctgcacttttccgtcctttctctctgcacttttctcctgctgtctcgttctccgtttcttgccctttcttcgtcgaagaaacgagacacccgacggccactgtgcgtcgcgcctcgcgtccattctctcgttttcaccggctagaacgaccgcgactccgttgtctttctgcgggggggaccgtgtcttcttcgtggttggaagatgccttctcggctggcgccgtgaggaagcggattccactcaggaggcagagcgacaaaccagaagaaacgccgcgttgcttctccgtcagtagtctcagcagaggcaggacgcagttcctctcgctgtcggcgacatagttccagccgaaaacgccagcaaggagaggaacca

SEQ ID NO: 2210 - DNA, 4518 bp, Toxoplasma gondii
tacgatgcagacctcatacaacctgcgaagaagtcaattatgtgatttcttcttgtcaatctaaaatgccaatgttgcactataggatgatacactgagcacttgccaacaaggaagacagctgggggagcgaaaccgagtggaggagggtgtttttcaactgtgattccatggttatggaagtaaatctcagtgacagttcagtttaccaaatacgatacactccctcttcagggatacctaccgcctccagaaaaatggccttcgaccttctcttatagttcgcgccacgtcacttgaacaagcagcctagcctcttcagccacggaatgcgtgcaagcgcacatgatcgtgaaggcggaagcggttcataatttaaaagctgctacctatgtcggctggtagcctcccgtgcgtttctgtgttcatttctcatctacggtgaagggccggtggcaccggcgctaggccttcacaagagcaaggagctgccatcattcgtaacattcacggaagctcctcaaatgggatggaccatatttttgccactgcgttgtggagttgacgaatgctcgcttttcgacatagaagccaggggggaacaggaaaactgacttccttagaggcgtttgtgaacgctgagatggctccaccccgaaaatgagaacaaacgattgtacagtactttcagcgctgtcgatgctgttgtctttctctatgttttctagtgcatgacacagcacagaagcagctgatggagttgtaggatgtttgagcactggaacggtggaaagaacatcgtttttcactaacctagggagtctgtatggggagtcagtagaatccaccggaagtcagatttcttcatccgcaagtacggacttcgtacacacgatgtacgatattcgagtagacagggtagaggtgtccaagcttttaactcagcactttgctgcggttgtctctgtatttccactcctaagacaaggaattgttattccgaacaagggtcagtgagattcgtcaaaacaggaggaacaactgtggacagcgacgtggcgaaaatggtcacgagaggtagagcgtgtcagcaaacggaagaagcactcccgcaatcgcgcgggattcgagtggtcactcactcatcgctcgatcacctctcctctcgttcttcgggtacgctggcgacacgacgccattgcgggggaagaaacaacctccttccccttaacttgtcaacatgttcctgtgcaaagcaacttcggaacattgcagtcacgttattttcccgccactcgaagtctcttttccacctatgttatatgcgttggcgtgcttgtcgagtttcttacacgtgtatgtatgggcatgacagaaatacatgtactgcaagcatacggctgaaactgtcattctccatcttctgtgccgcagaggttcagtttctgctcctcttcgtccatctacttttggttgcgaagtcgcatcccaattccatcaaactagctcatacagaaagacagtacgtgagtgcattcctgttttacttggcagaaacttcggtgtcaggcgaggaggttcacttttctcccactgttgttgacatatttcgttcttgctccgtctcaagcggatgccgtcgcctcccattcgtacaacgcgtttgcatttttcgggacgcacacatccgacgtttgaatgaaaccagccacagtcgtctcttgagtggtagcgctgactcaccgcagaatttccattcttctcttgtcagaaaaacgcccctgcctcctactcatcgcaatgagtctacaatcatctccttgcaaaaatccttcacgcggtcccattaagtgtggccgctatctgcaggcccgtttaacgaagacgcgcctgtgcaagtatataaccgagcgaggaagctgcgaagcgggcagtgcctgtgcatatgcacattcagaggcagaattggttcccagacctgatcttcggaaaactaagctgtgttatgcatttctggctaacagatgcaaactgtaagttgcgcgggcgaccactgcctctgtgatatgctgcagttgtagagaccaggtgtacatgagaacctaaacctaattacagtgaggaacagtgaacaagagagaacacacaatacatgtgaaataggggaaatacagctctgctgcaccctgctgattacatgaaaaattctgaaaattgaaactatgcaactgctccccctttctgtatgctcgggttgattagttcgtcgtgcacaatgtagtgttgaagaacccctcttgctagtgagtcgcagatagctcactagaggaattcctgcaataaaactgtcttttctcaagtagacagagcgttcaaaaaagccaggaaaatgcaactatacatctgaataacattcatcaaaccgtttccattgtacggaactgggattgaaacgaaaaacaacttcgctgctgatagagaaaggctctgacaccaatgcaaggtaatactacgattgcttccacttgtgacacacagttgctgctgtgtgagtttcgtgaacgcaaacgaacaaaatacagcagcgttcgcctactgcatggttctttgatgttactggaatgaatgaaacaggcactacctgtacgttggatcgagctcaaaaacttctggaagggtgctcaacatcaaaagcatggtcatgcgtgctgaacctagaacaaagaattggtttttcaggagcggttgtttgtcgttatatttccctttcaggggggatgcctgttcgtatgcccatacaagccaagaacttagagaggttcaacgcctggttctccccctcgacgagagtgaagcggacaccatagagcccaacttttgttctccctacgttgaatacgtaacacctccaaattcaccatcaccctaccgtgctaaaaaggcccaaacaacacagagagtcgactccacggccaacgtgcaaggacccattcagaacagtgtggccgattcgaccgactatacgcctccgaagacgttgttcattcctttgcctaaacatggggatcagacggaaactagaaaagaacacacaaaacaggtagaggaagtagttgggggcgagtcaacgccagagacgcctttgctgagtgaccaccctcaagttgcggcagcacttcaacagaactgcttaaatgacgagaaaggtttgatatggccgcatttcgcaaaactccagagtttctttcatgccgaaaatcaacccgcgtggacacaatcaactccaactccacatgtcgacaggagttttgttacttgcaatgcagctccagcacaggctcgccatctggtccctgtacaagcgtctcctgcgtctccaggggcatatcttcctctcgctcccgcaggaagcctttcaacatcgccttacttccctcaaaacccctcccagatttgtcccattatggtacccttctggaatcagttcatcaataacacagttcactcctccccaggggtcttgtgcacaccggcttttcagatgcagcacccgagaagtcagtatccacagaatggagcgttctgctagcttgttgtctccctaacccggaccactgtctctccagtctgattgagcgaagacgtcagactttgagctttcaaaaacgtgtgcttcatgtgtaccttgtccacacgtcgcctgttctgtaacccctgtaaacatgtgtttccgtacatacacgcagaaacgggttagcatcgaacgagactgctgtgtagtccgatttccccttctttctagctttcgtttcagctccacagggcggaaaactgttgcaacaggagaacccgtggtgattgttgctcgctgtcatccttcgtgtacaatgccaacagttctggtacatttgtcctccggtgcacgcatgcacgcatttcttgcatgcagtccctcgctcacagaaaacgatggtaggtgtactttttgtagcttaacgcccgtttttctgtgttttatcagttctttcttcctcgtgtgacccttgtctattccccgtgatgttcgcactaggtcgagaatttatggctgtcttacccttcgaacgaacaccgcgtttctcgtatttcgttgtacggacaccgcttgagaacgcatgatttacctgtccgtgtaccaaaactgaatcaaggaaagcaacatacgaaaattgttggctggaagagtggcttccagttctgctcacacaactccggatcgtggagcagttctatacatacagccggtgggtcatggtacagcccggatgcaagccgcgccgttgagctatccgtgattctcagtagtagagtagaagaatcacccttttcaatgcagctgacgtactcctgctcccattttaaccaacgcgtcgcattcggtctgctctctgtttaacgctcatttcgcaaacacggaagccacgatgcaaaatccctgctgagatactgtctgccggtcctgaggtcatttgcctgtca

SEQ ID NO: 2211 - DNA, 1927 bp, Toxoplasma gondii
acacagctcaagagagaaagccacagttgagcctacaaatactcatgtgtatatcgacagagagagccaagtacatacatgaatatatatatatatatagagagagagagagagacatataatataaatgtgtaaatatatatatatatataaccagagtcacagagctttttcgctgtttgtcgtccgtctgcaatctgcttggtggataagagtttcttccttggccacctggctgcgccgtgcaattcgtttttttaacttctgaaagaagctcaccagaacgtcctcagggtcgatgaaacctggatcggtgcggaagaagcctgtacgtacaccccgttgtgaggagcggagacaccacaatgtttctctgtgcctgcgtccagaaccgggtgcatgcgcggtcgaggagaggagtaagggagaaggcgaagacgatggtctccgaggtgaatcggaaagacagaaagaagagaaaagagaacgcgaagaacgagactcaaaccgcaacaccagaggagacgaagacggcgaaacgttacaagacaaaagagacttgaaagacgaagaagaggaaggagagaaagcggagggagagaaacaggaagatgtcggaggagagagagtggagcttccgcggctctgttcatttttctcttgtcttgcttcgcgtctttcttgaatggccgtttgcacagggaagttgattttcaccctgcgcctctgctgctgtcggagaccgcagactggctttcctcccctgtcgcccaaggagcacagagaagagaaaaggttcctcatcgtgtctgcgttttcgaggaaaaccggacctcttgaaaaatgatgcgccggaaacatgaggtgaggcagtggggaaaggacgacgatacagcgcttcgggtactcgagtcaaaattccaagtcttcgcgagagaaaggctcgaccctttgcctctctcgcgtcttctctctcccttgttcttcgctcctttccagttctctgcgttgcccttcgtttttcctctcgccgttgagcttcccgcagccatttgcttctctttgttcgtcctctctctgttgttctctttgagctttctcggcgactcttcccagacttcctcggtcagcaaagagaaagagagaaagagactcgagggccagcgctgcggcgtagcgacgctcggtaagaacagccgggcacccttttcgtctgagtcacaggcatgaatgaacaagttttttcaggcctttgtttccacccactgcgttccttcaatcattcatcagtctcgacgctttgcacaaaagcggctcccgctctcacgccctctgttcaactgccctgtctccgcgttctcgcgtccgtcgcgttgcatgaggctttgcatgcacttgcatgcactctacttttttaaagtatttatttaaatgttcataaagacatgagcttgtaataattcaaatataacttgcgcctttgcatgcgtctcactgtccctctgaggggctctgaaggaactccgtcaggaaggccttccagttttggcggcgacgataacgagtcgaggggatcctcgaggcacacccagactaagatcaaagattttttttcctcccctccgttttcctttgtatgtacatcttcgtcttctctcacgttcgtctgcgtcttctttgatccttgtaaaagaacagtccgtgacgcaggggggagcttctttagtcttgcttctcctccagctctttctcgacccccgaatcttccctctctgacattgctccctcttcttccctctgtcgttgctctctcttcttctcttttgttcttgctcttcttcctctcttcctccgtctgacctccttcgtcagcatcttgcctttcttcgccgactgcttcttcggcttcctgacggcgaaacagaca

SEQ ID NO: 2212 - DNA, 2027 bp, Toxoplasma gondii
attctttgtttcctcgtcgcgccttgtaagaagctctgactgattcagtgtcttttcctctctcctctgctcccgcggcctggagagaagcagaggcgccccctcgtcgtctcggtggggctcttcgattgctttttctttgacgtcatggcaagccttcacatgatggtcgtcagttgtttctctgctgcagtgacagggcggcctccttcgtctccaacaagggacatgacatctccagttttcgcacgcgtcaccctcgtcttgatcttcgctctcctgcgtctcctctctcgccatcgtggtgacgagatcaacagcgaaggagaataaaggaatgtggaggagcgacggctctcagtcgacagccacggatttaaggtctcggctttccttcttcgactctgtgcctttccttctgctgtcttcctgttttatgagtctcctttcctcgttacattccttcttctctcccctcaacctgtctcttttccccggcttgcttcacctctcggacctcacctgcagcttctctgatcccaggctgtccttggcaactcaaagtctagccgagaattcagcgcccaacagacgtccttacgtgccaccacagatgcacgggcagacacagtccgtcctttttctgttcgaacttacttttggagtcctcaatgcatgcaagttcctttgtttccaactctgtccgccttctcctgcggcatcgcctgcgtttgcttcttcctttcaatgtcgcttggtttgtgatccacccgaactcgtcttgttccttctgctgcctccggcgcatccagctcctgcctgctgcagcttcttcccggttgtcaccttcccttcttcactggtcgggcagacgacacaggaaagacagaacactgcagaaaagagagattcgacgcgacggtcccagagaagacgactggcaaaggagagaagcaccaaagatttggaatttcagcgaggcaaaaagtcttcgcggccgggaacgaggcactccagggtgtaccgacacccgaagcacgcgagagctgacagagcgactgtttcaaggagggactgtcttcttcctggttcgcgacttctttccattttcaggtggaactcgaccataacgaagagaagaccagcatgtgtcgagacagaaaaacagctaacagttcacacgcgagacggcgcatgtcgtttcgccgcttgcatgcatgcacggacatactggcgagttcaaaaaaagtgtcggattgatgaagaaattcaagcaggaaaacctcatagtatcaaagtttttgtgatcatcgtttttttttgcatctctgtagagctaactctccactttcacacaccctggacagcccttctgcctcgtgtttgtacctcgtatctcgtggcgagttcctcagcagtcacatcgacataaaactcgaagaaaggtccgttttttttctcgccagatcgtgctgactaggtgaacacaaaaatcgccctgcgaaaatggaaccagtgaagctacgttgacttccgttaacgggcctacctctccgattatcttgctgccgtggcttgtacttcaacgtaaacatccaacgtctcaaaaacttttctgttctgcctgaaaccctctgtggctgttccaatgcatgctttcagctggctgaactctgagtcttgcgctgtccgctttcctgctcctttgaaagggactgtttctgcgtcgtttcgtggtcctctgtgcttccgtgacggcttctaaagacgctgctctgtctccggttgcttcctggtcggttttgcatgcatggtcctcgtattgtggttgcctgtgggagctaggcctagaaatcccctcttataatgtacaagagggagtttagcttcagttgtgtcttgactgatgctccatgcgcgcggagttctgttgcgattctcgagggttgaagatatcatagcaagacagagagcagcagatagagagacaaagaggtagaacaacaggacgacagacagtggagaga

SEQ ID NO: 2213 - DNA, 4260 bp, Toxoplasma gondii
cgtggttgctgtcctggaaacgaacctggcaaaagcactgggaaaaaatgacgccagctagcgggtggcatgtcgttgagaggggcaatctcttcagcgcttctcagagtgaagcggctgaacttgccttctttgtagatgaagaggaaggcagagaaagaagcgcagagcttcagtggcgaggtagaaagtatgcgcgggagtggaacgggcgagaaagtggctctgtcgagacggggattacccacaagagtattgatcaggaaaggggtggtaagcttgaggaatggtcgcataaactttccgaggaaggtcagaggacgagaccagagaatagtggtagcgtgcggaaccagagagagaccctaggagatgaactactcgcgaaaaaaaaaagtagctcgacttccagtgatacgttgcaagagccatctgctaagccgaatgcaaacaaacccggcctttcttctccacaggcttctcagagcggacgaatgctgaacgatggggacaagcgtggtcagctcccctcgatcattgatgactcctggctcaccgaggaagacaacgacgcaagtcctgccctttggtggcttgtccccaaaggggcctactgctgtcgctgtgggcgaacacagcgagaaatggcgttgtcatgtctgggtgacattgtcgcgcttcctcggtctctccgtgaagaggcctggaagcgtgcaaaggaggctgaagctacagctgatgcagcggcttctctgtcctcagtgtttgcgggcagccctcttcgccacggttcgagcactgttctcgagcgagacatggcaaggacacgatctctggaagataggtcttttgcgcaaatgatgcctcactatttaagcggtgcatgcgaggggctgacttacagaagaacattccggggaggggatccgacagcagaagagagtgaaggggggagaacgagccacggtcaatcccctcactcgcagacacagcgagacagagctgacagaagtgaagagcatgggcagacaccggggtttgcagatacgaacgaacgaaggagtagaggcgctgagtggggaacgagtggtcaccagacagaagtgtcttcctctcagttgccgccggtggcatctctcaatgtgcaacctccacaacacgtaagcgaaacgaaaagaggaaaatttccgccagtccctgtggacagagtaggctaccgggaagagacggggattgggtttgaccgggacggacaaggacaccgaacgagtatcccaagcgacgagaacgacacaggttctatgtttctttcacgcggacccgggagctcgtgggcacacgaaagcagcaaggacgagtttggggaaaactgcaaaagcaaggacttggcgctcactcgtcaaatcaaatcgtctccgccctcgcctccatatttgaaagcggtgtcatcgcagtcgagacactccaccacgggcgtacaaaattgttacggcttttctgaatcgcggcctgccatttacacttcgagttcgtcgctgccagctaccccgggaggcaacactactgattgcgacaaagggcgttccgccaataaggaggatctccgtgcgttcaaccacgatcagaaaaaacagtttgtggacattgtacagtcctgggtaccaggaacgcctcgagtcgatgttcagagcgattcgccatcgtcggacaaagtttcgcgactaagtgaagcctatacattcaatttacatcgtgcctcctgggagttgcagagaaccgacgagcaccgcgacttgccccaagatggattcattattcaggagaacagtcaagtaagaggcggggatcggacgggtggtaacctctcagaggccgaactccgccgaacagactcatcggcggacagattttattgtcagtgccacatgcaacccgagaatgctgacaacggagtgatatcttccggaggtgcagcagtacattcccccctttccacttcttcgacgtcgtcgtggaatccgggttctccgttagcgtctgaagcagacacattagatacccacactttcagagcggcagcggaggtgaatttggctccgcctagcgccacttcactttgcgacactagaattaagtcatcgcaagagaacaaccgacgaacggaagagaggcagatgtcccaggacgccgcgtctcatgggcaatccgtaagccaacaaaagatccttgataccaatgggctattttgcctctccgaatctccccctaagaatcgtaggatgaatcgctggtcacctgagtttgcggtacacactgaatcacagatcacaacggcagaagagtccctgcgccgagtgtctgtgaaggcgaaggcacaggagaccgcatcacagcagcggatctcgctgctcgcggttggacgtatggcccgacacttggagcttgtcaacgaagatacatttgccgtgtttgcgcacataattatgatcctcccctcccgagttctcgttgtggttgcccctcctttgttcgaatttctctttgccctgagagatgtttggtgtcgagatctcctccttctcccccccaaagggcagccctcactcatgctcaaccaatcgcaacaccagcttcagcaggaacttcagaaacatcaagcgtacagagaggccgttctgcagccgatcgtctcccaaagactccggcaactcctggctctcgcactgcgcaagttctattcatatagaagacacagaaaagcaggacagtcgtacatgctggaagacccagtctatggaaggggagcgaagtgtttaacaagaaggtccgtttctgcaacggccgcagttccatgataccagtgttctagcaacgcatccgtagtgggtgtgtggtgaactgccagacaacttcgcaatgtattatcaagcgcccagaggaaaacggatgtttcttgcgatgcccgtcgtgttgacatagctgaatcagagaccgtgtacatttcttcaccttaactcaagtgatccagtggcttgctgcgttcaccagcatgtgcccgcaaacgcgctgaacggcctactgacgtgtcttcctttgttcgtctgtgccatgttttcacaatgtgtgtgcgtggtggccagcgcaatgctgccgaggtgaccgtgtgtctttttttccctcgtgtttcacgaaagagcgaaacgatcgtgtggcagacgattcatgtggaagggacaactacagtaagtaagcatcccacactaaaccgggagacacggataacgacggtcgtgtgtgccatacgcgatagagatgcatgagtaggccttcgcgttcatagaaacgacagcgaaacgtaacgacgaacgcaggtgaaaacatgagcgcacatggcttcagatgcagaaactttgcaggagaggcaatctgtgtatcatgagcgaaagcatggaacgagacgcaattgtgtaaggataatacaaccgggagggcgcagcacacaactgtaacagcattgttcctctggcgcccccctacggcgaaagagacgccagtctatcgttgcggcactaaacagtggtgtctaatgccgatcccgtgttgcgctgtggggatgatccttacgaagggtggcccgaaaggactgccgaaaagctggaaggggatcagctatttcttaaaagctgtcgatactcgccaaattacttccgaggataatcccgttctgttcagtcgggactgcgtctgttgtccaacacacagagggcgaagtgaatgagagagtagacatagggtactttcgcagctcccgttggttttcaaaggacaggagcgagattagagcaaaatgttgtctggggaacagcctgagtggctgtgtgcaggggattcatgctcgtccgataggccgctcgccaacgggttgaggtgtaactacagctagacgaagccggtgtgtctaccggggagctgtgcagtggcgcgtcattgtatagcttactgttgcctctcttttaattacgccagtgcctttttctttagatcataaacgtggcgacgtcttatcgcacagaaaccccttctgtccaggtctgtctctcctgagacgccaatcggacaattccttgttccggtatcgtatgggaccgctagtgaacaagttagggaagagtgactgacagttggaaacctttgcgtttttggcaaacatacttcgaacgacacaggcaggtttccggctgctcgagacaaatcagggga

SEQ ID NO: 2214 - DNA, 1928 bp, Toxoplasma gondii
gcttttgttttcgctcgaaaagaagcgttttatgtctcaaaggctgcagatgtttgcgatttgcagcaccttagtggggattgtacaggaaatggttcccctgtggacaggcgtcggttcttggtgcactcgcaggatatcccgtgcctgcagtggtaggggaaacagggcgttttgagggagaagaactccccttttttctgtcgcctctggtctttccgagtgtctctgttgtttcaagcgttctgtcgcccagagagaaacgccgcgtttgcaagatgtatttgcaagatgtaccgacgccccgtttcgtcgcttcggatcgacttttccgacccactgacgaattttcgagttctcgggtgaatgtgccgtgtcaccagagagaagcgcttcgggctctcctgccctcagcaattgtaattctgttccctggaactgaaaaggagcgtcgagacgcttggcttcaccccgagatccgaaaaccgcattctcccgccacagacctgtcgtgcggcgtagccctctcggaagccttagcatcgcagcacacccggggcagagagagcagaccccgagactttgttgcgcctcagagaacagagcgcgaaactcaagccacgttcggtcttcaaatgcacagccagagaaacggaaacaaaatgttcgtctcgccagcttccggagagacaaccaaggggcacccgcttatacgcagtggggttgcttatacgtccttctactgactcaactctgtagagatgtatacaaaaaagtatgaatgtgaaagtagagatagaccaagatatataaatatacatgggaggcacatgcatatatatatatatataaatatgagtgcgtatatagatatgaacatgactccggttgtaaatagggtattttaggtgcagctagtaaagggctgcctgccactagacgaaaatgcgtctttccgggctccaggagatccgccgacttccctctcggcgctcggcacctccttctcttctttttgtttctctgtctttttctgcaaactggatggttgccctgtcctcgcctcagcttcacacaagatctttccgttcgtgcatcacatcgaagaagcatgccttggggcttggcatttgcagagacacgtgtggcgtggcgttggatgaagcagagatttttcctcaccagcacaggttttttctggcagacggctgatcggttgcgctcccattcttcctcagacgtttacggtttccccgctttcttcgctcctcggttcctcgtctttttcggggcaactcctgacttttctgttgcgacatgccccttgcgtttgtgtgtgcacagtgtcttgagttttctctgaaacgtcgacttgcgaaacttcggctcttctgccgtctttctagtgttttgccgtctgcactgggacttcttcgagactgcctagacagcgaaagtaatggatttcactctcgtgtatgacctgtggttccacgtttgttgggttctcgacataacctgcatggactgccgctatcaaacttaacagcgagagaaaacgactgttcagatgctcgtgcgatcaggagcgtccaactgacgtcaacagtttttcccgcgaaagcttcgttcctcgcaacttccaccacaaccccgtttccgacagtcgtgggatcgattcttacacccccctcccccctcctcctcatctttttggcgctggcaaaggcgtccgctgcgcgggcggctggcccctggcgagacagaggtcgcttgcttgtcttccacgttcgcctggcaacggggctagtctgcagccaagaactgtgcgggcagatttgtcttttgtgtccgtgttgttcatgtcgtgtgcggtcgccaatctgtttgtttgttccggagaggacgctcttcctgcaaatccaaaa

SEQ ID NO: 2215 - DNA, 3845 bp, Toxoplasma gondii
gttctgtttgcttgtagaattgcgacttttgatattggctgaggaacgcagccgtcttccgttggttttgtgttgttctacctggacgacgcgaagagcgccggaaacaaaggagtttccgtcttctccagtgtacttttggttcctcttttgcatgtttctctgttttgcaggcgctccgtgagcttgcgcaagagctccaaacggccgcggtaatcgctgggaaccctgtctttgtaagacccgcgtttcttcgagaaaaagctcttgtcccagtgatgcgtattaccaattcagtggtgcccaaacgtaggaagcctgtcttataaggtagaacggggattctagcttcacatttttatccgagcggtgttgctctcttttaggggtcttcaacagtccactggattgctcgcgtacagcaatcctaaacaaggctactccacatcggttgtgatcgaggcgccatttgtgggcggtgggagtagtcttctgagacgggagtatttagaagctcttgcattgactgaaagtttcattcgatttccatgattcaagattagctgtacgattcaagaaatgcacttacaatgtcaccgtcgcatatcgatcctgattcgcaaaaggcattcggctttaataggagttcaagaggaacaaccggtgaagactcagacctttttccacgcgcgacccgacttacttgaccaaggttttacattgctgcgggtgattcgctgtagaaacgtacttttatgtcgaccaaaaggctgcgaacgcttttgccttgtgaggcgatctgggcaggtgcctccagtgtatacatgtgaccacagttgctcagatagttgttccgatgtggagacaactggacgttcttgtcacggaagaacgcagacaatcgatttttcgaaagcttcacacccacgggggcactttccgccgtttttcgttccagttgtctgtttttgaatctgctttgctcgattggaggcctctcgaccaactcgtaggtttttgcaggcgggatcgcgcttttgaacgacggttcgcggctttgctgggaatcgagatcgtcatcttgttgttttttccgtagtgtgttacctgctcgttctgcgtcctttctgccacaagtgcgtgtctcaggtcggtcgcgattggatccgacaaatctgccgggttctccgaccgtgtgcattttcaggtaggggaagttactcacactttcagccacgttcagcacgagctgaaactgttctggatagagagcaacgatgccgagacgctctccaacattcgagcgactccggacgagtgcaaacaggaaaagcaggtgaaacggagcggcagcgacttcaggagacaactggaatggatcccactgaaacaagcatttgtgagtgcgaaaaaacgcagagaaaacacaggcttcgacgggtttccggttcatcaacggagaagtaggaaatacagataggctgcgtagattaaagttcggttaccatctgttttcgttaatatatcccgctaatttaataaaacatcactatgttgttcattgtaagagcgcaacttccttgccagttagattgacgcactctatacagacacagaaaccactccgaatacgcgagtccgccgcgcggcgaagctcggagtgaccgaaatgggtttctcagcatttcccgaaatgcgatgtgaaacacttgcggcgttcttcgctcccgaaaacaactaccagatcgggagttgttgcgcgccttgagtgccggttcgcaacctgtttttcttcaaacacacgtttccgaggaggcgcgtgtgccgctttccacatttgtgtagaaaccgcaaatgatgaaccgtaagttattgacttcttgcggcacattgctcatttacgcagccctgctcgcatttcagacgagcgaaaaaggtttggcccggcaatttgggaaggcgaaagagttaaatgtactttagggattccccagaaaggctcacagaggcctgcttgcttgctgacgtccgctgcttgtgtgactcggcacaggatctttgtcactcaacgtacacaaccaaggtcctgcaggcgttgacggactttttacggctacgcggagattcttcgaagagaaaactcgtgaaatcgaacatcaagcgagaggcaaagctccagccgtccctgcctagtcgcttccttgggtgaaccgccgagtcgataaccagacacactgcgagttgggagaaatatccgtatctgtctcgaaaagtggttttgcacaacacttctctgtcgcagtgagtaccgtttctcgtcgagttccaagacttcttgccactgcagttgcgtgagtgttttacctaacctggacggacgctactgaatgccgaatataaaaaaactccagatccgtaaagttcgtctccaattcagaggccttcaagcgtcgcacacctgcgttgcgactctctctataggagccgtaactgtgaaagctggataaaaacgaaactggcgatggacaaacagagctcaccggtagctttagcgatgcttttatccaagaagaggaagtattcgcagacattttgcgacacagaagtaggaacaagggacagggaaccgttctaagatacgaaagaaaaagaaaacgatgttacgaaacagttgactatcttcatctgttaatgacctatgctgagtgtttctctcgtgcttgactggagtaatcttgcaagcggcttctgattcggtggaatcgggtagtgctctttcatttccagaatttccattcaccacgttgtatcgattgtttgtgaaaggacgcaaaactcgagagctaccagtacatctgcccacatatctctttagaacaagggaatttatagatttctcgggtcttcgataccatgtcatcttcagactgctttcagagctgcgatacttgctgtaggcccacgcctttcgcgtagcttgtaaagaaaacagcataaacgtgtaggtaaggccatatcacacacctttgaatctgcactgtttgccagctctgccgcagttcctgcagcttcctgaaagtgcaaaaccctttgaaaaaatacacctttacagcaagtgagtcttcgcaaggtcctgttcgcgcattccatcattctttcgcgcgatgaagacgctgaaaggtaatttctttagagacgacgacgccgtggttgatcgtgctctcacattctagaaagacgatactgagagtttctttttgcgagcagctgtcccagggggcaggctcttgacatgaattaggcatgaagaagaccacggcgaaaacaggtttacacaaatgagagtgtaccgcacggactggtaccacccagacaagcttcttgcagagccgaccaaaaacaagatggcaactaaaaagtggaaacgtcggctggaggtggcaaagcagtggccattcaggattcgtcttcagtcgaggaaaccggagaaaacggattttcttggatcaccacggacgttaacaagcggtgagacgtgctgcgagattctttgcttgccattccttctatgacaagaatgctgctcatgaaaccttttaattcttggcagtgaaaaacatccacctttggaaaaaacggattccgtcacgcgagcacataagcacatttatgcaaaaaaacgaatctcggtttcgcggctatacatacgccttgggccaaactatttgaagacctttcaagatgtagttcttgctagtctctgaattctagagggcgaatttcaagaggaaacggcaattccttctttcctcgatccctctttgtcgcggtgcgctcagtctcta

SEQ ID NO: 2216 - DNA, 4721 bp, Toxoplasma gondii
gcaactcaccagcggatttggttgtggtcgaacgtcaggccctggacacggggagtctgtcgagcgaagtgtctgtacagcttgcgctgctgaagcggcaggcctcggacggggcgcgaagtgccgcccgcagcgccagagccggttttggaggcgcgaccggcctggggcgagcggcgtggggctttggggcttctgcgacgggccttgcgcgcgccggcagttccccgtttcggggacgaggcgccggtggggagctgcgggtcttggggcaagccttgggaagacggcgagagtgcggcaggttcttggacgcgcgcgaaggcaggaggaaaggacgaggccgagttgtacgagttgtcggcagagaccgggaacgagaagggcgcggggaagcgctgttgagactggaccggggtgcatgcagtgtagggcgcggggcctgagaacgacggagcgaaggcatagccatagttcacgtttggccctgggtaaggcgttgcggactcgtagtatacggtccccgacatcgagggtcggggatgtgcaactcggccacacgaggcgtcggacggggctccggactcgggcggcagcgggtgcaggaaatttctgtccgtttcttgtctgggcactgcggggtcctggacaccctcaggcgagcggtagtcgtcgaggcagcggcccggttgttcgctttcagagtagcgagacacgaagggccggtcggcggctccgatcttgccgcggccctcgccgattgccggtgcgccctggctgggccatgcaggttgcccgcaagaataccctggttcgtaagtccagggaaacgcttcgcctggagaagcgtcctcaggcctgggtccgtggctgtggagaaaggcgtccttgccagctgcgaaggcgtgcatgcagcggtcccgggacttgggctgctggctcaccaccagcacggcgccaccctgaggctgttctcccggatagctggcgatgctatccaccgagactgggtgagacggatggccgtggcgaggctggctcggagaaaagcgggtgttcgggggcgaaccggcggggccagcagaaagaaccgccggtgcgggcggtgtgcagacagcgaacatcgatccagaggcggtgggtgtgcattgggtaggcgcgacagaggaaggcgagagtctcgagaggttcgcttcgatcgccatgggcgcggcgcctcgttggtgaggcggcgaagacacatgaatgctttgcatggtggcgagtttgagggacgagacgcgtgggcgcagcggagaactcgagagaagcgtatgggatgcagcgaggcgtagcgtcttcacagcagacacacgcctactgctcaaagtgtggcaagacagacaaactgcggacagaggcgaggcctcgagtcggcgggcaaatttctccacaaattctactttcggacgccactcatccttaggtgtacgccgaggtctcttgctgcgagtcttctttggacaaagcagcggtattttaggcgccaggcactgcgccgagattcatatggagtggtcaacaagctttttttgcggcagacaagttcacgtcgggaaccgaggcctcgctgtttcaagaccgctctcgaggtgaagcggggcgtataggcgcgaaacaactgcagatggcaagagaactggagacgaaagtcagacactggaacaacggagcaaaatgtgtatgtccgtggacaaccaggtgcacacgcagcaggcgaggaccggtcaacagcgccgaagatgggaagagagcgacagactttcctgactttagctcacttccctatttaggagtccacagagccgctggaaagcacccgcttcgtcgaagggttcggcaaacggacgtgagaagcgcatggttggctggagcctcaagggcctgccggggattctcctctgtgcctgaacacgcgagcgaggaaggtgacctgggtaagagaggtatcgggcagctgggcgcggcgagaccagtgactgtgcgaggtgagaaaagacacaaaagtgaaacgaaaaaagacaacggccgcaggggtttgcaggggtttcgcttcccgtcctaagacactgtccggaggaaagaacggccgcctcgcgggtcagcgatgtgtcggtcgttgcaggacacaggacctcgacctaagactgttgctccagaaccgagcagtgcagatccgaaaggttctgtttttcgggtttgctgctcgggtcagagcacggtcgtttgaacctgtgtgacggttcagctccaaggaagctgtgtgaagcagaggaaatttttgcggcatggggacaaatgcagtccaggtcaaccgatctgaggtgttgggcgacacccggcctcggtcggcgcgcgccgaaaagccaggcgaatcctcggaagacgcagggcgaacggttggatgtgcccgcagaaaaagtcgaagcgcgaaagacagaagcacgagacgcatttcaaaggaagaaaaacggcctcgaggaggccgcgcgtcacgcgttggctgccactcctgcggcagggcagtggctcttaccttggcttgttgcgcagcgtccaccgtgaggggcggagcgccagtcaggcagaagctcagacgaagacagttgccgcgccgtcctggacccccttcgcggcggaacaaagtccggagtgaagaaaaaggtcgcctggaaacaattgcagtgcgtactctacaaaaagatgttttgactggccaagctccgtcaaccaagatccgaagttccgttcggctgtctcgatggaaagcggcgcatggtgttgtagcctctccgtccgctcgacggaggcacgtccccctggccactacggcagccgaacgtgtttaccacgccaacgtattttaagcacacttctgcctttgacttcagacacaacttcagcggcaacttatggcgtggagaaccagcctctctcgtcactccacccagaagtccgtgtaagacacgacgcgaattgcacgtgctcgcacctcctctcgatcagctcgcacagctgcttgggagactgcggacagagctgaagtgacccaccagactttgtacggaacagactaatgcattttgtgtccggacatacagaagccacgcagggcccctttacagccattcgaaaggcaaaagaggactcgacacgggttgtacgcagaccccagcaggtcaaaatacctgcccatgagatcccgttgtgtctgaggaagtagggggccatcgagcgaaggcatgtttcttgtctagcgatacaaaaaggttgagctcttcaaatggcgttatccgctgctaagtggaactgggatgaagcgtggctttgtttttcgtgatggtaagaaggtgtatcccgtacttcaggaaattgtcctcgctttccaggctaacgtatgttgaggagcagtatcgttccagtagagtcacagaacgtagaacggtaaactcgtcatggttccgaaacacacatcaaactcttttttagttccagttgataggctggtcgagacgccctctggatctgcttaccactcgttgtgtcatcacctacgtctttttagccgattggcgaatccaagaatctcttcgagcgtgagagactccgtgcgtgtgtgatgaaggaagcagtgtcacttgagacgtgcagatgatgtttccgtcggtaagaatgtgcagttggtgtccgttgctggtacgcattcgagccctgtgtagtcgcaatggactaccttgcaccgttcgtggcaaattcctgcctgtttgtggtggcctcggcaactgtgtctcgcggggttggtgacccagcattgccaaatgaacaaggatgctgcgtatgtgttcagttgagtctgcttcagtgaaagcggctctgcattctatctacgttgaaggaaacgaggagcatttacgtccaggagcgctgtgacagacagtctgtgtgggggagctacccgctcactttcgcagcgacgctcgtggcataacacgagccaccaaactagacacaaatcggcttggcttgatgtcttggcaaccatcctacggcaccccgatgcaagaggcagtgaccctccggtcgcggccggaagtaagagctctgcgagtctgacaagaacagtgaacataacggcaggcgtggggaagccctcgcagttgttgccccacccgttctggaaacaccggacttgtggcctccatggcaagtgtctccttcttagcacatttgttacagctgaactacgtggtagagcgcagatgagtttcgcatacgggcatcaagtggacaaggaacgcggatcgaatgatagtgtatcccgcggccgtctattctaggctttcggaaacaaggttattgtctgagacaatggcatgatccacggcagtacttggggtaattttgaaacacttcggagaagctgttggtatttccaaacttgaaaaaacggcagaacggacaggatttccgcgttcagatagcccccgctgtgaggggcaccggaaagaacagcaggccttttttcgacagccccacagtgttttgtcggctgtaatgcacacctagcttcagtgcgaaaacgaaaaaaaatccttgactgctagcacacgacaaagctggaggtgtcgcagcttcgtgagcaaacactaaacagcacttccgcgttgcatttctcggcctca

SEQ ID NO: 2217 - DNA, 3099 bp, Toxoplasma gondii
aaagttacgagtcgtttgcttcacttcccgtttctctgttcactgctgtaactgccatggtcaggccgatgcagagaatgtcctcatgcatcgagacaattcttccccttgttgtgttacggacactcgagcgtcgcgctttctagccgtcgacacagacatagaaactggcaacaatgaacagagtttcagccttgttcaaacagaacattactttccagtcacggtggagagagaacgctttgggcccctgcgcaccggctgtgcgtcctagatgaagtgcccccgacgcgcgtgcgtcagtctctgcactgcagctgagacaagcgaccgtggaaaaaaggagctagagatcaaccttgtagaaacgtgagctccagtttacgagaaacaaacaaccgtgttcttcgaggttgctgtatatcgccacctatcaagacagctaaagtgctagttgcagtgtcctgcgacatcatggttattcctcttcggtcaccaagcatcgtggacatcatcgaaggagtcgagatatcaccagcgcgcagccgccacataattttatctccaatagggaacacgtcgcaccgtgggatgctgggatagactcttgggacatcataccactgacgcaactacttgtccggcgcaagattgtgaattggaggacggagtctcccctttgaagccagagttgtgattcccgcaacggaactgcgcatgcaactccgagagaagcgactcagatcaatgctcctcagaaacgaggggaacgcagacagaaaatccctgtgcgtcagtgtgctgcagcgtggtcgacttgtggtagtttacaacctgtttacggtttaagataagagtctacgcgcctgataatgtttgactgtgtcagtggagcagatcccttgtgcacatctcggcttctcgattgctttgcaactttttgtgaacacaggtctgctacggtattttttgctatggtgaatacacggaagagacagcatcacacgcgcgagcaaacccggttgttgattccaagggtactgagtccatcgtgtgcatctgtgtccaaggacagatgggtagtcatatggatatggacttcgaactgcttaacgagataaacgcctgcgagcgactgaacgtcttcgatgttgacacatgattctacatcatgatgaacaggcgctttcgaccagtcaacctggagcattgtgacacctttccacagtcttgtcaagttccgcttatctatttatattacttcggagtagtagctttctgtcgctgaaaatattgtcccactgcacaacgacaataacattcgtagtctctccaaatgtcttgccatctttgtacatcaccgcaatccattttcatttctgcccgttgccgtgcacatagtctcctagcgaaagaggtacaccgattttgttaactattcaaggcttgttctctgctagtaaactctcctgtgtgggccatgcgtatccacttgttcaaacttcaaaagtgcacattcgtaaaaacgccgtgagattttttcgcggtcctgcaggcagccacgatgcaagcatttccacatggccacgagaactgtggcggtgtctaaatcggtcttccctcggggtatgtgaacgggtgaaacatgttgctttctacttccagtggcgctaggtctgcgttcaaggagatccctttaaatacgctgggatagatcacattttcttgcatgcttgtgtattcgcggctagttgcctgtctaatccacgcttttaggttaccctgggaaccccttatgagcaaagcctcgatagtactactgcaagcacaggtgcccgtgttcacgacaggtgaacctccagtagatcacttgtttggaaagcgttggcgggggaaagttcagctgtaagtgaattttctttaccccaccaaaagtaactcgacaggcttggacctcctgagagaggtcccagaagaactccgtctgtacctccctgtttccgtagcggccgatgaagactccaaacataattgtccaaactggcactgtagcctcgcctgaatttactcgaaactgctgggggtaaacgcctgctccgttgccatcacgcagaaaatcttgggatcaccgaacaacaagcctgtggacagccggtcgtcccctcttttccgtcgaaatgaaatcaccacggccctaccctcgcctcaggcccacttccccttatcaaatatcgccagatccacgtggtctgtgcaagaagagtttaattcaaaggaatgatcatggcagtgaaaaaccttgtcttcgccacaagacgtaccggtggcttgttccgtagcccacctacgctagaagaagattttcgccacggcgttcccctgcatgcctttcgagtctagaagttgcactcgcgcattttctgcgtgttcgacagcgaaggataaaaaaacgactctagtcgtttgggtggagaagcatctcgtttaatgccttctccctttttttcgtgaaggttcacctgagggcatctctctgtcacgcagcaagacgcgagcaacacaattcgatccgtgtgtcgtgtctccgtctcgtacacggtctcgatgcttcattcgttgcctctgaaaagtatcactccctttcgtctcccggcaaagcttgtcttgctaagcaacctgtttgcttcttcactgcttccaaagcatccgtcttcgatgtttttccattccgacactgtactcgtggtatccttcacgcgtccgcattttcgacccggtttccccctcgtcttactctttgctgaaggcagcttgtctttgctttcctcgctctttccccatcagggaatgccaaagtcatgctcgaatttcgggcagcggcaaatactcatcgcggcagaaagcgaacctcgtcgcgcaggggtcctgcttctagattctcgccagcagactgcacgtttgctcttctgccatcgccggaagaaccaagaaaaacatccacggacgctgagagaacgagacgatggagagaaaatcgatacccctgagggctcgtcaacttcctcttttggatttgaaggcgcgacggacacgagaaga

SEQ ID NO: 2218 - DNA, 4727 bp, Toxoplasma gondii
tcgatgagaaacaagtccctctaacgagcacctggaaagatgctttctcttgacgaagacgccaccaggacagaccagtgagaaggaagaacatgttctgtcaacttacgcccgagagatttctttgaatttctcagggtcgccgcccttgtcggggtggtgcttgatggccagctttctgtaactcttcttgatatctgaagacagccgagacaccacacacaggcacaaggtgagttcccccggcctcggccccgctgtaaggtaaccaccggcaagttcgtcgattcgtcctagaaaggtcatcttcggtgtccggtgtacggacagttcggaggggtggacagagtctcgcgtccccccgaacacgattcgatcttgcgcaccagccgacagagaaaccacactgcacagttccgaacccacggtcgcgggaagcaccattctgccttccccaagcccgccagaccgagatggtctgagatcaggagaacgtacggttacccacggacaagacgcttctttcgactgctcatgtcacaaaggagaaagggcagatgctccgcggcaagagcactcgaacctctgcaactgcagactgagagaaaggacgccccacgggaagcaagaagcttttgatttcgggtgcgtgcagccaaattactgagagactcgcccgaaacacatttcaccggtttgttgcattcgttctggacggctcgggggtgaggggggacgtggttcgggccagaagcatgccaagcagaaaaatctgtgacccgcgacgcccggaagaagcgaagcaggcacagtctgcctttccgctggcccgagccagccattctggattacataaaccgcacacggtgccgagactcacgttacaaacagtgcgatcacaacggcggtggccctaccgaaggttttttgcggagttttctgcgcgtcttttgagtgctggccattatcaagtggtccaactcagcgacacaacacgcgcagacggaacgaaacacccaaaagatggcagattcggctcgcgacgtaccggcaaccgacgcagtgcggtcaacttccaggatctcgtaaaatttcgtgttgtttttctctttgctgccgccccgtcgcggaccaggtccacgcatgtcgtccccgaaggggaagctgccaaaatacattttgcaggaaaggtgtgggggaaggagagcttgcacggccaaagagttcgacgatgggaacggaagaggcaccagcaactttctcgagtgtctctcaaacgaaaagcttggaaccgcagttgcgagtcacgcggaggcagaaccggcgggaggaaagagcaggacgacgagaagcgaggtggcgcagcacgccgcccggattgggttgcggacccgtgagcacagtgcagaggaagcggccaagaaaaattcaacagaaaaagacgtgttctgcgggtggaaacgaaaggaccgcgagacgaagggtggggcgcactgcggtgctttttcccggccggacgagggggtgggacgccgaaacgactgtagcggaactagatcaacgcaggacgcacgaaagacgcgttcgcgagtcgcagacaaacagaagcaaaacaatccccgaaaaaggagaataaacgggcgaaatcgctgagcgcctgttgatagccgtgctcaaggaaagaatccgcggacgggggcaatctggcagagcttatatggaagcgggcgggggatgcgggatcagaggcaaacacaactagtagtgcacttgcgccatgcatacacacgatcatagactgcggaaagcggaggcgaccgtcgcggcgccgagcgcgagaaaccgctaaaagagtatttataaaggaagaagaaatccctgctctcacgcctctgcacactctggagaagcaccgagttcccgaaccacgcagcgggctcacctggcccccccttcccccctgggtgtgcctactgcagccagggcaccctaaactctacgcggaaaacggagcaaaggtacccccagcggatcttgcgccctcagctggcctttctctgggccaccgcagtttctccgttacaattaagcgtataagggaaacagcgttcccttgaaactcgagcgagcctttcagaatcttgcaaaaacgcactgtggccgccgcctgaaaacaaggatcgcgacgaaaggtctcgcagacacgcgttctcgctatgcactccgtcttctggtctttccaggaagaaactacagtcgaattgttataatggcctttccgttaaaaagttccttccaataggagagttcctggtcattctgatgtgcacttagaggcgacccaggggaagcgttcggcagctgcgtcggggaaagtaacggtggactgagatggcgtgtctcgaggctttagaactgagacaccgaattcttaaacagattttgtcttgataagaaaacctggctgcttagtgactggcactacgcttctcatctgtggtcgcttccgatggaatgggcactgaacgcacgctcgggtgctgcgcctatctacaacgcacgaaacctcgtcacaaagactagtcggagtcgatactgtggagatttagtctcgagtgaactgccggaggcgggctgcgaagctcactttcgcgaactcctctgtccaaaggcagctagggggtataaacaggtctgtctcagagatcataattcctagggcgatggtactggccgtactcgcgtaggaccagtaatcttttgcgctgtgaatgtgaatgacaagggtatcccaaatattgcacctcgaacgcaaaccgttttccgcgctattttcatggcggttctcggtgcactctgggtatggacgacttgggcgcttcgtatgtcgatggcagtctatcagcggggacacggaaagagacaaactgtctcaagaagaactggactgctgtgttgttgagaaaactaaagtgcatcggtccgatcagaagcatggtacttgctgacacgcaaacgaatggccagaaaagagaaatctggaactgtcaaccgaataaccgttcactgctgctgcatggagggagagggcacgcggaaatactcggggagacggcgacaactttttgctttcggaggcactagtaggacggtattacaacgagtcggggtaagggctgtacgtggcgtgtggagcacctcctggaaggaactgcattcccgctgccgttctccacggtttatagcaggtggagacgtgactctttgggagctccagcacgtcctctcgcagaaaatatgttgaattaagaagactcagtggcaagaatcatatgcgacttcccagaggcgcctgaatcgcagccaacacttgacgccaacttcacgcgcaacagtcaggtgtacatacaccccagccatatgccccgcacgacccctcgtgagcgtttttctcctttcttttattgattagaggctctaatacgtctgtccactctttttcaggtgttttaccaatgcacgtttgtcttgtcttttatctttcctctcatttgcgccttgctgtcccccaacaacctgtcacctccctggtctgctcccagacggtcttcccttcacttccccttgcttctgcaaagttttcactttttatctctgcagcagttcttgtcttgtctctgacgtctcccacgattcatcagctctcaaacgcctgatcgactccgacaagcggtatttgtccaccgcagatgaatgtgaaatcgcagagatgtgtacgtttgagcgctcgtcttggcaggcgaagaatgtgcttgcatcagtttagacaatgacaaacgcaagaacagctcaaacgaacctcacaatgagaaaagacctttccttcctcgcccccctccagctggctcggcgtctgcgagctgtgcatgcgttttcttggcgatgtgtgttactcggggttctgcgtgtaaatcgacacccggcggcgcctttgtcctcaagaacagtaccgccgatgtcttttcttcgcagttctcctggtgaggagtatttgttttcgtttctgcttttccctcgatcgccactgcacgcgggtacaccgcacgcttggcagactgcgcccttcttctcgccgcgttgccctgtcggttacttgtctcgacgcgctttcccttcgctgaccccatttcttcgccttcgcctcaactgtctcttcgaggcagagtgatggagcccagcagagatattgttctttcgtacgcggggagaaacacgcttctctcttcgcattcgtagactgcagcgcggcagtgcaggtcgcgaagccagccgcgacaacactcgagcacgcaacccagcctttttcgagtgcttttttccgacaggttttctctaacatttccctggactgtttcgcagcaatgtaaggcgcagataggcgccttccgggcgaagaccctcgcctgctgtggcctccggctcgcgcccgatctcgttatcttgtgactctctctcctcctctgcccccttcgcctcttcctctgctcttctctttccggcattcagctgtgtcatcgcagttcctctctccctttctctatttcaagggaggtttcgtctctttgtctcacctcgcctttccctgcgtacttgtcctcggtctccctttcttctcgcggggaaaggagcagagtcatttctggacgttccaagaacctggcagacca

SEQ ID NO: 2219 - DNA, 1847 bp, Toxoplasma gondii
tgtctaaaaacgacctggaagtgtgtctacctacctaagtgtcttcgcgacacaaacggatgctcgtaaagaacatgagccgtttccttcaggctgccgagcagccaccagcctctgccctttagtggaatcaggtcgacgatgacgccttcccgaatgacttcgagcaccaagtcgggaaacgcgggatgaccgcatgcctgttggatggcttcctccgtcgctgtatggacaccgccgagtccccagggtggaggctcgtagacgtagcctgctttcttgtcgacagtgccgggcggaagcagactcgcgttcccttgcggctggggagagccctgaagctccgctgaacttcccttggctttcgcggcgccagtctcggctgaatgttggccgaaggcgttcttgcggatgtgttccagagcctccggcactgcaaacgtaccggaggtcgcttctttctcgctttcagcaaggcatccagaatgctgttgcgtcgaagcaccacccggggaggcgttggcactggacgcctccatcgtctgtttagatcgcctcagaattgtaagtgcgtcagcagttcctcaggtagacacactgcctttaaaaacgtggaggtaaacgggtgagcacagcctcaaagactgagagtttcgtgtggctgcttcgccggggcatcaccgcagaaaggagctgtattcgcaaccgcaggcggtaagacgcaagtgagtcttcgcactcgacggaatgatggactaaaaacgtctcgtttttgtgccacctttacttcaaaaaagcagctacagaccatgaaacataaaaagcatggagttacgcccgaaacagacctgtgcgtggcacatcaaggacggtgatgaggaagcgaaggccctctggattcggtccagcgcctgcagcgggcaacccgtagagaaagctcgcaagaaaagggcagtgcacgagcgttgttcatgaggacgaagaggaaagacacaactaaaaaaagctgagtcggcattagttcctgtctgcaaaagaaacaacaaagagggaagaacttggaatgcctcgaaacccttcgactggttctttgaaccgtgcatgcggtcgggtggccttcacacgcatgcgcggtgaagatcgagtatgtcggatcaactacgcacttcatttctaggcattaccattttctggcagccagaggatgacgaagaaaaaggtgtgtttcggcttgtctattttctcgctacttccgtcatccgcaaattgccgacgacgcggaagcgcacgcagaactcggcataagcgtcctctgtgagcttcatccatagccggtagccagcatgggaagcttggggcttgccgcttaagcttgaacgctttagtactaccaacgccggtatgacttccgaagtttggtgtggacagcgaatcacttaaatatcactgctctatggctggtagggtctgcacagcggctgtagggcgctgtccgagtcattccgcacgctgcagcgagacaaattgtttctgcattgtggttgcctggtgtgtacgcgtgctctgtgcgtctcagtgcctcacgaatctggaagtgtcaagtcagtcaaagagtgttgtggttgaagctatcctcccagtgttgccccggaatgcgcgtgtgaaggtgtcttgctgtgctgttgctcatcaatctgcacactccaacgtggctcaatgctagtgcgtgcttgtgtgtggtaacctcgtctctatatatatcttggcgtctctcacggcatgaattttgattctgtctctattagctgcggtcatttccgaggcagagcagaggcggttcttgacca

SEQ ID NO: 2220 - DNA, 3118 bp, Toxoplasma gondii
ctcagatcaatcgtcttatgttctcttcttcctgagagcaatcgctgagtctgttctgcagtttccgttgtcctggtttgtctctttcggattcctccactcgctgaaactggcctcaagttcgccatgttttaggactcaagttaaacgttcgacggtgcggttcctccgtccacatgaactattttctctgaagggtgtcgactcttcgactgggactacatgttgacacaaagaaaagggtctttgtttccagatccgagatccactttgcgtttcatggccttggtgtgaagttcactgagcattgcggtgtccagcgtctgtgtgaaaaccaaggtgtgaggtgagtgagacggtggcaacgttcgcactggatgtcgggaccctaagcgagcgcctacgctcaaggagactgagacactccccctgtttcactcggtctggtgccagagaactcgccaggtttcgctggaatcaacgtcttggttcagggtacaccgaccatcaccgactttcgaaagaattgctttcagcactgcatcgggtgcacagcatgcagaaaaactaccatcgggtgcggtgtgaagtcgcgttgagaactcgttttcttgtgaaaggtggaattgtctgccggaggtatgttcggagacactctaaacctgtttcatgtaacgccaggctctccactgcacaggactacttcgtttgttgacttctggcccttgcatacacccagagaagccagctgagtgtgagaggccaaccgaggagccgctttttttcgtgagaaatcgaattcaattggatggtctttctgccgccgctcctgccctcgacaccgaaaaccctgagggggcacccctctgtcagcaatttctctgcctgttcaaacgtaggattcaaggcatcgtcgtttcctttttctttgtagacctctgagtgtttgtggaggcaactgtgtgtggatcctcactgcctgccactctcgggaagttcgaactgcccagctttcgctttctctgctgtctgcatcatttttatcgaaacctgttccacgttttttgagaaattcactcttcgcgccggactgaggcaagtaaacgagtcccgatcccgtggtgcagtcagtgacaagaaagctcttttatggtatcgtccggcgaccttaacgttcctccacgtcggtcctgttctacgcgcaaggtgtcgactactacgcaactcaccttgcagcgcccctttcactacttcagtgacttcctgtgttgcagaacatgcgagccgttcggacgaatccaccaagcgttcatcgagaaacagggcgcagggtgaaaacgaggcatctgcctcgcctccggataaacgaaatccccagcttcttcagcacaacttcctcgagtgtcctttcctttctcagtacactcaaacagattcggttggttcttttgtgggtttgtttttgacagagatgtccaggaagtcgccagatctatcttttcgcgtcaacacccgttctcactcgatttgaggatcttcttgcgtgtagccctatctcgtagtcaggcccccttcccgactagacaagttccaggatctaacttttttctggatctaactttttcctgtatttaactttatctagcatttaacgttttggtaagaaacccagaccactgccatgagtctctctgtcggagtccgcgttctcgtttgatgtagtctctgggcgtctgtaatgcctccaagttacttcggtacttccatagaagttaattttaaacgattcaggtgggagccggacagttcaccgtcagaggcaagaagtggtagattaaagagtccgatactgccccataacttgtgtgtgaacagctgaagaaagccactgggttctcggtaaacgctcggcggaactttctaagaaccccagaagacagtttcctccctctggagtgctctgcgtgcttgtaaccttgggggtccgtgcctgtgagagtgaaggtgcagattcacggcgagtaagcgacgagaaatgaccgaaaatgcacgaacaacacggtggagactccctgaagaactgcggaaagaaaaagagaagaaaggaacttgcaagcgtgagacactcccgaggggacgtcgaggcgacgccccagagcgagtgtgcggcagagacggttgggagtttgcggagaaactcgcctgccttgaacgtttcctccctccttttcacacgcaaggcaagaaaggaaagagaaatacaagacagatacaaatcttcgacaacgaagatgtcaggaagggaaagaagctcggcgagagtttcttcagcgcgccgaggctttgagtggaaaaccgcgcggctggttgaacgccgcaaagcgccacgaaaagtcggaagtcagcgtgtttagtcaaaatcggggacggctttctctgcattttttctctgagtctttctgaagatttctccactcttactccgcatgtccactgttttctgcgggcgtacaaccgaggaagaaccgcgactggcatgtcctgcggcctctgagcgcctttcccgctgcgtcgagtgtatgtacacctgacctcccgggatacggaaaaaagaagaagaggagctgttcatttttcatttgtagtcggtccagttcaccggggaggcttcgttctttctggaagaggagtcgagtttttgcgaggacacaaggggagagggggattctcaaaagtcgacttccacttctgcaaaggctctgcaagcggcgtcgagttttctcgagtgctgaacatcagaaggaaccctctgtgtgttctctgactcctttatccttcttctctctctccttcttctcttcgtcgcttccacgcttgttcgacttccctttctccccctcttccccctctcttctccctcttcttcccttcctctccctttccttcctttatacgctttcgttccttttccccttctgtctctgtctttcggtctgaagcttgctttgcgagaggagacagaggagatcggcagcgacgctcgactcgcgtaagaggggagataagcgagaagacttggcgactgagagagaagccgctcgaggagaagggcagggga

SEQ ID NO: 2221 - DNA, 2445 bp, Toxoplasma gondii
cgaaactgtgtacacgtttggccctttacgtttgctgcctgggtttcccggtggggtgcgatttgctgccgcggacgtgggggtagtcggatactttgagttttttttcgacctgcggattctgtaaaagcaatgctctagagaagagggaaggcgacatcgccgtcgtgtatagggcgtttcgttcttttctcgcgtctgtctcgggtccgtcatttgtatcggcgctgcgtgcaaagagtgtgttttggtccactcaccaacacaacaggtctctcttgattagtactggtttccctgcgaaatgccgaaaccaaaactgcttctctgcaggcgtgagccacgcgaacaaattcaaagagcagcggtcacagagtttcggtgttctgcgtcggcttcggcgccaaagtccggccgtagggtgtaaaggcgcggtgcaagggggcctcggtgcgagtggcgcagccttccaactttttgcagaactcaattcatgacaaaactcacatcaacctacactgcaggctagtgccacgatcacgaccagcctgatttgccccagacattcctttgtgtcggctgttctaccatagcagatactgaacccacggtagccatttggcgtctgtcctcagcacatgagtataaagcaacttaaagcgcgatatctatactggctgtggtctcctggttgacgtcaaccactcgagcgagttccagaaggaacattttatttgcatgagacggcgatgatgcctgttggaaacttgcctctgttcagttgcgtgtgcgagcgtccactgcttcccgattttatcacgggtacggagaagcaattacaccgctcacgaaagtgggagggaatacgccgttgtgactctatgagatcagtgctcggagaaaaaggaactcatacttcgatcacgacggtgcgagaagcgacgtgagctcgagcagcctcttgaaactagccgtcgacacggggctgtttcgagaatccagttttgtacagggtcaagatttctgcaactttccatgcagagaaacgcaccggaatgttcaagaatactccccccagcacggatcaagaaattgacagacaccgtacgaatatcgagttcgaccttaccagtagtaaccccttttctatcctatactttgtcaccccggcttgaagccgttcacgttcaggagggcaaggcaacaaggtggccgatttgtgtacactttgagcgcctgaggactcgcaagcggctgagtgcccgtatataagccggcgcacaaaaaggcggcttcaactttcgtggttctttgcggtagaagcagcaactgcgaaacacggttgtttctcgggactggtaaacgtgtaatgattgcgttctcagcctattttcactgttgagtttaccagttccttgcagtttcaccctcccgcccttccacccgcacttagggcgcaagctcttgttcggttcgacttaacctagcaagtttcagccaaggaacagcttgagcactccctaagacaaatagccaatcgccactgccacgccacactctcgaaaactggaaaccccgtgagacctctccgctgttctgactgtcaccccaccatccggacgcaagtcatagtttgcagcgtccgcacacaagggtggaaacgggaaatgctgcagccctggatctgtagctctgcttttctacgtggagactgcaggaaatctcaatacctgacacagagcccctcaacccgttttggaccctccgcaacagaggactcggaacatttaccaatgttctgcgagaggtggccgccgtgggcaaacaattcgctgggatcacgcggaagagaaagaaactttgcgacaggagccgcgcttctccgcaaagacgaacggccggcttctgccagtcgaacggctgggaaccggaaaaccctgcaggtccggcggcggccggtcgttgacttttgtttttcggccaaaaagacacttttatgcgctctctttccggactttgaaaatctggtgccttttcacggaccaggttgcggattttttcgtcgaaaagacgcgttctcaagccctttgaaattattatttcgcgtgaactgcggcgccgaccgagctgcgcgccgtttttgcgtctctttgtattgtttgtgtgtttctccgtgtgttgtccgtggttcgcttctttcgtgagtctcgtgtgtgtgtcccgttgtcttcctgacaccgtgcgtgcgtttttgtcccccaaaattcagctccgtgcgccctgcccctcgcgttttctgtgccccgtgcgttccgttcagtgtacatgctctgcgtgtttcaaccaaccgtcctctgccaagagcctagccttttctcccgcttcttctgcgtgccgtttggccccgttgtcttcagcccgcctgcacctcgtctcacctcgcga

SEQ ID NO: 2222 - DNA, 4138 bp, Toxoplasma gondii
gaagaaggtcgctccaggacagaggaagaggccggcgttttccaatgcatcacgctgcggcttcctccacccacttctgatgactcctccgcggcttctctgctcttctgacgggtgtctccctcctctgcggagtctgaactgccgccaggagaaggcctgacagagaacgagagatccgtggtactttgtggctgtcttttgcgagcggcgattcgcccggaggagcgaagcagcgacataactctggtaagaacaccggagccgccaaagcggctgtcctgcccacgtcgagtaccacacagtgtaccgacacccgaagagaggcgcgacagtggccgggaggcggaaggcgactctggggcagaagacgaggacgtcgcggggaggtccgcgcctccgcctgcagaccggcttgacttgtggagggctctcacggagacaaagcgcccacaagcagggtgagaagcgacggagggagacaagccattcagagggtccgacagaggctcttccgcacctcccgcgtctccagagatcccgggacgctgctgactcctggcgagcttcatcgtggtgggcgacgaagagacggccggacgcgggagcgctggagacggcgagaacggagacgttgacggacggcttcagaagcaatgcggtagcaaactgtgttggcagcagcccggcgacactccgcctgttcaagcgaaagacatttttgacgcgtttgtggcgcgacggagagagagaggctttgacgcgacaccgatggcacgaaacaggtgacgaggaggtcgatgacaaagtgagtagccccaaagaggcaatccccagcacgaagggggcgagaagaggcttgtagaagcaaagacagacgtttctggaggcaaaatgcaatggaaaagccgagaaaggccacagtctccgggttggaaggagataaagggtcgagaacctcgtaaagcatgtacgcgttgcccgcaagcggagacgcagcgggggttgctcacagaggcgacaaacgtctggcgcgcgaattagccagaaatcgggaaagtgaaggaaggaaggcgtgaagcgcgacggagacacacgcgaggcgggcgggagacaacgcgggagattggccagagagactggcgaagaaaaaaggtttcagtagcgtggaatgcagagaagaagaatttcggcctctcgaaaaggcgccgaaagtcaagtgggagaagcgaagctctgtagagacaaaaaacgcgtgcggaaatacccgcaacgacgggaaaaaggagcgaggaagcgcgcgcggactcgagccgctgtggaacgcaacgcaccgggtgtctcggccgacaaaggcgaaagcgatagccttgacacggcctactcgaaaggacaacaagaatcaccggggaatccaccggaacgcagctttcctttcgatacccaaaaacgcgtttcctccatcgacctggacgcaatgcctgcgaagcgcacggcaaaccccgatgttcaacttctatggaaaacgcgtgtttacgttcacgggaatttctttcgtttcttctcacgcaatgaccgcacggaacgacactggacacgcaaacatcgtcgtgggaggagaaaatgcgaagggatagagagttgacacaagagtgtcccgccagttccgcgccggctgctgatgtggcgaatcgcggcttccggcttccctccagcgccttccgagcaagaaaaacccctcaccccgggaacaggacttttctaacgagagcttgcttgaagacacgacacaaaaacactgcgttcaacagaaaacgcagaaggggaaaaagcatcgtccagtctccgcgcgcagcagacttggactgggtgcgacaccagttgagtgggggcaaatgcgtcctgtcccttgtttctagctttacagggaagcagtacagagcgtgcgcccacaaactggaaagaaatccgtttgagagatgtgattctcatttatcaatttggtacggcgaagaatcaggcgtgtaaagcgaaaagagttgcaggcccgacgtacccacgaacaccgcggccgacaccttgcgcgctgcgggcacaccccgaaacccccctttttaggagcgacacgaaaatgccacaacagaccgcagttcgcggaatgttgaaactgaacgctagagctctctctgttgcagcaacgaagagaagaaatagcctcactacgagggtcggtaaaagcaaaagctgcagccacttccgcagcgccccgtaacaccgggatctcgactggtgagtcgcgctagttttacagagttccggagcgccccggatccaccgaataccagctaatgcagtgtatctgctaccaagacagattttagagcttgctgaagtggtgaggtgaacaaatgtagggaactgcctgtcttcaggtctcctctcgagctgcggaaaacgtggttttcctgaggtcgcgagactgcggcgccacaccgcggatgttgagatgagcgggcgcctccccacgggataactgctcacagaaagccagtgttttcggcgatcagaaaaaacgttagacagaaacgctggaaagtggtgcaacgcacacctaaccatggaaggcgccggatttccctgaatgtgtagaaaaccgagacgcgcctaacccgtctgaggcggctgcgatggcaggaatctcgtacgcactggcaagcctacgagtcgagacattctgaatatcctataaagtcacgaatttccaatagctatcacctctcttagactgctagttccctccgtgcttccgtgactacccgcacacggggattcaaaaccgccaagagttgaacctcgcggagcgatacggtttgaggggggtagcatctgtgagtcggtacttgctctagttgtttcgagttccttaaactacaggagcattctgtgtgctcgcctccgtgttataactgaagcattcggacctagtcatgtcgacgaacgtgagagggaatcattttcgaaaccagtaccgcaacaccgactgcggactgcgatgacaaaggctggcgggaaagtcctagctgagcagcagaccacaagggacagaggctttgcgcgcgctcgtgctctcttcgattttaagccgacaaaacccccaaagcggagtaagtgagaacggaagaagtgtatgtatccttttgcgaaagagaacagggaaaggcgtctgggccgcgcgcgcgacgggttttaagccatgaccgagagaaagctggttctttttctgcttggttttgcgcacgcactgacagcagactactcacacacacggccgtcagaaaagcggccgcaatgaaggcctgatttcctgggtggagaaaagaaaaggagagagggtcgtgtcttggagcgttctcccgagtctccactgttttaccttcgccggagcgtgtgtcggggaaatccatctgtctcgtgaatgtatgatccgctgcacatccgcaaacttttcgggtgtacgtacaccgtataataagctttctacataacgaacgagccgtccagtttttggtctcgtcccttcggctctggacgaaaatttcgcgggtgacatcgccgagccacttccgggagcaggccttttcttgtttccgtgctccgccaccgcaaactgtgtcatcgttctgtcagttctcttgttctcaccacgtttcctcagggtcttcgaaaacgtgtttctgtgcgtatccgcataagccaaaaaggcttgcgtcgacctaaaccgccgtcttgctgagtccccgtgtctacctcctccagtgttgctgtttttctccgttcgagtatcctttacgtttcactctgacttctcttcgaacggatatttcccacctcagatgcagcattatctctaattcggaaccgtaggcacgtccgcttgcccgttcctccgttttccgcagtagcgaatcccgttttttccctctcggcgaagaaccagttgtcttgcattcttcgcttcccacgttggcacactccgcgtttcacctacctgttggctccggtacgccgttcgtcaatttcgtctcttcaccgttggtcctcctcgattttctttgactttctgccctttccagcaaaa

SEQ ID NO: 2223 - DNA, 3749 bp, Toxoplasma gondii
gtcgttttccctcccgccttcgttgtctttctaccgcatcgttggctttctaccgcatcgttggctttctctctcgttgctctgcgtgtctcactcttcctcccggcgttatttctcttggcttcctcagttctttgctggacgaactggagcgatcccaggcaggcggcagtgtgcggtcaatcgtcgtgcgccttctgagtcagccggtggggcttttttcagccatgccgagacacctgagagctccagaagcggcggcgtttgcagagcgcgaggcgagcatggagttttcacgtgacgtttttccagaaaagacttcctccgacttcggcaccgatcgctcagcggtggctgaactcagtcctttgagcagtcggtcttggcgggacaagtgctaagggtcgaacgactaaacacgccgctcgctcctgccagaggaaccacggctctctggaggaatggagcctcagcggcaacaccgggagggggaacgcgcgggcggtaacggagcggtcagtggggagagaagtggaacacacaacgtgaaaaaaactaaatggcgatccaaagtaagaggaaccaattgtgaaatgacacgtgcatcaatatatatatatatatatatatattcatatgtgtgtgtgtcttttgagatgagtatgttggagatagacaggagtgttggagtgtgggaatgcaagcagttcgcaacacgaggcaaagcctcggttttgtgagttttctgaaggtcagagggtccacagatagctcatatggattcctcgattcggaacacgtgcgactgcaataggaggtgtctgtacacagtccggggaaaggtctgaacagaggggaaagaagcgcggcgttcatatgtttcatactgcagtggaacgcctctaaggacgatgtgaatgcgggacgataatacacgagactggataatacttgtctcacaacacaacggcgacgcaaagtgagaaagaggcacaagcgttttcgatgggtccctcagctagctacaaaacttttttatgggttgccgtacgcagttaggtgcatgcgaatatttgacacgttcgtccgatgtcatttgctttcaagcgagtggtgtcgtctcccagaagacgcatctgtgcgggtgtcaagggatatacgtcgagggttctcccttatacagtcttatgttccagaacgtatatcaatctagttcgtgcgtacacacacgtagatcggatacgtgggtgctaactacagatatgcgtattttatccgaatgtgtgtaactgtcgcacaagatgtgcgacagtttggggaaacgtgtccagatgcaacgagttccgatcaagttcttcgttttctgcgacatgtagctcgtgccttgcgagtagagcctgtcggattatgtctagtacccctgaggatcagttccttctgactccgcttctgcgtgtcttctcttccgacaactgttgtcttgtgtgcttcatgatgcgcgttggctgacgacatcacggcgggtggatcacttcagggattcgttttttgtggcactctttggctctcgtgtgcgggacgacttcgggctgtttcttttccttcgttacgagacagggcactgtgtgacctgctcgctgattgtgttcatgtctgatgttcgatgatttgctacaactcttatgggcaggctatgctgcctcggtaccctgcactgccgggtccgtttttcattaatgacctcaagaatggagatacgaaactcgaggttttgtgcaaaagcgcacgttgacagcacgcgaagaggcttcatggcttcgacggacgaaaatgctgtttagcgctatgcgacggatgctgactaagaaaaaaaagaacactgacatgcgttgcggtgcaaaatattcctggtgacctgcaaacagacgagtgtagacggagatgagtattgcggcagtttctttgctgatgacctgtcccagtccatatttctttcccttgcaccgctctcaccgggtcggatgcgtagtagcttgacttgtgtgcaccatttgcaccccttgatatcggcaattttcaaaaatctaaagcgcccttatcgtcaacagtacgttgtagtagagcaacgaatctgtggtactgcgagagctactgaaaacggtttaatgaatcgaacttttgtgggttcgggtttctgcgtgtactgaaaggtgccacatctgtgcagacccgtcttctgtacacagatgctgtcagcacggagaagctttaagctgtggtaagtggcgcttgcctggtgatgacttttccaccgccaaaaaagtgccaacggacaatgatgcggcgtactgtcaccctgagctgcgtcagacagtttgaagacacgaaatatcgagtagggaaggcaggcgtccgtgggggaacgcctgttttttttggaagtggaactggtatcagcagcaaatgaaagaacggtcttcctccgtaagggtgcctctgcccacgttctgtgtgacggtcgctatcctgcttctgtgttgtttcagtatttcagtaaggcatggtacccgttaaaagactccgctctaaaccggtggaattcagcatctcccatgtttgtgtgcttctaaggggctccgaatgcaccagcttccgcatccaagaagcttctgtatttctttcgtgtgtacacagacaagtcttctggggtaggagcgccgtgtgtgttgagtgacgtgacacaatgtcgtgactatttgaagcttttcaagaaagggtctttgacgcccagagagatctagagagaccgactagcgggatcacgcccaaacatacgcagccctccggaattctttttgataacttccgttctataagatcacctttttgtgtaatggcagctccctgcagatcccgaaaagcagtttaactattgaccttgtccccaccgtgtgcgaagttggaccagcgcagcgaagactgtgacaaaaaactcgaccggtctgtgggctcaacgatgcaagtgtgccattgggatccggaaccgcgtttctcagctgtttgcgcttgccaactttggacgcgttttccagttcttttgctttcacctggagattctactgtcgctaaagagcaccgtcctcgttctcccgtctctctccaagggaagtgacgcttgacggagacgaggaacagcggctgtccgcgccgcgggtcagagaggtcctttctgctagacggcccacgggtgccacgcgcgcgagccagccggtaacatttcggtcaattcgaggaggttcgcatttttctgacggcatacccttgtgacttcccctccttctcatctaaagtcaaacgatctgtgcttttgcctctgttttcctcggtttttctgctgggcagtgcgcgtgtagcccttcgaggtgtgcatttcggccggagagcgtccctaggtaactgcagcttttcggagccgttcgtgtgtggaagcctctgctacttacgtgatctgcgtatttatcgtttcgcagatggttttattttcgtgtttacaaagtcgactgggaaagcgctagagaatcaggggtttagctcactctcatcaagtcgctgtacttcctgacccgcgcatcgtctagcggtggaccgagacggtttcgtctagaccgtcgagagggtgaaactcgagactgcttggttcactcaaaatccctccgttcttcagaacacactaaccgtttgaaacaaca

SEQ ID NO: 2224 - DNA, 1924 bp, Toxoplasma gondii
atatattatgcattgaccgttgcaaattgagaccctgcaaggaaccgcgtcttaattcgggatcttcattgatattttcctgttatgggcatatccatgttcctgatggtggcgaaagcagccgctttctcaggttcgtttttttgcgattgaggcagctgagacttcgctccggcgtcgtgctccacagttggtacacttgcagaatagccagtgggaagcgccgtagtcagctggaggaaccttgcaaaggctgcccacagaatcccaccgacggcatgctttaagccaagccaccaaaagtcagaacatggttcccgattctgcagttgtgctcccttacccctatcatagcaaactgacgcccaagcagcagacggagccgcgcgcgctggccggccggccgctacgttcgtcgaggaaacaaacgcgtccggaagctgttaagaagcatccaaacggttccaactatgtactgaagaatctcaggcagtcgctcttccatgagggttggtgaccctgcttccatttcttgctgtaccggaaaacaagaagtctgcacaagcggaaagtcctgtgctctgagcgctgtttgctgcatgccgaggtccgatacgtgcgcctttcccagtcaaggacccatggaatttatcctctttgcttcgctcaatatcaattcattcatagggcatggcatactcatgctggctgccttattcattcgtagtcacgtgcacggatagcaacgcagaaagacagccgaccagcaaactcaacaacctaggatagttcccctttgccaggcacgtatttgaaaatggagcagtcctggatatagcgtccgtgttttgaggtgtctagaagtgatcggacagaaagctgaacactgccaccgtcccgccctcccccactcccgtgttgagcgcacaccgttcctgagccatcgtgtggccaagaaatatgccagaatcacccttatttggtaacgcatgtgtcatttaaggcctttgattacctaagagaaactaaatttgcagggaaggattttctttctatgttaccgaattcgttcattatattcaaaagtgagacggtaggttttagtaaaacccgccccgtgagcatgagtagtttgcaaagtgcggtgtggctggtagcattgacagaggcgctgtgcattaacactgatcttgacaggctccagctctaatgtttccaaggagtcccccaagacagataactagaaatttgaatgtacctcctctgagtaacgtcgtctcaaagcttttaactaactggaaaagtgaaggttttttgtgcgcgtgcacacgctgtcttttgcatgcattcttatcgcccgcggaagtaatcgctcaagcatttagcttcattatcgagttctctgagagcccggcgagacacggttctgtttcgtcatctgtcagcgcggccgatctcaaacgcataggaacagctctgtacaggcactggccgctggagatgaatgaaagtcaacaagatttcatttgtcgtcccaaatgtaatcacccacctcgcggcaactaaatttttttactttcacctcggtgtaccatgtgggttggctgtcggctgcttctcttacgaaagctccctgttcttcatgtgtggtttcgcaacacaactatcttttgaagagaatttgattcgggctcaaacggcccacagacccaacaagaggatttgagggcgtcggtgtatacgggagtctagaaaaggagtacaatgccagtgacatgcttctttactgttttccgacacggaatgtggacatccgttgaactgccaaaggaggagggcctctgtttaactgtgttcaagaaactctgtgcgtgtatctgagagagcagaaatagccacccgacaagacggacgccggcaacga

SEQ ID NO: 2225 - DNA, 3593 bp, Toxoplasma gondii
atgttcgtgactcctcaggacttctgcgatgcctttccaccgtcgaaagccggtggtcaccacgcttttagacaactgggaaaacaacttgcagcaaaagcagtagaccgcatcgcgagtccgggagtacaccagccagcttctccacagcttctcacccgacggtaacgtgcgccagtagtgctggcgaccgaaccgtctctgagtggcgtcgcgagggtacgggaaatcgacgagttgaacagggcctttcttcacgaggctccatcggagttcctcggtgatctgtgagggccacagggccaggtcgtccaactcgtcttcgtcctcaggggtccccggcgacgcccgcaaaggcgccagcgccgggaagcccccgtcatggacctgctcatcccgcctttcacgtgtgcacacacaacgcgcgacgagtcggggagaactgtggggcgacaccgggcctggaccggaggactgtcgcgggagtcttggaggcgaagacgggctcaccgaagaggtcacgctcgacgcgtcatccgagaccggcgagagaaacggagaaggcggagaacagcagctgccgccgctcccgtcgcctctcaagctcgaacaacaactcgagtggcgggtgctacagcttccgcagctcccgttcgagcccccgcacggcgagaagcaatctatcaggcggtctcggccttctgcggtcgctagaggcgagagcggggtgcctggaccggtgagggacggcagcaacggccgctgggtagagcactcatctcccatcgtggctcccgcgcttcgacaccgctgtccatcacctccagactctgcagatctgagaacgtggctcaccgcggcgccgtcatcccccgcaccactactccctgtcggctcgattccgtgcgcgtgccagttcacatcaactctctctgcgccatctttgttttccaagacatccaccgcttcgaggctgtcgtggctgctccccctggtgctcctgtgactgcggctctcgtccaggagcagccgccacgactcacgcagtgtgcttgcgcacggaagccgtaggccgcacgaggtcggcgaagtggcagccgagggagacgtcaggcaagggcggtgaccttcatcttcttcacagtcgtcttcgtcttcctttcccgactcccggctgctgacgcaccagttccgcgtgctgctgtcgcttcttccgcttgcgtggcaactcggagacaggagcctttcttggttcaccggcaaccgtctcttctcctcgtcggctccacttgaacagcagtgcttcttacgctcgcttcctccctccacgcccgaatcttctagtatgtcacagtgacgaggtcgtttctgtcctcccgcgtcctcgtctgcgccacacagtgtcaccgaagacccggcacctctctcttctgtccaacagacaagcgccctagcgcaacagcagcacccgccccctgtggatgtttctggttggctcatgagaggagacgaagcggacagggtgcgagcttcatagcgcgcagactcctctcggatggccctattcaggtcttgccagttttcgtagatcgcctcggaagttactgtcgtcgagaggaaagagaacagggacgcaggttctacgcgattcttcgccaacagttcccgctttcgctttctcttctgagcaccggacagctgcttccttcgcaccaccccttgcccagttccggttccactggtgctcgagttcggactgaaggcagtgctgccgcatcccgtgctggagggacaagtggcccccggtgtcagtgtgtccgccgaaatctcgcgcgacagatctgtgtgcagcaccacattctgttcgggagatacaaacgcgcacggccctgtgactgcggcgagacgagacgagagcgcttcttcttccacggctgcgtacgctggagtggagaccctcggagaggcttccaagggagaagaggcccctctcacccggaacgccgaaaagaacgaacagacagttgacgagactgctgctgacatcatcgaggagaaactgagcaacttccactgatgcgagaaggatacatgcagggatatctctgtgtcgccagtggaggcgcggccgctcgctggcaactaactgcagggagttatggatcttcggagatacccacccacgcgattcccaaatagaaaactgggaagcgtccacggttctaaattagaaaaccgacgaaggcgcccacgaccccgctttgtctcgcagccttcgtttcgagagacgtccagaaaaccggaaaaactataggatgctcaaccacggaaaatacccacaggtgtgccgcagctcggtagcgctggacgacgagtctcgtcccctgtcgcaatccgctccgcgagacctcgtaggcagctgcagttcttgtccctcaaggacagtcgatatatgtaaaatcctaaaaatggactacagacatgtacgcggtggtccgctgcgattcctgcgactctccctccgacatcgcctctggcaacgagccgggaaaacaatacaatacagtcggaggagatccgtgaacacagaaagagcggcaggacagcgaccttcacctgcccaccgtaagatgctagtaggtacggaacgcaccggttctgagggttcatgtattacttcgccacaagagaacgattcctggaaaacagtccgaaactgtttacctgcacaaagtccccccgtgccatccctcggactggtccacggacagttgcggttgatcgccgagttcggcgctatcccggaggatgtcagtaacacgttcttttcacctctagccgcgctggggaacctgacgacccttcctctgacatacacgcggcggcactcaccgagtgcagcacaaaacatgacagaaacggccggtcccgggccagtttctcgatgaagtgatctacggaaaagagcgaaaacggaaatgcgaaagtgagatcaaggccaattcggaaagaggacgagacacaccgaggtcaccctgggagagaggaatctggccgtttcgcccggcttgtaaaccctgtcttccagcagtcctggccaccggcgcggctcaccggggtgagttcagcaatctggagtgaatccagcgttccttgattgccaacgaaaacccccaacgaaacgaagcagaagtgacggtaggtatgaggagcctccggcgaatcggcttgagaacgcgcctccctctaccggtcgtctctacgccacactcagaaaatccggattgtccgccgggccggaagagacgccgccgaccagtccccaaccgtttcgctggccctctggcctatccaaaggtgcgcaagggtccccctctcacttaccacagcaggctaccggggtcgacgcgcggcagaaattgtgctgagaggcagacggggacttcacacgcgcgtcgaacctattcggacctactcggttccctaggaaaaacttcgatgatcctccggaacgctggacaaacaatgacaggccagtagctgaccgccaagggacacccctggaagccgttttcagagacgcgctaggacaa

SEQ ID NO: 2226 - DNA, 2405 bp, Toxoplasma gondii
cgtcctgtgcatccgtttaaagtagcgcgcagaaggccgtccttctcgtacggctgtcgatactttcttttctccctccttgcctcggagactcgcggccggagaagatgcgcgagcatgctctctcgctctgcccgacttcgaacgtaaaaccccacaggctctgaagacgctccccagaaagaagaagaaaaagaaggaggaggctctggaggcccggcgctacagaagaggtcagcgagcgcagacaacgagaaaccaggagagagagagtcacagtcaagaaccgcggaacgccgcggttgaacggagaccgaggagtgacccgacagagtggagcaggaaggcccagaagacgcacaagccgagggggaaaaagaagaacaaggcagagaagaagaatccgccgaagaggaagaatcacaacaaggcagagaaggagaagagggagagggaggagacgaacgagggaaacggcaaagggaagaacaaggcgaggagggcaaggagctgcacttcggtgtgtggctgatcgacagacttgacgaagactgcagtgctgtacctgccctgagcaaacgacttgaagaggaaggcaaagcgacgagagtcgctacggacgaggcagcagcagtcacatcgcttccgacggatgacccgtatctcccgcgcttcacctgcaactcccccgtcgagagtctgttcaccgctcgcctcttcctctcctctctctcttttctctcttcttcttctcttcggttcgaggagtgccgtccgcctcgctgcagagatgaaggagacgcgagagcaggttctgggcgcagcgagagaggaagcgagtagaaactgacgtcgaagcagtcggcttcgccctctccctcgctcgtgtcttctggactctctctgccggcaatgcgtcgcgtgtctctgcttcgattttcctcgtcttctccaatgagctgttcttctccgctctcacgtccttcgttgctgtctccggtggcgtctccttgtgtctctccctcagagggggcgatggaaggcagtccaggcgctgcgtcgccggctgcactcactggagaaggacgagacattttttctcaacggcgaggaagagcctgtcttgacacagtgcatgcacttcccgccttcgcctcggcgagaagacgaagcgcggcagaggagagacgaccaagtccaccaagtcgcgagtctcttcggatgtttcgtggcgcaaacactcaaagagctgcgcagagcgcttggactcgaaacagagacacggagcgcatgtggaaggggaaagcgaggatatgcggttcttcctgcggtgtctccgcagatcgctcaaccacggactgaggcgggaaactcaggaagttgacacgacgccgagaaccaaggacgcaaaaagcttcctcctcgttcctggtcctcgtgtctctcttttcttgctcgggtgaggcttcaaaccgtgtctctctagagcccgcgcgcgatgaacgacgagagagccgccgaccccccgacaggagagcatgcgcctgcgactctttttttccctccgtttccttgcaagacgtcaagtccaagacactgctcacagacagttgcctttcctgtcgctgcgccttcggcggaaaaagttcgacagtgcgggtgtcgatacacggcgcgtacgcagcttcttcgcaggtgggtgcatgcagagggagacacatgaagacagcgcgttgggagcgccggagggacgagaccgttcctgttcttttccggtgtctctttcctcttcgtctccttgtattcctttgtgttctcggagcgtctcccgcctctctcagaaagcagggatcccgcgcgtgagaacttgcaccgctcccgacaccgggtacacgctgtctcggtgtgtgtgtcttctttcttgttcatttgcttcgctctctcgaatgtccaggcactcgaaagaggcgaaccagagcgcaaagaaagaacaggttgaaattctcgaccatttggaacgtcacgcagtttccgaccctcggtgcggccttctgggctcccgttcccctttctgctctcggatccctgcctcaacttttacgatggtcttctctgtcgtttctctttaaggctcttctccttcttcagtgctgtttcacacgttcatcttccacgcttctgcctccttgtcccacccttttctccaatttccttcctcttctctcccctctctccggtttttcctctctctcctctctctcctctcctctctttcctctctctctggtttttcctctttctgtttctctacattttccttctttccccgacgagaatctgtccaccttgggtgcgtcgagtgccgctctcggttttcttcgcctgttctcgcctgctctccagca

SEQ ID NO: 2227 - DNA, 1538 bp, Toxoplasma gondii
ctgcttctccactcgagacgttttcagcctacgccaacgcagttcttccgtgcgaagatgcgcaggtcgaagaacgcgttcatgacgcgtgtttcccgtcgacgaaactaagtctcgccgtggacagggaaatttttttcagaagacatgccaacgtcaatgctcgttcgtttacgtagcgtgttacagtgtttcatcctttgtgtcattgggtaagggaacgcgccgcggtcattactcgttttttatgaacgtgtttgcgctgcattttcagcttgttgttttgcagcgcaacacggttgccagcgtctccgcttcggtcgcagtgttacgctttttttggttgtaattgtcagtgcagtgcatgggactgtacagcgttgggcatccgtgcttttccttcaccggcaacaagcgcgtgaaactcaaaagatggcatcccgcttctgtccttgcacttgagaaaagcatcttacaaggtgatcattgcgtaggtgtgcacgtgatcaacatgtcatcgaggaggcatggtgtgtttcgtattcttgtgtactgcgtttcacatgtttttttagaaacggttatagtggctatgggtgtatacagagccttggtcgttccgtaacaaactcgatgcgtcattgcctagatcgaagacgtcatgctaaacagtgctgaaaggcctgttctcatttatcacgtgtacgaacaatggcacagactgttgaaaggacatgccacggccggacccggacaaggcgactctgcgaggaggctcagaaagtctgtctagccatgatcaaacgcccaattgtagaatgcatttgcgagtgtgtcacgtggtgctggctcgtttagacatcgaatgataacaattgggttgacacttgctggtgccaaaactgtatccggaaagcagctcgaaaaccagctttttatttctgcagcacatcctttgatggatacatagatgcagcaaagagggaaatgtctttggcgcatcaccaggcaggcgctgccatcttcctgtcagctgcttcatttcttctctctcagaaagagatcgaaacgacaaacacaacacacatctgtgcaatatagggggtccctcacgcaaaggcgctattgcacggcgtaggcaccgctgcttgcgcgaagacagttcccactccggcacgggttcaggcgctgcgattcaggaattccgcgcgggttttcgccccagtttttatatgtttcttcttttctttctggaaaatattggcgtcgttcagattttttgcccgtggcatcttttcctgccacgttgctttagctttttctgccgttccgcgtgcgtgtgatgatctgacggactggagaggcagatgaagcaccacctgttctgtgacgtctcgcgagccctcgtgtccgacccccaggccttgacttgttcggtgcagacattcccctcgactttgcacacatcttactgcaacgaggcctttgtggccgtcattccgaatgacaaaaatcgcatctgcttctatccattctga

SEQ ID NO: 2228 - DNA, 2944 bp, Toxoplasma gondii
gtccggaacttgtgcggcaccgaaccttttggatgacatatgatcagcttatgtcgcgtggttatgttcttctgtttatcagagacgccatcatatgtgaacgaagaagttcttgatgtactgtcactccttttcaaaccgactgtgtggtgtgatgtcccccaccgacggcaatattatccggaagtgtacttagcgtgcacagactttcactagacgtggacgtctcctctggttatcgaatatcattttctactcttggcgaagcgacgctgaatgtgcgcaacctgcatggaactgggctagatgtgcttgcagtagcagcatgcttcagctgggcgtcactaaacttattcgtgtaaggctttggatggcaatatgtgacggggagggaagtcgctcgaaaacgtccaccgcttctctacacgggcttcttgtgcaacttaagtttgtattgctactcgatggagtgccccaattttgctgcggtttcgcgacgaccagtacagtaactggcggagttcctcgattcgtatcctaggtggtatgagaaacaccttaagaagacgagcatgaactcttcaataacaacacaaaaccgaatgtcgatcgtcactggatcgtgcatgctccacagtggctgttgggtaaacgcggctgccctcaagcaccaagaaatgagtgtgtccgaagtgcacgcagtagcgccgaggccagcagctcctgcattttcacgttagcagtaaaattatatactggttcggaccacacgcaccccaaggcgccgtacagacgacggcagtgtcgttccacatcatctgcgcaacaggcctgttccgcgagaacgtgtggcaagcagggtgaagcataatggctttgtacaattgggaaaaaatgatatgtaaaacggagctgacgccgtcaaggtgctaatgcacacgtaacgacgaacccgtcctcggggaaatgcttcgctcccaacgaagaaccgctgtcgcccgaagaggacgccttcacatcgagaggtttagtcctccagcattcatatgttttcgcagtcacatttctgatggactacaccaataacctatatccctaccagcctcatggaggacagatgcccagagagagtctatgacgaggacgcaagtccagttgatgttatccttactttccagcggcactatcgtggggaacgaacttcaacaccacgctgcgccgtgaaatgcgcttgccacgacgggaggcacatctcctcaaacctttgcttgtactccttgcactcagcatatgagtccccgccgtgcttgtccaagcatgcaaaatattcgtccttggctgcccaacaggcagaccgggagaaattgtttgctcgcccttgttgcagaccatcagtcctgtcctcttttgtgctagtgatagcagaacccattccgtcggcggtttctctaaaaacaaatagcccagcgctagaccttccgaaccaccgtttgcgcagacggaatcaccgttcaggcgagggggtctggttgcgactgatgctcacgttgtacggggagaaggcactgttgtactattgcactgcagacgtaaacaggcgtcccaatactactcagtacacagatcttccttactggaggcgcagacgctcatacgaaatgtgtttggttcgagagaaatgtgtttggcgacacatgttattatgaatgccgatgcctctggcgaacggctagcgcatgctcagcgtacgacaccgttggagaccccctgtgacgaggaagttaccttacctggcaccaagcagagctgctgtatccaaattaaattaaacgcgtaaaagagaggctcaggacactcaagtaagacaggggtctttcattttgtcggttcttccggcaatccgtgtgctcgttcgcaaaaagtatcctcggtaagctgttcgtttagcgaccgttaccacaacgctgatgtagcgctggaaccgtgacgatatcgcacaacagaagacgcacagacgcctgcatccggcttcatatttcgaggaactgatcctaacattcttgcgcgtaaataaaattctcgtagcgctgtctatgcctacgactttttcactcggggctgtcgcccggatgatagcgtaaatcgcttgtccccagtcatcttcgcatggcagtcctgtagtccaccttcaagccgggtgactagtagactcgagagtgaaatttcccgttgctcactttgaaaacgaagcatcgaaaggatgggtggtggttccaccctcactgtcttgatgaatgagctccaatggaactgaactataacaacggcggccgattgtaggaacccatcacggaaacccaagagaacgcaaggcgaacctcgctaatgctcaccctcagcaggtgagcgtcggtgtttggctacggtttgacgatgcagtgtttgtttgttgatgataccccgtgctgctcctcaggaatgcaacctggttgtgagctattgcctctaatacccccacgtggcgttgctgcatgtcgcatcagtgtacctgtagcgttagtttcgcagtctgtcaatggaaaaaaaataggtgcctggtgcagtgagtgcagttcgagcgatgaaagtgttttccagtacacacacacccacacaacggcagatgtttagcctggcttcagaacaaataccggcgaaaagtagaaatcagaccgcataacgaaagactttgtttcccacacggaaagatagaactacgtccgtgcccagtttggtagataagatattgcgatgacgataagctttgaagtgcgtcaagggtcggctgtctgtacaccacccccctcagaaaagcatcaaggccaatgtaggattccaagtgattgctcggatctggaacgtcttgctgacgatcatcgtttgtctctttctgaaaagccaacca

SEQ ID NO: 2229 - DNA, 2316 bp, Toxoplasma gondii
gacgacgcaaacctattcacaaatctgctgacaatgaggcggtgcacagcatgagaggtgcagtgactaaccgggtcgtctttccaagtcgctgcggaagagtgtaggaaactccacgcagcgcgtccaattgacatgcgatcaggagggtcgtcgtcctcatcctgtggcgcatcgtcttttaagatccggtcgcggcaagcggcatctacacattgattgagtttctgtggaaagacctgtgaggcaagcagtgcagccgctgctgaatgtgacgccggcgcgcttgaccgaccatttggtgtgggcgtcgaggacgccggcaggtttcggctcgcctgattaccgtgtgccaaatccagagaaacagcagcttcggaacctggcgaagagaatacgtcccccttcccgcgagaagacatcctgcctatgtagaccgtggcaacagaaacgcaaacacggtagtagggacgggaaaatgtgcttatctctcgttcgcccgtgtaactcgtaaaagtgcgtcggcatacaaagtattttcttcgacggcggctgctgttgagcctcgctgttcccctctgtcagacaactcgtcaatgaacggacgaccaaatgagactcttacaaaatggccgcagagagcccgcttctagttgtttcgcaataacctcagcagtacgtctttcatagatgttgcttcgcagtagcttgtcgcgtagacggcgaaaagtatcaaagggcatacccttgttctggaccatatacggaataagatctatcgacaacacgccgatgcttgctactgcaaaagagtcttgcattgtaggaaataatgaacggtttagcgatttgcaccgaaatcggtatgagtgacaaggggagcagcgctttcctgcacgctgctgttatgtcggacgtagctacacacagccaagcgctaataagctggccgtcgttctactgtttgcgttttgcaaagaggatttgaagggaagaaagaacacattccaccacaaaaaaccttctgagtggcttggactgactccaccgtgttgctcgcagagacacgtagatcgacaccactgagggcaccaaacgggacgggaattgagtacgcaggagcagcaggcagctgcgccaagtggagagcgcaacactccctgagaagcagccgataaaacagttccacagtacgtactgccatattggaaagcagcacttcggtgatctcgcgttagggatttggcacatgcgcgtgcagcgattcatgtcctgcagcagctgcagttctgctgtaagagctgtctcgcgcgtcacaacgtttgtcgcatgcggtacggcttataatcaagttcggattcgagaaactgcctaggtgcgccgccacgcgttagcggaaaaggcggtcgagagtgactacgaggcgcaagagtccgagcgtaggaaccacccatcagtggcacatgaactgttgccgctctagcaccttcgcggtcttctgctaatggctgctctgagaaacagcgcctggcctgtgtggtggtcccaaaggacgatgatgcaggacggcctgcgtccactgccggggcgactgccctcttcccctcgatttcttcgctgatcctaccgccgacaccggttccacttcccggtgcgaaatgcctgcactcgacagccagcaccgagctttgcgtcacgcaccggattccgaagccatgcatcccacccgtgtaaagctgtcaacgcctgctctcccctttttttgcatcgtcgtgttttcttcggaaggttgtccttgtcctgggaaggcgacccccgttgacacagccggtcgctccgccgctgcgcagtccaagtgttcacgcgcgctgccccacgcgttgcattcaccatctccgttctgctttagtgttcagcagattcgcttattgctctgggtcgattgcttcgtgcgtgcttgtttattttctgcgcacaccaagtgctgtttttcgaacccgtagagtctccgtttaagaccggtgaaaacagttgcttggggccacaggtttggcaaagttagcgtcacctttggaggcagcgtgaacgactgcaaattcattttatttatttcctgattgaagagacagaggtccgggaagctacgtttggtacagtgcccgcattaccttcaattgccgcgtgacattcgtctgtctgggcggaagcggagtctccatgcgtatttggcttggtgagttcgtgtctcgtcaatctctctcatcgcagcgctacttccgtgtcgctacagtcgacgtgtgcctgacctcttgaaaa

SEQ ID NO: 2230 - DNA, 2380 bp, Toxoplasma gondii
agaagtgacgaatgcgagcacaagagacagctccatatctttcgcgtttccagccttctctcggcaccactcccttctcgatcttctcctctgcatctcgattcacttttctcctcatccctgtctccctctttctctccagctgcgtcccttcaatggtgactgtctcttgcaacaactgaaacctgctaagaagaacaccattgcccttctcatcttccgcttccccgctcttcgggtgttgaagtgcctgtgacctgccgaccggccgtcccggttgctcgcactctgtttctatccgacccgcaactgtgaggcatgtgtggacgttacggcctccggtcctttagaatgcctccggccggagtcctcagtccgaatcgaggcgtctcctgcttgaggcgtctcgctgtgaatctgcgcctttttctcactcgagcgtggtatgcagctctggggacgcggtcgcagtcgatgaggaagaaagtggcgttgttgctcgcgctcgcggcgaagtcgaggaagggctggaggaggactttgctctggagggagaagcgtgcgaaaaacagacagacgatgggcttcttaaagctttcctcgtacaccgcggcttcgtagcgctccatggtggagacttcttcgacgtttttcagggcgttagtcccactcgcgattccggaagaggcagacgaaacagcctcaaacactggcggcggggtgggcgtcgccgggagagggtccgcgagcgctgcggcgttggccggaggaatcgcgaaagaaaagtggcgggcggtagcggcgcaagggtgcgacatcacagccgatgaggagcgcgaaagaaaatttgtccgcgaggaaaaagcagagacagaagacggaactgacgacacggcggccgcggcaggcagccggcaggcgtttctggggtgtacatacaccccagacaccgcgaacggcagtacgcgggagggcactctgttgagggccattttcgcgaagtttgggggtggaaaacgcagaactcttcgctcaggagagagaggagagaaagcgtgtgttcgagacggaggaaaaacggaggaatccggggtttcagggcggcgaactggaccagccgtcgcccgctgcgaattgcggcctagaccttcaggtttgtggtgccagttctacacgctcgaacgcgtactgaagcttgtgagatggtgttgaatccgggaacgaagaacagcatggaaaccggcacgccaaagcgagcagactcttcgcaacttcgcaacttttccgcgggtaaagcacgccagcggcgccacagtgggaccccgacacctgttgtacgccaggggaaactgccctgcagatccgtgtgtgttgaatttttcgcgggcgaaaaaattcaaaagaggtatctttggccaccagtcgccgagccagagaagaaggcactgtcgccgaggttcgcagggaagcccgcccgtttgtctccggttttcgacgcacgcggaaagtcggtctccgaatgcggtacggggggacggcgcagactacttttgcagagacggcttggctcttgctgcgaaaatgtcctcacattcccaacgagttgtgttcaggaaacaaagtgtctggagccgacgcctggcggggaaacggtcccttgctttgaattctcctgtcgcaaaccgcgttgggagtgaatcctcggttcgctgcacgactcctgccttcccgggagaagaagtagctgcggaacccagcgagacacgagcgagcgcaacatccttttcagagtctctccagggccgcagtccggcacacatgtatatactcgcagaaagagagagagaggggtgtgcgtccgtgtcgagagtgttgcctcgaacgcctttctcgatctcgtcttgtgtgctgtcggtctcgcgggctgtcgggctgtctgtgtatctccccgtcgcttggctttggtccgcgacgaaacagtagggagttcaggagacgcggcggaacagtttttatttcgcgaggggtgacgcttttttctcgcgtctcgacattgcgtgtctgttcgctttctcgaaactcgccgagcgccgccggcggccgagttcggcctctcacacaccacagcatggggaggacgtgacgctcgagtgtagcgattaggcacctgtagctgcccggtttttctgtgttttctgggtatctgtagctgttgcatcctcgagggctttgcagagctcacctttctgcgttgtctctcttccctttcctcgtgtgtcgcctcgcgcgccacgtctcttgctgctggcggcttgtttcttctcttttccggtgtcttcctccgcgcgcgtctgtccagcttgcggtgtgttgtgtacga

SEQ ID NO: 2231 - DNA, 1403 bp, Toxoplasma gondii
gacagctcttcaaacaacaggatacttctcacgtgtggcaagatcatgaagcctgactttcgtctccctaccacgtgaattacacgaatcaaatattcaacagtatctctaaattctcctgtagatggtacttccctcgctcgattgtaaacatcactgcgcgtaaacactccattgagttgggggatcctatcagcctacgtggtgcaaacggtttgatttaacattgctcacgattcacacgcgattatcttcaaagtaattccctgttcgtcggtgctgccgttcgacccgccgcttcctcccgcaaagcacagagaaaaaaatatatacaccggaacgcagaattgcgttcccgatccctgtgtctttgtcgctttgtaccttgaggcgacactcctgaagcaaaagaatcattcaacactagtcgtttctttacgttatgtgtagctgggactgcccgctccgaaacctagccggtcggaatcttcgggaggctacacccatgttacatccctccgccgggtgccatttctgcgttaaattaccaggcaaacacagtgaagacagcggatgaatatagaggtaagggaaacttaccaaaacaatcgaactctccgggtgaacggctgcctggcactttgtattgcggttttatttcaggggaactcgctcggtttttctcttcatgcgccactctatgattaccgcggcttgatagtcttcgtattctgtctggcaaccaaccttccccgtggactgttcggctttcgtcactgccgtggtgaagatggaacaaatgggttgccaatacacagtcattcgggacgttggtgtatcgcgtagtagctggacagaggtgtcggttttcattgcacgcagactgccaccgatcttggagataacctcgtacccaaaagcaagaataacaaatatggagccaaatcactatacctcgctgtggtttttctttagcgtctacatgcacacacggttggcgatttcgatgctcgtggctgtacatgcaactggctctcgctgtccagcaactacctgaacacatcgcattcctttctcaagcgttaccacttttccacgcaatcaaagcgcgactagattccttacctttcatttgttaaagctatgaattgaaaaaagtgcttcttcagacgtgtatttccgtgtcttggcgactgcatgcactcggcccaacagagaacagtaggcgtttgtatttctctgagtccgagatcacacctgactctgggtccatgtcttcttcattcatccgtctcccggtctgtttaatgtgacgcgttgtcttttagtccgaagcaactctgctgtggcacgtgatctgagcgttcttccccgttctcccgcctgtcccctgcatgtcgtca

SEQ ID NO: 2232 - DNA, 2684 bp, Toxoplasma gondii
cgagtctctgtcgtccgcttcccacaacgtcactgaggacaaggaaaggcctcgccctctcgtctcttcttctcctgatcgagttcgaaacctcaactccccctcagccgcgtcttctctctccctcgcctctccttgccgtctctcttcctcttctcgttccttctttgccctggcgaggttgcgtctcgtttctctctcttctcgcctctgttctctcctgcgctctctctctcgatcgaggcgctctcggaggccagcgagagagaacaccatcacatctccggctcgcgttgtgcacagaagaacttcttcgcctgcaagaatctcacaggcaatgtgagtggctttcacgcgcctgtcgctcgagagcctcgcggtcgaccatccttcttcagcttcgaggtctgcgtcgcgcgcatgcagcgaaaacgcgcccggccgtctgtggtcttcgccggggagaagaagcgtgaagcgttctgggaggaaggcctgttctctaccgaggactctgtggttctgcggagctcgagcctcgccgtttagagctgcgaggaaggaccagacgcgcgcgtctccgtcgtttcgcgagtcgccgcaggctccttcgtcctcgacctcagacagcgtctcctcagagctcgacgacagagactcccagtcgctctccaccaacgcctgcccgcgtcggtcgcttcgccatgcgttcgaagaactccaaacctctccagactgctgtcgccgccgcagttcgtctgcactcgcggggactccccacagagactcctggggtcctggcgtccccaccacttggcctgcaatcaatgaagaagaaaacgaagaagaaaacgaagaagaaaacggagatgcagacagagaggtggaaggagaggtggaaggaagggcactgggagacggaggcgcgaaagacagccgctttgtgcgggtgaagggaggagctcttcgatacagtttggccgtcggtgttcctcgaggagtgagagggagaacaatcagctggccgtccgttccaacgacaaagagaaggtcgcctgaaggcgacagcgccagcgtatttgttgcatcttcggggagggtgagggggtttgaccgaagaggcgagcatcgcgaggaaggcgacggcctgagcgagactgaaaacaagagtgagagactcttcagctttccagagaagccaggcgcagtgcaggcagaccgggaaggtgaggagacagaggacgaagcggacgaagaggacgaagcggacgaagaggacgaagcggacgaagaggagcctccagggagagaccttggcagagcgctgccgaagagagaaggaagaaagaactccacagaaggcaccgacgcgggcgcggcaaaaggatctgcggccgccattgcaactcagagatgggaggttcagacagacaagtcggagcgcgaaagagacaagagagtgagagaaagaaagaaagagaaaggaaggagaggagacatagaaaggacgacagggacggaggagtgaagaggaaaggtggaggcctgggaaggacgcagagaggctggacagagggagggagaagacacaaaaacgaggaggcgactctatctagcggctccgacgcgactcgacagaaagcgaccagtggagttttccactcttcgcatggtcctcgttttccagcgtctggacggtccttgcaactccgtgaaagacctctttctgaaatttagagcgcctcccagtctcggaacgcccagcgagtctctcgtcagctctccctcccaaccgcgtcttgcaaaggctgtctctccggcgtcgacttcgtagcctcccgccagcgcaggatttcctcgcgtcgcgcgttgccaggaccagtgtcgctctggaagcgagaaagggctctttcttctctccgggaaaggcgctcttctcggagaaagaggcaaaaaagacgatgcgcgacgctctccgcctcgtttctcgacgtactcctgcgtgcgaccgccaacgctctccagcgctctccagcgctctccagcgcgcatgcacctcgaaaaacggctaccagtagcttctccggactcgagagcgtttctgaggcaaacagttgcttaccgcagagatgagagaatgtcgagggagcttcggagacttcttcttagcagaggaacctcctcgagagacgaagtcaggtgcagcgccctgcagaggcgcgtcaacttttcgaggcatcgcgagcgagtgcgagacacgacgccacagaaagaattgccaaagaagaggtcctttttggaaaaaattcttcttcttctcgtgtctgtgaaaggtactgtgaatttctgagtctgcaaacggtgcattctgcatgatgttccggcgtcttcccctcgcagctcggctggagtgacagctgatctcgcgcggtgtctcttttttctctttgacgtctcgaccagtactgcttcatctccgtttccttcatctgggccttcctcagattccccattgtgtctgctcttcctttctttccgtcgtctctgttcttcttccgctccctcttctctttctcttcttcttctcgttctctctctgcctcacctgctgcttgccgtcggctcttctcttcttcttttcgtcggtctctcctcctcgttcgttttcagcgtctgcggagcca

SEQ ID NO: 2233 - DNA, 4167 bp, Toxoplasma gondii
cgcctgacacatcgctctcttcgtcaagactcacgagggccgtcttcgaagagcccacagaaagcttctccactccttgcgcgcgcctcttccccgatatcgaagaagcatggctggacacgccctcggcatgcgctttctgcttggaggcaacggcgagcgacgtgagaaaagagagaggcgacgaagacgtcttcgagtccgagtccggccccgcctgaatctccggcctcgcctctcccgggttggcaccctgagcatgcgtctccgcgtctgtatggccatggccactcgccgcgggaagcgccccgtcttgcggcggagtcgcctcgtggagtcgctgcggcaagaatgtcaaaagacgagggccctcgccggccttcgacgccacgcctgacgaagaagcagaggcgcgaggcgactcacgcaaagaaggcaaactggaggcatgttcacacgtctgttggtctgggtccaaagagctggtggacgaccgcgttgggctctcgtctcttgcggcgagtcccgcgctctcgatcggccccgacggggaagactccgctgccatcgcagacgccaaggcagacacaccgagttcggtcttctcgtcctcttccctccttctcttttgcttcaggaattgtctgacggctttgccacttccttcgcgccctcgatttgtctctcggagaacgcgggcttcagacccgtttcttcctcacgcgtttctgctttcgcacaagcactggaaagcgtggcaatggggaaaagatggagacaaaggccgtgttggggaccggacggaaaaggagatgcacgagactccacatgcccatgcccgcagatccacactttctttcaacttaaaacccgcgtgaaggccggcggcatcgggcggaaagagcaaagggagcgcaagagatgaagaagacgaaaagaagacgtcgtgcatagaagtcgtggggagacagtcatgcatacacagcagactgaccacagagaccgcgacaaaaaagcaagtgtctctctctccggggtcagagagacgcaagagacacaggcgacgcgctcatcggcgggtccgccagacgacgcgatctccacgttcacaggcaggaaggagggaggcaggaagcaagaacgcagtcgccgctgggatgcgagaagtcttttttcacgccgaaaatcccgcagctgcgaggtcgccactccaacagggaaaaggtgtctccactgggaagagacaaatggagtcaacgcaagaaccaggcagaacgcaaatgtgaacagcagcgtcggtgaattcacggaaatggagcgcgggatgaagcagtagagagagatccaacggaagttaccggacaagaaactcgacgcagacgtgagtgcggtgagtctgtcttccaggtaccggtgtcctcgaaacgacagcgcgggcacgaagacacgaggagaaaacggggtcttgctggaaagaggagaagcgcctcatactagatgaaaacggcataaagcggaaaaaccagacagaaggagaaagacgtttggatccagtgagtacgaccgctgaatacgttttctacgagcgaaaacagcaaagctgatagacgggaagagatacgggatcgaactagatgacatttcaaaagccgcgaaaatctttgaaaaacaagcacaacgggggtgtgtggttgcaaagacgtccccgattagaaaatccaatactgccttgcggtcacccaaggtaaagcaatgattccgtgccccatcgacgaatcagcgatcctgcgactcatggagggcatgcaggaccacagagaaagagaaaagctgcgatctcactcacttccggagaggaacactgaaaaatagtgggaaattcggtcagaaaccaattaatttttacggaagagggcaaaaggcatctttcggaagcatgcagtttgggcatccaccacgcaaaaagccatgaatgagacacgtgttacctcggacagccaggaggtcctgcatataccacatgctccgacttcagtaggcgctgttgcctttgaaatcctttgatcagagctagacgctcgattgtagaaagtaaaaacaaaaatagtctttgcactgcggccggtctacatttgccttgcttttgggcacgctctacaccaaattggtgtgagctggcgaggactgcatttcccctcgcccttttgtggaggaactgaagtgccgtatggatcatgagcaacgaagactattagattatccgcacatgcatcctttagggtatcggccgaaaacagacagcaacgaagaagtttctgccgcataaaatgagaaagttctgttggtcctgtaaggtgtcgctccactcctgttcgtagtacttgcgtctacgcaagaaccagcttactttactttgtaattggtgttatgctcgtcagcggtacgcacaacgcttttgcgttgctgcaaatttgattttggcactctcggtggagtcgagaatatacaacttgctttcccctatctcgaccatcggccttcatttagtgtatggttacgtatcaggaagtgggatctgtgaacctgaattgttgtggtgaaaacttgttgagtttcagacatattctaaggctgtggttgcacaagctctgcgcgtaggctgcctgccatacgaaaagaggggcccgtgtgacgcagtgtgacggatttcaccgatctgcagcagtctgtagaactatattctgtttggaaaagggccgcatcaggtcatccttcccgacaaacccagtcagtgtttcaaggagctgatgtgagtttctctcgctccacaggagacgaagcctggaattgtactgaaactttagccactgaacacagtgtaagataggtgtggtgaacatgcaggaagttagcctaggcgccagaacacgtcatgaagggatgccagaagtgcagtgtatccttttagaaatcctcttcgaatgaaaaaaacgccacacgttcatatcggatgtgtctagagttcgaagcgcaaaggctgcagaaaatggtgcttccatgtattcacgagcctaaatgcgttcccttcctgagtaaaacgctgtgcccttgcaagagagctgccggttgtctgcagtttggatactcatgtgagctacagtactgtcgaaaaaaggcatgattagtgaaaagcactttgaagtatcacgtagttggcataaagtcgtggcacaaagtgtaaacgaccgtcgtttatctgttgtgtcgcacgacaacgagtctgctttagggttgacatgggagaccaaattgataactagacggcaggatgcggaaagcgtagtcgttcacgccaagacaaagttactgaatgctgcacgggtgtcttgacaaacgcccaaagcaacggactgatttgggtcgagtatcctgtatctcgacgaaactgccccccccccccgccaccaaaaaaggcccaagtcgggacttctgctggcgctttcgagaacactaaccagtggtctttcctccgcataactgtgtgtcttcaaaccaaaacactagtcgagagtctccggataaacctcagacgggacttctttaattcctcagttgaccggcgctgtcacattttgggcagctagtctggggatcgtttggactgctgcctcgactctacacgttcctttccttgctttttccagaaatatgtgttgaggtgcttcgaacacagtgacatcgggtttccttttacgcacatctgcagctctgcttcagagccgcattacgaggaagggcactaaaagcatgcatcgcccggtcccagtgcgcgtacaacagtccgcagctacgagacgctgagaaacctgtgcttgataagcatgagtaacgaaaactggtttttctccttttacattatctcccactttgcaaaaaatctatcgcacaaacctcgcttgaaatatcagccgttttgtgcgagcaaaattttatccgatttggcaaccgcagagaaagccccttcagccgcttacctagattcactggatgccctgtcagacaaagagtcagactcaccacgaggtagaactcgaatttaccttgcgttcctctttctccgaaaccataagagcttggatgcaccttttgtcgagtgctctgccacaa

SEQ ID NO: 2234 - DNA, 1165 bp, Toxoplasma gondii
ttttgctggacgaggccgagggtggcttccaaaggctggaacacttggttctccttgcgtcgtctccccggagtgatcaagagggaaaggacctgcagcagatgtgaaggtgcctgttgtctcttttgaatctgctgggttcgttctcgtcacgtcaggtcttccactgttgtttgttctccaactgaagtctttcaacctgtctacacgcgctggcgcgaacgtgtctctccgtggctctggccgcctctctctagcgcaagtggccaggatgcgcttgtcaatattcgagaaagactaaaacacaagagcaggaggttcctcaccttggagtctatcgcgcgaagatgtgctgcgagtttctcctcccgcttacctgcacgttcacagttctgggatccatctggacacaagcgaccaggttattttccagacgcccaacgttagccaatttgcgaaatgcttaagcgccaatatagatgtatacaccgacatggaagagagtgctccttgggagaagttgttgcgacacaaatgacaagttcagagggtgaagatctagaaaatacgaaaattcaaggccttctctctggtgtaaactcctatcgctagctatatcgccagcgagtgttccaaatcgtaaagttgtccatctgcaaccacaaacgcgtatgtttacacatttctttgtagagatctctacagcactgctctgtttattacatatatatatatatatatatagacagtaagtatacgcagtctttatcggatgtggagatggctgcttggaagttcgcacagtctctctgtgttcagagagaaaccggaagacagtgagttggagcaaaagcaccatctgcagactgcatgtaattcgcaagcgtgtcctcttctgtccgagtcttcctttgatcttcggactctatctacacatctacatcgttttttcccgcgcttgttttcggatcagactcagtagggtgcgaccgttcactcctcgcgagcgtctctcagcaacaagctgcgtgtatggaaatcacttaatctatcgtcaaaagaggtggatagtgcgtgcgcgggtttcaagcgtcgcagccaaggcgggtgaaagtcctcccatcacatggcaaatgacggagtccacgagcactcacctgaatca

SEQ ID NO: 2235 - DNA, 1816 bp, Toxoplasma gondii
cgtcgaaaaccttcctcgcactttcacacagagaacctcgtgacggggatgcctccgctctgtcgtcgccgttctcgctgtttcctcgaccgcccgctcggccttcctctgtgtcctcgcgcttcttcgcctcgccactgcaaggggggcaagaagagctctttcctgcgtttgtcatgctgagaaacggctctcgaaaaggtttcctaatcgcctccttaggagtcggaatccgctcgcatgcgcctcttccgtgtgaagtgagaaaccgagtgaagcggcctttttttcttctaactcgtagggcgtcaagctcccccacccccctccccctctgctctctgttctcagccaggaggagagagtgaaaaggtctgggcaaggagcaggaagagctcagagctccgcacggaggaaacgattattggaaagcagcagacgaaaaagacgcgcggtgtctgcggagaggcgaggaacaagatagaagccgttcaggcatcgagggaaaaaggaaacctgagagagacgggacgggcagcaaacgaaagaagaggacaagggagaagaaagagacaaaggagcagacgaaagagataacaaaaagaacgaaagagagagaagaagaaagggatgcaaggtttcctgcacctttctggaaacgagaacgaagtgagacgtatcgccgggacaccgggaaaaaggcttgttgtgcgtaggagcagcgctgacgacagcgcgatgagaagagaggcctaaaaaacgtttgcaagaggaaacacaacaaaggaaggaaaaggagactcggacggatcttgagcgtctcccttcagaaaaaatcagttcccgatccacggcatgtcgagccagccccccgggtgtacgcacacctcgactcgtggtgctctccaagtctgtcgagaaccttttggagcgaggtaacaacggcgaatgaaagataaaaacagtgaaacacagagagaaacacagagagaaacacagagagaaacacagaaagaaacaccaggacaactttgcggaacagcgatcgttagtgtgcggcgtttgcatgcacaagaagttccgagagaagggcatgctagacaggtttgtcgctttctgcgccggagactcaccgagaaaacggcggagaagagtcgttttctcgaggacgaactccggaactccaaagacgtctcttccttgcgccgcttcctgtttctcctgtcctctgtctcctcggcgcctccagtgtgcatgtgtgtacagccagagacactggcgaggcgccgacgagaggaagagagagctccaggtttcgctgcgcttgctcacccttgtcagaagtcgagttttcgcctcctccatgtacacaaaaatcgcgaaaatcctcgggaagctttctgccagacgcttcgtgcagtcgctgcgctctctggacggcctgcgagcagagagacggcggaaaggaagccccccggcaaacagagtctcggtgggaggagatgcgcagcttctctccaccgtcggtccacgactttggaggacgtccatcctcctcggtagaggccaaagacgcgcttctgtcgactcgagttttacgcattagcctcgtccgcagctgtctgtacacctggggacagctgcctatgcaagagcgactcggaacgttctgtcgacaccgttgtaagtttgtatcacgctggaagtttttccttttttagggaggaaggtgaaggaaggtgagtgcagttgctgcttgtttttcttttccggggggagtgcagacacccgtctcttctcttctttgtgtcggcga

SEQ ID NO: 2236 - DNA, 2130 bp, Toxoplasma gondii
cgaacttgcgaaaattaagttttcaatggaatcaactgggaagaacaggcttcagcgtccactctgtgtgcttccgcattagtcccacaccaatgctacctttttagacatgtggcagtgcgtgctgccctcaatcagatgtatcagcataggtatctcgtttttttcgacctcgatgtgttccgtgagggtaaaacgagactctatgtcggaagggaaatgcctcacatttccacagacgctgcatttggctacagaaatccacggaaagcacaatcgaagttgaatccggtaggcaaagaccttcaaagatatctaagccaatagtacagctcgtagtatattctccccagaaaagccgacaaacttggttgggtatcccaaacgtagccgatactgcatctttatcgagcatcttgaaaacgtgacagctgggtcgcacggggacgcatgtgaacgcgcgtgaaaaaaagttcttccgcgcgagccgctgcgtgtccgggctattcggtgcaaattgatcttatggttggcgctctgtcgaaacgacagggtgagatattttgcagggactaacccaggagagcgaggccggcccacttagcgcccttcgtgagtgatgctaagaggtacgacatgctgggagtcgacgacgggtgaaattaatggtcacagaacgacgaaaaacgcgcaaaaaagagacgtgagacctggtcagcgggagcgaaacggtactggtgtgaagaagcggcgacgaaaagaggaacctggagacggaaggccactgcggagccaaggagaagggcaactgtgcattcaaggctgaagaggagacagacgatgcaaaggagaggtagagaaacggaaaagactacgtaaaatgggagagaaaatggtgggaggacataaccggcgagaacttcctggtttaagcagtaaatgggaagtcgatggatggatgcatgcaggggatgcaacagatacaacgatggactaggcacaaaggagacgcccagcgaagttgattcgccatgcggaaaaagacaaaggcgaaacgcgtttggcagtagagatgggaagtcgaaggagtgagtgaaggcaaacaaccccacgaacgaacaccctggctgctatgcgtcagcaacaaaccagaacacggaccggaatgccgagagacacaaccgggcggacggccacttactatcgagtgacagcttcttccaggtgtttccaagaacataagaacgtctcaagaaaccctctagaaagtcaaaacgtttcctcgaagagaagcatgtagttgagtggagaaagtcaaggtccgcatgcacattaagttaccaatggagagctcctggaggtcgctcgtcagcaatggacgaaggtgacctgcggctgaaggttgcaaatcttctctggagggacttccacacatttacctacgccgggtgtcccatcattatagccttatgtcatttgttatgaactggtatgtcatgttcggttttcttggggtagcgaatgagtagttggacacgatatttgtaccgcaaaggatgagcgacgttacatgacacgtaggccggaaagaagtgcctcatccatggtaaaaaacgtatacggatatattctgaagcagtgtgtctggtgatgagaaaataacaaggttgatgacggcttacgcatattccgtacctgaacgatgtaatcagaataccgagtttctccgagagcatcgttccgcccacgatcggctccatacagccgtccccctcctgcgttccagtccatgtgatcagggtttgcagcccttctgtgcccaacccctatccaagtcctgtcgatgaggcgtctgtttcgcacgcattcaactgatgtaatgtttcttgactttccccgtgtgaaatcctagtagctcagcaggcctacagttcctacaataaccctactcaaaaatgcgaacagcggtctttcgctctcttggcatcgtctactatatcctgtataatggccgccagtgcaacgccgtgtgtgtcggttttcatcttgggtggccagagccgctgagacgcacgtgcgcagcctgtagtgtcttgttgttcgacttcccccccatataaatatatttca

SEQ ID NO: 2237 - DNA, 2283 bp, Toxoplasma gondii
cttcggttgtgccagagacagaaaatcgctttgatttcattcgaagtctgggggcagtcaggggggcttgtgcatctttctctgcctccgcactccattttgagtgcgctcgtgggatgaaatgcttctttttctttcctgaccttccttgacctcagacgcttctttgttgagactacctcgcaatagactggcgcgtctctccttcacatgcactgccttgtggctcgggttggagtggactgagaaccccaattaggcacggcattttagcggaaaaaacaggatatatgagacacacaaacactgggaattggttgcatgtctgaagacagatgcgttcacaactctgcaagcaagatggaaacaattagaggtcgacagaactatagtgtgttgacagatatcaccgatgtgtatacatatccgtatttttctgtctatctatagaaattcaggtgtagatagacctctagttgcactctttgtcgtatcttcagctatctcgatctgcgcgtttacatatcagttacgctttccctttcgttggctgtcagcgagctgatccggaacgcatatccggatatgatgtgtttggccacacaatttaatgtctcggaatgaagggcctattcgtgtcttgctgtgtgttcatcaatcttttgtggagaaggaagagaagggaggagtggaaggcgcaaaggaacgaagcgaggaagtgccatgatagacgccgtggaaaagaccacaggagacggaagacagacaaaaccggagagacgaggttatagttgttcctctaacgcaatagagtggttcatgattgtcttcgccggagctgtgtgccggccgcatgttaaattcggtttctaagatccgagtattatcagaaaacgattctcaagtgcgttcgcgaccgcatttctcagtgtgtagagattaccccaagcagagaggctctgcactgactgaaacatctgcggtaggcacggttgtggtgtgcgcaggtgttcccgcagacacccaagctttatttttgtgcacgaaaactccgtgtagacaacgggtgtcatcctacgttcgcacgcctgccggaacgtgaaaagtgaaacaaatattgttgcacaaggaatctgtcaaccctaaaccgtatgtaaagcggaagtttgtgctggtgaacgtgactgacaagctagccgatgcattgtgacacgacagattgtatccgaggtcgtgcacggggccttccagattttgttctgccacgaattctgacgggtgtggctgagaactacggagagaggcatccactcgtttaaaaacaaacggccccacaggtgggcgcgaattcacctggaaagctgctgtgtgttctatgttgtggtcgcaaatagggcgagtgttcttaaaaggctgattgccagcccagtttgtcaaatgataaagttttcgtggaggcgatacggtagtgcaacaaccctaaagacattgtccgcggcaccgagctgctctgcagctgctcatcgtccaacactgtcaacgaaaaggagaaaaaaacggaaggcactgtggtcttggttatgtatcctcgctctatcaccccagagcgaaacctgcttcggccaccgcagcgtctatgctctccaattcaccccttattaatctagaaatactgagatccaagctttcaacgcccaaatgtttagttcatccaattcatgactacagttggagtgtgccgccaaaggaacatgaggttgggcagagaacgaggttgtacaccagcatgttttcatatgaagaaagttaacatcgattgtgactctcgaaaacgctgtcgtcgtatcatgatttaggtagctgcaccctgccgacccgggaacaagccggttaacagtggcactggtttcagctggttcatattttctgccatccaacttgaaaccaatacgaaaccttgaattttggtgtattgtttcctcgagtgcaccgccgttctgcacactgtcacggccagttgtgaagagattcactgagaatgaaaaagtgatacgaatatcactgaagtctgggagtaagccgaatgtatgtgtggtgattcttgcgttcggagagtgaatctggtcttcagcattcgagtcttgattttgaagggaaagtgggactctgtaaggcactgattctgcgaaacatatgattttcaggcattagaagcctgtcaatgaaatccccggacagtgttgctcagggtcaaggtcaactttttttcgcctcatactccga

SEQ ID NO: 2238 - DNA, 3275 bp, Toxoplasma gondii
cggctcccgcctaagcgatcactttgaagttgcaagttaaatcgttcacagggtttactgtctgctggccatgtgacacatccctcgagtcagcatggctgtcgccctctgtcacaattaaacctctcttgacactgatgaatgaaaagaaaccatgtgcatagacaaagcagaaagtatcaacacaaagccaaaaatctgggggtaacagcaagccaggacgccaacagcggataccgcatcagaaggcagcatggttcctggctgtcttcaagtatgcatttctatattctgcggagctcgcctcaagaggtgcagatagtcaactagagttgacgactcgtagttgacgatgctgtcctggtagatgcctgctgggtttcactgtcgcttagcaatactgttttaccttacggagtttatgcggctcgtccatcgaatgtctgttgctccgcgaatccagctcattacaacggtaacacaaatagcgtcaagtgcctcaaacatgatctgaattcaaaaatgtcgagacgagcgtaaacagctggaaatcaccgaacttaccaagatcgttgacatacatatgatgaatatggctacaacaacgtggagaacgttatctagtcctttcaatccctaatcgagataccggcaagatgcagttcctgttccttggatgatggtgttcattcctcacctggtgggagaataacggtaattgcaggatcacagcccatgaaatactaacaagaaggaatagctgaagtcccaaagttaaaaaacataccaaacggctccgggcatacttatctcaccaagctcgatagcgcaacaatactaaatattggactgcaggaggcattgtcttctcgatcgtaaacgtctggtgtcgcttcatgctcacgttatcatttcttgcaaggcgtattttttcatcagtcgatggtcatcaacaatcacctccgccatatcctacgatagaggagctttgtcacgtgaggaagcaaagtgcgctaatgcatgccacacccaccgcattacccgcgaaagtgcattcgaagtatggctgtttctgctcagccagcttgaaatatagaatgctgctgtagaacagtcctgccgtgagatatagcccccgactgccgtcccgccgagaagcatcgtggttctcacttaagtctttcagtggcgacagaacacgtagcgccgtggttgtccaccggtttctgctgcgtgacgcactgttttcggcctccagtacgttgatgactacagatggaaaacggcagaaacccgaaaaggctgctgcacatcactcgagtaaacttctgtaagtctctgtacaggatttgcattaccggcgaaggcaatcggggaagcacaggaaggtacggaagccaccgacgatatgagtgctcggtactccggcggtctgctgccgtctgtggtcatacgctggaacctgcactgggatttttatcctgcttttgcaagggcgagccaaattggtttaccatgccacagtacatttggtgcagaggaattttattaaagatatgactacaacagaaataatggatatttatttgcaactgcttcgacaggcagtcgcactaactagtctcggtctggaggaggtgagaaagtataacaacaccgagagcaactggccgccacgcgggtgccagaaagtccgtctcgacgccaaggatttccccggcgtcacttgtaagtggtttgggaacaggccgtccgatggtcaagactgcagcgcacatccacgcattccagatcacaagaacgccagaaaacagcattgtagcaatcagcgcagtaactaaatctggcatctcaaacaatgcttggattccagccaacgtcagcgaacgtcccctgcatgctatggataagaccagggcgtacttgcacacgctcaactaattacctctcgtacgaactggtgacaagatatcgcagcataccgaacgtaacaggcagcttgatctgcacccgacctcaggacgctttctggcaccagcaggtttcacataattagcgtgcttaccaggaagccagtgactacgacccacacagccgtcgctttcgtgaaaggggacgcttgcaaagtgaaggaggctgagactataaaaatcgctgacgaaacaaacggcaagcagtcaaccagaagaaaggaaactacacgaagtgaccttgcgagatataggacttttagccatccaaagcaactgaacacacaaacaaaagcgaatgcgaaaagaaattcggtgcttttggcgatatcccgaaaaacaccgtggacaacatccgtttgaagttgtgtggacgagacgaagtcagttgcattgaccctctctggcaggcaatattcgccaataacctagagcaggctgagagttgatgccttaaaaccgacggcataacgaagctgcgtaccagctgagaaggagagaagcggtgatccctgacaccgccttttccattggggagcttcacagttttgtttgtttcaactgagcagccagtctttaaccgtgcggatgatccgaaagccgtcttcttacctcccgggcattcgctcacgcacacggcgagtgccatgttccctaattcagggtagtagagaaaaacccgatctcctccgacggctacacctccacacgggtcagctgcgaacaggaaacatgtgacctacctcttgtacaacactcttgaccctcttaccgttcaagtcgtatggtgcgagtttttccacacccccatgactggcggcgtagtacgtgataagcaagcttaaagtggacagcagggtcattcctacgcagacgagagtttccactttggacattacggcgcgtttttctgccatttctgcctcctgctggttcagcgtttagactggcaattgtcactgtgggattctgtgaaagaaatcaggttcgctttgaaagttcacacgcatttgccactgcacctcgggtgtatgcgctgcccatccctgttagacacctggaagctcctgactgttgtactgtaccgatgagcatcactaaaaaaacgtgtttcactgaacagcttgcgttctcagtattcagctagtgtatttgttcatctcgagcaaagacgcgtggaaacacactgcagcagacggccggccctggggcccgtagcccagcacgttaaacgtaacggtcggtgacctggtctcgttttgacatctgtgttctcttccttgttccacgggacagaagcgggca

SEQ ID NO: 2239 - DNA, 4980 bp, Toxoplasma gondii
ttgctcgtgtcgcgacaaacacacacggataaaacacagacatgttcaggacacccgccatgaatgcatgcgtagacctgaagcaacccctagacagctgtacgtatctgggcagtgcgttgaaccctctgtcttggttatccttcctctgcctcttcctccaatccaaagaagttgtttttctctcgttgctcgcgactgcctcccgcatcccccccccacccaccccaacgcccctatgtgtgtgcgtgtcaggttttcttcacacagcagaagcgcgtcctcccaacatttgtttgcacgttttcgcgtttactctgtctgcggaacttgtcttttttttcaaacgaaacattcgcgtgtaccttgtgttgctcgagttgcttctggtctaggctgtccacgtacgtggcctcaagttcagagagagaaactttgccgtcgttgtctttgtcgatcgcctggaactccatgcggacctggtgctggtgcatcgcgttcttcaactttgcactccattctttcgcttcctcggtgtcgattgtgttgtcttggttcgtgtcgatgaggtcgaagagcgccagcatgcgttccttgatgtccttcacgtccatctgcatgagttccgcgagcttttctcctgacaacttgggcatcgccgcctccgcgaactgcgaaggcgcgccagagagtgcagagaaagcaaacgaaaaaaggaagagagaaaacacgcaaaggggcagagactttcggagtcggtgcagctcccgcgcaaggaagaccgcacccagagacacccggcaggtcggtctgtctgcgaaggccgccattgttttctcgagataagcgacgaaagtagaattgattggggggaacagtcgagagcgcgacgagaagaagatcagaagaagaggagaagaggacgagaaaaggcaagacaacgaacaccgccgaagcaaccacgttggagagtcggaaaactcgaacttttttgtgtggttgagaagggcagcaaccgagatccggtttcctgcagaaccagctaaattgttgaggcaaaagttgaggatagaagagacaccgaaaaagttcgagagaaaggagaagtagacagaaagaacgctgtgcagtgttcgaacaggcagacgagaggagggggggagaaaaaaactgaaaaggttgtctcacacccacgctcacccgcctcgccagccgactagcagccgccacgcgtggtggcttctcgtctcgtagaaaagacgaagtggcgcttgcgagaaaaagacaaagaagctcagacgcttaccccccgcaacttttttcatcgaaatcgcccgtcgttacgtgtaacatattgatgtgatggagcaactttggggagactcggccatggggcgcaaaaggtacctctcggcgtttgtcagaagccatttggatatcagttgcagaaggggcggtctagtgcctctgaggagaaaagaagttggaacgtttaaaggaaacttcctcagagaaaaccgagaaaaacacacagcagcagacactcggggtgtgtgtgaatggtgatgaggtcggaaacgctggtgtatgcacctggcagtaaaatcggagtcaccgatttgaaggaacctgaatgtcccatgacgtggaaatccaccatgttcagcattgcgtacttctaaagtcatgtgtaaacacgctgaacaagtcgtcgtcgctttgctcagcctctaggctatctgctggaaactacctgtcagagacccgcagccgcactgatggcgcaagcacttgcggtagtcaagtcacatgttccggctgtctatgcacagacagaaaggaaatgctcctgcagacggaaacgcgcacttagtgctgcaaacgatcccaccgctcacacaccaatttgcacataactccacgtcgactagacgtccgggcaatttgctaggcagagtaaaaatggagtcacccgtgcttgacagagaccgcaggacctttggggaagactctgaggtgttctttactgatgtaaagctttttaacttaaagcacatacccaggaggcaacgggacgcaccagttagacttcataagtgtgtgcttggggtgcttctttgcagaaaacgggatgcgcagcgtagcagcagacgaacgcctgcaaacagaaagagttcactgcgactgcacctccctaggagtttgtttctgcggacgcacaatgcaaatccttgaaacctgatctgcgttccgtaccatcgattctaattcaaatatgtgaccaagaactggcaatcgcattggggcatttcctctttcgggctatcgaagcagaaaaacgtttctcaactcttgaaaaagacaacacgacggggggtacgatagaaagtgacgctcgcactggttaactgctattcctgcatttacgcaccgccaaccaagagccagacaaacaagagaaagaactacctcaccagtggagagttctcttgaatgtggttggtacaccacatgagacatctcagtccacaaaagcaacgcatctgtcttctgcttttaggttagggttatgtcgtcgtatcaccaaaacggtaaaaaatggtgcatttgtgatctcccagttcacttaaaaccctctatccatggagaaaaaggtgtagtctctgcctctccacagcagagggaaaaaaacgtttgacaaccgcacaaattgagatttgaatcagcagtgtgtcgacgctcttgaagttgataaagcgctttctatactctcagcttatcaggcagcagcatacccaggcgaagcaaactcgctcaacgttttttgaaacgaatgactagtcttatattttgcaaagatactataatatctggaacaaaggatgacgcactggaagattcacagcgttgctttccgcagaggcacaaattgaccgggtaggtgttttggagctttcacagattttgatctacaaaatgctacacatgcagctcgcgggaaccactcagagaaaaaacaagaagcgggttctttggtcatccatcaaaactgtaacgctgcgtttctgtcgcagaatgaggaacctctgttcgtgacagaaacgcttgtctacgaggaaagagctttttccagccccctagtcgacccgcacactacgagcgtatctgcgaaaagaccctttgtcagaaacgaatagacggatgaggtgtgaacgaaacctgtagacaaatgtcgaaaccctacgtgcgttctacagcagaaacattacgattttagactggttgcttcagtggaacaaacctcccaaccaggtgccaggctgacaccaaaaactaaacctataaacatccgttcagacttccatgaggaaggcaacgccagcaatgaaaatggtagttgtacagcttgcacacaaataaggtagacacggtaacaacgctgacggcacagctgtgtgcagaccagattgggctctgtttctgacgcactggattaaagactttcgtctgtgcagggcaaaacaggcgggaagtcactctgctgaacaggcgacagcattgcgttgggacttaacagcccacgcagaaatccacttcttcgagtgtattgcttggacacgcgacttctgtgtgtggcgatttcctgtgtaccgcgtctcttcccgtccaggaatttctagaagttctgtttccatgtgcacttttctcgtgttttcgcggaccacccttcttttcacgggggaacagcagtggctgtgcgtgagaaacgcgaattttcgctgtcaaatcggccgagcagcatgcacccgccagcagctcgcgtgcggcgctttccaccagttttccgcaatagaaaagtgtcttcttccgtaaacgtttctgtcagattcgggatcggtcgctagaccgttttctgcgccgggtgtcgcctgaaacgacaagtcgccttctcgccgagaagttgaacatttttggactgcctcaggctgcgtcccgaacaccaaactctgcgctctctcgttttctggatttcttcggtgcacatcctcacgctgcttttctctcgtcgcagcagaccgacgtgcgtttccgtttctcgagctttgctgcatgttgtgtcgttccgatcgtcgtgaccctccttcgaacgactcgccgccggccgcctctcagtcgacgtgctcgtgcgtggctggactcgcaaaacatttcttcacgcgtttgacgatgtcctcttcacatcgacaatcctccgactgtccaggtagacgttctgggctcctcttgcttttcataggcgccgcgcgtccgcaagcgacatagtgctgtttcttttgccagtttgcggcgcgtttcaagggactggcgcctctcgaaggccatccagagaaagcatacgtcaaatccttttcctcaccgcgagaaaggtcgcgctggcggaaaagtgaagtttctgtcacagccgcgtctttggatctggtagagaatccagtcaaggtggaatgaagtaggcactcaggaggcgaacgcttcgtcactcgtcgccagaggagacactcgtcgatgcatgcgcgtttccctgtttctgcgaatccaatcgaggaagcgcacctgccctctctctctcaccctctcaggcgacttgtttgtacgtgtgaaaacgtccctgttgcgcgctgtgtccgacgacagtcgcgcggcatgcctcttgctcgaatcaacagagcgttcttcgtctgtccggaaagggtgagactcagtctctgcgttcgcctgacacctctcgaagcctcctgtcgctctgccttttctttctcgtcagagagtccgcctttctcgacgctgcctccagcttgaagagaacagagaggacaagttctggatcaagaccttccatcactgcgactcttccagcgagaactgtggagctgtttcgcgtacacaagctcgtctcctccgccaccggcgagactgacacca

SEQ ID NO: 2240 - DNA, 1673 bp, Toxoplasma gondii
accacactttcccgcgactgcgcagatccacagtgataccacgacttggacatgtacgtatacagctgtttacatacacacatatacatatatacacatatgaatttatgtgtatatatacatatacatatatatacatatacatatatatacatatataagtatgtaagtatgtgcttatagacagatagatattcatacatttttcgacggaggcatgcgcactgagatgcgatgaggcgagcgcctggctgcgaaaaataaaaaattggagctgcggcgttccccagacgccttctttccttctgtgcgttttgcgtccgcttcacgtcgaggcgtggattcgagtgtcgtggaagaaagtggaagcctttctgttttccactgtctctacccagtcgcttacctcgcatttcatccatggttgctctcgtcgaaaatagaaaacagagcctaagagacaccgaaactctggcaaaccgcctgaatggtcctcgcctcgctttgcgcttcctcttgctctcgctcgtgtcttgtgcgtcctgttgttatcgctcgtgttcttcctctcgttctccgcgagccgcgtggaaaacaggcgaggcaagctgagagagtgaaacgctggcgagacgcccgatacttctgtacgtggggtgtatgtccactggagtgtgtgtaccccacagaaagggcagggaggaggaggcgactcggggaagacggagagttgcgcaagtcgaggaaaaacgaaaagttgggagacaaggctccaccagacgttgaaaatactcacggagaacagctgaccggaacagcgtgcgtacacgactgcagaaaggcgagtgcagggtcgcggagacaaacggtcctgcccttggcttccctcctgcagacagtcgtgctcgactcggagtgtggaagaaagcgacgacgaaatcgcgcatgcagatctttgcacgtagtgccccagctgtcacccttccgtgaactggccgaggcaaaggaagatcgccggcgacctgctctctgccgtggaaggccttcttctcggactgcaggcgtcaaaaagcaaaccgctcgaaagacaagcaagtcgtttctgaagagtggaggagcacgcagtgcaggggcggagaacgaaccgagagaagagaaggcgcgcagagacggaggaatcccagtctgcggtctgcgtcttttcgcgcaactctgcgtcttcaggcaatttctgggtgccttctcggcctccccaactctgcgcttgccaaggcaagaactgccgcggagaaaaaaaaagagacaacggagacgatggtgcgcgcgagtcgacgaaaaatcacgagtgtacagagccgtcgagatggaggtggaagcggcgaaatccggactctttccacgaaggaaaacggagaatctgtgaagtcaacgcggaaagaaaccgcaggtttccccggatgaaaggcggaaaagagccgcacagggagcaacgagaagtggaaccgtacctggccgcctgtgcttcttgccccctacatccacgcctgttcagtccagctgagttgggagagacaccgagtctctggagcagagtttgcgcagagaaatcgagcgtgaaaatcaattcaaagtcctgtttcgaaaaaagtttgccgcgacgtctgccgagagga

SEQ ID NO: 2241 - DNA, 3221 bp, Toxoplasma gondii
cccgaccgttgttcggccgttcaacatgccgtgacgtgaaacggttcccgttggaagcgagtcacgtcaaaacccccgtgacttgttccacgctgtacagggagagcttacgagacagaaagaacacaaatgaattttttctgtgtgctggaagataaactggctgggcatgacttccataacgcagctatcgtcaacttaggtcacccgcagaagtgacggcggaacgtgccaagcgtagagcattgatagaacgttgaggtagatgtaggagatggtattctttgttcgcttgcacctatgttttttgtttcttgcaaaatggtagaacgtgcagacaactgaaaggctcccacagattccgtcgcccagagctgttgatgaagtgcctgggcaggactcccgtaaggcaactatcgtgactacttagactacttgcagagttagcaagaccctttagagactcgtttactagatttggtgatgaatgctgtccaatctgttctgtattccacggattatctgcagcgctgtttacaacaacccgtttcattccaaggcatggcaagccacctctcgatcctggaatagctcaatatgtaccatgggtgtaacttggcgcttttagaaatcatcatagtacactgaccgttttccataccagtttcacgtcgattttcaatcgaaatcaacagcatcacttcagcttggatgtggcctcgtatccgtcatcggagactctgagaggatgagaggaaatggctggcttggttcgagtgctcaggttcataggcaccacgcaaatcaatgccaagtgcgttgttgttacatcctctcacaagtgtaattccgaatcgctggtgcaatatatctgtagcaacggtaaattggctctgtttcgctcctgtggctgcccagccgtgtcatgtgaaacgtcttagtgtcatccatggacaaccggcattgagctgccggcagatttacagaaaaccattgtggggcttcgtgtagcccgcggaaagttgaaatcatatgctatggtaatttctatagttgtgcagctactccaaaacaattaagaaagcatgcccagacttccgtcggcgacaccggcaatatatatatatatatatatatgcgatagttaaactgctggtcgagtctaaaacgaccaaatgccttgcttgtttgtagtgtggtacacgcggcgtggcactgccgcatggagcaccacaacaacagatgaaatctgcataagtgttcatattttcggatgggagaaacaaaatagacgccgcgattaccaaacggcaggtacagcgattgtgttgctgccggcgaacttgtaattcggtactgcctcgggaacaaaggcatgcagtgtggtagggctgcgctcccacgaatccgcgaacttcagttatcggcgtcattccatctgcaaggcaaaaaacctgagtttatttcggcagcaaaccgtgtctcctaacagatcgacgagactccagaagtaaacaagaaaggtcctcaaactgattttctgcacgctgtctttgcctcattgatgacgctggccgcggatatccccgacgtctcagtgtcagtcaggaaaggcattgcggctggtgaaataatgcaaagtgctatggctccagacatcgtgaggccgtgcggctgaagaaaacgcgtcaccagatccgccgctttctgggtatcgatctctctggttttccaaggagctcctacgtgacctgcacaaagagaaggcaaaacggttcatctcagcattgccataaatgataagtctcgcttttcgaggacaaaaccgacacttccgaggcgacattcttaggtgcatagcatgatgctacacttgagactggacgagaaaaggtgctgacctaaatggggacgcccaaacgcaccaaaccctgtgactctcacttcaccacaatagccgttaataaggagaaatcgtccatccccacggaacccagtgatgcaccgaagcgtcggcaaacctgccggcttctttaagggacgttgcaaaaagtagcgtttgatgggtgtcttgatgtcggtcacaaagtgttgaataggatccctttaagggacagaaccaatacacgtacgtcctctgtcagctgtatgcttgcctgttcatggagcagcttgtcctgtgaacgctttccatttctaattctttcagtcttacccgcgaactcttccagaaagcatgcggggtcaacgccggtaagattacagtcgaagccggcggtctcagcaacagttgcgctggtctgtttgaactcgtcggactgcgtcagcatcgctaaagggatctgctgcagaacatcgcgcactcggtagttgtccgtgtcgccaagcagttcgaagagcataccggttggggacccgcccgaagcgaacaagtcgacgagatcgatgtcttgcgcggatgacgcactggtcaaaccaagcaaaaccacgaggacaagagctaaaactagagccatcttgtaggctgactttgaatgtaaggaggcgctgtccttgacagatgtgcaaacctttgcggaaacgtgttggacacacaggaaattacctgacgggaggaggtgtttcgtcgtcgacgcaggtgttttgttacagctattttcgggaaggtgaaagtggatgaaactctgtttcaccgtcgacaaatgcaggatttgaacgtgattctagagtgtgctggttgctggctgacacagacgaaaggtccgaaacgcgatcctatcctcgcttggcatatttttggctgcctgacttggactgctgcctccttcctagattaccagttgagtaatttgatacactgccgcggatagatggaaacaggtgattccctatgtatttgtttgtctgtctgtagagctatcttgccgcagttagccatcattccaggcatcacgccattcctagtacccgccttgcgccagtcagttgaaggtcccagatgggccctttacatgtttcacggcacttctccgagtaaactacgtttacccccgtcaccaagattccttttttgcaaattgaaacatcatcctattaatgcttttgagaggtgtacactgccgcaagcgtttgccgtattcttcggttcccaggtatccggttgtccgtctctacaggttcccaacacgtggtcaactgtctggtttgctatgttaacacca

SEQ ID NO: 2242 - DNA, 3373 bp, Toxoplasma gondii
gcttgaggattgcaagttatcgtttccgtccgcccaccaggatgctgctgctcgcaggatagtcctccatgttgttggtcttcattccaagggttcctcgacctcgttttcagtccaccaccacatgagaccgagcatgtactccattcttcaaactgaccgcaagttgcattaattggacacggtgaggtattacatgcttcctcctgtcgtagatctgtcccaggccacagtttggacacgagcgattcgtcactttctccgttctgcgaccccagtcctggtggcagtgcgtttctcactcgatgccgattgccaccgccacacgtgacagtgcagtcgctccatgcagcccattctgggggagttggcggtatagttatgcaaggagcaagagttgcttcttctgtctgctcctgtaacaccggcggatcctgattttcacaccgacggcctgccccctggggtggtgggtcattgtaacgcgttcgctctcgcttccttgtggcatttccgcaagacgcgctccaggcggaccactctccccagacgccacatccagcgtcaacagcacatacccccgcactgcattcacgaatttcttcaagtccgccttgttccacgcaagtccttcccatgggcgcagggcagtccggacatgttggtgttccaggttgcggagcagaaacctcagttcgcgtcctgatttggcttccgtcaccgcaggatacactgcaggggctccatgcggaccaatccgagcaaatggcatcctgggggagtgtcttacaaacctctttaagcatcggtttaatcgccgtcgcgagctgcccccagtcagcccgaagatacaggggacacggactgtcatcatcgctcgtaccactgcacccacacatgcttcggcactcactatgtttgacgtaatgaccgactgcaaggactgtgacgatgcctccaagctcacgaatctcctttgccgctctcacggtgcgaaaatcagaatccgattcgccatctgtcattccaatcactagcttcggcacatgttcgcgtcctgggcgcgaacctgtaaacagaatttgtttgcaggccttcagtccatcactggtgttggtactgccctttttatacggcatgtctagcaccgcatgcgccgcgagctgcttgtcaaccgcgttcggactctgtagatcccattgcaggtgaacgtccgtcgagtaagtaacaactgcattgttaacttcttctgggccaatgggcaacaccattaaaaaggtgtggaggaactgttttactagacggaaattctgtattcctatgcttccagacgaatcgataagaaagcaaatgtccagctggttggtgcacccctctgcggctccgatggcactctcagattgaatcacatcttcaacgccttcaggaacgagcacacacatatcccacaaagaacagcgacaacatgggtataatcatggcatatgcggccactacacgcagcagcatgatccctctgtgcgtagtcacctcgaagtcttcgccggtgaagtcacgaaagttaaaaacagaaaatacaagtctcttgggggaggacgccgactgcggctccacggtaaataacttcccatacgtctagtgcgggagaagccaacatcaacaacacgtagctgcagaagccagcaaccacaaaacatgctgaatgccgtttactgttcaagagagactaccacactctccgatatacaatggctgctgctgcccatcttcgaagagagggagacgagacgctacgagatacacaatcgaggtacactgttgtcgtcaccttacctgaagtatcgacaccgtttgcgtcgcctcctcgactcgtgtcgtacctttttcgtaaggcatccacaatactccaccctccacctgccacttcgctcggccacatccacataccgcaagcgaacatcagaccgaaaacggcctcgcgttggagtctcattgtgaaaacaactgcagcaaatgtcgcgaggcgaaccaaacaaccgaagtccacgatcgggacgagcacccaaaatgagagacgccaaagggcgggccggaaaaaacaaatgataaccgctgaaatcgagtagacgacgttgcacctgacaaacgaaactcatgagcacggtttcgttattcgaacaactcggcataccatgcggcgtcgtctctgaaatcgacgtcgcgtcgatccggctgtcacactcggccttggcgttgcttgcagataaagctggacggtcatttgagacgcgacactgctaagaggaactgcagaaagcgtgcgcacatcatcgttaatccctttttggcgccagcagcctcagtttctccaatgctgagtgtggtatacgtcgtcgttgagttgcgatttaaggtcgctctggagaggacactaatgaagaacagcattgtcgaggtagactgcagatacttgctaagcgtcatctcgaataagcgtattgttatatccgctggtccctaggcgagaacgtggtcgtcattcagatcatgcagaattttcccgtaaaaaaacaactgtgacgtcctgggataattttcttggcaacggtttttgtggggtgcgatgtctatgatacaagcataagcgacggcacggtggtgggcaacaaggaggagacgaaaggagagtaacacgggtacgtactcaatgtgggatttgtttggctgtcggtgtttcgtagacctgacaggtgactgcacaaaagcaagcgctttcgacgctgttgtaacactggttgagcgcgtctgcggcacgcagatgactgaggtaactttctgctagttttaggcaaatggcaaacttgttattttcagtttctgcgttacaaaggaattatctcctgtgggtagagtgtcttaaattacaagttttggcaaagaaagcgttgtggtgaagcaagcgagcgctcttttgacataacgaatgtagtcgtcagcttgtacagtctcatttagagttaatcaatctcactggcacggacgaacactatgcgttcaatatagagtgctcgtgtagcctatgaagctagtgtacgagtaacagtgccggcaacgtcgctcaggaagcacgagttacattcaactactggttaacagattccttcagcagttgtctttctgcatgtcgcaataaccgtgctggctgcgtcgttattcaccacgaagtcgtattcggcgcagagtcagaactgctgaacgaacgtctccaacaactgcggatgcaagtccactcacagcaggactcgcgtagcgctgacggcctcccacacgacccgttcctggtgtaaacttgcattacggctttttttgacca

SEQ ID NO: 2243 - DNA, 2025 bp, Toxoplasma gondii
gcatatctctgtacaaatcggcgttggtggtctttccctctgtcgcggtgggcgcgtccgttgtgacgtttttccgcttgttattcttgtacgacagaagctatgaagttctgctgtttcaggtattggtaatatcctcagcgccctcagctttgttggaacgctttatgtctgcagaagacaagggggctttttccatctcgtctaacgactacggtggcgctcggcgccggccgacaggaacactgggattgcacagttttctgaaatgaatgcctcttttctctcataatgtgtgcgtcggtatttttggccacatggcaagagttctttcactcagcggtctccctcacaaccactgagagcttttgcgcacacaaaatcagccgtatgtgcgtgggcatctatggcactgtgtgcgccctgggcagtgctcctaaatgacctgtagtcgggagttgaacacagagggtcctgccaaagaatagctgtcttgcagagacggcatgcaaacggtagcttccgtcctcgctcgccatgcgtcgatgtccactttcgtcggctgcacggtttctcaccacttctttttcaagggaatcaaggctgctcatactcgtgcccacgactgagcacgttgctggttgtacacgaaccagaaacagggcctctgccttgctcgcgtggacgcgttgttcgtgtctctcctatttctatttctggagtcgttgcttgcgacgaggcaccccgtttgttgcccagggccccacagtgtaggagataatacttggtcgatgttttccaacggtggagcgctgtctggtagcgacagaagcgaagtgaggttgagagttctaggatatcggaccactgcgaagtccctttatctgcgatgagatgaacggttccacgttccaatgtttacccaacacacctcgcttttccagttggcttgagccttccagtcatgatctgttctatatgaatacctacctacagcagcagggaaacgagctatttatcatgcgagttgcagtgtttccgagtagcgacggtcgccaatgtgtctgcaggtcactttacgatagcgtcactttgggccacgaactctggaaagcttcacggtgcgtggaagccagcacacggcccgtctacggttaggtgaagggacctgcgtactacaagaacgttcgtcttgctattgagaacattgagagccgggaccgtcttcgaaaaatgcaagcgctcgagcacaatctgacaggtttctttttttgcctgacgggcatggccaagcagagaaatggtgcaaacctcgtccgccgatgaagtgcacgtacatagcagtgtcgcagaagcctcctcgcatgcgaaacggaactacctgtaacgtatgtgtgtccaggaagtaccagaagtgacgtcttttggtgcgtgtcacaagcagtccacatcccggatggtgttgccgagtgactattcgcgttacgctgcgtgcctagagtgtacagatcctttcagtgcctagcgcctgcctgctacttaagtgtgaccggtcagtttcagtctttacgcaaacggtatacagcaaccacagcagttttacatccatgaaaagttggatgccctaccgggatttcacccattcgcggcagaatgcctgggcagcagatgccgcccctgggtattcgtctgctcaaaattcgcgcgtcgcaaatcccaagtccacctgcactgacctagatcattctcggagaaccacaggcatctgcagaattcagaaaacagccgaaggttcacagatccagtgcggtcaactcgcgacgtgaagatgccgtttgcgaacggcgtactccaccttcgttgcccccaagtgccgcccacgctgtggccagtcgcgagaagcccagcgtattgaattgcgacgcacaagacagacctgccaggagcggcagcgattcgatttgagtcgaagaaggtcgcaggggaacgactcgaggttgtatccgttccacggccttttcacga

SEQ ID NO: 2244 - DNA, 1559 bp, Toxoplasma gondii
cttgttcggcttttcgcatggcgatttctcgcttcagcttgtcggcacaggcgagaatcggcatgcctgtgcagtggaggccgaggggccagagaatgtttttgccttgcatgcgctggaaacgcgcctgaaactcggccctgcacaaggtgaagccatggcccagatgcagctttccattcatgtacggataggggaagctgcagaaatactttttcttctcggcatttgccgcatccaagggcgcgtcgacctcgtaaggattttcgcgggcccaccgagcctgaatcgcctcctcgatgctaagaagcttgtcgcggcgaccacgcgactgaggcgctgctggagctgctgccattttggaagaaagtccgcgaaaaagcaccggaagaggcgcggcagaagaggatgcagatggaggagatcgggagagaacggccgggagaggcagaggcgctctgagagaggcaagtgaagagaagcgcttcggagttggggaggggagactcggagaagcagccgaggaaacaaactgggagacaggctgggacagagccaggagagcgcggcgcagccgttcgccggaggggatcgacgggaggtgaaaacggtcacgaacagcttcgcccgcagacttgcatgaggccattcaggtgaaagcgagacactgaggaacatgcagagcaccgagaacccaagacaaggaagcgtcagggtgaagaaagcatacaatccgcggcggacacccagagggaagaggggagaggctttatggcggacgcggggacgcaggacagaagagaaggaatggtggaaaacgagtttatgccacagcgatttgtcaagagattcgcagatttgccgtggggcgaggacgctgaacggtccaggccttcaccccgacgaagagacacggtggcgacgacgggcgttcccgcggaagaagagggtcccctggggaggcaggtcgtatgacgacggacagcagaagaaccagccgcagggaagaacgacaagatctacaggggaagaagcgaggaacccaccatttctgttccactagaaggcgctgtcggccccagagaaaatcgtcgtgtgtcagcatctgcgtagacaagatgagacggcgggccgcatgcgagaaaaccagctgtgcatgccctctcgctctctaaacgcgcgacgccagctcgctcacagccatatgtttatgcgcgagtagcccggtttgagtttgcgcggtggccggttctcagtacggacgggaagttcagcgctgggaatggtctgccaatttgtataataaaaacggcaggataaagctgggacgcggcttacgcgaccagagaacgcgcggacgccgaacgtcaggtgggtgcggagacggccgccgcgagctgttctcccagttttcgaatgttctgcgggcgtcgcgaacccatttccgcggcgctttccctgatgaagcgtttttgacggatggaaacggaacgtcaaggctcaagagcaccgggaacgggataggtcactgcaggtgtcaatcttctggaggaagcgga

SEQ ID NO: 2245 - DNA, 3720 bp, Toxoplasma gondii
acacgagtagtatgcactggtggagagaggatcgcacgagagggagtgcctctcgaaactgtcgtggcctgcgggtgctgtcctgcctcagggccgacagaagcagcgtgagacgcagagggcggaaagtgggggacaggcggcggacatggaaagaccggaggcgggggagggccagatgcatgctgtgcggacatggaagcaacaggcaccacgagatgagaaggcggaggccggggagaagcggcggaggaagaggaagaatgaactgcatgtgcaggagatgacgggaatgaaggaccggaatacgcggccgatggtgacgaagaggtgaataatggagacggagaggaactggaaacaggcggaggcagaggagaggtaggaagcactgacgagttcattcctggaagcggagagaactcaggacgtggacgaactgcgaatgagggcatccagctggatgcacaggggacgtacgacggagaagatagggatggaaacaaaggatccgaagaaggggaaggcttagcagcttgtgaccccgacgacacgggggtcgcggcttcgcttgccgacagcccgtgtcgccggtgagaagaggaggaaacaaatcgccaagagacgcgcgcgacgcagtgtttggaagcccgaggggattgagaccccccattagcggccacgggagagaggacggggaagccggaggagacaggtgacgcctgaatcggcagcctcaccttcttgccaatctgagagaccgagaaaccaggccctgttgagtcctcgtctgaccataccgtgggcgaacggcagagacaggatacagtccgctggtggtccctcagcgggggtgctggagaagaacccacagcgaagcactgtgtaggcaaggagggcaacagacgacgtccaaaagatgtgggatgattcccgtaagacgcgcaaccgcgacacggcaccaggcgacgcattttgaaagagtagttacgaaatcaccagagttctgtctagaaggcagaaaagaaagtcatgaatcgaaagggaacaggcctcgctcggtcggcaggcgcccctacgccacggcgaactttatggtgtctctgcttctgaattgagacacgggacacaaggcagtgagagacagggggctcacggaaaggggagcaaagctccacaagatagaaggtaagagtggatatcgaacattccgaatattcaagtcaacaaatcagagaaggggatgttttcgcagagcgccgtcatggcaaactctcgatgatggggctgacggggggactgcgacacccaacacagcgggggcaccctgactcggtgttggaggcggatgggttactcaaaaagaatgagtcattcactgcttcgaagacacgataaaggcggttacaatactcccaccaacaagtgtgtatcaacggcagatcacggtcggaaggccatccacggtatccgactcttgggctgcgggagccagtcagacacgcgagaggaggccctcggcagcagtgacgaaggaggcttcaagaatgtagctgcagatgagaagtgactacagaggaccagttatttctcatggggcaagtgtgcaaggaaaaacgccagagaagttgccggcaaatcgcgttgcgctttcttagcgttttttttcgaagtctcgctgcatctgtccaccaacgcctggctcgctgcatgcaatagaattgcagggcatgtgtgcgtttcactccgatttcgcctgagtctccttcattttgttaaaggtacatgcatttccctttccaagtgcaacggaaattacatatgctacatgctgtattgtaactttcgatggaatcaacgttctgccaaactcagaaagaggcgttccgtgtcaagcggggtttcatatgggttacagacggggaaggaccctagcgacaagcaccgatatccacgggcacgccagctgagtttgtaagcgtcggagtcgagcagcacggatcatcacttttcatttcactctacgctggatgattgatgtctcagcagtatgactcgaacggcaaatgaatggggcgcgtcgtacttggtggcaagaccgttggtgtggagtcgtctgtaacgcagccgcagtgtagttgtgcactgtagttgcgcactgtagttgcgcagtgatgtttacacctgaacgtagccacgtcatgaaacgagcacaagcggctgaatattagtaaatcggcaaacgaaagagcgtgtccagaaagccggccctgatggctggtgccagaagcgcagtttccaccggacttggccaacacagaagtcccagttcgactggctgattagaatgaacacaaacactcctatgctagtgcgggtaggaacgacgctgacctttcagtttgcgtccgagcaagatccaggtgggcgtcctaggagaggaagcaaggtcttgaagtgtccggaaacgtccctcagtttgttacgaacctgcggaccggttctgtttgttggcccatagcaattagaacttttccacagtcaaatgggtacggcatctgacagcctcttgagatacattgctgttggcaaagtaagccagacaggaactccgataactggatggttgtactatcagtgggagtggcgttctcctgcgtgacttcctgcacacactgcaacctcacaggggacaaggcgcctacggggggatcgagtgtttgtgggttccaacgcgaggaatgccatgaaattttcggggcaattattggacgcaaccacgttaatgatacatattgggtaccgtgtccgtatgtttgatgtgaaaccaatcccaagtgcttcaccggcgtacgtggtatagacggagagagagcaaagggggagtcttgccggtgaaggctctacgaacgccacctactcgggcggtgctctggaagttgaaagatcgatagccatgagcaatgctagcttgctgaaagccaaatggttgtggctagtttttctgtgttcgtgttataatacttttgtcacgttgttacccggcccaattccgaatgcgattttacgcgagacaaggccagatgccagcacatcggccgcgcttcggtcgtgctgccggataaacggctcgtaaaaaccgaggtgaggctgtaatgctctcggtgatactgttcgtaaaacctgaggggttgctctaaaagagcggtctgggcgtatggcgactaccgtcgcaaagccccactccatggaaacgtacgaggatagcggctcggcgttctcggtgagacgagtcttcttttctctgagaactcagttaattaccactttgttctctcgtaggcactgtgcgtcaggctgcgtggtagtcttgcgagacagaaacgacgatcgtcattgattgcgggacggacaagaatgcatccgtgtgtgtatttgtcttgaacagttggcagcagatggcctccgcccaatcctgccatgacgtgatattgtttttcctacctggtcgctcagagtaccgctagcagtcgctacgtcgacacggccaatatggtcactgatacggggatgcgtgccggatttcacaactgaagcactggctggggaggcgaaacagcctcggcgtctgaacacttcatgacaatccaccactatttttctgctaaagaacatagcatgttacaaaaacaaaggcgtggcaagcatgagtgtttctga

SEQ ID NO: 2246 - DNA, 2065 bp, Toxoplasma gondii
ctgagggactccgagggcgattaggaagtaacgtgggttctgaaaataacaagagtgtgacgatcacggcaccgcacgattcgagaggtagccaagagagcctgcttgctgtatgtggcccacagtggactgtgggtgagttgacgggtaccgtggtgtcgccaggtgagggtaggggtctgtgtcttccctctccaaacagtctactcaaacgtgacgacttgtcgctcggaggtgtgaatcggggtgtgatagcgtatggaggcacacgggagacttccgaggcacattgtcatttcaggcgagcactcgattcagactcggcgggacgattggtcgcgcagtctgctgccgtgatgggaagtgcggagaagcatctctgcccagttgaaagggcgcaaggggacaagaaaacgtgtctgcgtaggagcgagagatctccgatgcgtctctctccccaggaagcctcactgaaaacagcgccgagcagcgtatcattaactgagcgctgaggcgagaaaaactggatctactacgctgaggagagcgatcagtccagagaacgttcggtgcgtccgtaaggccgaggtgtgttgagagctcactactgtgatatgcgcttttttttctcttgaaaggtcaaaagtaccaagaagctgttaggggcacccaagtgggggtgggattgtcttgcagtggtacaggggtaaccacctccccccaggtggtcggtttcttaacattcggggaagaacgtcgttcccaatatctgtgttacggtcagcgcaccctctctgtcaagctcaagcctggtcacagaacctgtgaatgttttgaagaacttaaaaccgcctggaaatgtcgcagcatggttgtcgttcaatggttcacacatcgatggcatacacactatcgttaaggagagaagcaaaatcgtcagcatgtagggaaaactgttacgtagttgtcttcaacgggaacaaaaacgtgctacgccttcagttcggaagcggtaatgcatgggcacacaatttgctggctgatagaggcttcgtcgtaggggagtgttgaacagggaaggaagtcccttgttgacgtaggccacgttttcggaccggggcaggattgaattgattgcagagggtcattgtagcgaaggcaaggctcacattgacacccagtatctatgaggtgtattttctacggagcagagaaatgaactcttcgttgcatcacacactgagttttaaatgggtgcttcgtctaagaatttcagaaatctaaggtatgtgcaacccggcacgaaagcagtataatatttctgtcggggagttgcgatggaactgcgcaatcggagctgacaatcttgttgacatacccagctcttctggccaagaaaagtgtctaatgtctatgaaaaacaaggatatgctttgagtttgtttaatcctgcatgcacatacttcaaggatcgtttcttctcgcgcttcgaaactgtctgtaaggcattttgaatgagagacaaagtattattactcagatgcgactcagccactgcagtttatcgccttacagtcttgcacgtcaggataaagtgagatccacgtttatacctcataacttgttaaacaaccggtctacctcgacagtttcgaacagccgctgagtagacaattcaacagaacgggatgagcacaccacaccgaatcgtgacctctcgtcgcatagcgccgtggccccaaaaacgcggcacgtgtatgcgacgcggagacacacaggacccagatgagacactggtcccacgcagtggtaggcaaaaccccatgttcgactgtcgttcgagaaatataacttttcgtaaagctcaatttgctaatcatagtcggaacgtgtgctgtcggtcctgccgaggccagcgctgcgccggctgccacgctgtcaggaagttccgcagtgtcgatgcgacggcgaaccgtccagaggtcccttttgttcacggtattttgttgaacagcgttattgattttcaggttggaatttggacgctgaaactgtttgatcaaga

SEQ ID NO: 2247 - DNA, 4340 bp, Toxoplasma gondii
acttgacactgcagatcttgaatgtatatttagcttgacgaacgacatcaaagcgagagctgtgcacgcagcgcgtttcgggcaggctaaacgacgcctctcctgcactgaatagaacccacgatttcctaatttcctctctacaatctctgaaaacacccgattcacgctgccattctccttcgcacgcggcgcctcggtcgacgaactacgcggatcgctgcacgcctcgcaacgaggctcagacgcagtgggctacgcggcgggggcactgactggactgttcggcgatgcttttgacatgctcagcagggaaggtgtagtggagggtgaccgaagtgagtggagggtaggcggagacggccaagtccgtgaagagccactcttttctggactggaggagaatgccgacgttggcaaacttgccgtcatttcgctcttcgtcggggaacgtctccagtttgattccgtcctttcgcataaggtccgcgagccccgaaccgagcgcgcggacggtttcgtcgacttgtgcgtaggtagtgtagtcaaagccgtcagcaatggctgcacttctccgttcgccaatgcacggcttctcaggccctgcatgcgcggacactcccaccaagaaaatgccgtacgcgctctcccaccagtcgtcgtctgtcaggggatcgagaatccgggaacctgcgaacgaagcgacttgcagatctgggtccaacagcgttctgtaggagctctcccccaaaggcatcgggcttgcggagtaagccgcaaatcccgtagactgccatgtcgcgctttcgcccggacctgtaaaaacggggagacagcgaataaaaaagagcacactcgtaccccaacgccgacatctctggattctcaaaaacaaagcaggaaccccaatgcacgtccactcgcggctctctgaccggcggtcccgataccaggcttgtaggacaaagaaacacatcgcaccatagaacgcctcacgggcaccagataaaaagcggaggagcgcgacgagcgtgcacatgtgcgaatccaactgttttcttacggacgcggacctactaacgcacgttttaacaaagtacgctaccgaatgagtcaactgcagacagtcgctccagttagcggtgagcaacagagtgggtctgaccacagaaacacactggatccgcttcagcagccgcgcctcgaaagagcacgattatgtgatgaactcttgcaggagacaacgggggggggcgccatgagtgaaggctgcggaaacacgctggaaatttgatgttgaacggtcgttcgcacgggaaaaagctgctgcccctccagagagaaactagcattcatcgaggaggctggaggagagccctccttgaagaaccgacgaggcaggtggcaaatacgcgaagaatagtgggaaatgggtgcgcttttctcacagttttacacacactcttttgtcaaggaacaccccagacacacccgagctatggaagccagctggccctattttctgctgcagggtgaccacccgcaggtttcacgggctctcctacagtttcgaatgaatcaaaacgtccgaacacgagaaaggcgcccattcattacctggactgccaacaggggtcgcgtatatcatcgtgtccagaaagccgagaggtttcctgcgccgagtttcagaacatctctggaaaagagactctttttccgacgttgctggccggatgtccacaagattgagacggctgcactcgttgacgacgcccgaggacgcggaaagcttccacccaaaaaccaaacttaccgcgtcaaaagcgtgcttctttcgcgtgacgacatcccccgcgctgagaaaaaaggttcgcctgactctagcgagttgcgtcgcgagcacggagtagctgtcgccgcaagaagcacgagcgcccgagacaggcatgcttatgtcactcaattgtacagtggtcgtgctacttttcgcacacggagcgcgcccgcctgctcctcaggatcgtttgtgtgccgccgcacaactggcgacagaacgttgtcggggtaccctgggaaactcatggtttttactatccttactattccaggctggtggctagaaagtgcacttggcttccaggaagccagtcaaaggcaaatttctcggcccagcagagtttgtgagcttgtgttggcacacgcctgcggtcacgacgcaggtgagacaccccgggagctttgggatccagaggtgcagttcctgtcttgagcacacagacacaaataccgagtgctgttcacgtcagtgaaacaaaaggaacgcgtctgtcttgacagaggtgagggacagagccgcaggaaacgcacgctcgtgatcgcagtgttaaggaaacgagcctgcgagaccgattaaaggttaaaaattaagatgatgcaggtgtgcagaccggatcagtgaaactgtgaagttacgagaagtaatgcgttcgtataagccggacgaacaaagaaggaaacaggatttccaagtgtagtcgatgtttgacaggtgccgaacaggtgcacactgttagactagtgtcagagagactccgctggtcgcagcaaactgggatttgcatcgctaaaagagtggtgtcgtgggaagtaaaatacagaagaagcaataggacgtgcgttcctgttcgtcacgaagaacgccatcagaagtaggcgggagcaaacgcgtagaaagtacagcagcagagggcagcaggggtgttttagcggtacagtcacccattgtgaactaatcagtataagggacacgcctcagcgtgtaatttatccagtctttcacttctacatgggttccgtattataatgtgggcaagaatgtttccgtttgcggctgtattagccgctatcaaaatatccacattcaaatatttcaaccggggcttgtcaagacagacgctgttcattgattcgatgtttcagggtttctcctagcattacgttcctctggaaataaaggcgtcggcagcatggtgcttcagacgatatgaacaatagcaatgacgccgttggcattgcggcaagctttgcaggctaggtccatgtgcgcattgttccacgtccatattatcagcttctctggtaactaacacgtggcactgtaaggtggtttattccgatacatgcacgattgtgtgaatcttttgacaggttgttagctaatcgttcatgtctttggtgtctaaacacgttttgatagggtgtactgtttgcgggtaccagagactagtgttgagggaacaccttcccgcctggttgagcgaagagttgccgttgaattagccagccatctctatgttcgtttgcagttctaaaaaataccagtgtcatccacgtgtggcaggttgtgtcacggacgactagtagcacgagtaggaatagcgcgaggtggatcagaaaaaatcccacccacgtgaacctcatcccagcaagcttggttcatcttgtttcatcccagcgagcctgtttcgtcccagcgagcttgttgccacagccgttacggcagattctttcgaagagggatatctttttcatcaccgtttcctatgtgacttctcaatgcgatgagaaccctgaggcctattggttcattgttccactgcgtcgtcgcgattggttctttctgttcgtggctccggctcgtctgggcagaggtataaagcggcactttggcggccgcagtcaacttttgctgctgtggctgtccacattgttagtacttttctggtgttttttcgcccctctctgttctctcgcaagtttttgctcctctcttgagcaaaggagggtcgattcacttgaatcacacctgtgttgttgttcatgtcggcatgtcaaaatatcgtgtcagttccttcgccttctgtgcagaaacaattcaagcataggtaacagcagcagatcttgtttgcacctctcatgcttcatcctccaggcaacagcgtggactcttctgaccggaagtgatatcgaggctagattttggcagtaccgcagtgctgtgagtcttgtcgcgtgctgttccatgcatacgcatacgattggtacggtggctacacactggacaaagttgtttgccagattgcctgttgttcacgttcctatattttttgccacaggtcttttcttttcaagggggcatccgagtgattagggtcatctgggagtttacccgtgtcatacgtcgtcgcctattgcagtctgacagaatagaaagcgttttctcttggtgaagtgttttcgcttcctggacacacctgtttttagcggaacgtttgaagaaa

SEQ ID NO: 2248 - DNA, 3127 bp, Toxoplasma gondii
gaacagatgagccagaagtgaatgatggattgccatgccggatagagctctccgacggttgctgcgcactggagttcgagggaagcgttggtggtcgttgcgtcgtcgcacagctgcctcgatcccctcggccgcgcccaactcttgcaccagcattcaaaacacctggggccaagcactggtgggggttcctggcgagagtgcacgcatctccccacctgtcaagctcatctgaaagtggctcttggccggccttcccgtgtgcgacggagctcgcagacttctcaggagtcggatatgtctccgcaattgaggcgcagggatcagactgcttgtctccagacaaaattgtagtattcctcgccctctcgctaaccccggacaaacatgtgtcctgcgagaatgcacggtctctaggagaggacgacggagggtgtcgggctggagtcagcctcggctgtgcacacggagttgggagccgtggcagcccctccaagtctcgctttaagacgacggcggcgagcgagaagcattcccccttgcagacgaagtcataaaacgtatgttcatacttgaacgggaaaagttcctcatgcagctgacgcagctgcgtgtaatcggacgctcggacagggcgaaagtgaatgcgagacagcggaagcttagagatatccgcatctttggcgaacctgtgaactggcgcagttaaaggtggccgagacgcacaactgggaggaattgccgaagaggacgacggcagcagagacgacgcaaacaaaagaccttttcgttcctgaggcaactggcctgcatcttcggtttccctgaagggctcctcgctaggcagtcgctctgctcctgaggggatcagctgacttggcacagatgccgaataaaccgaatcgtcctcttcgccgacctgccctgaggccttctgcgcacagccaggcacttccgtgagtctgagagtgtcagacccctcgactcgcaggcaagacattgagtcagaggggtgtcgaagttggaacggcttgcaaggagcgcagatcagcactgcatggttacaaaaaaggcccgttccggggatttctcgccgctgcgatatacccgggaggttgcgtttccgctggctctgtgtgttgacacttacttcagagatgttctgagacagaagaaaagtgagaggtacgcgattccgtccttaatgatttgaatccaccgtcgtggaggatatacgttgctcaacgaagtgtgccggtgtttgcgggtgacaacacaattcataaagagcgctgtaaagggaaaaaacgaggccagtatctcagccggggagactaaagatgatacaccaggaatgccctggtaagtgacaccgcagagaggaaacacaaactcgaacagtaccactatatcatttccactgctcgtaggttaccgatggcggtcgaggcttgcccgaacaaagaacgaggtcaactttgcttggcactgaaaaataatcgcgttgacgtcaaaaagaaacgacagaagtcgttgcacgaaggcttcggatcgacaagaatgataactcatgacggaatagctcaattttgtttaacaagacccaaaatggttgctctttccctgtcgcatgctgaggaaccaaccccgacggttggccgtccgagaaaagagtgcgcggggggcggtgtaagcggcgtgtcggtaaggacgcgtgtgttctcctttcttcatttcctcttcactacatagtctgtctgattcgttacagcaaaatcgcctgtgcggaagaggaacactgcattctggagacatgcaagagcacggaagggctcaagcaataccgcacgcttttgggcggccggcaaagtgccgttttttaagcatatccacaatttgggtacgcagagagaccatgaatacaaacgacaatggacgaggcagaagcttacgacagatgcacttgcctcttgcacgcagagacccccagtctgccgtagcacaagacagtctcgctggtgaccagctccagcactgaaaaccgctcacaccaaggaagggcgatcatcgagacccgcgctcaccatgcaagcggacacagcctgtgcaacgggacatccgtgcctgtatcgtattgtatgggacagcatctcgaattgtgggacttgcatcctctgcgcatctcgtcgtgctgttctaaagtggaaaaagcgaggctgaaacaaagagcattgatggtttcttgatgtttgtctatattcaacgaagatttgggtagacgagtgtgtagcgaactgaaaacccttgcgtattcgctcgacctccagctcattctgcatcgcgggggtttcccgataccgacccacgctgtgcaagtcgggatcttgaatgcgacggcatttgttgcagctcagggacgctgaatgcaacgtgaacagccgccctcgttcgtctgtttcctggtcaaccctttatttccgcaagaatttccgtcgtcacccgacggatttgttgcagttgctcctttgtcccgtcattctgcgtgtcacgaggggtttccgcggctcgagagaaagaggatgggctagctggcggtcagaatcgattgccgaagcgtgtgagtccggttttaaggaaaaccgaactttgcttttcacaactctatcgggcacgctagtacatatatactgctggtttgtacattgggaagcaatgctcgtcgtaggatattgtgctggacgcaagctaaaaacctcatttctctgtcaatatctgcgaggcccttatcagttgctctgccgcgtagagaactcgtgtaactgccaaaatacaatacagcgcctgcctgtccgctgtcatgaagtcgctgacgctttaggaagcattatgcctgtgcacagacctcgtgtccagaaccgaaaaaaggaggcgttggaacttcgctgcgagtgctcaaattccagtctagccctcatttgtagcactgtttgcctgatgtctgcagttcgcgacgtattctcctgctttaaagcgtcattcgttgctaattgaggactggagtcttcctcttgtgtttcgtgtggaccggaaggaaatcgcattaatccgttaccaatagtggacacga

SEQ ID NO: 2249 - DNA, 2473 bp, Toxoplasma gondii
gcggtccaagcttcaacactcaatgtaactaaaccttcgtggaaccaatccccttctgcgtgtcaatgacatctgtttttcattcgtataccgtcaacttccgtcaacttgctgtgttgtctgtgcgtcagtcgaggtgcatactcttgtcagttttgcaaaaatatcgagatccgatttcgaccatgagtgcttgtgagtgaaacaggctacgcgaactgacaccgggataggctgttggttcgtcactggttcggagttgtatgtgtgtgcccagacaatcccacaccgactcacgctttcatcaactcgtctccctggaatgtacagtcaagcgagtttgtgaagtgtgtttgcagtaaattgtatgcacgtttcttgtcctttgagttgcggcgcggtttcatcttgtccaggatgctcgttgacactcggcggacgtcggtgactgcactacggctgtgcgtgagaaaaaatggccccgcggagcgtcctctgaatccatgttagccatacacctcattgagcaaggagcctcgacagaaacactgcaatcgttacggtgcgagggaggtatagtgtacctcgcacgatgccctgaccttccgaacctcactggaacctaatattgcgcacatctgtaaacagttagatcatttgaaactttgatcccctgctgcctccatttcgcgtagagaatcagttaaggtgtcgtgcactccatgaaacgctgcagaagcagaaggcaacagcatggggaatgccccaggatcttccggaacaggcgtgcccggaggaacccgatgtggcctcatgacattgcgcaggtcgtgttcttatttcagtttataaaacgcgcggctgttttagtcatatctgtttctgagttcttctagtagcctcggttttcgcgcgctcgcgtattgaagagtgctagccgcccgacggctgcctctctacgccggcgggtgcggtacagcaactctatagaacactggtcatatgcggttattctattgattacgcccaccattaacttggctggtgtctgccgctacgcgctgcattcgttgttacataccacgaaaaacgagtgttcgctctgatatccactcaaccggcgcgggaccgcctgttcctgacaggcggtcccgcttcttgttgcatgccgaagatacaaggaaaacaacttggcgtttaaactcccaaatttgtatctggcgccaatccactagcaacccaaagaaccgatcgctgtctccggttctcgcgtgggatcgcagtcgactcaattggagacatggccgcatgcagattctccccctttgtacagtatctccaaggccgacgagacaagcagcatcagggaaggctgtgtttttggcttacattcctgtcttgtccatagatgcgaaggttttggccttttgaagttgcagatgtgccctgtgcctgtttcttcgcactgactcgtgccttggcagggcaacgtggcggctcgtgcgacttgcacacacggaagcgtgtctcacgctggactcttcgcgcgtgacacgctccacgtggtccttttgattttccttcacgcgctaaggttttatcgtccaagtctgtctactatgaatcactgcctgccggaaaaaacttgttttccctgtgatacgcatccctgatctccgttcatgcgtacctgttctgggcaaactggtccacgacacggaagcttgagcgactcgtcttttctcgcgggagaacatgcctcataagttctttgctttcgtcagtttgtgaaaccttcccggaaggcggtcgggcagtcctggcatgtgaaatcgagagctggaaagggatgaacacttcaaacgccgaggacacaccgcccggcaggccccgtccgcgacctcgtccgttctggatggacacccgtgtatactttccaaattacccaccaccccgcctttcttcccctcactttcgtgcctgcttctgtgcaatgtaactgttttcccctgcctctctgcagtcgccttcgtctcatgggagcgcgcgccgcctgcccgagccacgtggaacgctctttttcctcttccgtgaattgcgtccgtcagtcctcagctgtttttctcggccccctctccatttttgtcccgtcctctgtgccacctctcgagaggattgtctgcctgggtcgtttctctgggaactccaggtctacatacactcgagggcgccactctcccgcacacctgcgctcacccttttcgtgtggtttccacttctgttggccgtcgccgcttcgggagtgcagccgatcggaaggttccgttttgagttttcagtttcgcgaaataacgccggtggttctcacagggctgttaccacctcggtccggctcgtcgctgcaccttttcctgctctttgttcgtctcctgttttgccagtctgctcgtttgctgtgccctcgcgcccacca

SEQ ID NO: 2250 - DNA, 3580 bp, Toxoplasma gondii
acgataaaaagcgcttgcatagaacatcctctcttcctctccgtatttacttgcttatggagaaggttacataggtacaggcaaatgtccccaaacgtgtaaacatccgtttcatgcccctcgcagttgcgattgccttacgcctaggagtgttaccaaaagaccgatgtaccacttgagtaacacgaaacaggccctgcagaagacaagacatcaaaacagacagaacgaaatgtgacggtttgtactacccttcatggccccagtcgcgtctccatactgacggccatgcctcaccttgcattcaatgcgattccagtataccggtggactaccgtagccgtttgcacggagcagctgaatgagttcccacgtgtttcctcgcacgtctgaggatggtgcgcgctgtgctggtctaagatctgcatttatgtttgtgcccaagacatactcgacttacacaaagccacaaataaataagacggccaagagggtgaacagcccagtaaatagcatgatcgtctggcgcgtcttgagattgacagccttcacatcttgctttccaaaaaccttctccagcatcttctctttctccgacccacggccgccctccaggccgtggagatacaggattcgcggcggcatagtggaaaagtgcagtctgtgcgagagtctcctgtttcctgctgaatgtcatcacccaggcaacggaattctgtagtgttcggtctgactgtgaatctgataaagagaagaacgcacgcgttgcaccttcattatgggcagaatgccttaaccgtcctcacagtgcccggaccttggcgactgaaccctgcaaggtgactgtgaatctgccaaaacacaacacatttacccgtccttgcgacaatcagcacgtcttcccattcacacatgcggctgcttcttaatgaaaaggctccacgtgcatctatcctcccccgccttgttcacctcatctccccctaacgggcgcttctggcttgtttccgcaacctacggaactgcgagtttagaccagtctgtgaaacctacacatgtcttcaaccgccccaaacggtctacaactcagttctgcacaaatctgttctacaccactgtgatggagatgcctgcgtattctgtgacgtaatctagtactgttcatgcccaccaccgccgggccctggcgtgtggcatgcggttatcaccgttatacgcgttatagcaggtctatatcatgcttggctccgatgctgcatctgagattctgaacctcggaaaaacactaacgtcacaaacggtagttaacagcctttttttaaatggaagaagtcctccatctggagggcgcgcccgctggtggctccggcgagagaccgctagacataccgtggcttaaatcattctcgtcgtttacacccactgctggcacacgctgtccacaatgctacacgagatctccacagactaaacaaaacaaagacttgcgtaatttgctttcttcagtttgctcacccgccacaaagacaggtcaagaccgaagctggaccgttcggacacagtcagtctcttaaaaaagacgacccgatgtattgaaaaaagaggcctgtaactcctccggtattacaatccgcaataagcattcgaaaccaattacatgttctaacttgaaaacccttgggcacaggcctccagctcggcgacctgcttgggtttgtgacagccacagcccctacgagagtgtcgggggggagcgagataccgaggttcgcgcgctggcaatatcaaaatctcggcacattccactgaaaccggtcagatctgctcgcgaagtcaggagctgccgcgtctcttcacgcaaaaaaacggaactgcgcaagttctaatctaccgaaaatcgacaattccgatggacacggacggaccgagcgagccggggacaaccagttctcgggaagcaggcacggccaagggcaggatccagccacccgccttctccagagagaaaacttaggcctagaaacgttgtctgaatggatctcctctcgctcccactagcgcctaaactcttggggaagacagacagttagtacagcaaaaacccgagttagacgtctctcgacaacctcccctgggaagtccagagccaagccacaccgcgaacctcgacttcctcgatgatgctgtgagtctgcatgtgacagctaggctgtacatacacccgaccgcccctctcaggggggagagtgcctgtctgctcctgtcgacgcgcgcacattgaaacgcttcgcagtctgcgtcagcagcagcgcaaagagggtcggtatgggcggccaccctacccgcctccgccgcagaggaggtcgaggaaagggcgcgttgtgccggcccaccatctcccgttgcgcgcgcactttcttgacgcgaatatccgagacctttgttccccctgcgtgcagaaaggagagatctcgcatacaagtcgtacggtttggtaataagtcgagaaaagaaggcagaaactggccagctgacatgcaaaaaaaaaactgaccggataagctagcccagttttctcagccgcgctagccctagcccaacagcttgaacttgaatcgaaaacgtgcaggccgcgccattacatcttgccggactttatcttgtttgtcatcgcttcatctctatgaaattccagagaagaagacgcagggtaagcgaggagaaaaagttcgcgaggcgaccacgggagagacaataagcctctacgcagagtctgcccgctaaagcggagacgcgacggctccccaagaagactggcacgaacacgacgttttttccgaccccgtgcttgacgttcgagcccagggcctagttaggcgcgcgtctgctcatcttccatctctcccatacagttctttctagtacacagttttctcaccatctcctgccgtgttttcatccctccgacatttgtggagcccctccttcgcaacgacaggctctgtgcaagccgcatcgcttcccggacaaaaaaagagctgtgccgcgaccataacagaaagaggccactttttgcaaatgacggagaccttgtattatggtgcgcaactttttttctgctgcaccggggacaactcgcgaggtcacactgagtgtaccccgtcagctgtgtggcacgcatgtgtggcgagctcggatttttaacgacgttgacacaggaaagggaagcgaggactcgacagtgaatgagaggggaagccagggggaagccactaaggagagacccaccagggaataggcccacgaacgtatattcggctcttctagtgcgtttcggcaaacgtagttcagcaaggaaagaaatctgtccgttttccctcggtatacgctgcatcaagtggaacgcgaccggccctcgatttttccagggtctgtacatcatcgtcaaagacaacggcccgccacacgacgcagacttttcatgggtcattattctccgcttcagcttgctccctgagcctctttggaagaaacaacgtttgtcgttttttccagaaacgtgattgacgtagaacagcaa

SEQ ID NO: 2251 - DNA, 1734 bp, Toxoplasma gondii
ttccggtcgctgtcgcacaatctcccgagcgacagcaagcatgattgcgccagactgcccgcccaggcctcccccgtgggcctgatgtcgaaggcaagcaaaaacgtaggaaagacgctgtaagaaatcattgcgaaacatatcgactgtcacccgaacctagctaacgtggcttacctccgcaatgatatcaaattcattctccagctgcagttccatgagtggcgcgatgcaattatgaatccaccatggattgtcttgaagatagtcggttgcgtctctgttgttgatcgttagctttccagaaccagggggaagccgaacccttgcataagacctgcccacgcgcacaccggagaaaccgcgatgcacatattagttgttacggcttcctaactcccgttcagaagatgacagacagctggactaggttctacccaacccgcaagtcacatcacgggtaccctccggtcaaaagcgtgaacgctgcacagctgtacagaaaagatatacctgaaaagattgcagtcctcgtgacagtgtttctcacagaaggcgaaggatcaattctgagaaagcattctctcgtcagtaccttttccgggtgccccatgagaagctgttccgcggcgttccaggctcaggtagctcggatggaatgcttgagagtgtcgcatccgcccctagagctgtgggttcactcctctccacccagtcactaggaagcgaagtttcatggactgcatcttcgaaagaaggacatccttctgtgaccgcagaccaggccgtcacctggccgacactccctgggagtgaccgaggggagagtcccgtttgctgaaaccagcctttacagtgttgcacagctgcatctcctgcaaaccatcgcttcccaaccaagggaaggacacggaaattcctggtaaagctatgcaggttgcgttgagggactatgaaggcagttccgactgcaggcccgcagagaaaatacgcaagacacattacagcccaggatggaaggctgcaccgaacccctcggcaccaacgttcgagggccattctacccaagtccgcccttcaagcacatgttacctgggtttcttgaataaaaagaaaacgaggatgtacataaaacactgctgtagccgcgactgacgattttgaatcggcagcatgctcattcctcaccgtatcagctactttgggtcgtgtctgcagcgtgcatgcactgacgtcatcggcacgagcgtttctaacgaagacaggctagtctcggtttgatgtggggccatactttactttttggagccacgtggatactctagaaactgttcacttgatggtcagtaccctgattttgcatcaacagtgacatccttcgcatgttctggagtaaggccgcctctggggggtgtctccttgatgcgctgcctagtccaccggtgttgtccgagaggcagctgggcattgcagcttggtactcttgagcgctcgactatttaagatattccacgactgtgagtagtgtttttccgaggtgtgccatggattagagaactcagttttaccatgcgacacccctgaatggagtagaaggcccctttgttggagtcgccggtggttcggctctagtcactggggacgcgcttctgcattgaccaacgggaaagccgagacggcaccgcggctccacaccacaatggtgtccttttctctttttcatcagacccacga

SEQ ID NO: 2252 - DNA, 1619 bp, Toxoplasma gondii
agcgaagctgcgcgtaccaagcatagcaagaagtagacgcatgcatgcatctctgtatcagtgcttgcatgtgctttgtgcacagctgtgtcctcacagatgagtgtgtggaagagcagaagcgcatgcacatatatacatatagttatatatatatgtatatatatatatatatatacgcatggatatgctaaatgtgtctatatatgtaggtagatatatgcagatgtttatatgtgtgtatcacgttgctgaaagaggacaggagaaaggcctggcagtgcttactgctttctcgccgggggcctcggaaggcggaggcgaagggagagtcggccttcttctgcctcggcctctggagcctcgcgaggagagacgaggcatcgtgtctggcggtggggaggtcaccgacaagagagacaagaaggaaagttgcgcagaaggaggccgaatcgaaaaattgaaaggaagagggaagacggagggagaaaagaagggaggaataaagagagagcgaggcaggaacgccacagggaagaagcgaggagagagaggaaagcgaaggaagatgatgaagacacggaatagcaaagcagagacgaggacgaccgataaagaagaacgagacgaaaaggagagacagggcgggataacggagacgcagtggaactgaatggacggggaaagatctgcaacgcaggtgtgtcatgaaggaggaagaacttcgacttctgaagaacgctgagagagacagagagagagagaaagttcttgcaaaacgggagaaagttcttgcaaaacggagacacaccgccggagaatgcccttttacgcggcggagaggagagtgcccatcgaggcgcggagcctccagtgaacgggatacaagaagaaggtacatccgccaaaagatacttgtagcgtccaaagaagcttctgcaggaaacaaaagagacgccgcttcctgcattgcgccgtagatcttataaatgcacactgaggttggccttttctgccgttgcatgcgcatgcagtttttttcgcatctggaaggagaacttctgaacgagcgacgcgggaggaagccagccacgaggaggacgcgtttgtgtttatgtttcttgaaaaaagatgtctgaaggaacaaaattcacagaagaaagaggaaagtacgaggaaggtgctccgcgtttttctctttggagaaggagggggccccgcagaaaccgacacggagatcgtttccccaaagacctctgcccgctcgcttcttctttgtctcttcctttctgttgcttcgtcatagtttattcgtctcgcctctctcaactgctctcgtcttctctctcgcactttccctgtctgcttcctgcgtcggcttggccctttgcatgcggtctccgactttcaggcctccgcgcgcgaccctcttgtctctgtcctctctcttcttctcctttccttctatctcttttcgccttcttgctttgaagtttcttcactcgtttccagtgcccctcctgtcttgcagtccttcttcttctccttctccttctccgtcttctccttctccgtctcgctttctcactatctttcgtggagccgtttgcttgtccaaa

SEQ ID NO: 2253 - DNA, 1539 bp, Toxoplasma gondii
acactcccaggaagaagtgacgtaggatgcacgtcacgagaaatatggagtcggcctcacctgtacaacagctctgccgacggcggagccagccaccacgacgaactgagcaagaattcttccaagagggccaatcgccatggcggccacgtttaccagaggacgcgcggaaacgggatactaaggatacagtttgcgttcgtgtgcaggaaacgcagatcctgtccctggtgtataaccggacttttagtcaattctgttgtcagacgaatctccgaaaaaaccggactcccaagagtgtgtggagctgtcgttgaaagatgcctttctcgacgttgcgttgcaacgcattcggtgaatgtagaccactggcaaacacggatatctcccacaatctagggcgacgacaggacggttgtgtcagttgcagaaagacacaaaagcgtgcaaggaaacaacagttcacgttacgaatcaccagcaatgcactgtcgtgataaaagcgatttctgtagttacttgactgtcaggctggcaccgcgcttcttgatataaatgaaaccttccctccaccagctggtgccctatacctgcagctgatttccaccatgaaggattggaaaaaggtactaaattcagactggcggagaaaagccatgcggttcactggagaatggtacacgaactagcagcccggcagcgtatcctacatcttccgtgatcctttcgcacagaacaaaacaccaccgcgtcctgctaatcacatgtacacaggaaccgagaaatactcgggttgttttcgttgcagatgttcatacagcaaaatggcgccatgtgtttcggcgaattcggcaggggaagtggacgacacccgtcgctgagctttcgcctggagtggagacatctacctgtgagtgaaccaggcgttctgctttcgccgctcctttgcaggccagaggacaatgatacaaatataagtgacactcttctcttcgatatcggttaactgacaaagaaccacagcggagttaaaatagcagcgtttgcagttcaacgcatgcacaaactgcttaactcccacatgcttgcctttgagagacgcgacagcacatcgttcgagcttgcatgcagcgaagacatctagacagcaattaggagatgcctgccgaatttgtatgtaaggcgcaaacgtctcctcggtgcgaatcacaattacgcacatttgcccggacttacatctgtcttctactggggtctttccttgtcaaaccgtgccgctgcaactccaaactagctcgttagtgagatgctggcaaggttttgacaagaatcgagttctgcgactgcatcgtggtacttgacaatcccagacttgcaagttcatacctctaaaataaattttattgttgacaccaggctacatgtggcgtgcgagactcttcatgcgcgatacgccctagtcgcacggtctaatgacgaagctgtcgtcaacgcgtaactgccactgatatcccgaaaggccgcaaggtttaaggaaaa

SEQ ID NO: 2254 - DNA, 1653 bp, Toxoplasma gondii
atcggctgttcgcctgtctcgaaagaccctctccatgtttctcgtacggggacgggattcctatcgtgtggaattccaggcgacagggtttccgaggaaccatggaaaagcaacgcgctaaagtcgtctgtccctgagatgtagcggagactcgttttctgcatctgtgtgtctgcgtgcttttcagaggctggagaacggagggatcgctcgaattcaaagggccattgacactctctttagaattcgatttcctctttcctgccgcgctctttccgctgcgacactctctgagaatcagcgctcacctccatgcacagtgtcgtgcttcgcgcgcttcaatttttcactttcttttcccgaggcactgagaccatgcaatacccgagagcagctcgattcctttaaacaaagtgcaagagtgtcggcgacctgccgtcggccctaaaaatgtcctgagattctctttctcaagctaggttcttccccccttcaacagaacatgtgacaggtgtgtcgcgttaggtgaaacacaaccacccttctccagaaccattgagatgcgtttgctgaagaagacgtatctcagggcgagtccgagaactacagggctagtcgatgggtgaaaagagtctctctttctcccttccgaagaacactgttcgagcaggccttcgctggtgccctgcaaaagatgaacatgcgctcaaattccctgtaaaagagaccccgccccaggtggacggagatgttgcgcagtgccacagcctgttgacgaatctagcagacgcttcaccgccacaaattcctccagttcttgctgagctgcgaaaagatacattccatctgagaatcaaacgacgaaggcctcctccactgaagtgtaactcgaaaccggtgctgctggcaagaagactctgcccgtccatcgtgtgacattatttcgcactcttgtgtcatgagcgcgggaggaccgatgggaggaaaaggcattctgctcccgtttcccttccactttatcccattgctcgagtcctctttcaacagaacaaactgtaacaggcgcaaaacagtccatgttccacctctttcctgcggagtttcggagccacaccgaagagagagggccggaacgcatgcacgatttttttttcggcggcgggcggcttttcgcgcgacattcgcgctgtcttcgtttcccctttgcattgaagccttccttctctgttttctgctctcgctgctcccgcattggacgcgacatctctcgcgcttttgcttcaccaagacacatgcccacctgagagttcgagcgagaccataccctccgcccattgtcggtgtctgttcaactgcaaacgaacctcccgacaccgtggacctcaaacattgcttttcttcggcaaagactctcgcaagttgaatcgcgactgtagcttccaatctctggacacagcccccccccggtcatctttgcctcttcctccacttatgcgcgtcgatctacgccgtttttcgtcgctcttcttgcgcttaaagttttgagctctcggagagacgcgtttggggtgtcttgcctcctctcgcgtttgcagttctctcgcttcccaaccaaaacgggcgtctgccttcctctttcgccttctgccaaga

SEQ ID NO: 2255 - DNA, 1927 bp, Toxoplasma gondii
ttggatattcaacaaacaacgacagacagtgacataacctgcgttctgcacagcacttctgcactcctcatcggcgacaagtgccttagacacaggcagactcagaggggctgcatcaggtggcttggctgtgtcaccagccttcacagatgtcacgagagtcacattggtagtcttcttcctggtgttagtccgtacggggaacgtttgtctctctatttgtatgaacgataacggaggcttcttccattgaggtaaaccggagagccaatccctctgtgcgtaacgaaacccacgagtgccctagtcaaacgaaggaccgcgacgtcgtcggtgtaggacgacagacccgcggcacatggcagatacacgtgcccgacacaagacgacaggcgtttctctcgacacactggtatattcggttcgagtgaggccgtcacccgccatctgataatttcagggtaggaagacggcagagacttgaaaagaagtccctaacaaatgcacggactttacgctagccagaggaaccgcatcgtgagaaccagaggtgacgagaaggagcctacctgagagtcattgagataagaatcatcggcaccatagggatttcttcattcgataaggattacgcttagatcgaaggacggtggacgaatctcggtctgcgggtagagagtctggctggacgcagaagcggagtgaacgtattctgggcagagttctcacacagcaataacttcatgaacatgacagaatgcgaggacagctggcgtgtacagagtaggtgaggcaattgtgtcgatcgttctaccaccagaggaataggaacactgacctgtattcacaaatgaggatatgtgtgcggatattgaaaagacctgggcttccttgaaatttccgccacgagaaaacagcgtcgaggctgtgagtcgggagatcgcgtcaacgaggcggtgagaccagggaaaaagaaaacccggagttttgctttaagagtaaggcaacatttttggacgggtaggcagggacgaaggggcaaaacagagctcaagggagggaaggacgcgagatgagacaagctgcgaggcacacactgtcggcattaaccgttacactgagtcttacattttgcgccgttagatccgagcgcaagtaagaacaacacagagttacacttacagaactcgcaaacggcaacgcagatcttgtctgtctgaatgcgagaggggatctttccacgatctgtttgttctcgtcttttttcggcttgcgctcggttactgctgcaaaagagtctcccagccacttggcgcgaaacaagtgaacgcttgactcgccaagtctcttcgtgtaggagaccacgaaggaagtaacggaagaaggggaggacgaggggcgcgttccagtttttgtcacattcagaaaaattagtggagctccggacacattttcagcgatgtggaaggcgttgttcaacaaatcctttgcgtgaaaattccgacacatggaatcacagccaactacgacggctcgcgtcacgaggcgtcacatgcggcaccctgtacactcgaagtatcaaactgttcctgttccattttgtttctttttatgtaggctcagaaaaaccatggcctccattccgacgttgtcttgaagcatgcgttcgtccttttgcggtgctgcgtccggctcctcgctctacagaatggctgtttgcgctaggacctacaccgacgaacaaagtgctctcatttaaggcacatgttgatcccctcctcctcctcctcatttgcctggataagcctccactgaggttcctcggtgcagtccgcctctccatttccgccgttttcttctgatttttttgttcgccttcagttcgtttttctggctgtccatgtagtgccgaaggaggaattgacca

SEQ ID NO: 2256 - DNA, 4848 bp, Toxoplasma gondii
cttccagaatctccttgtttgggccgagcgactgtgcgtcgtcttcccgtctccgagcgacggaacagaggacagcggggaaaccgaatcgtcgaaattcggaggagcagaggtggggaaacagcatgggcgtctacgttctttgctatcaagacccgtgcagatgcggggacttctccgcaacattgaatacagaaaggatcgcgggagcctaccactccagggcccttcccgaggaatggtgaccacgaaatgcgctcggacaatgtgtgttgttcgtcgccaaacgaacaaacgcgccttggaaagaatctcgcatacccacagcggcgctacctggagccccgttcgagcaacacgcgtcgtctgtgcttttgtgggcaactctctgagctaatttcctctcaaattcgtccactaaaaagttacgcttctcctgatccaatgaaaagctccgcctctcttcgttggcaatacgtggctgctacctctagcgccacaagtcggcagctcctacgattctctccctacagcctccctcgtgagggacattgccccatgacgcggaaacacttctaactgcacgaacagattctcgacgatatggagagtagagaatacgccggagaaatcagagacgattacagagagcaacgcaatacgagttcacacgtgtttgagagcccacggagaaactgaggactactctccaagtgcttggcagcggacttccaccggaagtgcacgtccgctgaaatctcttggctccattcttatccccctcaggactttgaagagccacacttttttccggtaaagatgccatttctgagacgtgaaacacttactcccgcggctcgcagtgttgctgttgtagcggctggtgccacctcggctgtatgctccccgaaccattgtgtagataagaagcagtgacgaagattcgccgatcctagaagcaacttaatgccttttaattgatggattccgcgagttttagcctgcggaacaagcttgcagtttctgtccgtcctgcacatgcgtgtccaccccactaggctgctgcgacgcagtagtgctcgaaaattcttgctgagagttcgtttcctgccacgatgaaaggggtcagtgttacgctgaaaagtgaacaataacagcaaaagtgcgttcctcgctgaccacaaaaaacgggtgtaccggggtcgcaaaaagcggacgcgcacacggcagggggcgagacacgccgattttcatacggtgatcagcacagacacaaattgcattcttcttcaacaatacgaggttttatggtccaaacgtatgcaaaaacgagccggctaaaaggcgcagtttttagaaacagaatcatgcatcacagtggattgcgcgcggtgacggcgccgcgatacgttgaaacgagattttggaaagcagcgagtgccgagctcagacgactccgcgaaaacacggaaaaacctaataaaagcagtggggaaaaggacacggccccaccaagagcggttcacggaaggaaacagtattttgaccacagtcacagcgactcagaacggcctcgaggaacgacgagcgcaggaaaaacacccagcagcgagcagggtcgtggaagaggaaaagcgacggaacggccgaagaggggtggggagcacgcacgaagcgaagggtggaagaattttacgctggccagcagcgcctggaacctgagaaaaggaggaactttgagagcagaaaaaggacctcctgcagcagttagcaaagttatcaatcattctgtatttttgagctatatgcgcggaatctataccgagagggaaccgttcttttggatacgctcccacaaaagtgattctggacgaacggtgttacgaggtttcatccagaagatagctccgtagtatgcttaggcgtgagacatgacggcggtcaccttgatccacgtagagaattcgtgaggtctcaaaggacggctgatattataaatgcagtgttttccatgactgtttgcgagactagatggggatcgacgcttagccgaaaaattgggttgtgcacttcattcgttactcagggcaaccagacaagccaagcggcgctactcccagccatgcactcacctcggttcacagcgcaccgctctataccggagggaaggctgccattaagatataaaagcacagtatagctctgccacagagacagaagacatttccagcagctgaagacaaggggtgagtatctcgtggtagtgtgtggcttttaaaagggaggttccatctatcactgtgtgagagaaatcatgcgaaactgatgagcgggcggtttcttgcctgagcctcaccacagaaagccagcaaaggtttctggcagcatctgtgacgtactgcgtctatgatatatatcatgtcgtggagggctgtcaatgacgctacaacatcacgcttcctgtataccccagatcacataaattatgttactctccattttgctcctgtggagctgcaagcctcacagggcaactgtttctcactcagtattccttcgcaaccagacttccgtgaccgccgggatccaaggatccgcaccggtcgggagttgcgaggtaagattcccgtttcgatgtgcgtaagtgtatgaaatatgttggaaaatttggtatttttggaaagccaacatttctgtacaggctgtacagatctagtgcgttgtccaatcttcacagcttctattttcggtaactaagaacacagtcaggatggattagtgagccgatagtttcatttccatgcagaagtaaattgacattcactgcagaatataaaattcttgcctgtgcaaagaataatccaattaaatctgatatttgtacgcagccgtcattaagaccataacgagcacagatgtccctgtttgtgcggtttgttgtgtatctttgatgactgtatactacggacgacagcgttatgcgatcagcgatgtaactgtgtagtggtcatttggactgcacctgttttatgaaacagagatctcgggatgagagacagtcttgagtccaggaaggatcactgaggacgccgtggaagtatactcagcaacgtcagccaacggtaacgtaccacatgaagaaacggctacccattacgttgccacatgactgtgtatatgcgacgctgccgaagaagtagaatgctccatgcttctcaggatatgtcgaaaaatcgaacctgcgcgagctggattgattgcaacgcctatcgggacacgtactgcttcctgaagcgtctgcggtgcaacctgtcacaaaaattcgttgataagttcaatacccttcgttctggtaactgggagactttccttgtcaacggcatcagctagtgtgcggttattaatcattcatcatactggcttttgttgttcttttgtgcggtgtatgccgttgattgaaaagtgccatttctagcgtgctttgcccaaatgatgggatctggacatcgctgcggatcaaaagaccatacgacgcactggtcatgttgcgtgaaagaagctactctctgttttacatacccctccctactagccttgccctgccaatcactgatgtcacccatggtttcgcttttttctgttttaccaacgaggtatcgcgcggcagttctacgcttcctgcaaacgcacgcagttcagaactatccagatagtgttttactgcctgaaaaattagacctcaatgaacaagtgtagtacatcacaacgtgcggggaagaaggggacaggaaacggtaggagaacggccaggagggcaagccacacatctagtttccttctggagtgggttaggtatcccacggctgatgcagtatcttgacaaccgcactcgaattcaagcatccctagctgtctcctttttcgggaagaactgccttacgaaattgtcaacgcaacagtgaattttgctgtctcccgaagcgaccctggtgtcttctcgtggagggtcgcatgcagatacaacgagctgtgccagaagacagacatcggcagccaggcattcgccaaacgtccatttcacatttgctccacgggtttctcactctaccccattttcccaagaaaagtttgtctcaactcggatctgtccgtggcacatcctcttttcagagacacatcatgcgcttgcatgcgctgcattacatgggattcacgcagtcaaccaatggtggtttccatgcatcggagagaaggcgctttccaatttttgctccgttttacctaacggatgtgtatcttttttaacttacgtgacaagcacctctttcaaaagcccgacaggctgtcgttcgttgaatccactatcgcctgttgctcgtcgtcttagggcggcttcagcaagtagtcttcgccgttagatttgtggatgctaaacactgttggtggtcacctttttgctgagcatccagtgaaagtttcttttctgcgttcccctatcttcgcctgctctctcggtgtgatcctgcgtaagaggtacaccctaccggtacggcttgccaagccgatctattggcatttgtctgtttaagcacactttactcagccgttcgctgcttggtggtgcgtttagcgtgcacgaggccatattgtttcgatatttgcctggttcaatgcccgcaactgtctccagaaagacgccctctgttattgcggatgtcccgtgtgtgtcctatgtagagctgtaagacctaatccgcgtgccctcccgaaatttcaacgacttcagtgctcggccttacgttaatatccacagtgtagggtatgcattgtccactaagggtggagcaa

SEQ ID NO: 2257 - DNA, 1910 bp, Toxoplasma gondii
taggattcgagaggaactcgaaacgacgaggaacaaccacagaaaaaacgagaagaacaacaagagtaggaagagcagacagagggagaagaagaggaggaacaatgagacaaagagcgaaaatgagagaaacacgaattggaagaacaagaataggaagatcgaagaggaaaagaacaaggaacggacgcctcgctccagtcagtggagaaggccgctgcgtacgcccgagtcctcaacccagcaaattttcttccttcttccacttgtctccacattctgtcaagaacacccacccttcttttcatttcttcagcaaacggaaaaacactgcattgcgctcctttccgccatctcctgagctctggtcgtccgccctttactcggcgtccagactcgcgcgtggcttcgggcaagatcctcattttcgttctttgttcaattttttccgagacacaccggctgcatgcacttcgcttccaaaaaggagaaaggcctcggtttccgtccctgcggtgtccgcggccgtttccgcaagaacgactcctcaacaggcgaaaagagaccgaccttttgctcctccataaacacgagctttttttcgagaggaacgacttttcgaggtagactgcgttcccacccagggagccgtgtcgtctgtttcttcttcttgcactgcttcgctctccccgcttttctgcgctcgtgcgtctctacgaccgcttcaggccagctgaagaagcaaagaatattcgaaaacgcctcgctctcagggagcggctgtcgccgtcacagagccttcgcggtgaatggctcgaacattgtagttttactggtgtcaagtgaacttgggagcctgaccaagtcgttcccgccgctcgtggcaagagaagatggaaaacatctcctgctgaagcaggtggaaagagagcaagttcgcgaatgaagaagaaactcagggaagaacgttgaccggggaagagtgtcaaacaagtcaaggtatcgcggcaaccgagtgcatgcagagatactgaattcgacaagcgggagctgacgaaaaagttcggaccaactggaattctcacccacttgcaaagacgcatgcacatacacactgatttaatgtggaggaaccaagaaaatcagagagacagaggaggaaatcgtttctccgtctttctgagactcgcgacaagacaagaaaagccaagtggggatgtcgatggaaacgctgtgcaacgtcgcaggcgacagatcgagtgagaagaaagtcaaagaagatagcaaaagtccttcttggattgcagaaagatgacagaagaaagaaggaacgactttgcttcttgtgaacgaggggccttcgatgttttctgcgcttcgccccctgatggacgacctgctgttgttcatcccgtctccagccttgttgacgccctgccaaaacacttgcggacccaaggcgaattcagcactggccctgagcctgaagcgatttgaaagcaagtacacacttcgtaattcttgatgaagtttcgttttcatgtcgtcttcctccgcgtctccactcttttcaacctaccaacacaagcctgggttgagcttctgtacgtcctcccaactcagatgagaacaaagactctccaagtttttctcacgccctggcagttgcctgtcgagcgcatgttagacagctggagtcgaggcgaaccggaatacctttttcatcgagtgcgagacactgaagcggtccgcgtccttctttcgcttcgctgtcactggttcctcctttaattccactcctaaagtctctttcttcttcatcacctgtttcgccacttgcttttctccgttttctcccactgttgtgcttccacctggtcttgcctctctcccttcgcgcgactccgcca

SEQ ID NO: 2258 - DNA, 4358 bp, Toxoplasma gondii
aagagttcagccttcagcaagggaagcggaaggatacggaaggaaagaggagagaagcagaagtgcaaggttttttcagaagggtctcagagaagtttattcatcacgaggagaaaccaagaaatgtctttggaagctgaagagaagatgagtcgttctctccagaaactgctcctctcttcacagagctcctgatctgagagagagaagagccgggctccagcacgcggaggcggccaggacgaacagcacctctgcgtggagagcacagaagcacaggagtaagaagagcgcaaagtgccggaaaattctctagaccaatctgctccaaagaggagagatgtggagggtgtggagactagacagatgacacggggctgtcttctgatcttcctcctcaagcggtgtgcggcttctgcccatgcaccctccgtccttggtgtttccctccagcctccagaggcgaagccgcaggaccgacgtgactcgcctcggcgttccagaaacaaggacaacgcattcaggaaaaggcaccgagaaagcgtggatgaaatgtattccggcacaggcaacagcctgacagctggtggagctcaaaccgagttacgaggcaggggggagaagccgtttagacccccgtagttatttcgctccgagtgggagaaaaggtgtccagacgtacatacggtgtcgacgaaacggaaaacttgatgaaggtggatttggttgatgtggtggagaaacacgaggagagaaggaacgcgaaagacatctccccggagggggttgagtggcaggcgtaagaacaagcagaggcgagggacgcggaaaggcaggaacggggacgagaagtggagagaaagggggaagactgagaaagaacggagaggaagaaaaccagggggaaacggcgttaaaaaaagaccgacaggcctcttcggatcacctcgagttattcgaggccctcacacacagtcgcaaaaaagaatgcaaattcgctttcagtgaagcctcttttgggttccgcaaactggtggcttcatttgtggctcaagaaagggtgaacattcctttctttcagcggaaaaacagaacgacacacggggagactgtacgaaaagacgacatcgcgccaagggtcagattatcagccgacagtctcaaacaaagaacgcgtgtggtaggggtccagacagcaggaaacaccccaggaagaaatccaaagattggcggggaaagcgacaagaagccacgcagagaaaaagtcgctttttcgctgaacacagcgatttctcacatccctctttgttttcgagtgtgcatgcacagtcgctctgtcgtctcaggccgcctcgacagaggcgcgcgatctcccgtctacctgtggcaagagagtgtcacactatcgcgatatttgttagaaacaacagggcgtttgccagcttcgagttcatactggtctcgaacgacttctttgaaaagaaagtcggccacctctcttcgcgagtaaacaaatgacggctttccgaatgaacgcgccgcagaagacagagaaggctttcgagagctccccgaaagacaagagatcgacattaacaaaggagacttcgtttcagtgaagagtgattggccttttaaaagtcgttcagagcaaagcctacccgacgaggattttcatgtctaccgaccttcatagtacagctgtacgtgcagtgaactctgctaaccactcttgtggaggtggagatggaaatgttgtaaaaaagcagttttctgcgtatctcaggaaaaaaaagaaagcccggttcgccgaaacccaagaaagcgtctggtctagctgtgatctttacgttgttagttcagcttttctgcaggaaacggtgacttcgaaatcgtgttcctgcacacgttcatgactctgccactcgagaatagagtatccctctcctcctccagatccaaagtcacccctttctgtggggggatgattctgttaattctctccgctttccgtctataacaaacgccaggtcacggtatctcggagacatggtggcgaaacgccctctgattcggccttccagagcagctgcacgtatactcaccgtgtaggttcggttttctcacttgctacgactgctgcgcacttcaaaccctcagagttgcaattatttaacgaagcgcatgcaaactcgcggaggcttgtggataaggtgtggcggcagcaacacggggagggcaagcaactcttttgcgtattatccagtaccggttttcaggtgtttcttcttagttatgtttctacgtctgtgactcccaatatcaagaataaaacaagtcacttggcaagcaacttcaaccagggaacactttgtggaacgactccctgtgacaaattatcatgtgggagtcccacggctctgaaaactagcttcctctggagagtgtacactacaagcagaactgtgcacctaacttggtttcccggcttttggagacagacttcctagaaagcatcccttgtccttctgaagagttgtcggctagcggcgctacacttaaatcttcgttgaagccacgattcgacccgaaacctgcctggcggtgcatgacggaaaaccacagtttgtcctaaatcgagagagatgtaacgatgccagagtgtggctgaaaagcgtgttggaatgccgcaccggatgctattttgggaggaaagaacatggcgggagatgcggagagtccgaatccgtcatttcagaagagtcattgcgggcctttcttacgacaactggataccactatgcataatgcactggacatggtggtcacgattaccacaacagaaccttgatccggtggacaccgatcttcagaatcctggttcaactcgtaacaagatgtggctgtttaaactccacacgctgcacttgaagtcatgggtctcttctctctttgcggttgcacaagttgtcgtttgcgtctacaccgtcaccacacggctacctcgagtgaacccaactgtttgagcagtaagtcgctctattttcaccgaatcttgaggcaacctgtctttctcgacgactatttttacttgtttccattttttgagttcgtgttgatgtccacggtgtcgggagtcgagagacacagtacaatatgggtcacggtaccagtacgagattcagagatccagcgtcgtgcagagttcttagcgaagtgtataacgggtctcgctcaagctcttcacgcttatatatgcttactaacattctttgctctcattgtctcgatgcgtcgtacgacttcagtccgatctgtctacaacgagtaatgcacgcagtggctggctcttcggccaacagtttcactgaaatacaacacaatcgagtaccgcggttcatctaagcaaatgtacaggcccaccaccccgcagtttttccactctgtaaatatccacatggcgtgcgagcgaaagtctgaaaatggcacagacgccggtcccgaactttgccacactcggatttcgctggggtgtctgtacacccacagcggcggatgtctgtctctccatgagacggttcctcgccgtcaatttccgttgatgtgtcaaagatactgaataggatcctatttacgaaacacttgcagccaggctttttgtgattgctgatagtatgtggtactcaggacattgttacggcttcagttattttgaggtaccaacacccaagttctctatggctgctctgccacaccctcctggactgctgaagacagctgaaactgttagatttcaacatcctacggccctgagatttctacacaccagtttcactctagacgcgacagcaaaaaccgataaactgtggcgggaagccgaagtccaatgcttttcgttgtcttgaaaaacgcacttcagccctccgtgtcttccacgtctcgtcgcgagcaagcgcatgcaacccccgagtcaccgcagtcgagtagaagcagggaggaaaagcgattcgctatctgtggttttgttcagtatgaactttgtgggaatctgaagaaagcttaccatttccacttgctttcttagcaagcaaacgattcttttcacggtccaattcccgttttcctcaccgttcatgcattcactcgacgtcctgtcgcgcatgcatcgaatgtgcatctgcggagacgccgcggttccccggagagtctgttttcgcgttggcttttgtcattgttagttctttcccgttctcccctcgtctttccatgtattttgtcttccattttcttttcattgagaccctcttctgcctcttttcttccacacctccacctcgacagagcttcctcgggaggca

SEQ ID NO: 2259 - DNA, 2339 bp, Toxoplasma gondii
attttgtcgtcccaaactctgccttaggcattgtgtcttttaaacagtggggacctcaacctgtcgaagtttcagtgcgtggtgtctgctgacctccagagtcgccggcgtattagcccaagcgttccatacagtccggtgacactttccgcgtgcattcactacaggatatcggaggcaccgaggaaacgtcgtataccgggatgagcgaccgatcggccggttcagcgaaatgtaacgagacgaagaaacccaccagagcaccggatgcggatagtccgccgaaatctgttgcgttcagagtaggctctagcagcttcgtgggcataaggagacgccaacacggtgtgaaattcgcgccacacttcctgtccgacgcagaaatggtgaacatggcgaagtgatatcacatgtaacccgccgcggcgttaactgccacttcgcaactcctaggagtccgaagcttcaggttgtgacccggcgtccgagaggcttgacaggccggctgtaccgacaccgccgcccgagtccgccgcagcgcaccgttgcgaccgacggggacgatcgagggaaggacgtagaatgaatttgcttgggcaaatcttggccaactaaatgtaacaactccaggcggtcgaactaagtgatgtgtttccgaaaaacgtcgcctgttgtcaaacgcgatgtcggcacgttccttctattttacagcgcaaggttccgacttgttcagttcacgaagtggaaatggagcgccacaccatacggaccttactgaggaaggggtcaaaagaagatcaaatccgcctactacacagcttgacaatgtgcttgattgaaggcgtgcaatgaaaacacaggcttgaataacaggagcagcgatataggcgtccagtagggaaggattgcgctttaagattccacggctcctggtccgtagcatgtgctagcatggtaggactcttgccacccagatagactgagcaaaaggttcgcagacgcggaacgtttgaaacaatcttttatcactggactgcaggacaacaatcatcctttgtgcatatcttcggactggctcctttcagctgcatgcagctggcgggttacctccactcgcaaggtggagtttggcaccgagtcaaacgacagacagagtacactgttgaagtgtttcaagactacagccagcgcaagaatgtggtccgtcttcggtgacgagaacatggggagcaacaaacaagtgtggaactacggtgacgtcgattgactagcgttcgacgcgtctctcgtggatccgggtcgctaccacgcacagtagggtgtaaaagtgctaattcgaccagagctcttaaaagacagatcacatcgcgttcccgctatcagctctaagcctccaccaccctgcgtacttcatctgtgggatggtttgcctggacagagacatttcgtttcgataactctctctcgttgcctaagcgtgcggaaaccttcacttacgctgtagacgcgatctgtggcaaagtagtactgcgcgtattatcccatgcggccggaggggcgccatgcttccgcccgcgcccggttcttggcaggccactcgaaccagattccattggggtggtggctccgtttaatttcccccggaggtgtgcagcagttttgctggaggcgagtgttttgtatttcacctcattcggggtgcgactgttgtgagggagagatgaggaagcaaacgcgtggctggaagcactgaaccccctcttcatttgggacccaacagatttgtgaaccgtgcgaaggctggaagcgaacgacatcctttgtgaatttgaaagttcaaacgaagccagttcccgtaacgcctcttcgcagcgcttttccggagaaaggattcctaaggaaccagaggggatcgactgtgggtttccgggcttcgcgttccactgtctccacgtctccgagctccacgtgcaaacgtcctcgtcccgttgcctgctgggattctagctgcaaacatcgttttcgagcgctgttgtgttggttgtcattttcatcgttgctaaagggttcctaaaagtcaccggcaagtggtggaagcacagagcaggctgtgggtgggactcgacgcgctccggaaacccagcgtgtcggtggtatcgttggtatttttgcatattaatgtactggctttgtggtggtgtgcacacgcctgagtagctccctgcagtatgcgcgcagagaagagcgcgtgagactttgcgtcattggactctctcgacctcctgggtcttgtacaggtgctcagcgttttgtgtattctccgtgttacttgaacaaga

SEQ ID NO: 2260 - DNA, 2843 bp, Toxoplasma gondii
tcgagaggaaaaagatttcttcaggcctgaggttcgacgctttgagagcaaacgtgtgaaactcacttcactcgaaacgtcggagaaacgagcgtgtcacgagcacattcgcgttaaagagtccccagatcagacgcttctcgccgagagaaaaggttccagaggagcgcaacacctcgcgcgcagctgacaggaaacgcgcaaaagagatctccaccaaaatggtctgatcggatctctcgatgcgcgttcacctgagaaggaggaacgagaaggtggacgacgcctcgggtgctctgccaggagtgacctgtgaaccgcgcgtcggcaacgtggaaggcagagaacgtcagaaaaaacagcctgcgttttcaaggaggcaatccaagaatcagggacccgcgagcaagacggaggggcatgagagagagagaggagttcggggactgtcgaagggaaaggaaaaacggctgaacggagaaaggaagggaaacgatgtccaccaaagctgggcagaggtctccagatgcgaactctggggtctcgaccgaaagaagaaatcgtgaaaaaaagagaaaaatagaaggaagggagagcgagaaagtgtcgtgagagaaacctagactcaaagtgaaccgtaaaaaaagcacaaattcgcgaccacctttctgagacctcacactgctcacccaggacagttcagaaaaggaagagaggacgcacgcgcgagagagagacgcagcgagaagagaagagaaaacgaagaaagtgacaggaagaagaaaggaggaaagaaggaaaatgaagaactcgggcagtctacacaaaaccgacgtgcacgaacggttgagatggccagaagaagtgtcgggattgcgagaaacacagaaatggattaaactgaggatggaaacctctgcgatttgaccggaagggaagccaaaaagaaaagaagaagcaaacacatatgacaaaagaacacgaaaaaggaacccttgcgcttcttctagccaccgggggcgcgggcgtcgcgggatcgctaggaaagaaggcgcacaaccccgagaaggcgagggaaaaaccttctctgaactcgcgtttctctcctcaggcgaccaagggcatttcgaattaaaggagtgaaggaaacgactcaaaagccgcgagaaaatccaccggttcgtacacctagacaaaaggcagcgacgggaacgctctgccaccggggacacattcgaggcgcagtcggatcgtgcaagtctgcagaaccgggaaagaggagagtgaacgcggcaacagcctagccatcgaccacccgattgataaatgtaacgacgacgaaggaagagaggaagaaaaaagggaggaagcaagggaaaggaacggatggttagtcccctgggaagcgggctcctggtagtttcgcgggttcgctgttccgcaagtgaagaaaagtgacgaagattgggaactggagagcgccggttgtcttaaacggatttaatcgatgcacattgacgtcaaacacaccttcttttcaaacgcagcgcgaccgtctctgcacacttgcgatttttcttcgcggctcttctcgacagacccgtcgctagtccgcatccgcgcgcgctgttccgaggtttcctcgatgctgattccatctcgagaatttggtttcacgttgttgttgacgcgcggaagaggcctactgcagcttctgcgtgatttcagaaagaaagacaagaaaatctcgccaaacgaagccacatagcgacaacccgccctcgccctccgcagagcccccaaacgttcccgttggtccccgcatttttcatctggattctcccgcctcactctgaggagaaacgcgcccgaaaaaacactccttagcacactttagctgcttccgaagaaggcggcaccgttgtttctaagtctgctctgatgggcatcaaatagtgaagtcgcacaaccgaacggcgtgtgccgcgtttacgtggaagccacgccagtgtgccagtcgcgtttttcttcctttcgtcagcagactggtgaaaacgcagaacggtgaggtgtggagagagacccaagggactgtgtgtttttctaggaaagggaagtcgtttctgcgactgccggccgcgagcgacgtcgggttgctctccacggttttgtatgttaaagttgggaagtacggagttgcagttggcggaaacttttgcgattcgaattcccggaaacgcttacccgcacaagaagccttgaagtggtgggacctgggagttcaaagtgcttctcagtgtgattttcttcccttcctggcgttactcgcctggtatcagggaacaagccttgaaacatctgcacgggtggaacttagacgtcgtttcgattcgcgtgggggataaaaggagagtcagaccggttcgtcggtttcccggattcgcctggagtgtttcgcattcatgagactcaatccttagaggttttttctccttggtttttggtatgaagtgaatctgctgcggccggtggtatgccttgttttcctgcttcagcacgtctcagtttcgtcctctccgagttttcttgttgccgtcggtctcagatggattgacacctattcctgtgttttctttacacctctggaagccgcgcttttctgccgtttgcgttccaccactgcctgtattgcctgttgtcgcgacttctcagtcgttttctcgccaccagtttcaggcccttcaaaatttcgtttgttccagtgcatgccgcgcgtgcagaagtgcaccgagtgggtgcgtaattcgttttcagtgtttttcccgtccgacagttccagaaaa

SEQ ID NO: 2261 - DNA, 2124 bp, Toxoplasma gondii
cattccactccagtttgtcgagtctgctgcaacccaagcggaagatgcccacagtcttccatcattttctccacgcttcagaaaacaaagacagaattgcactcaccgaagcctaggtattttctcatgcactcaccagtcacgagcacctcgaactaccgatctcagtcccctgcactacgcatatatatatatatatatatatatatatatatgcttgtccatacacgcatacgagcatcatatgatctctctctctctcaatatatatatatatatatatatatatatcagcgtattcgcagattctttctgttcttgcagaagtttctgagaagcgtttccactcctgtgtgtcgggtggatgaggaacgtttatttacgtttcgtttctgcttcgcgaggagctctgtttcgagcttgagcgcgcgtgcaatgaagacaatctgtttccgagaaaatcttcaatcctgacaaccggcgcgacgcatgcaccaagcgtttctgtctcggcctccaaggttttcttagaggacgaagaaaggacattttcagccgccatcgcttgatttttccgtcgcagtctcccataaattgggcattgcctagggcctcgtgttgcttctcccgacctcgttttcaggtttctgtattttttgatttcgtgctcgctggcaaacgcgccagcaggatcgaggatctacaggcactggtttcggtggaatttcgcgcttcttggtgttcgcggcattctcccttcctccttttctcctcctctgcagctcttctgcacgcgttaaccgatgccctcgttcgatggatagaaattcttcgaccccccaacgtggacagccatcgattgccgctcaagggatagagagacatgcacctcagttttcgagcgacatgcacctgtgtttacctctggagatacaggttgcagtgacataatggttgcagtgacaagccgctctgtgccgagacgtctacgagcactcgcagggagaggcgagggaaagaagacgcagatatgcgcgaaaaggtaggcacttgcatgccggcatctacaggtagagatctgcgcgcgacattgagcactctctgattttccttttcgtgacgaacgcgtctctctgtgcaggacgtagctctgccctttttgaggagacggcaagaccagtacaaatttggactgagtgaccgtcttcggtggtttttccccgaggccttcttcgctgtcgaaacagatcgcggcagagacggatctcgagagcttttagtaacctcctgtgttgcggcctcggtcggcgtttctcgctctccgttgcttcgcctccccgttctcgagccttccgcgcgctgtcgtcgaaaccgatttcgctctgcatgcagcccagagacacgcaaagaggacagagactcttttctcgcgcgagtctcgttgagcgctcttgaacagaggctctgcggacggtgaagtcagggatgatgaagagtttttttccacttgcttcctctctcagtctcgcgtttctaccatttgttttccacttccgtactccccccccacagaaacttctctgtttacgtctcctgcggcgtgcatgcgctgcagcggatcgttgaggggcaaacacggagctccagacctcgcttcgccgctcttttttctcttcggctttctcctcgctctcctccttttgcaggttccgttcgacgacttctctccagaatctgcgtagcgagagacgccaggcgaaaggaagtcgtcacggcgaagcaaactgtcactgtcttcccttggctgcggggctcgcgcgtcgttgacagacgcttctgaaatcagtttccttctcctctcataaacacaggctcttcaggctcttctcctcgccttcttcctccctcacagcggctgcggctggtggtggagttctgcgtttgtcctctctcttcgtccccgctgcgtccaaacatttcggaggacgcctgccttgtgttgacactctggaaacgcgtcgcttcacagcgtcgagcctgcttctctcttcgcctcgaagccgtgagagaaaccgcaagaacagaatatttcggacgcgaaaaacgcgagcgcagtccccagca

SEQ ID NO: 2262 - DNA, 2378 bp, Toxoplasma gondii
gaataagctagtgcagattggatagccagtgtagcactgagagttgctttatcaccaccagaaagcttgaatatcaccacctgtactacaattcaggtaagtcgtgcacatgcagtagggtgcaattcctttcgcctgctgtggggctcatcgaactctggacaagcccagcgagtctgtattcagcctcacagagagcagacgacaatgtttcatacattcattaacagtcgcgccccagttcgtgcgcgtcacaactcatacacggtcgatgctagagaagtccgaggtacatagcgtagcctatacgtcgggggaccgcattgttcgaaatacgcaaggtatcatggcatagaaacctggatgtgagaagaaagaacaaaactcagttcgctggcgcctgcgggagcgacctagccggttcacacttctgaaacacgaacataatccatgctacagctcattttccccaagcaagcacgcaaatactggcaaagttaccacctgaaaagacgttcggttataatgagccacggggttcggttgtaaaactgcagaaagcggcagtggacctcagctattgacagcgccactgaagcgtctttggatcgttaatcggaaaaccaatcacagactcccctgcatgcagacacaagtgttcctcgtggcaagtgcagatgactgacgacatcactaaatgctggagaattttcaacatcaggttgaatgagcctgctgtccggcgaaacgccattgaggtatctcgctggaaacatgaatgcaaatggcttgccgtatcaattgaatacgaatgtcttacgaagggtgaatgctaaactaccggtcgaacctgcatgcgcacatgtaattccttcgtttcgattttcacttgaggggaacgggccgcccccgacaacagatgattcctcggactgagaccgttgcattactcacgtttcactattataaaaacaacacaggctttgaggggggggaactggtggtgcttgtgtaacgccagaagaacttagatgctccctcagcccttccagcatcgagaaccgtcgcctgggaaagaacagcctctgaatgaactggttcttcccgggggccagggtacttgataagcgcggtcctcgaaatgctcgtaggcgaaaaaaacccgcgctctttgctttcttgccttgtgtagcttctgccttcaacctaaatgctacgcgccagtctgtcgtcgcacggcctaaccatgtctcaagcagctggctacgcggaaaagaattgcttttcggaatcgcggatggtttccttatcaagacgaagccagtgcatcatccatcccatcggattgaaacgagtagttaatccgtcattactacgccagaagtgtggctttttcgtcggcctcgactagagtgtcggtctatgacggttgttgtatgatgccttccgcgtcgcgctggcgcgaactaggttcgtgcactggagatctacgactgcatggtcgaagaaacaacaaacgttatcctttgctgcgatcccttttcccagcttgcttggctagaacatggacagaaactcttccgtgatcgtaaactagttggtttcgactgtatgctctcaagaggatttcccgggtgtgcatttgtagacgggcaggtgttcagctgttgcatgccgcaaactggtaccttctcatgcgcgttttccagcatcgtcctcaaaatgtacaccaaaaatccgtctgtgaatcacaaatgaacagctttcgtccatctgcttttcatctcaaaggccgaggagatcctctagtagacagaagaacgctcgaaccgtctctttcccttctgccgacagctgcgaaaggcaggtgacttcgcgcgtgctctcacgcctgcccaactgcggttccgtcgctcgacaaagtttcctaaccctcctccttcactagaacattccctgaaatgtacagccttcgttcactaaactttttttttcagtgcccttctattaggcagtcttttcgagttcccagactgtgtgtgtgccttcgctagcgtcccggctcttcgccgtcgttcagcattctagcctcgcgcagcacagcccgttgcttaactggcacgtcagtgactttcgtccccactttcgtaccaccatcgcgtcgccatgttcacagcgcagtaggcgagctcgtctctcgagctataggaaagcttgaaacgctagaccgcgaataacgcgtagctggccttcgcctcacggattcttcggctgttcgcacacctgcatagacacacgcctttgtagacttttacctgaagcattcgtggcgcgtttttcttcggcgtccctaacttcacctggaggccaccgcagca

SEQ ID NO: 2263 - DNA, 4108 bp, Toxoplasma gondii
cctcttgtctcttgcttttctgttgatctgccgcgtttcccacacgtgccagccaaatgtctttctcgccatccttttttctttagacgcaggtttgaccccagggcgggcagggtgtcttacgaggaacgcgaggcgcgggcgtttcttgtgtttgtcagtttgtggcggtttctgccgccagcgctttgttccacttgaggttctgcgacggtaaaatgatcacaagagaactccgtgactttagacgacacacctgtcactcctttttgggcgttgtgcacagaaaacatctgaccatgacatattcgccggggccctcctggttcggggctttccctgtgcgtctcgggacggctagttttcttctcgtggcttggagattcccacggacagagcagaagggttgtgtatagcagtgataaagaactcggttgtctgtaccgcctaactggaggcatattcagcaccttagatacgatatggctttgcgatttgagtcattctaatctgcacacataagatcactaactattacattatgctccgaagtgtaacggcacaagtcattcgctgtcagcaacgtctctcctagcttccctcagagaagacaccaacgacaccggattggtgacagaaaagcgcgattgctacattcccatatcgaaagactattcgattcaaagaaatcggatttggtcactgctcgcacgccgtcgggagacgaggggtgcactccaagggtgcttaagaacaatttaccgtatgcgtgtagaaaggtgtggagaaaaacgtttccatactgcgaaacaaaaggaagtaccattgagtcgcgtcaccaaaacatacaaacggatcctgaacgacacatgtatcggcttaaacactttgctaaagaatgttacgaacaaccttgaacacgttggaacaattggacctcatccggttgtgtgtgggttggagcagcgtgaagcaggcgcccagtttagattgcgaatctatgctgaagcgagagtgttacttgtcttcgaaggaaatttacaaacagtaaaaaagaaagccatgcaacctttgttttggcggttcttttcgtcggcatgcggaattggcgcgaccgctactaaatacacagactgccattcgctgacaaaagtaatccttttatgagtatatgtgtgcagaaacatgcagaaagaacctctaagagaagtcgaaacgtagcatcagaagaggagcaaccttgacgcatgtactcaaatagttctatggtcagcaacacgatgaccgtatccccccccccttctccccgcctcgagggaaggttgtctgttcaccgggctgatggaaacggtgttgaagcagttgtgcgcagaagaaaaactacacttgcagtcggcggggtggattctgagaaggaattacccttttttcatgcaggaacttccacgggactgctgtgggcatagagagtttttacagagtactggttttctctgcgttgcgctggtcagagactttgttgcacacggacagttgtggtatggactgaaacggtgagatttcatggcacgaaaggggtgttttctcagcgaatcaaccgacccttggggctcggccgctgttgctgagtggtctttcgcgttgacagaactcgcaaccttccgcctccatggtttctttatttaatattcgccgagcgtcctcgccgactccccttgttgtcccactttctgtatttgtcattttagaaacccgcagagagagaagggacaaaaatccagaaacacctctaatgttgtgtggaagaacatgaaagaatacagctgaaggtcagaagcaggccaaggagaaaccgtgtttcatccgctggcctccagacttgaagaggcacttccctgtcctcatttccgttaatatgcgtacacatgttacatccacaagcacaagaacaaatgttcatgcaattctattcatgtttttatgcaccaccccaatatctccatctgcgcgtacttcctatgcgacatacataatctacagtacatgtctggttagatcatttttttttcttgatgcctctgattatttgaatgccacgactgtgtcaaggtccctcgttgggacatttggctgaaaaacccagtatactcgacggctgtttcctccgtatctctttatcggagtgagaagaaccgaggcatttcagctgcctcgattccttttttctcccgcccgttgtcgcgcccatttttctccagttctggttgaccgtggaaccagcccggagcgggcggctctatgcgcgcggtttccgagactgtgtgtgggagcttggattgtctcgactctctctctgcggggattacttgaccattgtgcatgtgtaattcgccgtggccaagcgatcttgcttgtccacctttgtctcttaagcccatgcggattttcttgccgtcaggaacagcagttcatttttgttcaacttcttgcatccgttgcttgtgtttcacagacgcgcgagcgcgcctgctcgcaacggcagagttccctttttacacccgagcgtcttgtctcgctttgaaccaaagtcaggtccgtctacggttcggagaaacgaagtcgctgcgatgggagggaagcctacaggtgcgagaaactcaggcttacaatttttgtgtaaatcttgcgttccatgtgttttgagttcgtctcttttctttgttcccgctgaggaaaaagacccccgttagcataccgcgtaacccggagcgactttctccacgcggaatcctcgggagaagtgcacatatgtctgtgtaccggaattaaaagagtttcgaagacgggaaagagggcatctgaattttccggaaacccagcactttcccttctcgctcaggcctggtgaccccttttccacccctctcatcttcggtaaaaggcgcgcgtcactcctgcgtgaccacggcgtacgccagcgacagcgcgagaaagcgtcacatgaaaaacgcaaaaacgactgactttcgcccctcgctgctgagtaacgagacagacacacgcgtgtgttttctaccacttgcgcgctgcttttcccaggtcgtcttccccagatattccgatatcccgacttctggtcgagatagtcacggtccacacagtccatgtagtggcggggggtggtcggagggctgccatactttaaatccgttgctgtcgcccccagtttcgctgctttttttgctttccgtccacaggtgaatcagcagacgggaacttccacgcttgagcgcggagcgcaacttgcggggagcaaaggcgagggtgaagttgcgtgggacgaactgggaggcggggcgcgagaaaaagcaagaaagggagtcgcgggtagaaaaaaccagaggctggaaaatacgaaagggccgaaagaaggatagaaggcgttttccggcagcattccgacgtttttcttactgtgacgagcactttgctccatgtgcggtgaagtgggggtatctaaagcgattccccgttttttccgttcttgtgcacaatgaattgtgcacgagtgtgaatcctcatgctgccgccagcgaccttttccacgtggttgcaaggaggcacttcagaaaactccgattccaggatcctatttctgttcagccccaatgcaggtgtatcagctgcacaaggtgacagagagtccgactgcgagcgtgctgttgcgagaggtgtcaattaacgcatgcaagagtaccaaagaggctgttgtggtgtgcaagaccctgaaaatccttgttcggctgctccttttctaggtggatgttcacgctcctccagaaagccaggtgccatgcagcctgtgtcgaagagagcctgtgggggaggagtgccgtagagaccttatcgtctttcgtgcggctccgtgatttgaaaggaagctcgtgcaagcgtctctgtcgaagaaatacagagaacatttcgcgttccacctagaccgggcgagagtctgtcgtgactcagcagccgcctcgaatctgcttctctgcggtcgcgtttgccgtctctctgccctgttccctgtcgaggagctctcttttcttgacca

SEQ ID NO: 2264 - DNA, 4674 bp, Toxoplasma gondii
agatctgcgaatggaggagcagctgcgagacgaaaagaagagaaaaaccagtggtgatgccgtgcggcgggtccgacctccacacccctcaagaaggtgatgcattcaaggatttttcgccgtgtttatcttggcaagtgcatgctcgcaaagacatgtgagtagaaaggatcggattcttgctggcctggcacctgtttaggaactgggtggatgctcttcacgccatcgtgaaagtctgggtgtaccggatccaattttgtgtgtgtttctgcgtgagttttcggtgtgtctggacacctgtgtaagggaagtttatgcggttgacgggagatggacatgtgtgcatagcgagagaggtgcatgcatagagggagatggagtgtggagagagggtctccggcctcggcgggcacgatgacagatcgtggtacgacaagggaatcagggcgcacagtgactgcggagatgtccacttcgtctcccgagttgttggcaaaaagaagacagtcgagagcggcagagaagagtgaagagaaggcgtctgagtattaacgaaagactggagttcctacagcttcagcgttgtccgcgcccatcttcaagctctgttgtgtttatttggaaacccccacacgtcagtgcctcagaatgagtttacgatgcgtggatctccaccctttcaactgagaatcatcgggataggcgtgaatcctggtaggttgggaataggcaaatgcacttgggtgttcgtcgggacgagcgacctaacgaaacgaacgacgcaaacgaagacagcgctctttcttgacgggttgtaacactcgaaaaacagaagaacaataaaatgagaaacgcatatggcggcacaacactcttggaatccgtaccacttcggtgttgagacagacacatcttcaattatcagtatcacctttcccactcagctgcaagttgcacaagacggtgcacacacacagaattgcctgattttcgatccggacaagactttcacaagacactgagtgttcgtcgagtcctcgagtggcctcttcgtgtttctgacgggacaaggctttgttcggcgtaacgcacggacgccgtcttgcttctcgcttgcgctccgtttgttggctacgcagcatggtgtcaaagatgaaaagagggggttccgaaacgatcgagaggagaatgagaggcatccaggtgaagaaagctttcccacattctttcttctgtccaaaacggaacgtgttcgacaagcgacgcctgtgtcattgtggtccatcttttttgtcaagacgagaaatactcacccactggatcggtttcctctacgagtgctggattcccaagcggcgcttcgttgcgctaggggatctctcaggcggaagaggaaaaacgaaggcacttttcttccatgactgtcctgagagattcttctgcttgcagtagaatgatgtaaccgcaactgaggtgagaaaaaacaaatctccaggcctagtgctgttccgaccacatgcccttttcgttgtgtcccctcaaaagggatggtgacagagggcgtcaggcgtttctgtcgtcttgaaagtttttgggaaggtaattgactacggagcagcaaactgaaaatgacgtcttcgggcgctcctcttctctccacgttccacgactaggtagactacacgctactcctgcttcttccattgatcccactacagaaaaatacggcgaacgcttaaatgactcagctgatgatggacaggcagtaagctgagtctaccagggatttgtctcgctgccacatgcctcttccggcgatgaagacagaacgcgggacttgggggtttagggtagacggcggcgacctctgttagcacttgagtcgcgcctgactgattcgctgtagtagttgttttgaagacttggagaaatatctagttactccccgagactctctcgcgcggcaaacgtggcgacgaccacgccgtcgaggagccctaccccgctagacaaaggaactgacagaccttgtccatgagggcccgaaaattcacatgacacatcaagacttccggaacgctgactggagcaacgcagaaaactatcaagctcagtgattgccaaattgtgttttagacgtctgggtccgcctctgcgatcttgccaactcatctgggctggggtgtaacgagagtcgcacgtgtcgcttgccagctctgcacttgtacacaatatgtgacggagccagaggcaggtgaaccgaatacgtttttctgcgtgaacagggaggacagtgggattttagtatcctaccggtattcacgtttgcttggatgctgtagtcaataacaccgttggcttatttgctgtacagcaccactccactgcaccgcttacgacagctggccatatccttcgtaggaagccggcactaaggacgtaagatcacagattgaccaagtaatgtaatcccgtaagaggtagataatatccctcgtcatgcctgaagaagccgcgttgagaacagtcctcacatgttcagcggggtcgaaggcgctatatgagctcctttacaaaacgcctatggggaaaactagtgcttagagttcctgtaaaacctttacaccacttccagatgactagcttctgagccgatggatagcccaccgcgctccaaaatgaatatgacaaggacagagttcacaccttttccactggtcactgccaatattacaaagtattgccttttcaaaggtccagttgccaggaggcaaacgccagaccgacaacaaagctaggtcgtctgtccttgcggtctacgtgcagagattacccggtgtcgcgagcttgtactgttgtcgagaaacagaagcagtccactccgctttcataaaatgtagtatccaaagggtgaataagtccgaggaaggagacaaagcgttaaaggcttcgttctgtcctattcacgcatcgcatttcttggtgaaagctgtgcctgtcgactgccctatgtaaccctacagctggcctcctgccccggagtctcgaactatgtcgccgttgagaaagatcgcattcactatttatcagtcgtagagagtctgagagaagtcaaaaaaatcgttgttttctgaaattgattccgcctatttcgtaagtaacccaccaccatcagacgctgccaacgtgtctcaaggcgcgcccaagcacaaacctggtcacggggcttcggaatgccgtaggttcgaaagtgtcccagttccttgtgaaactcggggttttcagtaaaactagacagtacaatgaaaaatgaaaggacggcagtcctccaaaagatgcgaacggattcttctgtgttcagcgttacggatgatactatcggggcttcctgctcaattgcaggtggcgggtgcgcgggtcggaccagcttttgcgctcgtttctgaaccgcattcttcctagtggcatcgccttttgaaaagatcgtaaaagcgagtcaaaacagacgccgcggctaccctggcaattgcttcttctccattgggtttcccagagtggcgcatctacaattgacagcgttgcggcttcgcgaaaccggtgcttgttcttttgtgtctgtgtcttgtcgattcgcgtgcatgctattacagcgctcttagctggacgttgcgaacgacggatttaaccctcaatacgaatcgtcgtgaataaagtaccatcgttttttccaggggtagcggtgtgtcagagagttctaggaaacgagaatcttctcagcgtgagctgcgaactggtatcctcgcggcttggctccgattgagcagttcaatttccttcgtaaaggctccctcaccgcaagaataatcggcaggaatctctttctttgatgatttaccgtaaatttcttttgtaaatctgccgtgcttcaccgtctcctgactcaacacttcggcgtagtttctttgccgctgcatatggcggcggaccgcttagcttttttctgttaacccgtctatctgtttcactcgttcgtcacaactcgttcccgtgtgcttgccctcttaaatctgtatctcgctttcttacttactggccagaaccgtcgcggaacgcgactgtagcaccgtggtctcggtacgatgacctagtcggagtcccggcagccgcagcacttgagtccgcttttgcttttcgtaacaaagaaatgccgggctgaaccccaacgatttgttcagagtgagcagcagctccggtatctggataactgtcatagaccgcgggacaaagcacatggtaaacactaatggcggatcgacccggtgcgggttgccgtctgatcgtttgtgccgtgtgccattccactcctttctaggcgcgcaggctgtattcaggtagtttttccgtgtgagtctcctttgcagacttattgtcgaaaccgttgcgttggactttcacgacgggagctcgacccgtctcttccgggtacccttgagtttttccctcactctcgctgcgtgcagcttcgagttttcatcgaacgcacgtttttccgcggaaccgcgaggccgcggcattcatcgcttcgcgagcaggcctctttccccgatggagtcggccggtggctcgtcagaggttgctcgtttcataccgacgccgctcggacatgagaaa

SEQ ID NO: 2265 - DNA, 2751 bp, Toxoplasma gondii
gacgccaaattgaggtcctacgtgaagcatcttccgttaatgttcaccataacgtggagggaagagcaagcgtacaatacgaactcgtctaccgtcagttttcacatacttctggtgacgatactataactgtctcgagcgctcctcgatgggatacacttttcactttaaggcgatgacctatttgaaggccagtgaaacatagtccatggtgtccatcgccatcacagatctacaatcactagacagtcaacagcggagttcgggtattcctccgaagcataccagataccaatgcaacaattgttctgttttcttaagacttgcacgtcccttggatttggatgctcgaggcgctggtgtcctgagacgacgagggacaacggcactgagtttggccaggtcccaccagcgtccactcttgggtaagagaaagtccttaaagaactggtggcaccgtgctgcataacaatccaggctcttcctggcatcttttaggagtattgactagtgtgatggcaaacgttctgcagatcgcttgccaatcaaagtgttttctcgcacgaaaccctgcgtgagactcgtttacatcgtgacgcagtgcaaacacttatcgcgaactctctcttgcccaaaccaccttagaatttcccggatctgcatgcttcaaactgtacacagatctctccatgaaagcatggcagaacagttgtaagggtgcgtgacaggtgttgaacatcggtgacaaaaagaagtacattgtcgctttgtcggcgtgtttctgtggcagctatgttggctttggggcaggcagccatttcagtaaatgcaaacatgcagtctcacttttccggggaagaggttttgcagtaatatgtgccgtcgtgggtaacattatcgagtttgctcaacgattgtacagaagcagggaccacggtgcccgggcacttcacttggccctaccttcggcgctttcccacggcagtgtggaagccaaagtgccaccaaaaagaactggtagatgcggtacacaaaagaggtaaatgtggtttcaaaaaatacacacgaataacgcgcacacacacagtgcaagaactcacaaaaaagttgaaacagtctgcacaacagcactcgattcactctcacaggtggcccgtgccccgtcacctaaagctggttcctgccaccgaaagtctgttagaatgcggtgcaaagttaactagcgacaaatgaatacatcagaagccttaaactacttggactgtccctcggatggtgttcagtaccgagagcacagaagccttttccatttcttgaggacgcgacatacggattgcagtacgcttgtacgacaccgagctgcctggcgctgccactatcccgggggctggacacacgctgcgttgtttcaacattatacggacgcccgagcaggaagtgtaggttcctgtaatttgagagaagccttcttttatggttttctccttggaaaaagtgttgatgcgcgggcagctgaaggggtggccatcctgtgtgtcttagcgcagccccccagacaccctctctgattcccgagtggagatggctgtgaaccacgtcgcccagcgctgtcccagcttcccgagtttcttttcgcgtttcccttggccacttcagtttcggttggatacgcggcacacgaggaaggaagttttcttgattttttgtttcaatggtcccacaggccatgccagtcgaaaggacttccgagcccgcaagcggctcgcacatttttttccgcagggggggagctggcatgtccctactgccgtgcaagaggccgtttctgcgtttccaatagatatacaatgtgaaatcttcttatctcgccttagtcatttttaaggatcacgcgaaacccctgctgagtgtatggtctggcactgctcttccagattcttgacttgcagcgcaattcgttcctgcgctgttagatcttcccggtgacgctacgatcgttttggactctggcgcgggcgtcagccccctggtgtttgcttggcaacttccgccttctttccctggtgacctcttctctcgttaccacacttattcctgctcgtttcttctcctgttcgttgattactgcatactaggggcgctcgattcacagaccgccgcctgtccgcccgtcgctgaactttggctaggcggtattttcagggacttgcttccatttctcgaaggctccatgctggacggaacgcggaaattgccggcatcgattggataaagtgggaaatcgtcaccacatctttaagagagcgtcggagatccttttcctctgccgttctgttccggcttctttgtgagcagcgctccaccgtgtctcggcttccacatcactccacagttttcttcccagcccactttccttcgggataccaaacgccctcttcttaactcttcaggcgtatcgtcaagacttttctttcaagtccgtgctttcttttcctcgggtgactcccaatctaaacctggggacgagagacagttctctctcgcaccccttcctctagagccggcctccgcgtcgacggcgactgtctctccacctctctccgaccaatctccttttttctccaaactgcgtcaagcgtttcttcctattttccggatatcgtaggtctggccgaggcaggctttctgctgggcaaccccagctgcacagatttcgcacgagagaacaccgtgtctcgtctgtggcggaga

SEQ ID NO: 2266 - DNA, 4847 bp, Toxoplasma gondii
acttccggatctcttatcatctccgacagtggccgtgttcggtcactgacacaggttccctggagaagggcctccaacgagaggtcgccttcccctagaggccggggaatttgggccgcggtttcggatagaaacggcatgatcgcgtagcagttttcgtttttcttctcatctcgaggtgcgagcgaagtgtctgcagatcgcctctctgagacgggctccttcgctccattccttctgctcgcgtaggcgagacatgcacgcgacgccagggtcggtgcgagttgtctcggaggagatcctccgccggcgtccatcatgtccacctcgacagaagaaacgctcgaggttctgctcagctcttccgactcgtctggaatgggtccgtggttcggactggctactgcgccagatggaacgtgagacgacacgggaaccagtccagtcgacgcggaggtagtcagccgactacccccggcaacatcgaccgctttaccctcatattcctcggaaaccaaccgcgagtgaacgtccggtcccagcagtcgtcgtcgtttcaatatgtctggatcaactgcagctgagagttctcgcgtggaagcctcccggcagcggctggcgtgggaagcggaaccggaggcgggcggacagctcacatcgccatggtgaagaggaacaaaaggatcgtcgtgctcggtccacgcaaatagccgcttggcagaattctgcccctgtcgttctggatggagggtcttatggtggtgtgtcgccatcaacgaagtgtaggaaaataggttttaagaaacaaagcatccaaagcggacccgccgggccccctcgcgaagaagcgacaaatctgcttaggcgaacaaagacgaagcgccagacgtgtggacgctagcaagacacgccccaattggtgctggcaaaaggacggtagaacgtttgttgtaagcacgaggaagttgaggacttcgttctccgaaggccgccctcctaaccagtgtttcttgacagacgaaaactaggcagctgtccacgtgccagctgaagcttctttttcaggctcattctgcgcattcaggagccgtaccacggggagagaacagccaaaaatgcaacggaaagaagccgtccaccggaaaaaacagtatgccctcaaacctgaagcaacacgcgaagaacttaccaagtccctcgttcaccgcgttgacgtgcaggcaaaaggagaggcgaaacgcagaaccgagagctcgaagttgccggacagcacgcgaaaacctggatgaaggcaagcgagctaaaatgcagaaccggccactgtcaagaaaagagttcccagcaagagacacacacacagctggacgccggaaagtcggcgcaaaacagggttcactagcaaaagcctcgatatcctgaaggatggcttcgattacctaacctcccgcctcaaaaactgttttccgcggaatttgagagtgcttttctttcgaaaacgcatgccccgcgcaccgcaggaaatgccaccgctcgccaactcttccggggcaaagccgttccgggattatgtggtccacggaagcgagtggcggcacgaaggtaactcacccagctgtaggacctcagaatggattcacctacgaaaatcatcctatccccataagtgtctcatgagcaacaaaagtcaccgtttccatggtacacaccctctgaggccaaccatggggactggaggcgttcggttaacaaaactcgggggagacacgagtcttacagatgtgcagctagttcgctgaggctggccaagatacgcgcatgcaacagcaaatggccgctgaaaaatcacttatatcgcgaatccaccttaggattccccaggattcttgtcccggacggtggtgcatgtcaagcttgtttgcagatggggagctcacagccgagggtctggccacccgacacgagaggtgagcgtttgccggagactgacaacggcaacgacgatgtgaattagacaaaaaaacagctcttaaaaagtaagcggcgaggatcgagaataacaggatcggcctatggcttctcggttgagtaaccggaaactagagcgcgcgccggaggagaagctgctggtaagggtacgcgtatcaatgagcgctcgacagtacccatagcgggacctcgcctgaagcaggagagattacctttggaacgacgctttgaatctgtctctgactttcttttaaactcacttcggaagcacactcacgggaagcgacgccttacagtcgccccagcttgccctcgaaagaccaaggatccgctgcaccgtgaaacgacgacgagcaggcaacaaaacatgttcctcgttatcgtggcaacagtaggtaacatggcagtggggtagttcctcatgattaattggtccattcgttttgcgctgcccagccttctggaagagtgccgtgtatcggcgtagacggggataacacggagagacaccagctagggcatccgcagtcacagtcgtccaggtctcaacctcgcgtcaagggcgagactctaaagagcgtacttatctctccgacaactgccgacaactaaaaagtcgtcttacgaggagagggactttgaagaacgatacttcccttgattaacggaagatctgtcacaatttttgaggcaggcctcacaaccacccaagtgatgttgaggtgatctcttgtataaggaatagcaagcgacaggctttgcctcatttctatttgcaatgatgtaccttctacaaggcgatttcaatgacgctgatacacgttcctaaacgttcggcgacggtgcgttgtcagctgcaccgagaacgattcaagcggtctctggaaaatagttcagttgattgaaaaacagactacaagctttctcaataaccctgtttagcgcttagggtccttgaaatccgtcgtacgaaaagtccttgtgtgtaccttccctctggcccctaacggtgctcagcgcaaaaagacacatacaagttgaattgtttaagccacaagagaaagtgtctatggtgttgctgacgagccatctcgcgtaagctcacgttttcaatcacgagaagcgggaaacgctgaatgcggtggtcatggtgatgtcaatggcagtgacatcaatccacggatggtgtatcttctcccttctccacctgctcacatcgtagcattcaaactggtgctcgcacacctttgtactttcgccttccatgaaaagagaccaagggctgaagttctgttggaggctgattatcacaatccggtcggctatggacctcacccctatccgaaaaacgtatgtggcaatatccgtgtgtctcagatacaaggctctggaggactttacgagtactgtaaagagcgtgttcgatgtactctgcagataagtcctcctaccagactgctgtgagtgcgaaagagctgtatgtatacctcttttcaagtcagttcaagcactgagcctgcggacactatgcttgcgaccccctgccacactgacccagtaatactaatgttcacttccgccagccgaaagggacgagaacaagaaacaacgagttcgaaacgactttaggcagaatatcaagggttacatttgcgttatcttccgtcctgaaacctttttgtggcggcatggatgtgtcgctgacgtgacaggtatccgccgcgcgatgcattcaagtcactcaccgatatctgggggcactggccccgcgtacgaaccgaaagagttgccaaagtaaccccgaatgcgccacgaagatggaaatgatatcgctgtataggtacgcagtgtgcgcggcaccctttacggtgtttgatttcgcaagaactcgcagacacgcctggacagcggtaggccagtcgcctcctggtttgcacgaaagtgacactcgggactgacagtgagacagttttaacgttgccgttatttaactgaaaaccacatgaatgaccagacttaatatcacgtggctattcttcggtcggtcttggagcttctcgaacacggatacagcgctgttgcttgtctgtctaacaaaaatcgcatgaatcgatgccgcgagagccgctttgcgatgacagtggggtcaagcgggcagcgctcgactgaaatttccacagacagttaaaaagcacagccggtctctacggaccgtttccccctctcttttcttactactctttccaacatctgtctcgttgtcggctttccagacaaatgattggcattttccgtagtcatgcggtgggaggccctttcctgtcagctttccgcgcagccccacaacattttctttgttcgaagttttttcgtggccttttcttggcaaattaaggtacttgcggactgcatctaaagttgaatctgcgaactggcttcttcatacagagcggacttggatttcaccgtctgctgagaatttccaaggcatttgagtgccgcgcggtagtggtctccattgtctctcatagcaatcgtactcgacatccgcgttctccattcttacctgttttgtccaggagttttacttgagctgtcgctgctccgatagttccaattttttgggggtcgactggcgtggttgagactgagctgtcactttcccttcaacccggtaactcttttgcaacttgacgcgtttgcgtatcacctccagctcttctgctctccagaggtttccttgttctggtcctcctttttccgttccttgacttcccttttggcatttttctcgtccccttttcagctctgcttcctgtctgccatcttttgtcctcggccctctcacatcgctgacgcga

SEQ ID NO: 2267 - DNA, 3009 bp, Toxoplasma gondii
gtaccgtgaaaatgacctctccttcgaaacgaaatcaactgccttcagaaaagtgcaagaacaaaagaggctgctttcactgacaccagacaggtttttccggtgccgacgcatgcccagcctgcctctcacggttctcacatgtttgccccgtgaaggcgtttgcttgtgtctactgtgggatttgatggtccgtccactgttgtctgtgccactttcagattagaagcgaggcgtcttcagctgcgctcgttggtctcaggaatcgtgcctacggtcgcacttgcatcgccgtgtactgcaaacagaagtttttctctgttgcagaactggcgcaccttcagcgcagttctccctctcccacctgtatgcatgagtcactcaccaccggcgaaaacttgaaagttgcttcagcttgtggcgacgaaaactttcctgtaagcgagtctcatgagtcaaacacgaacacggcaccttctgaaacggcgaaacaagcacaatgctatctgacggtgccgcgcaggagtggagtgcatgcagacagagcggcgttgaaaaaccttctcccggtcagtagtctttggtatggtcagcagagaccggaggagtttgtcccccttgggatgcggcgacagcagcttgttgcagaaggctggattgaaaagaaaccagcagcgggacgcagaagaacaacccccgacaaattgagggacgaccacgatccggaacctgggaagacccaactcgactaaggaggggtccgtgccgatatgcgtctacatttgtacgagcatacgcttcagaggcatatgcatgtgtatatataccttgtgtatcgggtcgtctagccgtcggataccccgcggccttgtgtcagtatttccgcttgtttaaaactgatcaactgttcgttagccggttctttcccgttgagattcaagacgaaaaaaccgctgagaacatgggccccgctcgacgcacatacccgtgatgaggctatctttttgacatatcagcccttctttgttttaaatttgcacgtgcctgcgcaaaattcatatttgtgaggaacgagacgaaagaggtcctactgggatttgaacccaggtcggcggattcagagtccgcagtgctaaccgctacaccatagaaccgacagtgagccttttggatgtggcgcctgcgctgtaggcgtctcattcccaacgcaaagttcatttttgtggaaaggcgaggcaaaactgcgcctttccaacgaggtcatgtttggcttgatgagagaaaacacctatggtacgaacaccccttagcgggcgccacgatactcttacggagagacgcgttttatgcagcctgtacgatatgtacagaaaatgtatcatatacagcagagatggattgaaagtgacttctccgaacaatctgagaaagggcggtttctgacgttcaacacttcttcagcaacttctacaacatagcaatccgccactacacttgtggcacagagactccagagatctcaggtgatttctgaacattgagaagatggaagattgctgaaagtctcttggattttcttggatagtgcagatcttaaagaaaggagggagtttcacctgagaggaacgaaagctccagctcacgagaagacattcaaattgaggcacacatttttctcgatctatcctagcgggcgcgggaaaaaccttaccccgttcattatctgatcggcgcattccctcatagatgtttatattgtacgtgtgtccatacattatttacaagtaagtacatccttaagtacaaaaggacacgtcgatgcttgtggatttgctttgcattggcttcctttcaagctcattccctgttttctacgcatacacggcaaatgccaacccagttcagccagttgctgctgtgcactgtaattttcgtcaagtcagcctggacaacattccatcgatttctttactgcttcgtaggcgtgcctgtagtatctcgctgcataaccgttcaggcgggatactacagaacccccgtgcaacagtggcagggaaaaataagtaaactgcaaagcgagttctgcttgctagaaaaccgtaaagcatggctgctctgcctaagaaaccagatagaaaggagctactactttctttctccgtaagacagagtgatttccggctcgaaacgcctttgccgcatgcaagcggattcctcaatagaaccaatgtgcgcttagaagtatgcacaatttcgagatcccttccaacaatactcgctctttgtatgaaaaacctttgttttctgcccaacattaatacgtctttggcttctcttgtccgaatcgctagcatctcctccgattctctagcgtctcagcttttgacctgactgttgcacctgccctatctgttacctgttgagttccaggcgcaaaagcttgagaccagagaacctccttcactgttcatgtttagctttcgacgggcagtgacccgcttttccctagactatttgaaacgcatgctattgcgtgaaaatgtatgtgcagatggccaaattacaaccacacatgtccgctgctgaccaaactgagacaagcgacccgaaggaaaacaaagcttgcgtttcttcgcttcgcatttgttaagagcttgttcacgcatgcatgcttagcaccggcacaacttttattgaaatgaaaaggtcgttcgagctttcattgtttttgtttgtcccaggtccggcaaagtgaaatccgtaactcttccctcggtctctccactgctgacttttctccgtcgttgtttcctgttctggacgtcactctcttcccgctttctcagtcataacgtccattccccaccttgtcgcgctgaatctttgtcctctgtcttctttgccgactcctcccggtccacttttcaagtgtctgcgtcgggcgttctctccccggcgccctgtatggtttgtgtgacttattcctccgatttagcctactcgcccaaa

SEQ ID NO: 2268 - DNA, 4263 bp, Toxoplasma gondii
gaagacggtacgccgtctcacatcaggcaacctttctcaagacaagctcagggccagtttgacgcagacagggtaacccggcatcaccactttcagcattcacgcacaaacgcgcaggtgttttctgcgccgtgtggcacggatttcgagggtggggtggtgcatggtgaaccggctttgcacacagagactcgcgaagctgaaggaaagaaacttacttctccaccgcctgcacctgccgtggcagccgccgagttctccggctccggcccatccgaactgggagcggcaggaactgaagcagcctcgggagatgacgactccgacggctggggcgcccctacgttattccggctttcctttgacggagattccgcgcggacctttttgggattctggtcacttggggtgggcgaggaagaggccggtgtcgcctgaccatcgcttcttcctgtcgatcggtctttggcatctggagaatcggtgtcgggtgccgaggcggcagatagcgtttgattatctttactggtgtctttctcgtctgttgcactaggttccacggtgctgtccacggacgcggtcgttgtggcctctccactccctccggcctgtggcgagtctccggacgcgcccttctctgtggcctcgaacattctgcctgcataaacctatccgattaagaatgtttgattaaagaacacaaaatacctcccggcaaagcaaggcgttgtcagcttatcgtccgggagaggaaccccgccagtcggatccgcccgctgacaacgcaggaactcgagttggcggggcgacagagctcgaagcagccgcaccaaggtagcttaccccgcagagatcagtccttctccgccggcgaatactcttggccgcgacgaaataagacgggtgaggaagacgaaagggatggggtacacgaagacaatctttaacgcacggattctgtatggtgagcgaggctgcaaaaattcagggaggctcggagtaacatgattcccgaagattggccttcaccagagaacgatcgagtcggaaacagccactccgccgtttggtggccttgcgcgtgggcagcagccacataataacggcgtgtaaacaacgggatacgtttcggaaaccagttttataatcggcatacgcgactagctgcagagtgtgtgaatttctagcaagcaagcccccgaaaaaacaacgaaaggacctctgtccgtcctgtagccgacctccttacgattggtgaagctttacttatcagaggtgcaggacttccggttgcaaagggccacgagggcctggatgcaagagcacagctcgttcaattcccccagtggcaacgtcgatgctcagaaaaaagcctaggaaaggactgtttatgtcagatttagagatgagagaaacttgacagtgcggacctgctgctgcctggcgcctgcgcactggtggtggagggacgaactagagaagcagtcatatcgggacagacggatactgagttaagaagcggtctaaagaaatcacgaaagaacggtcatatgccgatgtttgcgaaggagagggacggaaagggaaactaagtaaggatagagggacgattagtcgcgggtttgaccaggaaactcgggaaattgtcggcatgatcccgtgcgcgagtgaagcacggcgaagacgtcagtctttgagacgaaacgcagcagctgcaaaaaatgtacaaatccgctggaatgcccactgtgtgacttaactgaaaagaagacaccttcgattttccgccacggcatcgctgtgtttggagcttttccccgtagctcgatttctggcaatcgaaggctgagcgcggcaaagatctagcaaatggcgcgttccgcagccaaaaaggggagatacacacgacacaaacgggacaggactgaacataaaaaaagcgttagcgagatcagaaaaatgccggcgaagaaaattgtcgaagagtatgcacttcttcaggaactgtgtcgcgaaggtgagtcttgacctcgcgcatgttgtatcgagccaagcaacggaaactctcattcgcgcgaggggcttttacatgcatggtcaacggaacttccgggtctctattcgacggaggcgaactttcacgttggtcgactagaggtcacattacagaaaaatccaaaacgacggggccctctacgcggttcaaactctccagggaattgtccgcaatactggaaagtgtataagtgggtcgcagttgctgggcaggccctactgataaaaacgcatctgtcggtgacggagaaacggctaggactacctcgaagccgacagaacgtctggaggtggccttccaggaccatgagggaccatgttgcattctcctagacattggttaaatctcgttgattttttctgtcgtctgcgtgtgacgagttttgaaattgccagcttcccaaccaaagccattctctcacaaattcatgtcacggcaaaaatcctgaggtatgtgtgtgtgtgtgaaaccagagtggcttttgcagtcgttctgcttccaaaggcccagagttgggataagatttggttccacacgcttggttgttcagctccttcgctggatcgaaaaggccatgtgttcagtgaatgcagcgagtcgctctgtgcgcgtgtcggcctatccagtcagtcgcaagaggcaggcgtctggatgcagagaacaggcgaatctcgcgcaaacaacgtagtcgacgacccaaaggatattggcttttcaggggacttacacgagtgagagtggcgacgtgaataggagtacaccaaaagaatgcacaaagcccaggtagtcttccaggacctaagcttggctgatcctcctcaggtttcgttcctagcttagcggcgcacacttgacacttcagggatgtaattttgccccctgggaaccgccgttcagcaacgtacgtgatatctgtcctgaatactgaatggtcaaggtctcaactcatggcggcacaacccgccactaaaacggatgcagatctgttgcctccatgctttcttctgcacctgcttgagtttgctaagcttgaatcaatctaaagaaatcccctgatttatctcagagaggtgactcagtggtgacctggggctgtcaccgacaacggactaacgagcgagcagcgccccggtatttcaggtcacccattagttgaagtttccacggtacggttgtcgagcatgatttgtcctctatgcgaacggatctactggagcaaacctagaccaatcacaacgcgatacatggtggctgtcaaaggcactgattgtcacttgagcgtttgaccggcttacaatgcatacaggtagtgtgctgctcatcccttggacggcggtccgtttttaagaagtgcacacattcagcacgattccttccagactacttcccatttgaaatgcgcaaaccgaaacggtcagtcctctttaatgacacaacagcgcagtggacccttccctttgacgcggctgttgctacacatgcacgcagtgcagtcagggtttgcagcgctgaacgctggcgtatcaaaaacttgtaattgagcgcacacactttcacgttcactttgccattgaaacagcgggaccgttgtgatatttctcttctccatgcgttctcgcttgtcaaaaggcagagagagccataattttgcggttgtttccgtcgaaaaatagtaacacacaatgactctgacccttgtttggacttcgttgagtgtgcacggatcggtgacacatgaattccgaagtccttaacacttttccaagattcctctgagtggtttctcggaagtcggaacttgtacgcaagcgaaaactatgtttttgcagtcgtgttgttgtttctgacccacaaaattttggcgttgcaacattgcaaaccagctctgaatggggcaatgtctttgattccctgcatgcagctttctccgtgacagcgttactgtcattgctttcttctcgaccctctgacagagtcttgtttctttgacgagcagccttagcgcacacatttgttgcggaccattttccctactttcccctgtctccttcagtgggagcgcaaatccgcgcgagtttcttccgaccgtgcctacgagcagctcgtcacaaccgtctccgttgcgcctctccgtttcttctctccgtttccgtcattttcctcccttccttcctttttcgtattctttgttccggccttacccacga

SEQ ID NO: 2269 - DNA, 3224 bp, Toxoplasma gondii
aggttcgacggttctccagaaagagatgtttgcaccaaaatctgacgagaaaaacagagacgaaggcgcagaggggacggacttcgtccacacccgtatatgaagttcacacgggatttctacatgttctttgactagaggaactcggatgatcgtctttcagtgatcggggacaaggtccactcgacttccttgtgcgaaaaaccgggtgtctgtcggcaacaggggcgagtgtcgtggagagacagccacgaaagatacgagaagcagggagggaggaactgtgttgttctggcacgaaggacttggcggaaacatgcgatcgaggaagagaagaaaaaaagagcagaaaaaaagcttaactcgatgtacatccggcagcctctgcgtgtgcctgtgctgccctgacctagaaggcagacatgcccgggtccacaggaatccacgagaaggagcagggcaacggcgagcgctatttcgcgggagtgaaacgggaggaagtcagcaggaaggaggtaggaaaaaaacagcggggaaagtgtcaggaacagagatggaaaagggatagcaactgactagagaagccgcagagccaggctcttggatacgtcgagaaaagagtgcgttgcgcccggggaaaaaagaggaaacagacgaaaagaggtgcactcgagttccactccgtgttgagaaacaacagaaacgacagaatgcctctcagggggtgactatttttctccgtgtagccctgcaatcctgcaatcctggaaacggctgaacgtcgacttacagtgcaacagcatccgctcttcgctctgtccctgtatggaaaacgcgcttcgccggacgaaatgacacagacgaaacggactgggacagagagagactgagaatcgaggaagcgaaacagagtgagaatggttcttaatcgtgacgcgcatgcggggtaaacggaactccacagccacgccaggtccgaggccggcaggctcctccaacaagcacgtagaaatggaaagaaatagacaactcgaccgcttggcgagctcagacacagaacggaaaagtgaaatcccttctcaggacttggttgattcagaagaaagcgcgcaggattcgacagaatctccgcaactgcatgcggctcgcagaaccgggaggtgggggcgttcacggtttgaggaggaaacggcaggcgtccgtcggcacatgggtaaacagactgcaccacgaagaaagaacttgatgggaagcaaaagcaaatctcatcgcttgttagcccattcgtggcttgttttttctccaggtcaattcgcaagcgctcaacgtgtgcgaaaactctaaagtcacagtttagggacgccagcggggtcaggaagcgcacacctgagaaagtgaatttcccaggaagcgaggaaagagaaaccgcacgcaccttcctagacagaaaatggcagagttttaactctgaaatcgaagtggaggctgaaaagattcacagaacgcagacaagaaggcgagtattgtgtgtgtgtggaggttgctggagtgattgtagataattagtagggcaggtgccaaaagcaaaagcgtacaaattacaatccaggaactaattaaaatatcagtccctgagggtaagcacttccggttttctacatgtgtgagagcacgcactggggtacggttggtgcgcaaaaatgtggtgtactgatgggacgagtgtcagcgaatgagaaagcaactggtgtcgagcgaaagagagcccgatggtggtcgttccactgctgtgatgctttcgtttgacacgtttcctgacttggaccctggcgattcggtatagatcgcattctcagaaatcgatgaacaccagatcgtcgagtgaagcggcgtgatcccgaatgcatgggtacaagctgcaaacaacactctttaacttttaatgtggggattcaggtaggtgcagacgcactgggaaaagaggtgtatcagattctctgaaatgcagaagaggcggtctaaaattcttgcaggaaagtagtgaatccggctcccttaaaactatagagaagcgccaatacgaatcagtgctgcgaattgctacgccgcacttggatacggtttctcgtggagacagaagaacatgtgtggaattcgttttcaaatggaaaccacgcttgcgttctacgcaggcttcgtttcagaattagaggagataaggacagaaggaaatccataggagtctttcttgtcccatgtctcagggttcgaaatggacatgagtcttccatgggcacagtcgctgacctggggtgggaatcccttttcatgtcgacttcctagtagcaagtaaagcgactagaatggcggctttggctttggtgaaacaaccacaccgagagaacccgtcaacctgttcataacgccatttcatatcgtatctgagaggtactttcgagcaggtgtgagttccacgcagagattctgtggcttgttgcactcttttgctagctgtccatatggctcttcagaaagtttgcagtgcagcccgacacttcgaattgctctggtgtcgatttctctgtaataaagcacagcacaccgtgagtaccccctctagctcaagcatgttgtgcaagactgggtcttagttcatatcgactgatttagagcagatatttgttattttcgaactcgaagtccgagctcagagcgacccatacccttctagcgccttgccttttatgagaagaaatccgaaacacgtaccatttcagtgcacagcctgcagacacaagtggcttctgccaacaccgttgtagccctatttgtgactgtgttccagtcttcggtcgcaagaatttcagtatttctggtttaagttgtaagccatgcgctccccacccacagacgctcgcatctgagcaagccgcagccccacgctgtttttcgtgtttgtattggataaacatgaaacagactgtggactgataggcgggaatttcactaaggcggcttgtgctgagacgatgtgggtgtttgtgagtcgcgcagtggctgcattgtaatccttcatggttgactagccaaaaaagaacggttgtcggttgtgcgactctgagtagccggagactggaacgttacaggagactggcgagggggtgagacgccgccgatcttctgaattctctgaatctgtctgcactccagaaactcggaaaaca

SEQ ID NO: 2270 - DNA, 2955 bp, Toxoplasma gondii
tacagttctgcggtataacgcgagcgacgtagtgtccgtgttactgccctctgattcggtgagacgctgtagcgaacacacgcagaaaagcgaaaagatccctggtgaccgaaccagacgaagacggtgacaccgaccagcaacgctgagcctagagtcgcagtgcagctctagaatacgagaaaatttgatatggcaaacgttacaagtgaaacagatggttccgtggctgcttcggacatgtacttgaagcacccgtggtggttatcgagcctaccaacagtttatttcgcttttcgaggcctgagtcgtgttacgatgtcacgtggcttgccggccgtttatgtgtctttgtccaaattcttcaaataacgcagcaaaagaggccaggagaattttgttcctgttgttcttgtctggttttcgtaaaccctggtacccggtctcgagacgaattgcagacagaaacgcctttaccggtagtgtctgcccaatctgttgtgattattcgagtctttgacagtaatttgctggccaaactcgaccaaggcttgtagccggtttggcaacgcgtcctggtggagaaacgagctttctaacacctccacatcggtcgctgattctgggtcttggatgctttgctttacagtccaaattcacaatcagccacatcatttatttgcttttcaacgaaagcagcatagaatgacagtgccttcatgtcgcccgctgttcgtcaagcatcgatgctcaattgaccagtactgtttaccgaagccttgatgcggatgtgtcacaagcggatgaaaaaacttgtttccttaaattgccttagaaaagccacgggccatggatgcctccctcgcattctaaagtgaacggcaaaacatcgaaggctgactctacgctaacgcaagggtcgctttctgccaggccgaaacaacggaggtggttccctcttttaagatgatcttttggatcttgaaagtccgtgtttaactagttccagctctatgaagactagagtcgcgccagcggcccttgggtgccttgtttcctcagaatttcatatgaaagatgcccggaggaacctggtacagacacatgcgctttccgttctctgttgaacaaacagactcaactttgggatttagacgtgcgggatagtggtcagcctcttgttcgtttgtgttgagacatccaacgtcttcgtttgcgtgtgtatcaagttcctgctgtgtagttgcctcgctgcgtactcagggctaggacgaaagagatcgctaatggtatcaagaaaaaaaggatcgcgttagttcgtggggaaacgacttccgaacccccaaaatagactgacacagaggttgccatggcgtgtatacacgtgtgcaaggctgctgatgggatataaggaacaaaatacatccagcaggtcataggtcaagtactaaagtatctgcaggaactgtaaggacgttctcaagcagtgaaaagatcgctctagtcacggtctacgacagaagacacctcagatgtcggggacacagaaacacagcagcctcggctgttcgctgcagaaaagtagtggacctttggtaaaaagagactcagagaacccaaaaggtacccttacgagtcagcgagacggtaacaagcagtgtatccaaactcgaatgtaagtctccagtattagaacgaggatctgaattacctatcggcacacactatgacgttattcgttgtttcagaacacaccggacgaactgttttgcctaagaaattacgttaccttcctgcgctttagctgttgctctgcagttcgacggaacaagaaaaaaaacaagtgccagaaagtcggccgccgttagctcccctccccccagccccccggtgaaagacattctagaagtccccagtctccaattggtgccggaagacagtctctgtccacactttttgttcgcccgcctcccccaactaagatgctcgagacagacacagatgaggaatacaagaaggcggagtgaaacggagacaactgcgcgaggcgtgtgaatgatgagagggcaggtaacaaagggggaacgcgaaaattgcgccatcttcctcgaccagggcgggtccacgatacgcgaaatcttttctcccgctgttcaggtgtgcatggcggcgggcaaccgggtgatatgccaggtgataccgcagtcggcattggcactgcctttccgtgttttctgcctctcaggaacgcggggttgccacagaaagatctgctctgtatttcgggagacaccttgtctgcttgaatttctccctcgattcgcttccggtgaaccttggcgttctgccggactcgcgcatctggcccgcccgtttgttcgctgaaaggcggacgacgggcacagaaccacacgtttccctcctgtctctcgacttctgttgcgtgcgttcaaattcgtcttgcgctcttccaaagggagaggagcgcacattgtaggtttgtttgagccgcgagaagtgtctgtaaagtcgttaccgcgcttccttcccaacttttgactttctgaagacacgccatcgcggtgtctcggtgtgtatgtacaccggagactgctgatccacgcggcgtgcgtgggcggcaatttctcgcgggtgtgtcagaattcgtagatcagctgcacctgtgaatcaaggaaacgagatttccctggtttgccggatctgtaggctttcggtgagcgtgttcgggacgagactttccattcttcgtccccctactctcggagttaggagcgacagtcttcccctggcagccctgtgcgcgtgcgtagtgggtttttgtccgcttctgttggcgacttgcaaacccgcacaaatcagcgtttccccgagtgcagtcttacctgtcactcaccctttcccattcctcgttttcagatagattccagacacaca

SEQ ID NO: 2271 - DNA, 1907 bp, Toxoplasma gondii
catgtgtcgagttactggctgaaaagcatacctcagggttgtcttgcctcctttgttgatgtcaccgcacaacaaatgtgccgttttcgatctggagtgtgtcatagaacggtgtgcctgtagttcctcttattcagttagattttttgttccctcgtaccatcttgtgtgtgaacaactgtggagatatatcggctgagtgactcaagaggaatttgtctactgcacacgaagctactgcggctcgctttggagtaagcagtggttacacccaagaggaatttgtctactgcacacgaagctactgcggctcgctttggactaagcagtggttacaccgcgcaggaagtgcaaacagtgcatgtgaagaccctcagttctgcggcacttcctctacagctgtttgcagtatactctataatgagctgattcttgtctgagcgtgtgtcaaatgtgattgagcaaacatgttctgcaagaacagcttccgtttgtccctctcttccgtacggggcataccaagttcgagacgtgcacatagcatagcattcacacctcacttgatgacacaaaatcgttagttggactgacagggcgaacggtcaagcagctgaacagcaaaccaacgctttaatagtgcgcagacagataactcacgcccaacgatgaaacagtgttcggccaggaacgctgcagttcattcaaaggtatcaggcacgggtcctttctgtacgtttttcagtcgaccatggcacctgcagacgcagaaaagaagcgcgtgtgaaccgctggcgcggacgaacctctcactggtgttggctaagagacactctgcgtacacctcaatagcagagaagtacaccagcatcactagaagcaattcgtcaccagttcatgtctcgaaatgttttcagtggatgggtaattatttggatacgaatggcatgcctttgcattctaccgcgtatttcgaacttgcaaacccgttacaggctgaaaaagactgccatttttgcgcttgctgtgccgtagtggaaccgtggtgcttctgggctgcagagggcaagcagtgcgtgactctgccttatctcgacgacaccttcgtcagctggcctgccgcatcatcggtcaggttgacgagaaacggcaggatgtccctgaagaagaaaaactccttctgtcttgtggtctatttttgtgtgtggcttacttttctcaccagcaggttttttcgccgggatcgcatgcacaggagagacatcaaaccaggaggggtgtgccaccgatccttcgagaggagggtttctttccgcgcgcgttttcgttcgctgtggcttttcttcagaggtgacagcggcaaacgggtgttttctgttactggcaaagtggacgcccgcctttcttcgacgtgaaactaaagtgaaacaaagaggagagagacagtcaatcgccagccgaagggaagacggggaagcctctggaaggaagttccgtgctggatgattctacaccagaaaagcgccgttctgacgacgttctacctttgaaagttgtactttctcttgttttgtcttttgtgtctttctgtttcatcttctgctgcctggggagacgacgtatagttcctcgttttttcaagtgtgtggagtccgccttctttttctcgatctcctttcgctgctggcccccctatgtccggaagacgacctgtagctctgtcacccttttgtccggattctctgtttgtcctgggtttcaaccgttcctcccctctcgcacctttgtgtttctttgacacacctttgtttccccccccttctctcgcttcgagacttccatctgtcttccagtcgtagaccacgcagcctcgtctcgccttttgtcttccatctgcaccgtcgccaaaa

SEQ ID NO: 2272 - DNA, 2881 bp, Toxoplasma gondii
agcgatgggcagagaccttggacacccgagacatgagaggaagagaaaccgagcgcgaagtcgcagaggagagcggaggaagaagcaagcgaggaggcaggaaagacagaccgactctagataggaaaggaaagcaaccgcacatgctggaactcgtcaaaaagggtctcttcggcgtctgaaagtggcggaaaaaatcatttccaagaaaatcacacttacctgtcgccgccataaactgctgaacagtttcctctgtgcaattcattgtgactttcgttccttgttcccctcttcgttcttggttttttccttgttttttctccggcgtttcctttctgtttcgagtgaccccacccccgtctttccttctgtacaggcgccttggaggaaaaggaggaaaaaaggcgaagaaagcctgaagaagacgacagagaagacgacgggtaaagaaggacttgctggtcttgaacaaagagtctccttcgctaccttaaggtccgttgacttcctgggacatgcgtcctgacacggttctctgcagaggccaacttcgatctcatgtcttggagaagaaggaagccgattcgctgccgagagagaaggaagagaacctgaggagatacggttgcccccaaaagaggagacaagacacgcgtctgctcggtgcccgccgtggggagttcgacgcgaagaaagacgcacaacgtccggcgcctcgctggctcgacctgtcgattctggaaagaaacgttccgattccccaagataaagagcactggtgcagagaacttatcgcattctccgttcgaagccggcgataaaaaggccaagattgcagggagagaccttgcggcgctagagaggatacattttgggatgtgtaccggggcgtctagctttcgttggcggctgaatcgttacgaaaacgggaagttcggaactccatccagaacgcttttctcatgtggttgagctaaaaagaagtcgccttccctgcaggtttcaggggcaaccggtggcgctggcgacgacgcgcaggaggtccgaagatgacacagggacgccgccgagagagagttgacggtgtcgaagcaccctcgacagcactccgcctcaaatcagaaaaaaaggcggacaagagactcgcatagtttccctcgaaacagcggggcaggtggtgacccggattttccccgcggtcgttcgcaagacaccggggaaacgaggcgctgcgacctctaggtcggagcaagatcttttttcgcgacggagatcgcagagaacggagacagggcgctgcgggatggaaaggagagacataaggcacgaaaacctccgcaaactcgaggaaagcgctaacctttcccagcagacaacagacgggaagtcagtcgcgcgcttccctcgttacttttcttcgcatcgggcagctgtctctcacgggtacacgccgcggcggcctgtgtgcgcgagaacggtttctctggcgcgatcagcgaggcgttgcgcgaggaattgcctccagtatccaatccagagaaggcctctagcaccggaactcgctcgcctctcgcccggacctgctctcgcgctgagaatatctcacctgtgcgcgagtctgctgcaggatctgcggtttatttttatgccgcgggtgccgccggcggcatcacccctgacccaagcacggacaacgtaggcagcccagttgtgtgtcctcagcaacgaaagaacagcttttttcgtgagacgttgcggacgcgatttcctcaaacatcccccttcaccccattcttcggtcccccccaaatctaccactttcatggcaaagtgtgcgaggaacaggtgacgacagtccgtaccggcggcaggcctttcagaccgcctgtttcatttggccaagtttctctgaaacaacctcggaacttccagttctacttcacctcgctctccttcgcttctccccttcctacccccagaacaggcacacctcggctctacagcgcgcgcgagcctgccgggtcgcgagaactcgaaaatcgacttctttgctcgactcttatgtcgctctccggaaaagcaaagtgcttcacctgtcttttctttcacaactttgtcggagttcttcagctacagctacgtcttcagttgaaagaggtactcgtgcagctacgtatgtatttagaaaaggtactcgtgagtacgcgggcaaccgcacggtgtactgttttgactcttcaccgaacctggcaagccacgcacccgagtaggagtaaccggctgccgttgcgaacaacgtttcttctcatctggagcaaaaacaaccagacttatgccactataaaagccctacagtcttagcggagtcgactcccgcgcgtttttctgtaagtcgcgtgacggtctggaggaagactgcagagggaactctccagtcgacccacacatcatcgttcaacaaagacaactgctctctcgctttccagtcgtctggtgtagattctcgcgtctaggttcatagtccacagtttcacagcctcgaggcggctttttgtccgtggggagtgtgcgtgcattccggttttttttcgaactggaaagcaccacccctggctggttgtttttgtgatggagagacggggcagcacacagcgtaaagtgcgccttcatggagtgcatgcacccgcaactctctcgcccgtcttgtgccaatgaggacgacggagaggggaagacggacggtctcgtgcttcctgtgctttcgatgccccgcggggatgcactccattcaagagacagcgcgtccgctgcgtttatcttcaatctttcttcctttctcagtcttcctctcagcctctctcttcaccctccgtaaaaa

SEQ ID NO: 2273 - DNA, 1842 bp, Toxoplasma gondii
gtttttcgcagaagcaaaagattgggacaaggtggagctgcaaatttgtgggcagcgcggactggacccaggccgtccgataaggccgaggcagcagagggaacagcagcaggcgagaaaacaggacacgcgagggcggaaagacgacagagagaggcagggcctgaaagacgggagtgtggagagaaagcaaggagggaaggaagcaccgaacgacgagtggaggacggggaactcgcgaaagacgactcgcgaccacctgcgcctgcagacggcgaccgcgcagagagcgaagcggagcacagagtgacctcggagcgagacagggaagaacgagcggaaaggacaggagagagagacgaaccagaggagagaggataagaggcagaggaagcggcagatagagagcgggagtggcacggcagagaggcagacagaaaagggtggttcagagacacaccggccggagaacgggattgcgacgcattggaggcggagacagatgagagaggagaagcagacagaacaaacttgcctcctgagcaagaactggacatgctcctctcagagaaacctcgtcgggcgtgactccgcagcgcttttgcgtgccgcgggaggccgcctgacgccaccggcagcattgttttcacaaagacgccgcggagacgctacaggtattttcgtattttcgttttctgttcttctactgcagttcccttgtagtcatatccgccggtctctgagcctggttttccgggagtgttgcccggcagcttgtcttgctgtcaacggggcgtccctagtaactcgaccgccaattgtgtccatataagcgggcaggaaacgactgtgaaacagtggtatcataaacagggggcagaatcaaagacgagagtcggaggtaccccgcctggaggagaggccgagctccttacgacgcacattcaggatgtgcagtcgaggctatctcaggctgtatgtgcctgcttccagacaggggcgcacgagaattgcacaccgaatggatgcagaagactgtcgactgaggaaagacgaatgacgagaggcgaaaagaggcagttgacgacgcgacagaagagggacgagggcaatcgcggagaaccggcgcgtgacacctggagcgactgggaagggagatatctaggtatccgacattttcacaccttcgttgggtcctccttggatccccgggacgaaacatttttcctcgaaacatgtgtactggtctctttctgcctcgttgagctctcccggcagtcgcgtgttcagcaaaaagcgcgcatgcagcgcgcaggggattttcgaaatcctggcgagggagaaatcggcgtatgctcgcaaccagtgacgatctctgatgagacagtcgacgtctgaatttctgtgttggccgaacgccaccagcagagtgtttcgctgtatcttttccggagcgtgtctcgtgcgctgttctgtttttctggtgtcttcccaaagtgaaattgtctgtttcttcgctcccgcgatctctgcgcccctgtagtctccacgacaggcggtttgtcgcgagttgtgtgacctgcggtcagcgaagcaaatgccggcacaccaatcagaaggaatcttcacttcgactctgcttttcggaatccccgaaaattccgcaaactaccattgtgtctgtgagcagcgtcgggttcctagtccactgttttctttctctccagtcgccaggaagtaacgaacacgcgccagctgaacgtgggttcgcggagtctgcgtgacggtttgtgtgtctctcgcactttcttttctttctagttttccaccgtttcgacaaaa

SEQ ID NO: 2274 - DNA, 3651 bp, Toxoplasma gondii
aagcgagacaggcaacgcagtgagcaagcaataaaatgcagataggggaagaacaagcaggactggacggaaggcaaggcaacgagaaaagcaagcgaagagacgggaggacgtagagcaggaatcacggcgggaacgaggttcagtggctcggctgcgacctggagtcttctgttcgtcgtttcctggtatcctattgtgtggattatttgaggaaatctcggcggaaagactacaaagaagaaagaatgcctttaaatcccgggggggaaagggtcatcgtatccggggtctgtcgaccacgtcgatgcaagcagccgagagattccggttggggacggtggagtggacgcaaactgcacgagacaaattttagtggtcccggtatgaaggacttctggcttgctcgcgagctccaaccaatcattgatatatttgatgtaccgcacagcgactaacggtgtaaaactgtgtagcagaacggggaagagagacacgcgccgctgttgctctagattcgaaggaaggaaggtccccccgtctttcaaaaggatcgagaggcctgcgaatgaggagggacggcagagcttaatgtagtgcctggaaaccggtatcgaggtcaagggagctaggacagtcttgaattgtgccaacacggaaacggacacacccatatcagacacggtgtagcagcacgcaccaagcggtggcctgtagcgcggtttagtcaacaaaggaaacagagacttcaaacgattgcgcttgaaacaatgtgagcaaaacgccttcgcccgttccggacggcactgtcacaccgtggagctctccgccgccgaggcggaggcaaaccgctgacttggtagctttacaagtctggcgcgaatgcctttctcgccacgacgtctgcttgttccgcgatatacccgtcagggaaaccgtcattgtacccggaagggaaaaatccagatgtctcaaaagtgacgcgcgccagccgcgaaggagcgacaactgcgtgggtgccactgctgcttgaggtgtacatccactgtccggtgtcaagcacagctgcacgtggccatcctgtccactacatcaaaatcttgactctctcaaagtttgacgaaaaagcttgctcacacggaagagctgattgctcgtgtgcaagcgcggcctcacgcctgtgcttgcgatttccgcttagtagcgcggtgagaaagtttcaagcgctgtgaagatggacagaaaggggggcgcgggagagtgtcttcattgcatgcacagcgcgaggcaacccaaccaaaaacgagttgcacccttattttgcgcaggcacgggtcatcccagttacccggcacggtccctgcgccctacgacagggagccgaggcaggctacaccggcgggaagcccagtcggatctccgggagagagtggaacggaggtcccaccacggaataaaaggcgggcgactgcacagctcggccgagttgtcgacccagactgctgcagttttctcaaataagccggctgcggcgtctgtcgtttttttcgccctgcgttggggtcgccaacgaccaggtcgcacgatgaaaccgtgtttaccgtctgccaatttacatgctggcgccaatcgacaggaggggagaacgtttctgtgagaaggcagaggagaaggaagagtgccagttgtgggtcctcagccaaatcttgagaaatcactacttctgtttacgccagaatgaggtcgctgaagtcgagttttttatcctgtggccccgggtactggaccaagatcacttgcccggcagtcttctcgatttaggtgtggcgacggatcacaactcctgtgtgtcctttattcgtttccaaacctctgtgcgaaaactaccttcacgtgtctcttcgacgacgtccccacatctgggaaagaactatcgtttactatactcttgtattcgtgcttcaagcttccacagtccgggggcccgcctctttgtactgcatcgttactgtctccgtcggggcttgctctacacagtggccaagccaagtgtttggagtccaactactttgccgtgccggctggcgtgtttgctttccgaagaagcacagtctagaaggccatttactgcgtctctttcgctgtctaggtctcagtttttccctcttttcccgttcagaggagaggcaggaatcgacacggctcccgtcgtcctctgctgccgttttgtccttttctcgtttgggcacctgcagggtcagggaacgacagagtggtggaatgcgtggcggattgtgtcgctcagatatcgcagtttgtccatgcaaaagagttgttcacttcaaagactcgacctcgcgccccaatgatgtttaaagagtgcgtattttcctgtcgcgccctgttgtgatgtcgacatttcgcttcagtgcgagagccaagcgcaagtcccaacgctagtgggagaccatttcctctgcaatccgcaccgccgtttccgctttttttgtgcacagacgaaggctctagccgctcttctctgtagcgcgcctgccttctgctgcacaacacgtggaccgttctcaccgttcggattgaagatactcttcggttgctcgtgacgtctgcgagtgaccagcacacacaaaaccgggtactactcgagaatctcgaaattcgcttcagcaacttctttttccactgttgtgtcttacccaattcgtgcttttttggagacttgtctcccgatgaaagccaggatccggagacagcagatctttggagcctcacccaaccttgggtgatcgacaaagaccccgtgggttatttagctagcttgagacgacgcgccgttggtcccagccgggtggccgacggctttttttctgatggattttgttggtgtctatgaacgtatgttccgaagatgcatgcccctgctatcctgcatcgctcactgcttcctcctggcagaccctcccgtggctctgcttctttgtcaaaaacgcctctgtagaacgcgccttccgcttgctctgttccaggcctttcttgtttaagcttaactctggcgtactcttctggcaaagactaactggaattgcgactcctctccgctttgcgttgtgcgcgagcttcccatcactctgaacgtgaggctgtccaatcgccacacacacccccccccccgatctagtgagtagtaaaccttaaaggaatgcgaaggctttcccgtccgttctgtctcttgcccttcactgaattttccttgacccggagttcacgcccgcagaaggaagggtgttctagagtttaaggaaaacctatacaaactctgaggatacccgcggcgaggcgagcggcgacagtcacctcgaggcttatgtcggttccaggtgcaaaggacgccgccgaagccccgagcagcgaagagaatacgcacctggtgcttgccccgtggccgttggcaaaggaacgaaatcgcaggctggatcgacgcagcgaaggccatacgcggatgtcctcgctgggctcggcgttgtatagttcgttgcaaccccagagaaaaggccatcccgctgcgcgccgttcctgcgtctccaccttgcgcctctccgctctcgtccccttggggtcgtcatgaagcagcca

SEQ ID NO: 2275 - DNA, 4832 bp, Toxoplasma gondii
tgtgtgtggtcagctctggagtgtctgtgtcgtttcgacttttagctgtcttcgcttcactgcagctggcgcaccacaagcagtcttctcgtttcgatgcgttttccaattcacataagatccagaatgcctgccgtgactttctccgtttcgcgcgtcgtcgcactgcgtgcttgccacacggtcaagagccccgacatcagactgcgcgggttgttcgcttttgaacaaggcgaattctcctgttgtctctgttttccagactccagaaaaagcagcgaaatatggatacaccagttgtgaagaacttctgaaggcttacgggtttgctgggaccctcgggggaagctccctgactccgccacagtggctctggtctgtggacgtcccagttttgtgcttaatgactgtcggcatgaagacgttcgcctgtttttaccaggcgtactgtgtccggcttcgtcgctgatcgagctcaaaagctcgcaggctttctccagtcaactctgtctctctctcgcttgcctctccgtgtgacagatgctggtctcctcagtgcactgctacttcgcccgctagggaggtgtgcctgacgtggtgtgtcaagcagtaaacggctgcaccgacttgttttgtttcgttaaaaggcacaacgctttcggaaaactgcgcttgactgcgacaccgtggacacggcagtaaacacagcaacgtttgatggaaaccaaccgatgtgtcgcgaacgcctctagagaaaggccagcgacgaagaacggctcactttagtgcattgcggcaggaaattatatgcatacgtgcacttatggatatgaaaatatatatcgtctcacgctgtcgccttgaatcatttagaacttccagtgtagtgctgggtgaagggttagggaaatttgtccccttgcaccacagctccataaatttcgagtaatgtaagacgtgagacagagagaaacgaacagacactcggaggcaaagactctcgcagttggcctggaggaacgtgcacgattgacgggtgacacaaaatgctcccggagtagcctgaagagttctgcgggactgtggaggaacaaacgtttctcgaaagacggtagtctcgctcgcgagacatgaaaggactgtcacaggcaaacggcaactggcaggcggcaacaggataaaaacagaagtaacgaagagcagaccatttgccaaagttacatagacggctgaagatactcctagtgccgcaatgcagagttgtttgtcgatcgcatccaaccacaagcgcatgactctgaaaaaacaatgcccacatccgttgccaggggcgcacgggccgaacctctttggctaagagaaagagtcttttacagctatcagaaatgaacatcagacgactcccaaaagatggaagggcgtgagaggttccgtgctggaccagcaggagattgaagcagcaggataatggaagtggagtcattctaacgcttcagttgtttgcttaactgctgtctacaaaacaatgtcgctaaaggccttatcgtccgcctttagaacttcctcgatttgatggacaatctcggtcaccttccaaatggcaagttgcacctcgtgctgacgacccgcagcttcagcgctcccgtcatcccggcatcgctttagcttctctaaaaactccctcactttctgtgcatctttctccaaatttacatggagctgcttcatgtgctcgttcaagttcgcagcctcttttctcagcagctccttgtcagcgggcaagtctctgcttgcggtactttccttgctcgccaagtacggatcgtagaaagactggaactgtcccctgactttacccagtgcattcagcttctggaacatgtcgtctgaaacacgcggaacttcctccaacagtcgacgcgtttctccgccacgcagacgagcagggatgccctgtgcaaacaggcaaaagccagtggcacaaatgaccgcgaagagcacgagtacattcgccatcatgccgcatattgatgcaccgaatcagattctttttgaccatgccaaggtgtcactcagctagtaactcccgactgcggggccaacgaacacaaaaaacggacttgatgccccgaaattagcctctatgaaaaaatcgaacaaggaaaacagagacgtgctcgacacagcttgtctcgaagcgcgtgagacgctagcgtcgttgatcacagcgacaccgattaccctggccggcaatattcccgcactgctagtttcgagtgaagagagaccccgaaagggaaaagaccgttagtggagggtgggagcagggaaggaggaaagtgtcgtgactcttttcaaggaatgacagtctttgagggaaccacgatgtcgaattcctgcaattccatctgcactactgcgggagatccggttttaccgccgggggttatagtataagccattgtggtaaacaacatcatttttcgcttttaggctttagaaagtacggccgtattgcttgaatctttcatctgtcgccggtaaatgttccttagaaaaccagaattagcgagccacacttcagctctcaactccgcagcttatgattgtgccgcagtcgacaatggtacggtttttttgctttgctccattctattgaaagtttgtgtgggcgaacgtggttgtcgtaacagggacacaaacggcaaaaatagcgtttggtatcgtgtaaggaaaaatgcaagatagtcttctacgaagcgagaagagcagagcagtggagtagttaggatttgctactgattgtctgcttccgcagcgcccttaccatatacaacggctgttattctgttttcacggagctcagtaaaatcaacccatatccgagcgttgcacgaactaagacttggaacttcttcctaacttgggatgttgactcccgtctccccgcatttcatcagttcagagagcactataataagcaatcgctttgaccttgatcggtctaagggagactggcaagttagtgtagaacagccagacaggtcctgaacaagatcaatatcagttctgaagcgactggctggccgcctcttccacgcaaagcctcaagaataattctcttgcttggcgtgtcttgtactacgatttctgactgacccgaattacggtgtggtgccatggtagcatcgtccccttggactgagtgggatggtattaaaaagtgcgtttgtgtcacgtgaatcgtattttgaaccatgttccgagactgtgcctcgcaagttgaccgctttgagctggcaccaacgtgtccaccagcaagtagatcgcggcttcgggaaaagccggttatgtcatcttccgttctctctgaagctgaccactggtgaaacccgctcgcagaggccgacgcagaaggagcctatcaatagagaacatctttattgaagacgaagtgcggggaatgagatctaagacaagacatatacccttgggcccctcaagtgatacaccagcacaaaataaaggaaaactcaaaatggcggatttcaaagccagcgtttatggtggcacgtgtgtgtggtttagctctgcacatcctaatagagtacccgggtcactcctccaaatccttctgggtcaccctttacacagaatagcgctgaacgtctttttttagagagacatgaggactgccctccacgcatgggtgtagcgtaacccggacggacacatgctgtcaccttgttgcaccggctgccagcgggtatacctcaattgtgctgtcagtttcgttcgccattcgctacgggccgacgctgggtaaggttttgtattttggtccacgcaagtcaaatggtcacagaattccgccggtctcctgctgctgttgtaccggggtacctcaacgtgtgctcttatccacagtacagctttctctccagaacgatggcttttcaggactgaaaaggtggtcgaccatagaagcatgtcgcttcgtgcacctgttttgcgttggaaacagttcaactgaagaacgtggattttcaccgtttcagagactgtacgtagtgttgtcgtgcatgcctctcgggatatcgccagagaagcaggcaccaaataaacaacgccgcgtcaggtacgccgtttgtgctttcggtgtctttctggttgcctcgttaccccctggaacgttcataaccatcctagtttatcccttatgccgactcgcacttgaaccacaaacggtgcaccaagtacgatcaccttcccaacttaccaagacagcagtctccttcacgcttagacgcccccgactttctcgatgtgtctctccgcgttgacgcggcactcccagttttttcctggcgaggcaaactgctggtaaataattcgcatgcacgccgtttccagcatggcctattgcgcgctgcccgcagtcgacaagcggctggcggctccgagttagcaagcgtggttgccatggtctgcccatgggaaaaggcttgtatctttgggaagaacggctccgcctcggtgaggtttcgtgtcttgattctctgaggagggtaagaaattcgcgcggaggtttccgcaaaaaagagcaacgaggcaaacaggttcacccgcttgtcttgccagcggcctgacctaaatttctgcaagctggttggggctctctcgcgagtggcccgacactcctctttcgttaccctttgttgtcgtgcgttttttgaattgctgccttctcgaggtttgtctgtagatcccgacgcaaccgttttcccccgtttctttggggacttaacgtctcttctcgggcggtgagacaa

SEQ ID NO: 2276 - DNA, 4336 bp, Toxoplasma gondii
acacaaggcaaacgttgaaatacagaacagcgacgaacggctgatagagagaccagaagcaacctgtgacgtcgcagacgtcgaagggtactcgcaacggcgtagggtgagaagacagttggaggaaggagaaggcaactcgaaagaggctgaggaaagaggaacgaaaaaacttacaacgtgtctccaggccacggagcaccggggtctgggggcgggaggtccggaggaggcactgaaggcttcgtttgatgtagtgcgtttttgcagcaattggatcccatggcgctttgtttttttgcgaatttcggcgaggctggagaaagagagaaagctccttcgggctgaaggagtggaaaaaagaaaacgggggcgaggagaccggcaacggagacgcgagccggggagcgcagctgacgaaatcgtaagcaagtctgcggtcgagctcccctgactctttgttcttccctgggcaaacagtgaaagagacccccagaaagcaagaatgcacgagagacaagtttggacggacagtaccacaggaaggcggaagaagaggataacggcggatttatcggaagaaaaaacagggaagctgtccctcaaaggaacccaacgtttctgcggcagccagtgaaccaacggagacggacaacttcgtaggcagaactacaagccgagggaaaaccgaatcgccggagaagagagtctgcaactcaattcggtgaaaaaggatgtctgctttacgcaggcagagtagtaagcagcgcgacagaaagtggagaaccgacaagattgacgagcattacggagtagaatgctatctggcctccgcttagagctaacggaaagacgtctgccgactcggtgctgcgttcaccgccacaaaaccggaagtttcgctctcactgcaggaaacaagagggcaggaaaatgcagagggagctaagcgtcacccacgggaaaaagaccgagaagaaaaaaacgcgccactctgacgcacagcggggcccctggactggctacgcacgtgcaaccctacgttgacccaaaacgcgaggcgagggaaggccgagagcaaactggcacgcccaacgaaaaaacgaaagggggaggacgaagaaatcgaagaatgcggcgggtttggaagctcaacatgcgcggatgaagttggagatgcgggagaactcggaatgagcggacggcagctgcggaaatttgcgttggggcgagagacacgaaaaaactctgtcaagcaaagtggattaatcccgaagaatcgcgagcaactgactctcggatgtccaacgcgaaaagaatcttgttcgtggagaaggggggcatggcgatccgaggagctggacgacacttgcactcgaggtcccgtgctattgttctccgaaggcctttcacgagagcacaccgcttgctcctcggcaaaacgacgagatgagtcatgctccaattggaaccagatgccgaagggaacggagaggctgaagaggcggggaactcttcagacgcgacgcaccagacaaggacggctcctggcaacacgaaatccttcttggtggaactcgtgcgcagcggcctctgcggggaacgcaagcgagtacggttgccgtgtcaggctgtcaggcacaagataccggaaatttctagagaaggcctagaaaggacgtgctctgatagacacaactgcaagaaccgggattcaatggttttatttgtgcccttctcgttggcgaaccggcggaatatccggaaaaccgaggaaaacgtcctgcccgcagctgtcgcatggcccgcctctcccactctgcaagccctcgcctctgtggtagttgcacaccggggaacctcggttccataactctcctctgtttgtttctctgtttctatttcaagtccggtctctcactctacttctcttcttattgccactcagctcattcttctagattgttgtgttctcctgcctcttggcacttgtaccccctgtcgcgtgcctcacgctgtgctgcgaagccagcgtgtgagtgccagcctccagaaccatcttcgcgacagttgtatcggcaaagagcaccgccagaaaaggctgaatttagctcaacaggtgaacaggggcgcaccttatactgttccacgcgtgtttcactgcgctggagactggaacatggagtcgggtgacttgtctaaaacgacaaagctgccgagtcactttccgtcttcaaaaatccagaaacccttacctacgatccacgccacggctcaatttaaccgcacaaaacctctgcggacacacacagaagacccatggcgaagaaacttactgacagcgctgacttactactcgtcaaggcgcgctctgatccttgtgtctcggtgtcgacatcatccggaagcatgggtgtgcctgcggccggtggcacgccagtgttcttttctctattcttaggactcagtggcccgtggatctttaccctttccgatccaacttctgtgctttgaaaaaaagagaacaggaatgttgccgctgtagcgaacagaaaccgaatcgacgcgggaactcgagccactgttttgtttccacagcctgacccaaccgaggcgagagatagcgtggggaattcgaacagtaactctgacgctgtgcatcggaggcgaaagagtgaggtgcacgaccgacagaaaagtaaacagaacgcccagaagactcgactacgttctgacacctcatcactaagtaacgctccagactcggagcctataggacttcgtcgctggtgcacaccagaagccggcgaaactcgcgcccacacaccccgtaccctctatttggtgtagaagcccctttcccctattgtttcgtcttgtttgtccgtcgacgcttctcgcgagaatcacgagacaattttgtggccggcgtaattagagccgcctgatagtttccgacctttcaccgtctaccacgggtgtccgctagaatgccgccgcattatagatcaatacagggcatgcaggtgcatgagaggcgacgtctgccgcggtaaacacctgaacaaactcacgagggggggaacagcagaacgatctaaatggtttgcattgctgcctcaattttcccgtccctctacccgtaccacagcggtctaggtaggacagaacgtacgcatgtatgcgctgtgccgcacgtaaccgaattggagatggacgcggaactttagggccgtgtcacgtgacgaaattcgtctgttcgggtaaaacggtggagtgccttcaaacggagctgacgaacctcattcccaacgcgcgtaccgtttcttcgcatttgcgtaggcacactgcttcgataaacgagttaggagcgccacgggtgcgcgcgcggcatcggctgacagcgtgcgtacgccgacattttgagttggcaatgcgactcttcctctgtgactgcttcgtttcttcagtttcgtttgttgtcgctttttccatagaaagtctatcgctatgttttccttttcctggccatgaacttcgcctccgaacgggctggtttgtgcgtcgtcccgcccgcctccagaccgctataccgcggccggacaactgtcgactcgactagtggtccggcttcttctatgactttgttttccatccttctctgcattttttatcacctttgtctctcgtactcgttcttcagatcactcgtctaaatctgccggacactgctcgtcgtttcggcgttgatgtgacttacgggaaaaagccagttctttgccaccgtggcggcgacgcttgcatgcgtggctgtcaagttaccgtaccggtgccatttctctacctctccttcgtggattaggttctcctgtcgggctgtccatttgctttctgtttgtcctcttcgtcagtaattcacttccgcgtaggcagagtgcgtttcggcgatgagcactccgtagacatcgactgtgccggagactgcgtggcgattgaaggcagttttagacaaggcactctctctcgaatttctcttctctttctccgtgtttccccttgttatttcttgttgtatttcgcttcttgttttcacaagtcaaacgctcacgaatcgccgtcggtgcgtgatgtaccgtgtcgagtgttcgtacacctcgtgccgtcgtcgacaactgaccggctggcagttgcttttcttgggcttgtctacgttttcctccgccgatctcgtctgctgctgtagcgtcttcctttcgtttctagaccgcttgtatctgctcacgaggttttctgtcttttctttcgacgtgttccgtctcgtgctcggcgcacacga

SEQ ID NO: 2277 - DNA, 2579 bp, Toxoplasma gondii
ttcttcgtggatgccggagttttcgatttttcaggcttccacgccgagtccgcagttcattcctctgtcttctctctcttcttcatctgattacttcccccgggagacgcgccgaagcccacacaggcgcagcgaagaaggtcaagaagaagcagaagagagttctgcgctccctggcgtcccttctcgcgtgccgagggccgggcgagtggcggaaaacggagagctgggagcaagtgcacgagtcgagcactttgatgactttgaattcggtgatttgtagaaataaagacgacacatgccagtcagttgcatctcagctgcgtgagccataccgccgctctgcggtacccgtcaaacgcggggcgcgtccgtggggacggtccgcccgcctcccctccccgcaagagctacacaaatgtctgcatatctaagcatgagcgtatgtaggcatgtgttcgtgtgagtgtcggttcgtggcgctcatcatacacgcgcagagaagtgaagaaatagaacggacaaagaaaatagcggttcgtagatcggtatgcgtctatcgaacacttgtcataactggtttgcggcgcgtggctccgaggcgcgcttgcacatctagaaagaaggtcaggttcacaagaagcgaaaacagacggcgcccgaactgtccagacactaaggcaagaggttaagcacgcatggcggcgttcccgcgttctcccgacgcaacccgcccagaatttcttgggcgttgtttcttttatattctctgtgcacagagtgaaaagggggacgggaaaagaaagcaggagtggatgtcgtgcgcacgagcctcgcagggcatgtgccgttggaagtggctgccgatctttgctagtcacgtcgaacagctgctttgtagaattccactgtgtcactcgaaaaacgtggcgcctggtacacattctttatctctgtctttcgcagcgtgtctgccgactgcgtggtttccgtttttaggttattttgacctcaatttactctctattcccttgcttcaatgatccttttgacagaaataaacctcattaccgttttacatagtacgcttctgctctccccagggcaaaagctgactggctcccgtccccggcaatctcacctcttcctcctcgcttcgccatttcagtcctttcccttcgcgctgtctcagtcgtgacagcctgtgttttttgtctagatcaggtcttctctagtagctatctttcatgaacacagataaggtgggaaattcgcgcgacagtgattagatagtgatgacgatgcatgaccttccaagacaaagagcagctaacggccgcgtagtggacaatgtggcgatataggagagtcaagccagaggtgcttttaatcttcgtcctcttgcggcttccctcctttttccctctctttcacagtgtggcaacctctcaaccgtctgggctgtgtgtgtgtagtttgtttcgatttgtactagaaataaacgcaagtgcatttatctcacaatacgaggatccgcgggcttatttacacaggcgtctggcttggtctcggggaattcctccgcacgggatgtacggtctagtgtatatatagttcgattgacactggatttccgatggtctcttgattgctgtgggtggagaggagagtaaggaagccgtgccattattgtcccactgagctgttgcagttaatgccaacttccagcgaatcactttcgcaaggagggcgggcggtgggcgattgctggctcccgtctacgtgtttgagtcgtttatcaagagcctgggaaagtactggtcgattcacagttcaggttgatttcatagttaccacctggggatttattgtgcatcagagtatgtagtaactgagctagaaataacatagtatcgaaggaggcgatggctacgagaaccccgagcatttatacgccgtggcgtgcgggagtgaacagaaggatgcacatacagtgccaaagggtctggcggtctcagtgctccggagaggtactggtgatgagtccaagcactgctgcgaaaaaaacgtaggagttaacaggagggccgctcgacaaaaaccggttgttcccgaattttctgggcccttgactcttgccggggacaaaacacaaaacgcggtcggcagtgcactgggcggaccgttcaggacctgttttttgtgtttttgcttctttgttgcctcctcgtatccctcgcaagtctctgctctgctcaaatctttccgccgctgctaggctgagtgcaagtgactcagcctccacagcagggggcctttgccattcgcccccccattgcttgggtgaccccgttgcaccatcagtgattgacttgcctcatcaggttccgcctaacgcctcatcataatttctcggggtgaaaaaccaagaggccattcaactacaccttcatttccgcgtgtcggatattgttgagcacgcaattacttagcaagtcccgggtgttcttcacgaatctcggggttttgtctagaagccgacctcaccgagcgaagcctgaaggttgcgtgcatcaaaa

SEQ ID NO: 2278 - DNA, 2797 bp, Toxoplasma gondii
gcatttgcctcgtgacgcctaaagccgttaatgaccgtgtgagtggtgcgcacgtacctcgtaaccgtcaatatcggcgccgaaattttgacagcctttttttcacacattcgttttcacccgtttccgtaagcgagacactcgtcaatcctgattttccttgttccttgaatatggtttacgagtaattggaacgaaaacagacgttccaacgcgccagaatgcgactgaggatcggtgctgttacgcacggcgtccttcctccgtgcccgaaatgaaggcgttggggttccccgaagaggaccgacctctgtatttttgctctcaggatgctttcaatcaaccgcggtggatggagaaagaatagtgttttgcccagtgccttagcgtagagttttccagacttttgactgttcctccagtacaccggtgaataagactcgcagcccgtcgttccatcggcacgcaccacacagtggcactgttgtactgtatgtggtcaacgtgtcgtgtgaacggtttccgtcagcattgtcaagaagaaagagtaaggggcagctgaggttctacgcaagagaaatgagcggtcaacttaggctaccccaagcacatggggacagtaggatgttgcgtctgtcaccaaggccatacgacgacagagttcgttgcccgcgtatcgcacggaacaaatccaggcatttaagcgaggttgctgtggcactgttgcagcagagtagactgtgaggaattaaaccttaaaacgaagaaacgtgagcacgaaagggagtaaaaggtccgtaggcgacattgtccggcggcaaaaggactcaatcggactgtacggaagccgcgtggggttcaatgctttggtgtactgttgcgctcgctaggccggtggtgctgaagctgttacggctggcctgcatttatatagacatggaaaatgccttatttgtgtacatacgaggaaacaacgaacctgtccgtggaggctgccgtccattactgaaacggtactcgtgctgagggtggggaactcgccctctggtgcttcttcaaagttttgttcgcgttctgctggagcttcggtggttgctgaggatagcgtttcctgctgctcctcttctacttccacgtcgtgctgcgcgattgtatctgccgtttcggcatcgtgaatgctgtctaaagatgcctgctcagcagcagcgatgtttgggtgtcgagttggaaatgccctcgtggattcgtccgctgcttttagaatgtttctgccacgtttcacgttttcgttcgcatgtgcgctcatttcggacactctctgtctgagttcctccttggctgcttcttccgcagcaatcttcgattcccgctcaagtgcttccaatttattctgaatttcctcttcagcgtttttacccaccgaaccctccgcgcgcattcgggctaattccacttccaggtcagcccgtttctcctcttcgtcgatttctttcacgtttttatcgatcgcttccgcgatcgtatgccgctcggccttcagattgctgaggtcagcttcagcctcatcggcttcgttctccctcctctttagcagctcttcattgaagtctgcttcatctttttcaatgtgcgcattcactttttccacctgtcccagctcgtgctccagcgcgataacctcctgatggaagcagtagtgatcgactctcatcgaaatgtgatgtacgcttcttatcgtcacgtaccgcctcagccacacgggactcagcttctgcctgtgcgacagccaaagtagcggcggcctcctcgtctctgcggctgcttcgtagctgacgttcgctcgcttttcttgcgtactcggcctgtgcaccgctgacgatcgctgcggcttgcagtgacttagctgattaaggggagagacatttctttcagcttccttggcagtaaggaactgtttatcagttaccgagttcggcttcggctttaccctaaaaaagaagaattgtgtggtgcgtcaaatggcggccggaggcactgattgcgcttctcaccttgctttcgactaccattttttccacgtcacagcagtgtggttcacggcagcagtgaatgcggtgtatcacgctttgctgcttctctggcaagggaactggcggcttgtaattgtcttcagatacttctgttctgtgaggtactgccgcatctgatggttctgcctggtcttcgggtactgagagtagcacggccgctcttgtgccctccgtaagtgccctccaaatccctgcttcgttccccacggcgctcctggcacgcagaacccagataactgacaacgtaaaaactacaatggtgtgcattttcggtgagacagagatcgttagtcccaggtacacaacaaaataacacggtcttgaaggccttgccgcttgctattctgcttcctcctctgcgttggagaggtcaaacaatataaatcagcgcggtagctggctgcatgtggtggtaccgctactgttgtctgctgtaatgacacgcgactttgctatgtcttgttctcggcgaaccgtcttcgctgtgagatgaacatcgttgaggcgtcaatgcttcctaaatgtaaatgcactgtggaatttcggggaactgcactgccgacatcagcaaattacgccgtggtgcgcggggagtgtggcatcgacccctgacggacacgtggctcgtgtagcgagacaaatcgacaaaaccgcacacgatgaagtgcttttccctggcacccccaaacctgttcgtactaaaacca

SEQ ID NO: 2279 - DNA, 2328 bp, Toxoplasma gondii
catcgtgtcagtatactttctttacatttgttgaggctgtgtttccgggtgatatctgtggagagtgcttctagttcgggggttggaatctcatttgaatagtgatggtgtcgtcgaccatggacgaaccgagttcggagtttttccgggttctcagcacagagaatgactcagggaaacgtttgtctggtgtccctttgcgatgtaaaggtttggggttgtacgggtcgctgttactcaagagattcaaagattcaaacatctggagtgccggcttctgtcatctttcgcatacgagctgcagtgagagagcaacgggcgcaggcgcgtcacaagagagcttcacgtggatctgggcatagaactcaatattggaaaaacgagtgaagaaggaaggccgccaagcggtgtccaacttccacacaatggcggcaacgcaaacatcgacggggtctttttacctcccttgggaagttgagcgtggagctatctcaggtattcgcattcgtgcaaagaatgacatatggacaattacctctatgcttgtttcggtctgcatatgtctacacacactgtgtagatcggtgtattttatgtagaaactgcagaataaatacagaggccgatccatatatgaatagtacagatgatatacagagagacacgtgtatgcgaataatgcataaaaaataccgaggtacatgcgtatgtagatcattaagcaaatatacagagatacatgcgtatgtgaataaaagaagagctgtatgccatagactttgcttcttgttttgtgcacgtgaacgtgtgcacggatgtagcgagtggagagggagaagcgtctgagatgggaaagagcagtgaggtattcgaagcgaaatattttgtggcactactgcagggggcaagtgcgctttctctgcaagcaaccaataaacgtgttgtcatgttgtgcggtgcctccattatggtggagaagagagcttacgtcgtgcattgtggctccacaaactaccagtggactcgattagaacgtcgtatttgtgaacatctatggtcctatgcaaactatacacactggacctaggaggcgtggtccttagatgataaacggagagatgcggatcctgtcgtgagtaaaaaacatacacgttatcattcgtcggccactgcgtcatgccgaggacagcatttccgcactgcccttccgcctcggcagggcgattggcatcatcaagagcactagtgataatcaccacaagattaaatcgacagcgtgcttcgcaacccactattcgttgatgacagaacaccaagccgatgttggttaaagacccggggaagagcggctcaggggcaggggcaacgtttgctcacgtagcctatggaggaaccgacggcaatcggcaatgtggcgtcggcacttcatgatgtccatcctccgtcggatggcgttttcccaactgacgcctgtatcggcaatatctttcccctggcagggattgtagagctggtgcataccgcctgtttccctgcctcattggaggtcaaatgtgattgttgttgaagtcaggttgacgttcactggcacctttaaccacatggacgctttggcaacgatcggctggggtgcacgagcacactgccaatgcatgcgtcgctcctgaaaacccactttacgttcgctcgtaagaacattcgtgcggcacgaagcagcgcgtcgcaataaacgcgtagtgtagttcagcgagggggagttcctgtctgaacgtagacacggcgttttccaggttgctgtcggcgatgttggcttctcaagagactacagcatactgcgatgaatgtagagtaacgtaactgcaccatcaagaatcaccatcgccagcgcagtgtggctggccatggaggatggaacacgaaacagcactccgcgaatccaccctgtgcgccatgagaagcaaatctcgatgcctggtgacagcgacaaggtagggtcgcagccagtttcgtgtaaccacttttgttacggtaggtagatggaagacgcccagtctatgaatgcaataaaaggccggttgtagatcctccatgcgaatgtgacggaatctcgccgttgtcgccaaggatcccaacttacttcaaagtacgatatgtcgacaacgacataacagagtgagttgacttcgtgtgagcaacttaatcgcggcgtggttagtaacccaaatgcctcatctgcaaagagccccccgcttgttactcttcagcaacagataccaaaaaaggtcatgatgaatgacaccaaacggtggtttcatcagtgaccgagaa

SEQ ID NO: 2280 - DNA, 2342 bp, Toxoplasma gondii
tgcatgtactatataacagtgcatatgtgtagaacatttgtgtcgagcacaaagtacttctgagtttgatattagacagtggtcgttcctttcaggagtcccgcagaaactcgtcttttcaatttcgtcgggaaagtctaaggggattgtcgtgaacagacccctttaattgatgaagctggctgtagtcacaatcagctacacttccagttagctgcgtccccacgtgtgctgataaacatcaatcacgtgtctgcggtacaagtgacgtttccacatttatcgtggctgtccctatgattccattgggatgcttttttcgtaggaggaaactcttcctttctttgttaattttttttgcggtaacgcgtccgttgtttttcgttttgaaagtgaatgcaagaaggaagagaaactccatgtagagcgtctcccaagtgaccttccttgttgaatccgttggaggagactttcagtgatgcagccgactgccttttctcagcacgtctacccgcgacgttttcgctctctaaggactccacgagaaagccgcaaaattttttgcaaaaggcctcgggaaagagccacacggagcgcgtatttagtgggttgttcgaggatacgaaaacccagtgacacacacgatcgcgttggcattttaaataaacagtcgtcacagatcgcttctccactcgtgtattaccggcgagcgaaaactactctgctcggctatcacgacggaactcgaatccggaagacagatgctttcgctacagcatttcagagattttgccagccgctctaagcacctgcggcactaacgactcgacggatcaaacggaactgtcgtttttgcagaagtcagttcagaaggaaatgactattccatcagctcttacaaacccgccgttcgtggatctcggtcctaagcgaagttccaacacgatgagggctaacgacgaagaaaggtgtggaagacgcgagaggctggccgcggattgaaaaattagaaaaagcgagggtatcaaacttgaagacagggaactggtttttcaaaggaaaaacaagctcagctgcttctttccaacttgcgaattcgcacatttacaagccgctcgactgtggcgtacatcatttgtatcctggtcaagttgagcattcgaagaaaagcagatggcgagaaggtttttgacaggaaaaaacaggcgaaatggggagagaaaagctacaaggaaaacggaggaatcaggaaacccagggcgacacgtagagtcggctctttctgctcttgctattttgattgagggtgtctattgcgttctatagcaaatcctccctattggttctttatgcgtaaaaaatcaagtaaaacagtgactgtcgatatgtgggaaaaaacgagaatcgaataaagccgttgaagacctgacacgttttgtctcccatggagtcttctgggtgtctccacacctctgggcccgtcaacaagattgtttcagcatttgtgcaattcatctactctgtcgcttagacgtagaagagtatttttttctgtttgtccattgtttttgcccgttatttgctcgtttccctttttttagatttagatccccccctttcgccgttcgtttccttgcgcactgctgtgaccggccaatctcgaggtgacgagactggtagaagtgtgtatgagtttcaaaacccgattttttcgcctactcctctgtttcctcttctttcgtccgtctccttcagttctattccttcgatttttcctctgtccgcctgcttccctagagcctcgtcgtcgcccccccccccgtgtattcggcactgaaagagctttcctgtctcccttttccattgtttcttccgtttcgaacttgccttattttctgtccttgtgttctttactactcacgttgcttctcccttccccgtgtttgcggcaccacacctctgcacgcgcgcagaaccctcgtctctctgtcttctctgagcggatatcgacacctgtacttgctgtctcttattatctcttcctccttcgagctcaagagcccctccctcctcgcgttcctctcttctcttctgtcggacatcgttttcgtcagttctcttcttgcctgcaggtgtgcgtgcgtctgcctgctgtccttttcgttttctctccttcatgaagcatcgtcggagcaaaactcggcaatccgcatttctctatagctggggagaccgactgtgtttcaacagcggtgaaccctcccgtttccttcattgcgtaggacatgcatactcatcagacgaagccccgacctctcgctttcctgtgaagcactgaaaga

SEQ ID NO: 2281 - DNA, 4414 bp, Toxoplasma gondii
cttgcgatgccaaggcgtttcttgttcgcatgtgttggatgctcaggatttcgatggaattcgaagcgtcatacatcggtaccaaatgcacgccaagcttcaagagagcattaaagattggagttcacctgcgtagttcgggaactctagcacgcctgtatcatggggggaaagtccgcttagtattgtgcacagcagctgttgttcatgctcaacacgacagtgatgaatagctcgttcctttaggtctaaagtgaatttcgttcgttcaatagctaaagaggacacgtagcggatatatttccccccctcacccccccccccccgatgctgagcatgaactacggacattttaatttcagctgacgggacgctgtcgagtctccagttcttctaaattcgtgtgagcatgaggatgcacgtgtacagaagacatagctgcagcacaagcggcgctctggcactcgtgcgtcagggttgttagaatatgcgttagctgagagttgttagagtacatgttagctgacggtctggcgaacgctcctggtaggcgtcgtctttggtatttgccgccttcgatcataagctgcgatttccttcatactgaaaaaaacgacagagaatttgctgaccatggcgtcagttaacaagtttcaaaacccaatttcgggagctcggtttctgtgtgaaattcaatcgttgcggcggtggtcaacgtgtggccttgtgatcgttgtccattctgaagactgaaaactctccgtggcaattctcgcaaaactagtgttgaaacgaagcatatttgttaaggcaaaacgttaaccgtgaccgcaattgcgagtcgaatcaccattcgcggctttgggtcccgttgtgaagtacaggactcaactgagcaagttgtttccaattggtaggacaggggaagcatgggataattgagagtttctacgatcaatacaacaagacgattagcagcagtaacatgtgaggaaggcgtgaattctcttgaagatgttgcgctggtagctaaatgggtgttcacagaaacctcaagaggtccctgcgttgcttggtgagattacgtcagtgccccgcagtaggtgctactgttgcggagagacatctgtcaaattttcggacgttcacttactgctcgacagaaaagacaaactcaagacgtggcttatgtcatgatctacgcgtctcaaaacatcactctaaccgagtctggtttaggcgtccaccccgtgatttccacttcgaaaacttgctcgccacaattccccatccacatatttatttccgcgagtgacaaagcatcatattccgccggctattcctacacagagtaaccggaaccctctgcagggggaccgtgaagagctccgctgctgttacacgccgttctcgaatagggaaaccacccattattcttcgttgacgtgtttctccttctcccgtaagtatctttcatacgcggcctcaacttcacgtcctcgactctcttggtgctcatgctgagacccctcgcgacatgaatgaggtacctgttgaaaccgagatggtccctgggacctgcaggcaagggaagggacagcgttataaggagtcaggcccgtcgttgttttttgccaggttccaccgcaggaatgtgcaaaaatgtagcgtggaaacacacggtctctggagtgttaaacagacgggttaagaaaccagattgtgactctaccagactcacggctaacacccgacacctgccgggattggctgtgaaaaagcgttttttaaaatgcattgggacgctcacaagatgcagaagcacaacaagcgttgcagccacgacaaaccacgcacggagagcgtttgcggtttactgtttctcttcgggaagtacagctttctgtatgtcttcgatcggcatgttgatgtggaacacctgctcgtacaagcggaggtagtgctgaggcggcaacggttgacgtagaaacagcgaagaaaacaaaattacacaacgttaggtgttatccggcaggtgaaagtagcggtaacagagagggaggcaaaaaactattactgatgtttggtcgttacgccagagaaggggtcgaggcataaaaggggccgaggcattatggaagccccggggtggtcaggaggcaggggcagcttcttagctgaccgcagacagagacgccaactagataaagttattgagtgtctggcactgaattatctgggcaggccccacgatagaccggcttgtcacggtggattccggcgacgagaacacctaccagttataatgtgaagagccacgcggatacaccacattagataagttagcttcctcagcgcgttgacaatatggcactacttacaacttttcatgttttccgtcgaagtaattacattccgactcattccacactattcgactgacttggcgcctggccgtttgaggagtgggaagctgttggagtcattgcaacggtgctagtgcaaaaaaagcactcgcaggagttgaagtgaaccagttttcggctgtttgtgtagaacgcttccaacatgtatggcaagcgttcatcctggttcgttctaggaacttatctggcatcagcagatacactctccactgcgagttaagtccatgacaagcggctcctgtagttgcctaccataacggccaggacgcgaaccgtgagagttcgttcgtcgactgaatgtggtgctacatatgcgtcaaagcgttaaattgagtatcctgctagccacgaactcactctgacaaatgtgctagctcagcggattcacaagagtagtcgcacacagcatgaaggccaatttaccgaacgatttaccgtcaggagcggcgaggtcctgcatcccgcgcatcgactagagggtgctcgagtagcagggctgaggaaatcatgcgcctgttccgaggctgtgctggtacactagcatatgaaatctgacagcttaactcaccgttgtcgagagcaacgcacgcgtggggttggccgatcctctaccaaatgtgtcggcaccagccagttgccacaaacattttgtgtgtcgggatacgtggacgcaaaccactccacctccagggaatactgccgtgagcctgtagtcaaaacggagtgaatagcttgtgggtggcttgttgcttctactcttaagcgcattgcacttcacactcagctctatttcctgacaagcaaggttccgcgatctgtcgctcccgtcccctgtatacttagcaagctgcagcgaatttggggttgcaaaacgttcgccaagttatttacaatacttgcagtcgcaacgtagttcccgacagagggctttcttttgcctccgattctgacaacacgccggctgcaggccgctcatcgaaggttcagttagcttatgacactacgacaacgcactttttcgtcttttttcatgcaagggattgcaacgtttctagaaaacacgcgaccagagccgcaggaataactctcgaactggaacccaagcacagaacccttcttgtgtatttgtaagcgtgacatactcttgtctctcaagatgacggggctagcctttttgcgagcacattctgcgtgaacgtgtttatttgaccgaaagcttcttacctacgcctttccaacaaaacaggctttcctggactccagggggaaaagcgattcagagtcgtcggctcacgagccaagaccgcaaatgttttttttgacttattctgtgccttcagggttggagacacgctattaccatgcgtcctcccccccccctgccgccctcctaaacgcacacatgcgtttcatgcactgacataccgactttgtgtctcgtgtcctgatgatactattttagctcaaacgggaaatttcgcgtcgccactcttttgctttttaatgtggtcgatggacgtcctcttttctggatggcgttcctgccagaaagtgtttgttctggatttcacgggacggacgcggctgtgcttcagtgtgcatgcatgtttgcgtgccacattcacacagccaatacgatgccttctgaggaaaacacttgcagcggtattttctgatcggcgcttctgaggctcttctctccagttgcttcgcttctcatcattgcctttttcgtggtggtgtcgccggaacgttcctctctcctcaatttcaccgggtccgccctagacggccatcaagacataccccctcaagaaattctgctccgtagagtgtcacttcttctcgcggaatcgccgctaacaatgatctgctttcccgccagcccgtttgggtagactgcctcccttcgccgactctgctcaaactcggatgtctgccgtttcttctgagtttctcgctcactcgcgtacgccagtcaagtttca

SEQ ID NO: 2282 - DNA, 1816 bp, Toxoplasma gondii
aacggagatgaacggttatggttttatgatgtggaacattcgggttagtgcgcggtcactctgaagtcgtgtgtggaattctaggctactggggggcgtggacatccatctctgtttgacatgtgtgccaaacgtatccagcgagcgcatgcggccatcgcacatagctttgtccggcaacgaggatgatagtacttctcagccggcatgcgaccgctagagtgatcaggcatgccactggagctactgtcacccggcctggcctcatcttccgtcgactgtaaacctgagctgcagaatggtcaaaacttcagggtagttagtggatttcggtttggagttgttttggggggggacaaagaagaactgggaaacatgcgaagcttggatgacttgctgctcggtcacgaatgtaactacacgttccactccttcacacacaagaatcactcaaggacaactggtgcttgccggagtcatgggagggtgaaaggaccacatcggtggaccactggaaggattcacccgacacataggcaccactggtgttttgatgtcagctttgagcagtgagtttgactgtgcagctgagagcgccagtagttgaacttgcggaggaatttgagtctttatctaaaaaacagttggtaattgtgactgtggccttctgctgcacacaccgctctgaactgtcaccagcaggatgcccacagtttaaaaaaatgaccgaggctcagtgcttcgacatttgctctcctccgactttctgcttgctgcctcgacccgctagcgtgtcccttcgttgagagtggtggtgtgcttcctctaatttggagcgagctgtgtagtaatccttcaatgtgttcgccgctgttgacgtggagaatatctgcaacgtaagactcaatttcaagcaggtcgcaaaagctgcatcagtcacaaagttaattcggcggagacaacaagctgctgcttccttcccgcgaatgcgccatgcaaggaagaaaagtgttttcttccagaacgacctctattcaggttattcgctaggggctgacactacaagggctcttgttttcacttttttccgtttaggcgcgcgaaggttctcacgaccagctaggtgactgcgtgtacgacacctaagaaggaaaagaatccaccttcggaaaggtagcgttgcgtggctcccgaatcacctagcaacagcaaggttacaaagatgcaaaactagctgaatttccgtgaaaacgaggattattttcagagagcgtagcgttttggcgaacagtcggccagaaaacgggaagcacagccagcgacacttctccagcgtacacatcacttgtcgcgcatgcgttattatcttggaaccttagtgagttctcctgcccctgccccgccgacccagacaaaccacgcaaatgccacgtgcaagcagcagaagctgcctatatcgacggaaaacaacaatccgaaggagcaggaaacgtaggcctcctggtttgacaccgcaagcccagggaaaagcgtgttcctcgctcccagaatctcttcccatggcgcatcagtcgagcctgtctcgtgtattgcgcagagataattgctggcgagtttcctaatccagcatatgattgtttccctgccgctttcgggtgcgcttaactccgctttttcccactagaaagaccgttatttcctccatgtctgcgtagccgaatcgcggctactgcggtggctcaccggacctcacggtggcgagcccaggcagataaaaggagtctttttccgacacatatcgtttttgcgttgaata

SEQ ID NO: 2283 - DNA, 1304 bp, Toxoplasma gondii
agcatgtgactagcgcgtgatacaatcatacatgaatatatgtatatttatcacgaaaccaccactatgtctctagggacgagagagacaacaacactcacctggtgccaagatgcgcctttttgtaggtcttgtccgcccacttctgcactctgcggcgagagcgcagcttgcgagcagtacggataccgttgggctttcctgaaggagcaaaagacgacgcacgacgtccacagttcacattcgcacactgaagaagccacgacggctggaatctcgagagatgacacccgccaacgtagaaaacacgggagcacacaacaaaacttcgcgctgtgcgaacactccagctctcgaaaaaaagtacgcaagttggccacgcatctggagttcccgcggcctctccgcgctctcgctgaggctctggcacagcagacattcacatgaatggaaaggtggaaagaaagcgattcggctgctgtcggcaatactggacatgcgactagaggaacctgagagccctctcgcgcgtgcatgaggaggcaggagcgcgtgggcgttgttcgcgacatttgaggagaagcaacggaaactgtgaacgcagaaaaccgggaagagatgcgccactgcatgcgcccttcgcactcgcttctgccccactggagagtcagcacgtgtacgaaacggcaaatccgcaggtgcgcaaactttcgctcgaccgaaactgagaaaactgtgtttttttgcgaggaaggaggcaacgtctcgcgtcaatagacccgagagaggcggcgcgcagctctcccccgcgcgcgcgtttgctgctgtgcatcgccaggagcagttttccacccgcgaaggacgctttgaatgcactcgcagagacgggagacgacaaacgtgcgagaggaagttaccagagacacaggatccagaaaaaaagcgggaggaaaccccgcccagaacttcccctgaagagccccacgcgcgccccccccttccgcgagactttgtgcgttgtgtgggagaggggaagccaccgagcaggaacggggaaaaggcgagaggcgaagaagaaacgcttcagaactcacccatttttgcagaagctccttgacgacaactacggacgggcgactcggcgcatcatggaaaacaagtaaacagcttcacctttctcgagggtccctaccatccacgaaccagttccccagttcctcctctgtgaacttgctcctgcgcatgcttgcggcagtgcgcggtcgccacgccacgcacagcgaattttttttgccggcgttgca

SEQ ID NO: 2284 - DNA, 1332 bp, Toxoplasma gondii
gatgaagatgctgccaatccagaccgcgagaaagattacgccgacggccaagacgatggtcgggaggatgctcgatcgactgcggtagagcagccagacgagcacctcgaacagcgtgatgatcatcttcgcgagggcgtacgcgatggcgagatgctgcgtgtacaccagtgtgtttggcgtcacaaagttgatgcaggttacgtaacggtacttggcgtagatttcctcctggatctctgggcggagaatcgcggccaagtcgtacttgacgcagaggttcgcgggactcgcgtttactgagaagaagtcgtagttgtgcgcggagccgaagcagtctgcgccgtcgttgccgcatgcgtcgagcagactctgcttccccgacgcctcgcgggcatcgaacgcccagtaagacagcacacaagtttgccacaggtagcagccgactacgagcaccgccgtccgcaacagccagaggtactgcatgcgaaccttccgggccgcaggtcctgaactgatgtccacctcgaagcagtagattcgccgcttccgcagcgtaaccatctggaacgcatgcggcaaaatcgacgcgtacagcgacatctcgtgaatcgccaacacaaacagcaagaccgtacaactcaacaccagtgtgaaacagttgtacacctggtacggccagtctcgcggccgcgtcaacagctcgctcacgggatcttccccagacattgtgaaagggagactgagaaaaaatacttaacggcgggtggaataagaggaagagaaggatgttgttcaacgtcgagacgaagaagacacggtcgggaggccagatcctgttcagggcagcgtgggcgccaggagtgagcagcagatacttgaggttcgagtgagacaaaaaggacagagagacgaaggaaaacaaaacacaaggtgagtcgcggcaacgacttggaaatacgcagatacgcaaacatggaggagattttgcggagaggcccaggggtcaaaactgaaagaagaggcgaagacgaggtcggaagagacaagacagcaggaaagaaaaagaaaaacatgtttcgacaagtcgagaacacccagaagagtcgctgcgtgtacacagctccagtttccaggtcgccgaatccatatatacacgggtgattccgccgtcacttgttggaggcctcggggacttcagagcgttcctgtctcccgcgcgaggggaacgcgggaaagcatgaaaggaaaaagtctccgtctccgtactctggacgagaaaaaaggaacgcgacaaacacggagaaccgcggaagcagctgtcttggcaca

SEQ ID NO: 2285 - DNA, 3327 bp, Toxoplasma gondii
ctgaagactagagggtcgacgaaactcaacatggacagggcaaaacgggcagtggaacgtgtatggtttgcatgggcggatctttcgctgtctcgcgcgaaaatggttcgttttcggagaccgttcctgcgagcgtctaacgcctctgatgcttctgcctaatgcgtagaaaaccggcgcgtctgccgcgcggcaggctggtgacactcagaaatggagtgattttgacagttggggtttccccgttgccgcatctcacctttttccagcttccgacgagtcgacgcttttgagaacggctctcgagagactcctggaactcgactgtgaaagagccgacatattcgtcacgtgaccagccggaaaaacgagggaatgcagagctttctttttgtcgaaaaacgttcgccaaccgcagtgacaccgagagagacgacgtcttcacagattccagtatggtcctcgccggactgtcgaagtcgtttctgttgtttgagaagaggctgtttttctgtaggtctcgagtggggaggaaacgggacgcgttgaacgatggtttctaaccgcgttccacaatcgcgcagtggaagcgaacatgcagacagatgagaggagcgagcacgaaagacgcaagagtacctttgcatgcattcggcctcagatttgagtgatttgttgatgcattttgtgccattcaaaggagagcggcctttcagccactcgagtctcagacgaagtcgctggcgaccacggttagagaaaagaacgtcgttgtctgcactgaaacgaactggaaagttttcgtggacgcagtctcccttaccgatgtcggagttttactaagcagagaacccatcccgtgaggaagagtgtaactaagagagtaatcactctgtcatttaaggtgttcgcgcttcttgtttagagtttaaacgttaagttcacctcgaacaatcaaagaactgaaagtcgcgcatcgaacctttcgagtttccagccgtgaataggagatgtgtcaacttgagggcattgaaaactcagaacttggttcttcaacaagggagctacaagtgcgaagcggcgggactaacgaacgcgacgcgactgtcctcctcttcggaatcgcgaaactctcacaacgtttctcgagctgccaactaaaggaccagaaagcaagcttgatctttgatacatgaaatcactgaaaacaacgacctgctcctgaacgttttttctgcccattttcttttcagtcacacatacgtagagagtccagacctcctactcagaggtctgctgctggcagctctgcttcgacgcctgctggttctgttgtaatccttggttgctgaaatgttaccgctgcgtccatcctgttctgttcaaaagagaaatctggaaatctccaactctatctgttcaaacgcctttttctttgccgatggccaagtaccttccgacgatggttcggacgctgcttttcgcctaggtctctcgatgaggccaagagatgaccaggcttctccctttgtctattggacatagtgtccagtgatagtcttgactattctaacacaacagaacatggatttacacctctagatgaaggcaaaaacaagactgaatgcttccgttatatctcaggtaaggacgaagaagcagcgtgaaactaacttcggaaagtcttatcccacggctcgagtgactgcttcattaacgaggttgtcaaggcaacggcttcttgaccacactactggcaaaacggggttctctctttcgacactagagacgtttttccgtcgttggtcacctttttctgacgggtttcttctccagatttgtcttccacactgacgagaagaccccaggaacttcggcacacccgccgagctttgagaccgtaacaagctacgcgaaaaagctctacaggaggcctgctctgctgcctcagttgaaatggacgtctcctccccaccaagttagaagacgactctctggcgttgttttctcgcgtattctttgcctgttgcgtttgtttcttcgtctgagttctgtgggtcggcgcctctttttccggtcaccgcgtggaaagcaattcgattcaaatcattggctcctttgttgttcggctcaatttgcgccatctgttatcaggtcaggacgaccatctaggctcgacctggggtactacagtcattgcaagccgcgtatttacttccgaggaacccgtgtctgtttaggggatgtcatcttttgttcttcccgcaggaacccgtcagctgtttatgctgagagcgccgctcgctctttcgcgatctgtctgcggcttttttcgcaagttcccctttttttccgaagagaaacccgcaaacagcagaggctgccagggaactcgctggtggtcgcgacttgatcggccagagagagcgtcttctatcgaggccaagtgctgctgacgttgcgcgaatgcgttactcgcaaacacgactttgtgggtttcattgtgcgtcaaatcgattgtgtctttcggtcttttctttgccgttcgtaaaaagcgaaaacttcgcggagacgaagagcgctcgcgtgcaagtcgccagcgaagggatccgtcggactgtcttcctcgcaacgattgcggctgtccaagaattcttttcgcggttcttttccccttcttcgtctctttcgtttctaaacgcttgcagctttaaacgcatgcgccacctttctttttccgtaggtctccgagactctgtgacgcgatttttgcgactgccgccgttcatctgcggtgcatgtactgcccgcctctaggtctcgaatgaggttgcgcctccccctgtttcgcttccccttcagctttgtgaatttcaaacaccggtcattgcctcaccttcctggcgcttttggtcgggagtgacctgctgagtcgctgtctctgtttccctcgtttccctgccttcgctggcgagctccgtgagaagtccgtgtccacgcgacactgagccaagaagttatccgccacgaactttttcagggaaacggacatcgacgactgtctaaccagtaaagagttcactcgcttttcaagaacctcccctttgcgtttcctcccgtcggacgttcacgaaactgcgacgcagatttccagggaaacggcgctccacagagtgacctctttgtgcctgtctcgcttttttccagacagaagactctgtttcatcgcacttctctgacggcaaactgtgccaagggcgcccgttcgcctgcgcctccgagtcctctacacgtttgatttctgtccacttcagactatcgagatca

SEQ ID NO: 2286 - DNA, 2504 bp, Toxoplasma gondii
ctttaacaccggcgcaaaggtgcatgtttgttaacttcgtcacacgcgaaaataacgtgtaatactgtgaagacatggcagcgacctcctgctccacaactccatacggtttaacatggttcctctatccagtgacgcggatggccgtaaatggaaaattttggaagatcgaccgcccacgttcgcagcagaatcttcttaaatgaaaaccgtgtaccgtatgtgcgtaccattcatccattcatgttgctaccccgtgttggtttcgtaatctctatctactttagactggtgcaggttagcgtcacgtatcccattattaaactgtcgtgccctttggttacgggagatttgtatcaccttgctttttcgcgggggcacttgtaaccacacctagacgaataaaacggagacaaacactttgaaggtaaaggacatcccaaagactttacgaactctaatgccggagaaaagtaagctacgaaatgcgtcgtttcaggacgatccgctaaagctcgcatattgtggagatgacataaaaacgataacgtgttttcaatggaatcaacagtgacaggaacattggttctgtttttccacacatgctaccgaaattttagaaaagatttggtgggcagataatagataaagaaaaattcggcttgttgaacggagaaggaagcaaagctgaacatgattcacatgcctagccatagtcagccagctctctagttacaaactttttacagtaaactgcctaacgttgagtaaatgcaaaggcatttctggtaagttcttcacggagttatcaccccgttccggcttcttcaaagggaacctgctgtagctgtcacatccttgtggaatggagtttaagatgacaacagtcaacagtaagaagctgtcgaattctgcgggggacagcaaagtgttaatgcaacaggtgtttcgtttgcagtacacaaaagtccacttctgggaattggtaagctctcgcggccgatgagggcgcgacgataattactttgatacagactttcgtgcccttatcctttcttggtacaccgagggattcatgttactgcagcaaggcattaaacgtccaatgagactggtcgtgctcttgaagcaatggtgaaaggaactgcaatcagaacatcacacattgattatgaaactgcactgcactgggagaaagtatgcactgtacgtccacagtcgcacgaacagtgtctggcgtcgatgtacaacaaccgctcgcgttgttccactaccgaatcaaagtctactgttccagatattcggaatgcacgcaacagctaactacataacgttacgccatgaaggactccagattacccttaggacttctgttatattgaggcgcagtgctaagtggttctatgtctgactgtcgccttcggggaccccccactgacagttggcagggctgcagcgctggccccgtcacttgacttgcagagagaaccttctaggtgctctttgcggagtcgtaagtcgagattcgtttataataccctttccaccgcacataggtccccacctgtctcgtgttccggtggaaggagtggaaaagtgcggtcccggacacgcatttcgccggtaaccgtttatgcggcttgcgatagtgcacgagagatttgttggatatctgtcgacgacttgcgctcttcactggcatactattcccacccagcatttttacctggaccaccaacctggagcaatcgcttaccctcttttcctcactgtcgcgttgcatttagtgtctggcgccacggccggctacggaaccttttcgcgtgcacacgcgcgacgtcgctactcgcgcttcgacgttccggtgtacatacatccgaaacataactttgagtcatcgccgcagaacggttctgtatgtagcgtacttcaaaacaagaagtgctgaagctttgctattccgcggaaaacgacgccggtgttaaaccaacttcgagcggccgcttctgaccgcgtgcatctgcacacttgggcgggaagtgtgcttttcttgccggcaagctttcgagcactcatcggtgggattggcctgtcaacagcctgtaaagattgggcctcttcgtcactggcttcatcccactttaccgcatcgctccccgggcttcctgcagagtttaactcgtcgacctacgtggcggtgcgtgcgcccaaaggcttcggcaaccgtgtttttctttcagtttcacaatttcccctgggtttttgccgcctgcggacatggcatctgctgctgtcgctgcctgttcctgcgtccagtacccctgctgaacattgcgcgttcaccacgacgctctgatctaacgaaccggtgctggtttgttgcctcggagtgcactgtcccgttccctgggcaaggtctttcagtacgagagaaccagttgagacgctgaaaggatgaatacctcgtgcggagggcgtcccctgtcggcctctgttcgcagaca

SEQ ID NO: 2287 - DNA, 1803 bp, Toxoplasma gondii
cgaaaccgatgaagcagtgccacagcgacgcttgaacgtgtttccgggctacctcgatccccctactcaagtatttatgcttcaaaatgctagaccaacgacatgtgaacggagtcagaccactgccacacacgacagcaataacccaaggatttttcttcctctggttttcagtgaattgtcaggaagtgaccgtagattctccgaagacacaacacacccaggcatcccggagtaacggacgcgtggttgagagagagaactcaccatttgttgtgggcgcgtgagtttttccattgctctgtaggggggattctttcgttttctccggtcctacgatgacgtctgtttcgggactcagtgatgcaggcattcttatgtatgtacatctagacgtgtacaccgctacaaacacgtgaacataaaaatatatattcaacatatatatatatatatacagatgtattctgtagaaggtggagaggtcaccttagattttttcccattcttttctaggttctcactgtagaactgcacgatttttgcagtgagccttggggggctggttggtttcgcttcttcctcctacagtagaacacggctgacaatgatgcaagcaagatacagggagagagaacggataagagacgaccatggagaaggagggagggtaatagtagacaaaggaaaacctacttgaaacagcgcgtcgtcggcgctgagtatcaactctcgcccaacaaccaggatttcatggagttctggggcacctgctgtgtagaactcagactcgcttgcttactgtcgagttgaatatacacttgcagacttcgtggattttgttcagttcgttttgaacgaagagagttcctttcgcagttgtcttgcaggacacgggggccacggaactcttcaaatcttgtaaagaccaggccaacttgtcgaaatcaatgtttccagaagcataaatgggactggaatgacagctgagactaaggaatgaggtaaaaaggtgcatggacaagcctccccttttttgcagactttctctttcgcaagttctcctgcggtaaggaaacgaggaacagctccgtgattctgcgtgtgctgctgccacctccactcagcgttgactttctgtctttgctctgtttgtgcaatacgcgcgagcctttttttccttctcccgacccgtcatggaagttctgtagcttcatacacgactccaccgacagcaaagtcaagcgagagtgcatgcacgcgcatgcagttgcgcccgtggtgtctgtttaccggctttgctctttcagctgaacttccggcgtagattcgccctctttttcaccgctggaaactctttttcacacgctgagaggctctgaactccgctggaatgcgaacctcactgcaccgtcctctgctctttgcttgttctctccggaggttcctgttccaggctgctttgcttcgctggacggaagtccttgaccacaacgctctgtcgcaaatgacggggagccttcacttgaaagtttacatacggggtctggatacgctagggtgtatggacagctgtggtacatctgtgttctggaaaacaggccgaaactctctccgagtctagccctctctcctctgtctctcaccctatcgattccaagcgcgtctctcggccttgtgactcccctgttctccatcggcttgcttggtttctctcgctctcttgtcccctgtcgatctcgcttgcagttgaagagcgcgagttttgccgttccgatcctgccgagagagagagagccgcca

SEQ ID NO: 2288 - DNA, 4425 bp, Toxoplasma gondii
tgcgtatgaagaaggcgacggcggtgcttgggatctctgttcgttttttcggtagacgcgatattctcgcccagtgcctccagccttcaaaattcggtaataggagaagagaataaggagcgctacgacggtgaccgtgagatgcagcccggtcatcacgaattgcatgacgcttgggttcgctgacgtggcatttgtgacgatttcagcgatatccatacacgtcgtgatagagaccgcgacgaggacgaaaataacaaaggacgccgaatagaaaattgtcgacagaatccccaacgtccccgcaagcaccgtaaagacggaagacgtaaagttgaaggtcgccaacgaatctgccccagacgcgtgacaagagcggcgtgattctgaccacaactcgacggtcgccgaaagaagattatagagggaaacgagcgcgacccaactcgccaggtcgagtccccagatgctcttcacagtgagccgcatgctttcaagagagaaggcagaggaacacaagagagggacgtgggacaggggcgcaacacaaggcgcttacgaggtgttggacgaagcaacggatcggcaaaaaagaaaaccaaccatgaggtgacggagcaaataagacgggctcctgagcaacgcacagaggaaaagttgagaacggtgaatgcgtgagggattgcgagaaagaaatggtggtgtattatagagacacagagtaacagagaagctcaggaggtcgagacaactgattctttggaatctaaagcttggaagagaggacgccaccgtggatactgcggaggaaaaaccgctgcagaaaccacgaaagtagagaaattaaaactgaaggaagtgagcagagagagaacctcgagcaagagaggtgtgacgttcgaaactctggcaggcttgaccctataggagaatgaaattgtggccttgcaccttacgatggaaatgtattttatgccaaggaacgaaaagggaagccacatcagagactgggtctgttgaagtcaacgcagtagagagtgatgccgaaagttcagtgtcggacacccgcgaatgtctcgtgacatcgatcgctttgagtagacgaagcagccctggcttctgtacagctacttggtctaggagctggggagtgagaaacgagacgtgagtagaagaaagaaacagacactcaagagcaacggatggcaaacggagagtgcacgggaaaaagaagacacaacaggttcgttgactgcaggaaccacggatgcctttgacgagtctccgatcaaaacataccgatatccgcgcagctcgctcccttctcttctcttagagcaaaaccagaaagtggacaaaacgggttaacgagtgaaaaatggtcaaaacggtttaacgagtgacgcggacatgtaccccgccaaaaccgctgtatccaaagaattcagccgtcagatccgaacggcagcgtgcctcacagtacaacgggtgaacacgaattatcgagaaaagaatgaagctggacagagaagaacatacatgcggctctgtgtctcacgaagagttcaatgtttgtcgaaataaatcggtctggctgtgaaaaccaggcgcttgagggagcctggccttctgggcgcggagccagccaagacaagcgatgcagcttgttgctaatgaacaccgaatacgtcgaaaaaaacgtatcgaaataggtcatgcctcggagcaaacaactaaatgcaattctttctttctgtcaactttttcactggtcctgtgtcaagcgcttcagttccatcaccgcaggattgtccctcgctgcctggcagctttagcgccgcgaggaccttgagagaacagcagcctgtctgctgccaaaagggagagcttttccgtagctacgggcagggaaagggggcaacctcgggtacacttagattgtggcagtcctcgttccatgtgactttccaaaatttggcctctgatctggaaatttctcgggcaacactacgacaaaagctgccgcgggttaacccgcgcactctctggagcaaatactgctaaaactaacaattcgtccttcaggtgggcgagcgcgcctctcttctttacacaaccataccccactgatttcagctcgatggctaaagggattacctcaaacatttgtctctggatgctcgttgtagtcggacacaaacgcttgccttagttatgcatgattaatagcagttagacgccactttctgtatgagtattggccccccgagtcggtcgtggacaccggaagcgcgtggactacttgcatatttcgcaacaaaggttggtgttttttgcttttgagcccgtcagaaactttgtcgcaccgcttttagtcattgccaacacgcgttagcctactttaagtggcgtcttgctccccacaactgctgcgcaacggacacttgcgtcgtcagcagagctcacgacagatcttcgccgttctcgtctcagtcgtgacctagttcaagtctgctaaaggggtccccacatgttctctgcctggtgtgacgcggtgtgcaaatcgtgtcagcgcattggaaggatgtgtggaaacttatttgcaactggacgacagaaagagacacggcaaaacggccacatggagtcatttcctctctagagtttcttccactgactggcacgtctcgtttgtatttcctagctcctcgcgaatccacatgagcatctacggtcgcgcgcctatggcttaagtcgatgcctgggcggatccacagtgtcgtgagcgtcggatgccacgtacagcgggaacggggtttccacatttctgcgcagtcgcgcggcagttccaaaacggttttggcagaaagcgagggtacacacgaccacagaaagtggcgaaagcgaggagtgcgaaagagagaagagtcactggctcagcagtcacggagaccggaaatgagacagaattccgcgaggtcttccgtcggcggtaccaggttctctaagtcaacatggggtctcgccgccgagttcaaagcagagccacagggtacgcgattcgccgtgtgcttttcttagagcctctccggcagctttccccatattttggcactcgcttaccgctgtctccgcaagatcttcccgctcggtcgcgaattgtgtccattctcctcgcttgagcagggaaaccagaggagcggagctgtgcgcgcccgccccgccgaaaaccgcgcggagaaaaccatgtctgaatcgctctgcaaggaacacgaaaaagccgtacacgacgacgctgtcgcttttgttcgcgcggaagtttgctcgcgtttcctttttctctgctcgtgcttccgaggatagcagtctgcggtgcctgctcttgcttgcctttcgttttccgctcttcgtccatttgtcgcgaaacgcacaggcgccttcagtcgcgcgtgtcgcacggttccctgtcgtccgcctcgctggatgaatgcgtactgttccgtttcaacgcaatccagctacatgtgcgtcgggtgccagcgtcacagttgggcatggagtgagtgttttctcgtcacttttcggacggtctcttcgttctacgggcgggatcgaaacctggatttgtcccgagttttctcgcgcctttccgtcgctcgggactcgcggtcttcgttggtcgacacaccaactgcggcggttcgtcttgccgcgactcctggcggcgacacgaaagtccagacaaggccagacaagcaggagtcgacttgtggacggtttctccctgaaaaaaggggaaccgggcgaaaactctcggcttttctgggggacgaccacgccatcgcgggtcacgcgtggagaggtcacagcttttcctcccccgtggcgactttgtggccacgaagcttgtgagagactcgtctctgttttccgcaaccaccgatccccgacaccgcgattttgtacaggcactcgacctgcacagactgcactctacagggaagtccacaatttaaatttttggctcatctatacgccttttgccgtgctaggtcgcacaccgtctgcctaccgccagtcgtgccgaaagaaatgcacacccttccgcgttcggtcttctccgtggctgactgctcgaatgctcatctcgagaggcacctgaccgccttcattcgttttaaagagggcgcctcagaggacctggcgccggcacacgcggaaggcacagccgaacggagttgctttttcgccatcgtattttgcgcccctctctgcctttccgagcaagtgcagccctcgtgtagcaaatcggcgacgccattgccccttggagcacagaagagaatctggggactggtggtcgcgaaacacataccacgtctccacaagcaggcgtaggcgggtgtgtagatgtgcagatcgaca

SEQ ID NO: 2289 - DNA, 4841 bp, Toxoplasma gondii
gccttctcttacactgcttctggctatgtacaggcacatcgagcagagtgcggaacatcgagaggatacggtcccgcatttgttgttagccagtctgtcacatgtcttgaaagtagtggtagacgcgagtcttctctgctgcaatgccttggtttgttgattgaatacctaaacaagaaaattcctaccaaagcgaagaaggtccaatttgcacgttacctttgccagctccaagcactaacagcaagcctactattgattcatataaacttgtataggtacatattaatgcgaatgtgtttgcggatcctgggcaagtgcgtgtgaaactctgaataaaacggcgtaccctggaagcccctgtaggtgatttggttcgtggtacaaagcttctgctttttctcgaacctgaaaagggcaaaccggatcacataacgctacccaaggcgacgatgtgccatttgaaagccgtttgtggcgtggctgccgctggtcttcctcattacctgatctgtgaataatttggtggagggggcacgaattcgtctgttttcagcctgcttctctggaacgaaatagatagcaaaaagcacaaccactgcgtaggattaagcggatgcattctttttcgactccgttttacaagtgagtaactgcttgcattcttacatatatattgtttgcaggcgtttctcaaacagtcgtagagagtacttacaggtaaaaacagtttgtgatacatgttctaactcgaaaggcgaagatgggtggcgcatacctcagctaacttcggcgaactgcttgctcacgtgacccgcctattcagcctcacctgggcattcggcttatagggactcagcggtttcctctgatcaccacaagaagtcggctgtcttggtcgataagcgtcttgatactcgctgcggttttgacaagcggtatagaacagcattaaaaacaaaggcgcttccagtgtgtctcgcttgcggcaagtccctcaacacagctttttctaaatatcaaaagattgcaggagcctagagaatactgtttgtttcgcagacagtaaccacccgcgtacaggtgccagtccagtcatccacattggacaattgatccgtaattccgtttctgtgtacgtggcatcgtcgaagtcttgtttactgcttttagcatgttgcgtagagagtcgtgccgtacttatatgtagggagttgcagttggacgttacgtattaaaggacgataggaattatgccgtcgactggacgtaatgcacgtattttcaccttttcgcaagaagacggactttgggatcgtccagtgcaggtgcgtcgtgaggcactgaaaagttaaaaataagaaatcagggagactgcagaaccaaatcaccgaaagatgaccctagcccatttatcaaaatagtctgacagtccatcgtgtttcgtaagacgaactctttaattcttggaagagagcagttccgtgggaatgtggtattgatgcagttaggtatcgatagcgtaaccagaaaaagtttgaaccaacaaacccgaaaaggctcctcgctgtgtagtgatgtgtaacggttttgcagagcggagtcgcacagaaatctttttccgcgtgtaaactgtggatggtcgttggacaacatcaattttctgggtattggcacacttaaatagttttcgtttcatgagacagaaagggaccccctcgtcacattaacgctagtgtatgtgcgcatccgtacatgccgatctgaattgtatagtaatgtgtcagcgtcctgtttacaactacagccataaacgtttacatgaagtctcttgattcacaaatgtatcaaacgtcatggaacctgaatgaatgcccaacatcggagcagaatgagaaatcacatctcgctattctgctcgtagacttgagatcagtaacttaccggccaagagtatgcctgaccggcagatgatctgtggaagacagaaagcgcagcacgcatcgcggcaacattacttgcggatgtgcaggcgtgtcattgcatgagaaaaacgttctgcgtgtttttctgttaacttcacgcttggtccacatcaagcattccctcttatagtttttcgcgccgtcccgaactttgtgcatctcatgcgggttcagaaagtgcaaccctccccgaccacgcattcctcagctttcttaaaaacagggcgttgtcaaaagactattctgtgggttcaggaccttgcgtgccgagtgaactgtggttgtgctcaggtcaagcggcatgagcgtcctcgtgacaggcgtctccttgtggggctgggcaccctccatcgcacattggaaaactcggttaccacgaagagacggtttcctcgaagcacaacagcccttcagagcactccaaatgtctcagtaagaccgggtgtctctcgcggttttgctattcgccaagaacagacgcaaacggcacggtgttcagtttaaaaagagaagacctggtcatcacagtagagacagtgtccggggcgggccccgcttctccggacgccagtctgagaatagtttggggcttgcctttgtttgtgttgtccgctgacaaggaaatggtccaagagaagacgactttcaatgtacaggcggagaatttgcaggttctccactgggatgaagaacgagagggcgaggcgattgaaatagtgaaccaaacacattgtacgcgaagggatggagctcctggcacatctcgtgatcttcctagagattaaaacactgttaccgatgtgaccaacaaaacaacagaataaacgcgtagctcttcatggctgataaaaatgctgccttacgctattttgtaaagtgacactaatattcagatcttgccgccaaaggataccaagcggtaataaatctaaaaggctaacagccaaacaccatctgtggttcacatatagcaggcagcttggcgacttggttttaagaagacatttgaggagtccacggtggtgtgttccaatttccaagacagaatttaaaactcccacatccggaacgacgtgtaatgataacaaaatgcaactgagctattgtctgtctgcagacatgtcacgacgatgctggagagtgtgcagatgcataagcaagaaacgcatccaaaaactcacgcccaccaatcgtcagtcgatactgtgtgacacggacacggttcacgactttctgtaaagaagaaaaacatcgagacggttacgcttggccgagatactgacactatcttccgtatagttacgcccactgctacagtagggcgaataactgagaacgagaactgtagttccgcgaccatttctcttttacgtattcgagcaaaaaaggagttctcacgagtacctctagttcgaattcgactggcgctgctcgataattatcttatccacacattaaccgcatggctggctttcttcataaataattgtgaatgaccgtggggaaagaaacatgcatgtcgtttccctctccgaagaattcatcaaccacgaacattaaaagtgggaacacaacggagattacttttgtcgtcgtttgcactcacccctaacgcctgcgcccttgactctgagaactgatatcgctatcagctcggtacgttgcgacagaataaacaccagctactgcattgtgtttgtcagttggcagaacggcttaatgagactgcataccgccagagtcgacctcttacgaagagaggaaagggaatagacagtggcatatcgcgttgcgaaactgcagtgtcatctgtagaaaagcagttacatgcgttttccaagaccttcctccacagtacgcacaagctggctgtcttggaggggcctgtctatcgatgtgcttatctcgaataacgggggcaaacgcagttgacgctaactcaacaaaattattagtaactggatggcgtcatcacgcatgtgatgcgttccgtcatcaagcatgcgacagaacattcctttgctcctcaaagtgcagtgacagttcgacccgttggcccaacacacgtacaaaatatttataaccacatactcgatacaactcaatggcttttacagaacacagacagttatcgtcgctacaatgctcactcgacgcacaccgaaaaatcggaaaacgaccatacacagataaatacaccgactctctttagtcgtcgtctttttgctgaaatacagtgagtcactctgacgtagagaaaaaatacgaatcgaatcgaaactaactcaaataattgtgttttgccggtcgactgtgcgggctcggcgcggctgttcaacagctgacgagcaggttactcacgcttttgggttcactgacattaacatcgtaagtttcctgttgctttgtggtaattcctggcactcagtttcgggaataacctttacttcattcaaatgaggagaagttctccgactacggcttgcgggcagtggcacatgtgatgtgaatgcgctagtcctccacagattctttacttcctgtggaatgggctgcggttcccaacagtttctctcgtaccgcccttagtggggggcgaagtaaagacagatgtgctaacatttgcgtgccatatggttcgctaacgacgacacttctccctactttcttgctttcctgggctttccgttctgtctgacgtttccagaaaactccgaattctttagagtgcccaaaaatatgtcaggagcgccgacgatcatgcggcgtcaaccagtctaccaaccactttgagacataatttccactaggaaggaagaattcagtgagggaaaaaataatccagttgtggagaaa

SEQ ID NO: 2290 - DNA, 2818 bp, Toxoplasma gondii
ggtgcccttttacataacgacatctgtttctgaaagtaggcacttcttccacaaatgttgtgtctcgagaaggcacgacttcccttcggggttggggtggacttgtggactcgtttttctcgccataagcctcgttgcttttgattagagaatgtgacgcgtgcatgagccttctcttcctcctttgaaaacatgttaggacaaccaggcggggaaacctgccatcgcgagagcaacacctctctggtgcagacaccgaaaacatcagactagtcggcaaaaatctcttctccgcagaggacggcagacacaccgtgctcgtcaataaaatgtccgcagttcgttagcagacctgctgtgtcgacagcgcgacacgccaatcaacttgctcttcttaccttaatgacacgcagatgcttttgcgtgaaagtcacaacgctcggcctattgatttcattgaaacatatatttacgtaccgccctcagcagtcagtgcacagtacccagctgcccacatgcacacacacctatatcccgtgaatctacacttactttcatggatggcgttgtaaacgtgtgttgtctgcgtgactacaaggaatggacaagcgaacatgtaagctcgctttcactcggtacattttgcaactgttgaaggccacaaggctcttcctggctgtgttcagtattgcgcgggcatgcaagtctccatgtgataggacctggaaaactagtagccgctacctgacgaacgaagagaagtggagcagtttggttggaggcagcagtattttccgctgtattctggtctcgtttctctccttgcaccaggaaacatcagaagggaacagccaaagacagtctcagccgctgtcttcgcagactttgctgacggaacccgaacggcgggaactcgtgggcagcttttccgaaaggtaggtagtcacagaacaagtggaacgggagaaatcacatgcgaaaacgcgtgtgacttgattctataggagcggccgaagagtggaaagtatgcaaaagtgaaggcaagagaaatgatcaatgcacagggtgtcagaggacagaacagcaccgaatggtagcaaatacagtaagcgacacagctctgagccacctacaagctgcaaaacacactgaatcgaccaactcagtcctccatctttcggatcaacacgaacgagtgccactttggcacgcgttgagtagaccaaagaggaatgcgaaggcaaacactctcgatacaggaatgctttattgaggatacctaggaaccaaggcacacgaaaaggcgtctagcatcaaatataaaaatttcctcttcagactgagtgtcgataggaaacagttcgtttaagctgacttatcgaaacccccattcttccttgagtggcgtggactgagctgagcgcttattttaccacagtttcgcagtcactattcctggtacatcccctccaaacagagacagagaggaatgtcgatactttttaaatgcgttgctgaatccggcagatccagaactgcgcttggagcatatattcttataaatccggtcttcgttcgtactttttctggcgccaagtctttcttctgacactagaggccaggcgtgagcaactacgtgcagtttgcttgtcaaactcaagagacacacagtgtaaaatcgaccttccgtcgagactgggtcccatttcatggtcttccaggcaagacaagactagttgcttccgcaaatttctcttccaagtgaagcccgtggtagtttttcgcttttcgccgcgggtactcgtctgctcgacagaccaccaagccgaaggcaagtctacgtagaagacaggagcccggaaagcgagcgccgaaaaatactgtcggaaggacttcggcgctctaaggcactgacgcgaccggaacaccgaacaggggtccagaagaaccgacaggaagagactcttcccacatgatcgtgagtttcttgcactggcgcgccgagcaagacgggagacgtcgagagcgagcaaaagtgcgaagacactacgtcgacctcaacagaggaagggagaaagaggagggacaggcggggagatttttatcatctgagtcatttctgcctcggcttctcttcaggcacagtttgaattcagtccatgatctcggaaccgtactcagatgcaaatttccatcggtgctgctgcatgtagagatgaatgcattcttgaacacgcggctgcttgacccgtagacacgtcaccgacgcagattttatacccacctgcagagaaagaataaaaaccaacttgcgaagagcagctcaaacagtggaagaagcgtgaaagagaggcggcaaagctgtcggagcgaccttggttttttctcgtcgttctgcctcacacacccttgtctccccgtcctcatcagtagaggacccgctggtaaagaggttctcgttgtttttttccccagtatttcatctctcggccaccttttatttcgctttcgctctgtcgtttcttcctccatgctgggtttgaaaagagcctagaagccccgatttcagttgtcgctcgttgcacgcgatcgcgttccttatccaatcatcatcgttatcctcttctgcttttctgcctctctctttttcctttttctattttttgttcactttcttctccccgcccgccttcttctcctccgtccccttcccttcttattcttcgtcttcttgtcttccccggtcgctcctggccgcttggtttcgccttctttctggagccctcggagttctaagaaagaaaggagaagtgcggta

SEQ ID NO: 2291 - DNA, 1474 bp, Toxoplasma gondii
acactcatttcaagtgacatcaccggccaagttgccgttttcacttgtccctcaggaaggaaagaagttctttttcagcagcaagcacttttctgttttctcatcgtgctgtacactgtgcctggggagacctgagagcgtggaccagcgtgaagccctttcctttttatttcgtgaagaaagtcgtttttcactgtgttttgtgagaacgcaagcggctgaggtcgcagcggggattcaagaggataagggaagtgtctgttctcgcacttttgacgccaaggtctgcggggccaaagacacgagaaatacagagacaaagtcacgcgtttctgctcgtttaagggacagtcgaactcgcattcgcacacgagtcgggaaacgagaatcgaaaaactcggaaggaagttcctccccgtaagccgggaagaaaggctcgaacgacacactgtacgcactcctgcagtctgagcttttaatcaccctttttccaccggaaaaatcagagcaggtgtcacgcgttgcatcatctgaaaatattgacaggctttttctccttcggctaaagagacttttgaaagggtgaagggaagaaaggcacgaatcagacacaggaggcatcgtgttcgggtattcatcacgtgaatgaacagaatgccgagatactccattgactgttatgacgtattcttttttatatctgcatatgtacacagaagagtagccctctgtatatatctatacataacgcgcatttctcctcctctacaagtggaggcgaggctcatgcatacgcatggtctgttaaatgaggctgcatacagtgtattaggcgtccgtttaaacacatcgagctgcagagaaatagatattttgcgtgcatatcaacgtgtatagcaagaagtttattggtatgaggaaggttctctcatcgcagaaactcttcaacgatgatcggggcttagacacagattgactccctgtcgcatacaaaggagcggcggccaagcaacatcgagcacactgcatgagagaaaagatttatttttcgagaacaaatttgcagcctcctttgtggttcatttttcttcgtttctcgcaggaaggcgcatttcactctgcacaccgacactccatctgcagtgacacccgcgcgagactgggctctgcccatcgaagccgtcttcaaatagttcccggtggaatttagacccgtcacagttcgtggcatatttttgcaaagaactgacaaagtatttctgatctttttcctcccatttcgccggtgagtgcccgggagacagacggttagttcactcgcgcggttggccaagtgtacagacacctcacagcccgccttctctcctgagctggagggctgtctggccccattacattccttgttctttctcgaaaccacctaatcgcgcaagaatatttctccgttcagattcactgtcttcatcgtgtgtga

SEQ ID NO: 2292 - DNA, 3509 bp, Toxoplasma gondii
  misc_feature (2141)..(2240): n is a, c, g, or t
gatctcagcaaggagataaggatgcttgaggaaacggaacagagactagccgctcaactgcagcatgctcgacagtcgagtgatttggccgcagagacgcaaacgcaagcgtccgccgtttccagctccacggaaccagcagaggcgtcggatgtgtctgggcgaagctctccgcgaggcactacccaggtgcctagagatctggtggaacgacaatctgagcctgccttggaaaagcccttggacgaggctgttgcgtcaccgttcgttgctcagactccttcccgatcaccaacgccagtgacgaccacagaaggggcttcgcgagagtcagctgccttggcctccaccacgcattctatggccagcggggatctcacaacatcatcggactggttgacgcacgctgagagaacatcggagtctgcttcaccgctgattttgcatcaccagacggcccctctgtttgccgcaggtgccccacaggcggtcgtgtatgggggcccctgcaccagcggcgatagcggtggacccccatattctctatcccaaatcttcgaacacgccggcgctgcgcatactactggggacccgcgcacagagagtaatattcctgaggacatcctggagttcgttctgtcccattccgcaccagcagcgactgcatatggggactgcgctgcgctcctcgcagaatcgacaccctcgatcattcagccatggagtccagaatattcgccaccaccgatcgtctccgcgagcgagcacgcggcaacgagttcgtcgtggccccacccgactacgagtgcctcggacgaaggcgcaacaccctgcgcagtcccagctagtagcagcgcgttttcggggccatggtggagctcgcctcaaccacagcgctcctggcgtaggcatcccacacacctgcatacacatccgaacagtgacatccccgcatcacgagagtatccggacgaaatgagataccagagtcaaggggggagctacgttgccacatggatcgaacaatatggtccacatctaatcgactagtgaataatcatagcacatcagtcatttctccgggtgccggggggtggggcgcttgaggacgagtgtgtagcagacatggagtcgtgttgcggcgatgagcggcacggaacctagtccgagaaggacgtcggccactgtttcggagtgccgccacttgtgggtgtgtagagatgggagctggcggcatgtctatttcttatacggtacagtaggccggtttgggcttgcagcacaccctcaatattttatggtctgacaaaaccacgtattggcctctatacagcggactcggtaagtgcgaacacattcgcagcattgtatttgctgcactagccgtgaagcgaacctgatacggggaatagaatttattgacaagagctcccgtgaatcccagagcggcccgagcagtgatgatacaggaaggaagcagaacccacgtaccatttgttgtcgcggaaaggttgccgctgtgtcatcattttcaacagattttcccggtgcccttggacattatgcacctgtttttggcgagccgctaccgcctgaacctcgacagccactgcttcagtcccctgcccgggcgcctcccgccgacgtcatcccgccacatgcagcccagccgtccacggcgttcgtggatgtcccttcgatgtttcaacaaagccaattgcggtcgcctcaactcctgtcgatgcgcgtccggcccccggattcgacctctaccacaccgccctccctcacgtcacccagccgaagaattacgggtgagcaagtgaagcagtgctgccaactcgcgagggtgtggaatgtgacacctctgttcacctatttctacacaacatctgttttagaaaagcgacgcgaaccctactgcgcccccatccagcagtgtgtgccggtgtttcggatacgaatgtgtacacgagaagctttagtgcagtctcatgacacgcgtcatgacagacggcatgacatgcggcttgacatgcagacgtttgcgtctggctgctttgtgaactcgcctccgagaacgcctcataatggaggacattctgggagctgtactgtgacagtaaccggcgcttcatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagtgttttattcgtcagccgctgtaacatgatagtgactgcatggtcgcacccgctcttgaaccttggcagagcgctagcgccaacagcgggcaccagtggtcttgactactatgatcattcccaagggcgatgttcttccagttctctgtcgtccgaacactacgccgatattaaataatggacccgaaggagaggttcgagaacagcatcgagggccgccgagactgtcgattgtggaagaacgggcaggggacgcagcgacactggtccactctttgcgtaacaccaatcgcttttcgtttgacttaccttctccgcagtgtcgcccagataagcagttccgactgcatcgcgactctggccgcggcagttaccagattgtgcttcactgccgcagtgccggccgagatctgagttgagggaacaagtagccatgtgatacgcacctgcgttttccgggacgtaggcgcctttcggcgggagaggaactgtcaaccgatataatatgtggcctctcgctactcctcctagccgtccgggttcagcagcgctgcagcgccgggggcaccgccaccgatgcaacaaccgtattcggtcttcgagaacgagaggtgtttgtcgcgtgtgctcgtcgagtgggacagtacacagcgcccaatttccacgtttttggaacagtgtctctagagctgaccagtggatgccggtgcgttggcgggttttcagaaatacaacggcgtcgctttagtggggcagatcgtacaggacccaagacgaacactgctcaggaaaattaagaagcatttttcgtgcgttgttgagcggttgtattcggtgtctcgcgtgagcacccatgtggggtcgctgctctcagttcatgctttccgcttagttgtggcatattaaatcatggcaaggaagaccctcatgtatatgcggtccggccaatggtttataggggatcggccttgaaaaggcctagcgttgtcgtcagcgacgcgaaagtgccgcaggcggcactggcgcttttgggcggcatggtacacctggggtaatccgcccgacgttcttcgcaagcacacagggatgcacctagcttgcttatttattttgcagttcctgtagaaaactgaagggagcgtcacaaggaacgggaacattctagtgaagaagagaggccccggactgtcgccccggcgtaacgaatacacacacaccttttcacaagggggcaaccgtggtgtgtttcgtccatggcacaagga

SEQ ID NO: 2293 - DNA, 1257 bp, Toxoplasma gondii
gggacgagcttttcttcaaacacaactacatctcatgagccactgatacacatgaagatgtgccttgacatctacatgcaaatgtatatgcacacagatatataagcatatatttaaatgaatgacataactatatgcatagtatatatgccattatacgtatacatatatatatgtatatatatgtttgaatatgtgtgaccgtctgtggtcgtgtgaaggttccattgtctttttctggtgtggaacaacaggctgagagtttgctttgtttgctgtgacgagaggaggagaagaacgagaagggcaccttcgcgtattacctcttcctcgccctccggttgcttcgcctctgcctcgacctgaggttcggaggcggccgcctcctcgcgtttttcgacttcggccatggtggtgacttgaaaactagggaagaagaaaggcgacagcagcacagcaaaaagagaagaaaaagaaggtcttagagacccaagacaacgaggacggccacagattcagagaagtcctcgaatttgcgcagacgcaccggggagacagaccttccacagggaagaggaacacaggagaaaaaaagaaagaccgaaacggagaaggggaaataaaagaaaaggcgaaagagacccagaagacgtcagagttcacctcgcgcgaagaagcctttcttgtggggtggcatttccacgcgacagaccagaggcggtttctggctttttgacatgctgcatgcgcaaaggtcgcaaggacaaagtcaccggggtcggcttatattcgaaggcaccttcacttgggtcacgcatgctcaccgatagagaaagcttcagtgcagcctgaaagtcgtcgagttccgcaagtgtctttttaagccgtagcgaaatatgaatcacaaaatgccgttcgattctcttctcctccgtgtctgcagtcaactgtctgcttcctgttttcgatttcctttcggcgctcctcagtctcgtgcatctcttacacgcgcatgcgcatctgcgcgaacttcgcgatccaacgcaacagaaaaggcttcttcttcctcgcggccgctgcgacgggtctctgcacctcgagtttctgtttctgcgttttcttttcgatttccatgcccgcaattcttcttgccgagaaggcaaacatactctgcctctctcttccgcgtctcctccggcgacgagtgccggaacttctgttccgcttgaagactctctgtaccttccaaaagcacga

SEQ ID NO: 2294 - DNA, 627 bp, Toxoplasma gondii
acggcggactggtcatcaacctctcgaaggtgtttgtgtttgacagcctcaaagtctgtcgcaaagcctggggctcctgttgtttcctctccgcccgtggatttgctctcggcggtcgcgcgggcgcctcctgcgtctttcacgccgttctcttcccctgcatctctcgcgtctggagtcgcacaccctcggccgccagctcgactcatttgctggcgcataaacgcctggagcgcgttctggtcaatctgatcatccattgccgcggcagctgcagcgaggccggcggccatggccaccgccacaccttctttctgagccatggtggtgtaaacgaggaagcaaatgcaaggtccaggaaacctagatcatggaaagttaggtcgtgaaaagctagctcgtggaaagctggccgcaagcaaggaagccagactcgcaggtgaacacgaagtcgtagagtgtgagaagcactcacggaccagacggaacgcagcagacaagcaaatgggttgccggaaagaggggggaggagaagcggggtgaaagaaagagtgggaacgggagaaaggcagggaaaggccggagaaagcacgcgtgtcaggagaaacctcaagagcacaggtgcaa

SEQ ID NO: 2295 - DNA, 2326 bp, Toxoplasma gondii
tcgaccgctttgctgcaaacgcagcagagtcgcctcaacttttctgcggcgcatgtcgagccagagaaggccgcgctcctgcacagatctttgctggcggagaacgaggcgcaggagctgctgcctctgcgctcgcagcttcgccttctgtcgctcgaggaaggccctgcggtcggtctcggagaacagccgagtttcccactcggaccgcagccggttcttgcctgccgccaagagggaagccgctcggcgcgaggagcctttcgcctgcctccagtgcatcttcccctcttcgagcgtcttgcggaatacggactgcgcgcttgcgccccgccacgagagaggcacaggatactgcatgcgacagcgccgaaaaaacgcgacgggatctcgagaaaaccgcgcaaatgtgtctacagacaaacgctggaaattgcgcaggtgaggcgaaggcgaagaagaggaagaagaggaagaggaggaagaggaggggaagggagaagaagaggaagaagaggggaagggagaagaagaggaagaagaggggaagggagatgaagaggaagaagaggggaagggagaagaagagggcgcagaggggggacgagaagagttggagaaagaccgatgaggagacaccggagaagaaagaggcaggaaactgtgaggacagagtggctccgcgctcccggctgtctcgacttgcggactgaagcctgaccgcagaagaagaggcgacagcaaccgagagtaacaggaaaagaggcggctttcgctgtgtcgagggaggagagactccacccacggagacgagacggagacagttcgaggaacgagagcagaggcgacagaagaggaaatccagtgcagcggaatcgcggcagacagaggtgccgacgggggaactcgaacaggaaaagcagatgcaggaaacgaagacgagaagggaggatcgaggggagacgagacagacgagggagatccccgcctcggggacgggggcgaagagaggcgcctccgttcacaagatgctgggacggtggacttcgaaaaacgcgcgcaaagtgaagagactgcatgcaggcgacaaagctgtgtttgtctttccgagaggccagaaaggaggctcggcctcggcggcgtcacgcgccgggcgaagtgccagctagcagctgccgccatctcgaacaaagaaaaaggcgacagaaaaggaggatgacggagagcagaaggaagcgcaaaggcagcagggaaaagcgagaggcagagaggaagaccaggaaacagagagacacagaaggctctacgaaaagatcgttgcgccgaatcgatgcggtgtatgtacgcagacttgttttttcgagaggagggaagaaaaaaggaacgcagaaaataagaaaaaagagagaacgagctgtgttccctccggaaaaaggctgtttgtagaaggcagcgctgcatattaagacaagagcttgtctctctctctccctcgtctcggacagacaaaagagcgaacagttctctgacgggagaggagccgcgctcgagaaagagagcagaaggtgcctcggtttttagttctctccttcctcattcaaagtcccttcacagcaagcagcctcagaacagaagaaacgcgactagacggtgtctctcgacgcaaccagcctttgcatgtgcgctttcgggcatgcatgttcaagtgtcaacaggacgctggaaatggtagctctctgggaagcggggacttgagaattaccccgcatgccttccaggttttcttcatctctcacggaaagagagacatttcgacaattcccttgactgccggtgctcaactcctcttgaaaagaagcgaaactcaaccgtgtgtgctgctggagtccggctccgggcaatacctctgtacttccttgtgttcattttcgcttcattccttccgtctcccattcaaggtgttcttttcttcttgtccagtgaacggtcgctcgtttccttgaagacaacgacctctttttctctgctctgccgtcaaattcacccactggccgtcactccccgtcagcagtagcagcagctccgcctgcggtctccacagagagtctcgacgcgtttcccctctgattcatcccctgctttcctccgagcttctttctcttcctccagttctctccacttgtctttgttttcctcgcttcgtctctcctcgtctccctgtctctcctctcggcttcctctctctcctcttcctcttctgctctgtcccccttctctttttttcactccatttgcctctcttttttcctctccttgcgctaaacga

SEQ ID NO: 2296 - DNA, 3105 bp, Toxoplasma gondii
aggatattttgatttctcccgcctgttaacggcttccaggtattcctggtcgtccactgagctctttgtgtctgcatgcacgcctgcactgtgttcacagactcacctgtcgtagtcgactgggagccagcctcttttcgcaagttccatggtgtacccgtgagccgtttccgggtccagtgggccgctgctgaagtaacgaaataagacggatgttaccggctcgtagaaggagtagatcatactgctcacgtcttgcagagcgctgtagcagtacactccggtgccgagaagaaggacgaggaagaccaggcgccgctgaagacaaagacaacatacgacctctgtatccgacgacatcaaggtggtaccacgccggctatgttctaggcgccatacgtatattactctagggactcgagacagctgaacgtggggaatttcaatatcgtatgacgttacggtcaatacacatcggctctgttctaaagtaaaagtgttggacttaaacttccactcgcactggagacaacgtctgagggtctggtagcgcggcgccacccaaggaagagcccgtggcttgatgtggatcctcacacacgcaggacatgacctttgaaaagacgacggtagaaaaccttgcttcaaaatctttgtgtggctgatgggagaacgcgaggagttctctgcgaaactagcggagatgttgcagattcgaaacgatttccagaagaaacggccagaggggcgcctgaacctgcagttccacgactgtctctagagacggcaactgtgacgcgtacgtagaaatgttctggtcgtatctaaatcaacaagacgcgactcagctgtgtctgtttccccgttggtcctgacggagtaacatgtttcaaattcgaaaacgagggcatcatatccgatactcagtgcaggtgggtggcctcagctaccgtccacgtctaacggccgtccaactgaatacatgtgcagtctctttgattttatagaatcaagtcgcagcggggtttccttaatatcgagtctcacagtgtgcgtgccagagacagaaaaacgaaatatccgccacgagagcggttctgctggtgaagtgaaatgtcctaacttcgacgcaattccgcctcgacgctttcgcgtttctttctgattcttcttcataagtgtccagattcccgaggcagctcccttacattcgcttttctctctcgagttgttcgttcccgaacgattctctcgatttcttctggatctacgtccttcggcgggagacccgcgctgggtctgctgctctccgcgctgcctggcctcgggtgtagagacacgctgagctttcggatttgcgtgcgcagcaaagcaccgggaaacgccgatttccagtgcacatcgttccccagagcggttagaaaggttccgaaattccggctggtgcctctagaaagagtgactctcgcctcgggactttcttgcattccgcccgccggacaaaacgaatggcatttcggcaggacacatctcgcatgcgacaggttgtcggcggaaacgggtcgagttccacttcgtcgcacgcgggtttccctgcagagcggcttgcctgaagagattggcagccgcagcaaggcgaaacgcccttggaaatgcatggtaagaggtgccatatttctcgcgggctgtgtttttgtgaaagcagctcttaatttcggtgaagacggagtgttgacggacagacacgcagacagctggcaagcaaaggtcttgtgtggcacttatcgtgtattattgcgggaccgacagctggtcaagagtgaagacatccatgaatgctttcagaagcacagcagaaactcaaaaaaataaaaaggagcagcgtggggattccggagcaccggcttctgtcgccgcccgacgcgaacgctgagtagcctgcaacaggaagatccgacgtggcgtctgcaatcaaaacctagcacgaaaagactatggcacgggagatacgaggcaaacggttcacatgtagccaccaagcaagggggaaatgccaaacatgggaatcgaagttcgttatcgctgtctccgcgtgtttgctagaacagattgagtagcgagcggcggtaggctgtggcccttaaatatccgccgacaatgggcattttataagaaaaagattgcgagaagtttgtgataaatgtatgtgagaattatgtgggtgtgtcagccaatctatccacagaacggtttctcttcatctcctggttccatcgatatctcgggggggcagcaacgatgagtcgcttttctgcgcgcaaatcgcagcagttcgctgcgttgacatcttttctccgagtagagactttgcaagtccagtgtctggcatcaggttattggtgtttccagcattgcttttgtctgatccgcatttctgaaccgatattccaatataagtggagatccgcattgtctttttggggggtacgcgaggtatcagtcgagcagggaagtcaaccgtccctatgctggagactggaagaagagacaggctcgttcatgcatcgattgcctgcatgtgaattcagccccgaacgaaaattcttttttcttttaaagagacggtgggctgaattggaatcgcgagatttttcgtcttatcatgtccgagacaccggccgcaccctccgtgtctccgtctgtggttgtgactgttcgtaacttcgttaagcagttttgtttcctccactgggatcgttttcatgtatcttttatcaaagagtaaaatacgcttctcgagtgttttctttgacgtggaggtgactcttggtgggtccgcgcatacttctcacaaccaccaccgaggcctggccaagatcgcaagcgccggaaccggaaacctctgtcgcgatacaatttaaacgtatgtgtatgtatctgtatatatatatatataatatgcatatgtcatgatccgtctacatgtgcgtatgtgtatgcgtgaaacgtagctgcgaggatatcgttcaagacactgtcactcctggtggttaccgaattacgctgcggtggagcatcgacgaaatccgacccgagtctgcgcta

SEQ ID NO: 2297 - DNA, 3657 bp, Toxoplasma gondii
ctatacatatgcaggtatatacatgtatgtgcgtatatttgtacatcctttcaggatacacgcacttgccccagtctagcgtcttcacctctggtctaacttgccctttctttcgaatgactaggcctttctctctctacttcatctacgctacacacatgcacacgcagacatttttttatttacgcgtatttgtatttcttttgtttttctggtgcaaatattttttgtgcgaacgaagcgagcggtaaacaacggtgtgagtgtccgaccttcgtgcgtaattctgaaaactgaatttttttattgctggaaagcgcctcaataagcgaatacgtcgagcgcgagcgatctgagagcgcgccgaaagcattgttggatacttgaaatattttttgcgctgcacaacgacgcagaaacagattgactttgcccctgatttgaatcaagaagcggcacgccacacaccgcagcatttcagtcatgttattgtcggtgctaccttgggcttcttttttactcagggtgtgcatagctctccagttatatacgtaccagtagagacaatatacacttataatgtgataataaccatacatggtctcacgaagatctttaggggttttaaggagtttccgagggaaggagaacggtctctccgttcaggcgaggtgcctgcgaaaatgtctgcgcggggctggagcgaaaccgtgactttgtaaaagttttgccaggcacctctccagaagtcgcgttgtttgccgtaggacttttcgccttttctgcggtgtctatcttgctgtcatacctctcttctgggacttcgtttttttcctttctctcccttccttctctcgctcctctctcttctttctctgtcttccctcgcgttttcttctctctgtttcctctctgcccttgttgtctcatatttgtcgtttttgtctctcttctctctcgctttcctcctggattcacaacgaactgtgccaagtgctcggttgctttccctccggtcttctgggtgtcgttcgttctctcagctgcctcggccttgaatagccagtgtgtttcacgcggcaaaagcatgaggcactctttgttcacgtaaatgaaattgtgaagtatgaagggccacgcgagaacctagactcgcctagacggcgagctcccccgcttcattctctgcgttcgtttgattttcttgtctcctcgcttgctgagatggcttgaagaagtctcttctcctttttctagcatttgcatgcgttcgcggcgagtgagacaatgacgaagaaaaacgtttttcggcgggcgctctgcttcccgccgtatcggccgaaaacaaaggcgctctgagaaacatcccaactgtctctccagtcttcaccgccttctccagagggacaagggccatttctgttttgatgagacgagactcgcgtcttgttcttcccctcgctctttcttctgaaaccgcttctcagtcctgagatccagggctttccacgacgaagcgaatggcctcctgtggggcgttgccgtgcccgcaagtgtctccgatgcctcgctcgcgaacgaatgttttgtctgtcttcttcgcgcctcgcgtttgcatgcgtctttccaccgtctctctgcctgtgcatcccctaaactgacaggggaaaaaaacgagaaagggagaagagaaacctatggaagttgtccctggtctgtcgtccaccagggaacgtcgaaagagaagcgagaggcgagacactcggcaccctacacccgcgacggggctccgaggcttcaagaggccttgattgctgcgagcaaggctccctagccggagacgcgctcccggcaggaacgggcccccagcggaagaaacattcgagggatcatcactgcactaggcgggaaaactttgaacgaaatcgttactctcgaacgacacgcggttcgaggcgtccacgccgatacgaccgagtgatttctggtagtcgaaagaagcaaacactcctcacggaaccccgttcgcgagcacctgatctcggtgtccgttgcctgttgggcacagtgaaattgccagttccccgaacaggccacatacctaaacggcggtgttcgttaacccatgactgcaccttttctgcccaacaagctgcaaggcactgccctgaaagctgtaaacgtacacacaccagccgcaaccagggcagcaggaaagcagcagatggcgtgccaggtcgcaagcgtatatttgaagatttcgaacacggatcatgtatatcgtgatactaactttggcagtatccttcctgctaacctcctcggtaaactgtgagttattgaaccatcctgggatcatagaagtaacggggacttatcaacgtaacgaactgtctgcgctgccacctttgcggtcgagttcccggagcgatgaattcagtcttccaatgtggctcttgaagcaccgtcggagagtttcacaaaacaccgtgcagtgagaaaagtaaaagtaattccacccatcatctgtgacttgttgggattcatgttatccacagtgagcgtggtgagcggtcacaacagaatatcaagcctaatcctaattaactgagttaaaaagtacaggttcggaacaagcattcttccgggagcaacctagtcaagaacttaagtgtcttgtcacgcgacctgtagaaaacaaaccgcgtcggagcacatctggaaaagcggtcttttatcacacatccagacccttcaaccgtaaatcaaggactcaacgtagcgagcatacgtcagtaaagtagtggctgttgagtctcccatgaaacaggagtccagcgtgtgaaccaacgctactagtgtctaaatggtcagatgccggtgcatccctgcagaaaggagaaaaagcgtctggagtcccatcctttccaggattcatttattcccttgtgtctccattttcttctctccttccttcgtctctcctttctgttttatttagactttcaaaatctgcgataccagtttctgtctgatttgggcaagtagactctgtctcggattctttgttccgggcgtcgacagcgatacaaactcagcggtggtagacgtataaggatccaaaacagtagagatcttgccgcgaaatgatcacgaaggaacgtcatctgctttatacctgaagtaaacgtcataacatgcatctactagtccttcggccttcccccctcttctgcacgccattgctaaattcctcctggatcaagtgtaggtgtaggtgaacaaattgcctgcagcgcgcctcacgtggtgcacagaagaccttttttcgagcatgtgtttgtttctttgctatctcggacctagagtaggtcgagaggcagtacgcgcaaaaccgttccagtttcttggcgagacggtcgggccactttgcatgcacaattcgaaaaaattccgcagcgcctcgcacagccccacacaactctgcagggagagctacgaccatgcgatatgccacactgcgtactacgcctgagcgccatcgcattgcaggtggggttcctacgtcgtctttttctctgttgcctggcgttcggtaacttttctgttgtgtacttttctcgattgtggtcgattgcaaacaaaccctcggcaaaa

SEQ ID NO: 2298 - DNA, 4824 bp, Toxoplasma gondii
aagaggttgtgcggcgaaaaacaaaccaaaaggctattgtcttccgaacagcacactcgtgttttgtagtagaaatcaccgtttttatcgtttcgtggttgggtgcggttaagagatagagaaggcgcacaggactaaagaaacgacatattcgatacataaacagtttcctagacgatacagatgtgaatgatggtggcagtcagagggcggggagaggctatggaatttcggtgtaaaggaacattgatgagcaggcgggtctgatagtgcaagtagaaagaaggcagagtggcgtttggtggcgatggcactgaaaattttccgttacgcgaagcagagcactgaacgctaccaagtcatgcgtaatccgaggcaacctcagaagagccggacaagtaacaaagtgctgaagataattgtgagacggaccaagaacgcggtgtatgtttcttcttgtcttggacggtgtgaacggtgtcccgtgccgtttcattcctttcgacttttctcttcttgaaagtaactgtctacgtccgtggttcacggtcagaatcacagcatgagtgtgtacatgacacccgttgctaggacgaccagcggcttcgttcgcgtcgaggaatctcgacagagttgttccattgtgtgtgttttttttttcttcctacctgaatgacgaacttgtcagcctttgtgttcttctggaaacgtggggttcgggattttcttagtgtgatctttccatctgctgttcctcagagacttctctgcctcgtgtatcaccatgactggtcctttctccattgttgaatactatgtcgttcatctcaaagctttttcttttatttcggttatggccgtcgcgcgaatgtaatccagtctgtgaaggtaggtcatagaagactgaaaggcttaaagaaacactcacaccgttttgtctagcttcgaagtctcatgggttcgtagtgtgtacaaattcggacagccgatataaagtactggactgacgctcttgcttctgtcagacagacaatgaacatgctattgtatcccccttctcgggaaaaacaccgctacggcaccagaatcaaatgtggcgggtccacagtttgagatttttatgttgtcgtcaatcgtttatacgaatggttttgttgacaaaattcatgttatatcgtttgcggcaaaaccaggtcggcccttcgaaactcaaatcacaaatagaactcggaactgcgtttttttcgacgataccggcgtataagagcgctgttggaacagagccgcttcgtggtgttcttttttcaacgttaagtgtcacggaagatcggcagagccgcatctaagaattcgaagaaaagcacttctgttctgctggtgggaaaaaatgcttcagtgatcgggctcggagaaacgcaagccttcgggccgtcatgaaagtaatggctcggacaggtcggtgtgtctgccagaaatcttgaactcggggaagctctgtattttaaaagatgtcggcccacaacttcaaataagcgacgtagtaacccacgtctttcgaacgggagctgtcccggcaaagtcacaaggatggctacagcgggatttcacctgccttatcttcggcatattgttgttgacggaagccgcggtgacataatttaataatgaagccgcctatgctaaccagttctgctaatgcagcagcaccagtgaggcgcaataaaccaaacaaacgatatcgactacgcgcaccagagacacctttcttgtgcgagtgcctgttaacgcgagcctaaagtgccatactgtgcagtgtttgacgactggttccaacaaattagcaatttgcagtagtagctgtggcagcctgcattctagaaatagacagttggaacacctcaactggctatgctgtcatcggaacagaacgtgtgcagcagtaacaagaaccggcaatacactgattgccgctatgcgacagcaactgaatccgagccgtcaaatgcctcattgattcacgcagatgcttgcactgtcgaagtagtcgttagttcagcaatatagttgtctcagcccacaactacgacgtgtcttgactagagtaaaacaatagtcagtctctgtgagtgagggttagggcattacagggttgtgtgtggaagtctgacacagcactcactgtccccttcctgactctgaaagctcgtggtactgctgacttgaatgtaaggacacggcgcgaaggggaatgttcttcagcttgctgattcctgccacacaaaggagcagtccccttgtaaggttctgcagatacctggaacctgtccaacatttgagggacgtaggtgagtcattttccaccgtttgaaaaaaagagtgaatctgagactcgtatcaaccaccaacatgcgtagccttgttgtcaccgtcaggcagtaggaatggcgttgtgtgcagagaacagtacaaaagggatatgggatgttattattactgccgcttgccaaactcaggaagcgggttccaacagcttaagcctatcgtcacgagtctcgatccttttgtgccttgtgggacaagggagttcgcgaatgctcgtcgttaaaatgccattgggccgagtatgagtgatggcagcacagggatccctgacagattttgtagtctcgagcattacctctgagctccaaaagacatgaagtgttcccgcaagaggatctggcagagcaacgcaaacctcgcttaacgagtgattcagctttcccgacgtgggcccggcggggggcagcgaaatgagatttggatgtgcgtggtaggaacacagagagatgcgacacgtgagtacgataatctccttgtaccgacaacaggtgcatgcatttctgactgggcgtcacacacgaaggggcgatttctctaggtgtttcgcatttaacaagcattcccacatctacggctcacgcttttgtcctcccggcagagcaccatgcccagtgtgttagatctgcagcgccttcgacaatacacgtgcagaaaaacgttacaagcgtcgcacgttacgagcgacgtccgcttcatctaaggtgtcgtaggaacaggaccaactcggactttttatccgtggacgtaacatgacgtgccgtccagatgagttcagagatcggtgacaggtttcccatccacggctgcatatgaacatggatatgcttttaaaaggctggaattgtcgaattcttatcggttcctgtgtgtttcgagcaaagcgagcgacactatcgcattctcgctgtgctgtggccacggcatccccgggagcagtttttccgcactaattttctgcctggaaccgtcggttctgacaggaaagcgcgagaccctaacacatcgtccatacttgctttgatgtgttgagcaagctgtgaaatcgagtacttaatagaaaaccgcgcagatcgcgaaaatcggcctcgccgacccgctgttgaaggcagacgcgccagttttcacactctgcaactgacaacagcgaagtacgctttgcgcactacttcctctcacacggttctgggcgtcgcgttgtccgctcttgctcgtaagtggctgtcgccgtccgtggggtgcaggaacagcctgtcccttaaggctttgggatttgcaagtctacgcgatttggtgtctacgttagatgaagatatctgtattagcatgcttcggcggggagagtatctttcagcccgcctatggcgctgtctccgcgtaattatgagagaggaactagaacgctgtcctcatcgtcgccagacatcctgtatgtgcccctctgccggttgccgggcgacagagtccttctctacgttgcaagttgtgctgagggagaactgaaattgtaatggattgctcagtgccttgcaaaatcgggcgcttgtgttgttcccggtctttttgtgtgttattttcccgtgttttcaccgtggtcgctcctgaagtcgcaccatgaaacaggagaacctttgtgccgccccgattcgtgaacaggtccgagtggagccagttccgtggcacgctgcggctgggtgtttcctttacttttattcttcagttgaactggggaaaaacatgcaaatctccctttgttgacgagttataggaaccactcgttctcctgagggatcatctgctcaggcgagcgtgatccgtatgcgttgtccgcgccctgacttcgcggcttttatcgtccctctatatcgcgtctggatcctcaaagaacgttcttttgtagaattgttttctccatagaaccagtggacccaccacccgggacactcctccacaagtttgggtcttttcctgagtagacggcatcttcagaagagggaactggtcgctgtgcggaccggcggtaggccggtagggcagcgttcgcggaaggacgactttcctccgcccatttccgacgctctttgagggtcatctaaagaccctgggttgtgaggcacgggacgagcacgtggagaaggactgacaagaagaatataagggtggctccggtcgtgtattcttgcactctggttgggcgtagccgttgctgaagttcggttgacgtgccggggcgagcctcgctcgggcgcagtcacttttctccattagacgttttgacgaggaatataaagcgctgtgggacttctggcttagaggttgccgcagcgtgacgaagaactgcgtccgtttagtcggaatgacgacgaacgcgtcgggagtggaagagtctctttcgtcgagcgttttcttcgggctacccctgcacaaactcgagttccctcacaa

SEQ ID NO: 2299 - DNA, 2379 bp, Toxoplasma gondii
gccttttcaaacgcgggtgcgaagttccgacatctctgaagaagagcttccagaccgaactccgatcgcatgcagtcgccgatctgcggcttctcgcgaggcaggcatgtccccctcctggccgtctctgcagggcctccgtcgcgcgagtctccccccgtttcttctcgctcggctgaggcctcaacgcgcctctctttgattccgagagacgcgggagaagaaggcacatgcagagaggacgcgggagagaacaagccgtcaattacggaggacgaggacccgaactcgagaggcaccgctgcttgcagggaggaggccgcagccgcggaacgagaaggggagacggagcctctcgcagagtcggaaggaggcatcttgttctgcttcgaacagaagaggtccgctggtatgtgggcggcagaaggaaagttgacgacagatctgagactgagaaggcgttgatggacgcgggggaagagcttcccccctttgaggcggactgacggaaggaccgttttcagaagatcttcttcatgttcgctaaagaaagagtcttctggccagaccttccacgctgaggcgcaccgctttcttgacgcctcacgcctctctccctctctctcgcgtcttttgctcgatttttcctttcctcgctcgctcgctttccgcttcgtccttcgcaaagaggcacctgtcctcggtcgtcggcggggaactcgcagccggcagaagcacagcaagtctcgcaggcgcgcgagccgcgcagctgggtgagctctcggcgacggagtttcgcggaggttccaagagacaaaaagtcagaagaaagagagagggcacacaagttccggcagccagttgccgtcgcgaagctgtctccctgagaaatgaagaaggcggttcgaggaagcaacttgaaggctggggagaactgcctgaacttgcgtcttcacctcgatctcgagcacgacaggttcagcgtcctctgcgccattttccaagagcgaaggcctgcagccttcaactgaactccgcgtttcagaaactcggatcgcctcgcgttgtggaatccggtcgaggcgtcacgggggcaggcgttgcgcaggcagttccgaacggcgcagttcagcgaaaacgccgcagtgcgacaaaaagacgaactcttcgttcagaaaagcgagtttaactcccagagtcgcggctgcgacctctcgcggctggcgaggccgtctgccgtggatcgcagaggagcggagccggcgtagcacggtggacggggaacgcagagccgctcggttgcctcggccgccgaaaatccggactggtcgggaggtcgaagcgagaggagagggtatggagaaaaggcaacgggaggaatggcacagcgcggcgagaaacgcggaaaagcttccttcgtcggccgatgcacgcgcggcgtctcgacgtatctgtcaacctgcgagaggagtcaactgggagggtgtggcgcgcgtggaatcggtttttcgtcgttttccccagaacttgacagtttcgagcgcgttttttcgagcggcgacaagcggctgttgcgcgctgcaccccacatgcaacagcgcggcggattcgccgagaaactcgagagattgtctcgtcgcatgcactctccgaagaggagcgccgcgctcctcgcctgcccaaggggcaggagtctacagagtgtctcgtcggtggcgcgacttggcggctgaacgggaaggacgttgatcgcgcgacgcgctgcgtttgcttttttccagatccttctcgagagttctcttctctctgacgctcgcttcgcgcgcttcgcgtcctcaggaagagtcgtggtatcgcaacacagagagtgcagcggtccgtcggcctctcttcctttcccggcgcgcgccctgtgcacatttttcctcggccttctcctctcgacctctgggtggattcgtcgcgcttctcctgctcgcgccgtcctactgccgagtctgtatcgcgctcgcgcgagggtcgctgttccctgagttcaggcgtctcgtcggcgaacctccgctttctcgcaatctcgaccgacagagagagacctgtgcgccagggcgctcgagcaccaacgcgaaacgccagttgacgctgaagactgccgcagcgctctcttccttgaatggttcttcggagcaggactctcgctcccgacgcgcgacctggagagcgcgctctccgtccactatctcctcgctccctcgacaccgacgcagtcgcgggtgacgccaccagcaggcgaggaaagcagaactttcagacgtagacggattgcgagatccccaagccttgctttcaccttgagatccgaccgctgctccttcgcaacca

SEQ ID NO: 2300 - DNA, 2135 bp, Toxoplasma gondii
gtttatctcttttagataggtgtggagactatgagagttgcgcagcgaagacaagctgtcgccgtctctcactcatccctgaggtgtatgtacagctgtgggagtcggtggagagggtcgtgagcgcctctttgacgctcgaaccttctctgcatcctgttgacgtttcttttccagaatggtcggattcgctgcatccgctgaatctgctggaagtcgccacggctctccggcgctgtctcggactgcagcagcgtgtacggacagtcaatcattcgttgtctgtctgctcacctgcagcagcaggccctcgagaaccgcgaggtcgtttgtggtggagaattcgcagaactggatcttgaacgcgcgccggtcgaagaggcagactccaacgacactcactcctgctccgacatttctcccgctctcaggttttccaaattccactgcacagagcacttcgtctaagtcgacttcgttcacatcaggagacaaatctgaagcgtctcccgaggcggacgcgccgccccgcgaaaaacttgaaaacatcttcagagacagagaggagaaagagaggagaggaagcgagacgcactcgaggcggcctgtcttcttctagaagagagcaagtcgactcgaggagcgacagggagagaaggacttccgaggcagacaacggacgcgacagtccagagccgcgcaggacgaggcctgagaatcgaccggtcgctctcgaggccgaaccagctgcaggacgttttgctctgcctcttccagaagaaaggaggaaaggcgagagaaaaagctccgaaaagagacactggcgaaatgccgcgaatgaaagggggagagaagacgcttgtctccagtgctctccaacgaggagacacgaggcgaccgaggaaggcgatgcggtgtgcgaggcgccttcgaaggactaggaggaggacggagagtcagaaacagcttttctcacgaaaaaacaaactcacctcacacacaggcgttttgagcggaccaagacgtcttctgtaaaagaaggttttcctcacaaacaggagactgcatgtgcacaccgacggctctccgtcctccctctgtatggccgccgggactgtctgcaggagtggaaatccgtctctgtcggttttctgttgtaattcttgcctccttgtttggatatcctcgctcggagcgaaggtcgacgacatactttcctttctcttgaagcctctttgcaggtgaaaacaccggaaaaactcctcctttttcgacgctgaaaccgggcagcgtctcgcgtgtcttctctccctccactcacatcacacacagcgtgagtgcaatcgcaaagacgccgttgcgagtccaccaggttgtgcagctctttccttcctctagagacaaacgttgcgtcttcctctttctcttttaaaggatcttcgttgactgaagctgtcactgtgcgccgccggtggctctccctccgtctgtgaagcaaagacgagacggagagaaggaaggcgcgaatccggaggaaaaatcagtctgattttgtgaggactctccgtttccgcggatgaactagtccgcgtagagcggaggcgagctcgtccagggacttccggcgtgcgcgcatgcagacaggaaaagtcaaaagttcgaggtttctgtccggcaaaaaatcgcttttctcccgttctcctcgggtgtacgtacacactcaagattcgtcagggcgccttctcagttcgtttcaaggcaggtggattcttctctgtctgggatccacgccgtttcttccgagtttctctttctttcctagattctcccacttccggcgccggcctccgcgctgtgcgcaccttttcctttgcttccttgcttctctctcgttcctgcaaagtttcttcttccgcttccatccttcctctccggcgccctgaagtcgactgacgcccccgtcttcctgccttttcctgcgcatgtacgcgcacaaattcgccgtgtcttcgtagaaaaccgtccgttcgagtgaccaggcgtctgcgtgaaggcaggtgaagggggatgtatgtttcaccggagataatgctccggtcgcgcttattggcttgctgtggtagcagaaaacaaga

SEQ ID NO: 2301 - DNA, 1620 bp, Toxoplasma gondii
tctgaaagaaacagtcgtcttcactgaattaccgcggtgaaagtaggtgactgagtggagaaagacctgggtcgcgtcgggtcgggggcgctccactggagaaagcgtgcacatgcacagcgtagggaatcgtcaaagggcggtaggtccgaatattcggcaacagattcactcattgtagcagaacctctgcgtggtcacggttggtgtcgctctccatgtcacaaaaggcgaatagttttcgtttgtcggccttctcagtgtaccgtggttgtgagaacagtgatgcggcgcagcatgctgaagaacagaaggcgatttgaaatcgacataaaccgaagttatgctgtcacacacacagcattaccaggttcatccttgcggttgagctgcgaactcggggccgtctagactataacccgtcactagtattacagcttcaccctttccctatttctacacagggcttcacggaagacatctatttccacactgaatagtgactgccaagtgccccgctacccctcattcgttattctcctagattatgtgtacgctacatgttacttgagtgggacgcaactcaactgtcgccagccgctacaacactgccagaggccgaagagcacttgaaccgacagagcaagaacgtagagcccctgagctggcgaatgcaaacatggactcgccaaaaagcgctgtcacatgaaggcaagatgatttaggatctcgtaagcacttgatcatgttatttagtcggtattactggcagtaaaacacgtttactctttgactgaagattgaatttcgcttgtgtgataatgttgtggaaagatcatctacgggcttaaatgaccagcgtgccagtaggaaactgacagtcatcgatgttccacctctcatccactgcatgttccagtttacacgagtacattgaaaatgccatccttctagtctaggggtagtcgcgggcttcgggaggctggccagaggctttcggcatcattctcgttgttttttcactcacaccttgcgtctccagtttcaaatgtggtcttcctttttgggcatgcattttttcgaataaaacgatggtgcttgcaaacagcagctctcaggtcgactgcactcgtactgtgttctttaacatttgtcgttcctcttcgtgagaccaacgcatgtctcatctggtgcgtgggtgtgttgaagtcccgttctagacccattttcggtcggggcagtcctggctttatattgcattttgttgtggtccatttcgtgaacggcggctagagcactcagcaatttgttgttgatgaggctggtcttcaaacagaaagctgccccacggttttctttcatattagactagtctcatagcccggaaatgcctcaagtatttttcataccggttttgcttcatgcatactttgcgcaatcccgcgactcctgcttgcccgccagtgcccccacttgccaggatgttgtgcttcctctcctacccaatctgtggcatgtacgcagtacactccctgtctatcatgagcggtcgtggtggacacagctgacattccagtaggttggttggctgcgtcctttagtgagagtcacagttggaga

SEQ ID NO: 2302 - DNA, 1096 bp, Toxoplasma gondii
aaggtgaaagaccctagagaaacacatgaatgtaagactgtaaggctgctaggtcagtttggtagccaaaaaccgcgaaacaacaaatattcacaagaagctggtgggatagctacaactgtggtggaattcactatcctgagacgatcaggctactctatatcggttatgtgctaggcaatgagactgatgttggtaaatcggctgtaaaatacccctattcctttgggcggagtcccgcaagtcacgtatcgttgtccaagatttatcttcatgtctggaactgcaaataaaacatgctaggaagcgtacccttgaatacgtctgtgtcgactttcagcttctcaagctgctcgcacaagaagctttcgaattcgggacttccggagtacatgttgccgacgtgtgcacgcagatggggtttccaggattgtctgttgctcagctgtgaaaagcaatcgagggtggaacctcttcgtcgttcctagcccccgaactcgatccagcccagcagagcgacgcagctgccggcgcagcggtcctttctgtcgcggaacaggggctgtgttgctctccctgctccgtttatgcaacatcaatccagaaaatgaactccgaatctggacaaattcctcgtggacgatgctggttcagggccactgcgttggtagtttcgaacgcatgtgcatagaggaccaagaatccaccagtagttgaagctcggcggcgccagcgtgctccgcagttgtctttgtaagggttcaaaagaaactggacagtggaagggaacagaaaatgcaaaccaagtcgacgacgcgttgccacggcttggagcggttggcaaggagcgagacttttaccgagagcatgcctttggccgcgagaaggggaagtccagatctcattcgaatgtgacccgcatgcacagaaagacaagatgccctctaagtagccgtcctgcgttcattagagcactgaattgtgacggaattcttcgtaatcggactgtcagcagtgaccgacatcagggaggtctcgaacatctggttccgcatgcatgtcctggcaaagctagcatcgattcagttcacctgca

SEQ ID NO: 2303 - DNA, 4862 bp, Toxoplasma gondii
atggtatcctcagtactgttcgcgccaaaagtctcgtggacggttgcggtgctgtgcgttttccagttcaagtgacactacgatgtctctgtttccaaaaggatatgccgagcaactcaagaagacatcgttgttgaggtctcgatgtacgacagacgcgtggacaacgtgtcagtgtaacagttaagcgcatgtttgtttgcggtgtccgttcgcttgacagggctaccacttggtcgtggtgtcgaatcaactcggggttcagaaagggcatacgacgctgatgtctctgacggagaagagtgacgcgctgcagcagacgttgaacgtgccgttgacggtttgcctcgcggttgctgacgactttttccgcaaaccacgaacagctgcagcctctttcatctttgctcaccttctgccacatctccaccaggtgcagtgctgtgtaagctcctctcagtgctgtacagtacggtgttcggatggtggatgggcattcgaccgagagcgacagctgtcgctcccaccggtttttttcgtcggcgatgcggcaggaaggttgggagttcccagtagcacaagtgtaggcgagaaacccaagggccagagggcaaagaacgagaaggcaaagacacccaaggatcacagtgcggcagatctgaaattcgctctgaacgtaggagtgcccttctttactccggagcagttttttcttgaacaggacgaagtgccaccaccgcttattgcgtattttgggaagggcactctccccataggttcggtacagagtggctggacgcggcacggaacgcactgggctggagtcggatccgaagttcactccgaccaacgcatactaaattctacagcagtgataacagaggcaacctccaaagtgaaactgttcgtgcctgctgagctggtgaagaacgctactccgaaccggcgaatgagggaagagcattttgggtggctgcgaggtgataaggtacgcagctcgtccgttggaagcacaggcctcactggtcccggcgtaaagtccgaaaacggtgaccgtgttacaggtggtgctgaaaacgactcaaggggattcactacggataacgctggcaacgagaccggtggtgacaagaaccgtcacgctacacagccgcaactggtaatccttattggcgctccgggaagtgggaagagcactctgacagagacagtgttcaaggattacacgtgcattcggcaggatgacctgaaaactcaagcaaagtgcgtcaaagcgtgtgaaaaggctcttagcgagaagcgcaatgtcgtgatcgacatgcaaaacgcgacatgcaaaacacgcgagccgtatatcaaactaggaaaggcactagggactcatcggatacggtgcgtcgttcttaaatggcccgaagaaatgtgcaaacatatgaatacgtacagagcgttggttggacgcgagagggcaaaacgatcacgaaacgcgctctcaactgatttcgagggacagcgacgacccaccaaacagcctagcacgcgattccgggaggaggctgttccgtcgtttgttctgaaaaatttttacagacaggtggaactgccgtccgccgatgcagaaggggtggacgatgttgttatccttgacgacgcagaacggcatttcatgtgtgaagagttctctgatgatgatgaaatggtactgtttggttctttcctcgactgagcctcaccttgaacatattcccattgtgtgtgtgctcattctttctgcttgacatgcagtcatgaaacagtgggaagactgacgcaggtcaacaaactggtgaacatggttgttgtatctaattggccaagtatagatgagccttttcttgcctgaagtgaaacacatcctaagcgtacagctacccttattgagccgtctcgtatgtcgaagcctacgaccaacacttggcttaccgtcaacagcggtcgctgagccgcagacttaatacggttgtgccgtctgtacaaacacattgccagctctgaagatggctctgaatcctgggttaacgtcgcttcggcgtgagagcctgcccaataccaacagctgtaaacacagagtttaaagccgatggcagtgcttgggcgcgcacggagcgcggaaataacaaggagttgttcttcaacacagctgagcctatgccaccgacacgaatcatcgatgaaaaccacaagcagagttatttaccagcgcaaaaattggctatttcaccgtatatattagtataccagaagattgcatcgactgttcggaggcaactcgccgctacacggaattcacagtgacaccagcaggattagggtggcgtggggggttctcgggggacaggtgttttaatcgagaaaaaaattcagaagcagaagtcctaaattcgccaatgacgtttgcgtccggtagccactagggaattctgcccgattataaagcactgggttctgtcatctgccagagtgctcccggaagtatgtacaccggccgcacctgaacactcgcaccaaggatgggagccagctggttgtccagtctgctgaagtaacgcttctgtcttttggcgcaccctccactctttccacaggcgtcttcctcaatcacagctatggaggtcatggacaggcttaaagccaggagtttctttggtttcataccgattcgacgcgtaagaaggttctactgacattgtagtacataaagcaaagggctacccaaattcagggtttgtttgtcattgcattcatccaactcctgaccggcattgcagtgtacatgtgctacaagtacctgcgtccgagtctgcattccgttgcttgctctcagcttactattttcagcgtcagtgctgttatagggtaggcgaaatagctgtgggtttctgaacaggcaataccaacataccgtaaccagggtcattggagcttatcgacgcaacactacagtggaaggattctactttgccacgttcctcgcatcaattgcattcctgatcattgctatcctcgatttcaccgatgtcgtccacatgatgccgaaagcgcctgagggagccgtatgttctcttgagaaattcgaggctgtcccctcctaacagttccatgcagacggaggccttcctacaaattgaccgagaaacgcaaaaccgaccctcatctcttcctgctcgtagatggcattacagtcatggctcattcgccgcaaacacgtcgcggctcacgcaggggggctgggcctcgaagcaggatatccagaagacactggaaacacttccattcggtatgagccaagtcattcgacccacattcagtgcagcactgccatagttctcttcagttcctcacattggtgagacggaaggcgaatcagaggaaatcagcattggcgagctaccaccggagtaagttgacagcagtttcgtatgataccagccgcgttgtcacaagctgtgctagggcgaaggaactccctacgaaggcgcagaacatggtaataacgataacgaagatgcaaaaacgacgtaagattgctccctgaatactttgagagccgtcactgtgttactctggtgacagctgttaagcttgctttcgctggcgtctttggtactctactcctgttccacctgtacttgtaagggaatcgccactgtcagcctgagcttccttaatattccatctttccccagcggctggatcattctgacatttctgatgaacaaatgcatgagtttggatgagcttacagggcagcccgagcagtaagactagattccatccgcgtttacggctcgctaggaaacaggaaaatttgtccaggttccaacccctgattcgtgacgagtagagactgcagggatgagcattggaagaaggcgtccttttatttacttgcttaaccgtattcttctgcttgtcttggatttgatcttttcctctgtttcgtgttgctttggaactggatttgactctcctttgccacatattgctctacactctgtgcgtgtctcggacactgaaggaatacgacactgtcgttcccagccgggcgctcctgtccagtgcgaaagaaggacatggctcatctagatcactgtctcgtcccgcagcaacaaacacactgttagtgcgaatagtaagggcgcagttactcagtgaaacacatgcatccttggtctgtttgcttagcttcactttgaattcgaatcgctctcggtgtgctgttgcggaccgggggggtgttggctggcagagcggcagtcgacgacccccgagcatgcgcttgcgctgccgtgaacctcttctttgagagactctgcaacgcagctctttaattcgcggcacaagatgaaacctactctgtggtgattcaacccatgcagattcacgatatgagatgcgtcttacgaagctgcttaatatctgcttgactccgggagttgtttgaagatcctcgagacaacccctgcgaacgagacctcaaacccaccctgtcttggtccctttcttactggctccctcatccgctgtcttaaaatttatgtttctgagtgacggccgttttctccccatcaaggaagttagtattccttttgacccttttttctggagaggtagataatacccagttttcccgtggctgtgccgtctttcacctagcgaacaccgcttctcccgccagttccgtgccgcaatcgaaattcaaaccaaggagatccgtgacactgaagaccaccatatctggtcagaagaaaagagtccccactaatcgtgttatatttgatcggaacgtctttcgtccctcacgcccccctcaaggtagccta

SEQ ID NO: 2304 - DNA, 4107 bp, Toxoplasma gondii
gaagggaagaactggaatgagattgcgacctcacgccagcatgcagctccggcagtacattcctcctgaccacagggttaccagaaggaacgaaggacgcaccgagacacacgaacggatcttatacgaagtgacattcggggattcgaagctcgaattcacgcgcttgcccgcgtgcaatctcgcatgtttttttttatcgcgtcacgggcaaatcgatacatcagagaagagaaagccgtgctgcataatccgtgaaagaagccaagaactgtgagtgcgctccggagtttcgctgcatgcgtgtccgtagaacaggcttaaagggagtagcagttcttcgttctctgtcaaaaggtctttgcttctcgtttctctgtgagcttactttcccaggccagtagcggggaaccgtcacttttttgtctttctgtggctcgaatttctgttgcatggggtcagcgccccgatacaaaatgctgtggacgtcggcggcagacattgtttgctgtgaagagctaaccaacagaagagaaacggagtagaacctggtgtcgtggccggattaagtcaaagaaagccattgacgcggctttcgtcattccctcctttccggcattcctcagcggtagttctctccgacccaagaccgcgatttctccggcagtgaagatccctcaacgggagaccggaagaagaacaggaacccctccccctatggttgggagtctcctaaagcctcagtgtggaaggataacaggacagcgcggtgaaacaccgagaaaaaacgcccgaacaacccctccgcggggagaaagcatggccgctcgttctttcctgcagacatgcaaacgggcgggccgtcaggacttgctgaaccacggaacggaaagacgcagcaagcgactcaccgagaagaaggaatgtatggagaacgacacgatagagaaaaagggagacgatatggaaaatagaagtcggtcgtgctgcagtagaagccggtgaaatcaaatgcgaaacgagcatgcaacacggagtagaaaacgtggcgttgtatcgcaaacaaaaattccacggtgacgaaacgaggaagacaccgcctctgacccagacttttgccccaaatgaagacttcccggaaagagtgccaatacaaacttctttggatcgaggcgcactccttttttctctggagaaaaagatttaaatgccccggagcgaaaaaaacaaaccgccaatcgccagctcagcctgcagaggactgtcgactgcatgcgggctaggtttcgagtgactgaacggcggaacgacgacggggaacagtcagtttttgcaggcactaaaagatgacatccacgcgtgaaaggagaaatttttgtcgatcctagtgacttgggcttcctaggtaaagaagtgacatgaacggagcctggcactcttctgggactgggttcgagacacttatctagggcaggtggcagcaataaagacagggcaaaaagctcgaaccgggcgggaaccgagacctctggtggtgaagtgtgacactattacttttagagaagcggcggagacgaggaaaaaggactcgtcaagactcttatgttactgcataatattcttgtgttagcggcaattcgtgctccactcaagcattcgaacccatctcttcgtcacttgtctttgctggcactccgttccgaaaacgagtttttgacctaggcgcgtctacgtcaattagctgtctggaaagaccttctgtaacaccccgtggctcttcagttttgtaagcttcagggggacatttacacccggatccgctgtcggcaggcactgcggctctgtggcacacttgcacaaccaaccttttcagctatgcgtgcaagtatcttcgagtgtctcatgagtttttcttgtcatgccaacaggtccttcagagaggcagctgaatctgccttcaggctacgcttggtcttgaagccaaaacctgtcaacggacggtgtgcagcttgccatgtttgttttggttcttggtcggtgagtgcgtgtcctctagacgtaaagacggaacgacttaatgtttacaattgtacgcatgcgaagaagcgactctgcatgatgaaatcgtgtgtacctctgtcttgcgggggaagcggaagtttgattgctgttccaaatcaggcactacggtgctcagagatcaaaggccggaggcgttttggatgaacttggacagatgcttagcgctctcactcattggaaaagtttgcgccgcttgcacattgtatgcgaatccagatcactcagtccgtcaactacgaaaaaacgcgtaaaggcagggacaagatcagcattccattatgtatgtttcagacaacatgaatggaagttatccatggagggaaatggtggaatatcttcaaccgctcatgtgctgtagtctacccaaaactgttgcagtaatggcggtaagcggcacacacaagcatgtcatatattctacggatgaatcgaaaaaaaacctttgtgtgcctggccgaggtgttttatcattgaaatcaccgctctggtcgctcgtatgatttgtcgtgtaacagctggttccctcaagaaggaatttatgtgccagggaggcctttagtttggtgaaaacaattcttaaaactctacgttctgacgggagtagcatgaagtcaaacggtagtgcaatgcagcctgtatctgttttgacgaacaaaagtagatttacatgcgtctgcccaggcaaatacataatcaaagaaaatgcacagtcatacagacaggctgagtacagggcagaagaccgtgttatttgtttggtttccggatgacggactgcagtcctagaattatccagctgcttgaggtgaagaactgtatagagatggcgggcacagttagagagaaacgcaatggcgtgctttctcaagcgacaggtgaaaggcggctcgaaggatataagcggcacccaggaggatcatggctacttttgttccaccgttacgggagatgacagggagcgtcacgcagacagaagaatgtggcggatcaaaccaacacataccccgtgacaattggtgatggaacgaccgtcgtcgttcggtactgaaatgaacttccagtgagaagctttccgcactaacgccaaagggacgtgttcactcgagctttaatcgacgatatgcgcataagattgttcttacaatgcggaacgctccagaagccagaagaagtttttactcaactctgtgatggggggagaaatataacagccccatttgtactgtgctcaagagtagaatttggtggtgatccgcttggagattccatgtatatggtgttcagttcactggatcttcagagtcgctctcttcttgcatccaagtctgggagcacgtgaattactaaagagtcagaccagctttcacgcacgacgataattacccgacaaggatgtgtgagacagctgacgacttcttgactagtggcattcagggagcgttcaaattttttgcctaccgcacccaccgtttcgaccacgagtttcacaggagagaactgagcagctcctgccacttgaaaaacattttttgccgtggggcacaaaacaaagacaaaaaagccggtcagcctaccgtgcattttttgcgaggaatggtcctgcgtccaattcgtactggagacagcacacggcggcgtctccgtctccaccgacggcggtcgagagtgcacttcgaacacttagatcagccagttcgcacgctgtcactcagtgggttgaccacgattactacatttttgcccgtccgataatcgctgttttcacttgccttctctacgtcattgtgacgattttcgtttgttagaggcagtcgccagtgcttgcacgcctggtcggctagacacttcccggcgcataggtcgcattgtatgttgattgctcgatgttcttgatggcagaacggtgcctgacaccataccaaagcctgcaccacttcctacttttcgagattgacgtcctgtcgttgtgaacgagaactgttccaggaatttcttctgttgcgcttcttcggttggtcgggacga

SEQ ID NO: 2305 - DNA, 1787 bp, Toxoplasma gondii
tgtctccttcagtcgatgtctccacttcgtctgaaccctttctttttctcgtgctgcctcttcggcgtcatttgccgctttcctctcttttttaacatctcgatcgcgtcgacagtgccgtttcattggcgcctgtggacatttccctcaaattctcgtctctcttctcctgtcgctggtggtttccctcctctaccccgtttttctgtttttttctctctctctgcacagctctttgtcttctctttctcttgtctcttcttcgctacgcttgacctcccggttctcttccaggtacacgcagccaggtagagacgttgcgctgtcttctctgttttcattgtcggggcagaggtgaagacagtaagaggggaacctaaacggagaccgtccaggtttgcgttctccgttctttccttcccttattttctgcaaactctctcaaaagccgagtgcgtcagcaagaacgaagaaagacactaagggtcaccccgtaatcgactatgagacaggaagaagatgcccatagacacgcccaaagtgcagatgaggaaccggcaaaaattgtttcccttctgttccccaccttgcgctttccttcttcgtctcttactttctctctgaaactcactgcacgaacccgagaggaaagagacgggagaaactctcgaggcgtgcagtggcaggaagaagaggtccgcggggaaacccaacgaaagtaaatagaagctctgagaaacgccgacagaaagccgaagcgctctgcaagaagtagagagaaagtgaatgagactgcctcgcgcccagccacacggagagcagggaaatggtcgggtcgaaaaacagacctagcagatggagggagcttttcgagatgcagagagacggcttttcgaggcggctgtgtagagcgaagtctcccctgttctgtcaccttttccgcgactgtttcgtcttaactcgcgagacgatgtctccttgggaagtccagagaggccaggagattgaaactgtgaatttcttccccctgttcttcttcgtgtctcccgtcgcctgttgccagcctacgcgtgcatgccgacgctggccccccatcgagacacctcgtgggacggcctgagtttcttttctggcttttacttctcgatagtcttagatcttaggtttccctgcttccttcgcttgctctcgatctgatgccctgatctccacgccacttctctccttcctttccgctgattctctcgctcctctgtcgtccatcccgcgtctgccggtctgctcgcctgcttgcctttcccgcgacttttcgctgcttcgtcggctcttgaaagaaagtgtaccttgctgcggctcccctcaacgctcctcagtccagcgtgctcgagcgttcgtatctccttgatttcttctgcccttctcctgcgtttttctcctcttctgtctcgtggcttcgccggttccctgtggtgcaacagtgacgccttgatggacggtgggcgcgaggtagaaaaagagccttctagtgtccaagactctcccgcttcctcgttggcaccataaccctttctcttaacctttcttttctttttctcccttttgaggactcaccttttgtccttccttgccgtcctcagtcccgactcttctcttcgtcaaaccttccttcctactctttaccctcgtcgtccccgtcgtcgtgacctctcgttgtcagttcctcctttcctttttcttacttccgtatctcgtgcttccatgtctcttgtcttcttcctcggccaaga

SEQ ID NO: 2306 - DNA, 3767 bp, Toxoplasma gondii
ctcctcgtttgtcctcctctgggtggtcaccacctcctcgtttcgcgaggtcccttgcttgtcgtctctgccttctcccgaggcctctcttgcttgcttttctgcgactgctcgcgcctctccgttttcgctgaggcgcctcgcggagctctccgtcccgctgccgtgcttgtgtccttcgtcacctcctttctcgccttcgcctagatcttcttcttcgtagccccgcaactggctgagctctgcgtcgacgacaaacagcctgttgctcaagccgcccgacagcggcttcgccgtgacactatggggaggcaggttacgccaggcggggacgtatattcttgccagcgaacgaacgatttccagctgtctgcggagccgctcttctgggctgtctgtacagccgaggggggcagtcagaacggagagatcgacggcggcagaggccgcgagaccactggtgtgagccgtggatggcggtgccatgtgaaagtctgtagagttcttagaagccgctgtcgatgaacctgagtgtttgggagtctcgacagcccacgtggtctgcactcgcgagttcccaggggtctcccgaggcggggctcgaattccgccttcttcgaccttcatgtcgtgtggctcttgcgagaagaaaaaaagaagaacgaagaccgaaagcaacggggaaaacgaggacgaagaggcgggacagcgagagtgtcgtgagggcgcgcctttcaggaaacaaaagaacgggggaaagaagaacttcaagagggtcacggagacagaagttttgaaggcgcctttgtcgcttgcttctgtccgtgaaggtcaccacccccttttcgtgccgggagagcggaaaaaagacgaagagtaaacaggcgcaaaagaggaaacccactcgttcttttcatatctcagcccttgtctgaactgtcactttcgcatacacttcaggtgaatgacaaccagcagtggatggtcacatgcacgaaaagaagtctcacagtgagacatgtgttcaggagacaccgtgagcgcaaggaaacttcgctctggcaaacagaggctttcaagaactacagctggatacaaactcgaagtaaatacaacaaacacagctcagagcccgttgggcgcgctgtgaccctgtacagaagttgcgagatcctcattcgtctgctgtttcttctacgcctgcttcttttcagacggccccctcgaagtggcgacccgaaaagacgcgattacttttcgttagcagcgtgcaatccagctgtggagatggagggaaagcggggaggcgacagtctctctgtaattgggaaaagtggcttttcctcaggggttttgcctcccgactgtctttctgggcacgtgcgctagctggcacactgcatgcagctctcagaagctgaccgcagacgactcggacgatggaagcgagctagtgagcaatgtcgtgaaatgtgtccactcatcgtcgctaagaagactttttctgcaagactatgagaagacttcttccatcggcgatttgcctcgttgttacagccacgtaatcctcctccatttccaagatggtttcggtgagaccgtgcggggcaggcgcgatatgtctgtgggattgtctgcggcttcttgcagacggttcttctgcctgaaggattcgagttataagagagacgagaacaagtgaaaagaatccgataaatcccatgtggagtggttttgtaacttcttctatacacgggagcactcaaaatgcaaaggcggacttgcagcgaagcggcgggtgtaagtacaccgtagcaagcccccttcgggcgttgcccctgtagtgatgttgacttgactttctcgagtttcacggactctgttgtctaacaaaaatccgtggttaagttgtgaccatgatagaactgctgccaactgtctgaagcggcaaaaggtgcttgagagtggaggcgatcttgcagggaaggttgtactgctagtttcacctggaaaccgtcggcgggccgcctggtctagacggccacatgcagaggttgggggatagccacagttcatggattcatgagacttagaaagaaaaatcaattctttcagaacgtctagaggcaaactctcgcggcgtgagtccgtagactatttcttggataaagaaccacagaccgtcggtagcttgtggtctagcggaaaggacatgaaacatgaattacacccttgcaattggagaagttcctgccaccggaagcattcctacttctcgacagcttcggtgcggagtcccaccgtcgctctagagagcccgaacagaacggttcgtcgaaggaagcgttgtatttcctgacgcatcgtgtgtctgtgcaaactggagaatagccagtgtcagtttaagacaaaagtccgaacgaaacggttctctgtcatacacgggggtggctgctagtgagcaaggtacctcatagaagcataacggcgttccctttttagtcaatgtgtttccagcggcaacgccgtattcctctacatgcttgagaactcacgtagcggtcacaaacaatcaacaatcaagaatcctttcccggctcaactttgaaggttatagcatgtgcagcgtgtcccagagcggcgatatctggtccgcatccggaggcaaatgacagtggacgcgctacggccagtcacgttcatacgcgtatgtacgctggcacccagagtccgttctactattcgtcgcttctacatttcgtgccctcattccaccttacggcaacattgcaggctctcctatttgattgtttgttctcgtttgtgtgcattcattcgcttcactagtttaaatgaacgtgacattctcttagcaccacttgaacggcgatccacacagcctgggaaggctccatggaacgatattcgctcttacctttctcaacgtgtttaacgaagaagaagatacccgattctcggctacaacaccccttgtgttggaaacactctccccatctcgccgccaggatatatatatcgaagcaccagaagccgtgtgatgtaaataattgtgtaacaggatattagccctagcctgcgatggagagaaatatcttggatgaaaggatgatggcggctaaagagagcggtgcaagcacgagctcaaaggacacgtttaagcgctctcgacttcgcttcgagtcgctgcactcttccgttccgacacaccgaaggaaaaaggagagacacagctaagcaaagtgagaacttccactggacagaaaaggggaatctctgccaaaggcaaaagttgtcaggctcggtttttctgtcttactgcgtgagtaaaagagacgttgccttacgtcggatcctgaatgtgactccagccatgtgatacagactacacagacctcttcgtttctgcaggcagcctactcgactgctgaagaaagctgaaatcgctggagtacattttcccacgacatgaagattatttcacagcggtaatggccttcacgaaatccacgttgaaactgctgtcacttgtatttgtttaacaacgagtgagtcgtcccctgcatgcaagtgagagtcgagcgacgaggaaaagcagcgggaaaaggtttgtagcgcaagtgtgtaccttacaaagtatctagacaaacagtgggaaggtgtgggtgggtttcttatcactcgaatcggaaatttcctttggatttcttggacggttgagcagacggatgccgaccagaaaactgaca

SEQ ID NO: 2307 - DNA, 3376 bp, Toxoplasma gondii
agactctccacttcctcagaaagattcaagtcacaggagtgcttcgaggccccgcaagtctggaccaggttctgaatggagaacgcctccggcggcgccaacggcgacgaagggtggaagagcacgagggcatgttgccggcggacggcagccagagcggcggggttgcgaggaaacgcggagcccgcggcgagaggttcgaggcggcagagaagcgaggactccgcaaactgctcgacggccgcgagcagcgaggggggggctgctgtccgcatctggtcgtgaaaggcctgcgtcaccgaggcatataagcaccggcactcaccgccctcatggcagcaggacggcgctcctggcgagttttcatcctgccccggcgccatgtagccacctgtggggctctgcgggcgcgacccgctcgacagctgcggcgacacttcggtggcgcctaagaccggcagggcccaccacacgcgagggcctggcaccgcgcgcatggacgcgggtgagggacagaagacgtcttctgctcttctcttggagggcgagagcggcggcctggaggagacagccaccgcgtcacgcgttcgctgcgcctcgccttcggcgcgcgggagactccacggcggccgctgacagggacgctctcgctgcatgcggtccttagtcgccgacggatcgcatgttctggcgaggcgacaaggcgaagaaagcgggctctgagagcctgttcgtgaagatacaggcgacggctcctgaggggtctctgaaggctttgggaactggagcccgagccgaagctgcgggatcgcggcagggcgcatctgaacgcggggacgctccgagaaactcgcctcggggggccctcccgtggggaagttgggagaagagacgcgatgcaagggtgaaagaccagaaagcgtagtcggtgagaagcaggcagactctttcgcccctgcttcttctcgcatagagaggccgtggggagaaggcggactcgaggcagtctctgagacgtccgccatcgtgaaaacaagactggaaactagcgggcaagaaaccgaactgcgtaaaacctgcagtcgtcgggaaggctcaggcaggcattttcaaaagactgcacagggagggaataagaactctctcacggacaagacggcagcgacgggggttaagggacaggaagaataaagatgcggggtacgcaatttgtcacagtgggatcaatcgagaagcgatgaggaaacaaagacctttctttggtctgagccggtggaggaccgccctgtgacggtcaaagaattttgattgaaaacaacggcgccgaggtggccacctcgcaagacctggagaaagtatctttgatttcttcagcaagagaaagcggcgacatctctcatcgaagaaggccacgttcagacatgttgtcttaactcagaaatacgtttacacgtcaagcggcgaaaaggaaggcggtttggtccagccttagggttttgaagcgacgccggttccgacgagaaaaaaggaaactctccatctcagccaggtaggcgaaaccgattctgaactgtttttgtgtggaaatgctcgatgcgaggaatcggcgacacggaccactatgtcgcagacgattggagggggaagaagacagatctccgcgacgcggcatatagtagtaggggcagcgtgaacaaatgagggtttggcaggtgggaagagcgacgggaaacgtgagaggacactagacggggaaggacagtcaagggttttgtctcgtgaagagaggcacaaacgaaagccttgaacaaggacgtcgctctcagttccccgtgacttcgcaacagcaagatcgggacgtggtaagaacaaagacatcaaatggcgtgacagcgcttgcgaactttgagtgaagaggcggattttgggggatttccgtcccaaacaattacgctgtcttgcaaaaggaccacgcgaaaatcgcgctctgttcggtgagccgcgtggacggacagcaagcgacggtccgcgtggcggtggcattcctttgaaccgcaggccgagcagggtcctcaagattccttgaaaagtctagacaagagaaacttgttggttcaatagcaaaggaaaaggtgcagaagccgggccatttgatcctctcaggaagcgctgcgcacatttcgacagccagcacattttcttgcgcgttctcaaccctgcctattttagacggggtttggcctctgcgtttcctgagcgaaaaagaagcgagctgcgcgagccgcgaaaaaggaaacgcggagcgattctggcgtgggaaaaaactctgttgaaggcgacagatcgcacagacacttgccctatccctccttatcagcgcgctcaaggctcaccggcactcaaggaccaaaaaccaccagacaacgcaagcacattcagccaccccctctccccccgtgcatctgaatctgagaacgctgctctctcgcaaaataagcgaaggttcggagcccctcgcgctcggcaatggcaaagttctgccagtctgcagagtcgctcggcacttgaaatacaccgtttttcaccgcaagaatgcgattccacacaagctctgcgctcagacttccacacatacttggtatggaggttttgaatagtccggacgacccagacaaaaggagagcggagcgcagtgagctggtcactgcaatccgtcgtcacgggagcaaaagcaaagagaagcatgaaccgcacagggcagagggcaaccacaccaacaacagttcgtaccgcactcggtctctttagctccgtctctgatgtttgtggcaaaggtaattctgtgtagaggatggtaatggacacctgtcagtgaacctccagagcgcacagaaagcccccccacctaaagagagggacgacccagcacgaatcaccagttagctctgaagaaaacccccctgtttcagcggagagagaagaaagtaagcggaactgagtccctcttcgcgtttcttctgtgttcggttccgagagagtgagcaggcccttacgctcgcgggtcgcgcagtcgtcgagctggcccggcttctgcccaggtgcacagcttcttggcgcatacatgtcacggcgatcgcatgcaatgcaaaaccccgttgcagtcacgggggaaaggcaccgctcttcggcggaactctggagaaaaacattcgcgaaaatctgaaaattccgttccgatccaagaacgtcgatttccacgttctggccaccgaatctcgaaaggcgccctagacaccactcctgcgcgtcggtgcggaccgtcgtaactcaaggagaagcattgctacccttttgcactcttctggctttacagaaa

SEQ ID NO: 2308 - DNA, 2224 bp, Toxoplasma gondii
gggagaccgaggagacgttcgaggattcgatgctgggataaaaatccactttcagtagtcggaaacagagtcaacaggcagagagcatttgaaagccaacacatgttttctgaagtgcacgtgctccgaatataagccgagacgacaaactgcgtttttcaaaacattcacggcgagaccaagaagtcgcttttttcctcaagtcgtgtcggtcaagccgagagaagacccgccgattcgctgctcgattttgcgtcctgatgagcccgagcggcgttgacagagtccaatctcgagtgctcagaggggcaagcacagaacaggaagaaagtggggagaaagaggtcgcaggagcttccagaaagcgtcctttccccggaggtttgctgtggtcagatgtaggcaaaaacaacgcgttgcagaaagagactgagagcttgagttctgaccctttccacgctcagttttgccgtgttgccgtgcatgcaaagccttagccgtaactagagctttttcagtccccagaaagcgctgcggtcattttcggtccagagaaacctttttcccctgttccgaggagggtgcgggaagtcctcgtctcggagacaggcttctcggcaagttgttctggagaggccgtagccactgcgagggcgactccaattgtagacgaccgtctgggcgtgtgactcactgtaaactccctcatcggtcggaagtaaagtcgtcgtcgaagcactcccgtagttgttgagagacctcgacgtgacgaccccagctgatcgttttttacggctctgagaagtcctagagacgcgaattgtcgcacaagactacgaaagcgaacacggtacttgaacagcttgttccagacacgagttctgcggatgatcgatacctctatacttggtgttcttacagacaggtcgtgaaaagcagatctttcgcatgcctagagaggctcagtctcacgacgaaacaggcgaattttacactttcagaactcgagtggtaccttctccagagaggctggagattccctctggaacgaggggggaagtcgcggaaacaaggtgtgtctcttggaggggtcggcgtcctcgcggcgaacgctggtcagacagaaaggcgttaaatcgggtggttttccagcggttacctcagactacctctgacgaccgttctttcgtgggttcctcttcgcattcaacaccctttttaattccgctctgctttttccgctctactcgagattgtggcgctgcagagggcgttcggatgtccccgttttccagagaatcacgcggaaaacgaagctgagaggaagcgcgttgcttctccgctcgccttctcgcccacgagactgcgagagtcacggactgtgtttctccgcgtagcatggaaaagctgagagttcatcgacagctaaacttggtgagttctcgtcgtttctgtcaacggagaatcgagatcatgaagtgtcgaagtcgttctccccgtttggagtgcgttagaaaaaacaaagttccagagactcacgtccctccgcgtgaggagacacgagaaatccttccgagctgggaggcgtttggcagtccacctccaacgaaatgcagtttctttctcgtctttttttccgtcgctttcttctccacgccttttctttctccatttttctctagcaagaccagcgggaacggagacacccccgtgtgccgcagctttccagtgtatgcgtctgggttttttttcgccatggcaaaagcgtgagcgattcagaaaaagattttttccgccggagagtctctcctcctttttccttttttgtttcctggggttctccaggctagggactccttcctgtctcgctgctctctctgccgccccccccccttccccccacggcttctctcagctgaagtcgctgcatctgcaagccgctatacgcgtgtcttctcacttgttcacaacggcggccattctgacagttcgagacggaggaggttcggaagaaaaaaagagaacggaaatacaacgaagtctcccgccggccctgtcctccactgacctcgccggccgcggaccgcctttccaactctctgtcttcttccctgtttcttgcgccatttcttctcctcttgttccctctctttcttccttttctccattcttacttctttctccccctcttcctcacgttctctccgttttttctccctgacaa

SEQ ID NO: 2309 - DNA, 2197 bp, Toxoplasma gondii
cgatcgatcacctctcgtctgagactgtcctgaagccttggcaaacgccgcttccttttcctgaactacgttcccctgtcgcgacaccgcctcagctgtgtcaccgcgtccgcgagagagacgcggtcctggagtccgctgcttgcgcgaagcatccgggcacctcatcgagagccgatctgtgcccacctgaagtgtgcctgttggcaacctgccctctacatctgcgccagctgcacctgctctcagtttcttcccgcgcgccagccccccgcgtttcgtctcgtcgacttgcgcgccagctgtgcgactcacttggctgctcttcttcttctcaggagtcacgcgcgagagaaaaaggagcatcttctcccagtcgacatccgccttccttcgcccttcggcgctcagagactctcctcgaggagacgcagaggacgcgtgtggctgccgcgcgcgcaaaccctcctccccgggtcccctccagccgtccccgccggcgagggagggagcctcacacccattgagccggttttcgcgcgcatcgtcagcctgcagggaaaagagcagctctgcatgcgcggcgccaacagaagctcgaggaccctctgggggctgaaccgcgggcggacacatgcaagagtagtcccagctcgcgcagcctggcggaactggggaggaaggaactcggtggggagtagaggctgctgtcgaacttcgcccagagacgcaactcggcggcgccatcagcgcaggcgcgaacggcggagtcccctcaatccgtttgagggagtgtgaggaaccgtggagaaggagtggcggcgagagagccaggagggattacttgaaggacatcacgtcgcttggcggaaatgacgaaaagggagaaaggtggaggagagcagttgctcgcgatgaaggagaagcacggaacgcggtgttcgaagagcttctgggacagcgaggagagagaaggacggtagaaaggggaagcaaaaaagaggcggacaggtcgatgtggaggcgagcacgttcaatgaagcgaacggcaaaacactacagtgataagatcctctggaaagtaacgacgggaggcgtcccggcgcctaccgaaaaccccacgggtgggggggcgtggaaggatcgcgggacgccaaaccgaaagaccgttctccacacagttcacgggcacaaaacttgcgggaaagggggaaacattcgatggatacgcacaaagccagggatgttccgatacgccaccgaaacacggaaaacacagaagtacacgaatctggagctttggtcgcggagtaaactcggaaacagagcggcaggaagggtccttgcccccccacccgggacaagaagccggttgtagcggacacgcatagaaaaaagtgagaaaatcgtgacgctcccacagccttccaagttcctcggttcagaaggacgtacagcgcgtcccaaacttggagtgtcgccgcggtttcgtcctgcagcttcctgcgcaaaatcgtcgccggaaacactgcgccaccgaccttctttgcgacagctgaccgcgattgcacgagggtgctctcgctcaaggccattttccagcaactggctttctcctctgcgccccccttccccagaggctctggagcatctcagctaccaagcgatctcagagacgaccagcctcctttgttttacgtctcgccacacacatacactctaccaaagataagaaggcaatcccaggggtacacggttctattctttatgcgcctcatgggcaaccggctgtcgagcagttctccgggggcttggcctttccccgttatgtctcgtgcaacacacattttcacctcagccacacagctgaactttgtcttctctccgtatcgctctctactcgcgttctgagtgagcggttcagccgtccccgtctatttgagtgtataaaaccggcgaaccatcgacgcgtgcgtcgtctttgtccgtgatttttttcgctgttccgtctcgctgctctctctgttctcactctcttacgctccgtggggctagctgtttctctcgctcgcgaacccagaggatggaacgcttccacttttccctttcttccgtctcccgggcttcgccggcttcgtccgcctcgcatcttcagctttttcgcctctcttcctccagattctgctccagtgtacaa

SEQ ID NO: 2310 - DNA, 1674 bp, Toxoplasma gondii
aatcttccaatcacctatttcagcaccaggatgctgttacgcacactaagaagtagtgccctgacagaagcaccacagtcaatgtctaaacgaatccaggggatttccctccggtaaaagccattggaatcaacacgattgcaagtagaaaaaacgtggctcccacagccatagaccagaacagggtcacctgaaggatggattgttttcaggagttggtataccgcgaatgctgaattcgtactgaaataaaaacggtccaccacagcagtggcgcagtcgactcgcatgtcgttgacatgtttatctgaatgtaggtgagtgaattttgtctacgtcaagcagcccagaatcgtggcgtaccccaattgtgccaatggccatccagaggaaaccaattacgagcaaaacaatttccataccgatctgtacacctaacgtctgctcgcacctttttgtgcccatttttgaaactcgactgaccgtagcatcgaagccgtaaagtttcttgaccaagttggtaatgtaggtagctggaatgctctgtaccacgcgtatgtgtgtgctgataaagagctgatgctgtgttctggatcttacaaaaaatatacatcctaagagccaccagtctacagaacgcagtcgggtgagatatggaactccgcgctcattctccgtcgccttactgagaggaacatcacactctgattttaactcgaagaggaagacaatcaagaaggacccagtcattacagaagagacactcgtgagagcgatcgcctgaagtcgacatgaaaccaaagccaaatatcgaaaaccgttcattaagacgcgtcgagtacggtagtcacgtaccgctcctggagttttcaagcagttccaagtagtgccactacacggagaaagacgtcttacggactctgaaaggttcccgcaggtggccgctgaggcgcgcctctggtggcagtgagagagtcgttgtctgtcatgttacaaaatcgctccagcttttagactggaaagcttgttcttggacgacgcttgcaatcattgccaacaaattgaagccagctgctcactctgccgcaaaactgatgatgagctgcggctattagaaattaaggtgtaaatacacctgttgcccgagttgccggcgtctgcgaacgcgtggattgcgcggaaactgttggctaaagttatatgtatctgaaagtgtttcttacatactatttctcttcaaaggggccttgtctgctagagttgaagttactccaaaacccttctttaaaggccgcagtaccaggagcaagcaagcaagctgtggacttcatgggtgtccgataggatatatctggtcactttttccacgtgcatttcggtggccgtgagtgtttttggttccgataataacatccgatcgtttgtggtctaatctgcttgtggggcatttcatcaccctctgtagtacagacgactgtttcatgaagatttgaaacgccagcgccggttaatgtcacaagcatgcgtgcatgcaaccgcgacctcacgtgataacgtagtggcagaaaagatgtccacaatagcacaacgtgattaattttttcggaacatcttggtgatgccatccttcgacgatgtaaattccaggaaaggacaggccaatcactcgcagca

SEQ ID NO: 2311 - DNA, 1743 bp, Toxoplasma gondii
ctgaatagggtcctggatcttcagcaggatgggtgcttggtgctccggctctgtcagcagtggattcgcttctccagtctctcctgcaagaaggcatctcgcgtcccctgtcggcagaggcggcggaatgaagtcaccctctggtgtgcacagacgctcgcgccctcccgcggcgacgaacggttccttcttcgaggaagaagcggcgagagacgagtgcgaagaagacgaagacatgcagaaggagggaacgggactggcgtcgcggtctgcggcggcatggtggacgacagcagggacagcctgacgcgcgagcgagaaagaagacgacgcgtctggagagagagaggaggccgaagacgcaggacacagagccgaggaagagaaggcagacggagacgacgaggaagaagagcgagagggagttgagaacatggacgaagaaaagagagacgacgaggagggaccgggagtcccggaggaagggaagaacgtcgaggcatccgacgaagacgcagaagccgagaacagagaggagcctgacgatgagaaaggagtagaagaagatggttttgtagcggcgtaggtcccggcagagaagacagacgacgcagatggaacattgcggccaaaaagcgaggaagaagtccctggaagggaaaacgggcggccggcaaacaaagaagacgaggaaaacggagacggttccatcttgacaaggcgcgcttagacgaaggggagaaacagaaagagaacttaacgcgagtcgagagtggagagaaggcgtatcaaactcggctttctgctgtgtgcttcgttgtcctggagacgaagcaaggccgcgcaaagacactgcgcgacgttggaggaaaaaagaggtcggcagcaacacgagaagccatttcccagcgaggcagggccagcagggtggaaaaaggatggcgaacgacggtaggacaagttcctagcctctctcgagtgcagtggccagacaagcagagaacgagagagaggggggaaacaccgaaatacacgcgaccaccggacagagaagaacttcaggtggacaagaaaaaaccggcgaaacgcgtgctttcctcttctccgtcctctgtgcgaaaatatggttgtgatgcgtcgcagcccgcttctcccgacacagctgaagcgcaagtctggagacgaaaagtccttccaaatgcatgcagctggctttctatccatctttggttcagggcgccttcagacgccgaacgaaaggagtgcgacgagacagagaagacgtttttcgttaacgcgcgactcaaggctatccaatgtcaagacacccggatctgcgacttctttgcactcaaaagtccaccgtcttgtttcgcttcctccggctgcgactgccattgctctgtcatcacgcctcggctgactcgcgtgcgcctccggtcgacggttcatcagcctcttctccgtcgtctgccttttgtttgcttttcatgagtggatcgatcgagagcgcatcctcttctcgctgacgcccggccttcttgaactcagggaaccggcgctaaccggagacgcccccgttgtcggtcggaattcgcggagcatcgacgcagacaacagagatcgatccacgcttcctcagcgtccgacgtccccgcaggtgcctgtttgctcgatctgagctgtaccactacggtcacaaaacaccgtcgaataaattgtcgcgcgagtcaacgccagcga

SEQ ID NO: 2312 - DNA, 2326 bp, Toxoplasma gondii
tttgcgctgtagactctcagaagccagggcgtgaacttgtttctgatgggcggaatgttgaggacaacaggtcagataatgttgggagctctaattctcggatggtatcaggacctccatggtggctcattactcccttaatattgagcaaaagttatttaggaacgatagctcaccgtcagatgtaatatatgagctgggttaagaacgtgttggggcagtttgttccctgcctatcaattaacattgtgtaaacatatacaacagaactacaatatgtgggaaacgaagcagcaatctgcatcattgaacaactctctcctcacttgctgatttgtaaaagaggattcaaatctctgtgagctttctaaaggacaccacggacgactggcgtgtgcgcaacgctttcaggaggtgaactaatcagttcgcaggagtccttgaatttctcttcgtcgatagcacatttgttgcaccggcaccattcagcggtaatttcttgctatggcgtcggaagataccggaagcgtgcctgtccctgtgtcctactactggtgttaaagagtctggcgagtgattatattcacatgtgagcctgtctaccactatctctagccttctgtctgcctccctgcttttccatccttttctgcgactccaaatgaaccgaagaaaaattctacttcccccctattcgcatctatcattccataagtcgtactcatgtccgtgtatgagtaggtgtccacctcttttgtatttttacccatccactttttcgaaagcaaatggggagtagatgcagggtccaactcgaatcggtcacgtcggtagatggcagccgccctgatcgatcctccattctctggaacatcagtgcttctgacatccgaaacatgccacccctgggttcgcgtgttggggtaaatcgagtccgggcaatcctcccgaatgagcgtctgcaaacctccacatatttatatgttgtctatgcatgtgcgtgccagtatgtacttctgtatacaaacggcagtctcgctgttaattcaagaccgttgacatcagacagaaattggctatggtgctgcccacagaagaccgtgcagcattactccaccgttggatagcgtctagttttctctctacgcccggatcttcagacttttgcgtgaagaggaatcatgtcggcacagaactgtaggagcatgactacctcatcactgtggtttcaatgcttagcgacatacttttacggcgagcagagcgtgttgtccaaacttcggtcccatcatcaactaccagaagctcgccgccttctcaaatccggcgttcgataccttgtcttttttgaacggataaaggacagagagattcccgagaatggcagaatactctgctttgctactgggtcctaccggccactcccgcttggacggcagtgtgtttcatcgactcttcgaaacgttgccgccgcctcgctcttcgtgtctcccacagacaatccggttttgttctttagttgccatgtcctccgtcaaaagccggcagcaaaatcatgaaggtcgtaggcagaccgtgtatgcaaccatgacaatactagtagacattgtctctgtacaaatggttcgcgagtcagaactgtagaacgcagatcgaatacagagggacattagagtgcccagatactgaatatcgttccagctgtttccagctcaggctccgccagatgatctattgacaagaaaagtatcctatattccagctgcgaggccagcatgtgacgcgcacgcaacgtcgacagtgaattcctcacaagttctcgattctagaagaattcactggggttcccggagcagatacgctagaagacgcatctctggcgttatgtttcgcgacggacggcaacagtccgaaagatacgaggaaaacgtaacgcgtgtctgcggtcacgagtgccggtttgtggtccgacagaccgcgtcaagggcgaatgaaaaactcgaactacgcagtcgcccgttggtagaccttctgcactgcacagaaacctctatatctgcatgatttctgtttcttgtgtttgcagaaaagatccgtgcatttatccatggatgtcgagagaaacagcaggggaagtgcgatcgctgactgagaagccgagagaggaatgagagggaaaggcgtcatgacaaacaaactgtcgggaagagtggaaaagaatcgattggcgaaggcacacccgtctctatgtttgcgggttttagagcatcttttccggggattctttcgcggcaatgctggcctcccccccgtcggttagcctgca

SEQ ID NO: 2313 - DNA, 2024 bp, Toxoplasma gondii
acgtgtttcttcagttagatgatgcggcgctaccctggtttatcggagggtaatctgagaatgtggttgacgttgtgattccacacacatgcctcaacgccgcaacttcccaagaacgctcagagaaagcagtatacctttatacacattgtcttttgtttgtggagagacttttgagcgcacttttgataccggagcgaatgttgagggactacacacctctattcggtaatgcggtcctcccctagtacttgcgacaggctttgtgaacttctcaagagatggatatcacgttcgctacggcagctaattcgcacggatgcataccgctgtcagccactattggagaggcagtgagacttctggcctggagtgaatgcgctgtatgctgcaaagtgatttgagttacggtgtgtaaccatagggtggtgtggcgctgcataggccaagtgtcttcactggcaagacccttcgccgtctaaaattatctcaactggcacactgtgaagaatctcgaaacacctgaggtacactcgagaactcgctgtgcaaggggatcggctaaacttttgatctttccatttacgtccccagcaccccgttttggaactccaggagttgaaaagagttacttttagatgactgaagaatgacctagcgcttcacttcttccaaaataacatttggttctgtgctctgtggtacacatgagactcgtgcaccgttcacaatcccgcaagccatccccagccagcctttgagccttacaaggcgacgcgtcttaaaacggtcccaaatcgaatggcgcacatctttgaggcattacccgccaaccgtcacagagcctttggcccaatcagatttgcacaaacgaggtcatgcatttttgaggatactaagagtggtgtttctttgcgtcagcgaacacataggcaagatgagtggctgcacacctatcgtccgacgaaggcatttcttcttcgaaagcactcctcattcgtaaacacaggtcaaactgagcccactttctgttttcgtgagtcgtaactctgcagaagaagagtgaccccgtcgggacctggtgatcttaatcccccgcggccaccaatattgtgaacatatgaactgaatgagtggtgtcctgcaacaaactccaagaggtgggaacattgataagccgaaagaccacatgttgatgtaggaggtgacacactgacatatacccggtgagtaaaatcagtaccccgaacggctgtatcgtacgctgcaggactgtcagcattgtcaagtccccgaatgacgtaaggccagtcgactagagctgtaccccgacgccacccgtcgctttacgttttagggttcgcttcaggatgtacgattcagtgagtttctcattctctcccatggacaccgcttatggttggtgcttcgggcaagccgtcgtcgagtcacgcacggcaatttgttggctaccagcgaggacgtaacacaatacgacaatacaaccgtactccaccggtcgtgtcccatcaactaaccagcaatgctcgtactgctgtaacgggctgcctgtctgcacggtgtcggggtcgggcacataagtgacgctaacccggctgccccccctccccagtggccggtttaggcggctcaccacatcaggccgcgaaatagtggctagtgacaaggaatggcatatgacgccataacatctcttctaattctgtaaaagcactcctttccagtggtggctgtctgctgaaaacagcgacagctgctgacctgcgagatttccgaggtctgatcggattgagagcatcgttcattgttgcctcgtgcaaaggagagtctctcggtgacctgggtttcgcagtctgtctaagccgggcttggattcaaagaaacggttctagtccacgtgcaaccgcatagttgtcggcccacttagacttgtcacaaacaggcctccgaatctgttggtgccgcgactgagttttaccgattcggctattgccgtgcagcaa

SEQ ID NO: 2314 - DNA, 1860 bp, Toxoplasma gondii
ttttaccaagcctcagtgtactcgagaagtgacagcaagtctgaacgactcgaatcggagctgcaagcgtcattccatgaagagggaaatatgtatatatatgtatatatatacatgctcatgtggttgtctggggagtgtgcggcttagggaaggcagagtaaactctcctaagtaaaagaggctggaagactcgtggactttttgcgtttcttcgttgcccctcgtctgcgtactgctgtatcgcgactaagtaacttggccacgttaccgtctatctcgcaggcgacccgagaactttctgacagtagactacccgaacaaggaagggtttgtttccgaccctttttcctcagcaagaaacagagaatcagccgaacgtttgtgctcacagataagacaaatgcgtttcattggatcccggcgaagataccggttctgagttgagattttcggtacagaccctgatccaattaccctcaccttcgatgaagggaaatgccacttgacgcgaacagtagtttctcgtttatgtttcttgtattctgtctgaaactgtaagaggagagctgttaatgatatggtggcaccgtgcctagtatgtccaaaacagtatcgtgagaagaatctgacacgcgggttgaccccagaggacccgaactcgatcactatcgtccccgatccctacatcgctggccaacagtgtgagccacaaccgcctggctcttgaaagcgaacgtcccaaattagtgacaagccacgacaaatttctaaaacaccctctctgtagcaactccagtgtggcaccccgtaccccttcggggattccgcactcgtgatctgagaaacatgcttacgtggaaaccactcacaaaagctgacacacgcacattcctctcggcgccaaacgcgtctacccattctttccagctggctacggccaaaactcctggtaggagaaatcgctactaggcaattgctggtgcgcggctctaacgcaacactactgtcaaacgcataaaacgccgaacaacagcgtggaaaccaaaacatgatgtgcatttcgaatggcagaaatgctgtctcgagaactctagcaccttcgcactcgtgccgcggcaaaaacgccagaaacgagatttctgtacaggcctactcagcgcctttctctgtcgacccgttctgctgagcgtgtcgtcttagtgcctccgcggaaagtgcaaacagctaaatttccgctttgggtgtccatacaccgcgcggctgcagttgtttgctaagaaaaatagcaaggtgcatcatagtttcatctgtctttgcaactgcctattcggtgcacccacgcggacgaccaccgtaatatgcaggtgtcttccgtggttttgtccggggttcgtcctggacgggggtgacggctaaaagaccccgtttcgcggtgaagccgcgatccaaccggcgaatcgtgaggaaaaaaatgcaccgtttttccagtcggccagaaacaagagcggcttggtttctcggtgcgatcacgccccacctccagtgggttttgccggggcatgcgttttggtggcggtggtgggaggaactagccagaaaacaggaggaactagccaggacgggggtgtggaggaaacgggttacgacgacgtgttcccctacggtgtcgcttgcagcgcgctgcgccaaggtggggaagacgcgattggtcggtcgacacaccctccactacaatcgttcttctggatttctgcccattttacgcaaagcaagaccgacctgtgcttttttgcacgcacgcgtgttttcgcatttcagagtctctggagagagtgtttcctccgtgtgtcgacaaaa

SEQ ID NO: 2315 - DNA, 1157 bp, Toxoplasma gondii
tatacttgcattcatctgtgatcctgtaactccaatgaggagcggtggaagtgcagttttccatagggttttccatagacgttccagtcccattcgttatctccacacacccaaacacgcacgcacacatgaaaatatctatgaactgcagaattagaaacgcgtggaaacatctatacacgtgagagttgagttatggacatgtgtctgggagtcttacggttggagtcacttggcggcaaggcccacaccaggaggcagagaactggaccaccttcactgaacagtcttcttcagagtcggtcactttctggaaatcttccgccttcttcacgcgctgaaaacagaccgagaccagaacaaagaatctgcatcctcttcgtcgccagagtgtccaactatgtgcttccaaaataatgcagagatactacatatgtgcgcaccaccggaaaatgcgtatacatatgcataccttgtattcgtataaatgtctccttcctcgtgtgtgtatcacagtgaatgatgcttctggtgtttgaggggtgtgttacaactcgagcgctcgacgaagactcgcaacaacgcggaaggctctgaagagacacatatttagacttgcttctcaaaagttcatcggtccaacgcattgcttttcctatgcatgcatgcacctgaatcaactcgttcaagacttacgttgacgatcgttcgaacttggaaatctccgcagaagcggttccggatgtcggcggtcgccgtttgtcgctgcaggatgccagtagcccccaaagaaaacctctgtctccatgagaagagagaggacgcagagaaagaggagaaggaattgacggaagaaaaaaaacgcgaacgaggagccagcagagtggctgcgccgcgccgaagtgccaacatagtggtctccgagtaccggtctgaggaggcggagtcaaaaaaaggcggcccaggcacacaaaattcacgtccagccggcgaaaaaaaagcaggaaatgaaagggaagcagcaattggtaagagggaattgacccagtttgaagccgtttcgccggctgacttcgcgcgttgttgggcgcgaaaagctgaacgcggcattcgttcgctgctacgggaatgagcaaagcgggtcgacagcagcgcga

SEQ ID NO: 2316 - DNA, 734 bp, Toxoplasma gondii
gtgaggcaaaggtagaccaagcgtagacaaatttggagaagaaacgcattttcagtctcatcctcaaatgcctgttttcaactcgttcctgttcacacacaaaaaggtttctttgtttcgagaaatcaatctcccccggcctcacacggtgcgcatctggtgattgctccagcatgctcttgacatcagtttaccgacggtggcagccggtcgtttttcggaaagcagcagcgctacaaaaagagagttccacattcctctgtggcttggaaagccgaggtttctccttccgccttcacgaatcgagtaaaaaaagagcactggcaagtcggggaagcgtcggcagactctctgccagcaggctcggtgggagagaacgcaaaacgagctccttcgacagacctgagcggcgttttccgccaaattacgcggagtcaagcaactccatccagcagcggcgatctgctttcttgtcactgcttgctcgtcgacaggtcctgtctgaagctatcgacagtatgttgaatacgcgagcgttaattcaagaattcatgacttttgaaacggaggtggtggatgctagaggatttgcgtgcaccgcatgatctgcctagttacttcaagtagtgctattccaaaagcaatacaagtcttatctgatagaggagtcataatcgaataccgatgctactcgccttatgcgttgcatcttctgcatttcctgcttctctcga

SEQ ID NO: 2317 - DNA, 1991 bp, Toxoplasma gondii
ggacctcatgtcgacgtaacaagacagaagaactggaccatctttcgggtgtacgtacgttgccttacagccagaagggaaatccttccacacctaccaacagtcccggaaagaggtcccgctcgacagcgggtgccgagaccacagtgactgcgtgggattcatgcagcatcccgcacctaaaaacgaaaagcggcagtggaaaggacgagttgtagcagttgaacaatttctatcagaatgatctcgatagacgctttcgaccccttcagggggctcctctgtacatgacactcgtggtatctttcattgtaagtcacgggtcccccacttttgaaagtgacgttctcaaggcgaccattcgtgggtttgacgtgttacagtgcattcttttcgttgaaaactttcagtcttctgttgggggctacacagcagaaatgtgtgtccagcgcttgatcgctactgggactttctccccctcagtctgttttcctaggaacctctgtttcctgcgtctccccgtgaacactccgaaccagcaatagaagccgcaaccgttcacgagataccttcgctactttagtagctattcggcagtatgcaacccgtgcccactcccctccccccccgtttcactgaacatcatccatatcgatcctactgtttacttaggcggctttgtgcttgagttgagacgtatgaagaaatttaccgttgtcgttctgcccgcttcacggctcctatctacgtgtagaaacgtagcggttgcgatacctacagacagagtctttcgtcgcgagtagaaccaggtcgtactgcgtaagtagaaaccctcaaaaacggacatgcaacgcggatggttggttgtcgtggccgctgaggccccagcccgcctccccacggctgtatcggtatctggtgtacaaaaaactgttaccaaatcaggtggctccctttccacggttctgaggagcaaggctgcctccggtctacgcactgtggcctgcctgaaaactagatagcgggaactgacgcacgaacttccacataccgtacgcatggcatcgacacttgttgcacgggggcagatcagatgaggataattgtatgagttctcgacactgacgctgcagaagccgacagttcctaggctaccacaaaaaagtcaatatcccacgctcaagacattgacgccaaacgggcgaagcaggaggtcgtcttcgcctgaaatggcaacctacatggcggaacgacgcacggtacgtgcgtctccaccagaccaacgatccataatttcttcatggaccatctacagcacaatatacctctccattctctcccagatgtccagggcgtcaaccagcatcgctagtcctcctgactgttggaaacaaccgtcactagtactcctgactgttggcaataactgtatcttttactcatgactgttaccaaagagcgtcgcgtgtcgcgcaagcgttcaggttgtccactttttccagaggtttctcgtgtctacgccggtgcgtgtacaaattaccccacgcacagccctgaccctgcatgcgggatgagtatgtcctcgtctcctgctttcctgtctactcagacgttgttgatgtgctgaaacgaactcgctgtgccacctgcgagatgctgcgaaggtgttgcacggattaataggcgaacgaccccacccctatctgagctggcgtcatcagcttctcgtcgcagaaggcatgtggggaggcgccatcgccaaattcggttgccgctccggcagcggtgcttgcggacgagggcgcgcatccatgatgcagcaccccgtcccgctccgctcttgttctccccaccagtcggaggcagggggggggtgggatggagacgcttgaactgaaaacaatcttttgtgttttgggcttatttttcctggttgccgttggccttgtgaatttttttgttttccgttgtttgagttccgtccgccaaaa

SEQ ID NO: 2318 - DNA, 2283 bp, Toxoplasma gondii
ccacttgtctcttccgcgcatccctatagccctcccagagacaggggtggcgccgccaccggcccgccgacgctgtcggttgcctgacttacagaggagtgtttccgacgaaaactttgcctgaaaaggagggaaaacagagaactcaggaggcggtgaaggactgtctctttcactctaggacacggccactctccgtggaagcacgtctcacgttttgtctctcgcgcccttcccggcctcgcagcgacccgttgctcccgtcccgtgtctccacctcgccagcgccctccgtccgcctcctcccgatcctctcggctgtgtctcctcgttcgccgctcgcctgtcccacaccctaaaaacctaggaatcgaactcgcagctgttctactataaacagattgtgcgcaatcctcagacacgacgagtcccagggcgacggttccggccacactagcatctgaggagatgttcaggtacgctctccccttgcacccgcgcaacttgcactccgcgctctgcttcgtccctctgaccgcacaacgcgcgttccagaaacgcaagaggccaagatcctcgcctgaaccccccgaacgcgaatgcgacatacgttcatcaattgggtcggagtcgtttcccttctctccagaaatcgtgagcgagtcttcgtcgtcgcggcgtgtctcctcgaggtcttctgcagtctcctcgccctcgttctcgcctacgtcctcctctcggccttcctgacgccctccttcgccatcatcgcgagcttcggcatcttcgtctctggaggcggcagatccctcgtctggagcctctggcctgccttccttttcagactcccagccgtagcaagcgtcccgctcctctcgctcgtggtccacgtcgctttcctcggggtctccttcatctcgcttgctcgccactctctcagaggcctggagataaggcgagtcgtcttctccatcgtactcaactggaaaagacgccgcatgcaactcccgctctcggctcacgctccgactctgcgcgacaacgagtcggccccctctctgctcaccagcctctccccacccttcgtctctctctccctccatgtactcttcctcctccagcgaggttgtcgccatcgcagacggagacgcttgcactgcgcccgagagagcgagagcggaagcgagcgaaggagaggaggaaaaaatgaaaaaagagagcgagagacggacacgaggcaggcgcacaacacagagaggcaaagaagaggcgaggtgctcggagggagggggggggtgacggtatagaaaagtcagagattgggaatagatgcggaattcgtacacgagagaatcggaaaggagctgagaaacaagcgaggagaaaaggcgcgtgaaaggagaagcgagagggtggcgggggggaagtgtcggagtaggacgaaaggtggacagaaaaagcggtctgaaaggtttccctcactgcccgatcttagggcggggaaaacagacagagggcgggaaagcaccaccggggaccagatgtatgaagaggaaaacaggcgggagaagattcaggcgtaaaacgtcaccttcccttgagatgaaaaatcctaaaaccgcgagttgagggcgaaattcgtcagttggaggggaccacacggagcgaaaagcccgcgtcgcgcacaagtaaaaaagagaaacgggaaaaaatgccacaacagcggctctgctcgtaaaaaagtagaaaagggaaatgttgactgcctaccttttcactgcgtgttgtcgactcgccctctcggtttttggccgggaaggaaaggactccgacgaaaggcgagggacgagaagattgagcgtgtgatgcattgaacaaagaagaggaaacgggaaagttgcccttgaaaagcagattatttcgacgtgcaacttcgtggaaacagcgagaggcagagagtggggtacgagggatcgccgctcctcttcgtctccccgccacacatggaaccgatgctgcgacgagttcagaaggaacttttctttcctgggccgcggagtaaaggccaccacgccgtggcttgcagaaaaagccggcagacagcttttctttcgatgtcgcatgaaggcaacataaaaaataaggagaaacggcgcctagcgcacacgcgacgaagagggtggtcagacacacacccagagacaaacagcaagggcccctgcactcctgcgcacaaagatacagaaaaggacaccgttctcgtggctaatctgttgcgtccga

SEQ ID NO: 2319 - DNA, 2031 bp, Toxoplasma gondii
cggtgttaggcaattccgccaaaaaccggtggtttgttagtatttttgtcatcaacatgtcactgaaatatcaataacgatgaaacttatttgactaccataacagcatagaagatatagattttagtacctgtaggaatagcagtcataattgtcatagctgagaagtatgctcgtgtatctacttctagacagacagtcatcatgtgatgtgcccataccagagaacgggttgcgtgtgttaaactccaactcgtcactgacgtaaagaaccccgtgtaaagtatggcaaagaactcgcatgttctcgacttcgccctctggacgagcgacaggggtatatctattggacgtaaacaacaagactgaacatccctttcctttgaaatacagtctccgtgtttgctttgtggaagctgtagtcatcaacagtgttggttgtatattggtataagcagagagccagtcccgtagaatgtctaagatagtactcattggccattctcccaaccccgttttctcgcttttgctgtgcgtagcaagacctcccgtggcagcaggtggagtgcgacggtatgtcagcgcgatattgtcactcgtaagcgtgtttgaatgctggaaaatagtgaaggaaaaccgtcagacaagctcacaagcttcgtagcgcagagtcaccacgtcagacacgtgctcagtcgttgtcagtaagcagaagcgagcattcttcgcagttgttcacttctcagggagatcttcccagctgcggattttccaacggcataaaaaagcattccaatgatggttgggacagtctggttcgatgctgcgaccgcgcgccgaaatactgtgacaacatgcgttttccgcgcatgcagccaagagatgctgtggtaggtcttggcagggaaacaactttgcgctagtgacgcctttgagaacgactagcagaaaaacacccatgtgctgagcctttggtgttgcgagcttgttggcgagtttcatttgcgaagaggctcgtgccgtttcgctttttcttcagcggaaagagtcgccttgttcctccttgcgccacttatcttgcacagtcttgctacgctgtacctcagagccaagctgagtgtcgggtattacactcgacagatgagtccaaggggctccgaagacagcctttcgctgcagaagcagaaaaaatgtttctttcgttggcggcgaaacagccagtgttttctaaggaggcagtgcgcgcttcttttttcgccgtctcttcgctctggaagcgctcgtgtctcatgccgcttcccctaactttctgactgcattgtctccaccttcatttttcttctccgcatccggtgaaatggttcttctgaaacggacatcgacgcatgcgttgtgcatacgctttgtgtctctgtgccggcagaaaggttggctctggcgacctcagctgccgcagcaagtcccagctgcgttcggctccgtgtgactgttgtaccagttcctctgtaaattcctctcttccttggctctctgtacttaaccgggaaccagaacgcttcatttcccccggccgttagcctctgtgcacatttcgtttgcggcgctgaccttttctaagccgtcacctcagcttcttcgcaggcccatgcagagctgttccgagaaattgctgcgtgttcttcccaaaccggcaacatgtatcgcttcttacttcctgtacacacatacgagcagatgcgcatttctaccgttcatcagttgtgaggtgcgacggcgcgctgggggacgcctgtataggcacaggctgtagcggttccctgaccgtatctgagttttctaggcgcccttctctcattgtttcttttcctgtaacgcctcgcgttcggcattcgcaacaaactcgcacgcggagaaggcgagaagatctgctgcgtctccaaaagtagaaacggatcaggcggtgtacatgcaactgcagagagtgctgagtcttcgtcggcaggcttcgggaaagggagaaaagcgaaacca

SEQ ID NO: 2320 - DNA, 2050 bp, Toxoplasma gondii
aataaaaacgcaactctacgccagggcacatgtacacatcgctacatgtaaatatatgtataaatatgtatatatatatatgaatatatttatatgtatatatatgtatgtgcatgtgagtgtatctgtgcgtgcgcgtatgtgtagagtgtctgcacatcttggagttgtgggagactgcagctgtgtgagggttcgggaacggcggcgtctttgtgaaacgcgttctcttcgtttctgctgtgtttcgctgaagagacgagagagtgttgtccaactgagagctcgcgcgctccagggtccgttcggcttatattcggatgagacaggcgttcccaaagagaacacctagccccctcgagcgacgcagggagaaaccggcgaagcgtgtggagagagcctttgcgtgttcgagtgccgcagggtcgttaacgcgtttctgttagagaggccccagctctcctgcgtttgcgaatggtgtcttctcagtcttgacagacatttgcttgaacactcatgcgaggcgaaactcacgcgttcctgtatccagaaagagatcttcgctggaggtgcgcggccgtacccggcgacgctgagtcacatcggcgacaaacgaagcgcacaaatacggcaccatcttctctttcctctgtctctcccgttctctcacgaactcttcttctctgtcttctcagctagtccggaggagcgcttgacgcaactccatggcccagacaccagcacaacacaaggtcgctcagacagagctcgttgcagagaggagctcccgtgtgtcaacgtggagttgtcgtcgtgactctgctggactggcccactgcttctctcggggatctaaaccagtagtccacctcgtagtatatactcccgtgaaaaagggagtttctataaacttaggaatctcattttataatgtgtaacagggagtgaactgaccacggcgcatgcaaacgctcggagagacgtgagcctccacagcactcgttcctcggagagatctcctggtcgcgactgtcgaccctctcggtctcgctcgacagattgctctttctccctctttctgcacatgtccttctcctttccttcagcgaacaaggaaagacagagggagaaactcgagaggaaggtcactggcaggcaggaagggagcatgcagagcgaaagaaaacggagagaagacagaaaaaacgagacggacgagaaaagacgaaggaagagacagagaacacgcagagactcagaaggacaccaaaggggagagcgagaagaagaggagagaaacgcgacaaagagaaaaatgagagaaataaacgacatgtgataaagccattttttcggagtgcgaagagtagaagtgtgcatgtctcgtggcaaaaagcgtgttgcccgactgcccagctgttttccctcaggagattttttgtattcgtccgcgtttctttaaacgaaaaacgcagtcgttcccctctctcaagcgaggttcttcctcctggaaacgtatcctttctctgcatgcatttgccttgggtttcttgcgaaaaaaagcgccacagaatgtgagtgtgagagagagacagcgagctgggaatacatcgaactggcgcacgagcgcctgagaacctacccaagcgtcgctgtgcgtttacactccttttccggttcccccgagtgacttcttttatttcttcatccgcgtttctcactgtaaagaaccgacaccgcgcgcgtgtatgcagcgatgaatcaaaggatccagaccatctccggtgtctctcttgtctcctctaccttcttcccttctccctcgtatcttctgcttctttcgccttccctcgctcctccctttcctctgtcttctctctcctctctctccccgctcttcgttcttttctcgctctcctcgctttccttgtcttcttctctttccttgtcttcttctctttcctcgttttcttctctgggcggtcggttcctggtttgcctgtcgcgtaacgcgctgaagatgcagaactgacctgcgcggaagagaaga

SEQ ID NO: 2321 - DNA, 2411 bp, Toxoplasma gondii
ttgagtgcccaggagtgatacaggctttgtgtgtgtggtcatgcgtcaggcgcccacgactggttgatggatctgtggaattatgtgtacttgcatttttcagtgcaagcatgttcatttagggatctcttcgtgtctgaacgtatgcgggaatgatacttgtactcgtgtggtgagatcatggctttgtccgacttagctggtccccgttttgacgcgactaaagaaatgaagcaagccgcgagggaatttggaagccgacggggagaattcgggtgatggcctgtcactgcttcgcgggcattatttatagcctttttattgaggagcgtcaagctcgccgtatcgtatactcacttgaaaagttctacaaatagtcttgtggcgacgacgaatgtgcctaccggacgatagataacccactgtacgacttgaacttcaggcggcatgtgcactccgcttacaacaagtgattgtccaaaaacgatataagcctagtgactagatggaaatcaatcatagcggtcgaagctcgcactttggtttaccccggcgattgttgtgttcgtgcgggagcgaactagaacgttttggcatctgtttaggactccggccgagacgccgttcacgcagtaaccgctggaagatgccattcaggatgtgtgttttgtcatctgctactcaagtgccacgcaacagaaagacctacgagtcgctgcctcgttttgtcgcggaaacgaatgatcgatgggagccgcaaagcgccagcagccgaccacacccttgctccactgacagtgtacgtggcataacaaacttcaaagaatcggtctggacaatccgatttttgcagagaaaatgagcagggaactgaatacgtcaaagaaaaggttaacctctgttctaatttctcggggtacacacacaggtagcgaataccaataagataacgactgaggctagacttcatttgcttgctatagccactgtcttcttcggatatgctgttatgatgatctgttcaattgttgaagctgggagaaagaatagtgccgcgaattacgacgcatgaactaccactcgagtggcacctcgacaaaacagacgcccttttaacgacggcgtttgctgcatgcgtttgcgagattcgaggcaagtaccaaagtatacttctcgtctgccgggggccattaaactcgagacggcactttccagtttgtgccacagatgcacggctgctcccggcaggagggtcacgcagtcatcgcatagctgatgtttatcgatgtttcagtgttattcaccttcaccgtgtgttctttatgtagagttgctttctacaaattgaacacggggtcgaggatgattgcttcgcatcacctggtcgccaaagggtctcccgacatgactcttaaataaccacatacacagtaccagcggtagaggtaaaactgtagaatagtcgagtattccgacatctctcaagatcttcagcgcctgtctcgcttacgcggaatgaaggatgtggttgccgctagacaatgtaggtcagactgcttcccggtagcggctaggagaagccggctccgagatgaaagtgcagtttgcgggagtttcaggaataatttgaagaaaagattacttcaccacacggtgtttttgtccaacaggaatcctggcgttctggtttcttgtgctctgaaaacaaatgcacccggtaccttgtccttatcctctctatttcggatcgctccccgatgcatccgatatccacacgtccagagcgagttacgcgaaacggcacggataggggtccggtaatgacaaccttaccgagatgcgattctccgaagtcgtacttggacatttttgcgaagttatagctgtgggctcatgagtgtctctcagaaactagctgagtgcttgcacggctcccccctcccctccccacttcattgcccattaaggtatgtagcatttcccgtgctccacagtattgcagccctctgtttgtaccgcgtgttaatggtatttttcctaaagtggaggaaaagcaggtgagcaagaggcctcctcaattgattcccacaggcgtcgtgcagaaatgaaagagcacccagcccccttgctttttcatcggcctctcacacgggtgtttgggtgggcggcgatcgatgtcgcgagacacgacgcggggtaccactgcccggaacgctgggctctatgtggagcgttgtggaagcctagcagctctgctcagtcgatcaaaccatgttgggaacgcattctttccctattttctgaagaggagacgcatcttagtgtctgacgcgtctgtgagcagagtcgttgcctgccctccccgtcagggtactcgacggaatggcgccggatctgctggattttctcaa

SEQ ID NO: 2322 - DNA, 4425 bp, Toxoplasma gondii
ctgctcgagcatgttcgtcctcagcttttcctgaagacgcacctaccctcgccgtctccattgtcctccgcgatcccctgctctcgcaaggagacgacacagtgcaggggtcggtgttgttgccttgttgtttgccgcaagattctggacagggggaacagggggggccagtcttctcaggagacggcgagcacatcgttgcctcgagcgagactcgcggctccgcgccctgctggtgcggcagcgactcttcagaggtctccgagccaggcagcttgccgcctgaggcgagggaagaaagcgaagcagaggatacagaagaagagggaagggaagaagacggagacacggaagaaaaacatacagaagagaaaggagaggaagaggaaggagaggaagaggaaggagagagagcagcgggaagagacgattggtccgtgatggtcgtcatggagagaaacaaaaggtcaggattccgtggaagtgaggaggggagatggcgcggcgagtttgtcgcctgatgcagaaaaatcaacaagatgcgcagagaacgacaaggaagcagaatatggccaagacaaaggggcggctggagagtgaaggcgaagttagaggaatgaagggaaacacagagacgactgcaggcgttgacagtggccggtgaaggaaggtgggctctgggaaagaaacggggcgagaagcatatgaagagcagagaccagagacgatgaggaacacctggagccgaaaaaacgtcgcatggaagtccgtgaagtgacaatatgcaagcacggtcttcgtgtagctggtgtgcgtgcagcgcaccgaaaacaacgcctaagagagagtggaagacgaagcgaaaaggttcgcgtcacctcttgaaaagacttccgagtccccgatctcgactggcgcagagaaagacacgatgggcggcggttgcctggcttcctctaactctgcaacggcactggaggatgtcgactctcgcacttactagcgcactgtccctcgttttggagagcgggtcgtcgagcatgtgcggtgaggatccacacagaaagttgcccaggccgacggcgtttgaatttcaagtttttgagaaactgaggaaagccgttccctgcaacgtgtaaaactgccctcgtctctgtcgcgggtgcctcacacgcgagcggtacaccgggagcgtcgcgtagtctgcgaaacggtgtgtctggctctccgtggagatagcagaaactcccggaaagatggcggaaaagagacagagaaacgccgaagaatgaggaggaaaagaaaccgctgccggacaagggaagagcgagcgcgccttttcgcacacggacgacacccctacgtgcaactttcgcgaggcgccccgtcggcggagaccggagacatgaaagcaaacaacgaggcttctgcaacagagaaagagtttttctacaggtgttagggcaagaaaagagagacgcagaaatcaagcgtggagaagacggtggaagctcaccggaagaaagtgaagcagacgaacgtcgagcagctgccctcgacactgagaatttgaggtgtacatacacccagtgagtggtcgctcgatctgcaagttcctttctggcggctttcccgcgagtgtcaacacatttgtgaaaagttcgtgctttcgctttctgaaacgccgctcctgctcacatctttcttcctcgtcggtgctgcattccagccgccgtctcctcgagaccagcaagcgcgtgtctcgaccctacgccgcttgtttgatatcggcggccgcgtcgtaccacgcgacgcgggctcccgcggaagtcgcctcgccgcaaatgccgtcctatttgacggtggaaatcgagtcagaggccacttcgtaactcattcgcagggtattgcagaaaacgcgagtcagctgacagatatgttgcggtttcttagcgatacacgggctgacgtattccgtcatcgctggagccgctgaacccgcgttggtcaccggggttgctcctcgctgtaattttcacttcatgccgcagagtccactgctttcctactggcaaaagtcctctagtttgctgcgttactgtgaatggtcgtcggtactacacgcgttaccaaggaactggaggcgcacgccgttcggagtggtaactcctgttgtgagcaggttccgcgctgattgtgtggcgcgacacagcgtttaaggttttcccgtccccataaagaagtcaccctttgctgtgaatacgtggaccagaaagagagacgagcgcgtctgtgcatgtcttcggggtcagggccctgtcgcggagcatcctcggcaggagagaagcgtgcagtcggcggcagctgtcttttcggggattttggggacatgacaaagagactttcttttcggttaaagcctgagagaacacctttcgtaaatgtggctactgctgtcttcactgtaagtggtgtcacacgagctgtctcgcatttcacactggctccagagagtcgttgcttttcagcaggaagagtctgccagcacggggagccgggtaacaccgtgtccgtgcaggatattctttttcgtgaagctaaagcttcggtttaagcgaaagtagaagccgccgcatccggacctcgccaaaaaacgcaaagcccagagggttttttctcttcccttgaaagtgtgtatttacacgcaaatccagtagaatcatcacgaatccacccgctgctgtacgttacaagacgttttttgcagaacagttccccgccgttcgtcttgattgaagatcgaccagggcatttccctcgacaaaggagtcattgtggaatgcagccttccccacaaaacatactctctacatataagacgcgggaaattcagatgtcgggactcgtctttttcgaatgcgagactctggtaggaagattgcagggtgtacgacacgagtcgttcttgcagggaaatggtttctgggagttgaggctttggcgctgctgctagagtagcgtagttggctcagaggcttttcgtgagactttcctttgtatttttttgcctgccttcttgatctgcaatgaaaacagcagacactgatgaagcagctaaccacatgcgcgcaggtggatcctccaacagacttcaaggaagcccgttgttgactagtccatatgctagagtaatcatctttcgctccccacgaaaactcatagtatcgtgacggacacacactcctacgaagggaaacggcaaagttccacttggtcaccacgaggatgacacatgcagggaaggcggaggagtcgcagaaactgaagtcgcccctcctttttcagtgcccgcctcgccattttcacaactctccatcatcgatacagccagggtctgcgagcatgtttgccgcgcgaatcagatacaatggtcacagcgtttcctaattgtgtaaacgtgtgttattttctatcaccggcatcctcgacagcgttttgtgagctcttcagcgacgatccgtgggtgtctgacgaaccccgcctcgcatctacgatcacaacttcgatgactgatgttccatcgatgtctgtcgagtacaagaactctgcaacttactgagggaagccgcgttccgattgtgaatagccggtgaaaaacgtacaaaccaccccggccgaaaaaagtttgacagctgctcgacacagaagcttttctccctaaacaggtattcgggtaagcaagtcttttctactcgagttgttcacgcgcagtacatattcactgtcgcctttaaaattttttaaatggaagggcaagagtgtgcagacgctttaggttccaacagcgcactctcacgcgttttttacatgcgacaaagttgactccgaagggaggctctccaaccgtcccgtttccagggagactggcatccgccgccctgtgttggtggcacctttccagctggggcctccagccctcaccgggaatttactggaacggtttggaacggaaagcgcacgtggaactgaaaagaaaattcgtctgctttcctttcagcgtttttcgtggatctttccatcgtttcgctggatcggcttatattcgagtaaaaacgcgagtccggcacagtcgcgctcggccccccacagtgtctgacttctcgcgtttttccccacctctccttgtcgctcttttccccccgcgcgtggctgcggcctttctctgtcgctgtccctttgctttgctggtttttctgcggctcgaatcccctgacattctctccttttttcagtccggactttcccgcttttcgccgaggcaggttccgcccccggcgccgtccttcccttccctgagaccgtacttttcgcgcttttctcgcgcgtttcgcgcttccctcgcgcccgcaaaactcctcgtcacca

SEQ ID NO: 2323 - DNA, 1175 bp, Toxoplasma gondii
ggatgcgcagtagggtaatctctcgacgagttcacttcgaaaaagattcacagaaaaaggcttgcatccgctgctccccccttgtcgtgccacgaaatggaactgcgactgccagtataacggggctcccttttcccgttcccgttcgtcactcgtcatattttgccacacctgcgattgcgtgctgtccttctctttgtctttctctgtgactctttcatttgctcctcctcgcttgacacaacgtattgacccctatatgtataattaggtaaatgtgtgtgtgtgtgtgtcaacctcacgacatggcctttcacaggcggcaaactgtagaacaccagcagacggataggcaatcttcaagtgtgtaggaaccgaagggatttcatgttgtgtgtcacgttacccagatacaggagacttgcttggtttcggtgatcggcgcacacctctacctgaagtcgaaatgcaagaagtgcattcgtgtgcaggaaatacgcactttctatagaaccgcgtggctccaagcaagatagggcatccacggctcgaacctccaggaacaaatccagcaggactcgttgtatctgacttggcttttgtaacgtcacacatatcgccggcagtgttcgttgttaaccaaggcgagacacctttcggtaaccgcggcctcagcaacgctgtacgatgactttctgtggaacaggaatgtggacctgttgagtagaggctgacggattggctgccaacagtcgcacagcatcgcgctcttttcccatctgcccccctgtgcgaatgtttttttcttatgcccctctccactagccaccaattttgtgggaaccatcagtccgataaaaagacgtctttcaaacggatcaggatcgttgccctaatcagaccctcttgttagcaaacacgagcgttttcgacgatgggacgtaagcggcgctcactggaagtatttgtttttgggtggttgtggccagaattaaataccgagttttgattctggtcagcgactttttcccatttctgccaactcaaacatgtagctgctccagtttctgctattccgtgtgcatcgccgtgtcgggaatctcgtgcgtgtgtgtcgtaacctgaaacataacgtcctccgtcatttgcatgccccgctcccccatttggcacaa

SEQ ID NO: 2324 - DNA, 2026 bp, Toxoplasma gondii
cagggctcccgccgtttccctcgaagagcgtttgtttccatttgtctccatcagcctcctgggcgccgagggagactgctgctctctgctcactgtgcgcaggagagagcgctgcattccgcgcggcgcccgcgagactcgagagaactgggaagatgcgcgcagtcgatgtgtgtcgatgtgcatcgccgccagacacaggccgcgacacagccgagtcgaacagggggagttgaatgccgaaaggcaacgacgcagttgaaggcgagggcggagaagacccagaatttggcgacagcggggcagggagactcgccattgtgtctgacggccgcaggtccaggatgcagaggaaggagaaaagcagagtcagaaccgcactccagggagatggaaggcgggaaggggatgagcggtcttctcttcagaagatgctgagctcagaggagacagactgcgttggtcacagcagaagaaaggagaagccgcgagcggaacggcaagcccggcgactgctgaagagttcgaccccgacagaagggcggcctatattcgggcagatgggaaggaaagacaccgactggaaacaggcacgagacgcctcagggacctgttacggacgtggaaagtgagaggtcggaagagagaggggggagagagggtgagagagacggagggctagaggggtaaaggagaaggacgcagaaagaaggaagagagacagaaaaggtcgaggacgggaagcaaagaagagaagacgaggaaggaaacgacgtgcggacgccgactttcgaggtaaacaacgctctcacaggtactcgaagagagagggatcgcggggagtcgcgagaccgcaactcgaaggggagagaagggaggagagggaacaaggaaggacagaggcattacatgaggaatgcagtcgccagggaggcttctcgacttacaaaaggagcgacgcaaacgggactcaagataagagcaacgcaagtcagctgtctgccagcatcgacagcaaccgtttcagagggcacagggagtctgagctgtttcgggatacagaaggagtgaaagccgcggcagagaagacggggaaagggtgaggcagaggtatgaaaagccttcagcgcattacgaagaaatcggcgatgtgtaggtttcgatgcgaagtcacgaggtgcatacacattgcatcggcttctcatctgggagaggcagccggccgcagcttgattcccggcgcaagaaaaccacagacgaaacgcggcagtctgtaatccgttggagaggaaagtgtgtgtttgagggaatgaaaagattaggaaagtgctgcaaaagccgaggccctctcaatgccaagaaaaggcgaccatttcttatcggcactttctctcaaagttgcagctcaccgagcgcggtaactggtggcgcgctcccgctacaacactccccgtccagatacggcgtttttctccgtccgtcttttctttgctttttgttcacgacacgtggttcgtttctgcttctagcggtcaacacgcggaaaaagtttacccgtgaacttctctttccggttctttgaaatgcgcggtgcgctcaagccggtcagctttgcgttcttggcttcttgcgagtcgtagacgccgagaaaaaggtccttaccgtgtttccttttccccttacccgctggcgtaaacgaagcgacggagttgctgcgttttcaatccggacgcactggctttcgtagttgtcggattccctttctttttgtcctttcttcgcttgttctgagcccgcgtggttaagtcagcgccctgaacccggtctctctgcgttcagtctcacccgaggagtgtcctattttgtggccgcggattggtttctgagtcagagaaatagccgacaaattgaccccgtgcacaacttcgactctcgcagatcccttggtttttctgccgtgactttgttcgatgcacggaccactcccggtttcctccccctttcctaaccccgtctttcgctccga

SEQ ID NO: 2325 - DNA, 3818 bp, Toxoplasma gondii
gtacgagaagcgaatcaatcgactcgacgaaccgatcgacatttacggagcgtggatcgatgcatgtgtgacggcgaacacgcaggcggctgagcaggcacagaagaaaatggggtcgaccctagagggggaagaaagtgtgttggagagcggcgttcctgtgccgtctaggaagccacgcgcttcgagagaggagagacccggcgtcgacagtggagacgacctggagttcagacggagtccagaagcctccgctgacgaagaaggcgaggcaagtgaagaggacgttccgcgaaactccgaggaaaaacgcactggaggtgctcggctgaagcgcctgcgaaaaagagaagaaagcagcgaggacgaggggagcgaccatgtcagtggcagggacactgacaatgctggtcaggaagacgccttgcgggttctgaagactctgcgggagcaacagagaaatgaagaagacgctggaagtggtcgcgatgaagctctttttgaagatgacgagtgacgatgcgtctgagcactgtgtgtcttacaaacgccacgctatcaagttcctctttcgtttgttcaggctgatggaacaagttaaaatgtgcgcggaaaagtctgcctcctgcacatacggaacgaagtactatcttggatgcatagatcgacagccagcgccagcccgtgtgcgtcggcgcgtggtacacactgtttttgagagcgaggcgagaaagggtgacacaagtctctacggggtagaaaaacgggaagcacgcagtgatttcgtggcttctgtccaaacggagtaccacgcagagcgacttttggatatgtctcgtacatctgcacatcgttccaacactcgctgagaaactacctcttgtcggaagcgtctccacacagctacccttacctcagcttttaccatcgataacggtaacgaacagcggaatctgcgagtttgagttaaaccacgctgtctcgtgcgtgagggcaggtgtaatgtcgggatgaaagtcttgagtcgcggacaaaaccacagacacacgacaaaaagtcgaaagctgctctgacacggaatgttcaaatcaactagactcaggtggaaaacggcttcagacaagacgctttgactatggagtcacggagggttatgttggtggggaaaacaatttctgaaactctctggcgaccaagaagcctcacgattcaacacagttcggccagcatcgactttttcgtaggcaatggtcttctcgaggcaaagtccggaggacgcgcttcaggtactggggatgtcaacggggaaacaaactgtcacacttcggcgccgaaattgttttgactacggcagtagtgtcttgaaacaccttgtgaagctgctgtttctgctccgcgtgagcagccgctgctttcctttccgggagaaacggcaaacttgtcgatacaagcaccctttctgttatttctcattgagttctgacacgcgagtgaagtcgtcaaaaagtctcatgtggctgaatgcggcagagatcgaaagggccatcaaaacagatagggacttcgtcggacgcgtgatctgtccccatcaaaacatattctgtttaccgatcttcaacatcaccttcaaaacagctcagcagaccatggttccgcgggagtgcaggttgacacggagcagtcaaactgaactgcagtttttcactacatacctctgaggtcttctgtgtactttacagcaaaatattgctttctcatattgtaggaactgcaagactgcattgccgcagatggtttcttgcacaggggggcgctgtcagcgttagagtcacccgctgccacgagcccgccctaaaggcagcaagtaaggcgtcaccagtacaacttaggcttttcaacggataaagttctacatttctttcgcctttgcacacatttgcaatctcaacatggaatatcactgcagcagttgtttataagacgcgcaggcaactggcaagcacacattcagttctgctttcacctgcattctcagccttgtagctcctcaacgaagttgctacgtattactgtgaacggttggtcatctaggtagtctacagtttatacggtaacaggtagcacggccactttcaccaattgccatacctaatgtttgtttcacgcggtatacgcaagacaacgcactgactcttgaatcacaggctttatcctggcaaagtgtaaagaactctcccaccgccaagttagatgaacactacccactccgttgcgtctggcatgcactgggattcaagtattattcctttctctttttcggacggttgttcaaagtccacaatttgccaagaagcgtcttttatggactcgaaatctgtcttctctgccgctgcattgctgctgagttccacaccgcctgtcatggcgcgatcagcctcccgccgtctcatcggcttgcagcatttcgggcagatgcgcggacagatcatttcttggttcagcagatcggatctagcccctggagatgtcttgcggatagtgctgtttaagcaactgccggtttgagaaatggcgcagccaactccacgtccgtcactgtttctctcctccaacagcacaaatatgccgcttcgcgaggatagcattttcttggagcctcttgggaagccagaaaccttgctaaagaagctggcggtcgcaaccaggcgacagaggagagctcccgctagataagacatcttgcgcagtacaagatcaatcgagctcgcaggaatctgcctggacaagatatacagaaaagggatgcaggccgcgccggccaaccctgtcaggaaaaacctggatataagctcttgccaatgccggatgatctagactacgaccgtcagaagaaatctagtgacggcactagacgaaaagttagagttcgctccttgccgctagctgaggtcgacggaactcgtcaagctgcccagatcaagacacaccccccaacggtcgcctcactcacctccctttccccgcatgtaagcgacggctgttccctgctctctgtctagaaccacatgccagaccatcacgcttgtgtgttgctgactcacaatctgacaaaaacagcgatttatacattccttccacgctgcatgaaaaaatttgagaggccctctgcgccttcttgtgctgtctggccgattcttaaggacaacaaagctcgttcttgaggcgagtggtggctgacagccaggagaattctagacggcctgttacggacctttgtttctcattcgcatcggcacgcttatctggatcaacatgtgcactagcgtgttgctaggacttttaagcagtttccgggggcgcttcttgtgttgaagatcgaagagttgtgtatagtgcggttgcgatcttgctcgcgtttctacgaacatgctgtagctgtggccgagacactactgagaattgcttcaacatacctgggcaacatgtctacattgaacaattccactgccgaatatgggccgcagcggtaaagaaccaccagtgcctcgttgtgtcgccagtacgatggggaaacaagctttcgttgatcggtaagagtcctagctgtcgacctaaacactcgcgttttttgattcctgtgatatagtgcgtgaacgtgtttaaccagtctactgagatacaacgtcatctctgaaattcgcactgcaacccatggtgtctgtgtgtgaagcaactcagataaacaatcgacagaggaactgaggccgtgattcgatgcttgccgcgacgcagttcgtcgggatgaaacaaacactgta

SEQ ID NO: 2326 - DNA, 1854 bp, Toxoplasma gondii
ggagcagttaacgggtcctcacagcaaccgcgatcagttctgttctatcggtgcacgactgagtaggagctttccgtcgctgctatacggcgtctcatgcattcctcaatacctggaattgccatttgtcaaggtctttgttcacggtgatcccagtcctgattgtagcgaaacagcgagagcggctgaacttcctcctttttcatttccggaccttccagatctcaacaagtggtgcaacgggcaggctctcttccgcaaaaaggggtgcttgcagaaaccaaggaatcccactgtagagagcgcaaaaaacagagagtccgttaggcagctgagagggaggatgcaagcgatgtgcgaagaagacgtcgtcagagtaaaacacgcacaagtgcgtgggcatttcataaactgtaaatgtgccatctttggcgtttgcttgctaatatttcacagcgttgctttcttgcatgcggttttttcgtctgacaaaacacctcgcactgccgcgtggtggtctccaacggctgaggtgtgtttttctgaattttttctcgagctgatgaaacaaagctgcgatacgggttcacgattctgctcttcgaaacagtgacactttcgcggctcaactcagctgcattccctcagtgctatgtatatatagaagtacataaatatttatatatgtaaatagaaatatgcagatgtgaatacgcgcatatgcgggtatatacagaaataaaattatatttaaatatatgtatatatatatatgtatatatttgtgtttatcggtaggcagatcaaaggtatgtttctctgtttgctgtaggaggcccgtggtttcgtgttgcttgagtgcttctctgcttccgtcgggagaagagttgccgcagggacgagaaaggcttcccaggcaacaaaagagatgttgacacaccatgagtcagttgttggcaaactcttccgcaaacgaagatcctcgcgcttttgcatgcagtccttcgttgtgtctcctcctggttgcagttctttttttccccgttccagctctctccgagttcttcctgttcgttctcttcgtccttctgtttcgaagtctcgttcttctgctccccattttccccccaacacaacccgcgaggaacagtcgccttagttgcgccttcattttccagcaggggtccgaccgggaaaagaagcagcatctagccatggagcgtgaaggcgcctggagctctacctcgcgtaaaaactttgatgtgtctcggaaaaaacgtcttttcgaatttaggtcaaaaacgtgaagtccgtctcctggttctcgtccaccgtcccttttttctccgggggaagaaatccacactgccctcgcacctgtggcttttctcggggctgcatgcgccggagacaagcggtgtgcgtgtctgctgcttgtcgccttccacgcgtttggaccgttgcttcggcgtttctcgaaaaggactctccaagagagaacccacgacatcttttcttgctgccgtctcgccctcgtgtacgagccgccagaaggcatctttccttgcctttttgagcggttcattccctagattcgcgacaggacagccgtggagagcacggctagtctcctgtgcatttcgcggagcggaactgagcgtcctctgttgaatctgtgacctctgtcgtattggttaatggagcactcacacacagacgagtcagtgacaggcaggcggttcgtagcgccacttcacatcgtgccttcagggtatttccgcgcccaccgtctgtggagctaaagtaaaataccatctaaaaccgatggtcgattgcgacttccgctccgagcca

SEQ ID NO: 2327 - DNA, 1055 bp, Toxoplasma gondii
cagaaaaagactgtgcacaatcattcgtagacgcagaagaagtggaggagagaggtggagaagtgacagatgtttctgcgtctacgcgctctcggaatttctttttccactcgtcgctagccgggtcgagaatgtgactccattctggcttgacaacagatcgcagcaagttgtagagttcttgaagcgaaggtgaagacgcagcgacggccggagccgaaggtggcgccatcgtggaaaagaactgaaaacgacgaaagaccctcctcgtgcgttctctaaagcctgttgccctcgatgtcgaaaacaagcgattttttcagccgacattgattcgttcttccgtcaaacagcaacaactcctctctgagtagctcgaaggaggcgtgcaaaggaatatagcggcctgcaaagacggcccaaggagggttcccacgggaggaagatccaagtcgcttgtgcgctttttgttcgaatgaaagtcacgttacagcggaaggacacaccagtgacccgtctgggcgttttccatatatacatcatatattctatgtctttgttcgatttgagttagaaacgaatgtggacacacacgatgatcgcataggttgctcctgaatgaagtcttgaggcggaacgagctgctctccaaattgaagtcacgcggaagaaaaggggtggaaaagagtcttttcttcgcttttcccggtggactgcgagtcttcggaagggcgtcgttgactgacgacgaggctcctggcgtcgtgacggcgtcacgcggacgcagcgcagcggcagaactgaagcattgaaaggaacggaaagacctatcgagtccaacggggcaagaaaacggagaagaaaagggacggttccagttctttggacaaaaacgagacggggacgctcaaagttcgtgcgagaagcgccccgagagtcgaaaatcccatgacctccgccatgtgcctcaaccaaggcggtttggaaaaaattactagtacgggaaacgtttgaaggatgttcaaaggcgtttcggagggaaaggaggaagccga

SEQ ID NO: 2328 - DNA, 1964 bp, Toxoplasma gondii
ctgggttactaccggaaaagcgaactaggagcctcttcacaaagtgcctcctgatatctgcctgacaatctcggagaatggcacgagatgacagagggctgcttctttggcggtccagttcaaaaccgaccggcgaagcatatggttaaagttctttcgaagaagaggagaaatctgacgttggctgatttcgtgcggcaagaagccgggggtgcagaatgaaccatgaaaacccagagagacttcccacatacagagaggtacctaagaaagcaagtttccgctgaaattcctccctgtgatctcggcctgaagaagctcactcttttttctgtaccgtcgttgagttcatcaaagaaaactaccacacctgcgtcgacacagagaaaacatttgtgaagcaattcgccaatcccaaacccaccgaaacgtattttccgaagcagacgcagttccactctctttctccaagtatatacatgttcatatatacattgtaaacagatacaaaggtgactatgtgtgtatatacttatacttctccgtgtgcagcatttctaaaaactgaacgccgaagaactgcatggaagcagctcttcctttcgatttgcttttctccatcgtttctgcgactcgaggcacatgaatcgtgtgaccccgccgatgcaaaaggacgctgaagagcccctcgagaacgataagaaaagagacagaggtgtacaaagtgagaaaggaacggcaaagaacgaacaagaacaaagtaaagaaaacggacttcccagttttacatagaaactcgcgcaggcacagcgagcgacagcaagtgagtggtgcagctgactgaacacgaaaccggagggaacacttcaaacaagacagcactcctttagttcgtgaaggtccttgtttccctgtccccagtttcattatagtgttgctctttccattaagaggcgaccacccgacagagaaggaaacagaagaacattcttttcgtccaatgcagagcttcgaaccgaatccgggaacttttcctgggagcactgcttcctttgaattccgctacagtgcttcttccttgagcactgagacaagagcgcaggccgaagctgtgttagttatcgcatttcgttcgtagaacgtttgctcacaacaccggcgttgtcttcatagcgtgcatgctacggaaaagcagcggcatgcatcgtggacttttcaagtcgtgggtttttctcctctcgtcgtttcgtctgctttgcctttttcatcggctctccagagactcctttccatcacatttacttcctctggactgcggtttcctcgcctccggtgtggttcttttgaggtctgcggcagatccgtgcatgcggctttttttcttcggaacacccaggtgaaaagaaagcgggagaaatccagaggagacgctggaggcgacgtttccttccttctcctaaagtcggaaaccgagggaaagtttgaatgagaactccaacggttctcgttgttcggccacacagacatggcaacagatctggttatcctgtctccgtggcacaggcgacgcagcgaagatcgcagccacataaagtccctacgattccgtatatttacattcacgtatttatatagatttacagatgcctgtatctttactggactggaggaaaaccggggtggacaggagagacggaagagttccggcttccggacacagagaggtgtgacgcgaggaagacaagagcagctgcgctgagatccagagccctcggcctctacgtttcctcccttttttccgatgaagctctttttctctcgtcttttctttcattcccagcgtttgacaaggaggaggctcgctttccaccgagtctccaattcgcatttctgaaggacactcaggtagagagccttctgctcgtttcatgttcgtgactcgtgtgttgatcttcgtcacacca

SEQ ID NO: 2329 - DNA, 2172 bp, Toxoplasma gondii
ggttctgcgtcttggcgtactgccaaatgcactgcgtgacctgcggccgggacatgcgcagctctcccgcctcgtgccttttctccgaatatacggcgaagacgatttcccgcagaaggggcgacaggcgcacttcgcgaagcagcgtcgcgcgacccgcagcccgctgggcggcggtcggcctccggcgcctgcgcgaggccttcccctttcttctgcgtgtctttcgacgtcgcggcttcttcaccgccggtgggacatggaagtcaccttccttcttgcaggccgaggctcccgaacgcggtttcccaagctgctgcgccgcacgaactcgcgccaacgctgcctgcttgtctgcccgacatgtccacgccgtcgtcttggaagaagagccagatgaagagacagaggactgggggcaagatttgatgagcttcgtgagtggggtctcggacttggggcgggagaagagacaggaggagacggcaggtttcgtttcgctttttttcacaggtggaagagagtgggaggagctccgggtggcgctgcacgcctgccggccgccctctgctttcgggcgtctcttttcctccttcatttcgctcttttcgagcagtactgctctcttagctgcgagaaaagaggcagagagtgcgcatgggagaagaagagggtctcttgctggtcttgctggtcctcaggacagcggagagagacacagagaaggaaaatgcgtggtggctgatgtctacttcctgaactccgccccaatctttctcgttgaggtcgctcgacaaaggcctagggcactcatccaagtcttctctctcttctcagtgtctggcgtcggcgacagacagttccctcgccatgccgtctgcgccctgacagtgacgtttcttcttttctgtctcttctccccgtttccgcttcttctctccacacggggggcctcgccccctcggtgctcagccttcttctcctctccactggctcttctcctcctccacgtagcggctgtcctcttccgctcggcagcctcctcgcgcgccgccgtcgcttccgccgagccgcgctacagcggaggagtccgcgttcgacactgaaaagcaccagaaaacggtgtcctggctcgagtcaagggaatgaggaaactggaggaaagaggacgaagcgactccgagggctctcgttcctgagagtcgcccgcagaactcagaggcaggtgtgtatgtacacccgatctgccactccgagtggaagcgcgacccggcgagaagcaggagagctgttggacacagaaagcaaggagagaaactcacatagacaacacacatgtaaataaaagggtgcaatggagaggtcgctgaacaagatggaagaagcagagacagcttttccgaacgcgcgcgcgttgttgccggaacacagcgaacggctgcgtgtgactttcgcgtatttttgtctgcctcacttctgtgtcccgttcagctgctttctttttcattcggacttctcctttcacttcgactcgtttgcttctctttgctcgcttcttttctgcgctgcagtgcgtgtctttttcccgcctcgccggttttcgcgcgcagactcaccgcgccgtgcacgctgatgcgctcagatgtctcgtgaccgccttctccgctgtctctccccttcgtctctcggtgtgtctctctatctccgctgtctccttctttccaccctctcttttcagctgcccgtccccagagagagtctgtgcagcgcgagtcggtcgttctgtcgtctgcggaaggggcagggagagctgcgagcgcgcactcccagagacagggtgtctttcgactcggtcttcttcggtttttgagagacacaacggaaaccatccccattttttcgcattttcttatgcagcagctcttcacttctccgcctccgagttgcgtttccctgttgtcctccctcttctgcgagagagcgtcctccttttccagacgcgaattctcgagtccaaacctcgccacgactcggcttctgctctctgctcgcctttcgtttcctcggtctcgccttctctcttccactgccgctgcggatttcttctctccgtacttcctgtcgcgcgctcgacctgttctcgccctctgccgctgcgcttcttcgccagca

SEQ ID NO: 2330 - DNA, 4799 bp, Toxoplasma gondii
gcttcgactacggttgttaccagacgttaaaacgggcactcgcaacaccagcaggttggtatgccatcctctttcagtatcttcacacaccgcgacagcgtctgggcacgcgttgaagaaagtgcgatgccctttaacctcatcttacttgtcgtcgagcggctgagtccaccgacaaacagtttgcgcatctggagctccttgtccggttcttggggtggagagcgttgtccgtcggcgcctgcggcactggaggggtcatcggcatcagatgagggtggaggggagccgctgttttcctcctcattccgcgcgccttccctcgaatcggcgttttctccgaacgcatgcgcgacgtctccggcgtttgcgccgtccgcgggcgccgccgcaccctgctccagactctggtggttttgtccttgaagcatctgcattacttcgccagagttcggctgggcctgggcgacttcatcctcgacgaagggcagcggaatgccagagtcgtcttcgggcataccgacagcgccgttgttgtgtgagtcgaaagccattttggaaaggttgagcttgtggctcgcgacacagagcgccacgcggggggaggatgcagaacgaaagtgggatgtgcagcagagcgcggcgagtaactccgacccagacgggagacagcacaaacgccaagaacagattgcaagcgggtgagaggcggccgaaacggaacaaggacgggaacggggactgcggattcctgcagaaaaaaggaactcgtctacgtcgaagacgaaagggaagtcgaaaaaaagcggcgaaaggcaaagaaacgggggaaggtacgcgggagaatgacgaagctcgctgggacaaaacgggcgtggacgggaagatgctacgcaggctggagtggccgacaggctcttgtggaaacgtccacggcaattggaacaggagcacagaaaatggaaccgagaaaatttgaacggaagagttgccttcacaagactttgcaaaaaccaaaaaagttgggatcgacgagaaaagtgctacagagagtttctccccacgcacccggtacggtgttggagggaacgggaaacgctccctttgaagagcgaaaagacaccgcaaacgtcaaacgtgaatcggtaagggtctaaaagaaaaggacagaaaacacacagagagatctcccctttatggatatcagcacacgtgaccctacattactccagctgtagccttttccgaagtccaacagttcccctctctaggaggccgcgggttggcgtcctacggtccgagtcccgctcttccttttcgaacgcgacacccttcttcccatataagcctgtattttttttactacatagcccgtttctagaggcgcagcttggatccacgtttccattgacggcccaggttttcccatagacttgcaccgtgacgccgacgactttctgctcacactaatcaaggcgttccaccggcatattttttcagcagagatcgggcgggtcgctttgttggttgcttcgccacgtctcccgagacgcaagcagcagtttcccgtagagaacgtgtgagctggctgcgtggcaattcgccgaaatatggacgcgataaacgtgaagcaaaaaaaatggcggatgggagcagacgttacccctggctacgtggaaggggattaagtgtgatgtaaaagaaacaactgatttgaagggatccagagattcgcaggcgtctctgttaggcgcttccgtattcggtcgacgaacgcgacagctctgtgcaaggaacatcatcgtcgttacgcacttgaacacatactttgccaatgattgacgatcatactctgccgaacgtaagctgcgtgacaagtaggggctcgttcttctgcaggacccgtgttcgccgacagatgaggaaaggcttttcgagaagacaagctctatacgcctgccatagtatttacattacagaaattgagtgatgtgaaattggttcgacaccttgtactgtggaagcctagctcgtagttcgagggaatatgcatacattcgggtaccaccgattacacgacgctgcacgcctgctcgctaaacgtaaatgttgtcgacggcgtcaatcataagaacgacacgtgctagtgtggctggctgaaatcgtttagagcaaagtacgttttgaagagcgcagagggaaaccgagaccgaacagaagcactcgctttccaaggcagccctccactcgtggctagaatacagcggtcttgaaaatgacgctctgtcagagctgaccgattttattcacgtttggtacaaagcagtttagaagcatattggtgtagtccactgtcctcgcggagccacttccaagcacaggagagatcgcatgtcaacgctgccgttgcacgacccttcccctccccagatcgcagggcgttttacttcccaaaatagaaggctgatccttcaggaatctgccagaagtgtatgaaacagtctggtcgcctgacaagacgggattcaaatgagcgttcgtttgtcggggttgcatgactgaaggtgcacggggaaagcaggaaaggacgaagcttccccgcttatgtgatcttgattcttttctccataggagaaaattgtcacgacaggaagccgctaaaagtagaactcccttgtcgatgttgtcctctggcaagggttgcgtgctctgggggatctgcgtgtttacactgagttggcatccccgttcacaattcaagaatggattggagcgcgcgctgtgaaggattcgtccgcagtgttttgttctccgctttctcttcggaaattttttcgcaatgtatgcatggcatcacttgactctctagggcttttcaggtgccatggaagatactcgcgagttgctcatacgtaggcacaatagtccttcacatcgtctataacccttcgaatggtgttcatctctacctttcgggcaaatccaatatcatgtggctcactggtatccacctcccagagcagagtgaccatcgattctgaagcagtacccgtggctcttgcggaaagcgcgcagactgccgaggcagaaaagcagacgtcaccgcgtgcgcaccgttgctaaacaaagaccgccagattgttgtttcgcaccgccgactcccccgaaacttcctggcgttctacaaacttcaagctcttcaagcgagtgctgaacgttgaaacgagttataatatcaccctgacagaagcattaataagcgtggcacctccctggtcctgtggctcaataacggctgctcgaccggacaaatcaagaacaccccaaacattcgaccgttgtcaatccagagaaaggtacctggaatgtctcgtgctattctgaggcggcattgcttattgcaagcgacttcatgtttcatgcaatagcttccagtcgagctcgtgtgttcggctgtacagcgggccgcctgaatactcacagaacatgtgaacaatggcgcttcgacttcttccttctgcgcgaatcactggtaacgcaactaggttatgcttcaatgacgatgtctcacaccccagtgtcgatccccctctaatacgtagtttttgtaattctcggagcctctgccaccaaaaccgtccgtctgaatctagtgcccgcagcggcctaacacatgcctaaatgtgggaaagctaactggcacagccacaagcactacttcaatatttacagtaatgtttccttgataaaaagcaattccggcctgcaggggctctgagggggtcgactggttccccccagggatgacagaaaaattggtttccagccgtcatgttcattgcaaagccaaggactcgtctgattcacccgatgaaccaggactcacgaagtctttgtttagttgctgctgcaggtcaaggagaaagacactacacaaaccagcccttggatttacaatgacgtagaggtgaatgaaagttctctttcaccactcctagtgaggcgtcactgctacagagcaccacccattttgggggtctgatgtctgtcggcttaacatgaaatctgcttcatcaaccgggcggactctcaccagctgtgcagaagcatgccgctagcagtgccggaagtggcaatgttgtggccaggtaacaatcggaaagggcatcccatcaggacgtagtgtttcctttaaaacaatgcctttcacggggaaattctgacaaaggggatcaatggaaccactccgtgaaagacaacaggagtcttgccacttgccgtgcaagacacgacgggcgggaggccttcgtcagcaatagcatcccgagcttgtttcgcttgctgaaacttccttcgcccactcctgttcccttttcgctttgttgcttccgttattgcgtcatgttacgggaaggaaaaagagtgctatttcggcgcttgcctctcgaagctgtttttgtggtccgttctcgctgcatacattggggctcctcattcccatgtatcacgtattgccgtcgtggatcggaccgtgttttcatgtccttcttgactctcctcactctgcaaggccttgaatacagtatttcgaagttgttgctttgaatgggtatgcttctcgtacacgactagacttttctgacttgccagtctcgggctagctgccgtgacttttatgctcaggacggagtgccatgtcggctgcgattagcggaatttttgcgagagacggtatcaaccacatgcctagcagaaaacgcaagcaaaactgactacaacaggacaaaaggggaagataa

SEQ ID NO: 2331 - DNA, 2904 bp, Toxoplasma gondii
agaagctcgaagaacacagtgcgctctgactcaacgcacagagacgaagagagaggcagatgtcggtaaaatggctgagagaattcattctgaatgtgtgttttcttctgaagacaagggcataagaatcaaagaaaggcttttctagaagagctgaactgtaaggcccaccatattctgaattatctgtccaggggcatgcggtgcttgtaaaaactgcgggtggctgtatgcgcaaaagcagatgtcaacagttctaattggaaagaatgcgaaacaacagtcgaaatgagaagaagcaagtgtctgtcaagtccttgccgtctccgaaaacaccggttttattgcggggatgcgtcggtggagtgcgtgatttaaagtgaagagagacctaagcgatgtcccgtgatcgcaggtgggccgtatttagtttttttcgttttttcaatcagaagtgtcgtaggaagatcgtgtatcatcatcgtggtggaacgtccacattgaggcgacaacctctcgaatactgattcatctagaggtacggtcgttgtcttgttgaaatatcggcaaccttatctatccttcacgtactcagggtatgcaatatgccactcagatgactatgaagcgagactcactggtgcacataatagaatgagatctctcggtttctattgccgccttttctctgaggaacatacactacgaaatcgacgacgacaggcttagatcgtggacgtctttgtttgccgacaaaaagttcgactttgtttctcttggcgaccatatcaactgcacggagtgttctcgtctccacagagtatccaggagtctcgcgtacaccctcggtgcagaaacacaggttccggtccttttcgaccggtgcctacggggaaagcaaagcgacagacacttctcagtgtgtggggtcacaagcataaaactatatgtatatatatgttgtagatcttgttcgatgttgttttagaatgggtagagacaaacacacacgtggtggtctaaatgcgtaggtttttgagaagcacaggacggaagaacgaagagcggtagttgcacgaggcagggaagaagcgactgccactttctcggagcgccgcttaagcatgatttccacattcgttttgatctcttgttcctttcgacagtcactggatcagctggatcgctgcctcgtgtagacgctactctcagcggtgcctcgagctgcgtgtccgacgcgtaaataaccttttcagcttcctgggtcctccagtcaactcaccgtatcatgtttttctccgaagccggattctgtgtttccgtgacagcctttctgctgccttagccgcatatatatctccctctcctttcaacatctattgctgtttgttagaccccgtatctgactcagctggatgtggttttctgcagcggttcagcctcgagaggagctttccaccttcttttctccttagtcgggctcattgcggcttactcgacaaactgcatgtctcgaatctttcgaccatcgattgtttgtatcggttctgtggtcctgttgatgcgcatccgtccgtagcttcaaactcagttgttgacacattcctacgcgtgttgccgcgtaccgtctccaaacttctagtcagatccatctatttgcgttcatatgcctaattcaaagtccagttgcatgtgtgttgatgggtttcatctttaacaatctacgcatctcaatctgtgtgtctatatgcatactgtgaggtccagctccataaatacacctctgtgctgcgagatcatggtgactcacgaaggtaggcactgatgtgccgattcatggcggtacacattgctgtgacccaaaacctaggcgcgtgtacgtgaatatctggtttctgtgttggttgagtacgccccctgaaggggcgaaaggggaacgctgcgtgagaccgaagcgacactgatgggttgtgtcgcggaacgggacttcaactagatccggcgttctttgtggaacgcagctagaaagcttaactgctgctggaagtacgaaaccagcgacttgcctccgggcaggggaagcagatgaggagcaaacaaaacaagacacaccgtccatgttctgcacagttttgggtctgtgtaaaaatcccgttcgtgagttcagaatccgtgcggggaatgttctttgcggctggtgcgcgcgaacgcccgagacggctgatattcggagaagcggcctctctccccgtccaagttgaacctccccactcggctcgcccccctgtatcgttgtggagagataaatgcatgggaagcaaaagattgctttctccggtttttccacgcaatttcagctgtatagggaggtgtttaattccaagtttttcgggttttcctcgtccccacgggtcggcacggatttgcttcagactcgaagtgaaagatccggtccaccccaactcagtccgatagtcgtttgtttctttgtttttgttgccgccggggtttcttctttataaagaagaacacttcgccgtcgctgtttttgctctcttgtcggggatttcccgtgctgtcgctcggcgtcagccgttcgaacgcctttccccccacggagaaacggctgtcttcccactgtgagtttcgggtttgaaaacccgtttctaaaagacaaagcccctttctgctttcacgtgtggtgtttttcatttctttgctgccttggctcctttccgacgctcctttagattgagacctgagtcgtggtattgacttctctccctgttccacctgagattctctgttgaccatggcccagacgcctttctcgtgttagagaatttcgcgtctatcagacggacgaacaatcaggtttctctgagagtttccgcagtggcaaga

SEQ ID NO: 2332 - DNA, 2654 bp, Toxoplasma gondii
ctgcgctaaacagtccctgttgcaataccacacctgcagcactttgggctgcccctgatttctctttgtggaaagcacggagaagaacccgcacctctaatggcaagttgcaagtgacggggagtaattcttttcactttgagatccttgctggcgtttcccgccaactcgagaacttcggcggtgaggtactcgagaatagccgatgcgtagacagccgcagtcgagccgacacgacctgcgtgcacacaagccgcggaaaagccaccgaactctcactgagtgcacacaaatgagccaaaatgtcgagacaaaaaacacacacgatcttcgtgccccccttttcccgaagaactcgcactcccgcattccaggtaaaccgtttccggccaaccacaggaagtatcatgcgccatgcacgcacacacacacagacctacgagacaatctaggtaaatccggttgtccacacactacgccttgtgtctgacaaaagacgacaaaccaccagcttcagggcacggctcccacagtttttgcggaatcggtgggagcgactcgaagtttcagaaagcacacgaattttgcgtagtatgtgcagtcagaaaagactcctgctatatgacgatgaagacttaacagagactcgattccatcgagtttggcacgtagttcgaaacccccatcgactgccggctttcgaacctctcgtccgcgacgtggacaactcgacacaaacgccacaccttatcacaacgcttttgcgaaacaacacaggactgaagacctggaaacgcacgagaggacccggtaggcagagagagtgagacacgtggaagcaactctgttgttctgaccggtccacagggcacgcgagcagcggcacaggggagcctttttttttggcgtcttcagataaagacttccgaagaccccgtgcacacaaagacgcgtctttcgggcgattcgcgtccttaccttcagagctgatgcggctcttgagcatacggtgaacgcgtccgacggggaactgcaaaccggctctggcagcgcgagaaagaggagccttcttgcctttgccgcttccactctttcccttgcctccctttcccataccaccgacctttccacccacttttcctccaacctttccgcctactttgccagctccgtccattgtgagtgtgtgagaaagagaaagaactctcaagggtggcttctgccgagaggtcggctctgcacaaagacgccaggagtcgcacgaaagcgagtcgaattctaccgttccacacccgcgacgggggactggaaaacactgcgaaacttgcgcttttgaaaaacgaacttttaaagtgcagcacgcattcagaaaagttgtcgcagacctgtgccaccctccggagtgcgtcgcactatttcctgacacgcaacatcagtccgagccaccccagcggcgcccgtccttgtcctgtcccatccgcgtgtattctgcaaaaagggggtgtagtgccgcgcgccgagagaccgtgggtgctgtggctaggaaggcgaagcgaccgcgcctctcttcgacaccgaagcgccgtgctctcgcacaacatctccgtctgctgcaaaaacgctgccagtctttccacagaaaaacctcaaatcgcaaatctccacgccaacttcggcgcatttccgccaacagagtctgctgtgcagacagacgccctttcgtaggaccaccagctctttcaaccgtttaggtgcgccgccgctgtgcggtgctatatacagcttagacgcggcaacaggactgtgtcctattacggaccgacagagaaagagaatctctagctgttcttttaaatcaacgccataaactctcctctattatattacccaccaccgccgttctgcagtgggctcagagattcaacgaagacagtacgcacgcgtttagatagcgacgaactcgaggaaacacgaagtcgacctggtgcaccaagaagggacgcccggtgccaggcacgttagctaatcacatagtacagtaagatccgaccatgatcaccgtagggctacgcttttgccgcaaaaagaccaagtctacacggttaaattctcttgtacagtgacggtttggtgttgctgcgcggtatattcactagatacaacggttcgctgtagaaggtgtaaggctgggcacacctccaggagcaccccttctctctttgcgtttttgtggaaaccctcaagccacaacttggtgaaggcatttcattttcacactcgtctacaggctcactcgtctttccgcgtttggaaggccgtcgaagggcagagttccttacacacaagccaacacattcaggaaccttgggttctcccattccccgtatataagccgacatacctcggggctttttctcggaagccgagggccgaatggacttctttgtattttggcggtacgctgtgtctgcttgaatcgcatcttctgaggcagaacgcgaatgtgggcttcagcatgcgcgtgttttcgcagagggcgtgccattgtgcgatgagctccatttttcttgctctctgtgagtagtcctcggttttcttccgaactttccccactcttttgaggccgcgaaaactccgctttcttgctatcacaa

SEQ ID NO: 2333 - DNA, 1956 bp, Toxoplasma gondii
ggctgtttccttctcgccgtcagtttctccgtcacttcctctctgtctccttctccgctcgcctgtctccgcgtctctctgctgactggcgaggcggaaacgcgcttcttctcgctctcgctgcagctgagaaatccgcttttcctgaaattcaattttcgcgcgctgcagctgaattcgcgcatgcaggcgattcacgtcgctcggcagaggactcgaagccgacgtatcctcgcaaggcactctcgacgacctcaaaggagttgacgaagaagctgaagaagaggaagaggaagcgaaaggcgaagaagagactggagggaagcgctgagaagagaagtgagatatgcgaggttcctccttgttgtcatcatcgacgacgacggcgtcctcgaaggcctccattcccccaaagcataagacagagcggagggagacgaagagaagaagaggaacaagtggaagagactgtctctgagaagagtaagaaaagcggctccgttagaccagacgaaggcgaagacgcaagaggaaacgagacgcacgcataagcggaagagagcagcgtgagtcgaagtgaggcctttgatgtcgaaggagactcacagaaagatgagaaaaaagagggaaaaccaaggagagaagagagaagagaagaagacgcgccgagacgaacaggccgcaatggagaccgaggcgctgtcgctttttagcgtaggcaaagaggagacagaagacccggaggcgcggtaaacgagagaagggggacagagggggagagagtgatgaacggattcaaagtcgagggaggatcaaaagagggaggaaagaagagaagatggaagaatccgaaaggaggaggatgaaacgctttctcgaggtgtctgacgcttctctctgctgtgcgtctcgtctccttaaattcttcttctttctgacggatcggcggaaacgttcgtgcttcttcatttccagcggtccgagacggacaactggaagagtgggggcgctttgcagcgaattaaacaaagagaaaaatgtgaaaagaaaagaagcatgtacaagacacgactcgggtggaacgagacagagaaagaggagggcgttctcgctcggatgcccccccccccccaggtgtctctctctacccttcttcgtcgaattcgaaggcgagaagacgacggagttgaagattcgagtggacgcagaactcatcaactcgatgaggcggtcttctgcaaaaaaaaacgacggtcgacgctgttggacttcttctcctcgaagcggcgaaaaaattgagcttctgtgttcgctgtcgtccgcgtgtctcctcggactgcgcatgctctatataccccctgaaacgcaggcagaaaacaagaagaggcgagagactctaacatcacctttggcccgcaaaccgtcgtccatatttcttcattttttctcctttttttgtgtttttgcagactctgttcttccgggtctccctcgtctctccttcgtggtcacctctcgcgggagaccgtgtctccggctacaccacggaaaccgcacacaagagagactcgcggctctagctccgcaaacgccgacagagaatcctttgctcttgtcgctgttccttttcgcttccttgcacctattgtctcggctcttgtcgaccatggggagaagacgttaaacccaggaaaagaaacgagccacggagcgcgagcagctcgtcaagctcaagcgacgccgcagagcagacaaggaaaaagagaaagagagaaaggacagaggccagcacggttgacgtatttcccttcccctcgtttttccttctccccgcggttccgtctgcccggaacttctcttctctcccctgtttttcctctccacgctccattcaaacgacctttttagtcaccttctgacccccgtacacgtccccctctgctgtctctcctccga

SEQ ID NO: 2334 - DNA, 4588 bp, Toxoplasma gondii
tatttgttgacagcacctgctgcactggcgaactgcgcgaaggccttcgattttgcggcgacggcgactgctgcacctcctcgcgcgtctcggctgccggcgcagggtcccccgggaagcggcggatctgttcttccttcctccctccccctcgttgtccgccctgacctcgacgacgtctctcccgtctccgcatcccctggcgacccgcggcgcttcgcgaaacctcgagcctctctcgcgccgcggtcgccacagactgtggcctgcgcttgctcctcgacgaagagtcggagcgcgtcgacgcctcgttgcagagcgaagagagagacggcgcccgcgtccacaaggcgcgtgaacacctcaggagtttgagaacttgcgccggggccgtccagctctgaactcggcgaacgtcctctccgcatgcgcagctggggaggcgacgagcagcgggaggccgcgcgaggctcgcctccgtcgcgacgagcactcgcatggctgtctgccgccggctctgcgaccagggaggctccgcgccgccttagcatcgccaaatggtcctcccacagctccgcgttgcttgtgcagagcacgacatggacaggacgaggagagtcttcgtcgccgtcgtcctccgaggctcggcggttgacggccgcgccagccagaggcggaagctgcgctcgagcgcgtccccgggggtctccgcagacatgcaggaagagcacccgcagaaaacggtacgccccgatgtgaggtttgaccgtcgttttgagggcgtgcaggacgcgttgcaggaacggctgcgaagacgtttcctcacttgttggcagcgaacgtccaggagcagaaggcgaacgctcgtcactgctcggagaggcaactggcagaaccttcgtggtcgagaccgagtcgagaacgcgtccacagagggtctggacagagacgcccagtgcggcctcgcaaagcggcgacttggcggcttcggcggcagagaagagtctcggactggaagcctcggcgacgatgcgcgcgccaacctggagcagagaagagccggggacgagaagctgcgaagtctcctcggcaagaagcttcctgccgagcagaccctggaggaggcactgcagcaaacttccccagtcgaggacgagagcgtctgcctcgacgagaaggactgaggggagagagacgcgcttcgacgtcggcagcgcgccgaggcgcgaagcagcttccggaggccgaggcgacggtctcgacatggctccggacgcagctgaagacgacaggactgcttcgagttctttttgtccgctctggaagtgccgccgcacttgaatcctcgcggcttcttcttgcagtgtcgcaagccacagcagcgggagagagaacgggcgtcctttcgcgagcccacggacggaagagagagaaaaaagaactgccgacgcgcaggcgaaacagacgaaaggcgtcgacgagacgcagggcgcgacctgcaaaggaagcagaagaagaaggagaagaagaagaaggagaagaagaaggaaaagaagaagaaggagaagaagaagcagaagaagaaccagctgcggcggccgttcacgccgacggtggagcatcgacgaggagtcgaaaactgttcaacatccgcgaggcaggaaaactgcagaaacatgcaggtcgcattgcatctctgctgcagaactctcacagaaaagagccgaagaaaagaaacactaacagcaggcgtcgctgctgtagaccaaacttcttttctcgagtgcagacgtccgacgccctcaaaccgacaaggaaggtgcctttccgccgagaccagcagtccgagagacggtacccaagagagaaaaagctccttccacggaggaaaaaatttcttttgaacagtgacttctctatacgcgaaaaggagacagcttgtcgcgcggacgcgaccgggcatgctgtgacgaggcaaacgcccttctctgtccggtttttctccagggaaaacgtacgctttttcatttgtatttctattcgccgttgaattctcaagaaacaggagacagcagactcgcggagactcagatgtacaggcagacaaagaaattgcctctttgcagctcagaagcgcgtggactcttcgacttcgttgctcttttgaaatcatgtaatcccctgacacaccgaaaaggattttaaaaaaaccgcgcacaaccttattctcttgacgcttgcaaaaaagtgcagttcgttcctttttcgtctccctccttctgtctcctctttcacgctagcggcacgcgtctccagtcctgctgcatgcggctaaggcgtttcttcgtttgtctcttcccctcgcaggctacgttcgcgaggaaatcgggagcaccctgaaatctctgaacatgaatccaccaacgaaggtgccatgccttgactctccccggaaaaggcctccttttctcccctccgaatcgagacatatctgcatctgaattttaggtgaaaagtctcacggcgcacactctccagtgtcgctaccacgagccataaacgtgaaatctttgattgtccaccaggaacaataccatttgaaagtctttaattaagagggaaaggtaattatatagtcattgaaccgctggaggaagtttttctcggaacctagcacttgaaagtctttaattaagagggaaaggtaattatatagtctttgaaccgctggaggaagtctttctcggaacctatcatttgaaagtcttttattacgaggtaaacggaggtaaggagtccgctaaaggtcttggatgtatctggagaattgtggtttagatgctcctaaggaagaagagaaaggaccttgaaagcctttccaaactaacgcggtcttctgcgtcctagtgccatgagtgaactctttcgctctgatcctaaaagtacgtcgcgagctatagagatacaagagacaggacaagcatttctggattcacgtaaccgacgaagaccacaaataccccagcagcaactccgcaggacgagacgaggccgtctagaaaaaaaagcccgctagctctgttttttgcgacgatagcgacgcttgtgcaaggatgaaaaggaggcagtctcgagagaattaacgaaatatctggaattgctgagaagcgcccggtgcgtgtgagggcgtttgttcacgggctgtccgcgaaaacggcatcccgcgtactcgtcgaagggggttattacgaatcaaatttcaaaggtcggcagaactgcttttagtacactgcatttctgatcggtggttggcgcgaaatgccggacgtatccgaggtaaactctctttgtcttccccgtcctttctttctctgcgctcctctcccttctctctcgccttctctcgtttatcagagactcggcgcctggggagctgctgtgtgcagctctccgcaccgtagggaactctctgtcacccgtgtcttcgccaaacttgaaagagagggaacagtcgaacaacagagagaaactggggacgacgaacgccagcaatcaagaagactgtgcgacgctttcgcgagggccggcgaccggactccagggaggggaggcgatgtccgcggcgggcggagactcgaaactcggagaatttctgcggacgtccgcgaccgctgatggagttctttgcgagtcgattttctgcctataagctagattttttcgaagggagagaaagtgagaactagacacggtctttgtaagtgacaaaaatcatcttttctccacgacgaagcgccgggcgccacaccagcgccctggaaggagcagagcgacagtctttgcatgcagtgctcgactgcttgttgcagaccttcgggggtttcacctttgttctccaagactccattttgaccgattttctgctgaagcgtacacaacaacttcttgcacactcttggactctcgagagatgctttttccagcaattcttccccggcgagcgggtcggcttctcgcacatgcacagagagaaaaaagtctctgagcaacgcgcgactttctcgcgttttcctcggaagaagccacgaacgctttaaggcgttttccggcttcgtcctagcgttcaggcatccacccagtgaactctttctggtgttacgtcgccgctgcttcctcacctggtcgacgcgaacttctctgttccgcgaccggcgccgacggcggaggagacgcgtctcccgactggctctcttctttccaactgtgcttcgtggtctgttccgcagacgcttcgccgcgaagaggccgtttctccatggagtttacttattacacgcgtcaacggcatccggagactcaacgctgcccatcgccgtgaagcgaccttgcgtcgacggccgcacagctctgcgcagagatagaagaagagcaaacctgaggggatcgcggcactcaccactgcttgcgcgacggaagttcagccgccgtcacccgcgaaaccagacgctcgccgccagccgcactgaggctggggtgtacgtacacccccggcaaggcccgcgtcgctctccgggaacctgcggcagga

SEQ ID NO: 2335 - DNA, 2290 bp, Toxoplasma gondii
caacgcacggagttctgcatacacagactgtgcgacatctgtgaaagcaagagacacaacaccgaactctgcaggagtggacgcatggacgttcacggtcttcagcagggacaggttcttcgctttcatgtggacagtcggaaggcgatacacacttacgttcttgtcaaaaggtaaggcatcatcgcagtcacagtgcgaggagcctggtagtactggcggtaagcgacattcgacccaaagtgtcgagtcgccaccctgcagaaaaaaacaaggccccgaatcgctacacaaatacacccatgtaaatatgtttacatgcacaggtatacagatggaaacaaacagttctaaagacatccacctttatatagaggcacgcacagagatatccaggcctagtacatatataaattggaacagatagagtaattggtaggcgaagacgcaatttgccgcacgcagacggagtccaagaacagaccatgcacctaccactgcagcatagtgtgtgagacacaagaaaacactgaatcgaggtgggatgcgtacatcacagactctccgatggagagttgagcacgccagctccgccataatttccgtcactgccggacgcacaaaaaaccacgcccaacatcgcacgaagcctatcctcttcatgtgtctattctacaggccttcagggtggcaggactgccgggggagtccactcgtgaaaaaaaaaatcaagaaggcgaaagctcggagtatgacgggggttcgaggttgcttcggaaccgcactgtatcaggatgcagaatccacacgaaatccacggacggagagaccaacagtagagctcaaaaaaacatggatgtacacacaagcagctcaattgactcctttatgcgtgtgggtggctctgcgaacaaaagggatgtgtagaacaaaaatgagggaaacggcttcaacgcagcgcggcctcacaaaaggggctccgaagggcaactgcgcatccggaattccaggcacaaaatgtaggcggacgcgggtgcattcacttgcaaagcgagtggcaaacgttctgggaactgatactgaaaggttcctcgtcagatccgttcttcgcgctgttgctgcttcgctctgccccgtcactcgcgattacctgtaagcagtccggaaggtcccgaaccgcattttgtagcggacacaaccggaaagtggaaggaattacaactcagtccgaggtgagattttccgaaataacggcgggacaagctccccttttatctgttcacgagtgaacagagaatggagaaacggcgcgccgtttgtcagcgccggagtggggtatggctgcgggttttcggggctggaactctgtgtgggtgtgtggagggtcgactgtggctctgtcgctgtatacgagaagtcagcgcacactcgagacgcaataaaagggcagtgcatgctccagtcgagtgtgcacgatgtgtgggcatgcctctgattttttcttgttcaaatccgagcagaagagccgtggttttccgttagacatctagtgtacgtacagctggttcgcggcgcgattcaaaaatatcgcaccagagtcagtcgaggcattcattcttttgcagcggtgctaaggtgttcatgtgccgtcggacttgctctccactccactgccggagcttttccgaggacaagccgggactcagcacagtcgacatattttctgcggcgcaaaatcgctgcgaaaaaagggtgccgcgtctcgcgcgtcctcgcgattcaggcccttgagccacgcttccgttgcttcttcaccagcgaagtctcaacgtgtgcgggtttaagaactcacgcagatggtcgattcattattttaggcaaggcgatttttcaggactgcaagtacgtacggtgattcatcgaactttctgctgtatctatagactcgtgagggacttaaaaagccgccggtgagagcagagctggacaaatgaccagacagaggcggcggcacacgagggagttagcaagcgactgggcctgcgtccgcttgcgttttcacaaccgaacaactgtggggggcgacagggggttcggttctgtctcctgcgctggggtcgtcgtgggtctgcctgcggactttgtccggtaattcggtattttctgaagaacgcgattctctctcatcgtttggacccacaggatcgtgcagtccaacgtttctcggcatcgaatcatttgtacgaagcacggtccattggcgccgctttttttgtgacgggtcactcaa

SEQ ID NO: 2336 - DNA, 3638 bp, Toxoplasma gondii
acagctgtacactccggctaggcactcccagagccttcccaaaaacacccccagaagtttgccgccgcgcgacttgtcagattccgctgccgacgcctgaggctcgtcgaagccgaaagcgccgccatcgccctttggtcccaagctcgtggggccggaggtgcgaggccagagccgcgagagacgaaaaagtcccgagaggaactgccagaaggaaaaggtgaggaagcccgcgaacgaggcccaggtgccaccctctccaccagcgggagagtccgctcctgaagtcttcacctctttcaaaacgaagtgcgtcgagcggccctggccaccaccggacgggccttggggctgggaagctggcccttgacgggcctgttgccccctgccccgccgcatgctgcagaggcgggtcgcggggaggtctggtaaagaaggggaaggtgaagcatgtagggtgaaagcgggtgaagcaagtaaaggcgggtgaagaatggaggggaagagccggtgtaaggctgagggccgcacgcggggaaaacgccgtcgtcagcttcaacggtaagcaaagatggaacaccaatggagttaaggtgaacgcggccgcagaaaaaagccgtgtatgggggcggaaacttgcacggcaaggtcgaggcagggggtgtctatacggtggcgctgagcagccgtggaagcgaagtaggtgaggtttcgaccccacgatctagcgcggccaaaggctgcgccgtgtttctccgacctgcctgaaaagcaaaaacactacgcgacaagagagacgccggacaatcaagctccgaaagtagcgcgccgccttccctggtctcgctgcgacggacaacggagcgggctgagaggaacacgtgcatcgtcttaaggcctctgctccccgacgcagcggatggtgcaaccggttggaacagagcatctctgagccggttctttggaaaaaaagggaaattccccgcgtttagtcatgatttccgagaaagacaaccaaggacacgcgggcggtaacggcgcatgcagtctccagtggcctcgtccacggaagccgcccgcctcctaccgtcgtggcgcgtgatcctacctacgaaacgactgtcgaaaaaactctaggttgtcagttgctgcaacgaaagggcgagaaaaaactggacaagcggatggaccctaaaaaccggtggcgtgccgtgcgcactagctcaagttcagatctgcctctccgccgcaccgatgacactttccgggggccaggaagatggcaaacacgcggagaaccggaactgtgtgcgcttcgccgtacacgaagtgaggacgaaagttcatcatgacttgccagaacgaactttgctgagaaaaacattctttccaagcgcggttacccccacgcagtgggtgctgcaaccgaatgctgcctctcgcaaagatccgtcaccgtcgcgctgcgaaagcttcgcaacgggtgtccccagtcgaggcgcggtaactgaactcgagttcaaccggcaggtggctgcatgcgctttccatcgacgacaaccccgacagaagcgtgaaatccgtgaaaacgtcctccccagtatacgcatgcttgatacgggagaaagtttggttgggacggcacgctgcacaagacggaaacaccctcaaaacccgactaggcatcaccgcaaagccgccgaaaacgcgatgcgtggtttcggtctctggcggtcccagccctccagctgtcgttaaaacaaggaaacagcctcgattgacagtcgctgctatcggaatgaggtgattgccacaaacggaaagattcagcacggccgcagtggtgagacacctccgcgggcgggaaaagtgtaagaccgaacatgcccgctgaggcgaccaccaacaacgtgcctacctcaaccgcttctgggcacccaaagacggttgcatgacagcgaaccgtcaacacagagttacgtcagtgatttcacaggttgcgtgtgcttggagcatcactgttgctcgagtgtgcttgtcgcataactctatccatgcaaaaaggagacacacacgaatggcgtcccccgaaagtatctaagcctgtcgattttcgaaggatgcttgcagagtaccccaagaaaatagggcccctgacagtgtctgaaaagaagcgagaacgcgtccgaaaagtgcaaagcccgcggctgcgatcgaaagtggagtggactgtgtcagcagacaccaggtgatcaaatgcgggaacgaacatattaccaacgatgtggaggcgtccaaaccagaaactcgcgaccgatgggctgatacgtaaatcgtgaagtgaatgagatcatcagcgggcagaatcaagagagatcttttaatgcgtttcaagtgaacccgctcgcctaccggtagctccagctccagttacatcgcatattacataatagacgcacgaaatgatttgcaaatgacctctcagcgtcatgtcccagccctgtacctcacgctgttgtagcaacaatttcaagcacaaacacaaagcacagcgtgcatatttggctgttcgtggaggaatcggtcgacgaacacgaaaatcttaaacaaattttgatagcgacagcgaccaactcaaaaatgctctgaaacgattcgtgggaaaagcttcgatgagtctgagtggcaaaacgcagcaaccacaacgaggggctgtatgccccatattatcttctcatcttattcccagacaccattcacttgattgctgtgaacgtaccatgctgtgccatgtaacgcgtttgaacaaactggtccggacagggactcaaattactctctcgctaccatgagcaaacgagtgctcgtcaggttttgatgctatcgtttggatgccgaaaaacccgtgcagcctttgtttcttacgaaggatgaccgagaggggtcaagagaggaccggcagagcactgttgtgcccctgctcatccataaaaggcctaattttagcggaaaattcattcagcagcgatatccaagcccccggtacacgaactgacagacgggtgttgcaagcagagcagtgacacagctaggcagagcaccattggtgaccccgtaaccagcataacgatgtttaccgcggagtgttcgtttttctctcggggtggtcgttcgaagggtggattctgtcaggaggagcaagcgaacttgcagagttttcaacgcaaactttcgaccacgctgccacactgaggcatgcagggcctgtccgacgttcatcgcggcgatccgccgccgcacggatgcacatgcaaaagtcatcctgctccgctccacccgccttgggtccgcgtgcgtctgcttgcgcgtcgtcccatgtgcagttaaacgagacttcgatgccacaaaaaagcgtctccatgttactttttcgcgctccttactactcagggggaagcatcagaggaaacccgcttgaatcccaactcgcaaagtcgaggaaggtacttgactgttgtcagctgcacgcagctgtcctgccactgtgaccgtatgtgtatctgagtgtcagcactcggcacctacactctatcgcgacatttttcggtttttaccaagcccatttcagagagacacaa

SEQ ID NO: 2337 - DNA, 3379 bp, Toxoplasma gondii
cttgccaaggtttctgtcgagcaacaaggttgctcgtgacgatcagctgcttctggcgcaccgccacaggcttccccacgatcgacggatccaggagttcctcgacttgtgcgtagaaacagtccatgtccacatgtatgatgacccgcgagacgcacccgccacagccggacagtccacccgaagaacaactctcttcgccgcgttcgacgtagccgagacagggagaagcaggtgaagcagacgaacgagaagagggagaaaaggaaagagtagaggcggcagaagggggcgaagaagaagaggaagaagaggaagaagaaggggaagaagcggatgaaacaaggtggagaaaggcgcaacacgaaccggagcaacagcagagaggatcgccgaggcggcgagccgcgcctatcgaaggctgcgcgttgcggcttggtttttcttctgtgctcgcagaacagcccaagagaggaagagagacggacgaagaggtgatcggggcgtcggaagaagaaggccagagggaagctgacgaagcaggagactcatgagaagacaagaaatagtccttcgaagcaaaggatgaagtgcatggcgcgtcccggagatgcggcggatcgggcgaagaagaggactcatccagacagcaagttggcgaatgagagatcgaccctggcggggtagggcaactggtctcggactttggtggagaagaggagtctcccgcgaacggctgtctgctggcctcacgcattatttttgtgcggcaacatcagatgtctccgaggtgacatgctctcgcgtttttctcttttcactttgggtcttagtcgtgtgcttcgttctttttaaaccagttggagaagccaaacgtcaaatgcctagacgaagaaccgacacaccaacaatgaaaaagcgctgcaattccccgcctcactcactgttcgactttcgctcgcgttctcttcgttctcaactccctttttcctctccacgttctgcccccttcgtcttctgccgtgatgcgaaactaccgcggagtcaaagcgaaaaactgctgaggaaatagatcgagtttcgaagttccacacccaaaaaatgtaaaaacaaaatgcgctgagtacacttgcgtaatgcaacagtgaaatgaagctctcaaccacatacatgcgcgtatatgtctagctacacacacatacaaatatatatatatatatatgcgtaaatatgtatatgtatgtaatctctgtagaataaggggctggtagacagagagacgagatgtgcggtgttttttctctcgttgtcggcagctgtcgcttctttttaccagtgccctaacgtttggatctgaacgagatattgtacactttgttcctttaacgtgtctaaatcgtcgcgactgtgcagaagtcgtctctaaacttccacgttttcggcgtttgcgtgcggccgagtctttgtcttctttgcctcgtttcactgcacagagagacccgatgagaactagcgacatctggaggcctctcctcaaggtctctctctcttccctcatgcctgctttgttcggcgacgcaaactcgattcaggtgggctctctactccccacgaaaagctgggcaaagatcctgccagagatgattcatcagaccgctcgcgaattcaagactccttgacatgttcttctacaccattccttctcgcgtgaggagaatttcgactttttccgtctctctctccccctccccctgttgcgtctgtctctctctctccctcctactcaggctcttcttggcatcgcactttttctcttgcttcctacctcgagttgcccttttcttggtctcgcgatgtctctccacacacccgcatttgcgctctctcaccatgtcaattcatttctgatttactgtgaaaattagcacaacatccagaaccgtttaaatgcggaacacaaacaaccatttcatacaccccccgttttctgtccagctttctggaggcgattttgtgtgtgtgcagaaggcctttcttttcttgtcagggacctctgccttcgtcctcttcagatctctcgcgttccttcggaaattccatttctgctcatttttcaatccccccgacctcgtccggaaaccgacacagccttcatgttccgccgatgagcatgcaaggggcaaggcgggagcccccacgacggaaagagcagaatattgcgtttctgcagggcgggaagagtcccgaacggccgccttttgatcaaggtctatgagaggagaaattgcaattgaaatgaaaccgtttcgaatgaaaacccacaggcagagagcagcctcaggcgcgcttttgccgcaagctggctgctcaacgccctctggctgcgaggcgcggcgtgtagtctgaaacccgtccgggcatgtcgcttcgtttcgaaggacttgcggagagagttaaaaagaggagcttcagcgaacccaccctgtcctcaaagggatggccttccagagagccttcggatcgaagatgcgtggaagaaagcgacggggaaacacggagaaatgagaaaaggaaaggaagcgaacaagggtgaggaagcgacgctcctatacggcgcttctaacgcacagagagaggcccaggtttctcccgtcgcacatgtcttcgcagcggacttccgaagtggatcttgacaagacccaaagaaggtttgaaaatcgacagaaggtttctgtgcattcaagagaagccagattctccgcggaggatatgagacagttgagaggaaggcgcgaaggccctgtctcctcagtcaacgcgcctctctgagcgcatgcgggaccgagagcctcgtgttccccctcttctctcgctgtgtcggcgtgacctcattttgtgaaagggttttcgtcttggttcttctgtgcctttctcttgttctcggttgacacgacgaggtcgataccgttccgtcttcccttttccctgtctgagaaaccgtaggtttcccccctccgtcgcgcggccgcttttctccctggactcttggtcgttttcttcgaagttccccgtcttttctgcagactctttctcagctatgcagcctcttcgcggcagagccgagaggcctttctatccccgcttatccaccttcatttcttccacctttctccctgctgctcaccccggcagcgcgacgcgttcgctctctgtgcgccttgcgtacgacgcctctcccttgttttcccagtgtgtgtttcctgtaagttttcgttgaattcttcgtttttcgcttttttaaaaaccatcctcgcttcggagaacttgctcggcggattgcatgcgcacccggatggtccgcggttctggcgtgtctgca

SEQ ID NO: 2338 - DNA, 2714 bp, Toxoplasma gondii
ggctcggagtgttgagatcggtgagagagaagcaagtgacacaccagaggcaaaaaacagcagaacgatgtgtggaagagttaagaataaggtcgagagagtctcccccgtcgacatgaactccctaatgcatgcgacgaaatggtctctgtttattcaatttaagttacacccagtgaacgcatacgaccgaatatcgcagtacgctcctggatgtagcgatacaagctacacgctgagcgctagaaagataaaagaacgatctatgtaatgcaagtaactctttcataagctccagtaaacggctactgtaacgagaaggctgctaaggcagcgaccttcgttgtcgggtgaccgagcgtcgggaaagtgggttatttgttaacaccactgatacaagggcgtccagagaggatgtcgaaactcacacgacaccgtctagagaagaatggacagagttcggagaagtgaagcgaggtgcctcgcaggcaagttgtgaacgcgcgcatgtgtgttgcaagcgggatatctacagtgcatcgagatgggagggaaagccttgcggcgcggtgtatcagcgtagagcacagaaggaatgacgcattacctcgtttgcagcagcacagaaacttgagagggggcgagacaaacgaatagactacaggaaacaccgaaagcgtggataacgccaacagacatcagaaaccgctcctctgacgcgagtgaatccgaacttggtgagagacactgactttgttaggccgtagagaagccgaaatccgtcttgggtaagtatgttgagtactctgcgactgtcgtccagtcctgggcgtcccccggggctgtcctgtctccgtccgtcgccgcgactcttccagttcctacttgggggcgttcctatgtacccgggggtatcgtcccggcgttctctaccgtatctgacaagatatgcagacctgtcaggctcccctgaataactcgacgaacctgcagaacagccaagctgcaggaggtgccgcaggcgctccagagaggcggcgtattcttcattgctccactctgccgggcgggaagggcaggaatccccggcccagagaacgccctcgcacggggtcgagaaatcagattcggacgagctagaactgcaagcagacgctgttgcaaacgtatcaaacgctggagcccgctcaagagctttcgggtctccagacgacggtgggatgaagacgcacagacggggctggccggagtcggaacgtagcaactgagaagaggagcttcgctctagacctgcggtctccagcgtgccaggcagctccgagaatgccattgtcaagcaatgagaaagagaagagagacgcggaagtggcgcacaaaggaatcgaccgactccgttcagttcactcggtgacacatactgacgacccagaaccaatactgctgttgtcgaagaggtcgaagaaacagaggttttctccccacaaacaggcaccgacagcagttctacatggctttctccccgtgacagtgtttcctagtcccctagggacccggtgcttgcatcagtggagagcgcagtggcagctgctgtccactgtgtgcggcatttctctagttggcaaaatggcggcaaatagttgaagggaaaaggatagccgcgttttttccagagacaagagtcacttgtagctggaagatgcttaccagcgttccctgtccccgggacctggagaattttcgtgtcttgtcaccgggaaactggcgacaaagggtcacgtgtttgactgcggcacgcacatgacggacggctacacagggggcgtctacaccttgacaatactggaaaacgacacactaaggaaagcgcgaaaagcgcgggaagaaaatccgggtcgcacacggccgcccgcctgaaaatcactattcaacccccagaacggacgaaaaagctgtgtgttgtagtgtgtgtggagggcggcagtgttcggctcctgacgagacacgagaaagcagttatagcgtcgtttcttcagtaacaagaaaggaaatattcgtggtccactcctctcaagcattaacagagctgtcgggacatgcatgacatcggatcagaaaagcggtatacggcgtgtgcttccccgctgtacactacgccgacggctccaaccgccatgtgcatgcatctatgacgtgatatcaaagaatctatgagtgataaacaacgaacacaggaaaagagcagacgaaataacctggattttgttctgcatttccttccggaggacaacttggcaacattacatatctccggggagctccggttccagaaagtccataaaaggacagcagaatccggagagaaggtagtccttctgtggcaaggattctcgatgctgtcaacgtggctgacaacctgtgaaaagaaatgaagcatcagcttctacctatacgacacatggaaatagcaaccgccagcggtacccaccgcagcgctacattccaacagaacatcggcaggaactgcacacctactcctcgtggaagctggtaaaatagtgggcatgaaaacgcacgaatagaatgcgtatgtatgagtcaattgaagatcgggtaatgcagtgcagcaaaccagctcatgctgacagtcaaaaaatacgattttgtaggcagttgcactcccacagtcaccttgtctagccccatgacccttcgac

SEQ ID NO: 2339 - DNA, 1739 bp, Toxoplasma gondii
ccattgagcattcaacgtcggttgcaggtcttgtcttgaccaccgaaggcatgatggttgaggaggaggagccagagaagcattcacgtgatgtaccagacatgccaatggcatgatgttcaaataccgcagttaacgagattgtcctgcctgacagggcttttttgtatgcttatgaggtgcagctgaaaggttcgttttcatcgaatgtaaatctcgatcccggacacctgacaggtgtgtgtcatttctgctgcgaaaaggaaagaatgactgaggtgactcactccccaagattgatcgaagggatcatcttcttgtatctgaatagtttttgaacttcactttcgtccccgggctctacctaacttgccgcttaccgtgctccccaagcctacagttacatattcttgactgtgcaacacagcaacatcaatcggtgctgcaaatttcccttctccaacagctcctacgaagaattcggacgtaacctgactgcacaacgtcatgtgacgcgtcatctaacctccacagacatttacggcctcctgttccatgtcctgcgaatggctgatgggtcgtttcatcctctgtagaaaaccaaatacacacaggtttggtgtgctttaccgctctgcccaaacgtgagtgagctgtccatgttcgcctggtcaggaggttgctgatgtaaatccgctggaccaacgcaaaacggtaaggatacattaccaatgtccagccgcatgaaacccgtttctccagcctaacatcgttggagaattcccggcagccgacaggaaaatacgtttcctcacttacccatgcatcaataaagtggaaagtagctttgacacgcaattcagtatgaggtggcagtcttccgaacttctttgtaacttcgccctacactggagtggtaaaagtttgcttttagatgaaattggaatttcgtaatacccttgcaaattttccgaagccacccagcatggttattccagcacatttcgatacgatatctctggatgctggtgaaaagcatttatctcgaaggatcatttgccaaaacagcaactgacacaccagtgttatcccagccggttgcttctcctgaggagagatcctccctcgcagcgatacgaaactgcttaaccccgttgacatgcaagtcgcccctcaagtcaagagatcttgaaaataattgtaatggaggtctgctgtggagaggtagcagatcgtgcatgattcttacgaggcagcgaagttcgtggcagtcaccgtcatgttatcttccgaatcgacctccagaagaggagatctactactttctacaacgaaacgtccagaagaatccatgccaattgcatagtacgtctcttcagatccaacgatgatctgggaaggctggccgtcagctgatccgactcgcaacacagatacggtcattccgctttgaactgtcggggccaccacagcagaaaccggtggtgcccaggcaaacaacaggcagaggcctgtcaccgtagtcagcttcattttgatgttttacacggggattctaactctgcattcgctcccgtgacaactgctctaactacaggcaaggatgatctcgagacaacggtttccacggcaagagacggagacagcagggagtacgtacacacaggttgtgccagtctacgcttggccactctctccgaggctttcgcacacaatcggctgaccccaaagacgcatca

SEQ ID NO: 2340 - DNA, 1864 bp, Toxoplasma gondii
gaccaacaaaacggcgaggttcagattcctcagcctcccagttcgtcgggtgtatgtacacctcaggggaagccttccggggcgttcagccgctccagagcctgtctgcgcgattcgcgtcctcgacacacacttcggtgtttcgctaccatgcttgctctctttgcagtgccggctacttgcaacaaaaacttttgttctgcctatttctcgcggatagggcaggtccgcccagagggcagacgagcgcaagaaagtctcgcgaagaatcaggcagagatgtcggagttccagagacgggaggctcggccctctctggccgccttccggtagtgccaccttggacactcacccctgtgaggcgacttgtgcggccgtcatttcgtctgtctttttcgtttctgaagaaatcggtcttctcctctctcgggtgtctcccgcgtccggtggatgtccacagggtctggatggataccgtgcttgaggctctgatctcttgcagatggagaaagcaaaagaaaaagcgacagacgtcaaatctgagagacgcacagcatgagggagccgacacaaagatgcgagtcgacgcttgtagagcaccctgaaaacaagtggaaaaatgaaagcgatgcatcagaggtgcgcggagaaactgaggagttgcacgacccagacacctggaggggagcggcagcgacgtcgttttcaggagagaagccttctcttttcgcacaggacggactggagaaaacagtgcaaaaaataaaaagagagaagcgactccgggggagagaaaacgaggacggagcggcaacagaccggacgtgaggaggatggaggagggacggagacagtggaagcgcgaggacggagggacgggtcgacaccgttttttttcgagagaagcaagtcagtgcatgcgctgcccagtgaacaaaaacacaaggcaacaaagaactgagaagaaggcgagagaagcgcattcgcaacttctgagaggtgaggtgtacgtacgccgaggggggcggagcttgatgcaggcagtcgacggcgaagtggcgcgaacgcagaagagtggagggagacagaggcctggctgtgtctgagaaaaagaagagcgactgagagaaagagaagaagataaaaagagaaatgcaaagacgaacgccgccgagagggcagaggcgaacccgcaaggcacacggccgggagaggggggaggagacagccgacagcaactgcttttcgaccgaagagaggttgtcttcaacctgcgaatctgaaaaagcgaatcggagaaccggagaacgaaaacaagtctcctgctggagtgaactcgagggagagaaaacgtaccagtaacagaatggcacgcagaaaagaaagcgagacacgcttctctcaatctggagcgggctgcttggattcttttctggggtggtgaaagcacacctagtcttccggtgtgagaaaagtagcctgtagaactgtgcgtggaacctcgatcgggggagtgcatttctgaacagtctgcgtctcgaaaggcagataaaaactggactcgaaaacgcccagagagcagaactttgtgtcttttctcgttcgtgtcatccggaagaagcaagggcgtcagaaaactgacagcaacccccctcctgaaaccgccgcctccagtacgcttgtcttcactggcgccaccggcgaggagcgcgcgtttgcggacttgctggcttctttgagactggactacgcttcccccttgttgagtctggagacgggaagaggtctaccttttcttcagtcacgaggcaagcagaaggccgctgcacacggagccggaggcgccgtcaatgtccccttcaaa

SEQ ID NO: 2341 - DNA, 2679 bp, Toxoplasma gondii
ttttttgaaattcattcgaccgtctgttgaggcatcgtgtgctccgcatctgcctgagacggtgacaagtgtaatcctccttgctgaccgtgaatgctcaggctagaacgccggcgcgaactgtcaatgaagaactgaagtgtcggtctcatccgcagtgcagcacgaatgctaggtgttgcgcaggtgttcgaaagctcagtttgaataggaaattcagacgaaaccatagaggccactaacaggtacacacctgggctagaaaaagtgatacagacgcataaaattctcgatacattcctgtcagggacatccgtgtcgcgtgtgtgtgtgtgtagaggtgaaacagtttttctactcagacaacagtgtgcatgttacgttggcagaacgcgagtgctaaaaagtgaaggaccagtgtcgtagcgcatagtgccgaacaccagtcctgggtgagccagaacggcgaaatccgctgtggacctcgtcgggcacagcaccagtcgttgttttgctacaaataagagcgctgccgcaagcttcctacggtttgtcgacttggtgtttttagagaaatcaaaaacaagaacgacagttgtttgacgtatcgcgcaaatccagaactggcatcccagcattggtgaagtacgctttttgaacggttacccgggcagtttctcctaccggtcgcgatcctttgaggttgcctcgtcgcgttctcagttccaaccaggcaaatgtgtgcggtaatctaatctgaccctatacggtaaccacgccctgaaaacgcctgagttcccgaaccaccagctgcaggtcgcggccggacagaacctccccaggtgctccctccgggaccaccagggccgcctccacccgcgccagttgaggcagttcctgttcggttggctgccggtcttctgcccacttcgggacgattcgaaagcctctctgccagccggtcgaacatcttcggcgtgtagctcagcaagtctgcaccgcctgggaaacgcataacacagtcgcgagacaaaaaggatgtctgcatgtctcggaggaaactgtggaagagacgaaagtgcctgacagtctcgactcaccttgcgccggcagaatctctctgaagaagtagtaaatgtgtccggagaggaggccgatcgcgtccgaccagagatccttccccatcaaaagatgtagaaggagcagaacgaaaggcagctgatgaccctggactgtcagaaagtagatagacactggagtgtacgattcccgccggctccagtagtagagaacggcgaagaggagagaaccacccagcaggtgaaggcctgcaaataccgattaatgcgacacatcacaccaggcgaccgaggatactcataaaaaggaaagaaacttgtgtgcgaagtcggctgtcctcggcactctgccgtcaacagctacagtagaaacaaacgcgaaaccagaaagggcacgagccgaccttttgtgtgaagaagcggacttacccgtgggccaaaaaagaagcagagagatgcagtctagacagagggtctgaagaacgatgaagtaaaggtacgcccctttgcttgcttgaacgaacacggcgttgttttcgaggtcggagctgacttgggtccacatgtacatgtgcagcacccaacccagagagaacctgccgatgtacaagacattggtgagcagcctccagacctgaagtttttggaaaaccaactcccagtccaaaatgagcaggcgagcgggcatcagttcaatcgacgagagcagggtgcacgcaaaggtgatacacgtgaccgcacgggtcactggcgggagggaaaagaaccatgcttcggggccgttcgacggatagccaccgccactgcccactccgtgggggagcgggtccatagtggtgactaacagagaaaggaacaagcgacgcgagtccctggaattgagtggtgggtcgagacggaaggcattccacaggttggctgtcgcacggagctctccctaaattccaccgctgcgacgccgctcaacatgcaacagtcctcttccgtatctgcaagggaaacgggaatccccgtaagacgacaaaatgagagtgtgtctggatcaagacatttatacgaaaacagcatgcagcccggcggcaggctaatgtttgcgaggcagacactcctcatgcgtgttcaccgcgcggcccagtcgcgccaaacaaaaaaattcccgtcaccgcgttctggaaggaacgcattacgacagcaaatgatgacagtgccgtctgcaacttctctgtccgttagagaacgtcacaggctttgtgcacgacaaaagctgtagcgtgtccgcgcaggcgggcgtcagcgtgtacgagacaacacacaaggtctgcgttgcacaggaaaatgttaccagcggcttcccgcgccattaccaaacgctgccctccagattccttcttcaacgccagccagccgcgataagcccactacgcttgccacggtcaactaacgtgccgagtgtacggacaccgcactgaatgtagcacaaggttggtggcttctgcatgcgtggcgtgttttcttcgactccacaaattgatacgggcgaccgacggcagcgttttctgttcccgcagctgtaggtaacgcgtgtccgcgaaacagtcca

SEQ ID NO: 2342 - DNA, 4480 bp, Toxoplasma gondii
gaacgttatctcggacgttctgttacgaaacgctggtctcgcacggtgccaggtggcgaacgaatcgctgttcgaccaatagtggaatgcgttatcgcttcaacagaattggacatagtatttctatctgacaatcgttgatgttcggtgctatgtggaactagcacccgacagtgcaccgcgacattttcttgctgtggccatacaaagagtgcacgtcgaagcacccactgctactgtattttccgcagcgggaacttgccgcaggtatacttgcacaactcgtctgaggcggtgaaggggttagggaaactgacagattgtcaacattcgtgtggtctcccaaaaacgtttggcaaatatgaggaagtctgttaatggtacaggatgcaactcattcaccatatttgatgcagtcaattcttcagtgcaaggatttggcaaatgtccacagctggtcacgtgatacattcgtggagtgctcaagaggacgaacatatgacgcgtcgaattctactgggacagtcaaatcacgatatttcacgggggtcattatcttttgttgcttgcgctattagccagtgttaacaatacggttgagtaccctggtggcatgagcaatagtgcggaaaaatcgcctccaccacgacacgatacgcgattttactgacatccgatgccagtcacctcacttgcaaccggaagtcgtttaaggcgccggcgaggtggacaggcgaactcggcgcaagaatcgagcattcatcgccatgcgttggtaaactgtggctttttgcgcacgagctgcagacgggcacctctgtatcaggaagtgccaacagcgtcgcaacacgacaggcccttgtgtagtagacctcaaacgccagacgcgtgtggtgccctctccgtcttttcttcaagaagaactgattcagtcgctcaactgatgttgcactcgtcacattctttcagaggaggttgttgtgtcctattttcacaccgagtgcgatggctagcaacggcccacgccccgaggtctacacttggcagatagatcatcatagtcgtctatatggacacgtggctctggtatatggtgtctgtcatcgttgtgcaccgaaaaatccgcgcaccagcagctttattttgctttggtaatagcaagagcgatgtatcaagaagtgtttgttggataatcagttacgagttacttttatctggcatccacagcattcatacagatggttatctgtggcccatgatcgcgcaaagtaaggacccgtgatacgcattgttgtttacattgacactggagttataccatgatggtgctccacaccggctcgtttgattctggtgtaagaacgatatcggactgagaaaacaacgacttgaccacaacaactgctccctttaacttgcatgtaaagaaacaaactgcgggagtctctttcgtacctgcgtgtctgtctcaagcaggatacaaatttattgatactgcgggagctctacaaatccttgctatggaattgtaaagtaacacgtgcccaaaagaaggaaattagccttgagcacagggggaattacaccgtaaaaaaacagaagcaaaaacagtgacaaacggatctgcgtcacctccacgtagtacactgtgactgaaggactaccgtcctgggaagctcctctgctacatgtttctttctcccgttctgcgccgcatcaagctgcagagaccccgggacgtttccccctagtatatagactgcgtgttatatgctccgtctcagttgcaaccgaagcagaaggacattacatttttcacgcgcttctcctagaaattgtcggctcagaaaccttggggaccgcacctcttcggggatgaatccttctgtactcttttaaccgctggtaaagcagttgtccagccgctccctcccgtggatgtggcagatccggcttgaatccgcaactgaagaaacgggacatcataaggagtttctttcaatgattgaatttagaagaatctctttcccagtacatccttttcaccaacaccaactaacgagttgtcaacccagtcagtcgcatgcttgaccctgtttgcctgttttgggacctcgctcatgtgtgtcagatgaaaacgcctcagaggcaattcagggaccatatagacgacacctgatactacttcataggccaaacgtgcttcatggcaatttgtactgttgttggcttcggtgtgtgtgaaaagcaagtgcttccttgagtcaccctatacctatagtggccaaccgacaggaaaccctcattgactgcggcctgcctatgtcattcagaaagtgccaacaacttctggccaagcaatccgccaacagcccttgacagccgagccatcaactcccgatcccgacgtccgacctacactcttgttgctccttcacgaaagacaagggacttcttcgaacgaccacataagtagagcaaaagcgactttgatacctacagtatttacccaaccagggtcagggtgtggatctgaaagaaaggacgggcaaacaaactcgaaaaaaacacgcttacgttgtaatcactcgtttgtcgtagccgcgagacacgtatttccgtaaaaaccgtgatttcacagcctggcctattagcaaggtgaaacatttttttgtgtaaatgagtcaatgatgtttgacacaatctgcttgtctaatgattaagccactctgcagcactctagaattccaggggatcacatcagcgttcgtgctggtgaagccaggctgtttccagttcgcggcgtagtcgagggacccatgtctcaggtgtgtgcttactagcttcaagtgcgtgcagccgttcccctttttcctttatcctacatacctgtcactaagataactatctgtagaaaagtgtcagtaaaactgcgtaacgaagacttgagcatcgactacgaagtgcacaatatcagcatatgctcctcgtgtcaccctatggagcggtttatcggtggaccgaccactgcactctgctctctgcatcacagtttccatacctttggagggagtggaacaatcgaaattcaggcaccggacactgaacaaacttccatatcgtcaacgccgttgcgtaccgctttcagatctctaaagcgggcccgacacgactgttccttatcttctcgaagtgagctcccttggcggatgggttttgcaactctgctttgaccgtctgttccaaaaacaattgtttctccgtcaaactacttgcgcaccccaacagtaatgatgctatttcttttggggtatcaccacaatggggtagctggtgactggggtgcctgtgcctcaaaggacgactaagaagggacgacttggttttgaccgggtctccgtccgttctgacgcaacagaaagatctctttctgtagcatcacatagacaaatgttctcgaaccactgcgcctccgctacagtcaatccatcagctttgtggagtttaatttggcagtttattcgcttcctctcggccacacttttctaaatacagacggtcaaaacggaaatcgcctctatgcaagccattgccgaccggtagttacaagctcgtcgcactgcacccacccgcgcaaccatgaggcctcttgcaagtgtcgcccgtttctttggctagggcggacagaagagctgttgtggtgttgccgtgactgtggtccccgtccagagaagggaaaatgactttttctctgtgttgtgttgcactttctgagcggctatactggcttagtactggcttttgtatgctaccgtctttttgctttgctgggagcattttctgaacaaagatccgtgctccgccagccgaagcactcgctgaactggcgttgcctcagcaactgcctctcccgcatcactccctctgcattggttggctcttgcgtttcttaaccgcacggcctttcaaggaaaccacaaggcaggcgcgttcaatggtgttttgtggggagatccgtttcgactgtgtaaggatttcacctcaactccacgcttcaagtccccgtgactagctgagtagcatactgctggtcttgtcgcaggctggccagtggaatttcgtgcaagagcgtggcgcgtttgtccaagaaacgacccataacaaccaatttcttgtttagtcgtacctcctgtggctttcttgtcttgacgcgggagaacgacgtccagtggtaggaagcgcctttgatgttttcagggtccgtgatcgtgtgctttcctcgatcacattattcctgtctcgcacacaccttccggacgatccagaccggcgcctgcaccgttttcattgtgtctgccccgttgatctccgctgttttctgaacgtactttccctgcgttgaaacatgcagccttacacgattcctcaacggtaatactacgctgttgccatcgcaccaacacagcagaaagagccacaa

SEQ ID NO: 2343 - DNA, 1817 bp, Toxoplasma gondii
aaacgtaagaaagcagagctcatggaagatataagttgaacgaacggtgcaacgaagaaagcaaatgaaaggacatgcaagagtaaagagtgcgtacggagaggtacttctggagagcattctgtttcatttcggattccaccaccaacagccgacatctcccgcaagataccccagtcgatctagatgacatggtctagagttgcttcacggcgcatttctgcaaaaatggtgacaaaagcccagcgtatttagtgttgctcttaagaacagaaaacggagtgcctcacaagttacaacagagccccgattatttccccgttgatcgttggttcgctgaaaaacagactagcgatgaaaagaagttgaccgaagttagcattatggtatttgtacatcttgtacccacatatttggtccgtcttccagtttccactcaagccacatatatttagatgagtgcacgttaacttctcttgcgcctgactgaagatgctcaagataacaccagcaataacatgactgacatgtaccccaacgatatcccgggggtggtttgtgtcgaggtttctctgaagtgttctgtcactcctagaacacacccgagtgcgtttaagtacaagaagaccccgaggtgaggcgtccgtcatccccgtcctctctttctcccattcgtagatacatttcttgacaagaaatacgcggaacggaacgtactcttggggcgaggtcccctattagatgacattttggatttcttcgctccagcggtctgcgacggaggcatggaacagattttcaactttttttcctgtaggtttgttttgaatgggctcgctttcaaccccgcaaattgcagtctcgggactctttaatggaggcatgtgtaacgcagaagtccagttcgtagattttggaggcgcgcgagacaagcagagagtcctagcgcttggcgtcgatgtgagcgtaaaggcttttctctacagttccagagaagattggatatccttacaactgaaaccactctcgaaataatttgtttccctcggtgtgtctcagcctgtctgtgttgttcaattcgagaaagtcccaacggactctctcgactagttatccccactgcgtgtgcatgcacgctgtttggaagagaggctggcgcggtccccccacagaaggggtcgtcggtcttggatttttcccagtttcttttctcttcttcgatttgcgattcttcgcgcatctctctgcaccttttctctgtttttccggattttggtctccgttctggggtctcctctcgacatgctccactccgttctgggtcgccgcccctggtcacccggcaccgtctctgcccttttttatacagacgaaaagctctttcttctctgttcttttgtctcacgtctcctttgtctttactaagaacgcggcgtttttcgtttcgcccatttctggccttcattctgccgtcgtcgaactgtctgtccatctctaacaaagaacatcccctccagctccgctgccttctccggatttgaactcccttcagctctgctccaaagttctcgcttctctccatcttctccactgtgctcaaccttccactttacacttcgtcgagacctagaaacccgtcgttcccccggtctgtgtccttcgcgcgcatctcgttcggtacactccgcctctccggtgccgccttccctgtttctgtctcctctcctgtcgtcttccctgtctttttcccccttcctctctttcccccttcctctctctcgtccttctctctcgtccttctctctcgtccttcaaaa

SEQ ID NO: 2344 - DNA, 2095 bp, Toxoplasma gondii
atcagcggagtaaagtgccattgttacttacgctgatatctcctctgcttcaccattgctagcgcagttcgccgaccccctccatatgcatccggctcctttctcgaatttgaccatgtctgcaacagatcgacttgctcgaagttcgatgaaaccctgatcggatatgcatttcctagaagcatgtgcgcgcatgttcccgaggaaccgttacgggtacctctctctagggggagaggacgagaaacaaagttcgagttggcaccattgtagtgcgaaccattgcaaagggaatgacaggaggacagcggacgaagccagagtgtgaacgtcgggggaggccgggaggagaaagtagagaaacagaggagcaaggaggacgggcgaaacataaatgacgctacacgctccgaatgtgggtctgctgcattgttcggtaacgcagacgttgctgaagagaacgaagaaggtcggggcaagtgagcgccatcgacgaaacacacaaggtgtttctgtgagatgcctccggtacgcctccccgtctgagctgaaaaagtcaccctttcattggagtacaacaaagaaacgataaaacaaaacctaaacagcaacgccaaagtcagggaccgcgccacaaccggaggacagaagaaataccgcatgcttgcagaccgccgaagcttcacaggcactagagggaaaccatgctgtcgcaagtgccgcgaatcacagtcgtgagggcgagatagtctgcttcagtggaagcataagtggacaaagcagaccatgcgagctctactcctggataaacatttttcttgatgtgtagaacaacgggaagatttgaaatataaattcaaaataagcgggcatgggtactctgcgtttgtgtcgtaacgcgaaacacggcggcggcagacttcagcagcacaccgggcagatcagcacctcagcggggctaaagcaccatagctcacgcctggacagagagttattctcgtctgcattcgctttcctaagttgcatatctccggtctcgagtggagacagcgactctaaccctcatcttgcagttaatataactgctgatgcactgctggttggcgcgaaacacacttcatgcaagaacagtgtcacctgggttgaagtctatacgctgttaatatggacatactcccgttcatgctttatagagtttgacgtgtctttttagccaggtgaaacgtatatccgaacatgtggacgcagacaaaggcaacttctcgcaggagtcgcttcaccagtttacgtgaactacgcttggcagcgggaaatgcatgcaggtcccttggcctgcatcctgcgtcgtttaggtctgcagccttcgtcgccctgtgctgcagttcgcttttttctcaatcgagtggatatcggagctgagacagtcctctgttcggcagttgtcttacccgtttgcggaaggtgcttcctggaagcccaggcacactgagcaacactagtcaggtggtgcagcacacattttgcgagttccttttccggagccacactttctttctccagtacgtcactctaagcgcggaaaactaatttcttagtaaatttctcactcgtgtgtgcatgccgtggtccgccttccgcgacggcagtcgtcgtgtatcacgttcgcataacaagcatgttcgataccaagttgccccgccagcaagccccagatatttacgaaacacacccaacgagatgcacactggccagaaagccgccttgacactgatcgttggtgtgtgtttgcgtgtctcttggcagcttcatcaacgagtggtggctcttcatgacaatggattttcgcacgagacacgcctgtttgctcgatgaatttgagctgtgcttctctcccgatcaggtgttatgaactgcgtcctggagcgcgaagtagttgttttttccatacagggtttaaccatcggcctttagtatgggccctcagtgcacggtactgaatatccccagaagccgaattgcaatttcgcggcgtgactgccccctttcctgtgctttggaactctaccctcagtctcagtggctgtatgcttcctga

SEQ ID NO: 2345 - DNA, 1310 bp, Toxoplasma gondii
ggtttcggagatgaccttgcggcctcttttgtctctcttccgaattcgcgggcgcgcgtccacgagcgagttccggacgtctcactccgcaagcactcccagcgttctgtttctcgctcctcttttccttcttccttctcacgcgctgtgccttggacgcggacaccaccagctgatgcggcctcgcttcttcgaagagaaacgccgaacatccactctctcttgcgcgcgtccgttgggctctgaacgaggagtgcgaacgcgcaggagacgcgaagggcgttggttctcctcgttcatcccctctcgcgcgttcagcctggatgcagggcgcgcgcctcgcgcccccagaggcctcaagagagaagtcgcgacacacagccttctcgactgcggctaaccagttatttgcctcgagtgtctgaacatctccagagcgcaggagagaggaagccgccagcgcccgcgtcaccgcagagcttagactcgcctgaatgcctagggaagctgcgtcgagaggcgaggaaagacacgcgggtgtcctgaagcactgctccaagatgtctgccaagaactcttcacactggacgtcaggcgagtacgcacaacgagtttgcgaaggcgcagaagatccggggaagccggcatcggaaatgtcgacggccagccaccacgttggacgaccaagtcgcgtctgcaaggactcacgggcggcctcggagattcttcttccacgcactgcgagcacggaagcagcagaggaagcagagtctcccgtcgacttccacgacgtctcgttcactggccaggaagacgcccccaccggaacacaggtttcagatctcttgcgtctcgccgcctgtcgctcttcctccatgtctacgtcggccgctttcctgctttgctgcgttgctggttcgtcggtcttcacccctctctgtcggtggtttgtttcagcagcgcgctggagggctttcgaggatcgacgttcgcgccggtccgatgaaggagttcccagctggaaggcgaaaaaaacagtttgcacggagcgaaacggaagaaggaacagacacgacggccttccattcttcgagttccgtcagagaaaagtctcttttctcgagactctggagaactgcggtcccggcgaccgccatgatcctggaactcggtgactccgttgacactgcggtgtctgtacacctcacacaccggcaacttggtcgcgcatgcgacggttccgctgtcttgatttgcggtgcaaatcgcccttgtaacgcctttgaaagtgaacgtctcttcgcgagcga

SEQ ID NO: 2346 - DNA, 4818 bp, Toxoplasma gondii
cgaatgaggattcttggtccttactcaagcgtagagcatcgcattgactttcagcagctaacattcaactgccgccgttgtcggtgaatctcagcgacggtgacacgaacatgatcaactgtgcaagcgacagaacaacaagtcgttgcaccggagctgtaccatatctcgaatacacggatggggtacatgagggctcaatgaaacctgaacctgtactgattctttctgtgacgcagcgtttttagaacgggaattcggttctctgacaccggtttttgcagtttgaatgctttttttcaacggtacaagaaaacagcacttgggcctaggatgtgccctctgctgtgtgttcgatatccgttattcactttggatgtggccgcagagcgctgcggagaaaatcgtctttgcgcaggtgaaaagggaggagacagagcaacggcgtggaggctagttaatggttttcccactaatgaaggactcgcacccaaaggcaaaaagaaaacagcgcgtccgtccgagatctgtgggctaatcgatccttcagggtcgacgtttctccccaccttaagaagagaaacttctaggcggaatccgcaccatttttttgttactgttgcttcatcgaaggactttttatgagaagccagatttgagtcttcacacattggccaacacgctaaagacagccctagacagaccccctaaatatcagccagcttccaccccctgttctaggttgctgtggatcattttttggacaacgttccaaattcggtataagtaaattagcggggtgactgtgccggggcagtgagaaacaactatttctgcggccacgtcgattggtactgggaggtaggaaggagttaccgaaaaaagagcttcctgaaactccgtggaagaaccaggtgtcacctcaatcagcccaactttacgatctttcgttctttggcgatgcgcgactctgagtcacgacgccggggccggggaaccagtggacctcctgtcagtgcttgaaactgtctctttaccaaattcagcagcttacctgtataaaggaggatgtaacacgtagaccaacgtgcaatgtagttgactgcttgcgacaccgacatgctattttttcctctttcgtggtcacaaacggccaaagacgttttatttttcgcgatgctctgcagggcttttccaggtccgaatctcgacagaaaacccggaatcagtccaagtgcatgcatgcacgctacaactgccagcaaagcaggcacaacgcgggtccgcgcccgattatacgagactgatgacatgcccactaagcgcattgtttttattgtgaactcactgtgtgctttcttccaatagcaacattctattcgaacttcagctccatcgtccctctttgtcctcctgtaaacgttccgtgacagccgcacagctcggacgccgtcgccttgctgctcgtcgatcggtgctgtgactgcgcttctgcttgcctttttccgacgacacccctcttgtgtcgtctacgatttttgatccatggccgggtgataggagggtcgtggcatgccttccgacactccaacttcggtgtcggatttgctcaatcgcaaatgccgctataattggcttccaaatgtcgtttcgttgctttctcagggaagcgcggctgctttgatcatttacctctgcactggtcactcgtgtgatggacagccctgagaggacctctctcgcagtccagacttgtgtaggcccagtgagccttcgtagctgggtctgtttcagacaagacaaattgtacttcctgaggcactagtcgagaaactgaagcattcgccgcgcccccatgtgtggttgacactgcatgcacacgccaattcatgaagcatccccgagtgtgggagacgaggaataaatctgctgtttcgtcagattgactcgcccagattatgcaccctgatcgtccacaggacctcgtcagtttccatagcctgaattctctgtattagatcagtatttctccctgaacatcagtggttttcctgtacaggaccgacaaaaagtgtcatgcgtttgacctatgtatatgtgtctatctgtgtatatggattttagtagacactcgtgggtaaggcacccctaagaggggcagtgagaggaatcccctacgaaaacccggacaacgcaggtcgttcctccgggtggtcgctcgcgtgaaccatcctagaatgtggcggatgattcaaatcagctgacgtaccaatggcatctgaagccgatatccaggtgcggttgcgccggttgtggcagaagcagcgggaaattgttgcgtcggtcgaagaacagttgctcgacctctcgtttcctcctggaggaacttttgttgacctggagaaagctgccagtcggacggaatcctacgtgaggctgctctttggtagggctagggctatggatgcggacgatccggcgtctccgcgtaatggtcaggaacctggctccgtcgatcccgagacagggccgcgcgcttcttcagctgaacagcggcctgatctggcgtctttgatgcgagttatcaaggaaattcacgttgttacgaaccggcacgctgctgacctgccttttggcaattcagcaagtgctgacggcggtgccggaggcgaaaaccgcgaaccatttgacgagcaagagcgtagcttcagggatggagcgtcgagacagctcgagttgcaaccgttcaccgaagaacaactggcacttttgcaaaaactgagaggcaatctcccgccggcggcgacagatgaatctacccagctgagggacagccggtgaccgaagtagctgcttttatggaactgtgataaaaaaacaccgttacataaatagtgctccacgctattgtacactgcgtgaagtctagggggaggtcaagggggtctgtctgaaatctcggcgaatgttcctgagtccctcgtgtacggatccgtgtttcggggggtatgtagattatcgtagtttatgagataccgctggtgccagggcgaaggcgagtacctggatgcggtaggaatgcgacgagttaagtcacgcggggaagcaaccttatgtggcattacatattctcatgttcccatattcgtagcacttcggcacttgaggaggaacctgctctgaaaaaccggtgaagcaacagggatttattcggtgctcctcgaggctggcgtcgggctcgatttgcctggcgaaaagcgtttgaagctgtgcctcactatatatcggatgcattgacatcagatgaaattgtgacactagagggtgcgcatttcttttagcagaatcgacgtggtgcagtattggagaggattaattatatccgtctgagcatctaggtttatactcggatatacacgttatacgcaaacttcttggctaaacatgtcttttctttcaaacgtacttcccttctcgccgttggtatcgtgtcaagcaccagaggaccgcagagagcagacttgcttctgtagtggcctctgcgaagacactcaaatatggacaagatttgtcactcacacgttgttacactgtcagttgtcgactgcggaaagaatgtgaatcaccaagttttcaaccgaggaaacgcctcagcacacacctcggtgacttttgcaaaatatggaatcctcctcctgcgggtcagtgagtgccgttggcaagcataacctccagaccaatgcaaacatacttctttctctggtttcaagggattggtacgaagaagttaccgcgtcttccgttaaggcgacatctctggtcatctttctgctcgttggaaaaggcaccctccgtgttgttccacaatgttggtgcccatcattcttttgcaaaccgcgtcaatcaagccagggaattccctcctcgttaatgtgtgtagaacttgccatggcatgacttcctctctgcggagttccgattcacagactcttgaattaagccacttctctcgaatctcgaatgacggaaagttcgcacaatttccgtcaagcgcttgctaccccagtgttcacgacgctgtcagcttcgtcagtgagactcaaacaatcatcggggtttgggttttaatacaatgtggatgttaattccttcatcctcgtctgaacctcattggggggccgtactggagactttccccttcgccggaaccagctgcttcaacagcactctggggagaacagccgcagacgttaattagtcgcttgccttcgctgcacctgcatgcaggaaggaaagccgtctacggactccctggtagagggaaatgaaagcaccataagacatttgttgtttgcgtgcacacaaacgcttggatcgagagtgagacagcccccgcgcttctccgcggcatttgagacatccagacgagccggacctcgttgcatagctagcacctataaatttgttttttttttacggtagcatgcgcttccacaacgatcaactagcctcgctactgtggatgcgggttgtcttcttttgtcactgtcgcgtctgaatttaccggcgggcgaaagaagaggccgggaacgaccgtggtcactttgagacgaagacgaacgccgccagctccgcctttgcaggggccgaccaacaagccacctctcggtgcgccttctttgcgcacggacagctgcgatgctttggaggtcttggcaggcgcaaatgaaaacattttcttttttctcaagccgctccgctcccccagctttccgtctgttaagtgtgacagaacgcggggatctgttctggatccga

SEQ ID NO: 2347 - DNA, 1916 bp, Toxoplasma gondii
gcttgaaagtgacagacgtttcacttgctatccggttaaaagacataccgaggcagagccccggactcgcgtcctctccccccatttccgccgccttctctctccgaccacctgaagctcttgctctctgcccggtctacatttccttctccctcttcagtccttctctcccctctgttttcttccctctcgtgtctcccatctctgtcattctctctctttctgtccttcttctcttcgtcccgtatgagagacaacgatttccagaaagtggagaccaagtgggcggccgcgtccccggtctgtggagctgaggacagcgaaaagagtggacggacacacagtcacgaaacgagacgcagctttgcttaggcgagtgaaatgcaggcgcctttctaaagagagatagcgagcaacctgccgaagactctgcgtcctcacagagaaacgcggggaaccgtgttgcgacctcagcagggagaccggaacgcgacggtctctcgctctctgcgtccgaaacaggaaagcgcgaagacgacgaacgctacaagaacagaagaagagttagaagaatatccataggcagattcgaacgaaaattagggagatcagcagaacaatgaaagaggtgggagaggttcaggagtatggccagacagtcgcggtgaactgagaaaaggagagaagacgagagacaaagaaagagagatatctgcagccgagaagaactccagctggaggagttcaggagggaagagactggcatcaaggaacgaccacagagagtgaaggagacaggaaggaaaacgtggctctccccagaaacagacacggcctgagacacaacggtgaacctctttgaaggagcgaagaagcaagagggcgttggagagaggagaaagaaagggcagtttcgactgaagaagaagaaaatggcgcgctgcgaggcacggacaccactgaagagactggcgaggaccgacaggtgagagacgtgcaaagacacagagcggcaggaaaagcggaggaaagagaggggagataagagtggaagtaggcagagatgagaggacacacgactgccaaatgagtttctactggttttttgcgccgcttgtgttttccacttttctccgctttctcgagagaactagctcgatgcacacggagcggagagaggaaaaccgtgcatgcagacaaagccaaataagagcccgtcactttaccgtttctggaatcacctcgttccctcccctctttcgactttatgttctttcttcctgcgaaaaagtctcgctggtcttctttttgtgcgccacgtcgtttttcttccgcgccttctcttctggatcgtctcccgctgtcctccctgtttttgcgcctcctccggtatcatcttgcgttccctgtaaaaactacaactttccttgcttccccttctttttcctagacttgaagcgcctttttatgttattcttctgcagccttctctcctttcgccgcggtgtcgggttctcctgtcttggcgcgcgccagtgacgacgccgacgcgtgtgaagctcgttgccgttttctcacgcttcgtttcgcaattttctggaaaacgactctgtctccacctttctgtccaacgcatctatgcgacaagtgtctcaggtctgtttgtgcgtggatgtcgccatagatttcaaggtcgacccccatttgttgtcctcgtcgaggaacgaagacggagaggcagctcaggccgttgtcttctgtctttctctcttctcccgcgcttccttcctgttaatccagtctccatctttcgtcgctgtctgccggtcaaaatcgcaggacactttgtcggagtcttctttctcggcttgctggtttgctgcgctcttctgctgtgcttggaaaaaccgtcagaa

SEQ ID NO: 2348 - DNA, 2340 bp, Toxoplasma gondii
ttctatggacggcgagcttttcagtgtgtacgacttcgttcgtctcgcgcgcgtaggcgcacaccttgacgccgcgctagtggaattcgcctgctgccacgacgtcgactgtaacacggctgacgggggaacgcacgccacagcagatatacagaggattcttctccacaggaatgcatggactgagttcacctcgtttgtggatcgcggatggctcatgattattccatatgattctgagggaggatgccctgtcatcaaaggaggccgtaaggctcattatggggtaattgtggggcacgcgtgccgaaagtctcagcaaagcgtgattatttcccaggcgggtttgctatcgccgtctggtgatgaggcaggcaactctgtatctggcggacaatgcgccgcgtcacccacctcaagtggcggggacgagaagaaaactgatcatgacacaagtgctcagcagccgaccgggccgcgagagttgtctaacgacgacgtttccgagcaacgtctgcggcatcgaatcgaggagtgtccgcgtgcatgtggtgagccgtatttgacggtggcaaatgcctcgcactcgggcagggcagtcgtgattcagcacggcaggtcccgactattaagtgtagcactctgggaccatctcatgaactcgaacgcacaactgtggaaagtcgacaagactgctttccctcacgcccgtgaaatgaagttgagaaaccgagccattctagttcgggggttcttgaatataaaaggcgcgccaacagggaacagatgagaggtgactacgaaggtgtttacaagaatagagaatggaatgcaatttgcattgtgcgcgtccctgcatcaaaggataagccgcctgcgacggctgcggtggtgggatttacggggcggcgaccaatatgaaatttgcacgggttttacgatacgcattctcgcggccaaaacatgtggacaggagattcgctggttcccctggtacggtgggtaaccgggaaaagcagtgcgcttcgtttttggtacaaagaacacacttatggtgcaggaccgctttcgtagttgtatggtaccatactgtgcatccaattacgtgatttaagtaatcgcattacttccgagaggtattcatttttcgttgtaaatcgtcaagggcttgacctcgacgtcctgacccggagtctggtgccggttgatgtccgtttgtcatgacggagaatcgtttcctcagcggattgcaaatattctggtgtttcttctaaaatgccattttggcattgaaccggcgttctgcggaagtaacagaaacatggcgttctgcatacattaatcaatgcccagtgagtgactctgctatctgcggaagtctgccaggattattgggtcacgtgttagggcgtcgctattcggtttacatcgtttgtgcagagcacggacaacgatccgaagctcatccgttatcaatacgcactgcgctctgagaatgaacagtattgtagtgagagcaagtatcgcactctcatcttctagctcttacccagtcaaatgagcagccatgacagagagcgggaagcagatagcagtccgttggaatatgaaattgtgttatattcggcgagactgtcagacattctttctcctctgatttatcgataatagaggattcataggcttctgcgtattcgctaggaagatctccgtggtcaacttctgttacatcagcacatcttacgcccaccataatccaagcagacatgctgtcgtaatacctcactagcacagattgctttctgtttatttgaaacgagtgtacgtagagagacagtacatgttggagaccttgattttgcttacagaaagcgggccgtaaacccggccaaatgccctttcgttcgtgaccctggaggtggtgacccccaggctattggattttgcctcctcctgtcagagctcctcagggcgggtcaaccgtaactatacatcgaacaacgctcccttttcccagcgtacactaactaccttttcaagcaatcttctgtaaggctaccgttgttgccatctagagcatagttttcttgcctggaccttccagctactctagaagaacaacccctcggagaatctcccatttgtcgccttgcaacgcgcaactactacgcgcaggctgctttgtggaagtgtgtgacaatttggtaccagctattcgcgtcgcatggataaacccgaaaatctttagtcttttcttcagttttttctttttgtttctgcgcacagtgggaattttccgttagcaggtagtcgggatttcgcggaggttccaacatcgca

SEQ ID NO: 2349 - DNA, 1459 bp, Toxoplasma gondii
cagaaaaataggcttcgcagagattgtcagtgcatgagacaaccgcgaaaagccggcagccgcggtaatacggggacgaggaaaacgactgagcgtcacaacagaagcagccgagtaaacggcgaaggaaatggaaaggacccaagtaaaatttcttgaagaatttcagcgcaacaactctgcgggttcttgcgaatagaggaatttcacttcctcatcgtctgatttatgctttcatcatctgccgctcaacagccgaataaacggttctcggtggcttccttaaactctacttcagtagttgaaactcttttgcttcacgagccttcgtctcagccctcaccgtcctgagttctgtctttgttgaggaaagctcccgctgaaaaaacaggactttgtttgcagatttccatgtgtgctggaaagtgagatgtgacttggggaagtccgctttgaaatttccattgttttctcaaaatgaaaagtctaaaaaatcgaagtgcgtgccccgcgaggaattcccctctgcagatttgttttgcatttgtatgtcgtttttacggagaaaagtcccaagctgctgctccttctctaactagatgttgaacgctagcacatatgcaccagatgcttctgaagtatacctaaacgcaccttgggaacaactgtgctcccattcataaaactcatacaagtcaccaagcatgccatacccgtgagacataacaacggaagctagactactcccccctgttattccacactatcgaaaaggattcctaggtttctatcctctgccttttcctggggcacactgcagagaaactaccgtcgcgcgtacctcccgacgtgcgaggcgatagcaaaacgcttttgaaggaaaaagtcgagaaatcgacgagtgcgtctcttgcatccgagagagagatccaacccaccgagttctcgcatgtgcagcatctgcaagaacgtgataatgcatgaactcgatcatcgccttatctgtgtgcatgcattttcgaaaaagaaaggcgttttctgcgcggagactcgcgcggaggcaagacgagactttctcttcttccaaactgcgagccacgggggcgcatgcaatttgagcatcacgcaaaatcccaaaacgggtggggtggagccgcaaacttttttggcatgcagcgttgagcctgagctgcggtgggggcttttgtcgcgagcgtggggtgccgcgagagagcaacgcggcgctacgcggccgacgggtcttctgggaagcctcgcatttcctcgacgggttctcccctcaattctcttcctttctctgcgtcttcctcaggtggcttcgtcaccggtttttctcctcgcgttcgtgctccgctgtgtgtccggagtgccgcgacagatcgagggcgttctccgcttccaccttgcggttcccaatttcgatttttctccgtcacca

SEQ ID NO: 2350 - DNA, 1509 bp, Toxoplasma gondii
gagaagacggaagacgaaagacacgagagaaagaacagtgcagtgtcgtcggtggagacgcaccatagggcgaaggcaaaacaggtcggttgcccatcgtgcttccgtcggtcaggagaacaatgacgaggatgggagaaaatcaagcagttcgcattctcttctctcatcggaccaatgctccaatggcagaatcacggccagaaatgaatcctattctcttcgaaaatccgttttctcttcttctctgcttctttccgtctccttgtccctgtctgtttctttctgtctcctgtttgtctcttgctgtctcctctctgtccattctgtctcctctctgtccctgtcgtctctgtggctgtcgaagagagaacgagaagccagaggaggcagagaggaaggagaaaaagattttcgacgaactggactcgctggaagatttgctagaaagctcttttctccgttcgcgcatcggacggtcgggcagaaggaaacaaaaaagacttgacgcgcaagacaggagaacagaggaaaacgggagaggacctgaagcaaaggaggcaggttgcgaacgaagaggagagaagagagagaagagaggcgctcgagcagaggggggaagaaggaaagcaaagagaggaaagcatccaagaacagcgagcacaggacaggccgtcgcgatgggcggggaagaggaatggagatgaagaaatacgaaagagagagaagaagagacaggaggaacagagaaggaccgatatggagtaacgggagacagacgaaggaagaagcagagacagatgttcagtgaaactgcgattccaaattgacagcaccccagagagctcgactcgtcagagacattttcccgccgcgtatcttcaaaaacaaaagagttctggatgctcgagcttctctgcgaatcttctgcctcggacgtcggtcatccttttgtcgaggagacgtatctcctaaaagaaagcgctcgacttgtctcgaccgcgtagctcgtaactgcagaaggtgacggcggcatctgtcgcctaccgcctaaaaaggaaagagttacgccagggaggaaagcggtcttgtaaaagctggtgcgacacacgaaacaagaaagaagtctcccaggccgtcgagcccgccgtggcaaaaacggcccgcgtttgcatgcacgagtaatgggaggtcgtttccgccctgtgactcaaatccgtagaaccttagatatttgtctcgacgtccaggctgtctaacaatttctcttgcaaagaaatcgcggctcttcaactctgcggtgctgcaccctctgtggcttctctacgagcaacagcagggtgtccgctgagccgtgaaaagaactcgccctgcttttctctactcgctctcttccttggggccatcggcgagaataggagctgtgtatcgtctctccctggtctacagcgagagaagtgtgcctttctttctccgctgtgcttttctccctcgaactcgcttcaagca

SEQ ID NO: 2351 - DNA, 1520 bp, Toxoplasma gondii
aacatcgtcaagtgaacctttcctccaaggagaaggctgctcgccaggcgaccgtccctgtatttgctgcccactttgtgaagccgaaacgctctccatagagagacacaacttgttcgtaaaaggcacgcataactcgaaatggagagagtatgcagtctttaccccagaaggacaggccatacagagtgcatttgacggcagatgctctggcacagtgcttaggaacagaagtaactgacagcaaactgacttttaaaagagcctcgtttggggacttaaaatgaccgacagaaaacacgcaccgagcacggcttctacgaaaaaacgtctacgctctggtatctatgcacacattttggttgcacgcaaagtcccggaactcagcatttatgggtgaaagaacttgcgataagcgcttttctcaacagccatcaacgaagagggctgacgtccttttggcatttctgccgaacaccctgaaagtgtttgactgccggcatgcacaaatccacaattctttgacagcggctttcctactctctgcggaagagaaaaagtcaaatagtctgtgaatggtaccttgaagtgctccttccgagcagtggtcacttctgtcggcacagcaaataggcatgtacagagcgcgcgggaaaaggtcttttcaagtaggcctcgctgcacatgtgagttcacagcagtgatgtgtttgttttcaactcgcctgcgacaagcgaaaaagaatctactgcgaccaactcccctagactgctgtttccttctgcgagcagaaatcacctgtgcgcagacactgattgtggttgtagttgcactggggatgtcttcatactaggaagccgcattcccgaaacggcggccaagctgcttcttgtacgtataatattgcgtcccacacaaacatcaacgctcgcgagggtgtgcatctcgtactggtgtccggttacctgggcaggaaacgagtttcgcatagagtgttgttggcaaaagagaatgtagtagtggatatagtcgcgtcaacagcacgctcgactcacgaggctagaaacgccgtcgagctgagacaccctttgaagagcagaccgccgttgttatccgcgtccacagcctgcgtgcaggcgtggctgttgtggacagcctgaagcaataccattcttttcttgtgtttgaccctcgtgaagaattcacacttggatgcgtaccgccaacgccgtttgtcgattgtgagtctgagccacaacagagcactggtgccaggtgggagtgcatcggccgatgctgggaaccgatcatttttgggaaacccacgatacactttcgccgctagtcgtgcgtctgcgccatcccacttttcgtcttcgatcgatctctggcttgcatccaccggcgataggaaactttccctgtttggtctggcgtttgcgtgaacgctcggtacgcactctgcccggtcgaagaaccgtcacatacaggatacattttccctttgttgtttgtcaaga

SEQ ID NO: 2352 - DNA, 3163 bp, Toxoplasma gondii
ttgtcaatgatgtttttctcatttgacggccgcacgcacaacgtactagatgctacaggtttggctgggtgggaaaaggcgcatggaggccgagctttcagtcgcttgcgccaagtaattcaacctgtttcgacgatgtcatgtggtgctgcagtcgccaacagagacaggactcgcatgccgttgaaccgttcactttttggatttcgaaaggttcaaactccagcgcgtacctaggagccttttctttatcgtttgttccacagttttttcttcgctcacgagtgaacaagatgcgtatacgacactgtggtttggatggccctcgcatagctgaatttaccgcgcgcttctcgcgtgaccgggcatcgaaggcggcttttgacgtgaacacaaatgaccggttgggttgttcagttgcagaggtacaagataccgtagcttaagaactgtgtttctacaatggccagactccgcataaataaaacaacgcgcgcttggcctatcagtggtgctgcagtacaagtttgtgaaggaaaccaatcggctcgcctgtttggaagtaggatagaggaaaagtgcatgtatagaccaacgactggccaggagttcccatgtgtggtcttccatcaacttgctcaacttcctgtccgtattgacagctcaccaggctagctaccagcgcccagcggaatccgtcttagtatcgcagtctacgacatattttatttatttccagaatgcttgtttgtcgatgtaattttgatgagttctgttaaaaagtaaacacgaggcgcccagatcaaacgcggatgcccctaaaccgtcctgtatcctcgaacctcttatacgagctgttctagggtctcccagttctacccgccttccgtgtccgctctctttcctctttaacccaacgaagaagccggaaaatgcaggaggtgtggctcaatctgcggcattttcatgatgtgggaaacgtagtcctgccaaacgagtatgtcgctctcttccttaccgcttgggcaactgtgatctggaagtatgcaaattgggggcacaaagtcatgaatcttccagctagcctgagctaactttttcttcatgggttctgtcctttatgatgaggtttgtgtcgttccaaaaaagtaaaaaacattacttaacggctcgcaccatgaatttacaggacgacgagcatcagcagtgaacacatgagaactggctctggacggcgaaaaccagtgtgctcggcaaaatgaatctgttttcctggtaagaaagatgcattcgcccgcttttctttaactcgtggttgctgttcacggtgtgcggccaaccactattctcgaactcggtatttttcgcctctttttctttgtctttttcttcgacctgggtggcgtgtcgtgggaatcgacacccactcccatcgcgaagaccaggtacaacgggtctgagacggttttacaggtacggtttcttgagaccccccttggaattcgacgacacactcatagttgccatttcacggaaaaccacatgtgaaacggctgcgggggaacacccgtgcagaaaggattcgagtgcatgaccgggcaattatgtcctgaggcggacagcttgttacttgctaacgaccagacatagccagtttgactctcacctgccgtgtcgcttgcgcgtcgctcgacgagtccccagccctttctcccgtctaaagaaaagacagcattttgcatttcgttctaccatgggatgaaaaacaaaactgtcacttgaatgcagactacgtattcacccacttagacgtacgagacgtacgcaggcatctttgtatcgataattgccgacacatatatgcggcacctgtgtatgcccacgcaaccgaaaaagcgtgtactcgtatctttacagttgaatgacggaaacgtaagtaaattttttgtaaatcgtgaagcagggtagttgtgtttctcattgttgtcgacactagacggtcgactatgcacgcgtggagttacacaagttttaaatgagtcaatgaggtgttgagccgcatggccgtgcgtgcgcctaaatgtttttttcggtgtgacgtaagcagaaaactgtaaatggggcagaagacggtgtgctcggcaagcagccagacctttttttgttatttcaaggaagttcgcgcgaaagcggatgactactcgtggcttccacgcatttcttcactgtcatcttgtcggctaggtaaacgctttttgagccccgtaccgccttgtgtttatgaaactgtgcgtggcacgcaggtcctcccagttgctcggcaacagtatattcaactccgcattagtcctttatccactcaggaatcatcagtctctttctcgggggcgcagctgtcaagtatttcacatcgaaagggacaccgtttttcactggcctcccctcaggcgctcggcttggtgagctgtccgagttacagtgttcgtttctgtttctgggggtaaacgaagcagcaaaagtgattaagcggcggcaagtatacttctgccagatggcgggagtatgcgcgaacataaaatcagatgatccgtaaagtggttgtgtgctttgttagtgttcatcataactcatattccgtttggatgtcttctccgcttcagaagaattcgggactcctaacaaaaggcgtatcatatctcgggcttcttcatctttgccttcttttcttcctctgcctcatctgctcctccccccgcctctgcactttcttctacttctcttcctgtggcgcgaccctagcagtttcctaaagctttcagaggctttccaggcacgcaaaccggcggggtgacgcatgcaaccgcccactaccctccggaatctgaggacgaacgcttaaaccgacagaagcgttgagttatctcagtttcgccgtcatacttatcattcaatcagctatatatatttatacattcccatacttcagacagaagtatgggcgtacataaatcctcttaatgtattcgggactaaatatgcgttgcggagacgcattttgagttgtatgtacaagcaataattttccgcttttttcctacttggcatagctgttgaaaaggcgaaacagagaaggaaccctttgtccgttggaatcagtcaacga

SEQ ID NO: 2353 - DNA, 2497 bp, Toxoplasma gondii
tgaagaagatcaaagagccgttgtcttttgggtgccgtgctttgcgccggttcttagaggcacttttgccactcgcatccacgcctcttgtcgcaacctcggtggatatgcttcgatctttgctgtcccgaatgcaaacacagttccgctatttgaaggccgcagcggccggcaagcgggcaagaggccggaaacaacctaggattttctttggattttgtgttttccgagtactaacctatcaccccagtgccgtggtgcgatggcagggaccaccgttgttcgtcatggagaaatgtgacgtcaccacatttcaaatgtaaaagcacagagcgcagtgttccaccgtcagaaaaacacggaatacgtccgggttcgccccgccggtgggtgggtccatcatttctttctgcgttcgtgccttacgtcggcacgtgtgtgtgccagccacttttggtcaagtggcagccaagagctgtttcctgcagcggtagaagacaagaaaatgcagtcgtttattcgacgaatcagcctgtgacattgtatctgttttcgaacgactccccagagtgggtacggattacctacggtagtgtggccgcaagtcctatgtccgtattaagaggagtaacacaaccagaacaagaagtattaatatcccggtggatattgtgggtgcgacggctcacggacatccgccaatgtgtgtgctctgtgccacctgtatcaccacaaccgttgtcggccaggtggcaaacagatcccaatttaatgctggggtgcgaaaaacttagcaggtgctgtgttttccgctagcttaggctccccagcaaaattagagcattactagtaaaagcatctagtcagttcagaagacgcaacagagcattgcccagtgagagtcgacacggtttttagtggactctcgtatcagataacggcgcgagaaaactttttttccccctggtttgtgtgtccgcggcagagaagtgtactgggcgcctgtctacagaaagagaaaggttcgctgtcggaccctgagaagaatggagcagattgcttccgttcatcttcaagtcgactcaaatgagtgtagtccgagcctgctacggattttgaaggagctcattcagttaatagagatggcttctgtgtactgagaccacccgtgatgagcgcagtgtagcagcgagcactgttattggcaggaaaagacgaatctaacagaaatgacagaaataatttgaggtagttgacattcgcggcacatcggaacaccagtgttgccattttctggcgtgcttatgcgggctgaccttgtcgaggagacctttggtgttgctgcgttaactacactggcggaccgaggccagtgaactagcataatcaacacatgggcatgaaatactataaaacagagtcatacatacctagaagcatagacgcgtacggccgctacatcgaatgctgaagttgtgaacgtgtgagggagaaatataagggcgccagctagtgctgcagagtatttcggcaaaacgatgtttgttctgttctaatggtaagccgccggaccttcaggtaccatctttgaggagatacgcatgatatagggatgactgcagttctttcattccacaaggagcaagggagatctcccgctgtccgcgtccttcgaagatgaaaataaccaaaacggattctcgaggctgaaccaccgtgtcggtaaacagagtcgtgttgcgatggtttctggcgagctctacagcagcccaccgtctgctgcatagtaacgccaatcctatatattgcagcgtcaacgaggatgtcctccaggcgaatagctcctctaaagacgtttgtgccaaactatcaagcggggaaaacagtggattcgtgtagattcctttgtgccttgacccaagcacggaacacaggaaagtgagaatctgaaaaatctgtaccgctggaagctgtataggtgaacttgtgaaattacgagaagggaaaaaacgcacctgtggcgtgcgaagaggaaatgaccgacttctgagcgtttgtggtctagtggtagaatacctcgttgccatcgaggtgacccgggttcgattcccggcaaacgcacgttctcacatgcttcttatttcacccgtgatagttcgaacctttgttgaaagaacaacggcaccggcaccagaacatgcttcaagcaaaagttttcggctgggaaacaagaaacatgcggtccccaaaagcggaaattcgaacagtgcgagcgtttgtggtctagtggtagaatacctcgttgccatcgaggtgacccgggttcgattcccggcaaacgcacttttcttatccagcgcttcgaaatcacacaggatacttgtacccgttgttgaaagcacaacagcaccgtcgccagaatatgattcaagcatgttttcgacagagaaacaagcaaagtgtggtcccgaaaaacgggattgtcaacgctgtcaag

SEQ ID NO: 2354 - DNA, 3309 bp, Toxoplasma gondii
ctaccacattgcctacctgcttctcttccgagagatcctcgtcgatgcgacagaggaggaagtgaagacggtcgagaagaaccacgcagagcaactggctcagacagacgccgcgaagaagtccaacggcgaagagaaaaacacccagtaaaggggaaacgtgtgatgtccagtggaggggttgaaacgtggaaagaggaaaggaaggcgaaaggtctgtcgctcttttgtccacccagaaaagaacggtatgcgtatacggcacgtgcgagtgcttctcgaccgtgtggatacacacgcagcctcggagatgctggaaaagagagaaaacaaggtaaacaggaccgtgcaaacaccacgcatttcgcaaacgcaaggaggaacgaacggtggcttgtcgaactctacacatgcgataaaggtgacaggcagtcctgtgtgtcacagagccactgagactttgtcggcaatccccgggcgctatcggtgcctgcgttccgagtattccagaagaggcatcacatgcgcagaagactgctgaacttgtggacttgctttcttcattcttcgcggacttcttcggctgtgatcgaaacgattcacgcgtgttccatcggccatcaacaaaaagactcttgagatacaccaaacagatagatgtatgacacctgcagatagccagagagatttatggaatttcagcgtaggcaacgtcgtacatgacgtttatagataggcagggagcttcacagccttcaaccaaacgagctcggcgtgtctgcggcgttacagtcccgtgggccgtgaataattaggaatgtcaaacggcgtttaggtggccggcgtgcgcgagggcgtcttcaccgctgtagaaggaaaccgcgattccagcctgttcggccgagcgtagagtttcaaccgagaaaggcgaagagtttagtcaagcaaaatctgcaggctcgctgcttttccgggaaaggtcacggaaactagcatgcctccggtgacgatcgacgctccaacatcacccgcgcttcttttcgggacttgtagcggcagggaattttgaggatagctttgctcctcggagtcgcgcggtgcctgaatgcccgctggcacaacataatttaaacctcctgtcgcatctcctggcaatcttatttcgtggaaaagtgtcgtccccctggttacgggtaacgatggaaaacgcttgctgaggctaaagtccggaagaacgcagcgcccacgagctccaaattacgaagtgacggtttggggcgtgtgagtgcctcccattaactggttgagagcttgtacggtaattgtaccactgcaggaccaaataaggtgtgcagcatttcctatgctcttgaacgtttggtcagtgtggctcgccggatgactggagtgtctacgttgctgcttcgaggcaaactgttggcttcacgctaccaaaactgggaataactgtcgctcgcacgatctgccgtcgcacaacccgacacattccctttaccactgaccctagaaagcgtgcacactgccggcgtttcttggtttcgcactctgagtgcacccttgcacactcttccctcaacatcatcatgtgttatccggagcactggtattccggcagctttgacatcgctgtcgagtgaaacggcccgttctcatgggggcgcctaaccagcgagagagtggtggtggactccagctcaccactctcagggggtggaacctgcgacaacgcgacgtcaatgtgctggccgttactgcttgaaaggtggcgaaagaaccggcgctccaagtcaactggttgaattcgttaatctgccacgcttccgtctcagtcccccgttctggttaggcagacgttgtcgccactgccgcctttgcagggcacacccgcgtgggaggtaataaagatcctgcgtcagagacacaaagtctcacagaacacaaggcaagagcctgtcgttttcttgtccgggcacggtattcgggtagacgcttcggaggccgtttcggcgcgaattgcgacagcagcgcgttcggtatatcgggcagtttaggggttggttctgggtttttattagctcgagaatctaagcctgtgtgcctgtgagaccaaacacagaacagtctgttagcaacttgcatcgtgcgttccttcgtcgcgtgagcgccgaatggaccgagacgcacactggtgtgctgcgtgtctcgaggtaaaacgcggttttttgtgttgggttcgtagtggcagacacagtgaatgctggaagtagtgtccggttgcgacacgtcaaccgcgttgcttgttgtgcatttgattcgtgtgaatgagaaaacgcatctcgtcacgggaggtgactgtaaggggtgacacacgtttggtcgttgtacgtgcacgacagggccggtcattgctcggtaacgtggatggcagtctacagggatcagcgtctctaaaacgagtggtagttcgtctgtgtacagcaaaggaaaaggataggacctgtacttccccggtttgcccgaattgatcaggggtcgcatgtctagttcgctatcaccgtttgcaaggtctgaggatgcttcaggttgttgctcactggcgagaaagtcggcagcgcagcttgaccttcccgaaaggtgggaatgttcaagaaacaactgtacccatcagccgtacagagaaacgtgctcgtgatgcaagtgcgttcagctgttttcaagagcacgtccatgaaagtttgaaacgtggagtgtcgccacctacgcagactgagagggggagtcttgtgattgacccgtgtctgaacggagtaggcaggctgtttctctagtttacagcttgctgacccgctgatacaagcctataacgtcacacaacggccgttgccagcagtgagtgtgaagatgtggtcgtggtgttatcgttggggaacttgttttttctggggtcaaggactgtcatggagtcgctctggatgtggcgtctctggtggactcaggtagggttctgtgagtgaaggcgagactgtgaggtttcaagaggccggaggcgggggtgtggacgccggcgcagaattgagcctgctgaaagttgtgatctcagaaatctgaattagtgtaaagacgaaggcgtttagcggcggagacttgccctcccgcgggtctcgtgtctaccgctccgactctttgcgtattaacacgtctggtgtgacggaagagatctgtgcggcggcagtcgcgagaaggaaattaggcatttcgaatttgaagtgcattcgccttcagtggaaa

SEQ ID NO: 2355 - DNA, 2710 bp, Toxoplasma gondii
acgcccagaaactctgtagctctgtctctccttactcactaagagccccgcttccaggaatgaacatctacacacgggaatcgtccccatcatatgtatatatatatatatatatatatatatatatatgtatatatcgatatatctatgagtacgcgttttggtcactgcttcggtcgttttttctgtatggctttacccggggagcagcggacgtgcttcagcaggtctgcctggagcgttgagggcgatgaggctgtagggcatggattgtgtagcgcccgttgccgcttcttcctctggattgtgggtgattctctggaggagcactcttttctcctcctcaaaggcgaggccttcaccgtgaaaggctcgtgcgagacgaagcggcgaggcggaaggtcggttgagagcgatcggacgcatgcgactgccgcaggactggtgccttcgcttcgcagagggaccggagggaacggtggggcaggcggcttggtctgcagagtcgacgaccggcggaaagaaaacgagatgcgccatcgtgaacaacagggaaaatcaggtgcaagagtgagcgaagagagggaaggaaagggacagtgggtggcgcgtccggtggaaatcgaggaaggaccgaatcaacgtgatggagtagaccacgagctacgggagagtggagcccggcggaactctcagactgaggccacagcccgcgaaagaggagggatcagatttgatgcaaaggagcaaagaaagaaaggagagacacggggaaaacgctggacggcaaggcagagagacacagagagagtagggaccagtctagtctgggatcgaggcgtcgtcgcttgttgggggaaaagaaccggggaaactcgaacagcgaagccggaagctttggcgagattaaccgcgaacttttgcgctgtgtccgccttctttcgatggcaaggaaaggggagaatttcttcgtctcgtgaaggacagggtcgccgccgacgcgagtcaagacactcacgtggactggtgagcccgaacctacagattttaccgactcgagttcgagaggagcaagaaaagacaactgcagaatcgagagagtggaccaaagaagtctctggacttgttgctctcaagctttcgcggatgttctcccgacgttttcagctcgattttctcggtaggcgaggaacaaacgcaaaggcacgaaccggttgagctctctttgccggcgcgctacgatggccgcgcagctcgggtgcgagttagcgagtccgccgcttgcgcggaaacagacgaagaccgccgaagaaagtcccgcggacagctcaaaaaagcgacaaatttatctgcaaagtcaccaggcagataaagcggggccggacgctcaaagtcctcgacaatttccgccgagctggcgtcgagcgccagctgcagcgcgaaaagacgagagggcgcgcgcggtcatctggcactgggaggccgttcttgagtcggaggtcagcaacgcgagactcacgggcagcagcagacggaacgccggcttttcggatgacgagtacgagtaagacgcgcaaacgacacgtggatctgaaaacggagatatccgccggaggaaaaggcagaaaaagtggagaatacgtgatgtgcatggagcctggcgtcgcagcgagctgccgaagccccgtgatcacctccgtgtctgggatgtacataacgcctgaatgacgtcggcggttcttgggacgagaggccgagcaactccagaacgcggccaaatgcgtgtagaatcgcaagggcaaaagaagtttggttgcggtcttgccacgaaaagagattgcgtctcatttgcacgggaaaaggccccaaacggggaaccgcacgtgaacgcccgcctgcgagtcaagagagtttagggtctacgcagcagcagctatcgctcaagcggagacgacatacgggacagtttctgaatgtattttgtcgagatttcttcctcaacgacagaagcttcttgcccctttcatcgttctgccgttcaggacgaccgattggactgtctacaacgggtgttaccttgtcgccgccgcggcggcacagcacaaagtctttttgctaggttgttccagctgtcttcatttgccgactttttctcatgtgtctttgttggtctgcacaatttcgctctgctcgtccctccagttacgcacgtcttaggtcggggcggcttgcactttcctctccgttgaaaaacaatttctctgtttctctctcgtgcttctctagatctgctgcatgtgcgaccgccacgtgagcaactctccaggtctctccctcgcattatttcacactgctgtttaggcgtcgacgtggacgtgaaagggatcctcacctcttcaaaatcgatttttgcaggtttcctcggcagtcgagaaacgcgcagatgaacacacacaactccatgggtgtgtattcaagtgttgccgatagataatcagtttggagttgaacactaccgagctgtcgaggcagaagtgacagacacagtgttgggtgccttgcctcgaagcgtccccgtcctctacctcgtacaaagcggactccgccagaagaagcagagagcagtgggctgccaagggtggtcgccagggaagcacagcctgaggaacggagaagacaggaggctgagggaggaacatagcggcgaaaa

SEQ ID NO: 2356 - DNA, 2048 bp, Toxoplasma gondii
tccaggagcgtagtgtacatcgggcacccgcgatttcgccatatccgagcaagtccgagaacttcttgcaggggaaggaggagaccttgaacgtagggaccctcttctccccccctccggctcctccacccctactgatacggcatacattttcaatatcgacgtcagtgttctacagcttagaagaaacacccgatttctccctcgaacagaacaaacacatgcgcagcatggatcgtccagcaaggcagaaaacagcgctcaggaaatcaccgggaagaaagggttcggtggataaagaatatgctgaagaaagggttcggtgaagaaggagtatgttgaaaaaaaagggagggatgtgcggaagcaaggcaacgttggagagaagccggagcagccccacgcagactaacgggggcactgtattagaagttaatatgcgtgtgcaatgaaggcatgaactacagaagacaataaacggttaaaagaccagaaattccgcgtcgtttgcttcttcaatccttcgttgtggtcgacaaatgcagttgtttccagcaattcgatgcgtaagggcaagccgaagaaacaaaccgaaagctggaacgcgcaacgaaatgccattaaagcatacctgcttgatgagaaccctccataacccttcgacggaggttttacccatctattttctccactctcgtggaacacagaagaacggtaaattcacagacgaggtgcaaaaccgggtcttcgtgtggtcagcgcggttccgcgacttagcgctgcagtaccaaagaagcagcagatcgtctcaagacccccgttgtcgcgtgagttcagaactgctgtagacgcaatccttcactgcaaaaatgtacgtcgtttcaggaagaatttgcagggaacggagaccaaacaactcgcatttgtcgttggatgccagcccgccagcatagggtacttcggcaacgcctgcgctcaagacgaagtgtcgccggaaacagctcaaatccccgaaaacgccgtgtaaagatccggtatctttgaaaaagaggcacagtctttcagcaatttgtccctttctgctccacgaatctccggagcactcaatagactcaagcgcccaagatcggtgcacatgtcctggtgggtggggatttatgtgaaaaggaacggaagaaatgcagcctgtttcattcagaaaaggcacctgcaacggtgacatcgagatacggtttctgaggagaatggtaagtcttgaaaacgcgatcgttttgcgtcaacagtcgccgtcgcaaccggaatgttggtggctcggaaaccaccggacaccgggactgcagcacagacgccgtcctattgaaggactgtctacgaaaccctgcagttgaggcacttcttaaagatatcctacggacaaaaatgctgagcaaagaaagaagcgagatacttttcccgtcgcgaagatgtcggggtgctacggaccgcggtaggactggcggtacgaagacggcagagacttccaggggtgtcgcagcatgcgagggaaatggttggacaaacagggattttcactccgaagcaggtaccagaatctggggaaaatggcagaaaaaggctgagtttcctacactgatgtcttccaaggctgattcgccgatctggactttccatgatctgtacagagacctccccttcattaagacttgctgaagcccatcgtcttgtagctgacactgtcgatggtctgtgaccgcatggcgaaagtgtctagtcagaaaaaggagttcccccgaaagtgtcttgtcaggaaaaggatttcgtcccgccagatcgaggtatccagatgcctcgagtagttgtttgccgaacaaggctgccgatgtgccaagcggctgaaggaacgcagatttaccatcgaacggccagacacacaaagtgaggattgaggcgtttgcctcgtcctcgcttattccctgatcttaggaataaactgattcggaatgcctcacagcatgcgtcgtgtaagacgtagacaagtgctacaacta

SEQ ID NO: 2357 - DNA, 1649 bp, Toxoplasma gondii
gtgaaacgtgtttcaccattcgactgggtgtgtaagcgacgacgggatttcgcagttcgttttttcaacgcttctgtcgctcctgatcccttatccaagccaagagcatggtgaagcaataattgtgttgttcattgttcgacagcgaaaggtccgggttgtctgtctcttccgaatacgcaaatgaatcgattcacccctttacccccttagtttcattgacaggcatcggagaccctcgcaagtagctttagtcactctgaagtaaggtttggtgtctctaggaactcctccctgagcagtgccacatttgaaccaggaatgcacctatgtgaatacgtaatcgacgttgtcatggtagatgggagggtgtgcaactagacaacgactctagaagcaactcgcgtgagaatggctctatctccctacgaaaccgaaaatccgcatccatgtactcaattggatagcgtaagagcatttgcactagaaatcgtgaagtgcagatgctgttgactatcctttttgcgtgtaggcagttagggaagcgaagataagacgtcccgaacatccgtcttagcggggtagttgcagcacttgaaactcgagagtagacagatcgagataaacttcatttccgctttccctgccgataagtcaagtaatatacagcggacgtcggagtgtacttgtgaatcaccgcttcgccttctctactccgagctatttttcaaatgcactccgaaaagactctcgatcgtctacgtcgccagcgacgtaacccaaaggtggtgtgtgccgggtgtggtgtgaacgctctagtttgaacactggactttttctttgccaaggcttttgctcgttgctggagcatcgtggcttggattgcatatctttctgattctgaaagcttagccaaacgcttcttagtagcgtcaaaggagaaccaaggaaacccgacactttcacgagtctccaagaaaatgtggagttcattgaggtgcattttaaccagcggtgtttaacaggtctgtgcttgcctgcagctttcatttagcttccgtcggcgtggaaaaaaaccgactaagcttgtatcgcacgcgagcaactcttggggtacgacacaagggaacgccggaagcatgcatgttcttgcactttgcgtcccggtgcacaaaaattatttggggctctaaatgcgtgcatcgaaccgtttttacgccgtttttgtgtcggcaagagtcgttttctttgtgaaaaggcaggagagtcttgaacgtgggagaatagtgcaaaagacggaaatccgaatttcgaggcagatgacggtttcactggccccggctgtccttagaaggaccttagatcgtaattccgcagtgaagccacgtcgtcgtttcgtgttttactagccgggagaatcaagcgcgcacaacggttggatattccgtaccaatgacgaacgaagtaatccagacctccgactctctctcctttgtttgcttttctcttccgctgtccggcgttgtgcatcactttgtgtagcaagacagaaagcctctacgcgcttgcgcagcgcaaatcaactcactctgcaaaactgctatacgaaggggtcaaaaaagacactcaatcggctaccaaaaccgcga

SEQ ID NO: 2358 - DNA, 3865 bp, Toxoplasma gondii
gcaagagtgcgagaccggcaatagtggtgatcatggacacctccctgcttccagctgacggctccgtttctgctcctgccatcggatctgcaactgctgtctcgcccgtccctgtgttgccaattggaacggtaggagcaccgtttccttgatggctgttgccgtatggagggacatatgtggggcgttgaccctgaacgtgaccggaattctcacgcaaatgccggtcggtagttcgcatctgtccatgcggatggggagagcgagtcggaacatgcccacgttgcccgatatctcgattgccaagagtgtcagttctgtaacgagctacgtgtgcgtgggtgttctgcgccgaagaggtgccttggggcgtcgtgcctataggatggtgagacactggggagacatgaggatgtagcgaaccaccaactggatgagaggtagctgctccagctcctgctgcacgtgcgaatcccctcccgcctgtgttttttgccgccacatgagcgaagtgagcaccgtgagatgcgatgtgcgctgcttccccggttgtcgcagttagacttgaaggagcggaagccgccgctcctgtagcttttgaaaggaagcttccagatcccttaagcgcagtcacggcaccctttgaaaggaacactgcaccggcggctttccctcccccagccacagcggtccctgccgcacctgctgctaatgaaacaggagcagctccggttacggtgctggcagctgctgctcccccagcaggcaaggatgttttgagaagcactggtcctagagcagtcaaggcgatcagggaccctcctccgagagctggcattgttttgcgtttcgaataggaacaaatgtttgccaccaagcggacaaaatagcatgggccatcgagcagtgccacgtcaacagttgttttcctagatgacaaatactacgggcatcttgtggcagctaccatctctcacgctaaacgaaggaacacttgggctcagaacaggacagagacgtttgaactataacagccacaaggttgggtgatgcgttatcccacagagtcaatgcttccgcaatggagcgaagacgattctgaaggcattttgtgtcagccacccttcggacttgggcccgtgtagcgaaacatgaaacgtcagcatgttggactttcgtcgtgaccagccggccagcaggtagatcaggctcatgtctcagaaaatcagaagcaatacggtttcaaggtctttcctccagccatctgaagagccatttacctgtctattcccggaaaaaagtggaccttacaaattctgaacatgaagtggaaaagtaatgatttcggggacattgtttaaattttccgggccactgatgggaggaatgagcgcggaacggcgcaaatgtagagaagtgtttgaatcaagcagtgaagtggatataatcacaaggaactcgcgattgccgggaaaccgtttacacgaaagcgctaagtcgtagattggaaacaagagctgcccctttttgtaggtaaccaatagaaacaagtaagtcgacgtaaatgggatgttatgaataagtggcccccctccaccactttctttggctcgctacgtggtgtgcgagcatgaaaagacagccaatggaccggtgcacagatatcaaacgtgcgttggtcgctcacgcctggactacactctcaaatgatcgacacggcgtaaaagttagtgatgatgtggctattctctcaaacagactcaaagtctctttgaaacaggaatgaagtcggtttgaaagaagctcgtgtaggggaagcttaggtcctctcggctgtgtacaaataaacggaacagtatcctaaagcatagcttggtagtgtctgagactctcgaagtcaccagtgtactaaataaaacgtattctcggctgagacggttctagtgtcttagaactcgtttcaatgactggacaaacgtggaggttgagttttccattttctttaaatttcaacaggggatacgttcatagacctcccaaaagcgccgggtcttggagatggaaggacgagaggggcatcaagctgccgggcacccgacacaaatatcggcgcctaaacgtaaccggcttgtacaccgaaaggtcttcgaaacaaaattcatatcatcgtgttcatgaatgacaggaacgacagcgaggggagacgcttgctactggatgagataaggacgtccggtgggcggattattctcgtcctggtgtgacagtagacaatgcctccatgacgtttacgtgcatcgggtatccttggtctgcaatcaccattggttgattcaattgtcatcatatctcacactcatgaagcgatcagtatccgttcacccaatccttggacacaccaaatagaaccagtaactgcgaagttctggcagcaccaactacttcatttaatttctgagactacacaggctgtgtctgtgcagaacggattgtacctagacttgtatcaacgcgacataactggctgttccgcaaacggtgaatggggcatcccttaagaacgacgtgactggcagaagcgaggaacgaaaagagggaacagttttgttacttgccacttcgcccgcaatcggaatgttgacatttgatgtcaacgtcatcttcttgtgcagacctttcatggttgacgcaactgcgagattgcattggtggcactgagggaatcatcgttgggatgtggctgaactttctgcagcttggcttgtccaccggagcactcacgtgcctttcacgcttcactagaaaacgtgccaaccaagactgcagcttatcttgagttgatgtaagcgagcgaacacagaattatcatgaaatgagttgaggcatcagagttaaggtaaagcgtacgttcagcagcccgcacctacagagtgtctgtgtgacgaacgtcactggcgtgtcagtttgctcggcgtgccagatccattgacgacggctacgtttctcagaaagctgggatatctttccttctcgtaacgggccatctgccggtgactgcagaccatacaatctgaacagttttccttcgtctgtgcgacttagaaggtttctatctgtggctgaaattcgtagaatcaagaaggtactcgcttacttgtaggacaaaccaggcgtgcggccaactgatctgaacgagacgtcggccgccacagctagttgcgacgacgtgaggggcgctggatggatggtttgtttccgtacatgggactatctgtggagtactggagtctctgttgcagttcattcttgtttttcaaattataagaaggtaattgtggtagcttatgaacaacgtcttttcgcttctcttggcttaaaggtgtctcgaaggtttccgtgggggtgccgttgccgttgcgaccagcgtaaagcgagaaagtaacgcttgggtttgttctgatacttcaaagttgaaaatctcaacgttccttataagtgagcaagatgttgcaaggacggatctctagaggtgacactgcttttggtaccttcagtggacagccgtgtcgcagcagtttcgcaagcaatcttgtgtcatacgtactgcgcagccaagcgagtgtcttcacagtctttgctgttcttgtgtcttgtgtgattacaaagtttggcaccttgttcacacgatgatttcgtccggagggaacatgcacatagtttagggaaagcactgtattcagtctagtacgtgctttctggacaggcaagcgagctgagacacacaaaatgatgttgttctcttgttcacgagtctgtttaattccacaggattttggccccatttgcttctttcgtgtccagtgga

SEQ ID NO: 2359 - DNA, 2226 bp, Toxoplasma gondii
ttacctgatgtcgaacgaggtgaacatgctggtggttaggtaaggaaacggggtggaccaaataaatatcacgagatttgtgttaccttgccacatttctctgcacgtatctgtgcaggcgtcgatgtacacgttgccactcgagatttcgtagagcatgaattgtttgaggtgcttgtattcacctgcagatcaacagctttttgttttactcgtgagtgtttacgatatcggcgtatctcacacgtaaaggctgcttggaaattgctaaggagtttgaagcaacgagaggggtcaggagcctcagcaattagcccctaaaaaagggttctcatcaaacacgggttgaagtgcaccagcttttccactgtccatacccttcggaactggaatgtagtaagagcaacggacgtgcacggtagtagaccaatggtctgggaatagctgccctctgtcgaatatgcgcccacgaggaagcaaaaacaaacgcaccgcacacagatcggtattgaatttggagtaaagtctgtcaactcgtatgcacgcgccgaccggtcgaagatcctcccacgcttcggcgggtccttcactggctcgtacctggagattcacgctgaagacgatcaaaatgaaaagagatatatcttccttcactgtcgccatcatcctggacaacccaaagttacaagggactcagctatcagacgcagttgtaaatttcctgcagtttcccttcaggaatggaaaagatagcgagactcagttgtccgcgatctcttcaagcacactaagattcggttgtacaggtgtctctgtgtacatacaggtgcgtggaggaaaagccaactgaaaccagtgcgtgtgaagggtgaggaggacggctcaacatcgaagcagtgtctgcttgtgtacaccaagccgtctatcccccaattctgaccccgaaccttcagtgttttactgtgcactaacgccttctgctattgtgattcttatctgaacgccgtttctccccaccgatctgtcattgaaacaggcacactgagcgaacgccctacggaatgcttgctatggctctgaattccgtcgtcctgtagaagtggctagattctgccaaaccgggaagcaggaaaacaatcttcttgggtaatttaccaacactactgcagtagttctgtgcatcttcgtctcgactaccggtccaaataccaagttgataaacgctccccggcgggagttgtcgcgactataattgacgaaacaagacattcgccttcagaggcaatcgaatgttcttccgttcatgtgttgaccgacatctcctctaaaatttttgtagtagtcgcaaacacagctctcccagcttgcaatggtgcatctcacctggggttggtgtcgtcccctgaaacaacgctttatgccttttgagtgagagtgttggcgccatctggtggcatgagagcctcgcgttagcattttcatcatacaagaactggaggcatctgaggtgtcttctaccgaacacctctctgcagcgttgttttgcctagtggaaacgtcgcgtgcttgccagctcgttcgctaaccatatcgttcacagcagtagcagcagaaagcatcggcccttcccgatatggttgcctgacaagagtccaacagaaaagactgtggaaaaaagttgggcacgtgcgggcatctacgaaaagctacctagcggtgtacatggcggcgctgcgtcacgtttctcgtagcgtgctcgtctcctagggaatctccgcatgtgctgctagtgcgatttgctgttgcgcagctaatccgcagttcagcccgattgtgtcgtcctcgacgcatgtgcatccttgagtggcgtgcgctcaccgctcgtctctgaacgagcgattcgcctgtcgttatttcttcttcatccagagaacgagcatccttgattccctcttctcctctgcgttttgcgttacaaatttgtcaagtaagttgttcttcagatcttctgagcttgtgggaaatgtaggatagcgagtcgcgtggcagtcgctgcaaccctgtgcaagaggaacacgaccgggcggtgagacccaacaggatatcgagtcgaaacagcaagccttgttacgagtcattagacgtcaggaaaagatttgggcgacttttgatttgcgatgttgcaataaaaaatgtagccgaaaatgtgctgttgtgctaccagga

SEQ ID NO: 2360 - DNA, 1868 bp, Toxoplasma gondii
gaaaaaggtcgttcaaccagagctgcgtgtgtgtacgcaaaacatgagatgcagacgaactggacaacgcgtgtcagtacacacaactttcccgccgcaggtctgtaaatttcctgtcgtcccactgaggacattcggtactgtccggtttccacttattcggtttttgctacgaactcctagatcggggagctttggtgacagtatccatttatcgtgtgacagctgcactgcgtatgtagttgacacctgtgaacattatcttcctccgtccttagagatacttttgagtatggagagagaaaaaacgatggagagtgtttgcgtaacctgggtggctagagagaactattgtgaaaaaatcgtcatcgaagaacatgagaaggtttgcacatgctcccttttcaatgctggcaactcccgtagcctggaaccccagactggaaacaatggcgtttactcaaagttatccagtttcctgttggtaaccagagagaagcaggtgacatacgtgagaggtctgtttgagttgattgagaaagatggaacagatgaatccaaagaggacgggtggagcatgtgaaaatcggaacagaagcttcgtgctgcccgacaaagggggagaaacgtagcagctacatagagaggcgggagcgtcaagatgccgagaaataaagacgacgcgcatacaatgcccgagatagtgtgaaaacaacaccgttcaagagtgctttgtgctctttgctccgtgctactgggaaaaaaagcccagcgattcaacatcaccaaaccaagcgatgcttggtgtctttcttggtgtgtccgaatcgcgtgttccagatgggggaaagttgcagctcggcaaactttttgcaaagttactgatgagctctgcggcattcgtttcatttgcttctttgtcttcttgagattaagaagcagtgcaccaatgacgacaaacagcatgtgcggtgttgtccgagaccgtacagaagacattgagggaaaagctgtgaaaaacgagttcgagtgtctctaaactgcaggaaatgaattcttccagtgtagacacaaaaagtcggaaaaggagcagtgtggtgtctgcgtaacggatatatttcagcaagcgcttttgaagaaactgcagtatctgcagacgcagcagctgagctctgacaacattgtttgctgatgatgtgttccctagaaaacgctaccatttgaaactgtgtaaaaatatacagcagaactgcagtctccactttccttggtctccctgatggatctgagacacgcgtttcctgggagtgtcgcagctgcatctttgtcgccacacgaggaaagcgcgtcgaaaccagatgcggacatacgattgtgtcttccgcaaaaccagcagctagctatcaaggaaacttgccgtatcgaaagacccgcccccggttgccactccgagttgccagcgttgcagaagccgagcgtcgttccttttctgcacttcgattctggaaaatttccgcctgcgttccctctcagaaaggcttgtgtagtttcgttcggaagcggtttctgcgggcattcggtgcctagaaaaaggcgaaagtaccacgttgtccgcgcaccagatatgtgcgtctatggcgggaaaacggcctggtaagactcttactggccacaggtggaaatttgctgcggcttttgcgaagtctacctagcagaaacgaccgctgtttggtgacgggagcgaagtgcgatttcgatccacgtggtatgtgagttccgaactgccttgcgtttctgtgttcggcctcaagtgcactctgaattgactcgcgctgtgtagcaattttcatttgtagtggcaaacgcca

SEQ ID NO: 2361 - DNA, 4953 bp, Toxoplasma gondii
aaggtgtgttttcttgcgagggaagtcagagcagggtgcgtcacctcgtcgagggacgcctctcgctaccagaggtttacgtagagaccgtcgttaaaacgcgctttgaagttgtcacgtgtaaatcaacatgaagtttcttcacttggcgtgggaagtggcagcctgcacacctgggtgtcacagcgagaagcgggcgatcatcatgagccactcccgcggggtacacgtgaagtcttcgtggcgcgtgtcgtttataacaattgcaacgctgtccggaacggacgaagtttaaacgccttcggtttctaattttgaaaggaccatcagaacgcagcggtttgactgcggtgattagcgacagcagcgcagcctcgtcgacgagacgatctgtagtgatctaaggaaacgtgaatcacggcgaaacagttcgatgcgaaaagaccatttgaaacccgttactcggccggtgttttgctccacacacgatgtcagagttgttgtaaagtcgcctggggtagcgtacccacggcatcgcgttacacgaatacttgctctgctaggtttgcaagaagatggaaaatatcggtttccctcgaaaaacgagagcgttcatccgccagtgcggtgccctccactgtgactcgcggaaacctacgatggcgcatcggccgttcaagcagagaatcggattctaatggacggtcttgtcacggatggccacttggttttttaacaaattcatcccgtggtcgtcatgaccacgggatggacacatttcagtggttcccgagtaacaaagaggcttagtttcgtgaggtcggttatgggcagaagtactttatgggagagaagtcttctgggacggtggaggagcgtagttcgagaggcaatttctcgaggctgatgctggcagggatcggattctgtgatgttttcccggcacacctctgtactccaaagaatgacatgtctcttaccgtctagatatacttgacaagaacacacagcacacaccagggagggagcgcggataccgtttcttactgaggtattttgtgttgtcggcggcgttgtggaagcacagtgtcgggagacacgatgaaatggacaaagagacacctcgaatgaagagcatgtgagaactgtgttctccccagagggggcgactccgttagttgtgaagaactcatgtgtgccaggcgttcagggtgagcaatgcaaactccaagaggtgtacattggaatctgcagatgggaatgcacactgcgtcttccgagaatgtgaacaggtgacggacaagggagttccgcatgcgtttatgcttttaaggaacgaactcgaggcgcggagaaacctgcgggtggttgcctcgctcgcatcagagccgctgcattcttcgtggcggctcaacacagaacagagcggtgctttcgacggcgttgcttgactcccgcacgtcccgcatctgcgtacgccgaaaccaaatagcgtagaaagcgttgccttttcaaaaagaagtgtattcgtttttcgggtcgacagtagggagggaaccgtccccctctcagtcccaaggtggttcgtcctctgagttttcttccaagtccaggtgctctatttcttctgcgcgttctgctgcttcggctgcccgctgctcgccttgcgcgagaatggaaacgatgcctctcatgcggcaagtttctcttgcctgtcgcaggcgatccgcttctttctcgtctcgctcttcccgctcgacctcttgcagctgtttgtcctcaggcctgctggactgcagctgctttctgacgagttcctccgcctccgtgcctcgcaagtgtccctcccgaaacagctgcaggcgtctgcgtagcttgcgtttccgctcctgctcggccatttcgtcgactccagtttcgaagaacttcttccgattttccaaaacaggtccacactgttgcggacatccctggtggcagccgctccagacgacgcagcgggcggcttctgcgccacaccaccgacacttcaactcgtccgttaggttcttcccgagacctctgcagtcttctccacagaactctctgcagtcccagtctctcgtgcaaaagtgctcggagaagcgacaaagctcacagtgcggcttcagcgggccaaaaccgtaaatgtccgtcatgcgagcccaccgctctggagttaagaaatgcggaattgcatcaaacggactctctgtgatggggaccgctccggagttcggaacatcgccgcccgactctcgacttgctcccgtaagctttgattctctttctgtaactgttcgagagtcgggagcactgccaggagatcgcccgcgtgctcccgaggagataactcgtccctcgcggggtcttcttccattgtggccgacgccacggttcgtttgtgtcgtacctgcctcagcgaagtcggagaagacatctaggacaggtgggcggaacggacatgtttcgggtccggaaaaagaatgtgcaaaagccgagtgctggtgtgcgagtctgtctccccctttgttgctttcgagttctctaggagttctactatggacttccgtcacgaccgtcgtgttcgggaatgtcgaccctaaggcgtcttcactctgcgcgacacagatgccgacgagcgcggcggcgagaagtgtgcacacgccggtgcgaacaaacatgattttctttgtcctgtgaggagctaccggaacacacaaatgtgcgaatcgagcccgccgcgctgtgaaacgatggactgggttttagacaccttttctaccgcggcgaactgccttcctgcacttaaacctgcagcgacagctcgtcaaaagctccctgggacaaaccgctggtcaagaagaaacttgagcgacttcgcagaggcttttacagatgctaaatcccagccatcggacaacgcgaactgtgactggcggcgctgtgggcgcgtgcgcgaggttctgtactttgaactgttttttaactgccccgccaggctaaccagccgggctgaaactgaatctccacagacgagtttcgtggagatgcaggcagtctgaggaagcccctctgcgaccgaaggaaaagaagactgaagtttggcaagtgcgactgcgtcctcttccggcacctaggcgtcggtctacgaacggagaaactccgctgatggtgtgttctgagcaacgagagggaaggcgcgaaacggctggcaaacgcctcacagtcgtttcagatggactgtgttttagccaagtgcgacgacaagagctcttcgcttgctctcaactcgaatgcggtgtcctcgcgacaactgtccagcgtcttcgacagtgagcgagatccccgttctcacaaacagctcgtggcttttatttttcttccatgcagcgaatcgtgcgaccggcaagacaaaaggctttaaagaaacgcgatcctccagtccgacaacttggctgctttcaacgcccaaccgtttcttttctctgccacgtgagtgtccgaggggcagtgcgactcctcgtcgtcctcctaactttctttttcgccgtttttcgaggtgcgccagctttcctcgtttctgctgccttttcaccgttcctacaaaactgttcttgcctcgccgctccgaacgcgaaaccgtgtgccagctgcagacctggtggacgactgcacgctctaaagcgtgttttttcgcgggcgcgccgacgtatcccgggagaaggcctcgcttcgaggagcagggtaaatctttacaatctagactgttcacttgccttttctggggtcgcactgggagaaacttgtccgctgccgctgcgcagctgcgccagcctgcccctccccctctctgagctcgccgacacacctctcacttcgccctggtactcgcggatcttctacgacaaagccgccttcctgcagaggggaaaaaccacgttatcgcagtcgcggagtgggtcccgccggggcggaaacgcgaaactggcaacgttcctaaatagtcgcggcagttctgacctcaccttcttcgctgctctgctttgctcggcttctcgtccgacccgccagtgttcgtccctcgagttcgctgtccagaagatcagagaggatcagagagcagagtcaaccttcgtttctatatcaggctggctgtcgactgctgtgcggcttgcgcaaattcgcgaggaaaaagtggaaaagacacagcgattttttccggttttcttcgagactctcgcgttttcttctcgaccgactccgcgaaagagtgcggcaaagactgtttcctgctgctgcgcggcgaactgcgctttcgtaagtttgtctgctctgtcacagccgtttctcgcgggcgcgcgtttcgctcctcgccgccctttttgcgaatacgccgctcttttctcaccacgcgtttccgcgacttcgactccgccgtgaagacacccgaaaactcgcttctcttgtggccgcttctcctgtcttctacctggaatctgcgccctgcttccgcaccgcaggactctgtcaagtcttcttcccgtcctctccccgtctgcgacggtttcgacgcgaagccagcactcacggagatccgcaagatagcaaaattgcacggttgtctcttttccgttttcgttttttccttcctcgcaccatgcgcctctcgtcggcgcgaaaccgccgcttcctccctgaataactctgttgctcgtgcctcctcctccctgctctctttcttctgcgtctcctctctttttcccccgttcaaggagcggcaacggcaaaccatctgttcgcatttaaatactcactcgtatcttacgtgcagaacaccaccgatgtgaaacaacctcgttggtgcaggatactgaagtccagctcttcgccgcgtccgaggctcccgccgcgttcctcgagttttccccaaga

SEQ ID NO: 2362 - DNA, 2701 bp, Toxoplasma gondii
ccgctctcattagcaagctgctggcggatggtcgcctgctctttttttgcgaaaaggaaataagccgacggtgccgcgcgagacctcttggcagaatatctgagacatcccacatatatatatatatatatatatacgaggggaaacggtatcatctgaagcaaggagggcagtcgttgctgtgacgctggttttgagtgttagcgtatgtttgcagcaaccctgcgtatttcgtgcagacattgctttgagtcatgatgacgaacaaaccgcgaaaacgaatgcagtcctgacaacagaagtgcctctcggcgtctgagcaagaatgtgctacgctgcagaagctctcgctgatcagaggtactctgtaaatttctaccaaaaaaggcgagtgaaaggtatgcgctacgtctgagtggtgagcatcgctgttcgccagacaggcaaagactgacgtttcctcggaagccattgtgactgcgttttgccttgcctcccgtggttgattcggggcactccccgagacgaaatggtcgacgcagctgcaaaaaggcaagcgacttccaggtcatgcttggactgcggggtcgggagcgatggtaatgactcccgaaatcaatggggagttgaaagtgagcatgggaaaagaaacgcgggtcgacgacaactgcctcgtccgcctagtatgccggccatcaggtcccggcagtctagagactggaggccacagaaaaatggaggcattcacctgaactgaccacacagatggaaaacccttatccgtgtattgtccagtgtggatctagaatgacacggtggtggtgcctccacgtggtgttgcctctgttctgacccgttgctggtccgtaccgggtatggagcgacaagaccccctgcacgggcacacaccagcgaagtggacggcggcgcttaactaccaacagaaattggagttttcagcctctgtagaatgagtgcgccggtaccatagcgcctcagtaatgcagaggtacggacagttgttaagattacgaaccggtaccctccagcgcgcatgagaccggggagacacgctgaaatttgggaagcaagtactctccgccccaaaataacagaagtcgaaatgcccaaaatggcattttttgtccaccccggaaaagcagacagatacagatagacgaagatcgtccactaaagtgcactgctcaggattttgaccaagctggagggtagcctactttgaagaaggcggtacaattcgcaaaggcgcaacagcttccgtgtggtctttacatctatggttgtggccggtttcctacaggcaaaaagtaagtagttgtccagttagtgccacaaaaagcctatgttaggacgatgctgtctttcagtgaggtatgtgagcggaacctctgtgcatggagtactctttctctagagacatacgttgtatctgagtaccgtggcagtgcggtgcggcgtgctccagtatggtactccttattcgacgtactgcaacctccgcatcgatacatccacattcctgccaccttcaggcggagtttcaccgaatgacacccgtttgaccttccctatatgaaacccttctttaaaagcatttttggggtctaaatagtcgtccgttgttctttgcgggcatgcccaacaagaaagctgtagattgaggcaagccacgcgttgcttctgcagagctgcgtgcgggaagatcccgtgctggaattaccttacccactcggagtggctgtgacgcttgcggttaagctgatggcaccggtggaagggagtgggggaatgcggtgacgtagaacctcctaacttaatcctctcgccacttcctccctttcaagtttttccttcaagcgaagtgattcccttctaaaactaggtaatacacagcatttctgtccacgcagagtaattcggtttccacgctaggcgtgccgtagacgggaccgcgtgttcgttgagccgcggacaacgagagagcgaccgctgccgtgttgaaaacctccaggtgagagacgagacgaaaagaggttcccccttttttttatgtatcagaagtgtcaaatatacaagtattgcggctcgctaacagcggtgacatcgcggcagataggttacggctgacatgagaaccgatgactgcaagtccgacttgtgagcaacaggaggccggcgcggctcaacccatgcgcgttgacagtcgaatggccctctgtttttcaaggcacacttttaaaggaacgcctaaattctgtgtcgtggtcctcgatcagatcagtacagcagctttccgcttgttgtgtcagctgtgtcttttatctttcagcgccatgcgctcttgtcgtggtgtccagcttctccagttttgcacagccaaaatgtcaagcgcggatttaggcaccagaagcgcacgagttttcgtgggctcatctttgatatgcagtcaagatgtcatcaatttcagcggatagaagggcttgtcactgcgaattggagttctgcagccgtgtttttggaatgcgttgtctcgagttggtttccggtgcccagctaaagccaacccaattaccacttcactaagtagtttaccagcaactgagtctctcccatttggaaaagtgacttgatgtttgttctttctgtggtctttgttctggactgcactcaggtctgaaaa

SEQ ID NO: 2363 - DNA, 4447 bp, Toxoplasma gondii
agcgactgcgtgaacttgtaacttcttttctaacggcgacagagaaggtgtggctggcgcctcagacgttgccgcgaacgcagaagtcgccgcggtcgcttctcgtttcacaggtgcagccgctggcgcttccgcctcttcattttcttcgtcgtacgctgaaaaaagagagaagagaggccccgagccgctgtcggcgtcatcgccttcatcctcccccttgctactctccggcgcctcaggcgccgttcgccttcgcttctgtggctgggcagacccgacacccgaggcaccttcggagtcgcttgcttctgcagactcgtcaacgactggctcttccgatttgacgcattttgcacggaggtcagctcctgcaaagcttcccaaagcctcctcggggggttttcctccaccgattttaccttcaccggttggatttccatctgttttgtttccttcagttagacagatactggcttcgctgcggccacgacgcagggtgggtaagctccagccatctgcatgagggctggcggcagtcgcgctttggggcttcggtagcctccgcagaagggcctggctgcgagtgctctgcggcgggagaccgtctgcgtcgggcgacagtttctgttgattttctctggcttcttttcggaggcgatgctgccggagtttttccaggcgaaactcctccacatcttcctcttctgcattcgcgaacactccgcggccgtactggagcagaggaacgttgtcggggccgatgatgacatcgggcgaagccaggaggttgctgcctgcgcctggcgcgctagaaacagtcttcccctttccatttcctgtcgcggtcgagacagacgcaggggaaccccggctcaactcatgttttccgtttttcgggactgggaaggctgctcgtgaggaaacggaagaagtggctgtcgcaaagaggccgtgtgcgctcagcgcggagccacggtcggcaccagccccgatgatggcgggacaacacatctgcaggcgcaggaggtttacggggacgttcttgcgcggcaccgagacctccgcgtggtagctccaacccgaaagtgccgcgttggcggaggcattcttcggccctgacttggacgacgtcgacgtactctcgtcctcatcggcgtaggacgacagaatgtctcccagcatgttggaaagtctcaggaattcagccacagacgaaaacggatcccaggtttgtttgccgaagagcggcgaagagtaagctgctgccaaaagtgtccgttaggaaaggggtttccgcaggcacgctgacaaaaacaccgagtttggcgaggcagctcaacagacgccagacactctctaagtgcgaaacgtctcagtcgtgctcctgtgctccccttaagccacctcaagtttagaatggacgcaaatgcaagggtaactgcaagggcaaatgcggcgcaccaaggaagaaccggtccgtccgtgatgtcagcgccggaaggcgacttcggattcggtcggagatcgtggaggagcggtctttgatgcaaaacgaacaagtcctgcaaaagcgactgctggagagagattcgcgggcgaaaaaagaaaaggaaagagggcgaaaaatgaagagccgcttcgacaaaaagtgagccagaaccaattttcctaaagacttccttggctcgcggacggccacgcgacagttaggacgtcagcgaagctctgtcgtttgctcctcacaacccaccgtatgaagacgttccgcgagataaactaatgcggtgttctgagcaaagactctaaggacatgttgtttttgtgaaaaaatgaccacgagtttgtgtccaatgctgcatgcaaaagtgtcgtacacggcggaagggatcgcgctctcgcatgcaaaatggactctaatcctgttacaacagatcgaatgtcatcctgggagagtggccgcacgcttgaaagtgcgcggcctgtaaccaaggccaaatgaagcatttacaggcctgcaaaagaccagtgggacacttcctagcgccgcgcatcagcagaacattgtgattccccgtggccggcactacgctcttaaattgccaacgctgtttaattggcttaccgcttcaaccttggaagtacacgaacaccctagtttgcgtcgatgaatgtgttccagccaacaccccatatttgaggagagtgatgggtatacccctgcaggttgctgcgcaggaactatgtggaacgtgccattggaacgtcagctgtggtcgttgtacgacaaccagcatggataagttgaccttggaaacacacgtagagaagcgtgcccagtatgtttacgccttgtttattcagactaaacaggtgccaggccagcaaaaatccgatccgtgtattccgtacagactaacattaggaagaagactaccaaggtgaataccatgataattgtacagcttgtatataaatgttggtttttcaaatatacgcccataaatctactgttcgtgtagtattatgactagccatataggtacctaaccatttaaagattttagtacctataggaatagcaatcataattgtcatagctgagaagtatgctcgtgtatcttcgtgtagaccgacagtcatcagttgatgtgcccatactggccttcttcgttaactgcgctgcagtgctgaaacatcgctctactgtgtactctctcaatgctgacgaatgtgacccgaacctgtcgctttcactcatgctgttacgtccacccgcacttagtttccgctggctttggacgcgttacgttgaaaaggagactacaaccctgcatgccgagcttcaaccatttcgagcgttccacttgtttcttgttagggttcctccgttttgggcagatgtggcgtgcagaacgttttgattgttctggagaacccccgttacgctgcggtgtggttcactctggtaagataagcatgcgcagttcacacagggagaaggagttggtcgtttcgtttgtgccgatagctgcaaagattgtgaccccctcacgcatggactttccgcgaaaacgcctgccactacggtctcctagctcctttgtttgaggtttgtctcgcctttcttcccccgttggtgtccataatcactcttcttcccgctgcaaggtcaacaggggtgcttctgctggctcgccaccgtcatattattcgtagacacgtatttatgcataacaacccaggtctcgcgtcgcttttcccgctgagacgttctcggaatattcaactaaacagttctacacgggcagcttccgagccggtgtatccagccgtaacacactctacacagttcatctgcgtaggcagtattcagcggcgaagaagcactcgtgtgtttgaacacgactattcattgctcaccaacgaattgtaggggcacgtgctaacttcagtcgcattttggtgcatgattctttggcaaattgcctttactgctcctccagaagcataaaacacatttcatgtgtcaagcctgcgttctttaagaggatctccgcgaacgccgttgcgttgcaccggaactccgcggccccttcctcacttcatggattaatttcccggaagaaacacatctgggaaaagagatatcagtgtggcacaataaaattgagaatatgtgcgagctgcgacgcgctggccatcatgttgttcttgctagttggatggagcagactgtcaacacacccgcaggcgctgctgaccaaacacacagaagcctcctgcatctgttcgttgtgaagaaattcacgacggtacacaaatgacggcaaactgctgagtgcttcgacagggcgagtggctgcgactgtctaccaaccgtacttttacggcagttctggtgaaccatgcttgagagaggttcatttcaaacatcctaatggcgggttgttgcctgtagtcgaagaggggagcgtggcccttcaggtgacgcatcgcctcacagagatagccggccacgggggctgcaaggtttcggcacgcagtactaaggcggagctctgcttgccagtatgtaccttcaattgtgcgccgtagtacaattacactagaacgctcttgggatccgtaatgcgacgcagcggagaagattccatatgacgagatgtcctgcaaggatcggaaaaccccattcgtcttcgcgtctcccgtttgagacgcaggcgtttctgaagaaggccgacgacagtgggacacctgcacctacgattctcgcctacgagagtgtcgcagccgcgccacaattataatatcaccttatttaatgttagatcatcccgaacgctcacgcagaggcaatactgtgcaaggtacgcgtcgagtaaccagtgaggatcctctgcaaatcttggaacccgcaggcttggtcacttgcgctgagtaacaa

SEQ ID NO: 2364 - DNA, 1484 bp, Toxoplasma gondii
gcttccctcgcgccttgcaaacgttccgggatcttctctgcttctcggtctctccccctcaccgtcctccccgcgccaaggcaaagaggtagaagagggagaagagggagaggaagaagaagagggagaagagggagaggaagaagaagagggagaagagggagaggaagaagaagagggagaagaagagggagaagaagagggagagggagacgaagaggaagaagaggaagaagaagagggagaagaaaaagtcgatgcgataggaagagaatcagacgaacccgacggagaactcgaaggcgaaggcggagttgggggaagagagatatcagcagcgcgttgtgtctcctcgtctgctgaagtggatgaagaggcgccgcgaggaaggaggcgcgaagcgtctgcggcgagaagaagcgacacaagaagaacgacaaacaggttgcagtgagaccggcgaacgtggacgggagtgcgagatgcaggagacagacgagggagaggacatacaggggaatcagagtgtctcttcgaggccggagacggagaagaaggaaacgcagaagaaaaaaaggaaggaaaagaggaggcaagaacttcggggcaagagagaggggaagagtcccgtctgtgtgtttgacgtctctccatcgctagagaagcgcgggagctcaaaatgaatttttgtggaggcggagacacgaacgacaccaaagagttaaaagggactgttccgtttcttcggagacgccggaagatgcggcctgccgaggaaccgtgacgggcgcgtccttcgctctcgccccgcgttgtttcttccccttctctccgcttcttcgtgcgaagagaaggcgacaaaagaaggaaaagagaattctcgagagaaagaagactcctttgtctctctctctctcttgtctcgcgcagacactgggagcggccgcgcctgtgaaacgccggtgcttgcgcacagccgggagaggaaagtcgaggaaaacaaagagacaggaaaagacgaaaaaaggcgacgccccaggaggcaaaggggaaaagcgagaccgaggcttcgagccaggacgaaacagacagacgaagacagagtgagaaaacgagacgcgacagggtcgacgcacacataccacgcgcgttcggctgcatgcagcagtttgagcgcatgcgcgtagtgtaaacgctttcttccttttcagaaaaagtcttcccctttccttgagcaacgaagaggcagagcttcttctcatctctctcctaggcactgcagttttccttcttccccaacggctgcatctccaggggacgagagtggagaagaagaaggcgacgctcttgggaggtcgacccggcgagctgcacacaggcaggttctgcgtaggccgaggtctgtgtcgcgatccgcttttttccggtgtctctccaaaaacatatctcctcttcttctttttgaagaggcgctaacgctgtca

SEQ ID NO: 2365 - DNA, 2789 bp, Toxoplasma gondii
tcgatgttgatcctctaggtgtacgcgtacgcatgcttgtgtgcatctgtgtaagagtgctgcatgcgttgaattcttgatgactgtgtcttttgtcttcgcacagtcgtgttttggggtcgatggtttctgttgtttactactttttcttccctcgtagggtctcttctcttgtcgctgtgccttctcccgctgggtgcctgccctgtgtggatccgacggtcatatctgtacgcctggctcgttcttttcacctaactgtttgatcagcgaatcgtgtcttggcctcttgccttatttccggtattatccttgttcaaaccttcccacgagtcctgggactatttggtatgtgctctttggtatgtgcccttcctgtcttttctgtttcatttttgctaccaccgttccatttgtgcagatgatacccctgcgtcgctgttccatttcccccctctttcgtcgcatctttttgtccttccacgtcgctctgacaccctgcgcattcttcggctcccggaccgagctgcgataacttctccttggacgggtcacacaagtccctcgtggcctctgaatctgtagcgcaacgccggagaattcgagtaatttttgccatttctttgcggaggcatgcgtggcttgcgtctgttcagtcgacctgccttccgtaaaatgcctgcttgtgaaacggtggaaaatgcaggtgctgaaacgactacttctgtgcctttcggctgccgatttttatccggggtaaatacgcccgccagtaccttttctgttgcagctaaagtgagcgagacgtctaccccgtttcccatccgaaagcagtgaatgcctcagtttgttgcggcgagaccccgacacggcagtgaaacgcgaagtttgcattccttgaatgcgtcctttcttttcacctcaccggccccttcagtatgcgttgacgcaaatggcaagatgggaacttaggatgttgcatgctacaccgtagccgagtatcacctcggatgcacgcattaacttatctatttctctgcttagtcacgaagaccgtattgtacacccaatgacaagctgtaatattaccttgatggtcttcgttagatcagcacatggtgtactcaagcgctcagttgttacctgatgggtatgggattcttgcgttcccaaataacaaggagactgacgaaacgcacgcatagtcacagtctgtacatgaagtttgagactagcattcgtccctgtgtctccccgtagtgaaacaaatttcgaaaaacgttgtttccgcttcacagccagcaagtcccacgtagcgccgaccaccagattcacaactaaactcgcttaaccacggctttcggttcgaagaactcgataacaactgcaactcgtaccttttcccccagtagcctcgaattcagaaaaccgcacacttcagtactgcgatgaacgtggcacccggaggaacctgagtttctcgtccatccgattgatgacgctaaacaagttgacgtgaggtctgtgcaattgccctctcttagagtttaggctgtgtaggaagagagaggcggggagtttcaaggctgtaagcggagagccaaatgtcactgggatacgaagggccaagatacgaggcaaggatatgagaggcagatccgggtgaggtaggaacgagatgatccgagttcccccagcgcgctcgcttcaactctgtgcacgtttaggcgttttccttgttttctttcctcaacggaggcacctcgaccgtatatggtatatttatagacagttgatcggcaacggacttgagggcagcagccagtctctttctttctgtgatgacgtatccgacgcggtcagaaactgaagacatggtttagggtgtctttttctgtcttttgtgttcctgaacggcatggctctcgttaatagcctcgactcctactttttttcaattctgtggctccaagtcttccgagtctcacgcctgacagtccgctggcgaactgatgagagacgggatctgcagggtacgacacacgggcgagacccacgagtgtttcggcaacggcgttttgtggcgacgatgaattagcgtcgccgagttcttgtcgaggcactcacgggcgcgctttcttctctgatgtatcgcaattttgttccaggcccatcgttttctgactgcggaagtgaatattcgtagctagctgcgatttccttttcgagaggcgcagcgtccgccggtatatccacaccctcggcagggtgcttctgtgccagtctcgtctccaatctgtgtgaggaccagctgccactcgactcgcttcaccctggcacctcctctgcatcggcgcgagttgcgcaaatgctagcgtgagtttttacgaagtttcgcgtgtgcttttcttaaacgacgcgcaggaaagtgttgctggcgcaggtgtctccgtgccttttgtcttgcgtccgttgttgtgcgtccgagggttacgtcgacggggacaccagagaccagcgaaatcgtcgtctcccgcttccgacgccctcctgattttggaagcgaactggttagttttcgagaatcttcatcgccgtcttttctcggaaacgcgtcggcgcacaggggctgcatgcgacttccgtggctccgcccgtcctgcgcgtcggttttggtggaagtttatgagtctttgttccatttccacggggaagagggaacagagaactttcgggccatctatttgtctgcgctactgaaccaccagacgcttgtgaggccgaccaga

SEQ ID NO: 2366 - DNA, 2324 bp, Toxoplasma gondii
aggttttctgtcaggtccatgcgcgtttcaaaaatcgtagcaccgctgcgaagcgagggaggccgcgttgcacaggggggtaaagagccatgggcttcgcgtctgaaggagtagccgagtatcaacggagaagcactggtgaacgcactcattttcagtgtcggtggaatcacaaaagaactcgcaatgcaagaacgagacagtcgcagagctgcagccgagcgcgcgcgatgacccctggactccgtttgcccctccatcgaaccgaagtcccaaaaaaaactcacagactgaggtgtctacacgaaacagttttgcatgtcattctttctaccacctcataagaggccgaaacgccatttacaatacgacacaaatacgtcaacaagaggtctcgtcagcctctgggtcaccaccgtttatccggctccgacctcgtacatgactgccaaggtggatctacgattctcttcttcgcagaacgccgttgcttccgacgtccgcgcaaccgtcgctctctcgcagcatccccgtttcacacctggctctgaacgcgagcttcgccggttgggaggaagccttcctaagtctcgctgtgggcgttctctggactctgcaggttaggatgagttgcaggaattttcgtgtctcaccatgaagtcgtctacttttaatccgagcgctctgcatgcagccttcaactcgcgcctgtcgaggcggccgtcgccgtcgcggtcgaacagagcaaaggctctctggatgtcgcgtctcctctcgcctgcctctgcgccggacgcactcgcagctctcttgtcttgcatgttgggctggccagaaacagacgcgagacgagaagcagagagagacgaaggaccagcgagagcaacacccggatcctcgccaggcgctcgcactcccggcgcatgcgctcggtgctgctctgagactgcgggtggacccgccatgccaccgccgtcgcacaggaaggcaaaaacggaggggcagacaggagggcaatccagcaacagagaagtgtggacaggaaggaaagaacagaaaaagcgggatttagcgaaagcaagggaaagtgaagagtgtgtgaacggtgggtgcaggcgatctgacagacagacggcagagcgttcgtcagagatttctcggcagcggcatcttgacaacactcagaagaagtgactcgtgaaacgcgaagaatgtgtcttggcgactgaagcaaacgaacacagatctgcctctttttccatttccgaattcccctgtcttctgggcgcatgcacatcccggctgctgacgcaggaacgaaagattcgtcaaaacccaaactgccccttcgcctgcacactttcgctgcgttcagagttaaatctacagactcagaaactggattagaaaactgagaggcaagcgtcttctcggtctttctcaggcgaacacacacacttttcaggtgcatgcagtgcagcatcactttaagacgcgaattcgcgacttttcttcctcggtcgtctcggcattgaggctggcaagaacctggcttgcgcagactgtttctctttctcctctgtagcttctcctgttgttaaaaaggcccagcatgcagccagacagcgtccagaaggaaagccttttcaccaccgcaaaagcgcagggggggggggcctgcgcagagttcttggccagtcaacccgcgcgtgcttttctttgacgacttcttccgtcgaagaacggtcaaagaacgtcattgcatcttttccttcagtttctctcttcctctcattgtctcgcgtcctgtctttgtctttttttgtggccgttttctacttgtccgagtgtcgcacatctccgctattcgcgtccggcagagagtccccatccaccggccgagagcggaagtttctttgccgcctgctcatccaactgtttttctccggatctagttcagtgtaaacggggaagaaggctctcagaaaaggaaggtgctctctttctgatgtcgttccgtgtgcaaatcgaggcatggatgaaaaacaggccaaacaaggctaggtttcaggcaagcgacccgtcttttaaaacgaacgtggaaacctgatcggattggcccattcaccacccggcagtccggtccgtctagggcgctcgaaaggctcgagatcgtcgggcgtcgactcccgcgaagtcgacagccgggaagagaatcgtttcgccgagacatccagagaaatcgcgtgacttttttatgcagctgtcctgacccgcatatgaaatctccgcagaaactcgacatgcgcttgcctctttcacaa

SEQ ID NO: 2367 - DNA, 4696 bp, Toxoplasma gondii
aaagagccgcgttccgcagattcagtcagcggtgtttcgctctttggacgcccatggagagagctaacgggacaatggactaaacctgggatagacaaatatattttggatggaagcagactgattcaactcgatgaggaagacgcggcagaagacaagcgaagaagcgcgccaagcagctacaggacactcttctctgcagatacagttcctgtgtttatgcgatctagttaaacaattcaggggcgcgaagcatgtgtacagagacaatgtgggcggaaaacgtggtagtgttttacagggtttgactgtgatcttcatgatgcagaaaatccacaatcctacgggacgcaaagacaagcgcaggcgttattggcctccagattgcgggagtagtgcgcgacgcctagaacacaatcgatgcgaagtaccttagtgacagggaagagtgaactccaacacttttatcttaccttggcaaagttgctgggggtcgggtggagcgacggccatggtgcgcgatgaattcgatggaaccggggatccctcgtggaggagctagatctgtcgggaaagagcaactgcgtttatgaagtggattccaacgcagagtggcgcagctccgtcgccgtttgccgcttattttccctgtttgtgtgcctggtgcctctgaaacgcgagcgacgaaagcgtggtaatggaagcccaccggaatgcgacaatcggaaggtgggaggctctgtcttctcgggagagagctgacaaaggtaggagccgtcggtttcgttagagtgtctacatccaattggaaaccgagacagaactgcggaggagaagattttgagctaggaccttccgagcaaaaccgccgaagtcggacgtgtctgtccacgaagaaaaacaggggtcttaaaagccatgcctgtctgtgcaaagacttaacacgcagacctcgacgtctgcctacgttgtcaaggttgttactttaggacaagcgaaaaacaattcagaagtggacaaggagcttctggagaaaaagtgagtaccggacaactctgcgattttcgcacacggcggaatctcgcgtcctcaagccacacactgcgagcacactgtttcgacagaaacccgtccgtcccgtgtatctactggaaggaaaactccgtgtatgcgtgacagagagagtcgtcaaggcttcgctgtttgtggaagaaacccagacagcagacgccgacaacagcaggcggccgttctccaacacagcaaagggaatcgacaagcaaaaatgcgccaatggaggagacaaaggaacggtgaagagaagctggaaataatttcggcggcttgacggtggcgtttcaagagtgcgaacaagccttcgctactgcccagatgggaaagtaccggggcaggacacgaaacggagagaaaagtcagcctttctgttgcgacaaccccccgcggtacttgtacccgatttccttggtggggttaccgtaagctgcagctacggacgtgcacacttcagaaagctgttgccgagacgatactcgcggtggacggtgcggcagaagcaatgtccttcagaaaatgtagacgtacaagaacaagcaaatatgtccacgttttgtcctgcgcgttccactctaatgcccacaaaaagtgagacacaccccgtgcaacggggaggccgtgttttctggaaagccgactaggagtctcgtatcttggagatgtcttgaaataagtgaacttcccatttcctgattgatacaacgcaaagtggactcaggatatatatccagcggaggacctcattacccgcaagtggccgaaagaaggcgaagtacacatacacggacttcgagcgaatcatctctcgtccatgattggctgcaaattcgacgttgtccggccatttgcacaggccgaagcgtgtgtctgtgtgcacgtgagtgtgcgtacaacctccagctgtcgtcacgtcagtcccgctaagtgcgtgctgcgctcgctgtggacactcacggtgcatggatggggaaacaacgcacaatctcatcgaaatcgatgctaggtactgtccacgacagcatacatgtagaagcagagtggaggaacacaatgttttcttcactgcacgtgttagttcgttgtcgtgtcgcctactcaagcagtcgagcaaaagcgatcgcagaaaagagaggtcacctgtcacagagtacgactttgaaagcgtctttcagaaaacatttcgaggccaacaacagataaagctggcaacgtctcgaactgctgtgacacatgatggatcagtgcagaagggtttctgaagcccataatgttgtaagacgaccccagcatgtgtacaaattgaaagacaggttgtgctggagttgtggatggatacgagctaccgatgccgctcgtctctgacgtaacttctgagggccttactgttgggcagtatccgattcaatgataattgctttttaagaagttttacacggacatgtgaagggtcggaccgacgtttccagatatacgctggattccacaatacataacgaacctcacatgaggctcatgaaaagcacaacagaacttggctcccgtaaacaaagacgtataccagggtccatcgatgccagctcgttgtagggaggaggcaactttccatagaagaatgccgatcgctcggacgcattttcagacaccggaaaatgacgctttgctttgaagaggtatggtaccagctctgaaaagtaagtttcaacagttcggggtgcattgaaatgcaagcgtacacgaacatggcagtctatcttattacacaggctgccgacggagcaaatgcgctccaacaagacaggcagctatttccacaaagactgaggagtcgagctcaaccggcggggtgctcatgagttcagccgttacaggtcttgttgcatttgctatcgagctgttgtagccaataggactagagcaggtaaaccctaaaatcagtctgtgtgacgtgtcacagtgataaaccgggaagctgccgctggacacgacaatgcaaaatgaatttactctaaagcctaccgacttgcctgtacggcaactgatgccctcgacgcctttcttcgtaagcaagtggtaatgattcccgagtagacacagcggcggtcgtcactgggtttgccgtgctctgtttcccttatgcgctcagccacgattcttcaaaacgcctctttgtcagacagagaagccacgatgatgctggtgacagaatgatgtcttctagactaatatgctcctcttgagttggcggccaccagcttgcatttgcccgacatgcagtttatcttcgcagtttttctgtgagttgtcgattcatagatctccgcctcttctccttcgcataaaagggagctactccggcctcgtaatggctccacgaatctctcttttggcaacgcctgaaggtcggcgtctgtccttcgccgtcaaccacggacggtgtgcacagaaggcgaaattccctttgtcgttattccctcatttctgagggattgtagggtgctttcccttgggctcacacgcagcagcaacacctacgccactaccctctagaaaagtcaccacggcctgctaatattaccagcatatcgagttcacccaatatactggtccaggcgtaagcatagcagcagtgacattcataagtccgtcgcagagatacacggggaagcgaacgtcagctgggtcggtcagtccttaatgggattgttcctctctgacctctcctccttctcccgcactgcctgtaattctcgcctcatctcgagcacaacacgagacagtgcctctggatgcacaccttgctcgacaagctccaccaaaatctgtagagtggccctgtccaaaccggtgtccagtagcgttgatatctccatcagaatttccatcgtctcctggccatcgccgtcatcgttcccacctctcgcacgctcgaggaagctggcttccggcgaggaagtcgtcgccattgttgccaatcacagaagtaaattggcaagaatctttgtgaggcggacaccggagcagcggccgatactggcgtgcgtgcggttcacctagagcacacaggtttccggtcaggtcggtggagacgaccgccccggaatgacagatcctgcctaactctcattacaaaggtatcggattatccgtctgagagtcagcttcatcatccgttgcagccgcagtctagtcaatctgccgtttgtagcgctcggacggcgtcagagtgtgcagcgtgtccagagggaaaccgggacacgcctgccaggtggatttccagacaaacgacacctttcgcccgagtggattttgctgcaacgtgcaggaaacaggtaaagcggcagttttttttcactatgaatttagtaagactcagaattccatgatcctttttcagagaaactgcccttcgaccgccggtgtgtctgcatgccgctgcatgcctgtgaatcaggtgtacgcacagctggctgtcgacacgtgactctgtttcgcttcccgttgtcagatccgcgaaacgtagaaaattaaagcaagtcacgtaggtgaaggagacgaccgagaacttgtccatgttgtctgattggtgttcaagcagtttctggagcagtagtagtcaggcaaa

SEQ ID NO: 2368 - DNA, 2966 bp, Toxoplasma gondii
aacccagacacagtcagagacaccgagagttggagaaagtcagaaaagccactggccttgggcgcggttcagaggtcgacctccacaagcagcactggaacaaaggaacctcgagacacagacggtgcgactacctacacacactcatcacgaaaagatgtttccggatatgctctcgaaactcacgaaaatacgctcacaggttcatacgtatggtgatacacatatatatatatatatatatatatatatatatatatatatatatatatatatatgcatttacatgcctctatgggggggatgcctgaggtaagcggttgtctctgtaaatacagttacacgagctgactcgttcatctgcggagaaaaaagacgaagggtcgaagcgcgtggtgcagatataacagtgtgcgatgtggagcaagcctcgccttcatttttgtgcatttcttgtgactctcagcttacaaaggaaagcagaaaaaaagccacaacagtcaggggcatcagcgccctcgagagcttcagcgtctgcatggtgtctgaagccttcacctcgaatggccaagcgctgccttcttcggtgttcacgttgacggacaacgcgattggcgaaaatgtcttctttcttcgacgccttgcgtttttctcggagaactcctctgtccacaggctttctgcgatgctgcccacacacaacgtggaggcagtggcacttttatttaagcttatttttagtctttcagtcaccctgcactccccttcgtttgcgcgttttccggcgacagcaacggcgagaacagacaagaagtcactgggggagacagacacacgagaggcgccaccgctgctcgtgtgtctgtacgccgtgtgcaagtgggattccgagaaaagacgcagagaagaaagaagcggagaatgagttgcacccgactgtgtgtctgcgacaaaactgtcaaagatcgggagagacgcggaagttgtgaagttgaggaagcaaaaagctgagagtcactcgactgacgtgaggcgcgcgcggttccgaaagacttcagacacgacagatgcaggtgtgaaagaccctgctgagcgcgattgggaactcaggagagtcaggccacttggctgaatgtttccactcgtctctgaaaaagatcaacgagaaggagaagcagcgaaccaaagaaactctcgaaagcgcctctatcgcattgcagacagtccggacggcttcccagtgcgtcgtcaactccctgatacgtagttgtcaccttcggtcgcttcagctgtccgaagcctgcagaatgttgcaagtttcgtggagagaaaaggcctcaaagacattcaacaaagtggaacacagtatccaccagagcgtctcgcggagctagcgaaggcagattgcagcagcagtgtgcacgctctcaggagggacagtcaattttccccaacttctctgcgtgatccgacgaaaaaaatcgagttctgctttgcctccgtcactgagacacaaggagatgggctactgcaactggagaagatccccagaacctgaagtcgcggtcgccaaggagacagcgaaaagagttgcggtgggtcgcggacgtcgccggcgtgtctgcgactcacagcgggagaaggaagcaaacttcgcgacactttctcggccgaatcggtcgtacacaaacgctagaaagaaggcgactgtgtttcttcaccttttgccgactttacaccccaaaaatcaggaagaaaccggaactcaccgacctgaacaatacccacacacagacagcctgcttcgtgtccagatagagtcacggcaggcacacgagccgcgcgaagacagcgtgaaaactgaagttcctgcactttaatttgacacgggaaagcaaacgcgcttccggtcagtacgggcttgacagaaagcgggaaagcgccgctaaactgcttgaaaaagttcgtttccttgactccaaggcaaagagaggggatcatgtgagcaaagtcgcacagaaggatgcgacctgagaaaaacacggaggatgcaagtggtctctctcacacatctggatctcctctcgttcaaactggcagagtgcttagaaggggagcatcaaacgtcgcaggaaaacaaggagagttcagcttttctccgctccaaggtcatctgtggcctcggccgccgcgtgtatgtacactcgagtttccaagtgggggaacattcgtcgagccaccacggccgattttgggctttcaagctgaagcttttccggctttcctttttccgctgcttcttcttctcagcttcttttaaaagcactcgcgatcgatggtaactcgcttcttccgacatactgggtgttttcatgcgcttccccctctccaatgtacacctacaccggcatgtagagcttgaccgcagcaagcgtctttcctggaaaatgattgaaagggatttttcgagcttttgtctttcagatgcggcttactgtcgcctctgagatcgcaccacagaggcgaacgcttgcagaaggagagcgtagcgttatgcggcaacatcgttggcgtgtgaagcatttccctgatcatcaacgcagcgacgttctcaggaccttttttctgggacgtcctgtcttcccgtagctcgatttgccctcaggttcgccacgccaactgtccctttctgctgcgtttctctcggcttttctctgggtctctcaccctcgggagaagctgctcttcaacgattcctcgtcgtgtgccatttttttccagagagggctcatcacaaacttcagcgttcccgagaaaaaaacggcattgccgtttgtcagaaaaaacgcaacctccttccgcgcaacagatctcgtgaaccgtctgtgtctttcacctgcgactggaaaccgcgtcttcaaaatttccctacacctacatcgaattctcttctcagtacaacaaca

SEQ ID NO: 2369 - DNA, 4561 bp, Toxoplasma gondii
aggaagggtctaggaatttcgccttacggtgggtagtagccaaagacaccctgggcttcgaaattcgcattactggctttcagcgtagcctcgacgaggggtcccgccgctatcctgtcaccgcgattctcccccttatctgaagcataaaaaaacaaagacagtgaacataaccgacccttttaccggcaacgtcgtgtgtccaatgtccctcccgttttacatgtacatgcaccctacctgtatcatgatacgcgtgtgcgtacgcggagacttgcgagtatctaaacaatcttttacgctcatacattccttcactgatgaacgcacaagacgacacgtccgggtgtctgacatcactctggagtcgaaacggcgttgtgtggcgaccttaccagaaaaggtgacaaagtaaattgggatatttcgtcttgtaagttcttctccaagcaacttgaagtcaggagtcaaagccccaagcacggaaagatcgtcgcgtcgcgcactgccacctgcacaggaagatgtccgataaaacccgattattcacaacataaactcacatcgaaaacaactacgatggacggcttcatttcttccttcccagagtcgcctgcagttacacatggcggtaaataaaacgcttgtaccttgtggatatatccatgtcaagcatacatgcatgtgttcatatgttcgtgtgtatgtatgcatgtatgtatactgtagaactgtcgggagggtagaccagtaagtgttttcgtaggcgtgctgacccgagtgaaccgaaatggcggttctgtcgtagtcgctggcgactacttgaatgccgcattcttggatggcgtcaacaaacgctttagctgcgtccctgccagtgaggtgctgtgcctgaaagcgctcgacagctgcagccagggtctttaagcaaggatgtctcttggacggtcccatcgtttcctcggtgaacaaggatggacctctcttcttcttccccggcccagcggaggaccgagaaggtcgaccaacttccgctgctgcggcagacgctgctccgggcgtctccgcgacggtgccttgcggtttaggttcagatgagctatccgacggttcccctttctggtgagaaacccccgtgtccctaattgcttctttttgtgacgccggcggcgatccttggggttttcccagctgaattgcgaggcagtgcgttttgagaggcagaaacggacagggggagggggagaagagaagtggcgcggcgatggtgaagaagagccgaaccagcggcatccgagaaacgagggaagcactgcgcgaaaaacgtgtttgaaggggatttgggtgcgtcatttggcccaccctaaaattggaagaactcctttctctacaaaggaaggcgaaggcctcgaggaggactggacaagacacgcaaacagcgtgctcgtttcacctgcgctgaagaggcggaagaaaacagtcgcacaacgagccctacgcgctaacgagaaacaagagtccggcgtgctgccagtgccatccactcaccaagctataagcgactgtgggatttgacagcgacaataaattaaacaaacatttgacataagggagtctttgagaacctggagccggatggagggcctccacaatgcctggcgtttgcgttgcctgctacggggcaacaaactcgtctctgaatgcgtcgctgactgctgaaaaagacacctttcggaacgggcagcaacaaagctagcggtagcgttcgactcaggtggctttcgtcatcgtgtatggacaaaatatttctggtaacagtaagtatcgtgtgcttggggggacccagcgaggatgagctggtcggagacacgtgacggcgacgaccaaggcacagcatggtgaatatgcagatacaccatactggcagtggcttcgatgtactttggtttcgtcacccacgaacatgatggtagacttttctccgtaggtcgagaagtaaaatccagtcgtttcttcgagcaggagcttgcttcgcgagagcaatggcacagcttggtcaactaatggcggccgctttccccaacgcacagatgtacgtgagagacaaacagaatctcattttcctgttcaggtttcaataccatgccagacgtttcagttctaggcaccgccagaagacctctctgggatattcttgcctctgttctagctttcatagcagcgttggcggatgcttgttgccaaggaggaagttgaacgctttcctcggctcgtcgactgtacagaggcggcagcactctgcgagacgctttacaaacactctagtcgtgcttagatgtttctgccagatatattgcccgtcttcttgtttgctgttcctcactcatcagaaggcgacaggtgcatctcccctagtatgatggcgtagcattcaccgctgatatatacgtctgctgtcgatttcgatattcatcttttcccaccgttttcaggggagagagaatcaattccagattacagtatgttatcgtgacagatgcaggcttttagtcataatctggaacacgggcactccggccgtggattcttcaaacccactcaaccgatggtcagcaatgtgcgcctaaaaggttgaaggagacacgagacttgatgggctcttcttcgagacacacctgcacaagcacataagcagcacaagtcacgaacagttcgtctgcaggactgcaacggacaatttcgctcccttttgaagagatcacctgttctggatcgctcgatgtgcttgcgttttatctgcacacttttcaccagaagttgcacacgaaaaatgctgacggaagtgggacggactctgaatatttcttgaactctgttcgctatcgcttcgcagtcagttacgggataggcgccatggggacttttactgataaacacacgtccacgatctacgcttcaagttaaggatacactcaatgctcagctgcgttgtttccaaacatttgcaacggcgtgcgaagaaattgatacagctgaaggcgccaaaaccatcttcctgtttctgggtcatggcctcgaaggccaggaacgcacgcttttcaaagacgggtgaaacccacacccccagcccgaaggagatgctctcaacagaggccgccagcaggggcggttatcccattacgagattgttacttctcatagggaagaacggaaagaaatgcgtggagatacgcttgtctacttgtatgctacatttcctctacgtcctctgtgaaggaactccgacttgcgtatgttcattaactcctacttttccgctgttctgctgtgtatacatgctggttcgtcccgtgcacaaaggttctagcggtgtcgcgggctgataacaattgacactctcccactgcataacgagttcctttgacattcgtgactagtaggcgagaacactcgttcccctgcacacggtcttccttccgaatttccttagctgcgtgattggcactctctctttgtttgacggcccaccggcggtccaccaccctccatggttctacgtggccaaaagccttgtttttgatttctaaaaaggtaaacatcaatgacgcaggaaaaggtttttcagtgtctcgataaaagaaacctggcagccttgtcgaaagcactacgcacgagaagttgtcgccgcggcacggcctgtgtgacggagtcacgttcttttgacttgtttgtcgtctattcggaatcaaatcttcggtcgtcattttttctctgtgttctatttcccactcaactatgcgcgtgctatctgcagcatcgaccaaaaactgtgtccgagtcaactctttcgctctctgttccgttccttccttatctatgtgtttgtggcagccatacacatacatgtagctgcatattttaagcatgtaatcataccgtcgctgtaagtgtatagctcctgttggcgcccgccttgccgtggtcttttaccttacacctttctccgtttttgttatcccagttgtatgtagcattggaagaggagtagcgggtgtagttcatctcgttgtaaccttcctcaatcatggcggaagttcgtcatcgattcgtctgagtttctgaatcctttcacctcggctcctctcccttccgatttttttttcatcttctttcgtcgtcgtctgtccagaagcgaagtaaaatctgtggtggattttcctgcgtttgcgttttcgtcttccctttctcttattcagcccgcaacctctgcaacagcttttccctttatttccctttatcgccaggagggaatacgctcacaggagagagtaaacccttacatcccgcatatctttccccgacagcctgtgtccctctttctccgagttatttttttgccggcgtaacgccaaaatcgaaccttccgtatgtggttctttccttttcctccgcaagccgccgggttgacagcacttctttccacgaaaagattctgcgttgtcccagattctcttttggctcgcttttcctctgattccagtgcttggtggcttggtggcca

SEQ ID NO: 2370 - DNA, 3679 bp, Toxoplasma gondii
atagtacactaaagaaaacgaaaagtctcgcaaaccgttccactgcttaccggcactgactcccatgacatcagtatagaagtaggctgcgaaagtcgtcaaagtgaagttcattccaccagcaccaatcataggtgccgcgtaggaaagaaggtaagaccagggaagatgcttcatgcgccgcgccgtcagccccttgcttgaaagcttctcgggtctacctgagggtaaaaaagacgagtagtagccaccagcaccacaccggccatcgccgagaaaatatcggcaccttttgaatcgacgaaaagcgctgtctgaaaccggacatgcactacggcatacacgtcaccctaaaccctttccaccagagaagcggaggttgaggtccacgcctgcataaaaacaccgttcgcggcagcagatgactgtgaaagtcactgcaggcggcatcactcacgtggtggaacaacgcttctaccgaaaacacacaaagcgccgccgacacccagggacgtacgatgacgctaaaacatttccgaggacaggcgaaccgatgcgacatgcatcccgtggatgccgctggggacggcgaactccctccattgtggttgagcttagtttgagttagatctctacagccacacaacttactgtctaatccttgaatattgaactcgtccgttgtttcctctgtggaacgtcgctggtctcggagcgaccgctggcggccctccttttgtaagctcatattcaccatggtggctcagatgagaaagcacgggtggcgaccgccgtatttcttctagaagaaagatccaaaatggaccttgttatacctggcctagtcggggatgcaccgcgctatacggacttagagaggaggtaatacggaaggaaagaacaagaactcggggaactacttcgtccacaggaacgcgaagcgctggagttttagctgtaacacagccagggttggggtcattttacttcccttcgcttgtgagatggcggaaatgttcaaattttcgaccaacgggcttgaaatcgctaaccggggagagaacggacgctcgggtggtccgggtggagattcgtcgcacggtcaggaaggtgaagggagaaaaacatcagagcccaaagcgggaaataactgcagggggatgccacatgcataaccgccgtaaaatgttactcgtcgcagataaaaccatttcggacacctcctgtgatccgtacctctaatcgaagactctctcggcagttaactacctaccagccaccccggactggcagtcgcttccagaccgccacgattcggggaaaaactgcttttattacgttgacttctatatccgtcacaaacgacactgcatacttttaccgattccgtctgctatgtttggcgcttgatccttgaacaagaacggtcccgagagacacgccacctcccatggatgagcatcgcatcaactcccctgtgcagtctcgagctcgccgctcgcttgtcacgctggcctccgttagccactgtaccgagaagtcatgcaaaatcacgcagaggaaatgcagacccagagccgacccgacatctgatgccgtgctgccagcacgagttactgtgtgttttcagctctcagtgtgttccttaccttcccaaataaaaacgtttcggctgtaggcactagctgactgtgggaggagctggaaaggcagacgcaagtgtgtggtcgggtctcgacagctggtgatcgggaaatgtgggtgtgacgaggatggtgattatgctgaacgactgaaatttacggcaggcagaatgatagagtcgttgtgcgttgattagataactggatcgccggagtgagaacttcgtttgtctattgcgtgtggtcaactgtagtttcagtgtgaactgatcgacagaaaccggcacactccccgttagaaacgagcggctggtagagataccagcgacgctggggaacagctggacttcctgtggacgaccaacctgggtgccccgggctgcgaaactttgggttctcaatacatgtgggggtgatgcaaattccaataatggcatttccacgcacctcaagaaacgcgactagcgttctgtagaacagacggtccggaacggcagcccacaggcagctctaaacactctgtacgccggggtagataccaatccacgatatacgacttgtcgatcagctgcatcgtataccgaaattgaacccttcacagtcaagagatctgaattgcgccggctctgctgcttagtcggataaaggctgttgtgcaaaccgaagtcgaggaagtagtttgcctcatgcgtctctgaaaaaacggcccccccaccacattcacaagctcgtttcgaatgccaaactcaagggggcgccacattttggagatatcataatatgtctgatacgacgggggagcattagtagtgtggtgaggtgccgaaccgaatttccgaggtctcgccacacacaccggctcggttttgagcatcatgagtcttctttcgacccacggaatccacgaggtagcaccatatcgcttgatgtagctttgtcatgcgtttttgtcagctcggatgagacgcttccaaaaagcacagaacagacgcatcttcttacgagaccgaggaagtagcatggctcaacagttggtgtcatttctgttacacatttttgagatcttctcagactgcaaagaacaacgtcctagtggaataacgtgtaagcggtcagcgtttgtattggtaacccagagtcctactgtttcactgtttcatgcaaataacacatggcctgactccgtcgatcgcctcatgttcgccctgcaacccgttacaccaagggaagtctgcacagcaagcacgatgcatgttgccgtttttcccgttttcttctcgactacgttcccgttgtgtggcttattactgatgggtgaggacgtttcatggactggcacgcaaagaatactaaatctgtgcatggagaagtacgttgtatcagagtcgccacgctacattatgctggtctcaaaactcatccagattcaccagaggtggtatttggccgccgtgcagtctgcctcggctaccacactgaaagtaacaatttcacatacacagccctcccacctacatccggcaccatttcactgaatgtttgttcccgaggacaggagggagacgcctgacagttgaagagggatgatatttccagaatgaactgagtttaagatcctgtatgtcattttcgtcttgtgcgtcccgtcctggatgatcacatccacatgcggctgcaaccacaaccgaacacacgtttcacaggaaagagtaagctgttggagtaaatcgacggtgaaaaaaaaaccaagcatgtcatgtggtgcgtggatttttctgagtatgccttgaatgttcgctgttttgtcattccttttttgaaaacaaagcgtccaaaagatacggtggcatttgcgtgcccggccgcgcggaacagaagaacgtcactctggtcgcactacaggccctgtttgcgaaagtgtgctcgtctctccccttcgtgatttcctatggcttggtaaaaggtctttttgttctggtagtgattggccgatgtgaaaggctctctctttttcttgagttgacacatctcgacga

SEQ ID NO: 2371 - DNA, 4821 bp, Toxoplasma gondii
aaacagagacagccgccactcgtcgctctccggaagagtccactttccgctgaacacggagtccgggagccaagcaaagaagtgcctcttgggaagctgatttggcgcagagacagcagcggagggcagcgagaaactgaccaaaggcgagaggcgctcccatgcctcagctgctgaagatgcgaaacagagcgaggcagaagtcgagtcgtgtgtggaatcatttttccatttgaaaaactccttttcaagacctagcacttcaggctctgggcgaggtcgagaattcaggcgcttgaggaacaagtggaaagacgcatctcgacattcacgcaggagtcacgaaccggacccgccggacacaaaatgaagcgacaactccttcccaaaacatgaagaaagtttttctctcgagaagacgctctcttaaggtctccaccttggagaaacgttcgccgactcagtgcgaagcagaggacccgagactgctctgaaacttctatgaatacatggagttcggttttttgcgcctccttctacaagtaccagcttcattgtgcgagcagacgcgagctcttctaaacgcacaaagcatgaaacgtaccgcgggtgagcacttcgtctgcggggagacaaagaaaatcggtttctccttcttcatctggcgcgtcgctctcgtctagcctgtcctcccttccttccgtccgtcctggctgttctccctgcttcgccgcattgtcgaagtccgacgcaagagacgcgcgagaggaagcaaacgcagatgtgtaagaggaagacaaagatggaaggtgtggaccgcaagaggcctttttggtgtgtttgtcgcgggtcttgcgagcggcgatgacgctgacggctctgcgcgcctgggcttccacgacttccacgacggagagaggcaggaggaggcgggcaagagttgtccagaggaagcgcataaggcgcagaagacgaagcgtctggcgaatgcagaagagggaagtgcggcgagaagggaagaagaaggggcagctccgggtggaagccgagcggtccttctgttggcatacgtctggtttgtcaagtttgttgtgaagactcgcagggaggaaactcgcggctcgtccagggggcaggaaaccgggagatggaggttgccgctctttcgtttcttctcctttgaatccttcgtgctctgcatcgctagcagttgtcgtggcctcccgggccgcgacgcacgaggcgcctggaacgacgtcgctctgatcgacgaatttctggctggcggccacagaaacacggaatcggggcccagtcgacgctccccagaaaggcggactcgaactcccgctctccttctctgagtcgccagcgtcttccggctcttggccgtccacgtggctgtgcgccgccggagcggcgcactgccactcgggcagattccggcggagtgccggcatgggccggactcggaccggcttcacgaccatctccgtgagccttttctttctggttgtctcgccttgggtccccggttcgggtgaggcgccggcgaaatgcggagctgcgccgtctcgaacgtctgctgcgcaactgtcggaccaccggtcgtcgactgctgcccccgattggggtgtatgtacacccgaagcgctggcctccatgttggccatctggccttcgcagctggggaccgctcgtttggcttccgctggaattcgctcttcgacctcttctggagcgaggagacaaaaagggcacactagaggctgggctgcagacgcgcgcgtcgtttcctcgtcttgcccgcgaaatggcttgctgttgtttcgagtggaatcaagaggaacgcgagcaacaatggtggaaagaacaagaaaagcggggagaggagcacggagaaggtagagacgaaatacgagatccggggcagcgcggtgacgacagggtgaacaatggaggatgacgtacttaagatccgttgtgttccttcacatcggaccagcgactttcgtcgcgatattccgcttaaacccttgaacttttttcgacacctaaccccacagatgtgcagctgagtccagcttcaactgttttgaggttcagctgaagtctacctcacacaccacacagctcctcttgtgtgccacggctacacactgcgcttcctggcgcaggctccggccagttcagtcgggcaaaaaatggcgttttttccgtcgcgtgaggcgcttttccatagaaacctccgtgttgtgcctctgggataattcaacacgggaccaagagcgacgcacctgtcgtccgttcagcaagaaaagcttcacggtcgtggcactcgcttactattgagaaacaggggcagggacagtggcactctgatgagggacgagggggcggcggcgcggcgggcccactagacgggaaaaggggagcaacagcacgaaagcgcatggagagggaaataactcaacgagaaaagcgttcgttgcacgataaaaagaagggagatagaacggctttccagaaattcggttccctttcgagtgcgcagaaccgagctttccgcaaccgtgagacacgcactgtgtgggacggactcctcatgaagcttttcttcaacagagactcggcgacaccgcgacacccaaaaacagacggatccaaaaaccatggagatccaaaaacatggcacaagtcgcctgccctctcgaagagttagtcacactcagctggatgaccgcctggaacccgccggacagcggcctgcagtgcagagtcacatgctgtgcgtgaaaggtgaccgagacggacgatggggacggggaagaatagagcccccaacaacaggagaactcagagagaaagtcgtttgtgataacggatgttcagccgtcgttaaagtggctttcggcagggcgaaagcgaagaacgtaggagacgccagagcgaaacaccgcattgattacgcgcaacggccctatgtcgccaccgttgctcctgctcacaccagctaccaaattgcacctgtgcttacgcacatcggtttttttcagacacagttgaatgtgaagattagtgcagtgtgcttggcgggttctttctcatgcgggttcatcaaccgaagcagcaaaaagggagtgcggctgagaaagagttacaccgtgatcatctgtgttggatataggcgccattctgtggacgagaaaagcagtcgatttccacgttgcggacgcaaacggggttcgcggaaccgatgaacgaaatctgtcgaaggttctggtaacaaactatgaatatctgtgctctgagcgaacttttcctccctctgtattcagacgcctgatttatgttaaagtgcagtgtctccagaagttcccacgacatgggaaacctgcataggcccagagaccgtttgcttgacgcggtgcatcccccccgaaactgcctttttctaccacaaaggtccacccagtgacgagtcctatattgtatatgcacaccacattaagacacaagtcacgcgcaagcataatgctcgtagcggggcacaagcaacgagaacggcagaaaaagacacgcgctttgtatggtgccgtcaggggccatgtaggcatcttctgcgaggcagtggtcgacattttcagggcaacatttcctttgttccacgctttccctatcgagttgcccgtattttctgctgttccacgaagcttcctctctcggttgtctgggtggcccgtggcacagagcagaaataagcaaaaagcggcaaaaaatgatccgtgccatcggacagaaggcttcgaaagacacctcgagcagtacgcttgtcagggcacaccaaagtcattcatttggttgcctcagagtaccgcagtcgtcagtcttttttgaggttgtagaacaggatgtctgcagtggctcacggtagactacgaatcttcacaggtgtctgcgcgggagtcttttgtctcctctgtttcgtctaaggaagtgtagaaccagtttgccgattatctgtctcgtttctcgttttcccatgcttcttcctgtgtatcctgttcaaaatagaagtctccatccatttatgttagtgatccaaactggtttacgcccaagcttgatgacgctctggctcgccaggcttgactcaggttggaatcttcggagaatcgctttccgtacctgtggcctcgcacaaacgtaaccagcacattccttttacgcatacctacgaccgtgcacggagtgaaagagaaacccttatttgcattcgcggttagtctcgctcaaagccttgcgcgtcgtccttccattccctactctccatcgaacgcagcaggcatccctgtataaatgattgcatgattttgtcccgtagactatctttgtttttgctctaggggtacctgtggtttcccttccagaggagatcccggtgatacacagaaatacgcaatattccccctggtctgcatattcagattagggcactggttgaacctgacaaataccctgattttttttcatacgctccaaatccccttttttctcacaagtggcgaaacgctgcctcagcttcttgttccatacaccagtatcgtcaatagatacatgcacatagatacgtacgttgccatcgagattgtattttttcacgtgcatcgcttaagcgttttatgcatgcccacggcatgtgcattcgtttataaatatttatacctctgcatggttacgtacgtctcaggatcgccgggttatctagttctctcatggttgctgagcttcttcgagtttaggcttctccatttgacaaga

SEQ ID NO: 2372 - DNA, 2641 bp, Toxoplasma gondii
ctggcaagtacttagatgtgaagccggtcgttggccgataactattctatacttaggtttttctgtagtcatcgtagttgtttatttttcgtcatcttccatacgggatgcggacacgtacaggatttggccgtcccggtggtcacgcatgcgaatgtgttccagttttttactagaactgcgggcagacagtctacacaactggagagttgaaagcggaggaagtcgcgtgagaggtttgaggttgccatattgcactgatggatgatttatttttcaattcacatcctgcttttttcacagatatttatcgttccacaggctccttttcaaagctggcacacactaacgtttttcgctggcagcatggaaaacacgcgaaactaggggaacaagaaatccaactgagtgtccagcaactaggcatcattacggcttttagctcagtggatccatgcattgtcaggttactgaactacgagtgcccacaggccttgtgcttaaattgtttatcagctatgcataagggcgcttcactaattctgttggacagcgaacatacttggccacgatttgcagtctgttcggaacccgccctttcagccttcacatcagagaaaatgacattcgtatttcatcaaaaggtggtacatgcaaacatggttgtcatagaattgttgtctatttcttccctgtgttgatgaatattctgtgtttttcccggtaacactctgtattcaaccaagaagaaccggagcgatttagtgtcccatttgatatattctcagacttgcttgcttgcgctataagtcgtggtaccatttctttgcctcacgatgagcggatacctcaccacttgccacactcatgtactagacagacgacgggtcacggctacacccacattgcccgttgctgtttttttttacacctcgctgcttgtaggcaagtctgctcgctgatttagatagcctgccgagtcttgtgtgcacacttctttactgctgtaccgccgtcgcatttccagttagtcggtttcctccattcgtccctcccacaaggagccaggttctcagacctttcgtttttctagcggacactctctctctcttaggactgccgttaacgcacgagtccatcatgaaggacagttccgccaggcaaacgggcaacgacgattttgaacgaaacaaaacccttttcagttatctgtttcatgcacttttatggtggcggggattgactacagctttccctgtttcgtgaacgcgccttggtagtcgtcagtggtctctgcagacactttgtgcgcatgatcgtttttttgaccctgggttttcggttcggcagctgcgcgatttcacactccgacttcgattattgctctcagttccctgcctttctcgtgaaacccgacgtaaatcagcgcaggcatttttctcagctcgcgccagccggatttgcagatgagctggccgtctacgcgacagttttccgtgtagcgtgtttcggttgcttgacctcatccgttttctcctaccacgttcccgcattcgctgcttgtttttctctgcagttgttcgtttacgtggcgaaagaattctgccggactcttgcaagttcttgcattgtaaaaaatggtgccccgccaagccgtcgctcgccgtcgtttttccgcatgcgttgagcgcgtaaatgtcccaagtgtgtacgtttttcaagattttaagagggcagagggagaatttcgtagtagccaactgttcgttaactatccaaatgagtacattttgtgtagtgcgacgtgccctcttttatccctcatttttctccgtcttcgagtgcttttcgctgttcagttagcactcgtgttggcaggtccgagggtccgcagcttgccatctaacctcatcgcgtcgtgactcggctgctgctgtttacgtgttttatttgaggcaagttcttgtacgtctacggccgcaactgctactttactgtacttctcattttcggaagacgatagaggatctttgcctttcccttccggcttgtttatctaaatgtgattccgtcgcagctcagctcggcgcgaggcacttgcgctgcaagaaacgtgcaagaaacggctgtgtatctgtctgagtacagaacgtcgttcgttccagattgtttttgtcgttcccaactttttcttgcgtgtcacccgcctttttctttttttcctgacgactgtcactcgagggttatggtgtccggcaggtgaaccgctgcagacaggcgtatgtaagccaagccagacgtttccatccacgaatcgtttttcttcgttttttcccccgttactttgcgcttactcgaagcgcctagtttccccttcccattcgaccttgccttccgctcgacggctccccgtttttctttcagatgcgacgcctccgcggccgtgtggctggtgatcccggaatcggcctgccgttcttgctgcttcttgaagcacaccccagacgattccggcggcgcctcgaagcagaaacaaatgaacaccatgcgttaatgctacagcgatactcagggtaatcttcggcaaacgtccgactccactttcagcttctccccgctcagcctcagtcggtttttggca

SEQ ID NO: 2373 - DNA, 1670 bp, Toxoplasma gondii
gttgcaaactaaaaatctggctcgacagcgtgtacagcgacgaatccgagacgcccccgatcttcactgccttcttgggcaggagggaactctcggtcaaccacccgtaagacatcttgtcgctttctggcctcaccgaaaccgcaaacgggagtatacaaggaaacgcgcacagacacagggtaaaacgcgaaactgttccgagaacgctgaggcagccaggggaaaggagtggcgcggacgatgggtaaaacgggacggcggaaagaaagcgcacaagactcagacaaccacggacacacggtaaatttgtgaaagaaagaataggaacgaaaggaacggattcctctgcagaccgaatgcagagcagatctcgttggttagtgactgcatctgctttttgcccgcaaacaagtctagttcgactgtttcgcgaaaactctgaaggcagaccgtgggctcgcaggcgaagaacggagggtctccctcggaaaacagcgaacaaacagggggtagcatccctttgtcacaaggaaaacaggcctgcatatctttatctgtctttttgcgtgctgctcctcgcaccagctggagccaaactcagccttgcgacaccgctgaagtcaggagaccgggaaagaagaacccgagaaactcaggctcacaagctgaatcgaaaaagaggtgcttcgctcgattggaacccatccaaagatcgactgtcacttgttgtctcgttcgcctcagatgtgccagttcaatcctctgtaagagagacacgggttggtgctgctttctgcaaacacccagtcagggtgaacgggacgaaggaaacgccgtgcatgctacaggccttcgtgacctcattgtttgcgaggcttctgaatctggaaagagactcgaccttcagcctccccttcactcatccaggacacgaagctgaacgtgaaggcggcaacagagtcgcgagcacgcgaggaacaaggaagtcgtatgagcaattgtcccggagaggaccgacggttttcagggctatcaagtgtgctcggctaagatggaattgtgaggcactgagcaaaatccaaagctcaaaaatggaccggggaaaaagaaaaatgaaggtgtaaacagaccactgaacgcggagacttctgtcagcgactcgcgttgacgcgtattatgcatgcagcctcctctctgcgtgtaaaagaattgttcgcctcgatgcctttttctaatgaaggactacatccagtatgttctttttcctacttcacccgtttctctcttctcatttcagagcttttccaacaagtttggggcgccgaagcaggcgtcaggcgaaacccatcgatttatcgacccagcgagccaaaacgcatgcacgcgttgttcgcagaacactcactccgcaaggcggcacatacaacgaggagcacgcgagccttcctcttttgtctttccatctctctcctttcttgcttttgttctggagagagcgttgtctgtgccgtctcatcctgtggtgctcggattgactgtctcccgacatctccgcaggtccgcgagtcgctggaagcatcgagacattgctttccgctgaagacgcaggagcattttgtcgcgcacctcgcctggtccttctcttcttccttcctttatcaccagga

SEQ ID NO: 2374 - DNA, 3111 bp, Toxoplasma gondii
atctctgctgttcgtttctgactgcggttcttggcatggagaattgggcgctgcggccgctgagctgtcggcgggattctcatcacgacgcgcttgcgagctctgcggttcttctcgcgctagcgtattcgtggcctctaggtcgtctaagaactcgctgtcaccatggtccctgaggacacgggaccgcctggcggcggagcgacttcgacggtctcggcggcttgccacagaaccgccctgccttccttgtctgcgtggctgtctccgtctgtgcgccagaaaaaagccgtcctccgtgatgtactggcggggcattcgcctgccttcacagtctatgcaggggcgcccggactcccgacagtcgacacagatccagggaaggcttatgtccgcgtgctccggagacaacaggcaacacgcgcggtgatagcgctcaccgcaagactgctcctcacacacgaggaagtcgcgatcgtcttggcgtacggtctggccacatgcagggcacatccagtctcggtgcagggttcccaaaaaatgcgaggcagccatagtgtcgtgctcggtatacgcagccacttgatccagtttccgaactcgcgtgacagcctcccgctctcccgtacgagagtaggaggccaaccaggagaacctgcatttgcactggggacaagaattctccctggtgcaccatttttcgatgcagacatggtgaaacacgtgcgagcagcaggagatcaagccgagagggagaagcgactgcctggaagatgccggtgagtcgcgcgaagaaagggcagaaggtttcatccgagataaacgtcgtctccgaacatacggtggcgaggatgaggaagctgctgggggagaaggatcgacagatacggcaggactctccgaaatgtcgatcacgtgagtagaaggtttcgcagcagtggtgccggggctagtctcgtcctcttccgcgcaattgtcctcttggaattccccgagacagacggcacacgcttggtcgagctgcagccgagaaagttgcaccacctcgggaaaaacttccgtcatcacatagctcttcgtcatgcgtttcttagccgcaggcttgctgctcgaaagagactgccgtggacccgccatctcgagaaaagttcgcagtctggggtttagctcttgtactgagtcaaaagcgtgacgcgccacaactgaaccgcacgactaacatcggccgagagaccgagatacgggttgatataccagttatcagatcagaatgatgaaacaagaaaatgcagcaagcgtgcatgtccagtggtcaaatgcaggtacaaagacgaatcggaaaatcgaacaacgacgctatcttgaactgaagagggacctgccttctgcagccagttgcaccgcgtggcgacttcggctttttccatgatctcgcgagaaagatacggcagccatttccgtaaatgagaaggggacgagcgaagcaggagaaagagcggataaagagaaaccgacgagcacctcgagggcggaaacagttgacctggtagctgacgacccgcagcctgtgacggcgcaaaatcgcgctctcgccacaggtcattcattcatgacgcagctactccccaactagtcgatacgggtgtgtcggttgctgcacaaaacagtggtataaatatatgaagagaccccattagggaccctgtacttcttgttttattttgagaggggaaaggaagctgaaaaattcgtggcgaatatgaaaacacaagcgcggatactctacttggagggattcagcttctctctactacagcttctccccgccatggacgggtcctttcgtctgctcgtgacccccccccccccacctccccgcccatagtaccagatgcaaccctaaaataggtgtactttcagaagcgtgtaagggatccagttgaagtgcccaccattacgaatgcttccatcccaaatgtgtgtctccacacgcagcaaggctggctccatttccttgcatttttgtgcttcggcagcccgatagctctgtatttttcgtgtgtacctgataaggaacccttgtatgcgctgctcgccacgctgctccttcgtggcttggtacctgcctagggagagcaagggacgggctagccggtggctgttccactctgccccatcccgaggtgcttgctaggtagcaatagagaattgctgaggcacagcgtgatttcctgctaatcacgtaaacacgagcaagtttgatgattttcaccctgtgttgctgtttctgttgggagtatagaagctctcgtggtgttacgacagggggatggggagcgtcgcattgcgatggtgtggtgtgaattagccctgatccttgcagtttatttgtaagcacaccagaaaccagaaagtaactacatccgtattgttgccctctctcttagagccctgtgttttaaagtgatggggcgccggaaactcgttgacaatagatcatactgtttatccaaaaatcagcatttgctgcagtgacttggtgagcgcggtaattgcggtcgaggctttccttgtgattgtttgtgcactccttaaaacaggttctgtgactcggttctcaactgcactttttcgtagagttgttatgatatgcttgttcatggatgtcaaatacattcctccccgctgcgaatgcgtagtcaggaaccgacaacaaacgctccgtctggtgtgccacaccagtgtttggcctcattttttcattcttcattaactcgttcgtcaccacatcgtcacttcatagctgttcctagagacaaactaagacattttgtaattgaaggtggtcccctttgtaggatttcaatctcccaccacgtgaccgagtgtttcctacttctgaacagttcctgtgggtccgtcggaaggcgtgtcgccaaacaggggtcttctgttccacgttgtgccctttttcaataatatttttgggagccaccgcttttcccctttgattttcaaagacaaaggaagcctgactcagtgaagactggactattcacccttcacagttcacctgtttggtaatttcctctcgttctgctctccggacca

SEQ ID NO: 2375 - DNA, 1876 bp, Toxoplasma gondii
aatgacacattaagagagtattgtacaccctgaaagaggcatgataacactacacacagtgaaaaatggaaaatgcagctggtgtccagaaagctgtcttcgggctctcccggccaagttaccctgccgtaaacgcccggcccgtccttacgggcaaccaggcacgaacaaaaatgctaaagagaagctctgcttcgcattttcagaattgtggacgcaggcaatgcgttctaggacggaagcaggcttaggtggcagcgccgccgtatcggccaggcaacaaacagcgacgtgtttcttggaagcatttgaagtgaaaacgaggaattcgaattcatcggaaatcaggttttgccctcgccccagagagacgacgagaaacaatcaaggtcttgtttgcctgatcaaaagttctagtgatggttgaactgccgaggaggcgagcactgtccaaacacaccagccgcagaaagcgtccgtcctgttaaaaggcacgttgtccctttgctttgtcgctactgaacagagtttttcttgctcttttcatcgtaaatatgtgtttcttctgcttcgtccgtacctctctttggcgccgccgagtttgacgctcctccccagtggcagcagcccgagccgcgggctcgacatgcggagaagtctcgtagcccaggacattttgtcgaaacggtggaaaactagaaagaaaagaaagtgcgagagacacacaaaccgtcacgcagactccgcgaacccacgttcagctggcgcgtgttcgttacttcctggcgactggagagaaagaaaacagtggactaggaacccgacgctgctcacagacacaatggtagtttgcggaattttcggggattccgaaaagcagagtcgaagtgaagattccttctgattggtgtgccggcatttgcttcgctgaccgcaggtcacacaactcgcgacaaaccgcctgtcgtggagactacaggggcgcagagatcgcgggagcgaagaaacagacaatttcactttgggaagacaccagaaaaacagaacagcgcacgagacacgctccggaaaagatacagcgaaacactctgctggtggcgttcggccaacacagaaattcagacgtcgactgtctcatcagagatcgtcactggttgcgagcatacgccgatttctccctcgccaggatttcgaaaatcccctgcgcgctgcatgcgcgctttttgctgaacacgcgactgccgggagagctcaacgaggcagaaagagaccagtacacatgtttcgaggaaaaatgtttcgtcccggggatccaaggaggacccaacgaaggtgtgaaaatgtcggatacctagatatctcccttcccagtcgctccaggtgtcacgcgccggttctccgcgattgccctcgtccctcttctgtcgcgtcgtcaactgcctcttttcgcctctcgtcattcgtctttcctcagtcgacagtcttctgcatccattcggtgtgcaattctcgtgcgcccctgtctggaagcaggcacatacagcctgagatagcctcgactgcacatcctgaatgtgcgtcgtaaggagctcggcctctcctccaggcggggtacctccgactctcgtctttgattctgccccctgtttatgataccactgtttcacagtcgtttcctgcccgcttatatggacacaattggcggtcgagttactagggacgccccgttgacagcaagacaagctgccgggcaacactcccggaaaaccaggctcagagaccggcggatatgactacaagggaactgcagtagaagaacagaaaacgaaaatacgaaaatacctgtagcgtctccgcggcgtctttgtgaaaacaa

SEQ ID NO: 2376 - DNA, 3584 bp, Toxoplasma gondii
tcgtacgcgcctcgcgacgtttctcagactcgagaaacgcagagactgtcgccacgagggcggtggctcgagtgctgctctctccgcctccccgtggacttcgagaacgagaaaccggaggaggggggcgcggtggggaagaagtcgcaggcggcatgcctgcctccggctgtttccgtgctccgagtgacgcgggaagagcgaaggtctgagacgctgccgtccctggagaagacgaacaggagggtgtgtgagaagcgtacctcggaggcgcaggagagcagtgagaggacggaggcgaagggatagagatagaggaagcgccgctgcactcgcttacgttaggcagaacagggaaggtattctggccgggccgagggccgcgcggcggccgcccgcgctgcagtccccagtggtagtgatggtgatggtgccgcgcgaggtgaggatgtctcggctgagaaaggtgaattgtgggtggaaaaccggaagaatgtggatggctttgaccgaatccctcccgaggcggaggcggctgcgcagcgtaactttgtggggctggaggacgtggtcctccaaaggcttgtccttgcggtgggtgtgacatagctgcgacgaattaagaagacgcaaaaaacgcaacggcggacagagagtcggggatagagccttccccgtgagtcgaatgtgacacgctgaaacgagagaacagtgaagagagcatggaggcgaaagtaagtacggaaaccggacaagagagagcacgagaggaaccagatgcagcagggtcgccgctgcgctagcagctcgacttgtttctcgaagtcaagaaaggcccgcgacgacgacgaacagagttacgggggtgagggcatagctaaaaaaggagggaaacgtgtgaaaaaaaacgagaaatagacgatgaagaaaggaacggaacttgggccttgactcgggcttgtgtcccgtttgtgcggggccagcgcagtgacgaaacgcgacagcgtataggaggccggggagaccgaggaactcgccgaaccctgcgtctgttcttgcatgtctcaaactcttggggttactttttaaatgcactaggaaaaaatagtttctctgctagagattctctatttttgcaggactggctgcattttgaccgcgatacgccgactcactcgcatgccgtacttgtgctggcaaaatcgccgtgcatgcgttatttcgacaagacgatcgcagaccccgaaaaacgaatacgcgctaaacgctaaccttcttctcagagagaagtgtgcttgtaaggtgattgaactgttctcggtattttgtttacgcacagcgacttagttgtttgtgttgagcctggagtaccgatggtctggatgaaacggttcggatttgccttttcaacaacttggaaagaacaaaggcctagagagggaggaacgcgatggaagaaagagtttcataatggggagaccttagacgcacgaaggaaacatgcgcgggatgtgcttcgtattgataaagggttcaacatgatgacaactggctcaggaatttgccttaatgtcgagggtggtctacacaaggacggtaaccggctagccatggttttccagagaattccctcaacgccgtgagatgaaacaatgagaggcttgctcaaagaaacatgacgcactcatcgcggcatgggagtcggcttttgtctggcatcgctgctgcgaaataccatgggacaatcccaacttaaactcagttggaggaagctcgtgggcagatgcgattctttcgtcactctctttgccttccaacctcgaatcaggaagcacagcaagcagcgagaatgttattggccgatagataaaggtgtagcatgaaacgtctcgagtgcctgagagaaactcgctcggctgatggggaagacacctagcgccgcccttcgggcaacggccagtagaccgcgtctacgtccgacgagaagtcctcaactgacgcaattgctctttcaatgggaatgtcgaacttacaagcgatatgtgatgcacgcaaaatgcgctgaacggtgtccggagtgcaccgtttaggccgttggtgtgtcactctacagactcgcttccgtaattctgcgcaccgtcaaccggctgtcttccacgcatgccctttccacgaattcacgatatcttctacagtctcatcaatacgctgaccctgtcaggaagcgcttgtttccgtaacccaagtgatggacttccacgtgataacaaaggcagctttatccattttctcgtgtatctcgtagctgtcttgcatgcttctacgtagaggtgcttgcagatgagcgtcctcaaggagggtaccaacgcttccggtacttgaaatgcggatccagtcctgggtcatgtacagactgagggattcctgtgtagtctgaatgcgccagacatgaggagaacgttctaagacgcacccttagcctccgaggaggacgtcagcatctctgagtctccagaggactggctgacgggataaacaccgcgacttgccagttgacgggcaaagctctttcctgcagagtcacttctgccgagcgtctgatagaagaagggagaatccgaaaaggctggtgatgcagcttccactgtggtgctgtctggattcacccagtgagcaccgccggcatatatacaggcatctgctgggacggctcagctctttccttgatttacatacaaggaacccaggtcgactctactccggtggaaaatctccggcatgcgctgtgttttttgtggctacggagaaagagggtatggagtagaggcagctgcatgacgtctaggcgccggggctacttctttgaacgtccctgcgtgaacttcaggagcgaggctaagcaaggcagtttgagtttctcattcatcagacatacaccacgagcggcttttgagtcgaattaatttaacccaatttgtatagtgagaatgccccgtcgaaagtgtgagttttgcttctgcgccgtcggtctcccgacgagaggaaactcaactcagactcagtctctacctagctgtagtgggcgctgtattactcctctccacaaagacacatacccttaccccgtcgcgaaacagctttgtttctttgaagtatcttttgtctacaaatagttcagtggggctatcgattccaatccatgtcccgcaggttgtgcaacagtggagcgcagcggctatccattgaactttttctatgcgttgactacaggtttcttcgatgcatttagaaaacgcagtggttcctctgcacctttgagtttacaccacacacacacacacactaacggtagagcaaacagacagccgttacgtgtctctgatgaagcggtgcgtttccgtttgtcagagatggcgtggagtttctcatcgaggatcctcctggtttacacgggagaaaatcaagaaaggcgtctgcgaaggaaatcgagaaagttgagttcctctgctacgcgtttcacctttttctttccttgcagaggcgagttcaccaccgtggacatgggaatggctgtttgcaggcta

SEQ ID NO: 2377 - DNA, 1278 bp, Toxoplasma gondii
ctcgtcacagcttcgcgcttccttttcgttataccgagtcacagttccttttcgttataccaagtcacagttccttttcgttatactaagtcacagttccttttcgttgcaggacagcactcttccttctctgtttttcgcggccgcaaagcgacatttctagctgctccgtcgagtctgcgtctgaatcgtttttgagtcgtggagaggcggacagggcaaagctggcccatcgcgtttcttgttccagtcgagttccacgggagttgcttgtggaggaaaaagttttgcgtctctgcgatactctggtcgacatgcatgcgcattaagaagccatccaccagcttttctggataggctggcttctctgcgcttcgaagaagcgagaaaaaaagctactcgatcagagcgtctcaaaagtttctactttctcggctgcagtctccaaagcaattagtcgacacgagacatatacatatatatatattatatttgcactcgatcaccgcgtttcttccatatatgtttcagtgcacctctgcagaaacgtatcttgtacatatatggagtccgtttgtctcggcagtgttggaacgccgcgacgtttcttcacacgagagagaggcctgctgttgctccttacaccttccacggtttttccaccgaggctcgactgtagaagtccgaccgcgttcagatcagaagaatgttttacagaaactgttgagaggagacggaagagaggagagcctctgctgtcactggaggactccgagaggctgcaagacaacgagaacgaaggcgcaacatatcgatgcgcgcatgtgtaggcgctcgctgtatcgtgagttgcatgcagcggggaagaaggagtttttatcgctccggagaaagaatcccatttgggcgcattttgcttcacttgaacagattttctcctcaactttgcgtaagtttctccctcaatttcgtcgccttctcattaccgtcagattcgttctcgcgcctgtctccgttcgcgcgcgactctgctgtgtcctcctctctcgcgtctccgtatttccccgtttcgcatgcgcctcgcgcttcgtcttcgtggagctttttgctttgcctcaagtgagaaagagacagtcgatctcgaggcctcgcgctgtccggacaccgcagtgtccgagttgcttgcagcgctgcatgcagttgctgtctcaaatcgagagagcggaacgaaagagagaactttcccctcaaacaggatgtgagcgccggagacgcaga

SEQ ID NO: 2378 - DNA, 2931 bp, Toxoplasma gondii
caagtgtgcatggctctcgggatcgtagctctttcgagcatgtggttgacccttccttacggtcaccctacgctggcccttccaggcctggaagcggctgcggcagtaacttcggaatcgctgcggggttccaccagagttcatcttcaagtgtgggactcgccagaaatccttccagaggctatgatgatgtcaacatggggcacccagtcgcgccacgaggtgtgttgaattcgatgccagttgtccgcacgcctactctgacaagagccgtatcacggcgattgggcgcagaatcaggtttcagcactccaaatggatccaatatataagaaatgatctactgcaacgcgtgaacagtagatgctgaacagaccagacctgtgaggcgatgtgtacgctgaagagcgcgcacgatgggcaggcacagataagcaagaccacagtgaaggaaaacccctttgactagtgtccaactatcctgttcgtgtctcctgtgtgtttgaattgtattgaccggccaccgtattgctccaggtgcaaacagtgttggtgcgccacggatgccaacacgacgacttcgtggcttgttttattttcttgtgaaggaaggatcaaggatcaaacgttttgcttgtgtaatgagaccctgtctgaaagaacttcgacagatagagtgtttcagggtgcggcggtaaatgcattcgcgaagggaacgtttgatcagggaaatgacggtttagttcattttttaatcggtagacgcccaccaccaggcgaacaatttcaacgacacggtaaacgtcgcaagtttttgtgtgttgttcaatgtagccactcttgcatttccagtgtgcgccgcctcttgagcgtaaattccgcacagtgtccctggggattgagtgtttccgcgtgtgtgcagtaccggtattcgaagtttggttcctttaatagtttgcctctcgagtcaactggtgttcccgcgtctgagaagtcccgttatcgaatagtctgttgcttgagtgcttcgcttttcgaaataactgaagatcgttacagcttcatgagaggaaccaacgccttcaggcatcgaagtttttttgtcctatcatgaggtaaaagtggcagaaacgtgcgagtctcgaagacagtaaagctactcctagtattgcaactgcaggaatgcgtatacgctgctttcacgttgtcgggttctctttgaccaaacgattattgcctagcagcttgacggaatcgccatcggcagttctatctcctggttagcagggctggcctcgcgacggatttatctttggcccggtgttgcgatttacattgccagtgactgggtaggtcccaatattctaagcgctccacattgcgtcgtacagacaaaacgacagctttgcagttgaaacacgctcaaaagcagaaactcttcttgttcaccgtagtgggaaagcgtatttaaacgatctcgctgggagagcgaggtcggtagtgccactatttggaagccgagcttggctatcacaggccttgcaaggaactgcaatgcaaaagaacctgtgatattctgtcagcgtccacaccgtagcacaaggtagcgcacgctgagcatgagcagttacagttttaaaaaaatcaggacatatattagttatgctacatttcagtaaaatgattctgtttaataactatagatttctgtgagcactattgctttttcgtttaaaatgttttcttcaaaatctttttcgcggatgcctgcgttccccataagcagtagctgcgactgttactcacgcttagcgaaaactaatcaagcaatactcaaaacggttcaaatgcctcttgaatttgcggtgggattaagatacatttcaggcgaagcagagcagttgggtagctcgtcggcggcagtgaagacagaagttgtagaaccgaacgccatggttatacatggcccacttccagccgaaggtaataatgctatctggttcttcttcccttgtgagcagtccacttggtctcgtcagccttggaagtttaaggcgtgtcagacttctgcacccaatcgcgaactctgtgtaccttccgcttggaaaatggagttgcatacgagcgaagcgaggaacttgctgataaatgaccaccaccaggtctttagggacgagcggtttcgtggggccgcgaggggatcgagtgtgttttgaggagttgactgccaagccctgttaagcaactctgcgtaggcgggaggctttgcaatcgatcttgacgtcccaaccaagaatacatgatcaactcctgtccgtcagtgtagcgctgtcaatcctcatttggtctaaggtgtcagaacttgacatgcgctctcgattgtcagagtgatcagcaacatcataggttgcacgcattcaaacaacagacgttgcatgtgacgatttgatgcttcatatcccatgggtctatgaaaagaggactacgatccatcgtagcgtgttagttgcactgttcatctagtaactaaccgcttcttgcaagtgttcagcgcattcgcagaactagtgtaccctcgtgttacgtatgtagtcgccgcaagaagtcaaaatacattctccaattttcttcgcgcatacgttcaaaaccaacggtgcaacaaaattgtacatttgagtagcctctgggttcttaactcatccgctcgcgctctgcaccaataaatattttcacactacagttccccgtcctctaggtgctttatgtggtatcctgttcgaacgtcgtgaactcttgcaggagagtctcggcgagatcccatcgtgtggtgatacgtttttacccgctactacctccaccggcagctcaactgttcgagcaggagacgagcgggcgctgccgaaacttgattcgttctctttgtgcaagcca

SEQ ID NO: 2379 - DNA, 4184 bp, Toxoplasma gondii
ccgtaactgggacctgcctgatccactgtcgtccctgtcggatctttcctcgggagctgtctccacccataaggggtctttctgcattgcctcctccccctctgtgggaccggaacaatgccgtatgaacacgcacgggcacctgcggacacagatccggaagtctccctgttcttcacctccttcaggcgcctgccgtccatgggtgtccctgtgcaagaccttaacagcaaggtcgctgtggtcatccatgaaccaggaactgtcctctttgttcgttcagcagtgcattcagttgtgaacgcgtgtaagaaagtggaaggacagctgctacaggcgtccacggaaggagcggcagccagggccgcgcgtacgccacctaagggcgagcatagaagaaaggagggaccaaaaggcaccaagacaagagcgaaacttagtagaaagaaaagaagtgtcaaaaagctattgaaggggccgcaaaggggaagaatccgagtcgaggactccgtcacctgaagagcaatgcaggcggggagagggacgacgccagtggcagcagggctgcagcgcatctttgggtctgtgtgtgcctcagactcgaaaagatgcgaagaaggttcactgtaagtgaaatgcgtgagtgcagcactctgtgagcgcttgaatatcattgttcgggggagacatcacttcgatcaactgccggcacaatcgagcctgtacgacgtgacaagagaggcgacagagctgttctgacgtatcggcatcggattgtaacgacattgtctccctcaaaatgaaggaaacacctcaaaatttcaggtgcaacgtcaatcgccgtggcaggaaatggggggaagccagccccgtggcaagcgcgagtgggccctcccaagaaatctgctctggggcacactcacactgggttgacattctgtgtcatccaagccaaacaacggggtgccaaaagatcttgagaaaaagtcgtgcgaacttgcatgggctgcgaaagtagctgatggtgcaataaaatatacctcgaatctattcagcctctcaattgccggctgcaccttcgcgcaaaatgtctatggcggaggaagagcatgtcatgtaattctccatattcgaacagccaaccaaaactcgaagactcgattagcagatcccttccgaagaaagactggtcttatcctttgtccggtaaaatcttcagagtgaaatggattgacaagacaatgaccagacgcttgtgtaatgcatgcgtaaagtcgtccggcttgctgaagcaaacgtactcgtaagctcgaccgcctcttctccgagtcggaccaagaaaattagaagcagtttacgacgggcaagccgaatctgtcaaagtaagtccaaatagtctcacaatttcggattgtgtacctctctggcatgcattgtgtagcctttttgcaggtaatctggactcatggtgaccgaatggtacgcaaatggcgcaaacatagacgtgctttggcgtctataaaaatctagcaatgcttgtcaagtctcttgtatctatttagttcactgcgtactcaggatcacaccaaaagagctatctaatggtactagggaggagcaaatcgcgttagcttttggtaaaacactatctttcagctaaacgaggcctgccagaaaggaccttgtccggagggaaagtggagtcgtaaccggagagaaacgtgccacgcctcctcttgcagccgacagaaaccaactgcaatttcgacacatcggacggcaaacagatgcaccaaaacaagaacaaacggtgcgtcagttgaaagaccagaagatcgacaatcctcgacatagaaaaccacagaaaaaaagcgaaacagcgcctgcagagcgtcagtcgaactaaccatgggtgaagaacaggggcgactgacagaaggtacccttaaattccctctacgaaagcagtgcaccagatgccacggaaatcgcttctcgggatcgacagccaaagtatgcgaaagacccaggattcaccattcgtcacgcgcgagagccgtctctaaacaaaacggcttgtctagttgactcgccacgacaaagttacgtaactataaccatcaactgaattcgtcactgtcacatcagcgacaaatctgacttgtgacatgcaattttcagcgctttctcacaccttcgttttcccaattcttggcgtggaagagaggaagaatgtcacgattttgaacagcgtccctttcccataaacgtgaagtcgcgacgctgacaacggattgtgaagacaagactagatgcaatcaactctccacagcaacctgcggcttatgtactcaaattcagaagatagcacagcgaaaattgtcctcactgcaacggcaactcgcgtaagtcacatagatgcgtatgcgcgacggtagtcaatacagttttcgaatcgtttctaaagcatgcgcgctgaccattccttcaacacgtgagctagtaaacattcggctgttgcacagtcatgaggcatacacctgcaaatgcactcactcctggaaaaggaatgcagcacctcaacacaccacaagtgatacaggacactagaggacgctgtagagcctcttgccaggcttgcacggtggcgtgtcggtcaccggaagctccacacacttttcttcgtaagcgccgtcatagcaggtgtaggaaatctagattgtccggaagcctgaaatcgagtgttggcccgctccgacttgtgcgtctcgtatccgaccactgtctgtttctcgttgcacggtgactgctgaacctcctggatgacggctgtgcagattcctgtctcgtagattaaaatatcgatacaccttcacagaggtgtctgttccacgcacagcgcctcgaattgatatgttaagctgctgctgatccccgaagatctcttcaaactattgtcgcgcacacagcttcacaattgtcttaaacactgttgcaacgcagcgtcgtaccagtaccaatgcggtaagggcaacggagttggggggggggggcttatcgtcagcgtggcaagattagtcaacgcactgaagttcgtatggaggctcagggtttccctagcggccgtcgcaaatatgggggcttgtccgagcagttgcgcctcgttggtggtgtggatatctacgactagtcgaatccgtcatgcagatacgtatgctgcacgtgaagagttggtcgtacatcgttgttcatggccgttggcaatggaccgcgaaggaattctactctaatgcggctgtaacggccacacacaggatcgccacccatccccaacatggagacccaccccggcgctgtcgcacgtggtacctgaccattttcctcgtgtagcctcgaaatgacgtaaacttctggggcgcagtgggaggacgcttagctagcaaaacactgaccattttgtacggctgcactgtggcactggccatggggaatgtctacgcgtttcctcccataataacgcttcaacttaaactcgtcgaccccggtgaaaggagtccctccgccgtgtaaacctgtccctgaggggctggaggctgcatttcaccacaacaaacattatatatgcgtgccatgcgtaacgatactattgatgcggtttccctgggtagcgagccatgatccaggggaaaatgaaaccagccgttagctatccactgcttccccccttcaagctctacgcagagagagctctactgttctcccctcagagagaccgactgtcccttccgtgctagtatcgcgccaacgcgggtcgaccgcgccacccgcgctgagatttcattttcgtatcgaccattctgcggggatctacgcaacagaattgtgccactcgcgcttgccgtagctactctatctgttcctttcctctgagccataactgttgtcaagccgagcagatattgacgatttgacccgaaaaacggtagcctcacagtcgaacgcgaacgatgctcctcaatctacccgctcctgtccagcgacccacgctcgtccccgtgcctctgatagaactgagccctcttcagaaaagccgggtatcccagcatcacacgctaacctctccggtttgcggggtttcgattcaggccttatggttcgtgggaaggcggcgtgacacaggcaaa

SEQ ID NO: 2380 - DNA, 4664 bp, Toxoplasma gondii
agaaagagaggctctgaaacgacaagaaggccattcttcgactgaggcgtcgcgacaggcgcgcccgcctcttcttcgcactcccgtcacggttcgtcttctccctccttcgtccgagtcgtcttgaccaacacacagctggacagactcaagataaaagcagaaacggggacagaaggagttccagcacatcgataacccatgctcgccccgtacgcttgcccatgccgcccgtcctgaacatctccggtccctcctacacacagagggcgcacagatgtatgttggtgaacccagtccgctggaagttgaagtccgacaagaagtgagtctagtctgtcaaacgtgaacgcgattgtttagaaccacggacaaagaagagaacagtgaggctccgtagtgttacgtatctaattcgcttgtagtagtagtagtggtagcagtggcagacttgcgggtgagtgcattttaccgcagctcggcgcgagaccaaagtggattaagagagtaccgaaataagaaacacacagatatgagactgatttagatatagagggacaagagacaagcggacttttagagacgtccggcaggtgggcgcatgagtcgaaagactctctctgtgtcatttcggtgatttttgaaggcaaccgcttcacgaagagcgcccagcgtaatacaaagagacgaggaacaactctcagctttccaacaaaaaaccagaagaggcacaattgcgtgagggcgtcagtgatgcagcgacagcttagaacggcgcacgacgcgttccccacaggctaccacagcgtggaaagggtgtcggcgacgagccgcgggagacaacagaaaataaaacggaaacggggaaagaatgcaaattcttagctttccgttgagaaaccggaagaggggcgtgggacgaacctcggggtggggggcaggaaagggtcctgacccgcagaagctggctgtggcgcagggcaactgtgaacagttccgatacgggattcgatccgcagcgagctttttaaaggaactatttaggttgcaagcaagtttcacagagaagcagcgaaaaagcgagttctttcgcgcaaaagttgaggaggccggcagagagggggaaggtctgcgacgggatgagtggaagctcacgcgcgtcacgcgctgtgtgacgaagattatgtgccggtctacaaatccgagacgaaagacagaaacaaaggcatgagagaagagaacggccagaagcgaacgccgagcaagaagcgagagaaaggacgctcccggtgacggggataataactcagggtaccgcgccacgcttggtctctcgcatcccgaggggagagaggggcgacgcagagaaaacagagactcaggcagcacacgagaccgaaagaaagagagagagagacagagagacgggagagaaggacaaaggagtcacgaacgcgttttcgccaaaaagaggaaaaaaggctagtgcgggaacaaggaaacgctctccagcgctctccccgtccggccacatgtgtgtttcaaaaaacgacgcttcgtcctcttattgccacgcacgcgtcccacctgctgacctttaaacacacttgcaatttgctcccaccctgctccatataaacgacgagctcaacacacgggtattgcagggcagtctcgccgaagacgctcagagacggcaaaccatctcgaggtgccgagacgtgcgcttgagcacgcaaaaagcagaaatggaagcgaaagctttcgtgggggccgaaactctcaactgcacgcgtgttgatcgcagtgtgagagcccgggaggacgacagacgctgcagactgtctgtgagagacgcctggcctgttttttggaggaagcgacgtggttgtcaacgcttttttccgatccgatggaaaatgggacgaaaacagccaaccgtacggctgtaaactgtgtggaggcctccttccaccgtggccaagaaaaggtgctttttgcccaggtgtgtctgtccgggtaggctgtccacgctctccgtcgttgatcgcttctccgtttctcagactgcttttgccgtaccacaacagtttcgagccagtcatcttccttttcgcctacggatgggaggaacgctgtttttttctagttttcaaagtaagaacgacccctttgcacggtgtgcagaaacggcgggaccagtcggggccagtccagcagcaagcggctgcggttactgccgcatgtgtgttttccaaggaacaagcggtccgaaaaagtagaccgtggagaggtacacgctccaatgggttacgcatacgttgcaaatcctggcagggacaaaggaaagtgtgtttgtggagactgcggggttttctcacaaccgttaagccaggcgccggatgtccttagcgtacatgttcaaagtctgtagcgcgaacacgccattatgcgaaaccgtcatcagttgacacacgcctctctcactatctcaccactgtaaacccaaacggaaaacgtcattttttgcctcatcgttgctggatcctgtggagaagccccactgtagaaggtggtcgatccgtaacttgggagttccgtcgctgaccggaaagtgttactgtgttcacccgtgcttagaggcaacgatgtttctttgtttcgccgtctgcctacctgccgctactgcatttgagaaacgagttgtgtgcgctatgtgaaactgctgagacagcagtcggatatctgtagcggcaacgtgtgaaactccggtacgcgttgtttagagcacacagcgggctaccaggtttaggggcgacactacgaaggcagcgtcggtagattcagttcctccaagttcctgatgcagttcgaggcaaaactctgtatttcgtagaccccgatcacacgtggagtaagcagtccacgacagcagtctctgtgcttcatttgagcttcagggtgaaacatcagaaccataacggttcgtcgaaacacagcctcagctcgaacacgttccgtcatgatgccagtttgcgctgaaggtcgttgctgtcgtgccgagcatagtcgacggacaatgcatcatccggatgccatggagatttacactcgatcggcactgtcgttcgccttttgtatgcgggttcttagagaacagggactatagcgctaagtaactcacaaacaacggctcatgttggttgtgactaactgctcccgatagagatgtgtgtgggctcttagtcggccaggagactcggtgtttccagaggacagagtcatcagctgacacagtggacatcgattgtattgccggtgcgtgtgtagtcaacgtccttctctctctctacgcttcttggggacagcacacaactgaagaccttaaaactatggtaactgcgttgggggagcgtttgaacgattgggagtagttcgacgtttggggtgggtcggcggtgttgttcgttgccgtcgggcagacaatgaaagaacgttaccactgcaaatttcgaagattgaccacatttcaacgcgaagcagatgtgccacgatgaaaacattggcaacttgtacacactgtctgatgtgaaggcatgcactgctgtgtcagcgcaacattttagttcactgtcaccgaagctggaaaagtctatagactgtgttgaccagcatgaagctccacaaaacaacacatttctagataagtaggacgtgaatacacgcggtgattccttgcgtccattcacgtgcactgttgttcaagcaaagaatacggaaacttagtccacatggttgtgttctaccggttgagcaccacacaccacgggcacgatatgcgaaaacaaaacgaatgtgttaagaaaggcactccatcgaattcggtatgccgtcttttgtgccctcgctgagacagctacgctctgctcgtggtccagaaatagtcatttttttgcgtcccgttccactgtgtgttcttactgggtactagtgtgtcgattgtcgtcatcgttttcttcgcctgtctcagtgtcactaaagtgctggccactgccttctgttctctgttcgtttgcagttatttcacccatgtccaacgcaaaccctaggaaaatcgcctcgacggaccatctgctttgcggaccctccaccaattaaatcctcggtgcccttttaccggtgacacgatctcattctgtcgccagcactacgtctgacggatcgtgaactgacaccaggaactgcaaacatttgcacccgcttgtgcgtgtccgacgcgggtgggtggtcctgatccgttgacggacgacagcgctgttccgaggattgtccggatgcggccagcctgtgtcaggacacgtccgcagtactttttagtgtggtttgtcagttcattgactaacttctcggcagccggctccgtctcactcttcctaacgcccacaactagataaacgtgagtgcgggcgtctctcctttctacgtttcttggcgttcacggtcaagcgtatcagagtgactctcgcgtcaccgcggcttcgggctctctgctgttcgactacgggtaagttttcaccactggacagaacaaaaacactcttcccgccttctccaagcgtttcgattaagctttgtttcccttcctctccgcatcttttctggaa

SEQ ID NO: 2381 - DNA, 4791 bp, Toxoplasma gondii
gacaaaaaggcgagccatctagacaggtagcgggcggtgtggtgcctctaagttccagtgagaatacagctgctgcctgctcatccgcagggattagaacaaactgttcgctacaaaaactcggatcctcgagggcatcggcgcagaagtcgcgccgcctcgtggagatcaggtgccgtttctgctccttcgtgttcaaacatctcgctgcaggcctccgtgtcgccagattgtttccagattctctctgtgcaatctttttaaaacgctgcgcagcatgtttccttgtcaccgctcctctcgccctcttctctacgtcacatccttcttcgtttcggatcccacggcctttcgtggggtccctggtcgcttggcaaggggctggtgcttatgggaaaatcgtagcacggctgagtagtcgaaactcgggtactcgtttagccagcttatcacgtcccaaaagaacataagattttttgccaggaacacgtagaaaaccagccggttgtggaagaaacgaaaaagcagtgtcccaagagtccgggttccccctgttcgcgccacggtcatctggtcgtagtagtctctgtagacgaagatatacgagtcgaggacttggagaaaaagcgtggcgaaaaggagcgaaattttccaccgcgcctcgaccttcagtgcctttcggcgatctcgcacgcaacgccgttgcagtcgttcctcgaggccccgcgcgctggcaggcacttcggctccgtttgcctgcgccttccgtctcgctgtaaagaccgcacgacggcgcaacgcttctgccgactgcagtgccttctcaccacacggggcttcccgcgtttcgtcgagcgagcgagactgagacctcgcaggaaatggagaaagggacggatgcggcgaaagcgtgcggtccttgctgacgtccgcctgactaagtcgctcgctgagtggcgtcccccagacagaacccggaggctcggctacgacctctgctgtgtttccagaagagatttgtgagtcaaaaatccggtgttgcccggtttgaacagaagaattgcctgcagcagtctcctggtgttcgtcctctgtcgtgcgatggtgcaagccagttcctccacccagtcgttcacgaccctgcgacctagaggactggtcgtcgctcaactcagaaacgccattctcaccggaagaaatcagtgaggaccattgattgccgacttcagcaaaggagacatccaataagacgtcgctcgttccaggctcggagccgccgttcgccgcgagcgtgaacggcaagtgctgaggactccatgccgccaggagcagcgccagcagggggggaagagcaaacacagatccaacaagattcttgcacattgcagcccttcggtaaaacatagtacccgacagaattcgagtagaagtcgctggaggcagcggcggaacaaagtccgccttctcgagctgcataagggagctttagaccggcgggtcccgccggtctacaatgcctctcccaggtgtgtcacacgcgcattctactcgcgtttgagaacgcggaataaatgtcactttcatgaagccatatgttggagaagcctcgtctgtttgttgcagaaaggaatatctgaatttacgtacccaggccgatttttaagtcgctgttgtgcctcttcgcggagagcggaacttacgggggacctccagagtcggtgaaaaaagtggcgcgacaaatgctcggagaaggaagggaaacgcacaggaaacgggtccgtcaaaatggatgcatgtaacataaagtagagactctcggtctccaaaggactcatctgtgtcgtaggggagcctcaagttctttttcgtggacgtatgattctcgcttcggaggatgggaaagacactccgaacccccatacaggagtatgctggcgcggcaagcggatgacgcaaggaactcacagtcgttgagttaaatgtaattcgatgcagcacgggaaaattgctttgccgttgttcacagtctaatcttgtgggcctgtggtgaacctgttattcagactaatgagagcagtggccccgtctgcctgctgctgcgtgaggctacgacacgaattctcccggcttgcgcgccacactgcttacagggtggttgacattccgggagttaacatatttactcgtatagaacatgcgaagacgcttgaaagagataaatgtacgattagtttttatttcgtgttgagttgcgcccatgaaaacggtaggagcacggtcgtcggtgggtttctgatacagctcacgcagcagcttcgcgaaatcctggctgaatgagacttctctgcgatgcgggaaagaaacagttgcgttcgggcagtggggataaaaaaacgtcaagaaaccacaactcttcttaaaccgccataaaatgttattcaaagcaacaccagcagtatctcttcgctcacattgtgctcatatcttttgcgaactgtgcgtctaacttggccacagtctcaggccaagtcctgtggagtgctgtgtgccgaccgtggtctggtggactataaccggcggctaaaaaagatatgactcatggttccgaggaactatcataggaaaatgggaactaactaggtggtgtctctgctcagtttatagaagcttcacggttcagaccgtcaccaccagtgtatgcatccagtgaattcacatgggattttgcttgtcactcccacagacgtcaaacacgcgcacatgcggaacgaaaccgtaatcgcagtacgtcgtcaatcctgtactaatcacacgtctcccgacctaaaacaccctggttgctgcctttggtttgtaagcacaggatctcactctcgtttcggtcctcgcagcacggcaacggcctccatggtaccaaacggcaacggttctatctattatagccctcaggtcaccacacaagacgtcttatggatgtttccggatagtccgtcctaagttgtcaacaatgcccctgtgatagaactgcacgttcaagtttttccggctcttgtcgaaagccgcctgctggatgttcttgtctgtacaacaaaaagcgtggtgctctccaatccccatttggaatgtcttagcagatgtgggtgaggtgcgtatctcaactctattgtttttcgttggtagatatatcagccgtaatttgctggcaaggtgtgccaaacgccaccgtgccaagtcagtgtcgatagtccaccgaagtgcgtccaaacagtcgcagaaaaagtgtgttcacctggttaattgctccccgttcgttgaagtgtttttcaggattgctggtgtatacatacgaagtctctcttacaagatgtgcgtgctggaggagttaacgtgatggatgcatagtcctcccgaattcgaccagcaacctcacaaataggtgggctcagtcacgtcattgtgcgcgtctagcaagagaagagtatgaagcatcaaaaccgaatcctctctcgaaaggaatttcctgagccaacacgagttccgcttcagccttgaagcctcaaggacagaggaaacttgggtgccttggcagcgcaactcgataaccagggcagtgtgttcgcaaggcagtgctgaagctccacaggttttgcgacacacattcctatccctcctatccttgtcatctcttccaacatagggtttatccaagagacagtgggtcggcgcagatatcagctccgtggtttcaacagttcccacggtgccagcagcggaactgatgtagacgcgggaattgtcgaatggtaagacagataggagaggtcatctgcccccttgttaagtcgacagtcagcacaggtttcttatcctttgatatgatcattcacagggaacacggaaaattcatccgggtcaaccaattaccgccggtttcagagaacctgctcaagcagccagtatccaggccaagggctcggggggttcgagcgtggggtggcagttgagagccagacgctaccgccaagctggaggcgcagctgttcgcgtagccgtccgttccgcgtgcattggaattttaaaaggaattcacccattgttttactgtatacgtctcatgcaaacttcgtttttggttgttaaaatccgggccgatctacacttctgcccattcgaggcaccactacgacctgtatgaatcttcccccttgcgactgttcctgtcgcggacggtgcggacttgacagctcctgtgcttgctggcccaactgttgagctggcgcggtgaacagaatcgagacgggagctgtcccatacttgaggaccccccgcgttccccctcaaccgcctcaacaaatctcaggaaggatctgcgtgctaaaagtcttttcttttccagaagttggaccgatcctggccccaaggttgagatttggtttcggacaatcgactatcagagagctgattttctgctcgtggctggttgagcgataccccagtacagccgtcaccccaaatacgcaggacttcgccccgcagccgcgccatcttctttgacgcgcatgcggcgttcttgtcctctactccccaagagttccgtttatgtttaccttcaatctgcgcgaaaggagtcagcccaggacgctgtagaacatcaggaactctgagtggaaagcagcagctagttaaccatcttcctaggccgttcacgtcgattccgcgcccgcgacaaacgggaaatcgctgtggtctttttgagctgcttccgacagtaggttttccgctctacagaaa

SEQ ID NO: 2382 - DNA, 2587 bp, Toxoplasma gondii
gaaacaaaagggcgagagaaaactgtgacatgcgtccagcctgtgtgcaggtgttgggtttcacgtgcacagacatttaccctggcagtcaatgcagttatgacggtcgcgtggttccgttttggagccgttgaacgaggtatacttttccacggaggatcgttcagcttctctccgtatacatattgtatacatgtctatatatgaagatacactccctttctatgtatctctctgaacatgcatgcttctgtccatatggaagtgcaacggaagtcggcatccacgacaattgctccgactccagatgtgggcttgaatcgcccggcctatgcgattcaacgaaggctcttcacgacacgagaagtatcacggttcacaaacgagaagctctcgcgtagtaccaacgaagtaaatattcgacaaatccaaggatcctcttgattccacgcacaccaagtcctccagtcaacccgtccctacgttcacctttccttctcttttcctgcgaagggcatgcgacaccagaaaacaacggtagctcgattccctgatacgctttgtaaataggcgattgtggcgctttgagatcatgctatcggcgaaaaggaaagtgcttttcacagggaagggatgcttagtcactcttctactgacaggtggacgcaacggaaaacacctgcaggcaaagaacttgataacaacttgatgatctcttatcattcccggaggtccacagagctagcactgttgtggacaagctttccacatatcaccgcattcactttggtatgacggaagccacagacttttcacgggaccttagaaactcgacgcgagccttctagtggcttttgctggcaccctgaaagccgctgtgccacggggaaggtgagataagacgaatcaaagcattctgtgttcctccttcgccctcagacgcccgacaggaagaacgcttaccttccctcaagtgccaccgaaattggcacgcattcctttacgtgtgtactaagagaaagtgtctcatcggaagaaagaagtctccctctgcagtcagtgaaagcctctttctgtggagagaaaacgtgtgattcttctacgagaaccagatgacacaagatatttctccgggcaccggcgacgcctccaacacgcagccttgtcgaaacggggcaagtgggtacatgtcttttctctgttctctccgccaaggaaaagggtaagcttcacgatgtcttggctacacacagaaccctgttttttcatcggcggcgagcagcgcttctgtgaaaacgaggccccgacttttctcgcaagaaagctgttcgcgaaaatgcgcccgcgactggaaccctagcattccccgcccgagcccacactggaagaggttcccgcgtctacggcaagaaaagccttcaatcggcttttgttagagctcaaaacaccttctttttcttggatatttcccctgtccaaattccccttcgatgcttcttgtcctagacgctcgttccgtcctctgtgtggttctgccggcacgtaggtctctgtctcttccccgcagttctgccgtctctctcaaggcctgtgttgtctgttcgtttgtgtccctttcttctcgagttctccaccagactaagaagggaattcccagcacaacgtggcagaagggcctttttctccgaagagaaaacgcaagcccttacattcgctcatcctagacttgccgttttaggacttgttcgtggataagtaacgtttttcctcattgttttccgcggaatcacttcaggtttccacgtttcctctttttctagctactcaatcgctttaaaaagcagcgggagtgtcctcaaatgcgcctcggtgtcccgggaaccccacaggcccccatcaaacgggtgggtatccacaggttcgttacggtctgtttgattcgtttttctccctccttttttctctccgttttcatccgctctttcgtttcccgttcctgactctccgaggcagcaggcttcttcgttgagtttcctaagccagtgccttgcggggttcgtcggtgcgcagtgtactcctgtgagacttacgtggcactcttgtgccgcattcacgggcatgcctcaacacacggtgtcagtttccttcatgctagagctcgcgggcatagagcgcatgttttcagctttgcaggtgttgtctcatttccacagttcgaagtcgctcttccaaccgcggttcgtgtctttccattccggggacctgaaatacttgcaggcaaatctttgcgaagcgtcttgcaacgcaggtgcatggacgtatgctcgcctttagatgaagtctggtttctccgtgtctctttggcatagaggcttcaggaagcgtattttcttctccgggctgcgcagctctcgactccgtcgctcccttctcccttgttgtcgctccatctgtctccacaaaaggatgaactaaaaccggactgtgaactgctggccgctgacttgcgagctcgcggctcacgcatctgcggcgtgaccgaaccccgcagaagtcgccgaatccttcttttgttcaaacgaggaaa

SEQ ID NO: 2383 - DNA, 2260 bp, Toxoplasma gondii
gatagagcaacttgttcttgcacagcgtcgagatcacgtcgcgaatcgagtgccgcttcaaggccgcaatcgactcgacgagaggaaaggggacgaactcgtggttcttgtgacccatctcgaccgccgtcaggatgcgaaactcctccttcgtcatgtaacgcagcacctccggatccagcttcatcttggcagcgagaaggggaaaaagaaaggaactagacgcgcccgcgggcgtggagagacccggatgcgaggcaaaacacgctgcgcaggtctcgcgaaaaacagaccggtaaaggaaggcacaccgagcgcggccgcagggaggcgaatgcggcagaaggaacacaggggaaacgggaactccacaggagagacagagagagctggagaccacgacgccgaggaagggaagtgcgaaagaaagggagacacgtaactcgggagcaagtgaagaaacggaaagaaacagcaggagagagtgagaagaccactacagagggtaaccacactgcctgcccacgatgcagacgaaagcgtttccgcctccgcgacacggacagaggttcgttttatgccgatgaaagggaaacagaacgagtgcaggggaccaaagcaagggagaagaggaagaggaaaacaatttgtgctctcgccaagactctgctgaggtctgagagacttggctgcagaggtagatgtaaggaacagggagtgacctaaaaaagtctcgcgaccaccggagaaggattcgaggatgggtcggcaactctctcaggctgtacagatatcatgagagtcactttggtagcacttgtgcatcgattggaaggaaaaatggcataaactctgcaggagggaaggggtatgggtcggagtaagagaacggacaatgttcccccaacacgaccatcgactcttcacggtaagtggcagccaggaactgaaaaaagacccgggacgagaaagtgcccgagagaaaatacatggaaggtctaatcgctttcatttatcacgctccgacctagcaacgcagactgccgcataccccacagagacgtatttcgcctctcgccgggaaggcgaagtgaacgcagcggaatcggggacgttcttgtcaaatcaggagttctaacaaagctaactacacgaaaacggaagaacgacgatgagagatattgggcaaagagagggtcgcgtccccagctaggccgtaatcgccacggtgtgcgggcgagggtcgcaccgaagggcgttagccagcggaaaactgcgaaattgtgatgaaatgtaccgttagcaaaacgggaggaaacatgtttggcagcttttttttaaaatgagaccaacgtcgcgcatgcaggtccaccgtgtagacgtctcgacgcatgcggaaggcttcgagcatctgacggggtctgtgaacatcgcgagactctggccagatacaagtcggttccctttgttaaacatactcgaggcaaacggacaggatgtctcagtagcgacatcgtactgcgtagcaagtctattccaaggccattcccaacattgtggcaagagtgaaattttggaaacctgacagctttctgcgcaggtctccgtgtcggggtcggaccgcgccgcgcgcactctctcattgcgatgcctgaacctcacgcgttcttgccactgcctggctgcaacaaaagggtaggcttgtctccttcgagctgctagtggccccacccctgcccttgcacgaatgcgtttgagtcgcgacgctgtcgacatgcagtggcggggtgcaaagctgcactgagacacgcgtgacgggcggcagtcgactggaacggacgccaccgtgtctcgactctgcctgcagtccggccatgtctgctttgttcttgcaatctcccagcacaaaggtcgagcgtgccgacagaaagacaaaacggttgttaggcaccgcgaggggagggtgtgcggagggagacatgggatttcgattgcgtcagcatcgacccccacggtgcgaatgcatggattgtttcttgttcgtttcgagggtgcatcggcggaaataattcgactgccgcgacacgcagggtgcgtacaatagcggcgctttgtgtctcgtgtatatggacaccccgcctcttgctgccgcagccatggcaacagtttcgtttcggcggccgtggacgagttcagggaacctgcaccgaagagcttttgcttggtagagcgaccgcatgtccccgtactctgacaaaaa

SEQ ID NO: 2384 - DNA, 2192 bp, Toxoplasma gondii
ttgaaatgtgtggttccagaactaaggaagacgacaccgagagagccctacttccttcgccgcccctccggtgctgcggagggcattgtacacgtctatgacaatattaaaaacaagctgagcgacaagctggggcctcacagcgacgcaatcaggaatctatacgaccaacacaacgaggatgaggcattatatgaagactacaaagaagcatagacggcgggctactgatgcaaaacagttctactggtggttcgggacgaaatgcttgcagttctctgataagcggcggtttctgtgatgcagccaaatagtgttccgctcgtacaggcatatgtttccacagccattgttacgtgaatggttcatgatcatgtattttactggctgaacactctatggccaagaacatgtgtgtttttccatacgcctccgactggaaattcagaatgaatttttgctattgctagctcgcctgacactcgggtcatgcgaaacgcagcaggcgcttcgccgttttggtcttcgggcttgcatgccatctgaaaacgaccctcgaccggctaagcggcggattccgactgcaacggatacacaggtagttttcgcatgaacgaagacgtcagtaacagaaatatcagcaataaacggaacatacggaggggcatgcttctcgggagtatacacgctccacatcgctcgtagatttcttacgcagaccataaggctccgtatcactggtgagaaacagaaaactcgtgcggacctagggaaaccctccaatcatgcacagaatgtaacatatacggtcgaacaactagtatgttccagtatacctgcacattataacgcctcgcataatcagtcaactaacgatgtagcaacgtactcgataaatttgcgtcttgcagagagcactttctcacgaactttccccaaaacctgcaaggaccctacggggttagcagtctgatagcgacgtgtggtgacccctaccagggcgtacactgggatttctctccgtggacggatgaaaatatgttgacctccttgggggctccactcaactaacaatcgggcattttccattgccgcgctgggattacattgtgtatctctcttttagggagggcagtaaattactcaagataaaaagaaactgcgggacgtagcgtcgtcaaatatcaaaataatttctcctgtccccacggctgcgatatgaaacgctggccagcagctagggctagcggccatgccgcgtaaagtcaccccagacgacgggggggaggaggggggaggtatgggctttcggtaataagccggtttcgacaaaataggagatacgggactaccaaaaacagcgtcctagtctgtgctttagagaatgtgtagaggaaggcgccactcgcgtccctctcactttgtcttctctctccattccctctttcttcgtgtaggagggtgcatttctgatcccgtgctccccgtgcgaagtggctcctcgacttccggcaaccggttgggattccgtacacattagcgtggttgctcttcagtgaaagtcctcttctgactgcctgctccgtcccccccgtagacgaaagtgtcccagtaaatggtagatgggagagctccctattcacgcctggcggaaaagacgcacaacaaaatctgtttgctgtctcccctcaatctgttcgccaacggtgtcacggccctccaccgttccgccccgagacgtccagttgttcaactggaaaaccgagcgatgcgccactctattatcccgtttataaagcactgtctcttttgcataggggatgtgctgtcagagtcggtaccctgtcctccgcactattgtttcgtcctctgtttgtttctttctataccactcacggcacctgtcctagggcatgcacacggcaacgttcctcaatcattgagggtccgtgtgtacacagtctttttcggggcggctcttccgcagttttgctggagtcccctgcttcacgtctttacctgtgactgaccgcacttcctcgacaacattgttgtgcgccaccgaatttttttcttcagaagataaaggagctgttcgagccaccatctcgtgttctgtccccatcgtcactgatttccttgctgtcttgctacgtgtattcggtgccctgtaatccgtcaggtatcctcaa

SEQ ID NO: 2385 - DNA, 2507 bp, Toxoplasma gondii
gatccagcagacgaagatggcgtcggtctcaacaacagaggaccgcgcagtggaccgtcggagaacgacgaagcagaggggagcagaggggagaagaggggagaagaggagagaagaggggagaagaggagagaagaggggagaagaggagagaagaggggagaagaggagagaagagggcgaggcgactttgaagagcctcgagtagcaagaaaaacggccgcgtcgcacgcatcactcgccgctcccgagcgccagagggaggctgctgcgcagcgcaaagagcgaaccattcgcttcaaaagaaaaaacagtctctcgctgtttggaaagacagaactcacaggacgaagtgccaagtcagtgtgtcgttcatatccggctgtaactgcgcatgcggcacgccgccctgcctctgcaaaagcgaaaactcgcgcgcaaggcggccgggaccgaggaaggcgcctcggcctcctcccttgtcgcgggacatcgaacagacgcttggagaaacgcagcaaccgagaggagcggagaagaatgcgcgaacaggtcgacagagagcgaagcgggggaacagagaggagaacgcacgaaggaaagaagaagacgtggagacgaagcgaagcggagacaagggagacaacgagagagcagagcacaggggttgcctctgaaagacttgaagcgactgagaggtagctgggcgagcagccactgtcgacaaggagagcagaggcgacgggagctacgaggaagaacaagacgaagacgcggtcagaagagactggtgtctcgcggcaatgctcgatggaggagaagcagcgtgacggaactgctgtgagttacggaaatcgagttctttccgctgcgtcaagcagtccatcgggatggccttttgaacagcagttgccctttctttccttcgcgcgctcgggacatgcagaaggttcgacagtgagtggggggcgggagagaggatccgcagagtgacacccgaagaagtcacgcgagacgccgcaggtccggaagtcgccgagacgagtgcgaaaccagcgggccgtgcagctcgcgcgacggaagcgacggagggaagggggaaaagaggagcagaaaaggaggagtggaacgggaggcgtcttcgccgctactgtgttctctgcggggcctcgcgctgtggtgttccgctcgaaaggacaacagagagtgaacatcccgcgagagagggctggagagagtgtgcggcacagacagtgtctgtttttcgcggaaagccgacagaagagacgcgaggatggtcttcgactgcgtccgtaaaaagagagcggaggaggagcccgttctggtgagctcagctggggctcttttccctctcgctgcccgctgtgtctccctaacacgactactacgactacgctgttccttcgcttttctcccgcaagacacgaccagtcgcgagagccgcaagaccgcgcgcgcgagagaggaaaccgcggcgagggaggcaccgcagaagcgaaggagttctctctgggaccccagagaaacgacatccaaggcaagagctttgtctgggggaccggcggaaaacgacacaaacgacgcatgctggcgcgcgcgagcgtcgagccgtctcgggggtgtacgtacagccgagggcgggcgtcaagatcgcggcttttccacgagtctgcggaaaccgcgcggaagacggaaaaatgtgcagtccagaccgcgattcgcgtgcgacagagggcggaaaaagtgacgaagaaacgagtaagcgtcgtttcgcaacagtacggcgaccgcgcggccccttccagtctgagacgacccacacacgcctcgtcgccgctgcccgcgttctcaagcgagctgcgagccggctccccagtcttggccttttcaggctacctctccgctctgttcccggtggcgattgttgcaaccgatctgctcaattcggagtctcctttcaggatctgcgtcctcgttctccagaactcagccaaaagccggaagagtcccccccctccttcacccgccgcccgggtatcaaacgcccgagctcccagtcgaactcgccgcgacgcctgagtccgcgaccagaggtgtgctgcagcgagcgacgccctcagtctcagtccaattcgcgtttctcctgaatttgttttcgttttcgcgtcttcgtgtgtgtctttcgttcctgagaaatgcgtccggcttcccgcattcgcagtgagaggcggtgcgccgctctacgtcgaatgtaggaacgacgcggagcacagagacgagaaaactcaccgtcgtgccagatctctgcgcccggggaggtggaggcggacggagttgctagaaaggaatacggttctcgtcggtgtcagttggccggagaggagctgcgccgtcgcttcctcgcttcgtccccgcgcctcctgcctctctgccccgacttttttctaagacgcttggccgacggccgccgcgcttttcaggagcca

SEQ ID NO: 2386 - DNA, 2993 bp, Toxoplasma gondii
tgaagaagatcaaagagccgttgtcttttgggtgccgtgctttgcgccggttcttagaggcacttttgccactcgcatccacgcctcttgtcgcaacctcggtggatatgcttcgatctttgctgtcccgaatgcaaacacagttccgctatttgaaggccgcagcggccggcaagcgggcaagaggccggaaacaacctaggattttctttggattttgtgttttccgagtactaacctatcaccccagtgccgtggtgcgatggcagggaccaccgttgttcgtcatggagaaatgtgacgtcaccacatttcaaatgtaaaagcacagagcgcagtgttccaccgtcagaaaaacacggaatacgtccgggttcgccccgccggtgggtgggtccatcatttctttctgcgttcgtgccttacgtcggcacgtgtgtgtgccagccacttttggtcaagtggcagccaagagctgtttcctgcagcggtagaagacaagaaaatgcagtcgtttattcgacgaatcagcctgtgacattgtatctgttttcgaacgactccccagagtgggtacggattacctacggtagtgtggccgcaagtcctatgtccgtattaagaggagtaacacaaccagaacaagaagtattaatatcccggtggatattgtgggtgcgacggctcacggacatccgccaatgtgtgtgctctgtgccacctgtatcaccacaaccgttgtcggccaggtggcaaacagatcccaatttaatgctggggtgcgaaaaacttagcaggtgctgtgttttccgctagcttaggctccccagcaaaattagagcattactagtaaaagcatctagtcagttcagaagacgcaacagagcattgcccagtgagagtcgacacggtttttagtggactctcgtatcagataacggcgcgagaaaactttttttccccctggtttgtgtgtccgcggcagagaagtgtactgggcgcctgtctacagaaagagaaaggttcgctgtcggaccctgagaagaatggagcagattgcttccgttcatcttcaagtcgactcaaatgagtgtagtccgagcctgctacggattttgaaggagctcattcagttaatagagatggcttctgtgtactgagaccacccgtgatgagcgcagtgtagcagcgagcactgttattggcaggaaaagacgaatctaacagaaatgacagaaataatttgaggtagttgacattcgcggcacatcggaacaccagtgttgccattttctggcgtgcttatgcgggctgaccttgtcgaggagacctttggtgttgctgcgttaactacactggcggaccgaggccagtgaactagcataatcaacacatgggcatgaaatactataaaacagagtcatacatacctagaagcatagacgcgtacggccgctacatcgaatgctgaagttgtgaacgtgtgagggagaaatataagggcgccagctagtgctgcagagtatttcggcaaaacgatgtttgttctgttctaatggtaagccgccggaccttcaggtaccatctttgaggagatacgcatgatatagggatgactgcagttctttcattccacaaggagcaagggagatctcccgctgtccgcgtccttcgaagatgaaaataaccaaaacggattctcgaggctgaaccaccgtgtcggtaaacagagtcgtgttgcgatggtttctggcgagctctacagcagcccaccgtctgctgcatagtaacgccaatcctatatattgcagcgtcaacgaggatgtcctccaggcgaatagctcctctaaagacgtttgtgccaaactatcaagcggggaaaacagtggattcgtgtagattcctttgtgccttgacccaagcacggaacacaggaaagtgagaatctgaaaaatctgtaccgctggaagctgtataggtgaacttgtgaaattacgagaagggaaaaaacgcacctgtggcgtgcgaagaggaaatgaccgacttctgagcgtttgtggtctagtggtagaatacctcgttgccatcgaggtgacccgggttcgattcccggcaaacgcacgttctcacatgcttcttatttcacccgtgatagttcgaacctttgttgaaagaacaacggcaccggcaccagaacatgcttcaagcaaaagttttcggctgggaaacaagaaacatgcggtccccaaaagcggaaattcgaacagtgcgagcgtttgtggtctagtggtagaatacctcgttgccatcgaggtgacccgggttcgattcccggcaaacgcacttttcttatccagcgcttcgaaatcacacaggatacttgtacccgttgttgaaagcacaacagcaccgtcgccagaatatgattcaagcatgttttcgacagagaaacaagcaaagtgtggtcccgaaaaacgggattgtcaacgctgtcaagcgtttgtggtctagtggtagaatacctcgttgccatcgaggtgacccgggttcgattcccggcaaacgcacttttcttccttatcagcccttaagaatcacccaggatactccgaatcattgttgaaagagaaacggtagctcttgtttgcgtgaacccgtgaatttccgaccactggtggaagagagacgaccccttatcctggaaaggtcatttagggagttttcctcaagggaaacacgcagcctgttgtcccttagagtggcatcgaattctgcaaggtagcgtttgtggtatagaggaatacctcgtttccaacgaggtgatcggagttcggctcccagcatgctccctttcgtgccgtttgtatcaacaggtcaacgacaaacattctccggaatatcctcgtatctgcagcctcaagaaatcagggtcctttacaaaaataggaaaagaaggatgtgggctcacaaaaacgaatgttgttgccatcaag

SEQ ID NO: 2387 - DNA, 882 bp, Toxoplasma gondii
gcaagagagccgcactgtgcactccaagaaaagactaaaagaagaaagagagctagtgtcaaccagagaggcggcgacgagagcccttgaggcagaaacctcgactgaaaaataaaaaggaatgttttacaaatacgtatatatatatatatatatatatatataggtggatagagagaaaaagaagagaaggaaatgatgtttctctgaggcagagagattcgtacctccttctcggctcgctgttcgtcatcttcgcctcccgattcagtttctgtcttcgtcttcctcaaagacgagaaagcatgagaaggaaaacgaggagagaaaaaggacgcaaaaagagagagcgaagacgaagggggagaagacgaaggaggcgaagaagaggacagagaaaaggaaggaagagaagaggaaggacgaggaggagaagcaagaatagaagaagaaggaagagaaccgcgcgaaggagagaaaaaagaagagaaagagggaagaggacttgcggcagagacaggcggcgacaaaggaaagagagaggaagagggtggaacgaaacgtttgtgtgcgtctctcgtcagagaggagagacggcgggcagaggctgccatggcaaggaaagaaacagaggcaccaagagagctgaaaaaataatgaaaacggagagacagcggagaacgggagagcaggagagagaaaaacttgaagaatgagcgcgagatgaaccgaagagagaggcagagacaccgaagaaggaatgacaggagaaaagggggagaagaaagaaagggagaaagagaaggaatgaagagtctgtgttgtgtcaaacgcaaaaagaggatcgaggcagacgaggcgagttgaatcgctgcggttgca

SEQ ID NO: 2388 - DNA, 1352 bp, Toxoplasma gondii
tgatagtgtagataggtggatccctgtcggcctttaccagtctacagtgctgcatctacgtttagccatgcatacatatactgtatgtattgcgtcctatgcagatgagtgaagcgaagtggcctgctggctacgtatatccggggagcacttgaaaccgggcaaggggaaaagggggggcgggcgggaggaaggtgggggttgagtttgagcctgcttctctgtcagttacagtttctgtttttgtcttctgtacgctgcgtcgaacctctttgtgctctcacaagggtgtatggaacagtacttctacacgacgtggactcatttccgctgatctcgcgttcatgcagttagctcctcattttttcaagcaaacaacttgccgatgagatgggcaaggaagcccattcagcaaaacttctgtatttgtacgtgaaaaaaagagatggtgcttcattcatttttgcacctcagttgcggcagtgcctcaggctgtggaagaagtcatgtaagccaccgcgccaggggtgcagatggtaaccgtttttggcccgccgccaacaggctgtcttctaaggctttcttaaattacggaacaccagaaatgagacggttgcaggtgacaccttcatttcttttcaaagaatgcggaaacggagggagtcagttcaataggttcaatcactttttgtgcaaaacggccatgttggcagatgacaaaaaatgatattggccgacgacgaagttagaaaccaacaagtgcattagtaagacgaattggggagacagcgcgcattccatccactccgcactgccgcggcatcgcccgcagttaatgaaaaaggtgtgaaagcaagctttgctcaagtatggtcttcgagcacgcatacattgttccttttccgttgcttccctcttttcatttggtgtgatattttagacgtttgagacgccaacacacgggacacgtggtacggtttcgcgcacaaaatgtgtgtacgaattctgttgatcgcgctcattcgttagaaacattgactggttcagtgataccagtattgccacatgagtataatggtgtctgcagggatatggaagcgatttaagatacagtagaaaaagtggagaaagtgcaaggaagggggtcttgcgaccatctgcacggcgaagcagcaaggccagtttgccacgtcactatgagtaaccagtacccattatgacttactgactctcagggcggcccgattagtccttggaatagtttcaggattgaaatgcagtcttaagctcacagtgtactaaagcattacgtgcgcgatacaccgacggaaatcttttagttctcggccttc

SEQ ID NO: 2389 - DNA, 1786 bp, Toxoplasma gondii
gttgtgtgaaggttgcttgttgggtttcaggcggtgaatggatatcaactatgatgtcgagtcgtgggggtggattggacctactttggtctatgcttttgtagtggtgtttgtcgctctccaggcgtatgcatggttcggttttttggtttttccacgagttaccaaatgaccgcatgcgtccgcgtgtgtgccctgctttctatttgcttcctgatccactttgggagttgcagagacaacggcaaagatcctctcttgtgtgtataccgcgatgcaggacgcgccaggttttctgtgccactgttttgtcgttaactgttttggtcacctattcactttagcgcgaggatgagaatgtcagtggctcaatcagcttgttttcattatatcacattgatgttgttttcgttttcacccaagagaaatgcgtctgaatgccgtgtattactctctgccgcagcgcagaggccggcattagatgcagattttgcttttgctgataggttgagtgggtttttttttggagctgctatggctggtgtgcttcgagtgtcccgacgtatgatttcgctggtgtgcttttagatttttttttgcgatagttatgtttctttacaacatctccggcgattcaaccagcactggggggaatcgggggggcgtttgattgtcaatttagacagtctttacctgcgcacttgaccctcgtttgaggcgcatcttcgtggggcgtaccccatgtggctacgggagaatttgtagtgctggatggttttttttttcatatgtaggggtattttatctcgatgaacccaaccacatatgtgtccttcgatggcatatcaactagcacttcgttccggtactggagggattccttctagtcatgctacacgagaaaaaccagctaaaagcaatcgtgaacaccagtggagcggtgacgctctgtactctatttcgaccgagggtagcaccaccactcagcagcgcctcggacgacgaaaggaatgttttgaaaagttgaaacagtaatgatgacgttcataccagactacacggttgacaagtgtcacatttcgactcacggtgtagtagacgtttgcaaaacaggacgcacaagcctccctataagctgaattagggtcgaatgcgatggggttacacgtgccaacatcgttcccctggttcacccagtacaaagagacgaaatgcactctcggtgaactgctggttagttttggaacttacgaaccatgaaatgtcctaacgccagcactttctcttaccttgtttccagctgagctaggtagcacgcaaggtgcctcgggcaccaccattggtacgcgtggaggtcacttggtgacgcagaaaacgagttgccgttgtctcgcgtgcgtctaccggtaaatcagaccaagtcccacaccggtgttgcgtcgtcgtttttatcctagggaaggaaaacattcgtcacgcactaatccctcaaacgaaggtctttctgtgcgagcaggcatgttgccgctgcagaaaattggttgcaattgaattcttcagctgcactgcggcagcgtggtgcttcgtcgctttttttgggctacttgcgcaccaaccctggtcacacggactccgaccgatcatagtggtgcgcgacctgcgcgaggggtgccagaaggcatttcgtctcgatacgatcgggaaatgtggtgcactacacatacggcctttggaagagtccaacgggtattgaagccgccattgacacgcctgtgtccatgacaca

SEQ ID NO: 2390 - DNA, 2373 bp, Toxoplasma gondii
cgaaatcgagcagcgacctacagaaacctttcgttgcgtgcgactcgtcgccagagagtgccgtcgagacggagagcaggtgcgttctttgtgcgttttttctaccagactctggtgaagacgacagaagcacagttttttgtccgaaaaggaaaacctttgccaaggcgcgtggatgctggattctcgaaacagacgctcgactccccgccataacacctggagctctcagcatggcggccgtgaaaagggcaaacgaaagcgattccccgattgcacaggcctgagacggaaaccagttgattcgcgccagacaagcttttcctgctcttccaagactctttcttttccgtttgtcttcgtcgtcctttctgcggacgcaaacctggaggagagacgttttagaaggaagtctctgaccggtgttgtctctgaatcttcgtggagttccccggggccagttgcactgcgtccacgtcagagagcgagctaataacgacgcgtttgcgagaacctccgagagacttctgagtccttctttttacacataatacacgcgttcaaacacgaagaaggaaacgcattcaactgcaatgctctcaaagtgtcgcgtgcgtcatatgagacgttttctccggggtatcaggcgcaacagagtcctttcgtttttcttaagacgcttgtcgcactctctgcctcgcgacccgttgcagccatctaactgggaagtgtgccgtggtctccgtgacttttctgtcttggaaaaaaaacaagttcagatctccactgttccggtgcagtactgcgactacgaatcacatccacgacggagagcttgtccctgcgccttctgttcgtccaccgccagacagcagatggaggaaaagcgtctttcaaggctgcggcagccagggtgtctggactgtcacgaggatctgcgactttccagaaactgggcggctctcaagaagctccggcattttctacacacatgtcttgcctgtggacgcctgcagctgtgcagctgagcagttctggaacccagaggctcgacagagctgctgcaggctttcgctcggacaagagcttgccgctgcagttcgcagagacgcagcgacagggaagagttccactgggtgtagaagagcttcgtgatgaactctgacaccagggcagatgcgagacatcgtttttccgagagaagccgttctcgcgagtgtgatggtagtccatgcactgcatgcattttgcctgcactgcacagagccaaacacaaactcgtgagcggtgtgaaacagctcgtcgaaagccgagctttgagggcaggacgtgtatatggcggtcagtccaaacccgcaagttactgcgtctgctcgagcgtggagtgacgcgagtgtttatggcgtcgagaacgtgattaatggggagtcgcttttatttttaagtggagctttgcttcggttcctgcgaatgccagagaaatacttcaggtttgaaccttttccaaacgttttctgcgctttcccgcgagcaacccatgccgcgcgcatgtgcgagaatgggatggactcaaactgttgcatgcaacgaagtcccgcgacagatgtctctcaagagcgacgcgttttctctccgcaggcgaccttgtttttcttctcttcgatctacaaacgcggaatccttttcttccttcgtctttcctcgatttctcatcgctcctgtagtcgaccactgccgctgacttgcgctgggtgtgggcctcgcgactcgcgcgactttttgcggccgagacttcttttcctccttcgtttttattttctcgcgccttggcttcaagaaatctaaccgcttcgcctctcctttcgaacggttctttcctctggcagccaaggcgctcgcttttgtcttctctgcctcctctgtcttctctgctttctctgtgcatgcatagacctcatcgctgggtgtctctcacgcttgcgaaggagagctgtgttgcctcgttcttcctcccgcttctccctctcttctccccaacctgcgccagtcggttgtttgaacttcttgctctttctccgcgtcctctgtgcatcgcgctgcgccgtccgaggtctcgtcggagagaaccgccgagacctcagacgaggctacgaagtcgtcgtcttcagtctgcggagggagttccttcttcttcttcgctctcgcgtcggtctgcgtccaattcttcgtccatgctgccgccgcctctccctcaacagtcgaacctcgaccgcgaaagccgagcctctctcaccagctgacaagcacagcgactcgtttcctgcgcggtcaaatccggagagaaaaccggagagaaaatcgccgcgacaccca

SEQ ID NO: 2391 - DNA, 2351 bp, Toxoplasma gondii
ggtacctcaggattatggcctaatactagcgattgctcgccaagaacaatagctacagaatgccgctgtctcaaagctgtgttaaacattctgctggtcctttagtttgtatgactacacaggcgcagtggctgatgtaccctattaatgccgttattacatgccagtcctaagaaaaactttaagcccttgatccatgtttactatgtaattctgcttcaggaagagccagtttgggttccagtgttgctcggatgtcttgggccttagagctactgatttccaggcgattttactcctcatgaggtatatataattcgccagtggtagcgaactcgcgtccagcaacttgtgttaaatgatggttcgaatgaccttcacagaagtttatgctggccgtcgtcctcaacacgtctattcctctccatttaacatgtgctgagctactgtatcgaaacagaactattcgtgcctagagcagctcgcttcgacttaccttcaatgttttaaggcctaatattcaataaagaaactctccgtggtaaaccaccagtcgccaacgaaggcctaggagtcggagacatcgactgtaatccttcattcgaccctgtcgttagtttgcggatcaggaccttcttttcaatgtacttagttcacatttgcttccgccagtggccttcctggcaacacgaccgggcgtccgaatgtggtgtgttcattgtcgctagtgtgtgaaagaccgaccatagatcttgcttgccctcgaagccctcagcggcttttggcagagatcttactgtgtgcaacgtggtccggatttggctatgggcaataactttcgatatctatccggataaattttacctgcgatggttcatgcgcataaatcgtatcaccgtggtcctgcattgttctacgcctttgaattgcacttttttcctttgaaggggacagggcgatcaatgcctaggactgaaatattgtggaaagtagtgacatatagaacaggtttcaatacggggatggaattagccagacaggaggggcgtccccacaaggcgttagaaaaacgcggcaggccaggcgggggcttcaccagggtgacaagtgttttcatgagccggcaaattaggcaacctctcttcaaaaaagtcccaaccatgtagtgtggcgtcaatgcagttgaacctgcgggtgcatgtgttaccttcgtccagccgctcctttgtaggcggacacggtacgatgacccactcttgaacacagagacgcacaggtctttgaaacacagtcccaacctacggcgcactgtgaaaccttttctgccgcctgattttgaacgactttgcttcctggtgtacagcgcttctaaagcatgccattctacgtcgtctcatgctgttcttcggtgcttgagatcgtcagtgtatcatgcagaaccgatgtcttagtaaacatacatctcgaacacttgcacgtcatttcatttttcacaaactgtgtctcatgcgtgatgggcaaatgctgcttgaaatcacatccgagtacagtcccttctgccagtaaagtgcacatttgcgcctatgtggtatgcctcctctattgcaatcagtgcactgtctgcaaccatacagcaaacaaaaagaatatgccatcaggcaacgcgtcatgctactgaacccgaggagtcgacaaatgttgtatcggcgtgtactctgaagacgggttgagcattttcgtatacaaccacgtgcagtgtattaccgttcctagtaggcgtcgagtgattgacgaaaatgaccacgaggtaaaacattggcgtcgcagcggtggcagggtgtaacgctgtaccatacaccattgtcagtagttgcataaattgttggcatagaaaaaacgacgtacctgaccttgcagaaaacctagtctctgtaggcggttggaactgcgcgtacgatagggtcaaagctgccgagatcgctgcatgccgtatgccgcatgccgatgtctcgatactaactacacctgggctacacacatgagggataagagttaccgcttagatgacacacgaatgaaagggactacattttttaacggttgacgttttggaaaagcaaatttgttattgtttgtaaatgggtcgtgtccgatggtttattgggcggcagatgtgtgtctactacggcgtgactgtacgatgtctctcttcacgtcaaccccgttccatgcggtcgtcatgtagtggtgcaagagatgaagcctctctgaaaaacactgtaggtggtcatattgatgtcatgcacaaaaagtttcagagcttctggaatggcggcgtgtgtctggcaata

SEQ ID NO: 2392 - DNA, 2492 bp, Toxoplasma gondii
tcagtgtggaggaagccatgacgacagcaccgtatcttctgttctaccaggttgcctcacctgctgtctgttgatcttggccatgtgtcacacgcctgtcttttctgaagagcgttagcaaatggcttattgtctgacgattacctgccatagtactaatttggaaacgggctctcgccatttttataacgggatggctgtgaacctccgtgagaccgataaacgaacacagaatatgtttctgcgttgtttccccagcccgttggtttgacggatctcggtccccggcccgctgtgtttttcaacgaaaactcagaaaggagcccaccaattgcgtgatactctattgtcgttgagcaaacgaagatcccgagttgaaattgcctcacagcagcaacacaaccttgccccaagtatcgcatgagtgtttccgacattcggttacgttgacagactattttctgacgaaacaatcgctggcctccagatggttcggatcaattgaacagccgttttcaataggtaatgttctcttcggtttggtaacgtgagaagctgtccgcaaaaatgaggcgtccagataagcactcgtctacactggcatactcaattcttgtgccacaggtagtagagagttacaagagttatcgcttttggcgaggtgcaggcgtatgaaggatgaccatcaacggactcaaactcccatgagttgcacgctgatctttttctcaagacaaactagacggctcccttcacggaatctgataggctgccttccctgtcatgactttgccgaggttactggacacgcgttgtatctgcagtgctttctgtgagtatgtggtgggtagatagggagtcgcacagttcgtgcctacaaagaggtgatttggtgcagtttcttgcttggattgcaagtgaagaatgactcctgttccgtgactggcggatgttcctgtacgagaccgtctaaagaactgcgtgctggaacggcgaaccctctacagtggaggccaggttatctcagtacactgcggcacgcgtgatgagtgcccgatgcaggccgtgcgaattgccaagagcacccttcgaaggttatgatgttctgctgcaggtgtcgtccgtcatgtagacaggttgaattgccgggggctcactgaatacaacgctatgctaccgattgaaacagtacgagctgcaaacaaatgactcaacctcaagcagaccacgttcttctaaggatcagttgaaagcacagccgttccaggaggatacgtttcccgacgaccacacttgtagagaagaccctgttttcgtgaaaccgaactgccacgagtctgttggagcagcggcgacaggagatcatcttctggcgttcgattgccctgattatggtcgatacggaagaaggtaatagaatacaggattcctgtgtcccacctggtagctgcgacaaaaccgtatccggtcctgtgcccgctcctgtcccttccgccgcccctccataataagacgacgagagactagccgccgtgtacacctacgagatgggaatttacaaccccctcgaatcatcaccgcgagaaaaccccacagttgcttcttggcagattctgccagttgatctctttttgattttccctgtaggggctacacaagttcccaccttttgcacttgcaacccgtgtgctcgtcgcgagaggagactgaccctcctcgcatgcacgcatgccacatggaggctcacggaatagtagagcagtcagtcggctgtgcagctgtccccctcagtcggcaactccatgcgacttaacccgcttacgaatcagcaaactgtcgccaagaaatcctcgtttttggcgttcatgctgaagcacttttcccgacttttgcctgcgggttcaagggccgcctcccagattcttcgctccaacaggagttgacagggtgctgtgcattgcaagtacacttgggccaccttaccacattgttcgctgctgagagtgtgatctctgtttccttttcttgtgtcgcctctgctgtctccactcgtcaacgaaaaatttctttccacactcggaaccatttgtcgcgtgattgtccgagattccagactctgccatcccctaccccccatcagtttttggctgtcgattctttccgcccctggtaagactctatcgtccctggtagtcgtgctgttccgctgagcgccacttgaggtaggaaaatcactgtctcgccatccgcagctgcgtgctccgccatctacgcggtaactggagtgataattgtgtacagtccgacgccattttgcactaccggcagcccttctatgtttccacctgttcgcccccctgctggatgcaggcgacactcctgacacagttcaggaccagttgaaatcgtacgacgaggttcgacagataggaccaagttttatttgtttctgggcatcagacccacaagaaccttccagttgccgtccacaa

SEQ ID NO: 2393 - DNA, 2250 bp, Toxoplasma gondii
gcagcggcaacttgtggcggaacacacctcccactggttttattcgacaccttttcctttttttagcatgcgatgacaccgggtattagtgtttgcgaccatagtagtgtattcttgaaatacgagtacgcgtgaggttcccggctgtggtgtctgtaaggatggcccgggtgtttcgtttccgcagtagcagtatctctggacactgaatccacgagtgtgaatactagattcgtgtttgtattttcacaactcccaatggtcgagggcatgcgtgcatggccaaatccaccagagatgttccgggttgccggatgcaaatggaagttcgcatgacgacgcagctgaaagggcagggggttgaacaggtcaaagttacacatcgatgtgcccacggtagttttagataaattgagcgctcgcgcaggtgttccgccgccgcaccgatgcagccggaactccaagggaggttctacatttcagtagacgcagaaaaaaaaagtgaagtttctgccgcggctccattagttacagattgttcagtggtcgtggcttcataagtgaatcctatgaggccataagaaagcgcggttcattgtggacgcaccatttctgggcagctgcaaagtgcacctcatagtcagggacgcttctgcgcagcaggtgtgacattcgagctgtacgattgacaaatggctttcgtgaaaacgaacatgccaccactaccactcttgtagtatccgctgcagcaggccatcgattgcttctcgtctgacatgtctagcttcaatgctacaaagagcaccgctgtgtcaaagagtcgcgctaccttcactagaagacatcctgctccccttgagttccctaccagtagacctttgtttatctcactgcggccatcttaccattaatgtagctacatgtggcaaataaacttctgctgagactccggcggcgccacttctcgtcgttctcgccaagctcttgatggtcacctcgacacaaccgacagcttcgcgcaataaatggccttttatgtccagatcgttgtcttcaacagatacttcgcattcgtggatcgacacgcgaatacatcccattgttgtacgtgttttgatgacagcaatcttatgtggagttactgccgcgctgatgtctgagtgaacttgccatatgcaataatgttcgaaggggaagaaataccacgtggcagcgaaacgacactgagacaagatgatacgtgcacagcattcatttttgcttaccctgagggataacgaacgaattccatgtttgtagaagaagttatcatcgtgtgccgttcgttctgttcactctccagaagcggctgtgtgcatgcagtgtcccctgcagacgcggtcgtgctacaactgttaagtttgcgtgtggagcgtctcgttcgacgtgtgtctcttctttgtgcgactggttttcgcagcagcgttttgtctgaaaactttggcaaagtcaacgaatcgaaatctctccagagcgctctcaacgagcaggttccggggactttggaacgcgcgtgtctctccgcactctgtaaaaaagccgtgagccggtgagtttagctggtatctctgtcgagcaggctatttcctcctctttcgtgtggtttcatagggactatgcaggtgaatcccttttccaggagaattttgggtctggaaaaatgccaccttacggggatcccgagaacgaccccgtggtgaggcgttttccccggtcctctccttaccagtcagcgggcctgtcccctgtctcctctgctttacgtcgctgtctctcaagttgccgcgatccttgccatgggaaattacgcggtcgtttcaccagtttttccaatgcctttcacgatgacaggctgaatttgagaggatctgtctcgtgctttctaccctcatcgccacccaaaaacacccaccggcaccggcgaagtatttttcacggctggcgagacgctcgatctcgtcagagtaatgaagtagcctatccccatcagtcgtttgtgtctcgtgaaaggacgagctctgtgtcgcgtttctatacgttgtttttctgccagctactcgttgcggcgtttgcatgttgctgcctgtgcacgagcctttccgtcgaatgctataacctgtcaccgcctgagcctccgaaggatccctctccggtaaaccaacgggaaaacttctcttattcttctagtcaaaatcactcgtctgagaaaaa

SEQ ID NO: 2394 - DNA, 1451 bp, Toxoplasma gondii
tggtgaaactctggtcggccacccattaacttgaaccttcttgggtgcccgccaagcgtcctcatctccttttttgaaagctgttttttaacctggcggcccgtgccgccactggtacttgaggcggaagcaagcgcctttcctttttcagacgcccggaccacgttgctccggatctcgctcaaggcggcctgtgagttcggtgaaagacttgcctcggacgaagaacgcttggcgtctttcacatctggtgtgcttgctgcagtaccagcactaccagtggagaaaaacagacgctggcgaggacgggctgagacgtaactagagcggggaaacgctgaactgaacggcagctgatgggtcgttcccgctgtagcgctctgtattttcaggccgctgtcggctaggcgttgcttcgattccttccatgaaatatttccatcggcgaagttattcgaaacgctcacacttcgctctctcggactgtcagaatgtcccggcaccggcatcttccgctgactgttgctgtccacccggtacgggacccgtctttgagacaccccatccctggtatggattctcggagtcttcacgacacgtccgagatttacagcaagctgagtctcgggtcgtgtctgtgaatatgacgcaaaaagcacaaaacgtctgacagatgcgtgacggaccgcaccaacacttcgctggagacaacagtggcttgccgctgccttcatccaaggcaagcagcgttccacgccacactgcagaaccccccagtgcaccgccatccccgtatgagccacgtaatagggttcaaggtgtcattggtccacaacgcgggacggtttacggaaagaaggacttttagttaaactggaaaagcatcctcgttggcccgttgcccccctacccagtaaacacgaagcatgcgcgtgaagacgtacaacctcgcgacatgaacgctaaacttctcatcagccggcactcgatacgtcccaatgacctcagaaagagatgttatccacaaaggagctcctcatattctaaatggactgtgtaattcgtgaattttacagttggtacctgtgcccgcagtgttgcatgcgcgaggatcaacgcgaagtcgccgcagcgcgggtcggaaccacgagacatgcgaaaagagatacgcccttggcctcccctgtagcctccacggttcttaccataacccaacagtacagagatgattttggtaattccgtgactgaagagcataaaagactacctacgtcaattcaagaaagggagacacacatcctctgaggtcccgtgtcagtcgctgtaacgggtggtcgcacagcgcgtgggtgtaggacgcagctatatgaatagtgctgaaggacgatcacccatacgggtgcagcttttgcacatactttcaattgtcaaatcgacagcgtcgttgttaa

SEQ ID NO: 2395 - DNA, 3178 bp, Toxoplasma gondii
cgcaggtctctccatgttgggcagctgttcgacggacagacgagaagagcgaggcgtcgctcgcgtcgcgcatgcgcagggtgcgagggtgtcgtctccggaagagtgagcagactccaggaaacgaaggaaaggtgcagaggcaccacagacgctcgcagcgaagcctgcgtcgagtttcctgcctgcgcttcccggccgctgctctgctccgagcgccgccgccggctcttccccgcgttctccacacacccgcgaggcagaaggaaaagacggaaggcgcagcggcgacccagatgcaaactcccttctccccgcctcctccgttccgtcctgcttctcccgcagctccacacagtggcaactcgcctccgactcaggcgccccgacacccgcggccgccggtgcagcgccgcagccgagcgcgttggatgggtgggcgcgcgcaaagaagctccgtttcttcagaagcgaagaaagcaactcagtggcgggacctggagtctctggttggccgcgttcctcgtcgcggcggcttcccgcctccctcgcgcgagactccggcgtctcttcggcgtcgtgcgcgtcgcgcagagacgctggcgcatggccggcggaggccttcaccgcggctgctccgcttccgcgccgcgcggccagaggtgcctgcagcaggtgaggaaagacaggcggagaagggtgaacagcggagagagttggaggagagcagcgcgagcaggcagaaggctctgcatggcactgatcgaccgcagaaaaatctcctgcagcgacgcggtgctcagccgtcacagacagagtcggggagtgcatgactgcagcagagcggcgagtgcagtcgccagcaggtctcgcctcgtcgcttgcctccaccggacggacaggggaactgggaggcgcgagcgccagtgcgaaggaccgccccgctctgttcgcagagacggacgcgatgcccaggcgctgcgggagaaagaggatctggactgtgggtgctgctgcgagaagtcgaggagccgcgccagagaaaaagcagctgaactcgacagaggggagcgcgcgacgctcgggggtgttgtcggcggaactcgcgagtcgcctgcgatgccggacttcgtctcggagaggacaggcggctttgccttgccttccttccagaagaaggcgagggcagtctgccgcagaaaagctggaaagcgagacagtcaaccgcacctggagcactccggaagccgaccgcccttcgttgccgacaagaacaattgcggctctggtgtctgacaccgggctccgaactcgccacctggaaaaggaccgagtccgcttgcgcctgtgttggcgtcgtgcactcgagataaaaagaaaagatgcgcgcaaggaaaaaatctagagcgcctcaacaggaaaaacggagaaaaaagacggcacgcacatttacgcgcgcgcgcgaaggagggggggtggcaaacgatgcgacagcgtgtaggaaggaagtgcctggaagaggaaaaaactcgcggaaaacgcaaacaaagaaagagtggaagaagacgaactcagtgtgcgtcctcttcacggcggcggagaaaaaaaaggatcctcttcgccggaaaacgcccttcttctctgccatcgcgcacacccgagcgttctgcaagcgacacagcattggggggagggggggggcaggagctcacacaacaccgccggcgccctgggaggaagacattccgaagtctttgtcatgaaagcgtttggcgacctggcgataaacgaaagccttttcctttttagcagaaagtcacaaagctgctgcaagcagtgtcgaagcttctgtgaggagcgtacgcctcagcggaagaaaatgcgccttccggacttccgcctcattcaccaagttgacgacgaccgtacctcttcttcttcttcttcaagagatgtcacggtctcacgcctgggtcactctgttcctccgaaattccgatgcccttcgctgtttgaggagcccccaaatacgacagagtgtgagtgcaaactaaagattcgatttctcgccgagagacgccgcccgccaactgtcttcccttccctgtccacgcagtcaaaacaggaaaaatagacataacaacacacatacaaatatatatatatatatgtttatataaatgtatgtatatatatgcatatacatatatttacatatacgcacatacgtagatgtgtatctatgtagatgtagtcctgtgtattcgtatttttatctgtactcgtgtatacagaaatatatatatatatatattatatgtatatatataaagtatagaaagaaggcgttgacagtcgaagagaatcgcggttttttgcttgatgtgaatcgcgagatgcttgtcgagtgccatgcagcagatttcttcgtcagcttaaaaaaacttctcacacggccaccagacttcccgcgggtgacagagactcgcggtgacccccctcggaggaaaggctttttttcagcggacagatgctcggctccgttcctggtttgagatgtttctcacggttcacggaagagacatgaacgcgacgtctttttgagagtcaactccacgtcaatcttcctcagaaaggacattgtttttcaggagaactcaactcttcggccttgtttttgcctcgcgctgacgtctgcgctgagaagaaaaagatgcgtcgtctttgccccgtgactttcggagattcttcggaaccagcactgtgtcgtaataagcgtttccttccgattcgcctcaatttttcttcttccactttcctgcttttctgcgcgtttttctccgaccaaagttccgttcaaaaaggggcgctgcctcggcgcaaagccgcgcccgcgttcggcaggaacgtgtgcatcgaggcaccgctgcacagttcctcgtttctttctttttcggatctctccttgtcactttcacctgcctcctgcgtctcccagccgcctcctcttcccagtttcttctcttcggcgtcatttcttctcttctgtttgtcttcctctccttgtctctccttctcccagccctctaggcaaaatttttgagcgcgtcgaagacttgcgtttctccttctttgcaaggatctcttctctctccttcaaccagctctctggacgaga

SEQ ID NO: 2396 - DNA, 1337 bp, Toxoplasma gondii
ctacaacaatgtcaaagactcatcccagagaagatagctacgtgtggtggtctccagttgggttggttagtgtagataaaacgttgttttgtcgtcggtagctttgctgaactcgtctcggaatccggcgaaaacaacggatcgaatgaggatgaggtttgtccaaatccatgcagtgagtgcaagataagttggtgtggatgtttccttcgctcaggcgtgtggcgcggggtgtgcagtggtccacggaatcgagcttttcgtgtggcaggcgttgattcagtctcgctattgggtgacatcgcaaggacctgttgatgtgaacgccaacgagcgggaggtgccaagcaattaccctaatcaagcagaaacaatcatacactgcacgatggggaagacgtgtgagtaccagaaattcttaatcgcgaggtggttagacacacctgaaggacgctcatatcgtcctatcgatctgaggcctgccgaacttcgggaggtcctcaaacgtgtcgagacattctacaggaatgtgattgatgtcgaccggcttgtcaccctccgaggggagaatttctttgtttgacactagggtaaccgcgctatctaacggttttgtgcgtttttggaattcgagcaatgtcatacggcccaaagacgcgtcttaccttcgtttacaggctcatatcaaaaagcttaacgatatgggtgtcaggaaaactggtcgcgaaaggagcgccagaccccctcccaaagcacatctaggaacatatcttccacgtagacgtgcagccgccaccattcttttccggttattcttcgttttcggggttacggcaacacggacagtgttcctcagtggaaagagaaaacactcagatagcatgttggaactcgtgttcacttgtccacgataatactcacgcctcaacgatcggtcgcgtttacatggtaaccgtggctgtctcagcggcagaccaagtcacgcccaaagtcaccacgagggagtagctcacacagttaacaatttgacacggcgcgtgcgtcaatttggctttttgcgttcaacatttatctgaacactctgaccatacgtctcttccttcttgggtggactgattcacgatatactggcacggctgtaaaggcgccaccacgggcacttaatcgtttttgacgcatatttttcagtgaatgaccttggccgtcccacgcgacgttcacttgcgaagggaaaacgtgggagaatcagctgctgacaacaaaaatctcctcacggaagcggacgccagatctcgagacagaaaataccccaatcgtcatcgacgggtatctatcga

SEQ ID NO: 2397 - DNA, 2483 bp, Toxoplasma gondii
atatttatctgtcggcgcgcatggaatatgaagtatacggatcggattcttggtggcctggcacctgcttagtaactggatgaacgctttgtacgttcatcttgttcaataataaaagagtgatgagccaacgtggaggtatttccatgtcaaagtttacgtgtatcttgcacagatctgttttttaggagtcctctcaacctcgcatgcgcgggcgtctcgatagcgccctgcgaatcgagtagcgaattctgtatgctcacgcgttacgcacgtttggtacgactggcactgccgtctcgcgaacgaaatgaaaggggcatcggggtgggtacattcgtccgttgttttccgcctctatttaacctgttttctcaagagatgcgtgttctgttcgctttataacgttgtcgagatgcggttgacaccgtcgtctcaactgttcgccgctcggcctccgaagcagggggcgcaggaaccagcaagaaaatgaaaacccccgcgctttctggcgcacaaagagtgcgcttggaaaccgtaccaattttgtgcctgggtgtgtgtaaagcgtagtaacacacacactccaaaaaaccgtcgtgtccccacgaaacctagcggagcaggtggctatttcagggatggtttttcctcatcgtcacgtgttggtggtttcccaactctgcatgttcacccaaacgcatagagccctctgtcctcctccaggttaggagaccacacagttcctttaaaaatacgaatgtacgaaagaactcaatagaaagagcggtactcctattgccaagaacacattggaagaatctcctgagagcttcaaagagccttgacgttgaaatctgcaatacctagcctggtacatccaataaggggaggcttctgctggccatgaagctacccgagtgagctgagccagctccctagtcgttttcgtgcagaatttgacgagaacttgaaaagtgtagctctcgcgctgtcactggcacacttcattgtcgagaccagagttaccgcccaggaaagggacaataaaactaactctgcgccgttgcctacagaagccaaacacgtaccgaacaacacaaaattgcgcacgggttgaccaagagaaggttaaacgctgcgaaggacacaaaaactcacttcgggtgacttcctgatctcaaaagttcggtgcaacgcgtgtctgctgtattaaaaatccccctgccgtctctctctacgtcaaaattgccaggtgatctcaaccatgtttttcccaaaggatctttagttgtggttcgtagcacaaacacttcttgcttccccagaaaaaaggcaagtgtgtcctcattcgtcttcactgttctgtcttctgaaattcaggattttccgcgctttgtcgccgtcccgattctgctatgcccagcgcggcttgcctatccatcgacggcccccatctacgaaaagctgaaggcatgcttggacgaagcagctggcacccttgcgaggaatgcccatgtgggttgcagcaagtttttgttcacgtcttgaattcaagggaggtaaccaattgtttcatagtaaatcaacaggtctgatcggtcactaaaaagaaacgcactggcacaagcgactcgcgtggtcggctaagacgaaacgacccgccgcagtcctgtctttcggggtggatttttctcgacggcaaaaggagttaaactttgggggtttgcccgctggttgtctctctttggattcctcgttcgagaaacccgctttctgtcgcagtgggttgcgagatcgtgtgtttttcgtgtgaaaaggagtagggatttcgttgacacgagggggtatgcatcgactgcctctggatcgacatcgcccgctgtctcgtcctaattccgcacttcacgcacctggcttttcgactttggaaagaagaaatcccgagtaaatgtgcgtcttttatcagagacgcaaatacccacatctgcacattcgcatcgcagacgggctctttgcaagctcagtttcctccctcttgttgattggaatcctgtgctccgcacgacacgctcagcagctatcggttccagtcgtcggtttgcttattggctttaagcggtcgtaactgactggacaacaagtgaagacgatctgccttatatccagatcgcagaatcaagggtcgcgctggagttcgaccatgtacgcgccgtgtcccgggaaggtcaccagtcggtaaaccccgcggacagaattttccgttgaaccagattctggaaaggacaggatctccagaggcgcatcgtcagtactcttgagaatttgcccgtagagcaaagcagctggagcacgttcggttttgtgttgtcctcgtggctaagcttgacaacccaaggggaaggcctgtcctgggcctttttaaaagccttgttttcccgtgttgtcccgcgctgattcactcagtattttgttttcaacca

SEQ ID NO: 2398 - DNA, 2580 bp, Toxoplasma gondii
catttgaacgtgaacaaagtacatcggtttggtgtgtaagagcggcgacgccccttacagcgcatgccggtctgtttcgcatgtcacgtgtcccctggtgctttttttttcatcgcaagtggtaacttactgcggcgtgtgtcagacggttgaatgatcaaggatcgattgttgtggtgtgtaggcgctccgcttgacaaaggtattaggtttggagtgtcatgcatcatcgaactggaaacaagagcttgtttgcgttttactgttctgttaagacgtgttgctcgccactctctagtgcgcacgtacccgcttgtctgtctgtaaaaaagtgaatcacgtctcgagcggacgacgccggacgtcccatttggcttgctgaccagcgaaagctgggttggaagaggagtcaccaaatacacgctgcgcatgtcggtagacagtcgtctgtaccagcagtcaacggagcacagtagataacggcttgagtagacgaaccccacccccctcaacgctgactcgggtagagtcttcccttagataagcaaagtgaggagctcttcgttgcggggtttcttctctgttctgcgcgtacgtgttcgagcacttgactatgcagtcgccacacggttactgacaggttttgaccgctgttacctgctacacccgtccctgtgaaattctatggtaagatcggttggatttcaaatcgatgtcgagggtagagacctcgttcgtattgttccgccagggcgagcggtgatgtctttggacaggagaaaatacatcacctaacagtgacgctcagtcggcgacaaagccatcgtgacccagcgtttaccgccgctggcaaggtgcatccagtcgtatgcggaagaaacaaacagcggcaagagagcgaaatttctgcagcgcgcaaggacgaaacgcgcgacctgtattgtacaccgttctccgactgcagtgtcaatcgtgaaactgtgccaagaaacactatcaagaatcgtatctggtcttcctcgtccacttttatacgaagaaagtaagacctcagttggtacgcatacggacatatttaaaattgtgacgagacaacagtggctgatcgtcgattgttgatacgaaagagtgtttctcgctctcgttttccactgagcgttagtgacttccagcgggagctccacgaggttcgcttcggtctgcggtccatagttagaaatgtattcataggtgggttatctacactacatgcaaagctagagaataggcatttttgagaaatcgggcgcggtaggggctcctttgtccgtagccacgaaagccaaaggtctgagtgaccgtgttcgcagactaccgggtgtaacgcatgcatatgcagcacgctaaatcaagttgttgaaggcagtggtgtgtcccgaagagctattcattcggaatgtaacagattccgcgagcaacgcgatgttagaaaatcacagccacttcccccttaagagtcatttccctcctccgcgcatttgccattccagctggaatctttgtgcaaaggctgggctgccaaactagcctttcagtcacttgctgggactgcagtgaagttagtgtagatggaggaaagcgcgagacgcctgtcgctgtggaaacagcgtcgagtggcagacagcggagacgacagactagctgaactgccccccagcagcggcgttctccgagaagcaaatctgggtttcggggtctgcagtggcatatgctcagttgtatatgcacaatagtgcctgcctcagttgagaatcaaagctttgtggaaatgtgctttgtccgatctgcccgaaaagcatggtgcaaatcttcgagcattatagtacccaatgagcgagctcgactccgctcgcgggtgtggcagccatgcattccgcacgtgcacccctgcgagaaaccgagtcgattatcggtagaaagaggctaacacaattttcaccggcgtttagtttcagaagagttgtattctgctgtggaaagagcagcggagcgcagcagagtgacttctgccctccttacgtgatcatgaatcttgacctccagcgagtgttcgcgggcgctacgactttcgtgtctcgtctgccacccatccttgtatttgtatcagctccgaatgcgaggtaatttgaagactccagaaaaccaggtcactctatgtgcacctcaaaagggggtccgagtaacgtgcaactcgaaactagaaaacgatatagtgctgtctggcgggtgacttcgtaccagccgcggttgtcgaacgcttcgcgcatggttccattccggtctatggcagtgtctgcatttctctatacaccgttttccttttcacacattgccttccgcaggttgcgacgcgtcgcacctatccgctacctccatagagagttctacacgtactctggcgtgttgtccaccgggtaagatctcagtgagccacttttcttcgttccctgtacctccctgttaccgattctattgccgggagtacaccagcagaggtttcggccgggcaactcggactggcgtgcttgctcaccgaccaca

SEQ ID NO: 2399 - DNA, 1655 bp, Toxoplasma gondii
gaaatttctcaagagcatccacgggaagcggagacacgagcgagggacctgcatgcgcaggcggtgggcacctggtctgactccagcctgaggacgcgagaagcttggaagggccttcgtcgcccttctcaggcggaggctctgttctctccttcgcctccgcacccttcctctccgtttcaagggagactctctgggattctggaggagaggcagaaccggcgcggcttcgcggagagtccggcaaaggcgagagagaaggcagcgggccgggaagctcctgaccttcgaagagccgagagaggctcgccttcagacgcgtcaccagagtgtctgcctcgagcgccgcgtccagcaacgaaagtcgatccttcacttttcgtttgagaaaggaagagatcgacgccattttcccaagtcagggacgaatcgttcattgtcctgcaaattcagagacgctcagacactcggcgagaagaagcgcatggatacccggaaggaagtacagacgggaagcaagagagaagaaggaagacggcggccgctcgaatgtctcgtgctgctgtgtggagtgaaaccgacaccacaggaggaggatggggacgacagcgaggcgaagaacggctcgacgagtacagaaaagcatcaaaggaagcaggcagccagagaggagccaagaacaaaagtttcagagcggcggaacggaacggagacacgacggaagagagtggcgtcacgagcgaggagcgagaaagaaacgcgagacagaacctaggcaaatgacaggagagatcagcacaagaagacgaaaggaaaaacatcgaaaagtgtaggaaaagcggaggacgtgcgagtctggagggatagaagccgggaagacgcgaaacagacaagtcagccacagcggaccaggacatgtgcaccgaaagtgcgaggaagtggagaaaagctgcaagcacaataatggtagacagactgctttgaagaggaaatgcggcaaaagattcctgctaaaaaacaacaacgacggcgttggacctcgtcctttcccatgtgtgatgtgaccgtgattgtcgccgtgtatgtacaccttggagggcatgcggttgcggagattttcatcgacatgcgaaaaaactgttcagctgaacgacttgtgcggaaactggtaaactgcgccgttcgaaaggcggcttccttttcctctactttccgaagaacgggtaacagccatctgatttcttcattccttcccgccgatttttttcgtctctcccttgagagttgttcgagctctttcggccgcgatccggccgtctgtttttgaggagacagaacgcacccccccctcccgcccccgctggatatcgcgttcctggtctccctttcgacaaaacaacaccaccgcgaagacttgcactggcagttgttcttccctttttgtccactgatgggtctcgggtgtacgtacggctgcatcttctgcctcgtgaagtcggtgtgccccaccctgaggcgaaaactcacccggggcagctggggagtccgagcgcattcattgtaccgttgagcaaggccatttctccagacgtgtgtcgcctgcggctttctccatgcgtcagtctctgtttcgtttcttaggaactgggtcgaca

SEQ ID NO: 2400 - DNA, 2236 bp, Toxoplasma gondii
ctttttacgacgcgttgtccgcatttcatctcgttcgcgtcgccggatttggacgtcgtctacgccgtcgtcggagaggtcgatcgactgcgtttgccccattgtgattgcaggaagttcaggaagggtggagagcgaaaacgcaggcgacagagagagaaaagagcggctggcgcagaaatgcaaattccaaagagacaccgttcgcagtcctcgaggttcgcgaggggaaaatcgcaagactgcggaagcggcaggtatcgcaggcgacgccgtgagttcccctaccgtggctcgctcggaaggctggtgcctcggcaaggacgccagcctcgcagcccaagagttcaggattttctgtcagaaaggcgcaaactgggagatccggaggcgcagttcagtggactggaccgacgcaggaaggcgaaggaaagcagagagccagaaccagttgaaaaaggggagagagaatgcaaggacaaggatagagtggggacgaagagaaacggccagaaggctcgagtgagagatgaacaagggaacaaaaggaaagctgaaacgaggacaaaggtgagacaaaacaagacgagcagaacacatccagaaggcgaacgaaggaactgcgtaaggaagatgagccgaaactcctcggttttcctatcgcccccaatttccctggactttttgcttggcaaaaactcgctgaggttctccgaagatcccctaaaaatgtcaaaagacttcgacagtcgcgccgccgctgacaccgcaaaacaaccgtcctcggtggctctccaggagaagtcagaaaagcggtcgaggcgagcgcctgcagatcctcaaacgggcaaagaactctcaaagcaaatacgcacaatgcagactcccatacgtacatacacatgtatataaatacatatatcaaattgtctatttatctgcatatttatatatatatatatatgtaaatatataaaaatacgaatatataaatatatagatgtatatatgtgtatatatgtatgcatgcatatgttttatacggaatgcctcgtttgacaagatgctggcgcggccttggattttgacggagacgccggctgcgaaacgctccacggatgagcgagtgcggatgcgccgcctctgttttcagttttctcggcatcagaaggtgaactgaaggacaggattgtcaaaacaagagtgcattcccctgaaactcagattccgcaactggcgaggaacagagtcactcttctgcagcgcgagcctgctaggaagatgaccaagaggaggaggcgcttcgggcactgcagagattcatgaaagagggaaacgacaaaggaactctgtcatctttctcacggaactcctcttgccttttggggaaaaacgaggaccgggagtctaaggcgaacagctgtcgcagtccagcatcgacgaagaagacggctctcgcatcgttcctttacctcgagagacgccgccaggatgacgaagaaaagaagtcacgaggaaacacggaaaagaattgttaattttgtctagaaaaatttgaggaaatgttcgctgaagcaacttctgcaacaaggtcttcttccaagcagacgcgctgacatgcgacgcggcagatcaggaagcggggagagagtcaagttgtttccttccttgtaaagacctccttttgacagttgcctcttccctcagaggcaaaggcggggatgttcttccatttggagaatcccagtgacttccgcacttctcttcgcgcctcgcttcttgtctctggctgggcagctctacagtgtgtgtgtgccggtcgatgacaaagcgccctcgctttgcgctggtatctgtcggcttcagggtgagttgtttcgaaatgaagtctaaaaaatgcaccagtgaaggacttccacttaaaaaaagtgagaaatcctctcgagttcgactcttcttctgatggccaactctctattctctcgcggtccgcgccccaggcagctgcgcacactcaactgctttttctctatttcctttcgcgctgttctttgtctattcttctcctagttacctctcgtcttccctttcactgtctccctgcttctctcttccctcttctcttcttcatggtccctcgcaaaaggactggcgccgtctctcatctctttttctggactgtgtctccacctgtccactatctcctgactttccagcgtttttctctctgtcaaca

SEQ ID NO: 2401 - DNA, 2009 bp, Toxoplasma gondii
tgctctcgctggcctcgattcttccttctatttgcttcaggagagaagctaggagagagacgcagtctgtcgtggcaatcttagtctggcctgacttacggaaggcgtgtcgcgcaccaggcggcttaatgcgaaagttgcccatcttatcgacagaaaaaagacatgtcgtcgaacatttcctcgttcacagagtggagacttctttgttctttcgtcgaagcgaagaaggagccttctacgcaaaattgtggaacaggcgtcggcgcgtctgcctgggaggcccttttgcctctcggcctgatctgctcgaagatcagcgccaaaagaagtgcttgccttgaacagaacggatcacagaatgaggaaactcacaggtctgtgtcttatggagttaagctggtcaactcagtcgcagctgcttcatcgggaccgaaacacctagtgaccccaagtaaacggagaagaccgagccgatgaccccatacgtttgcttctgctggtaggctgaaggggcaagattcggcgaagaggcagaaagacaaagagaggcgagtaaaagagtgtgcaggagacgggacggtcttcagagttcaaaaaccggccgaaacatgtgcagagggaaactggtaaggaaagaccgtccgtttgtcaaacacgcgcagactgctctgttacgctgcgaaccggaagcagcgtagaagaacaaaatgctggcacggaaaggagaaatggagagaaacgagacttgaaaagtgaacgatccactcgaaaaggaaaaaacccgtttgcatgcagaaagctggcggctttttctggcgccgtgcatgccttcgctgcttgcatgtgtgcaacagggtctccgagccgaaagtcggcttttcaaaggacaaacgcggctgcgcagagacacgctagagaaaagagatgctgtgcggggtctggtaagttgcgccgtaaagctgtgttcagaggctgctggggcggctgctcaggcaaagatgatttccggcggggtctctacctcctttcacccttgcagaggcgagttgtgcgcggtgtacgtacacctcacagaccgtgatccccagttgcttttgttggttttctttcggccttgttcaaggtaagcgccttttgtgtggtcttgtatcacatttgcgctcgtcacgtttcgtttctcccgtatccccactcagaaagtgtcgggcaaattcgctgcatacgagtgcggggctcgtagcgcattttttctccccacgttcttgcaattttaggcgtgctgaggaacacggtttgcccatcgtcccggttttttctttgcttgtcgcatcaagaggtttgcgaggtttcgctggtgtgcgggcgatctttttctggaacgagattacttgctttcggggtcgaagccagagagtggtgctggggcatgctatttcaaagacaccaccggcatctgcgttctcgatcacggctggcggatgcgtctgttcttatgcctggggttcaacattgagatttggagggggcttccgttgttttgactggagacttcaacccagaaatacctgtatcggtccgtaccgctatgctgttcgcgagggcagccagagcccggaccgctgtcgcctgacatcttattacgggggtttactccaaattttcttccgtcgttcctccttcttccctttcattccaattgcacttcgactccgtcgtcggcctgcgcggcgtgcactgtgcatgcgtgtggtaccataaattatgctgtcgagtcctcccggtgactgtaccccccgcagtgtttgttctgtccgttctgacgagctcgtcggtatcagtttttcgtgattttcacctaggtgtatatgtaggtgttctgattctagccttaccacacaggacggtatttctgctgcgtttcccacctgcgtatgcctaacaggctccaacatctacttcccggatcggcgggctcgtcttcgtttttcttccaccgtttttcaaga

SEQ ID NO: 2402 - DNA, 2427 bp, Toxoplasma gondii
aaggaagtctcgagttgtcaagtcgcagccgcagaaacaaccgagaagtccgcagaaagatcggggcgcctccaccgggcaacaggtgcagcatgaggcgcagcggcctcgactttctccgggcggtgccatgggtcacaacgtgatgcacgcgatagcgggagtcgaagtcaccgtcagaaaagtcggatcaacgcgccacagggttcatcagcgaaacgtccgccacgcagcaccccgaagagacaggtgaggtgatggagccgcgaggatccgagaatcacgggagagagtaggctggaattgtcctagaccttggcgggaaagggaagcggacccacctcagagcggagtacaaaactagaaaactccacacggatttgaaggacagtcgatttcttctcgcagaccttttcgtcaccccgtcgagtggagtgagcgactggtgaaaatgcagggctacacagatttcccgatacgacaaccacgaaatggaagaaatcgttggcagcacgcgggtgatgaaaaggagacgagtgataacagaccaagtggtgcacggggaaactgcggaccgacctgaaaccagcaattcagtggtcttttcagactcgatcgcggctgacaggaagatggacctggcaattcatgcacatcgagtcctgccgttttcccacaacgggaacaatccgtacttcacgaaaaaagcttctttttcagaagaacccgccctgcggcgtttccgggggaatccgtgcggcgtatagacacccgaacgacaaccccctggggtcgacggaactgcaagcaccgaccaacgaacgcaagtgtgatccagaagagccgtgaaaaaacagaacggaacagaagagcacgagagcggaatggattcagtctgccttcaggaacgaaattattcttctgtcgcggggggacgcgcggtaaaaaagtagcgccgatacacgcgagcatacgcaagtagtgttgtttggaagcgctgcagttgtgccaaagggtgcgaaatcagcaaacgaaggagactattcagcagaggtccgacggaagaagaccaagcgttcgactcgaattatgggttctttccagcaatcaagcaaagcgctttccaggtgcctggcgggctgagagccgacgacggccaggaagcaacgtgtgcttaggaaagacaaatttgtgcgtacccgactggcgacgcctccccaggaaccgccctctgttgtgtgtgaagatgagcgcgttgaaagcggaaagcagaaaagtacgcggggagacaattgccgataccaacgagacggaaacactggcaaggtggccaactcctcgacacacgcaaggcgtccgcagctgttggattccgagcttttgatctgtgtagatctgccggatttgccgcaacgcggatgagcatgttcgagttaggagtgtccttttattagcaacttctcacggatttttccggacttttctcacacgattgcaacccgtcaactccggccaccttttcgcaggccagtggtcaggaggctgaaacctgcgacggtggcccggcttatttgctggtgccatccgctctcactcgctactcgtgaaaatggttctgggggcacgggcaagccgacgtagacaaaacaaagacactgttaagtgttgttgttggcaagccccaaaaggactttccgccccctccatatccttgatccagcaaccttcacattacaaccacagagcacgggtgattctctgaaaccaagtaaccggattccccttgaaaaaaaagcagaaaaatggacgcacaccagatgctgtgtctggcgacacagaccgtattttgcgctgggcgacttgcttctaggaccataggaaaccccggttgctaccgccgcccattctcagcaaagtcaagcactctgcaccgtttcttgcaggggatgggttttccaagcagtctgtattcgtgtctttgaccttcaggcagatatttcgacttctcataacaaatgtaggggaccacaaccgcagccggcacaccgcggtcagcacagccagcccgtcatcgcacagtcagagggggccgttgcggcaagccagaaacgcttgtctacaaagataacaggcctgaacgcgatttccgcagttttatttccgaaatgccagtgcagagcgatccgtggactgggtcgcgacccttccctgtttcgcttcttgaagccgtcgggcgtcactgcaggtgagccactgcgcgcgtgaccccccttggcggcgcggctctattctgcactgagctcggacgtttctctactgggacagactgcttcttcttgagatacatctttgttttttcgtcacccttttctgccgactcaggggctacgcagtcgggagattggaagcgagtaaaacgaccgttca

SEQ ID NO: 2403 - DNA, 5034 bp, Toxoplasma gondii
gaaattactagacttgaatgacgtattgagacagtcgtcatttactgctgaggttctctgactgtgacgagttagcgaggctttctgtgaatttgttttgagttttaattccaaaaactgggagacgaacagggtacgcgccggcccccaggcggccctgtccgtttcgccagtttgtggaggagcacaaagagtttgcgcttttccaaaatgttgcctcgaaagcattctcgaggaaaaatctgtttttggagagatctccactttaatcgagtgccacggtgccgccgcattcgttcacttgtttgttgcttttcgatgaatgcacaagacgttttcaaagatacttttatctagtagtcgttccttgtttcagcaaagtcaaaccttcatcgcctttcctttaaaagaagtcacattttctgggttcgctggagagatgttttcgttcactgtgtagaggaatctcggaatttcctctattcgttgctttcccgagggtgtgtgtcattttctttcttccaagtgctggaaaacaaaatgtcgcccacacatgcgacttgttcaaggaatttgttttcgaagaagaggcttcagaagtcccccggaagcgcacaaattcacacctagcagaagcggttgaactctataaaaggaacaggcacattcagcgccaacttcttcactcgagcagacagtggcgtccggatgcaaagcctcacgctcacgttcgttgtgcctgacacagattcgtcttcgtcttaggcgaggaaggtctgtcaggcggatttgaatttctcgttggcaacagggtggagctcgcacgcgctccttatacaatagattttcaccgacagaagatcttctctgtcttcacgcttcctctttcgtttcttcaaatgcagcggagacaccgactggctgtcacgtgacttccgacgcgtagaaacaagttcaacaaattcaaggatcctcactttggcaagccccttcgttgtgttcgcttgtacacaaaagaacgcggatcgatcttttgttgacctggcacctgtattggaactgcgtgaaagctttttatgtccggtgcgtgtgatgctcacgcagaaaggaggcacaaaaacgaagctcttgcgtgctacactttttgccgactcgtgttccttctgaaacgtattgaatcctgtttcttggaggtttccttttgcacccccagcggcggaaaggaccctcactctgcagcaagggcacataacaccagcacggaggaagtgtgcaaagcgagtttacagaaaatcttgtggagcgtttttttgtagagattctaaatcatcccctatcgacaacagcaagcaatggccaccttgtcccgataaacgccaacgcaaaaaccgatttcagaagcttgaaatggacttcgtttccgtttttctaaaaaggcacatcgcatgagacccttctgacacaaagttgactggtagtgcatgcataggttcgaagataaacgtaacactaccgagaaattgaacggacaaactccatacacagtacaaagacatttacagttcttccacgcaaaagatctccgggaacgtacgcaaaacgcaatcgggaacagcgtctatgctgcagcctcgagggtgctgaaggtggtttgtgagtgccctttagtctctttgaagttcgtttcttagtcgacagtcgacaaaagaacggaggaaactcgtggacctttggaggtgaggtgaaggaaagagtgcgcgacaagaaacaaagatgtggttgagtggacaggaaagctttggattttttcgaagctgtagaggctttctggaagagtcgagagtgtctattgcaccttgagacgaaacaactcttccaccgcatctgttgcagtcagatgtttcttggccaatgctttttacagaagaaagcaaggccataagacgggcaggagcccatgttgcgtaagcaagtagcaggtccgaagcctgaatggcgacactcggtcaagtccggggtgggggctatctttgcacaacgcttatgttctttgcgtcacatgtatgaggtattgcgattaggcgtatgaacagcaagagaaaactgctcctcagatggtaaatgagctcgtaacgtctcccttactgcctacctggttctacgatttcactatttactagccctctctgcgaacgaataaaggatcaaaagcgggatatttcttgccgccgagtcttttcaagaatgaatttgacatccacacaaaaacgtaaactatcggttgcggtgagcttcacctatcgcttcacctatcgcttgcgccttaccatcgctggtaacgaacaggagtctacgtgaaggaaattttccagctcactgtggcatatcagaagacacaaccaaaaccggcatttgccgcctgcgccatttcatcgcctcctttgccggggacagcctggcagagatagttccgtttgtggggcagacgaaagcgcaccgagacgcggtaaactctcctcagtgacggagaacactttgtgctcaccatccgtggaaaatcctaccacttcacactttcgtaaaagacgcagaaagtgtgcttctttcctctgcccggacagcactcagttcttctcccagaaaacgagtgaactgttgcccgcaagagacgaacgacctcgttctggtccgttgcgcgctgctgcgtctgttgatagttccggatgcgtgccgtcgacttgtgagacagctgtgaggaaagccgtgacaccgaaagatcttggggacactgaaaagaaggaatagagagttgaccagtccccggcctactttgttccacgagtgcgagtcaagctatctactttctggaaagcagcactccacacagacatacagatgaaattatataagcatatgaacttgtacacatgtacaaacatacacgtgttcctacatatatacagtattacatttacatgtattcggatatacatgtatcttatgtatctatatactgatgtatacatatacatatatatatatatatgcatctgtatatcacaccgttgaacaagacggtgtactgcgttgactgcacgttgcctttttcccctttttcccgtgcaaatgtcggatggattcgtcgttgccatgcgtcacgaaggaagcctttttctagctcttcgatcatgtttaacctggaaggaactgaaggattcccctctctgtagatcttcttttgatgcatgcagagagccagctgtgaatacgattttggtgtatatggtcacagtcgcgctatggtgcacagacagcaccactcatttcagcacagcccttttccggtcactgtgtttcactaaaagcgaaatgtgaagtttcatctgttaccctgactttgttcgactgtgtcgtgcatgcgtttgaggtgtttgtctcccgcccagaactctgcagatttgtgtttcgttggctttttccatagacacagaatcgctgcacgaggatccggtaccgcgcttgccgcgcctcgaggcgaaagcgacttcttcttttactttggttgggtctccttttcgtcagcaactctgctgctcccaccgacacgatttatacatcagaagaaatggaggtagaatggcagttcaagccgatatgatagccgcaacgagcatcagttgttgacgtgtgaagatgacaggcagatgcacttttggaacctccgattccgaatttatttacttcctgcgccggcttgcgaaaggcatgtacgtgcaggttgagatgcgtagaacgactataaaatgctacatgtaggcagcaggaggtaacgggatacaacggggtgcgttcgtttgctgtgagaatcgctccagtgtacacagaagaaaagttagtttatagtccgtacccacttgtttgaaattgtctgcatttggctcaggtcgcctggccaggcgcttctctagccgtctcagtgcttccgggtgaggtcacctcgactttttttgaaagtgcggggaggaaagcgttgtaaacagaggcgaaacgttgccttccgtattctcactcgttccagccacatgtgtgtccgtttttcgctcgaaaattcccctttctgccgaaaaagatggagtgaggcgcgacaccagtcgagcgaaggacgacggtggcgggggggagagggtgcacggcgcgcgttcgccacaggcgcatggagttttccgtttcatcctttcgtttttccgcgttcaggatttcttcgccgataccgtccaaactctctttcttatgcttggacgggttgcccgttttcctttgattcgttttcacgcgcgcttttgccggcttgccttccttttcttctttgtttcagagtctcggaggttccactcgcgctgtgcggaattctcctgggacttggcttctgttcgcttgttgaaatttgcatttcttctatctggatttgtcgctattccgcaaactgccgagtagccattcggcggtgtgtacatacacctgactccgtggcggttcgctccagtctcgcccgcttaccagccagttttccggtgcagaaaggcgcccgctcccaagcgttggccctcgctgtttcgttgctttccccattcaacctcatcgctctcttttttctgctttagcgtcaagcgagtaagggagaacgcttctacgccggaccggtcaccgcttctggaggcccggcctctcgcgtttccccgttttttgccgcgcatgttcacgatggtgctcccgagacacatacgtctgaatgggagtttgcgtggacagacgaaatcctcgaattcaacggtgcgctcctgaatggaacggtacgcgcttcgctcgcctttcgacgctaccccccatccgaagagaatacgcgcagaactgatgacgtaagtccggacaagacgcagcttgtgggtgagtcgcgttttggctctcgcaaccctgcaggtcgttgaccatcgcgtcgtctgttttccgctgtgcatattcgccgtcaccgcacca

SEQ ID NO: 2404 - DNA, 2053 bp, Toxoplasma gondii
agttctggtgtttccaagtccgcgttgcttggctgcgcgatccgaagaagccccgggagtatttcgtctctttcgggggagagccgctttcggcttgtctctcttgcggccacagtcgagctcgacgcggagcggcagcctcggatttgcgaagcgaagatggagcggggggaaacggaggaaaagaaaagatcgaaggaagcgaagatgcgcgcgaggggggcagcaccgcacccttggactggtgaaagagagagtcgtcatacagagagacggcagaagccgcagtcgggtgcagcgacgctgggtgatccagcgccgagagagaaacgatgcgacagtttcttccttctgcgtttgaggagagaaaaatagagaaacctagaaagacgagtaacagacgagggccggtcatcaggcctgagacccgggacgaccgagttgctttcctgggtggaggggaaggcggacggcgaagaagagaagagcgagaagagcagacgagaaaaggacgagagagactagaacaagagagcagaaaacaagcgagtggaggaaaagccggggcaagatccatcaaggagacgaagaacgcagtggcagcagcacggagaagagagagagcggagaaacagcgaaagaaaagaagagaaaaacaacagatcgcacaagtgcggccttcgggtggacgaccgaaatggcacagcaggacagactgcagaagccgaggatgaaagactttctccatttttcgacgcgaagaaaagagaagaagccacaggagagagaaaacaaagtgaaaagacaaattcgaagaaacccctcgactcggcagcagcgcgggtgccggcaccagcctgcccccactcacggggtgtacgtacacccggtgcatgctggccatagtgaccggtcgaagcctcttagcttcctcatgctccacaaagacttctcgatgaggagcaacaattttctgcagttcttgccagcattattgcgtcatgaagcattgatctacaacgggtctcggattctccctctgtaggtccacactgtcggctgcgcgagttcggcatccctttgtcacgagatgggggaggtgaaaaattgacaggaagaggaggacgaaaaggacatgaaacgaaggggatttgcagacagaagcgaactcggatgaactcgcgtcgtccgccttttcgcgcctcccggcgcagcggccgcacacgacgggtctgtcttgtcacctcgatcttcgatacgcggagtgaagctcgtcgcggcggacaggtttgaggtttttgccccctctagaggtaccggaaaaaggaataaaggttgaggcagcgaaccacgcgtcaagagcactgaaactgcggtgtaatcttcaactgtgcgccaagagtactgtgcagcgagagcatgcagcgaaaacaacagaaacttgtgtgctggactggggacaaggaagaatcgcctgtcgcctgtttacgacgattttctcgcaaggattcaaaggaattctcacgttgattcgatttgaacttctccgttgtccacaacaagttctcagaagctgcctgccccctgggtctctggagacacacaactccacgtgcatgcaagcgtttttcagcgctctcatctgcagtgtggcctgctgtgccgcacatctttttctctctttctgtaattgctgtttctcctcgatctcgtggagatccagagggagaagaggtgacgaaggaactcgatgaacctcaacagccatcatctgtatctcctctcgactggtttctccttccactttttccgggtcccaaaagcgatgccagaaacggagatcgctggtcgacagaaagggggatgagaaggagcaggtacacttcacgtttcgagctgttgttggggagacgcactcgagaaaatcaggtgaatccaacagagacggagggcgcgtagcggcaggagcagccggcacagtctttgcaaagtcgtgggcggggcaccttggccagcactggaaatgggtcgaaactgcaaagagaagtcaaaa

SEQ ID NO: 2405 - DNA, 2409 bp, Toxoplasma gondii
agtcagatcaagactgtgacaccctacccttggtggactcgatggagccacgaaaaaaggaggcatatatatatatatatatatatatggcgagacgtgcactgtcacggccagatggagagtagatctgctttgaagactgagggaaggcaagagaaggatgaaatttaaaggagaaaacgagacaaggcgctacacaaaatctcgtgacgcgagcgcacctgggtacgcttacacatactcaatgacctcagaggaggaaacatcccggttcaacggtgccgcgtcagaagaaaaggtgcgaaaacgcattttaaaaaacagctcttcatgtgcacactagcactgtagaacgaacaaacaacttttacgtatcaggcatacgtatgaatagtcaggttctgacataaatacagtgttatgtgtatatacattgtattatatttgtatatcatatatgtatatctataaatgtatatatatatatatatatatataggggatggcccacgggttgcttacggattcatcaacaaatgccaatgtacactgaggcagctttcgctggacaaccttgatatctgagtgtttcattaatggctgaaacagttgttacatgtgtttgtgtacaaataagtagatgcggaaagaagacatgcggcgcaaggtccgcggttaggacacgaccctgctagctggagactcgctgcgctgtgctccaaacgggctaggggaacaggcgttgcaaatcgcgctttgtggcgctgaaacactataaaggaatatttcctccttctcaggaccggcagttcgaacccttgataagaaggagaatggtcatccatgcttcctgccccggttccaaatgtgaagcacgccagaagatacgaagcactcgcagcaagacaccaactttccaatgggaagagccgaaggaagctgcatcacaggcttgctgtccagtgcaaatttgagcctgtagttcctctgtagagttcatctgtctctaataaatcctctctgtaattgaacccggaaatgggatccggagaaaagtgacccagacgcatgcgcgggacaagcgagacggcacactggttctttggatggatctacatgagcgtaaaagccgcgaaaaagaaggcgaaattcggttacgacgaaggcactgagctctctggaaagaaaataaggtcaagcatgtgaaaaactcgtttcagcggagacttggcaggtgatgctcccgaaaacgcagagtgagctcagacggaggggggtagccacatatatcgaggagtcgggctgagacttaacaactacaatgacaggagctctcttcttcctggagccttttggagttttagaagaaacgttcttgagaactagcaaaatggcaacatgtcctcgctgctggcactaacttctcaaggtcgtgaaacaacgcgtccgaagagctacagggtggaggggggcgcttcccaacacacgttctgtttgcgacgctacggataagctttgcttcgttgcctcgtctcgccacgccgtgatgacaaaaaggattcctcaacctgccgtacgaaggatgactggatgccttcgggtacagttcttctcagtagtttagttgttgtgtttcatttgttgtcgtcaagagcggcagatgtaccacgcaaggtctccttggcgggcgctctgcagtccgtctccaatggactgagacattccctctttcagcgttctggcagtaacttgtgcgatgaaataattctcctcgtgtgggactggacgactcttgcggaatcgacatctcagggctcagccgtggatttgtgtcattccggctgagatggaatttttggaccaggctactttggccaccctggccacgtttcttctttccaatgagctgcccaagctccggcttctctctaaagcactcaatggtcgtcttttccccgttgactcgtttcggcggcttatacgagagccgcgatcgctggtctttccagccgaatggggacaagagaaactggaaagcgtgaagaatcgcagcaagcgtgagcagcttttcgaggaaggaagccaaagagcgcaaggcagtgctgtgccagaggcatcggaggtccacagcgtgactgcgtccccgcgggtttccctgggcataccggtttcatcagttgccccttccagacgagatttcaactaccttcgggttctggtgaacttaccccccccaccgccgcatttgctgcacctgactcttcacatcccgaagaatttacgcacagtaacgcgttcgtggctgcgaacctaccatcagcttctgtgtgtggcggctcctcacctggaaactctgcagctcgtcgagtttttctcagctcgtctggggaaggacctcatggtacgcga

SEQ ID NO: 2406 - DNA, 1750 bp, Toxoplasma gondii
aaaacagaggaatggaagattggatggcggcttaaacgtccgaacagcagagaccagagagggcaccagcctcagttgatcgaccagccagttggggtccgcgggtcaccactttcagcgaattgacagagcagggagtcgcgacgaaaaactgcgtaggaaaagtgagaacgacagaccagtataaaccgtcgcaaaaacaggtgaacttctgaaaagatggactttggtgaggagcctgggagaaacagaccacggagacaacggggcgagtcggctcttccgatttcgtggcttcgggtatctccgcagataccgtggctggaacagatttctttcacggaactcgagagttgaaaagcgcggaaaagcgagagaaaatgcgggggcgaccgccaagacagacttcgctcgagcggcaaccaacgcgagagagttcgtgtgttttcacccgggacaggaccccggacaggaaagtgacgagacagagacgctgttcagtgcgtccatacactcagggacaagagacgaaaaacgcttttggggaaagcgacagaagccaaagagagaaagaagaggtacgtggacgaaggcttctgcggttgcaggtgcgggaagttggaggagaaaacaggcggcagagactgcgtgtcaacgccacacacaacgcttgcggcatcacctgtcgaaaggcggatagagatggacggagacgaaggaaaaccggacagaaaagaagcgagagagcagcggccggcgaggcaaacgacgaggagaaatgggaggaaatcgccggagagggccgaggagaaagaggagtgttgactcgggtgtccagacgtctttcgaaacggggaagctccacagtaaggagaagctgagtgaaaagaagaaaggggaaaacgtaagacgacgtggcggaagaaacaaaggatgcaggcagtagccgcagtctgttctggagaccgcgagagttgatacacggaggcaaaggagaagggaaaaggccggaaaaaacgaaaggaaagcagaaaaatgaggtcaagggtggaaggcagaaaagaaacaagagggcgaagaccgcgttttccggagaagtggaaaggaaggaacagacgggagacggacccgaaagccgcacatgcatgcatcgcgggcacaatttgtacgctttcgcgaagaggccttcaaatcctcgcagtgcgcgtcgtagtctctcggcctcattttttgtgggggcagagaaaggatccctgtgagcaacgaagctgcacatatgcaggcctatatatagtcccgagagtggctgccgacagccgcctcgcgcctgtctgtctcgccatgcctccgaatatacggcggtctctccgcgttaaaaacgcacagtgtggaggccggttttcggggtggcggcggagcagggggaggcgaagaagtcgaaatttcgcctcgttcgtagtgttggatcgcggctcaggttctggaggaaggaagcggggagattctgttcgttttccttcgcagaaaactcgcacagcgttctggatcgcccggcagacgacgccgcaggcactgtgctgttcctcgtgtcctcgcgctcctcaaaggcgtggcagaattcgagtgccaggcgctttctgtcgcgactgcggagactgcctgctcactctcgagagcaaatatcgttttgcgcacatcgagctggtttctgtcttgtgctccgttcctgtacaccccgcgctctggttca

SEQ ID NO: 2407 - DNA, 1445 bp, Toxoplasma gondii
aaataacaggtgtacttataatcaggtgtgaaacttccctcgctcgttggtctccaccactcagtaatggtacgactgccagcgagctgacgatctcagcccaatgttccaacttcttgaggtttctctgcattgataaacataacttattctatctcgacacaacgtttgtcgagagattgcagacgacactgttctctactatgtggctaagcgtcagtccaacagtcctcaacggataattaagccttctccagaaggcgcgattttgtcgacagtacaccaacttcaacttcttcctgtcgctaccgtggcgccgcatcagcagcgacgttcagtttgcagttcttcatgtgacattggaaatacacgaacacgcagtactcagatgtacggtaacatctgcacaaaaccaagcgatgttcacagctcctctcgtcctaagcatccggacactagttatcagatggaaatgagaaagaaaggtccatatgaacgcatggaggatggagaaaatatacttcacatgaagtccttgtccgccttcttttccactatgaagagaaaaccagtgatggagacgacaggggacgttatgcatctgacgtaaactgtacacaggcggcaagaccagacgaactagtatgccccttggcaaggaaggcgaaggttgccaactggggctcagcacttctagctgaggcagaactaaaacaacgaaattccaagacatgcgagcgggtgccagtggcgtctatcaagccagggcacgagcctttcggagaactgcacatgcactttgtttgttccgagaaaaagaatacgcacaacatgaacgcacagccggaaggacatgcagggctcacctgcttgcttgtcctcctgtttcattattctcgaacagacaagagtgaccagcttctcgacacgtgctgttctgtgccgtctagcgatagaagtatcttgtcttgcttatgatctttcgatgctgcatgcatgcgaaatgaatgcatgcggaaaaacatgttcgctcccgcttgagttcggtgcgcctcaggcccacagaaacacattgccgtaaatgttttttccatggacatgcatttgaacagaagcaattagatatactccgagtgtgcctgttatctgcgcatcgtttgctggtgtgccggaattaaacagtcttgtcctgctgcagttgtgaaaaagccgctgtctcatcgagtccgactgagcacacatggcgagcgtgtcgttgcagcacgactgttcgttgccattttcttgaaaacttcctaattgaacttgtctttccctcgtttccgagaggcattgctctttgaactagacgtcttgccgaaggaaaaggatgcgtgtggcaactcgaggcaggcaggaacatttacggtgtgcggatacttgaaagtcggcacaccttcgctcga

SEQ ID NO: 2408 - DNA, 1963 bp, Toxoplasma gondii
atgcagccttgtgttcagttttcagcagtcgacagaagggtagaagggggatggaccatatattttcgggcttccgtctgcaccgtccgcattccgcacctgagccagagacaagcgtcagcagctcctctcgtttccggtagccgcatcttgtttctaagcatgttcactacaaccgacactcccacgaaacccagacttctttgtcttgtcggtgctttttatgcccacatttatggaaccaagaaatatgacacttttcttcgtctttcgctcgctacctgacacgacgtgattcaaatcgagaacaacggccgacgaatagaatccttgacaaataccgacggaccctttgcacgagagtgacagattacacttcctttcaatctacatccggcaccagtagccccacgttctcctatttctttctggtctgtagtttcagattatgtagaggaacatctttggtggtcgcctgctgtctcaaagtactatcttaatggaaaagcttggcacggttccagcattcaacagaactcttcgacagcgttttttcagattggccatgtgcgtaggtgacagaatgtggttttacggattgcagtgtcaagtggaagaaagattactggcataggggagtcctacggtactcctgtgtataggcttaagcccttgccttatgacaaacacaacggcacgagttgagcttaggggtgcagcataggtgtctgcttcctgtagcgcctcagggggcactagtctgagttgtgcccaagttttcgtcaatggtggggatgtggtagcgcacagtaacaatgtttcaaagacgtcgaagacatgaaataaaaagtgagctggaaggccagttcaagacttggaaacgacagaagccgtgccgcacaagcggcatcgaattatgtacgtgtatgtgtctatataaaacactggagtcgcactcgccgtagatgaaaccttctgacagcctctctctctcgcgccgactcggtgcttacgaatatgtgtgccagcatgcgtagatatacctatactttacagaattgtacacaagatctcgtcgaccgtgtataggttttccattgcttctctacgactgtctcagtagtgcatgctacttgggtgctgagcatattagttacggacaagagctaagaaggaacgacggccgcaaagtatgcagtcccgaagcggagcgagcgccagacggtccatggtgtgtcggcgcatgcgccccgcatgcaagaaaagaccaaatcgaaggcatagtccgccgatgtggtaggaaaacgaatggaaaatggagcggcctgtctgggacattgcttttatgactccagtgtgttcgttggtgacgaaagaatgatcttaaaagcggaacaatgaggctgactgtttgagtcgcagtcactccatcacgcgccatcgaccgcaagccgcgcgccaattccatagcagcagatgcacggtcacttggcgttttctcttttctaccctggaagcttcagccccgatattcctttctttttccaccattcatctcctgttttgcggaggccttccttcgccaaatatcggcgttccctctgtcggaaaccagcggaggcgtgcatgcagccgatctctgcaactgcgaggtgcatgcgctgtgtctccgaattcgcaatctttctgctggatcctcacgatttccaaagaccaggccgcaactcgtctccagtgggtttgtcgagctgggtagcacacgttcctcgctcctttgatttctcctctggctgctgccccagacgagtccctctcgcgtctcgtgctcctttttttcctgttcccgagggcctccggtcctggccttcgcgtccgtccttccgggtctcggcgtcctcttctcgttttccttgggtgtcgacctcctgagttttcgttcgcttttttcgctcgcagtgcgaga

SEQ ID NO: 2409 - DNA, 1684 bp, Toxoplasma gondii
acgacgtttgaagtgtcggaccaactttcacgcacgacgataacaccgcataatatgttaggaaataccattcaggtacgatatgaagcggtgttacgaacctgtctctacccctaatggtttgttggaacaaccgtggcttctggaaggaattggaagaattcatttcgttctgcagccacgtactctacagacacaatctgtttctcgaacctctgcggctgtgcatgactcctccactcgtagtctagaggcataaatcagacctctgagtcgtttggcctgacaaggaaactgcattcttgttacagaagactaaaagtggtccccatgccgtgtcagaccagcatccgttctgtgtaggagatattgtgacactcgtggattgtttagcactccatgggcatccattcttgtgctgtcggtgcgtagtggcaccagtctactaaaagctcttgggtgcgtttaggagacgagcgcagctgcgtttcttgtaaacccagagcacatctgtaaacgcacacttgacggcttttagggtgatttgtccgaaaggtgtcaaccacgggagcgtactcgacaaagtaagaacgcaaacggactgttacaaccgtttcagggtaagtgccagagacaaaggatgacgagctcagcggtggcgaagtgtgtacacgagtttgctgccaatcatcaagtgcaagtgaacattcttactactgtcttgaacggcaatcaataagaactagcttccggacagtattttcccaggaaacgaatcagcgttccagctcgctaaaaggaaaaatgccagatacacgtaagctctctgcctgaacgacccgctgtactgaccatgccctaccgtggtttgcttttccggaatgagcatgctttctggcaactcgcggaaagcgaccaggacgaaacctgcttcgagggacgaaggtcacgggctgtttgccccacagtgacagtgatggcctgcggagacacgagtcccaggtcctcccttgtccagaacaacctttggaaaatttgtaaaactcaaatgttccctaaattgacgtgcagagagtgatggaagcctaaagcccgcggatttcttctccaagacccgcctctggacaagcagtgtcgttcaagcttctcgaaaaagaggtgcatgcgcaacattcctgcgagtcgctaaagcggtgttcctggccaccgtcatatggttttcaaatcggctgggaactttgactgccgcagcgctttgtctgtgatgtgcaagtgtgtccgggtgtctgtacaccccagttctgaacgaagtcgatgagtcgctacgggcctgtgctgtcatttttcgaaaactacccggaatctgagacagtcgcgaccctctgcaagccccttcaggcccgaagtccaggacgcaagactcgaatcttccagactctttcgctccctccgttttcccggacgtatctttctgtcgggcagataacttggtttccgactttgttgcgactccggcactgtgccaacgcggacaactgtctccacacgcacgtgcacatctgacgtttgtcctcgagtgcggcaggccttcccgtactctgcaagtgaactctgcccgcgactttcccgggaattctgcaaggtcgttccgattttccttcgttcccgccggcagttcgcacca

SEQ ID NO: 2410 - DNA, 1916 bp, Toxoplasma gondii
gagaatgcgcaagccaaaagatacagttgtcagtcattctcattcaacgtctctctaattctccgttccactgaaccagtgcacgcctcccatcgtgtctatgtctttttgttcatcccgtgggtttctggtccctcaaaaaaagaaccaagtcagctgcgccggtaaaagtgactaaccggaagctgctgaagaagcagcaagacagctgcgttctcctatcgactcgcatgttggtggcatatgcaattcaccactactgagtttcttctgcggtatgtttttggagagtggaacgtactgatcagtattgatgtggacgtaacataatgcgatctgtaggcttggaattccttctttcattcactgtaggaggtagaaaaggcgtagttgcgggtaatgcaattatggatgttgcactatatgatacagactatctttctgcacacttcatctttgcattgtctcttggagcaaccttggcgtaaacggttcagttcgctctcgacacacagacgagttagctgtgtaggcacacgagccaagtgtgtacggcgaattccctcagaactccgagatgttttctcgtggctttttgaaaacccccgcacttgttctctggcgacgagatagtgcctgcgcagccgctgctcttttcaccgaacaccgggacggaatctagagtttagatttccacctccaagtttcattttatcagtctcgtgctctgcaccacagcacggaagcctccagcttcttgtcttgtgtgtgcgtcgtctgtacacaggcatcaacatgtttttcgtctccgtggaggagaagacccatttctcgccgcaaagaatcacggatcgtatgaattccttcatcatttagttctacgccaacttcttcgctctctgctgcctcaaaaaactccctacatccactgtttttctttttactcaacagtaaactctttcgcgtgccaaccgaccactacatccacatccagagctgtgcctgtatagggaaaatgcgttgcacatggatgtagacgtatttctgcccatgttagcccatttacactttttaaaaggtgcatgcgggacttcgttcccactacaaagatgcatgtgcaggtacgttgtctgccacagttgcatgcaacagaaccgttgactgtgtgcatgcattcgaatcgcaaacggtccgcagcacagtgacggtgtctccggatggatttctcgaaatcgaaaggatgccccgaagttttttctgttccgaacgtcacacttgtcgagggaaagggaagaccttcgctgacttcgagtttgctgcctggtcttcgtgagggacttctcgacgtcctttctgccgttctggattgcgccggtgccgggcatgacttcgaccgttttccctagcaaatttaccacgtctcgctgtcttcaaatatcattggtgagtccatgtcgctctagttttcgtgtctactgttactcgagagatcagcgaaaaccgagtctcctcctctcgcatgtcctaggcgcgagggtccgctctaccttctgacttgccggagacttaggaaaaggccttctcacttctttctggcgtttctgtctctgccactaccttttttgaaatcccttcaacgccccgtttgctgcctcatttcttccctagtttctaccgttctgcgaaaaccaacttctctcctgtctccctaacgtccccagcgcgtctccaaagtctcccttggtgcaccatcggacctacctctgctcctacacggagaacatgcatgtagcctgttgacaagcacccatctatgtggatttctcgctctctcctgagtcgatttttcgtgcgcgaacctcgtctccgttccgtttttcgcttcgcagacccccgctgttcgttcttcgccgtca

SEQ ID NO: 2411 - DNA, 4286 bp, Toxoplasma gondii
aaacaggatggtgcacgatggtgaatggctcggaatcaacgtcttgaaagattgacccggcgacgcgatgtcgtctttagaaaaaaacttcgagaaacgtacgaaagagcacacaaagcgtcgcccacaacaccgctctgaagaactccacagaggcgatccgagggaaacgaaaaaggatctactttcttgcaaaaatagacaccttgcaatctttactcttttgtgtctcccatgtgacattcacgcacacaggaacgccatgcgtatgcagatgctcacagaaaaccactcacaaaaggtacacatacatggaagtatacatacatatttacatatatatatatatatatatgtataaactgacaacagatgtgtgcgcatgtccgtagctttgtatgtaatatgtatgaacgagagatcgacgtttcttgtagataatttagaaaggaaagtccacctgcaggtccagcggattcaaagggaagtgcacgtagcatggcgggggttgcaccttgggagcacggaacactggttgtcgcgttttcccttcagacgcaacagatctctccccatagggccgcacccggaggtttttggatagaagaaggtcggtaaaagcgcgcgaaagtcttctgtgactgcgaggaaaaagcaattttgttcccgcggtgcctcggagaaggcaccgccgagcgtcgcacgcgtcgttgggctggaccggaaagaaactcggacaagtgaggagacaggcgagaaaaattggagtttctgcaccggcctacgtaagacctttcatttccatgggagaaaactctcaaaatccgaagaaccggcagatttctctgggaagctgcagacttgtttgcgcgtgtcttgtagtggcatgccgcgttgaaagcgagaccgggaaaccgttttgaagaagcggcggcttcactgtcgactcatccctttgttggcatcgccagagagtcgagagtttcggcggcaaagagacagagaaaaaagtggagaaagagcgcgaacgggcaactgaacacaagcacacacttggcgggcgtcctcgtccccgggcgggcaggagggagctttcagaatttgaggcttccaggtagcagtggatttcgtttcaccagtcctttctcctggactctcctctgcacttttccaagttttctctttcttcggctgcaagcgtgtggcttcctcctcgaaacccaaggcgagtatttctctgtagcgggcagatatcaacgtcgactttcgctgtcgtgtgtctgcatgcaaggcacatatgggagcctcggagtgaggcagcaggagtttctggccgcggaatttccccccgcttctctccagagaggacaaggcttcacagtttacacagtccgtcgcggtagatcgaaagatgacgagccttgaggcgacgttgggggctgcagaagactgaacagagaaaaaagttctgacgccaacgttctgcagcttggctagcggagttgcctttctcggagactcgataaatgcctttcgagttccgtctctgtccgccggaactcctcagttgtgtgtgtgtgggtgtccccgctacacaaagagctgaaagcgcggttctacactgcgactcggtttcttgcagccggttctctccagtgactcaaacggcacctggaagagcgagccggaagtcctttgcccgagacattatccacgcatgtccagtgtgcagtgtggtctcgtttcgcagcgactgcgcgctcgtttcttgttcccgcgaacctgcagaagaagccgtaggactaccgcttctctcgagtaaacggtctttgcgaggtcggacagaacgcatgaactctgcggtgcgtgagattccgccagaatcacggcgttcgcaggttgccgcgggtctcgcaaaaaaactttttgcagaaagcggacatctctcggtgcatgcttctcccgctagagaatcaagggcaaacgcaggaacacccatgcggcaggccgcgcctctcttccgccgtgtgggggctggggagttttagaagactcctctcggctttctcctgtctgctctttccaagtgctccgcgtaaaaacggagatgttttcacagaaacttccaccagatgctcccgtgaaccgcttggtcacacgagcagcaaggagcagactgtccggaacgccagcctgccctcggcggcctgcgccttccctgcaccatggcagtcttccttggcgtttggaagagatgattctatcatgccttcgtccagaaaacatgaaacatggaaaagcgcagaaagcgtctctctctcatgagttatagccggcacacactggcagttggcaagctgcgaatcctaatagacgctccgcagacaaaagactgtatacgcatgcatatacatacaaatatatatatatatatatgaaaacatatgcataggcataggtatatatattcgtatatagagatggaggtatatagatatatctgaagcgaggtgaatatctgaaagcagatgtatatacatatgtatatatatatatataaatatatatgaaaacaggtgtatatttatattaaaatagatgtgattttcttccgactggtggaggcaggcagtggatatcaggaaggtgaaggaaatgtgtgacctctggaatagacagaaatagacctacgcaggagaatacgccttgttttcgctagggacgaaatggttcactcacgaagcctttccgagaggaaaaatgcatttgctccccaaacgcagcgctcgagtgagtaggaaccaacaccgtcttccactccagcgcgattctgaagtggaaatacaccctcgggatctggagaactctctcttgtgcgcccggcagaagcctgtgacaagcagacaaatgcaaatgaactgaagtagcctgttagtcgccaggcatttgctgcagaacgttttcccccccctccacttgtccctacatatgcataccttatatccatatatacgtctttattatatatatatatatttatctatattatagtataatatatatatatatatatatatgtatttgcagacatcttcggctggcgctacgtccgtcgaggaagagaaagtctacagcttctcggtgcactcgagagaagatttttttcggagtgtatatctgcgaacgctctgttattggattctccccgacgtgagagcgacgaggccatcatgtcttttgctctggcaaagtcacaagaatccggttctcacgacgcgttccctggctagttgtctctcgcgatttccccgcgactttcgacggtttggagacttaggaaagtggaggagacgacgatgtttctcggcgcttgattgactgctttttttgcttgtttccgtcacctgtgtgacgactttatggtgtcgagaaggttttcaagttttctttggaggctcggaaaacgacgcgtcatgccccgcccctccgacggtgtgcgtagggttacaccgcaagactgagagagaagaggagcttggtactttttttctccactgtctgcgtctctcctcgcctccgtgaacgcgtttttccgcggtttcctgcatttctttcgcgtcgttcaagcggactcggagacattttccttcaaaggatgacgggagcacccgtccgtcctcgtcttcttttccctcgctcttctcgcgcaagtcgattgtccagctctcgctgtgtgtctgccgagaccttcgtttcgttgagggcagcgtctgccgtttcctctcgcgatccacgcctcgctgtatccgcctttgctctctcgcaaaaatgtgagatttccccgagacgcgatacactcagcgcctccggagaccaagcgcatcgatgatcacgcttattctctcccgccaccactaacgcgtttccttcttcggtctgtgttttccgatacttgcttcgacgggattcgaacagctcttcttcgcgcttcctttctcttgcttcgccgccctcaaaaatctgcgtataaagagaacctcagaggagcaaccgctagcaagcagcctgcatccgcagagagaggaaaaagacgaggacccgccggggcaactcggatctcctttccggggaaacatgacgcagaagaacgtcgaaaggatcgtccattccagctgcgcttgcgacagaggagacgaacgatagtcgcgtctcccgccacggtgttctcgtctctcctctttgcttttctctcgttgacttccttcgtttctcctctccccgcaaaa

SEQ ID NO: 2412 - DNA, 2510 bp, Toxoplasma gondii
tgtaccgtcatcccactgacagttgacgacgtgttctgtctcttttccacttcagaaaagtagtcggatcttcagtttgggctctacagaagccaacaggatagctgcaatgtggcctgagactgtgaggcctatcgacttcgcgcatgacggagtatactgcatgctgacgtaaaatttgtggatacacactcccgcactcccagctccgtagattcgaacgaagccgcgcgctacacatggcacaatttcttgaagcaacacagagctactaggatatatctaggtccgagagttccatcaaaccaaagccgcctgtaggaagaatacaattcagtgtggttaacatttagaatcctgttcaactggtgctacgagcagttgagtggcgtcgccaggcactggaaacgcacaagctcttgttcactcgttggtcttcggctattctcgacaaacgacattcgtgtttttttccgtccaccctctcgctgaggtgtggatacaacaaatacggcctagagacctttttacaacggagagacgtacttgcaggtacctcactcgcacatctatatgataccttttcctggctgtatgctgtcttttcctatgaaaggataaaccgcatagggttagtcggggcctaagataagaaatttattgtttcttgggcatggacagcgagataattcgggtacacacttgctctgaaaggcacacagtggcgcctcggaataccttttccccgtaggcttctgtgtgtgttggacagagctgtcagcaaccccggggtacgcgcgtacccgaaactaagcgtgtgcgtgtacgggcgagagtcgattgtcagccattcatcccaggcaccaacagcgttcatccaggtcctcagttggtgtgaggccaacaggaatccaatccgtgtactctgtagaaaccaacacctggaatgaaactatcaaagttaaagactttgatgcgatgagtatgattcagacaaaagcctgctgtgtggctgtctgatgtcacaaccaacagaacgcgaatccggattctggaacaggagccacgaaaggttgtcaatgccttttgcctctgcctctaaatttcaaggggaggtagcggatacggggttttaggtggcatctgttgggaagccgtgaggatctccgtcattcctcttgcttgtctgtgacgagtcttgcctagactcgcactaacgccgtcgatgatcgccgcgagcaaccacgcaacaagtgaacaatgcgtgcgactaatcacagtctgagaaccgagatgcggattcttgtctgaattccacttttcctctcacacagatcctgcccccacatcttcaaggtgtagagccaaaataccgagagcgacggggcgttaaccctcacccccccgccgtcatgcactgaacggcgttcgcacgagcaacagatgcgacctttcgctgcctctgtcatccgcgtagatgcggtgtcacgctttttctgttttccattgtgtttcggaatcgtcgacgtccatcctttcggcaactaagtccttcccttgctatttgctcgttagccgctcaactctcctctatttaagagggagcgttcatgcgggaagcgttcgacatgcgttgacctttgggtccaaggttcccgcgagttttctgtctcgtcgcgtctcccgatacagaacatcatcgtctgagcacatcgaacagagtattgctgctaaacgcggccttttggtaacactgaaggactttccaccggcaagtctcgtggttttctaggatgaacccctgaacagttcctgttgcctcgcatgcagctcgctcgaaaagggaactcaacagctggcgcaagaaagtgagaagggtagcgatatggaccctttcgttttctgattgtggacggagaaaatcacgaaggacgtggaaggaatgataggatttcagcccgatttcgtgttactttcaaccagcgtttcatgaaactccattttttcgggtcgcaccgctgccaaagacgagcactcacgacgctggcgtgtggttgtaggggaacactgctgagtttcgcgctgcagagcgctcacacgttttctcgagttcgtttttcagtctcaatcctttagaggttgtgccgtgcgccattccaggagagaggctgcactcgagcgccgagtgacagctcccaaagtatgccgggatacttcggaacttgggcgggttcagaagcaaagaaaaagcaacgtgatgaccagactgataggaggagttgcgcagtagcaatgtctcgcgtttacgtgtatgttcaagggttatgtgcgtcgataccacatcaatgagaggcgctccagttgggtgggtgtgggaaagtcgttcacctcccgcgccagctcctggatctggtggctcgcgagcttgaggtgcaagtactcctcgagcagccgtgccagagtgtggcttctctagatcagataggctctcagagatccatcttcgacga

SEQ ID NO: 2413 - DNA, 4017 bp, Toxoplasma gondii
ttgtgccctacagacacaggcaaagaacacacatttgttttgttcgtttacctccacctctgagtagcttcgtcgttcgacccccagtacacaacattcctgaagaggtcttggacgctcgtggggacatagcggagtagatccgaaggcgtactaagttccgacatgttgaggacagggtttagaatttctgacagaaacaaggcagccaacacaccaacggaaaccacacacagtaaacgcagagatctacttcttcgtgcgacgtgtgctacagagacagtgaacaccatggatctctgtatttccagcccagtacatggttgggcagtcatttggtgtcatgtccagcctgcactcaagacggtaccaagaaagagaagtgcgctcgtcaccaatttttgtcgaaacagggtggaagtggtatacgccgtacagttgtaaatgcatatatatatatatatatatgtatatatatggaaaaagcacaagccggaaaaagtgcattacaaatcggagaatgctgctgctacctggtttttgtgcgtacacacatggcacatggtgaccgccatcgtatgacagccacgatgcaaagttggcacgtcagacgcccttgcgctctccaccaacgtaatcgtatgagaggcgagaacggaacccgcagtaattcctccacggccatatgatttccctctgcggttaccagtgtcaaggaggcaaggggaacttaagaaaaatgacattccggattggtctcacaggatacctcttgtcgctgttacagtgggtatcagatgcgccgggggaaagacttgtcaacgtggacgaggatatatccgtagcatgtgacagactcacaagagacctaatacagagaagatacaccattaaacggcggccgagacaaaggcttttcttcatacaggaaaaattgctcctcacctctccagacaacacgccgcttttgcttaaaatcgagcctgtgtgttcagcagcggtgcgcaaatctttcacccgcagaacagccaagtcgaaaaccccattaacttcgtctacagcttctggcaaaaaagctgctagcttttgggagctgacgcaaacagcgcgaaagatgaaccggctgtgtcccgtcacagcttcatctagccgtcaactgaggaaaaccacagaattaccaaatcgctaagaacgcgcaaggccgcggtagagtgctacagacgcacgcagacagacacacaaaagacactgtatgtaaagccagcaaagtgcgaaaagacgaaacagtttccgcgttttggccacacaaacgcatctagctacccgaaccagcgaagttccgacccggtccccgctcatatctctccccgcttgctctagcgttttgactcccatttctcactgtttccctctctgcagcgcagttagttatctcgcgatgaatagaaattgcatccatcagaatccagttgtatcacgcctgtttttgatagtgtttacgcgatgtgccagtgtgattctgtcacagagattgagaggaacccacgtgctttgtttgcatctgtttaaccgccaagcaacagggggtcaggcctttgacgttccagctgagaactcggtttgggggcgtacagttgaagccaacacgtccgtaagcatgcaacttaagaagcttctggccggatcgggacggaaaatcggcaccaaaactgaaaaaaaaggctgaaaaaacccgaacgtcgaaagcctcgctgagagaccgctaaggggacgtagcagttggtagacgacttcaacgtcaccgcagtctcacacgcgatgtcaactcacgcgcatgtcagaagacgccctttacatgccatgcgttgtgctgggcagcacacaagtacgtacttaatgcatgtccgcttaagaagacaagatcggaccacaaatttcccgagtacgccaaaagccgctatggatagatatctagactggtctccctttctccgctgtaccacaccaaacacgtctgccgtgctcgacagaaaatactcatcgtaaatacagagggttggaatgcagttggttccacaacgctctcccaccctactccagtgctgcggcttcgagccgaagaagggcttttcatctgctagaaatcattgcagtgtcgaagtgcagtatggaccgccaccgtgtctgtagctctgaaatgaaaggtgcagggacagggattcatgctggaggttataccggtgcttcctgacggagcacatagacagttgatgcttcactggtaagtcgacactgcgtaacaatagtggaaatgtctgaattaacgagtgtctgataagccaaagtctaccactgcagtggcagtgcgccacgtgagacttgacaacagacgggcagatcggatagtgtcacttctgtgcgggaagacgatgtaatccttcgacgtcattggccagcagccagaaagcagctctgggtgccatgttgcagcaattttgggactactgcctttcctggttgactgtgttactgccttgaactctaatctgcccagatgcaattgcgttgcgccatgctgccgtctgattgagtgtctcatctgtgtccgttcggaaaagtgtaacggtttcctgcagggaagaaaactgctccttaaggaacaagtctgctccttaaggaacaagtctggtgcgacgttagtcgcgcaagcacacatttaggtccttgatgggggtgaatttggcttccgttttctaccaattagatgccgcggtatcaaaaggctcttcaaatccactagcaatcactgatgcatgtcggcacacaactggtttcaccagtatgtcctgtatccctatgcctgcagtcatcgtggcattctgctgattccttcactggcctagctccacggtgtctggtcgtaaaccaagcgtgcgcgtccttcgttgagccatgtatgtgtctgtgagtgtttggtgcacaatccgtgttctaagttgctgagatcgtttatgatctgtaacaaacttcttgccccgattctgtcatagcattcatacacccccctctatgcacggtgacggcagagtagctagctgagaccggagaaaaagcgtgtttctttgcatgggctgcggtccgtcaagacgagactgagagtcttgatgaaggatcgatgcatcactggcaattgtgcgaaaacatgtctttactgaagtacatttttgtttaggtagcagtttaccttttttccttaagggtctttgtggtcttgctcgacctttttatcgtcaatccgggcgcggccaccgcaagtgctcggattctcgtcgcttcctcgcagagtaagaaggtttcacggaaatctggtaaccattccggtctaaaaaaggcgcatcatgccctgttttttcgtgcttccgaattctcttccccgttaaacttgccaccacgtgacgaagtgtcttatcggggtgcatccaaaagaccaaatcgacggcttgttttcggtttgcccggaagaagtgtaacgaagcaagaagctgcttccatcgtctccatacgaaacactcagcctctttgcctccgaacgaatgcttttttgcactaccgtctgtctttgtccttcccctgcgtcttcgcttcttcaccagtcagcaccgttttttcgacagaagcaacggcagcgaactcgttcctacgcatgaggattgtgcgtcaactgcgtaacttatcgtcaacaacagaactctgttactcgaaagcactgtattcagaatcagacagcttccaagtcctaaccccaaccaagcagctttattcttttgcatcttcttcgttctctgctatagttactggggtcgtgtccattagcgaaagcgcatgtgtgctaagagttcttgagcaaacatcatgccggtttctccagtccttactctctctctctttgcattctgttgcatcttttgttttagttgaaaggtgataaagttcgttgagacgttctgggtgtcaaga

SEQ ID NO: 2414 - DNA, 3119 bp, Toxoplasma gondii
ggaacatttgagaagtgaaaggacggcatttgccattgaggagttgtttctcgagggaggagcctcggaggctcccagcttgccgggaagacaatttgtggaaacattcatatcgagaggaaggtctcgacctggcatttttcgagccgtttcagacctcacgctcgagaaacaaagagacaagaaaagttgacagacacgcagaaaccaagtagcgcgctccacgggagaagttgcgcctcgcagtagacgacgcacagatccttctccttgagtttgttggagcactggagagaagaattggagcgagaaggacatcacaaaaacgcgtttccaacctggagagggtgccgagtcgtgcagccgacgacttgcttgcgcgtccagttgttttgcgaggcatctcgcgcgtttcagcaatctcgaaatgacacacttcagagcggtggtcaacacagcgttttgaatctgaacccaaaccgtcgatcggctttccccgttctccaactgccaccgtttatctgtctcgtctgtctcggcctgctcctcggctttgtgcgcctacgcagcgtcgaggtcaagagttcactgtttgtggtgactgagtcgtcacacatgttgttctgtccgtttgtcccttgttggcagtggcgttttccgttcgttttttcccgctcctgttcagagcgcgttgacgcaggtgccgaaacggcgtttggagaatccacgaagagtcttctcgcagacctggccgtcggaatctctgaaagtcgcagcgcctgcgtcgtcgcgctgccgacggacgcttcggcgtctgtgcgtccgcgtctcggtgcccccctacggaaaatattttttttcagttacttacttccgcgggacaaaccgggttctgagcaacgaagtggtgtgaccaaccgtcaagtctaaagccggttgaaaaagccggtgactctgattgatggagtgcgacaagactctgagacattttccgcttgaaccgttacgctcgtgtgcatcccatcgtccgaatcgattgtcttctgtattcataggggccatactcaagtcgacagagatattgcgtacgaccgcgctggttccagtttgtgtcgcactgcacaagtttcgtttcgcacaaaggacccaacctttccaccccctgagcttgatttctcgtcgttttctgttcggtctggagcagccccccgaacccgcagcgtctgtagtgtcccgttccttttcttctgccgttctctgtcctttcaagtggttctttctccgctgccttcacatattccagtttgtgcacggtctcgcaaaggctgtcatgagctccgaagctcgggtacagccccaagacgcgttccactcacatcagcatgaagcgtaacatatctacatatctacaggcagaagggaggtcgtcttgtgttccgacacccggtgacacagagagtctgcgaatgccggaggctaattaccgttcaagcgctcagagacacacatacgatgcgggaaccatgaaatcgcagtttcttgcgatagaacggggctgtcgagaaaacaggtgcagtcgtttcgtatacgtggtttcaatcgtatatgcgctcgaaacagactgttctccggtaacgcctttgaaacaaatagtcttcacactctgctctcttgaaacagtgcgagcgtcgtgtaaacggattcgcaagcgtctcctcgacgaggtgtgcatctcggctgtgtccgttctttctccgttctgattcctgctgtgcattcgcgttcccctcccgtccgttgtctctccgtcttcggatttctgctcgctgcgtcactcattttttttctcctcggtctcttcatgtctcagcactcactgacgacacatggcacgctcctccagactcgccgcaagtcctttaacgaagttcggacttctgtttacacaggagatacggtgtcggaccgagactacgaattcagaagagaggcttcgtggtactgacacccaaactaacatgtgtagtgcgcttcgagaaagccttttctcttttgaaggtgttccatattttccctacggtcttccacattctctgccaactcgcgtcttcttcatcgcgtagttcaccctcattcgcatcttcgagttctttcttctttcgctcaacccaggaaaacgcagcgttacttcctctgttcccgctctcgcttccgccctcgcgaaaaaacagagaacgaaacagtccttcccttcctgaaaaatgcagaagagagcaggagaagagatcgccgtggttttgcgtcctcagaggatactcctctaaaaaaagacagtgtgtctttgtctcagatccagtttcctcgtcccgatattttgtcttcactgcatgcgttcccgttcggcgccgatataaactacacacttgtgcgcgtaaccgggagagagactggcagaacgaccgcatcgcttctcctggcctcttcactgcacaattcagctctcttcgtccttctctctgtgtgagtcttctttctagctctttctccattccattccgtcttcgcctcttctgtcgcggcatttttctccgcgggcgtcgctctcgcccagacgagtgccggcgcatgcagcgcgcaaagacgtacccggcggagcgaaacaaagacggagagagaaacggaaagagaagacggaaccaaaagagggagaggagagaagaagagaaaaaagagaatgtcaaggtgggaaagaacgcatgtggagagcgacgcctctcaacctacgtacagccaagtctctcgaccgccatgtgaccgaagcatagcgttttacaacacgagattggaggctcacctaatcaatatcgctgtgaacctcaccagaacatgtaattgtgttgagagaacaataggaactgtttacttggtgcgaatgccgctgtgcagaaaggaattcccgacatcgaaacgtgtgtgtcctttgtttcagacatgtcagaatcgttgatccttttttttccagcgtcgccgctcgcttcgacctcttgccctttctttctagcctcgttcttccgtccttccgctcgctcagcttctctcgatccttcagctctcgaaaa

SEQ ID NO: 2415 - DNA, 3482 bp, Toxoplasma gondii
agttcttgattatcccgatgtaggtgtatattcgtaccaaacaaggcgccagtgtttctctgaaatgagttgttaagatgatgttggcgactgtgttgtccagatagttaccttcccaaatatgccgcacgcagagcttcagcgagctgctctcgtgagtcctgagtcacggaatcgtacactctatagcgcaccgtacgctgtagtcttactgatagttcggcgattctctgagacgatcgattcaagtcttcctcgatttccttccgccgctctctttccatcaacacttcctctttgagcttttcgaggctagcggacgactaggggctgtttttttattttgtcccttgaaaagctctagagtgtcataccgcgataagttgttctctcaggtgtgtagtatgctgccgatatttgtgctcgtctgcctgatagtcgtccacggcagccttaagcgcctctagctccatctgcatttcaagctgctttttcagaacgtcactccgttctttcttgacatcttcattgaacgagagcgacatactgaccgtggaaaacaagccgcgtgtcacccggaatgaaagtaccttaccgttcaacgcctgctgtagatcctcaaatttcctagtcgcttggccttgcagtgagatgatcttgtcgcacaacgtagccgaggactccatatcgtggtcccgtgcgcgtgtaagagttttacaggccttcagctcctgtatcgcactgtatctttccagctcacactgtttcagcctggcttggattgactctaggagatttttgaggttatcgcgggtggcctgcagcagcctatatgctcagcctcctttgtggattgggcaatatggtcacctcaccttcagttcatcattctcctttgacaaaatgcgcgcgttttcgcttgctatcccgcactcgatggtccggtcaacggccgcaagctcgagctccttagcattgagatccgattttagcgaactgatctccagccgtagttctacacattctgcttttttgcgtctttccgactcgcttagtctcgcagcttcgtcaataatgtcaagcagctgagtcttgtagcgcactatggacaaaatgtccaagcactcctccggttcaaacatcttgtctacaaccattttttctcctgcagatggacccaggaagaagccgttgctggcaagtacgtccacacaaacgtggcggagtgggcgtgaacactttttttaatcttggccgctatacattagggcagccacccttgtcgatgactatcgtcttccatagacatccgccaggtgtaatttcaattctctgatagctgccgctgttgttcaggtccgaaaaccggcagtagctacaccgcaagtagttgaaccctgtatgtatgaagatcggcaggagaaatgccgctctgtgatgacaccttcgcctccatcgccaggctgctctgttcagttgtgaggaaggatccgttacttacgcctttgtagccgttcctgggtggaggctgcggtagtctctttgcggagttcggggtttcacctgagtttttaggcaaaacaagagaacttgtcagagttcacgacaatgtggtgacgaacaccggcttttttggcgcattttacggcgcggttttgggtgtgacacgacattaggtggatacatcttgcgggacgcaaaaataatcagtggacagcaagtgcattccgggcgtgaaacgaaaataaaggtatttgtgtcaacccctccctagattgacgaagctgaacgtcatccgaacgcaagcagaatgaactagttgcatttttctgcggcgccgtgagaaagttggcgtcgcttttgtcgcgctcattcctacaaaaggcagttatgatggcagccaaatttagagttactgtggtacggccgttttgaggtcatgtgctactccgctcgacccttctgtggcatactagttaccatgaacgtgtgcagaagaaaaactgtgcagcttcattagcaagacattgccatgtacatgctctcgcgatggcattacgaattgttggtttggcgaacggtgttcaagtttcccttctttaacgcagaggttcgctcagttcaataggttcataactcgagaaaaccacaggcatcctcgagcctaccgggatagcaacgctgttgatccaggcctgtgccatctgctaggtgctgcagcggcatgttcaggtgctccggaaccaccgtttgagtttttcctttgatactgttcggaatggcgcagctcaactcgtcgtgaaggcacatatcgtgacaacgtttgctgccgggtagcaacatattagtggacgaccaaacgatgcgctgtttctttagaaaacgatcagcggctgacaagactggtggctgtggttgttgagactttgccatgctggctggtgagagagggtgtgcccggcgcctgcaaagaaaggaactactagatgacacttgatctacgggaatccctagaatcaacccttcctcacattgatattcccacacatgcctgtttttcgttgtggcaacatgatatcttgaaaatgcgatactatcggtgcattcgcgagttggcgcgaagcatgctggagctccagccaatgccaagcactgcgtgaacaggttggaatcggccaccaacagaaaaacagcaggcatgcctgtagcggtgatgcatgcaactcgcgtcgtctctgtcgctattcccggtggccgagacagggcaaatgaaacgaattcaagagttggtctgccagcgagaagctagtgttttcttgaacaactcaactttttgcgtagctaccccttgacatttttgaggggtggtggtgccgcggacgacgactttttatgggttgcagacggctggcgctgcggcggtttcgcttgtggacatctgattgttcgtgacattcatgaaatgttccttctgcgtttcattcttggcggcggagcaactgtgtagcgtacttgacctttgtgtattgcgctttttttcgttcaagtgcgaacgggtgcccggggtcgatgtcccctcggaaagtgtcgtcttttgcgtggtaaaggcaggagggtgtgtcctcctgtcgtagggagaggtagtcagacatgttgcgtgtcttccttgtctcgagtttccttgccagcctgctttggcacagacacgcgtgagaagcctcgctggccgcggtctacttccgcatccgtagtccaccatgtgatcgccacatggttccatcttctcgctgctgagtttttttcagtgttctctcctcgtgtatcgacgaccgtgtttcgcttcggctcaggcctgcgtctgcggggacccggctccaccccgtgaaggcttttcttccgcagttcttgcgtgtccgtccctaccccggcgccctcttctgggaaggcagatagcaactcaccgcattcgctccgtttcgcca

SEQ ID NO: 2416 - DNA, 1404 bp, Toxoplasma gondii
gcctttcagcgccctgcggcagggagaaagcttttgcactggcaaggagcgcctccctgccggaggcggccgcgaagagaacagcgcaggcagacgttgcttcctgttctgcggacctcggagacgaagagaaggcgaggcgcctgcgcgcgcggctctggcgctgatgtgtgcaagccttccgagcaagaaggcgtcgaagcgaatgtcgacggtgggaagccgagcgattggaggaggaggaggaggctgaagtccctggcgaggcgcgcctgcccgcagttgctaccgagacggccctcatcttgctcgactggagcactcgtgagttgcgcgcatgcagcaggcgaagagtgtcttcactggaggatggaagcgccgtagtctggggacggatacactcaggccgcagtctccatcatcctgcgagacagctgcggcggtcctccctcgcacgagcatgcggcgagtctcctgcgcttctggagaagccgcaagtcacctggtgatcgggaacgacggaagcaaagtcgaggcggaaaaggcgtcagggcagcagaggagaagacgaccggcgctgttcctccgggcccgcgaaaaggctgccgccgggaaggagggggaagaaggcggagaggaagagacgaaagagacgaaaaagacgagaaaaagaggaaagaagaaaaaagaaagcggcggaaagggagagaagactctcggcaaaagagggcagacaggagtgtgaccagcagcaagacaccgaaatgtgatctccgcgaaaacaggtccagtggagagaatcgactccaccggaggcagagagacggcgaggaaggcagcgggaaatgtggattcttctgaggcgagtttcgccgttcggcaaaaaacgagaaagacaagagtccgggggtgtgctgtttccggaaggggagagacagctgtctctcgcatgtctctcctagccaaccgtgtagggtctcgcggcgcgcaacacaggagagacactctccctcgccagtgcgtcttgtgatgcttttgaatgacagtttttcagcctgaagggagtcgggccaagacgctctgtcctcgccgggcagagcgcggacgcctgattttttcgttgtttctgccgcgtgcatgcaaccgttttcacaacgtccttttcttcctagggaaaacttctgcgccggtgaaaaaacaagcagaagcagcccccgagagaagagcgcacagagtacaagaaggggcccgaccagagagggcaagcaaagaagaggagcagagagaagaagaaaggacgaagaacagagagagaagtagaaaggacgaagagcagagagagaagaagaaaggacgaagaacagagagagaagaagaagtctggggagcacgagaggggaagga

SEQ ID NO: 2417 - DNA, 4098 bp, Toxoplasma gondii
agtgcaaatgacgccatagatgtacttcgctgcatgcgttggagagttggggtcgttcacaatccgaacgggagcattcgtgcccggcacgacgccgacatcgctctgcacttgtactgcagaaaagcacacgattgagagacattcgcgagttcgaaagggcaactttgtggtctccacgggttgcgaaaccgatgtagaaaaagttcaccgtagcaagatagtgaaagccacttattttagccgtctcaagaagcccagtggagtggtggcgcagaaagcattcatcggtggctgtcgctagaatcccaacttgtggtgcactggaccgagaaacctcaagacgctcctccgcttacatccagagtattcccggaagtcgaatagggcgctttctccgactgcagcagcttgtttgaatgtatcgctcatctccttgttcaggcacatttggttgaaaacctgccactgggactgatacatggagcaccaagtgcgcacgctgtggaaggtgggggccgtcatctccacaacctgtccgttggttagtggggtcatcgcctgaaaaaagcgagcgtcggacaagccgaggttcatcggaatgttgatacctttgcttcggcctctcttcgaatgtttgtgaggtctgccattacatgtcactgttttgtgtcgactccttgcatgtcacaagctcgcgctttcagtcaactacctgccccttccgtaatttccaccccgcatacacgcacatgttcctctgaagctgagaaacacttgtcaaactcgactgcactcttgaagagttcgtggagaagaataccgcaagatgtagaagggaacacgcagagtactggtgaaaatctaagatctatgtcagcttaccccaggccgccaagtctgtgtccgaaggcttaacctggccagaaacagtgttcatctactcccccacacagccagtctcatccttctcgtctaatgaggaaattccactgtctctgagaacatggtaactcgttccgccgggacgggtcacactcaccgtggcagtcggggcttggagcgcgctgtcctcccgcactgctgcccgcagggccagcgcgtgcccaaggatccgccagcggccatcgagaacagaagcaaggaagacaaatgtgagtgaaaagaggagactgaaactcctagacaagtgtacggttttctgctccgagtgaagagagccactcggtgggcagcggctggtgcagccgcggcaaggcgtggtagcgctagccgcagatcccattgtctcaccgcccgagaagagacgttaagtccccaaagaaacgggggaaaacggttgcgtcgggatctacagacaaacctcgagaaggcagcaattcaaaaaacgcacgacaacaaagggtaacgaaagaggagtgtcgggccactcgcgagagagccccaaccagcttgcagaaatttaggtcaggccgctggcaagacaagcgggtgaacctgtttgcctcgttgctcttttttgcggaaacctccgcgcgaatttcttaccctcctcagagaatcaagacacgaaacctcaccgaggcggagccgttcttcccaaagatacaagccttttcccatgggcagaccatggcaaccacgcttgctaactcggagccgccagccgcttgtcgactgcgggcagcgcgcaataggccatgctggaaacggcgtgcatgcgaattatttaccagcagtttgcctcgccaggaaaaaactgggagtgccgcgtcaacgcggagagacacatcgagaaagtcgggggcgtctaagcgtgaaggagactgctgtcttggtaagttgggaaggtgatcgtacttggtgcaccgtttgtggttcaagtgcgagtcggcataagggataaactaggatggttatgaacgttccagggggtaacgaggcaaccagaaagacaccgaaagcacaaacggcgtacctgacgcggcgttgtttatttggtgcctgcttctctggcgatatcccgagaggcatgcacgacaacactacgtacagtctctgaaacggtgaaaatccacgttcttcagttgaactgtttccaacgcaaaacaggtgcacgaagcgacatgcttctatggtcgaccaccttttcagtcctgaaaagccatcgttctggagagaaagctgtactgtggataagagcacacgttgaggtaccccggtacaacagcagcaggagaccggcggaattctgtgaccatttgacttgcgtggaccaaaatacaaaaccttacccagcgtcggcccgtagcgaatggcgaacgaaactgacagcacaattgaggtatacccgctggcagccggtgcaacaaggtgacagcatgtgtccgtccgggttacgctacacccatgcgtggagggcagtcctcatgtctctctaaaaaaagacgttcagcgctattctgtgtaaagggtgacccagaaggatttggaggagtgacccgggtactctattaggatgtgcagagctaaaccacacacacgtgccaccataaacgctggctttgaaatccgccattttgagttttcctttattttgtgctggtgtatcacttgaggggcccaagggtatatgtcttgtcttagatctcattccccgcacttcgtcttcaataaagatgttctctattgataggctccttctgcgtcggcctctgcgagcgggtttcaccagtggtcagcttcagagagaacggaagatgacataaccggcttttcccgaagccgcgatctacttgctggtggacacgttggtgccagctcaaagcggtcaacttgcgaggcacagtctcggaacatggttcaaaatacgattcacgtgacacaaacgcactttttaataccatcccactcagtccaaggggacgatgctaccatggcaccacaccgtaattcgggtcagtcagaaatcgtagtacaagacacgccaagcaagagaattattcttgaggctttgcgtggaagaggcggccagccagtcgcttcagaactgatattgatcttgttcaggacctgtctggctgttctacactaacttgccagtctcccttagaccgatcaaggtcaaagcgattgcttattatagtgctctctgaactgatgaaatgcggggagacgggagtcaacatcccaagttaggaagaagttccaagtcttagttcgtgcaacgctcggatatgggttgattttactgagctccgtgaaaacagaataacagccgttgtatatggtaagggcgctgcggaagcagacaatcagtagcaaatcctaactactccactgctctgctcttctcgcttcgtagaagactatcttgcatttttccttacacgataccaaacgctatttttgccgtttgtgtccctgttacgacaaccacgttcgcccacacaaactttcaatagaatggagcaaagcaaaaaaaccgtaccattgtcgactgcggcacaatcataagctgcggagttgagagctgaagtgtggctcgctaattctggttttctaaggaacatttaccggcgacagatgaaagattcaagcaatacggccgtactttctaaagcctaaaagcgaaaaatgatgttgtttaccacaatggcttatactataacccccggcggtaaaaccggatctcccgcagtagtgcagatggaattgcaggaattcgacatcgtggttccctcaaagactgtcattccttgaaaagagtcacgacactttcctccttccctgctcccaccctccactaacggtcttttccctttcggggtctctcttcactcgaaactagcagtgcgggaatattgccggccagggtaatcggtgtcgctgtgatcaacgacgctagcgtctcacgcgcttcgagacaagctgtgtcgagcacgtctctgttttccttgttcgattttttcatagaggctaatttcggggcatcaagtccgttttttgtgttcgttggccccgcagtcgggagttactagctgagtgacaccttggcatggtcaaaaagaatctgattcggtgcatcaatatgcggca

SEQ ID NO: 2418 - DNA, 4103 bp, Toxoplasma gondii
tggtggccattttgacaggtcgatgctttctagtcacaccgtaggaacccggcagagaccgaacgcatctgtgaggcgttcgattgctagtctgggagcagcgtgaactggcgtattcctgaagcgaagcaatagaaagaatgcagcactgcgggggcgtcacttcttggtgtgccgctcgtggggcgaacttgtagcgatgaacagaaatgttgcgtctgctccggttgcgtttgcgagctgatgaagaggcagttttggtctccttgattctggcattccagtgtggaacacgaaactgaggtatttcgggaagctgtccttcactggtggaatgcaggagatgctctcacttttgaaagcttcctgccgatactcgtttgatggttcaaggattaagagatgcgccagtggctccaggcaaaagctaccgtggtgaaactccgtagtcggttagagcatggactattggagcactgcatgttacatgcgtaacaaacaagaaacaattgattactcttcgtctgtatggcgtctgtgtagacatcgtgcacgggcatacgatatctcgagccaccgagtttcaaaggaaggcgttgcacctgcctgcacaatggaagcggggtttcttccatgacactcgttgagcgaccttcatttcactgctggttttcgtgccgctgagaacatgcacaagatccatcgttgtatccttgtagtaattcgtctgtccaagaaaggacctcggttaagctggaaaggtgacacccgcacggtaaaacgtgcctgcgttcgcagttgtagttgattccacacgttttcaggccgaatgtgtcggaaattaccgatgaaaagtgtatggggcaagcagttgatggtcgaaaacatttctgtctcaaagagtcgaatcaaacctgtcgccgctatatgctgttcagtgagcggtggtgaccaccgcgactccccgtttctgtataagtcatccagagttccttcgacacttggtcatacaggaataagcttagcatttgcagacttacaatcaacaccactgctgtcggtctagtcgcatcgaccatgatccatggcggcaccttggcaccgcaacataggtattgctgatgttttttgcgcagttcgacggcgaagcaaatggaaaatttcacgtctccagctcgttctgctggttcttgtcaccagtagccactagtagcatcctagtctaaatttcgtcgcgctttttgtagatcgcacgctgttctctgtctacgtggagggagacagtgacatgtcgtttcccaaaaggtcttgcaactcatggtgatttgctgattttcctagagtcgctgtccgctaatccaatccctgtgcgtaaatcaccggactggaaggaggacgacagacagcggggcacaacatggaacgaaaggacacattcagcaggaacagccaggtattccgtgctaagcatcccgtgagaagtggtagtaacgccactgcaaggaactagtccactctaggaaattcataaatagagagcaccgtgtccttgactgagttttaagaggacataaatcttaccagaaccacaccacctttgcaccccgcggccgtgttcgtgtaaccttatgattttgtgctcgtttccgacacttgccaagccttgtgagttctgttacctcagttcacctccttccttcggttgttccactttttgagctggtcgtactgaagtgaggatatacccctcgccgcttcagcagccgcaaccgcagcgactaataaaacatgctgtgacggctgggtaagaatgaaacatttctgttttaaccaacactcctcttctcacggtggcaccgtgtctgtttctacgcactccaaacatctagtccgaattctcggcgacaacgcgtgtctgatggaactcgtgacttaggcgaattgtacaccacactttgtagagcactctaacgcgggttcaacaccaattggtgtccatgtgcagaagatggggaattaacgttgccccaagaatggcaaaactccacgagagcacactagatcgaaacattgcaccctctcgatggtgtcagtccctggttcacgtgcgtaacaacgggttctgatgcatggtctacgccccttcgggcgcagcccgatgtagtacgatgtcttttatgctgaaaacgtgcgtatttgctgagtggtacgctttcaattccagacgtgttgtcatttttctgtccgtttatcggcatccccaatatgaacggggcagtgaagaggtcggagacgtacccccctgcaatttcttggtgagctttcgccacgagacgtgagcttgcactccattttcccctgccagtcttgcggggtggctagtttacaactttcgttaaactcttctgtcagtttagaacgctccaagaagaattcactgtgaacgggactcctctttttctctcaagtgtcacgccttttgagtcaccctgcccagccgtcggctgtgtgttcctcgccatgtggttgtaccactccacaacgactgcgcaaggccttgatcctgaagttccagcatgcgccattcaagtgtgctgtaaaccaacacatgtatgtgcgcaaggccttctagcgtttgcgcccaagttcctggccaggtgcgtagccaaaactcatcaggaggggaagtgtggaaacttggttcgcggcttcagttcttctcacgccgttcgattttttcgtcgctttgattgagtagaactttggaaagtgtagccgttctcggacattcgtgcaggaaactcgtggccctcgaaagacttctctatccaccacgccaggaaggagcgctgcgtcgccgcccctctgttcagtgtcctctggtccgctgctgccgcgcgtgcattctgcgcttgcgccttcacccaaatgtccacctcgtaccaaactgccactcgtccctgaactcgaaggcagtagagcgacagaattttggtgtgtgtccggtcaaccgagataatacgaaggaaaggcaggaagttcaacggcatgttgtgaacggtcttatcagtggtaggcgtggcaaaagctttcgggaacggaggagccgaggggcatctcaaaaaaagcctgttccactacatcgcacccctagaggaacgaggagggccgtgccccccccttgcacgtcaacacagttgttacggtacaacgtacacagaattgccgtgtccgtttatgtcttcaactaggtgtctgtgtttcttcaatattctgtcttccgtccaacggttttcaacttgccgctgcgaagaaggccgtaccgctccttagcaatgcccggtcaggccacgcatcgctgtgtcctcgtgctttagtacctaccttctcagggtaaatcattttccccaaagtgactccattcataattgctgttgccgagaccagaatcttagcccgcggtgcgtttcgaaaacggtggccccaagcgtccctcaagtcatctggccaacgtgttgtgcttcaaaaaaaggcgccgcccccgttaaaattcctcctttttggattccacaaaagaggaagatgtgacgctaggacgtgcacccccgtgtgtcgtgatcgccgtgtgtatacactcgagtctgtcagttaagaaacttgcgcctgctcatcatgtgacacaccgagacaaccgacgttctcggagagccaattgtgcaccgaggtgaattcccttgtgttcaacagggcgaaaactcagtatttagtggagcgtattttctcggcgtacgaaagtgttgcttgtaacggctagctctccgtcattgccggttccctgcatcctggcgttcgcgtgccacaagaggtgctgtgccgttgtgcacgctttgcagacacgcaatggtttctgtctgttcatgtccacaggatcattcccgatagactgctccgcagaaggccgtctccacatctggaaggtcttccgctaatgtccccgcgcataggtgcagcttaaacagggagttcatcgtgctcaggcggcgcgactgctctaacttgctccactttcgcctctctcttctccgtaatctatcctgtagcca

SEQ ID NO: 2419 - DNA, 1904 bp, Toxoplasma gondii
tcaactaggcttttgctgcggataggctcgaaatgatggcttctctcaacggcaggtaaagcgcgcggttcccttcgacatgtgagacgccaccccaggcgcaatcggcggaacaacgaagcagagaaaataacgtcggcgaaaataacttctgcagggtacgaccaagacggttgcagtgcggcatacacgatgtgtaacagatcatacaggaggaaatgtgaaggcgagaacgtcagagaaactcgaaacgtggtatccacaccttaagagcctctgcccggcctatgagacgctcctctgggtggctctaaacccttccatcgagttgagcgtgcagacggaacggcaagtcttctaagtcacttcagccaaatttgcgtggactctccatcacctgtgcatcttgaaaaagtgttaacgtacttcggtttacgaaagtctccacctcactggagtagacgaaattcggctcgcgtttgctctctctgtctgacgcgaacatgcacgggaactttatgccgtcgcggtagtcgaaactcatcaacaccgcgaagaagacaacgaggcaaattgccaaaatggcgcattcccccattgttcgcaggagtgcaggaaactccaccgcagagagacggatgccggcgagctgcaagagagcggtgttgcacaaggttggtggtcgacgccgaagaagcgagatccctcgtccccccgttgaacacaaatagcatatctgttcaacgtcaggcaagcttgcgtcaccgccaaattgttgtcactcaaataagattcgccggagccatgtgccatccagaactgacttcggcaagagttcaacccgagaatttccgcagcaagcacccgcttgctcgtacgacaaaaaacagagttgacactctcaggaagacggacggggctatgaatgatctgtatatcgactttagctgaatgattcaactgcatgatgtggcatcaccgccactacgccgcaccagtgaaaagtgtatttcgcgacgtttctcccgtacacaaggaagaagaaaagcgcaatttcccaaatttaccctgaaaagctgagaggaaagttttcctcgagaaaaaaagtctccagtggcggtgatctctcacgaaaccaaagcggtaaaccccgaaacgcgaacacgactctgccccgtccctgtggtcgagcagtcggagcgctacagttcccgaagaaggcaaacgatggcactcacaaaatgccagagaaaagaagtcaagtggtacaccttcgctccagttaatccagcagtgatgcgcgtctacattcactcctacattttttcgacggcagtgtcctgccctgcgcagctttatacagcgagtgtgcagatgcatgcgtggtacgggcgacgtcatgcaggcgcatgtgaagaaactgctggaaaacgactaccgaatccctaaaagtcagcaatgatgttttctcgtgaagattccctctttccaggaaatacttccgccgtctgtctctatcctggggcgtgtcgcttgggtggtcgatgtattgtcgcgatcggaatgaggtacgataaccgattcgtagctgaactggtttccgctggtcaacgccgtttttgtcggtatgtgttgctcgtggcttgttgacgtctggaaggaaagaagcgaactgacttgcaaccgacttcgcgtgacgacaacgtggacagattttcaggggtcgtagaagcttgaatgcgttcatacggggcttttgtccctgaggcgctgtgaaagtaaagcgttttaactttcgtgtcagcaaactgtggagacgcgaagcctcaaggggtggagtagggtcgagggcggtgtgctgccaccaccgcagcctcgcgtgtcctaaaagtttgtgtccacga

SEQ ID NO: 2420 - DNA, 1948 bp, Toxoplasma gondii
ttattgtgcctgagttaatgttcaacgtgtagctagagaagaagcagcagattgtgatttcaaactggtgcatgccccaattccttcgtcctcttgtgcttgcccctgcgcagcacccgagaactctatgacgttacagttatttaactcccgctgggatgcgtctctttggaacatgctttccttcctttctctcgcgcaccgtgtaggcctcatttttctttccggagacgatgcccacaacgacgtcgccttctacaggctcgtagcgtttctggcttccccgaatatatgacggagaatacggatagagaggcgagctctcgacaaaggcacagggagcagaggctgtgagttctcgagaccctgcagacgcgcagcgtgccgctgcagcgacaggagaagagaaatcaaattgttcttctacttgagacaatcgctcgatagcgcgcctcgactctgacggagaagccgaggggacaatccgaagcaacatgtctccgggcaaaaacactgcaggggaagatggacctgaggaggcccccgcaggcgtcggagccatcagaaagcggaaaaaggagacagagagacaaacaccgggagggcagacgggtagggcagacgaggaggggaagtcaggaggggaagtccgagaaatcaacagggtaagggagaggtcaagcagcacagcgagagcgagagagacagacggtgacagacagagaggtggacgagagaaacggcccaagcaggagaaagggagactggctaagacgaagagcagaggaaggaaacacgaaaagcagcagggtggttcactggaggggcggtagcgaatcaataggagacacgaagacagagaagaaaaaagctgaagagactgtcgtagagataacgagattattctctctttgccatggcgattcacgagggcgtttgcctttgcgataggaaacgagtcaacaggacgagaaaaaaggcgcttaaaaggtgaaggtaagcaggggaggaaaaggagactgacgccaaaagaaaattgatgctcctgggtgcgcaacttggtcgaacgcctccgttgttgggaaacactttcaacaacaatgaaaagcatggggcaatgcgttaaacgcagcacgacctgaaaaacctggaaccgtgcctgtcgagaactccatcgagaactccatattgtggagtggcgcgatgagtcgccagaaaattaacaaacttaaaaaaatacgttttccttttctctcagaagcggagacagaagaagcgctgcctagaagccgtccgagcgaatgcaaatcgcggtagtcgcgcccgcatgcggttatttccatcaatatcgacaggagacaagaacatcgagatgctgtctgccgtctcttctcgtctgtttcagtcactttcctcttttctcctctcacctcggattggagcgcattcaaaaactcactgaaaagagatcgtctcttcgccgtaccctcgcggtgagagagaacagcgataactcgtaggcaggaagaagtatgtttctcatgcactttgcttcggatttcttgttccgattacggtgtgtcgattgccgctcgtggcttgacctagtcagttcgctctctcttcccctgtttttccgactctctgtgttgttgccagcaacgtcatcgaacgcatcttcttcgtctctgggcggctctctcgcgctgccctcagtctctccatcttcgtcatctcattcagaggaaagagaagtcactttttcgcttgttcccaccctaccgtctctccttccaaatctcgacgaagccatctttcttgtctccttgtttgttctcattcttttcttttcgtatccttcctctgtctccctgccatccttcctggtcgtttctgtctcctccctcgtctctgtcttctctttcgacttccagcctccctcttacca

SEQ ID NO: 2421 - DNA, 1865 bp, Toxoplasma gondii
gttattgcacaagctgtcgcctgcgtctgtccttctccagaaaacgcctcgtcgcgcttccactcttgatgcagggaaagccttggcctatttgccttctctcgcaggacatggacgcacgggcatggcggctccaaagcttccgctttcgatacccaccgtctctgacacgaatcgacagagcacatgagctgctcgacaggatggtcgggatcgtggtacgcgttctcgtcacagaactccagtctgctgctctttttaatcacccggcccctcaacgactggccacgtgacacgcttattgccctagacacaacaggcgggaggcccggcgccgcaagcgtgtgttcatcgtcgcgagcaatccatgagtaacagcccaccgtctgtctgtcgctaaagcatgccgaaaaacccctttcacagtatccagatccagacgactttcgtgaagacagtgctcctggcgtacgcagagaatcctctatgcgtccaatgctatcggcagatatcgcgaataaacagtcgcctatctcggccggcgcggaagacccctgcatgatggagagaacctgcagtgactagttccccgggccatacaccgggggcactcagacacgtcacaagagaccacctagagaaacaatgaggcaaaaaagcaagccgcctaaaaatcgcatgcaaaatatttgtaaccgtacgcatgcctcgaagtgtttacacgcgcagatatgtgcgcgcccttcgtgtacatgcaactactccctcggatgtaaaggaagcttaagtacctgatcatcccgaccggctcgctgacgcaaatggttacgcgtcggaacgtgtacacacacactctcctgtctgacaattggggattttgtgaaacacggaggtcttctggagcgtttcagtctctcagcgttgccatgttgcggtcgcgcgtttacacagctgaactagaagcgccgacagaggctggatcgggtaaaaagcgtcagcgttgcaacgtggtaaaacagatccgcgactacagggttcaatgccacatacagcagctgcttgtgactgtaaaaggagaaatacgaaaaaacaacgaagcgcgctctcccaggcacggagttgtttacctgtccagcacgcgcaacaggatgagaatccacgcctgtttgcaacttttaacacggaacacggccttaaacacaaaaggaaacaaggttagatgctgcggtgaatcaaacggcgacaatcggtgacacgagtctaagtctctaacacacccttcacctacgactgtccgaactatccagggtctcaccggagcatgcatgcaacctgggtcgataaatgccatcctgaggaccaatgttctgtctctggttagaaagcgaacctcttcattctgcgtgagaagtatcttcactttagtgaggaggcctgtatttcacgcatccactgagggctctttttttgtgtggtgtttcccgaacttcgcaaccgggagagcgcaacatccgtggacacctgccgcgtgtctctgtctccgcagcctctgcggacgccctttccgggaagcggctcatttaatacttcccatcctttgccgtacagtgacctgtatgtctcttatgtggcgagcctttcacataacgataatatctaggtgatatatgtgccactcagaccccccgcgtttctcgtttctcgagccactcgcggccagacgctgaatgggcgcgaatatctggccgcggtcaagcgtgtcgagaccacctggcggcgactctctgtttgttctcgacgtacaacttgtgttgctcccctcgtaactctctctgtttcactgcgaaggtgtggttctgtctaca

SEQ ID NO: 2422 - DNA, 4548 bp, Toxoplasma gondii
tagtattcaaaggaacgctccacgaagtatatgtacagcagaggaaccaacagcatgcacagccagtgcatcatgaccatggccagcaggacgctgtgcagcccgacgatgaacaagatcatgcagaagacgggcgcgaagccgacaactagcaacacgggaattgagagagtcacaggtgcagttggggcaaggaaggtcagccaagacccggagcgagagaacgtcggggggggcggagagaggggcggagagagggaggtgtagtggctgcctgcgacgtgtacctctccgggagtagaaggcgtctgaggccctgcctcgccatccgtcgacggcgctgctgtcggccgcactgaagcgcccaaccccggaggtgatagaggaggtggccgtctccagtctccgcagcacgctgtgggaaaagctggcagcttgctccatacgcctgcatctggaagcgaatcctgaggctgacctggggagccaaagagtggacacgacacacgataagatgtgcagctggcgagaaaacccacttgcgtcaagtgtggttacccgctccacgaccgtccgcctcttccactcccagatgtacttcgatgatttctgcctctatttgtacgagaaggagtcatacagccgagcccatgcagagagtggccgtcgactgagagcactcacactcaacatatcgcgaaggaaacccggaaaagtgaacaagacatgagcaagctacctcacacggtttgtacagaccactaaaggcggaacctgagctcctatgctcgagtcaagcttgtgttttttacctgagctattccgcaaggaggcccgctggttcctcatcgtccgaagaccccttggacatcgaacaagcgaaatatgtgggcaccatcagtctgttcttaccgtgtagttggggctcatccgcaccttcagatctgatttcggccgccatacttttctctatagtctggggaagacacacactgctcctgaagcgcagcgacggtaaatgacttaagagggagcatagcttgcagaaaactccgtttatgtgatgcagagatgaaagacaaacaccagattcacattgcattcgagtacgggtaacgctgccttcctttgtcaattgaaagcctgctcgttagacagctgaccatcagtggcatcgaagaaacatattcaaacagtagtgtgcatttcccaccgacattcctcagtcgtgaattcacaggtctcatcccctcgtgttctgttgggcctttctgcggaaaaaggctggaagagatggaaagtcgcgcaaatggaactgacggaagggcagaggcctacaggtgatgacgcacaggcgagattcgttcggtaaaaaaagcagcttgaagaggtcactttgtaaacagaagcgccctggatggaagggagagctacagaggctaggaagaaaagaaagaagaacggacgggcacttgagaacaaacaaaaatgccgcctagcgcttgacccgaccgcacagggagggacacggccagtgtgtgccggatttacccgtttggggaagagttcgcatgctcatcgatacgtttttgattcggttattccctcagtctgtccccagagatctcggccaaaaagacggtcgctggttgccaccctgagtctgcacatccaagggatggcagacacgtgcaacgacagtctctgtgtggacggaaaagccacgagatctgtcgtcattgaagaaaggcacttcgtttctccccagaaggaaaaaattttatagttcccaataaacagtgtactaccatgcacaaatagaaaagttcagtccgtcagaactgacgtgaaaaacaaaagctggacggtgccgcgaaaactttgcgacgggaagagacagatccttctgaagacgattgaaaactcaggaacaactatacataaatataaacaaggcgcgagagtgaataagacagtccattcatcttctcctctatatttcttccccgttttatgctactagctgacccagcttactagtccattctcaggttgaacggagtatgccccccaaccgccctgctctctgggttcactgaaggcaggcgagtcgtgcccaacaaggtgtggttattcgtcattttcggagagcaagttctcagagctcctgttccggaagaagcagctgtttgcgtagggacatatctccaagtgggaatgagtaaattggaaaggatgcaggatatagacctccgtcaccctccgtcacccagtgctggaacggaagctcttcttggagatcgacagacccaccctgcacgagacacgctgcgctgagtgttttttctagatcactcctcctccgctgattgatgaattcgatggtgtccatcacaatgccgatcacgcttgcgaaggctggtaaagcaattcttcttggggatctgcacaaggtcctagtagcaacgtttgtcgttcatatcagccatgttatgctcatctaacccccagtgcgtgcgtatattttttcgtgaagggaaagaaaggcggattacgaagttgtctgctcacgtccaactgacacgcacagcctcccttgtgtaagaaaatggttgcttcacggtactccccgacttccgaaaggctattgagtataagaggtcggatcggccgacagtcgactcgaaaccattggctgaaagtgtgtcaaaaaatgaaggaaaacattttgaactgtggagcttctggttgttatgtccttttcaattcatctatttcgtgaaagaacaactaggcagtgaccaaaaggcccacgatttccaagcaattgccgtggagagttcgcactgggtgttacgcagacgccctcttccagggtgaacaccctcactaaagcgtccgtatgcatgtgcacttgtaaacaacagtcgcgtttccagtatcgaaatcaggttcccatccccaatcctatttgttgtgaacaagtatggtagttttttcttaagaagcgtctctggtgcgacatggatcaggtcgatttgcttggcaggctccgggtcgatagtgacgcgtaaatttgccgatattcggtttgtcagttaatttccactcgataatgggtttctacacatttggcaatgtaataggtgtcctccattgtcctcaggcatccctatttgaccaaagagtttctttgttggttgtagagagaactgcgttgccatctgccctggctgctgagtcaatctactgtttcggagaagtttcccttgtgtatacatcgttgtccgaaggcagcagaatcactgacatgcccctatctttccaaaatgcgcagcgtcatgctacattcaaagaagatcatgttgtcccgcgcaagtatttctttggagagcacctggggagaagcatcttcaaaaaacgggggttttcgatgaaatcctgtcagtccgttatctaaattgatgaatagtaaaacacatcagttgatccacaccttcacgcacactcgaaaaatgtatcctttcgttctggcaacatgtgattatagtaccttcggaggtccaaaaaagtgtctttaccggcatctaagagtgctgtcggtggcgtacgtgacactatcgagaaaccgtttctcaatcttgtcttctttttgaatcaacccagcctgtctcccaaggaaggaacgaactctcttcgacggcttcgcatctgtctgctttttctttcgtcgtgaactgacagtttcattgacttggaagcttcaaggtctccttttcgagattacttgcccaaacccacactaataaatttgttgaccctttattatccacatttttaggcgaaacgcgactctctttcatgagtcatgccctgagttgactcatgatgtctaccacgtacatcacgccttcatacactaagtgcggtcactcttgtaaggtaatcgacaggtacctgcttgtcccgagcttttgcagatgttaagtttcgagttttggcttgtcttcttggcaccatcgacagctcctctttccagcgactaaagaagctgcttctctgtttgaacaacggaaggcgaatggcctttcggctttgtgttgacaggcagatttccagtgaactgaatgatactggcattgtcagacaaatttcagacgtaggtgggtacagtactcgtatgcactgcggcgcaagacaggctatatagttacagacacaatcatacgcgcgccagactgtgtgactgggaaatcttcatctgctgactgaactgaaaaacattcatatggaactaggtatgagtgagtgagcgtcgtctgttgtacagaggttggtctaccgcaagtgagcatattcacacgtgtgctcagagcctgtcgagaacacgttcctctctccatccgttcattcttcgtaacatctttcccacaccaattcgggtggtgtgtcccgttaggtgatctagtgtcccagtttcctgatcctacgcaaagaggatcaccttgtttgccgtgcaatttgttctattactgatcggagtggcca

SEQ ID NO: 2423 - DNA, 1549 bp, Toxoplasma gondii
acagggaacggagaatgaaggaaaagaagcgtccacatgtgagtttgtcttttacgatttaactctgagtcactccccctcgccctcccccccctccccatgtcgcttttcggtggaacgagtgtcgagataaagcaaactgctgggaaagagagaaagccttttttttattttgccgtcgatgtcaggcccagactttgcctctgagtggctttgtgttctcagtcgggtggggagagactccattgctctttttttggagggggaggggggtctgcaggtttcggagctcgcggggagaagtcttgcgaaggagttttcggacaaggctcgccagtttcttgaaggaatagggaaagcagagaggcagagacacggaagaaatgcagaacgcgtcgcttctcctcttgacgcctttgggcgcggtagaactttttcaacaatttccgagacaagtttccgagtcgatagacgcagatgacccgagccaagtggcagagtcgttttctgagagaattcaggtgcagcatggccttctttctttctttttttctttctttttttctttcttcgcatctcttatttcggctgaggaaactcttcgggtttgaagggctgcactgcaagcaaagccagttaaaaagacctacacatggatacctatagggatgcaggcacacatgtaaattcgaaagtctttgaagaaacatatatacatggacatgaaatcaaagatgcgtccttcgaggttcacacgcatcccgatctgcctattttgagttggaaacagatctgtttctgcgcatttcggagactcttgctaaaagatgacaaaaggccattgggagagccctcgagaaaacgggtggtgcctccacaggcctcgcgtcggccgttttctccccttcgttccatgtccttgtcgatatagtctacctgttccctgtttctcggtctcaacgtccctctttcgctgtttgaagagctctgtccttctgtcagccgccctcgttatctatgttcgtcggacttctctctgtcttccattctctgtctccgtatttctctatttctcgctttcaccactcctctcagctcctcgatctaaaattctctcccgttccttctctctgtctccttccttttctcgctgtctctccgtctctcctttcctctgtgtctgcttttccctctgccttcctttctctctgtctcgcgtttctttttttcgtccttccacgttgctttctttcgctttttctcttcttcgttcttcttctcttgtctgtttttctccgctctgctattggcctcctccttttccccgtgccgctttccccgctagccggctcggtggagacagggggggccgggggaggtcacaagctgtgcggttccccggtgtctctctgcatgcgctcacatgcggtcaagacagccgaagagaaaggcgacctctgtgtctgcagcttcttcgagtagtcagtatttttcgcgatttttcctttttttccaacgctggaaacgcagaaagttccaccgtcgcgca

SEQ ID NO: 2424 - DNA, 961 bp, Toxoplasma gondii
caaccgtgagaagattgaaagctccagagatgcagtgagacaagaaccatggagggaagacacaggttgaaagaagagaaagtgaacagaggcaagagagaagactcacccgaaagattgagtctggtaaggagaagcgagggaaactttgaccctacgattccgcttggcttgtgcatctgtctgtccaatgagctcgaggggaccttgtctcttccgtttctgtttcggcgcctttgtctgctcgattcccttgcatgcagaagccttaccaccccctgagttcgccttcctctggaggtgaaacccaccggcgttatccatcttgggcgctggacacgatacaggccaggcagagggaaagaacagagaacgagagagagagataggccagcaaagacgagaaaagacgacaaacgaagagatatgaagaaggagcagacgaagaaggcagatctgaaggaagcattgaagaaaaagttccaaagagaccgaggcgagaaggagcagaagaagaaagagacgacacaaaagcgttaggaaggaagagataagaagaaacagatctaaaggacagtaaacaagcaggtcgagggagaaggatgagcgtgaggcagtgaagcagactggtttctccgttgtcgacgaaacgcagggattcgacaagcaaatggaaggagacaaaggaagagaaagagaacgaagcctgaagaatgcacaccttcgtaagagacctcgatgcgttggctacgcctgatgtttctatcgatttcccttgatgcgttccacgatagtttcgcgtcttgtccaccggaaaaagcaggcgccaatctcgaaagcgggaagagaaactcatgaagacgttgttcctttcagcttttcttccgccgcatcttctctctgacctcatctacgactttcccggtctctggcgcatgcaaacaatcatttgcggtttgca

SEQ ID NO: 2425 - DNA, 1746 bp, Toxoplasma gondii
aaagacgctttacaaaggatcttgtttccatctttgcctgcgacttccagacgctgtctcgacgtctcggaagagtacgactcaactgggttcctcccccggcgcatgcatgacacacgagagccggaagaaccgcgtttctgcgtttttcctcgagtcggtcgatgaggcgaagccgacgcacttggtttgcgatgctgcgtctctgtggaaaaggaagccacactttttttcgcagaaaaaacgaggtctccagaaactaccgagtcccaagagacccaacgtgcagctctttgaacgcccgacagagggccggtcgtttgcatgttccgcagtctgccgtcgtcatgcgttgtctaaacggttcagaaaatccgcgcgtggagcggcagagttgacatgaggtagcgcgactcgtcgtcttcgcttggaactgacagacgaatgctgagcgacttgaaattatctacgaacgattccacgagagagcctgctttttccacacgcaaccgcccagttgtttgactttcttcctggtaagaaatgcgctgattgccttaaggatgccgcgctgccggcaaaggagtgaaagcgagattctcaacagctctcggtgtatgcgacaagcaaagacaaagccagcagcacaaagcggctcttttgacgtagcggtgcctcgtacatttttctgcagctaaactgggctatcgtgcaaaaagagttgagacaggctacaaatgaaaacaggagttcgaccgcgaaatccaccagcgtacgcagaaacctttctcggtggaccgcgagaaacatgttcagcagaaaacggtgcgctctgcgaattcagaaaggtaaagagctgtgcgagtggaaagagtttcagcggaatcctgaccccccttccgcccgccactcctggcgccagtttgcccacatgcgaagattctgcttctttccagagggaagctgaaaaaccaccgcaacctcaaagcggcacaacagaggtacgaaaaggcggattgctccttctccgacgacgacgtccgcgcagagacgcagcagtcgagaggaactcgaaactgcgcctccaaacactgtattacctccccaaaaacgaagttcgaggcagtacaagaatgccctttcgccgactaagaaacgcaaacacatagatcagaaacaaacaaatatatatatatatatatatgtatacatatatatatatatatatgtacgtatttaggtgtatgtgcatgtgtatatgtgtgaatttttatatgtgtacagggcaaagaaatgtaggaacgctgaaatcttttttggggagagactgcagaaaacagacggaggaatcacacaccttgaggaaagaaatatttccagtgggtttgttaggcaaacagctgttctcttgttactgaaaaaaaaagtaaaaggagaccggagaacggtgacgcgtacaaacgccacagttttttcttgttacgctgcatgcgtcagctctcagcagctgtttgaggcttttttcttcgtagttttcgcttcgtcttggcaacgccaattttctctttttctctgatgtttcgccactttttctcaccctcatcgccctgccgctttttttccgatctccgagtttttctagaggcgccgtgtctccttcctcgcggtgttctttgcttctcttctcactcttttttcttcacatagttccgcgttcgactctttttcctacaaagtcaaagaaaa

SEQ ID NO: 2426 - DNA, 1058 bp, Toxoplasma gondii
cgtttgctctgcttcggaacagcgtcgaagtccgctcgcgacttttgtcggagttccctctcgccgcgctgagccgaacagaaggagagaaacctttcgagaatcgcccctgagagaagcgaggaccgcgccagcgtctcccggtggacgacgcgcagccatgccgtccagctgagcacctcgagctgtcggaaaatcctcactcgaacgcggtctctctgtctctgtctcctctcctcttgcttcgaaggcgacgacgacgaagaagaagaggacgcagaggaagacgacgcagaggagagagaagaagaggaagaggacgcagaggaagaggacgcagatgagagagaaaaaggggaagaggacgaagaggaagaggacgcagatgagagagaagaaggggaagaggacgaagaggaagaggacgtatatgagagagaagaaggggaagaggacgaagaggaagtagatggcccggaacaggcagaggagagaggaggaggtagaaaaggaagagaaaagttacacgcagaaaaagagagagagtcttcgctcgcctctggccgggagtgggcgtccaaggctgcttcaggttcctcctcagttccaggaaggagacctagctgttcgtcaagagaatcaaagcgagaagaagaaagcggaatcgaggaggacgaagaagaagaggaagaagaagcgcctgctaccgaggacgcttgtggaccgaggacttcgtcgccaagccgagggtgtctcgagtcctgctcgtcaccggtggagtggagcttttgaagaggcgtcgtttgttcggcctcttctgtctccattgtccatggagaaagtccggaaacgaaggaaagaaattcgccgagcgcctcgaggcgagaacaagaaagaggagagaggcgacgcgcggaaggacgcggaaaaggagcgacgcaaggctgagaacgaaggcagcagagagagggcgcgttgaggagaaataaaaacggagagaagaacgcgcaggaaaacggcaaagaagaagcggaacttctcacgcgcgcttctgtgca

SEQ ID NO: 2427 - DNA, 4355 bp, Toxoplasma gondii
cgacgctcttgcacgtgtcgcctggcttctgagaggacctgaaaagcctcgaccggagacgtccatcttctcagagagtgaagtttccgtgagaagctgccaaaccccgcgcgccttccgcaaacttgttgctcctcttgacaaactctcctccgttctcttgcctgcctttgtcagaatgcgcgaatgcacgcgagtcagcagcagaaagtggcgagacagaagcttagaagagttcagcagggagtcgtttgtttacagcctgtaccgtgagtttcaggaggatactgttatagtcgctgatctcatgtgttcacatcagtgtaactcaaatcgaataaacagacacattaacttgggcagaaagcgttgaaggacgtggtcgatttccaagtagaaaaaacagatcaaaggagctcgacggcatcgaaaggaagagtgaagttgtcttcagagctcctcgaactctagagagcttcgagaaaagctggaccgtgctaagaacaagtctgaagtgtgaatgtcacgcaggcaatccatttacgttctgttgatcgaatacacttcaccgctgctcacactcttgcggatgaagagacaatcagaaaggagttcctcaggaacttcttcggcacctcagctgtggaaaaaaaactcgggaagcaagacagttcgacagtgaagtcgacgacgcgagacgcgatggatggtgcagaaagtgtaaagctctttgaggggaacgagagacgcagaacgcgaaacatttaccaaaagcaaacagacagaacagcaaaaggcaaacgaatcacgaattttcgaaaagagagtgctcgcgtcttcatggctgccaagtcaaataacgcacaggccgggaaactcccgccagggtctactcaaagttgttttccttacatgaatcagggatcagcgagaaactgcagtcgagcaagaagcctgtcgaattaaatgagaactcatccatgaagaagagcgtttgctgcggtttgcatagctggttgatggaaaagactgaaagtgaccccaggtctggctatttacgagataggccgtgagatgttccacagctgaacagacagcgtgaaaatcgcgcctgacgagagtgcaccggagaacacggaaggtggacgggcaaagcaggcttttttttcaaacgaagaaaagaggaaagcggaaaagcaaaggagagccgcaaacgtcgaaaatactagccactcgcgcgtttccgcgcctcctgacacgtactttgtgaaaggcagggtggccgtcgaacacatcgattcggagttttcaacgcattcataaatcacccgaattctgtgagacgaaggaaaaacaagcacttgcgacttgctccttggcgttcgttttccaaaagtgttctcggaaagaactccgcggcccccgcctcccttccagtccttgcgtgacagcgcgtcttggcgggccgcatgtgcgctgctaaaaaaacgaggtttactcgactcagagagcaagtctattgaatcgcagggcgggcgttcgagaaaaaggtcctgcactggtgaatctggaagggaggggagttgttcaatttatccggcagagatatactgttttccttgacaggggtgtgtcccgctttgcttcccactgtcggaagagggaagccctgtatcggattctacccagcaaagtcggagaaaaaggtctgcagaaccgtagtttctcggataggatttctacgcggacagatgagttcgccgaaagaccacctgtggtctgcaactgacacgtgcagctgaatgccgcggacggcaactgtgagacttctacaggcatccttgtcactcctgtcggtttgcgtgtttttttttgtgggagatgaacacacaggaacacgagaaggccccggaattccttcagcactgctccgttttctccttttcagcttgttgataggtaatggtacttcgttaccacgtggaaaagtccaggaatcacctgttctatggtcaaaacatgtacgatggcatttcctggaaacatgacactttgttgggaactgcgcaactggagagctttgcgaagaccaggttgaagaatctcaagacagcactgatatagagaaaatgatccgaaacaaggtcttcgccagcagcatagactgtttgcaaacatacacatttcctggtcagggcgtttacacaagttcttggtttcagataggaaaaaaaacaacggaaactgtaaggtacgagttgtgatggctggtacagccgaaaacgagacattcctcagagtgtacagttccgtaattggcacagatgatccgcgttccagaactgcatgactcaaaccgaataaaatagatacaacgagagtggcaggaacgacttgcattgagtgatatgtcaacagttgtggcaactctcgacggatccgcaagacgcttactcgtagactgcggcggatcaaaagtacttgcttacgcactgtggagtccgcgttttccggagtcgccttcccgacccgccacaagaggttgctgtaaccgacaacggtgacagcgacgaaaacatcaagaagcagagagatgcatcaaaacgagcctgatggcgttgaagaaacagtttccggagccccgtgcctgtggactgggaaacacccgctcagggtaccctttgttgggaaacaacgagaggtacgtttctaagcagctttggtgcgctcacgcacctcacatacgactgccttcgattaatgaaaaaccatacagagaaacgtgtgaattgatgtgtttctgtgcctgtcatgggttgtgtgtttggtcaaaactctcgagctcctgtgtggtggggagttgtcacgcgtaataggtcgctattcgcattttactcattgttgccgtgagcactgctaagcagcatcgtgttagcgcgtttcagaacgtgacgggagtgtttcttcttgtgcagcgagcgtgcaaacggagaactgactggccaagccaggagaggtgcaggcgagaaagacacgcagcttctcacgacgctttttccgtaggcagccgcttgccattttcctgcggttgcgaacgcaggccgctaaaatcctcagttttctcagaggcaacttggtagcaggtcgaacacgcccggcgagactgagcgagttcctctcactccccaacacagagcaacaccgtactgtgaggcgtgcccgccacacacttgacagagctcttcgaagatgacgaaacacacacgttcgtgcaggcgcggctgccacagaagtgaaccttcatgtgagcaggaagtggcggttctcgaagacggcgttctgattgctgaaaagccacagttgtccatttggtagggagggaattcaaaacattcaaatgatcctgcgagtgagacagagctctggaacgtcgccgaagccacagggactcccttagagcgacaagatacttcttttgactctccggcgacattttcccgttgtggtgtggaaacgcgttttttgcgagttacttggagggccctacgaggtgcatgcagcagccgttcgtttcgctgagcgccaaaccacttggacgggctttttttccttcaacagacgaagcgctcttgcttttccggctgttggccgacatctgtcaaaagagaacgccgctttcatgatctttctcctcgtctggcgccacggcgccagaccacgcgcgacacaactcgtttttccctgcatgctctgaagacaaccggagactgcaagtttcttgctcgcgtgctcggccggtgaatgcatttccagttcttcattttccacaagaagctgctcgggtgttttctctacggttttcatggcggcctcgaactcgggatactcaccgtctctcgaagttgcttctttctcggaagttggttttccgtccctgacaggacgatgcctacggcgagacacacggctccgcgaatgttgagttggcgagcagagttttccatctccactgcgttccacttctggcttttccttgactctcgcgggtcacagaaacgcaagtccctgtgactgtcgtccgcgaaagtccggtcctgcggagcggagccaaactcacatttttctgcgtcggttctgctggccgccaaagtcttctgccgcacgtcgcgaaaaccgagctgtctgcacagttgtcgtgcatttctttgtctcttctgcggttgttctcggtgcatcgtttggttggtggattcgtgaacttttcttgcgtcgatctttgtcgggtcttcggcaggcggtgtctctatgatctcgcgtcttcccttcacgttgcctgttcgcagtttccggcgaaa

SEQ ID NO: 2428 - DNA, 4593 bp, Toxoplasma gondii
cacagttcacagagtgggaccgggtaggtggcctcaatgtacagcaccggcgccgtttctgcacagaagcgggcgtgaaggtcgaaccgaacagagtcttccctaaggcaccgagcccagcgtatcgatgagaggaaaacggctgagaactacaccgtacgaacgcctgtaaatacatcccaaaccctcggtgattcgtacccttctctcccctgctctcttgaactgtaaaaaattgcggatggaagaggtgatgttctggtcgctcctgccgtgacagtgtaaagcctcggctcctcgaatttaaagaaaatatggacctagggaaaacggaagatgatggggtagtgcagttgcgtctggtgactgacgaaacaccactggagcaggcgtatactggtgacgtagcacaggcaccggaagaagccacaacttttgcaacaagatctgcaactaaaagaaggacagtgaagccgaacaacgaaacgcagcgtgcacggacactgcggtggcagaggggtttgaacgtgccggtgttcaaacattgaaaccgtctcgcacgagtagcagcgtgtggagcaggaagggtgatacgcgtcgacggtgaagggaagctaaacaaactgagaggagtccacgaatagcacttcaaggaggctgtgcaagaggaatatctacgccgcatctgtcccagaaaaaaactgagaaggaaggcaacggcgccagaagccatggtggacaagatgccctggaagaaccggggaagcacgcaaagccaccgctgacacaaaaaaaaatcgaaataatctttcgctcagttgatcctgtgcggtgaattaggaactccggtcgtccgttttctttgtgtcagaatactcgcgcctcacagtcgtgatgagcgcctccggaattgctttgacggaagaaatcaccattgtggaccacgcggaaacatctcgtcaacttccaactggttgcgctgcggcatgaagacttcctttctcgaattagcggagagtgggcttgagtcgagccactttatttggagtgattcgagaatacgggttttttggcaggtccactcatgctcggcccttcaccgctgtaaaaaacgagtgcacatgcaaatcaagcgccagaactgcaggggtgacgctgatgcaacgccaatctgacggatatatcatctgatatcgggtcgacgcggttgccaccagaaaacgccaacagatgctgcggcaaggttacgccttccagcaccgcctcctgaccattggaatacgttttccgaagagaaacatgccacagagcatcttctgttttatgcatgcttcgtgggtgagacagcagtatgtagaacaacagtctcctgtggttgtcttgtgcatgcgccagcgtgtctccataagccagcgtcaatcaattgggcccgacatcgacgaaaactcacaacacttttagctgtcttaagcagtccagtggggtggtggtgtacagcaatcataaagaagatatgtaaaactattataatacaaccaataaaaggcaagataaaaaagtgatgcatgaagttgtcaacagttccagtgtgaaaacgtacttaaacggatacgagtgactcagcaaagaggtacaactaaacggggagcaattggaacacacaaaagtctcgacgatgccctttcttacaactttcggaccgctgggggcggctgcttttgcactggaacggcttggggtacttcgtaccacgttagttccccggaaatgttcccagaaaacacaggagtggtaaccttgagcactttattggctcgaggcatccaccttgactcgctcccaagtgcttgggcacctcatttggcagtagcgcttgtttgttggaaggtgagtgtcggtctgccaagcgttcttccgcagaacttccagaactgcccgatcatcctgaatcattgtttcttgagatctttcacagtggagcgggtgcccttccaagatgccttgcaaaacgaacgcaggcctttcggcaagcgtgtttgcggcagcatcatcggttggacctcctgtagctgattgactgcgacacctcgagcatacacgtaagcaaacaactcaccaaacgggaaggatagatatcgtcactaggctatgaacagcgccttacaaccgcagaggcgatccaacggcatccctccggacgagacctgcatttctgtgaatacggccgttgagtgtgagattcagaccaacgggaacgttctgctgcgccagcgtagtaattcgggcgcgaatcgttatggaggaattccataagctcactggaattcataaaaggaaacaggtggttttatggcttgtcaaagagtcacgatgaaaatggactcctgcaaaaaaggtgaactgtctcttttggtgcgaacggcgcccatctgaatgagaagagttacttatcacagtctgcggcgtaaacgggaggaagcgtcacactgtggatagtggcggaacctctgacagtgtcgcctcaaaagccattccttagcagcgtcgtattcctctgcggcagtgcgatcatttgcacaagacggccccgcgggtctccaatcctgaagaacagaaaatcgctctcatccccaagataactgcggtcagggtacagaacaccttctgtcaatcaggtgcaaaggcggttccggataacgaggggtcatgagcagcacctacactgatgatttttcttttcggattgacgaacacttgagttactgataccacgtagcacacagggggacgctgctctccctcccgaggagaaacttgtcaaccatctgccggaaccattctcgaaaaaggcagatccttcctcggagtagtaaaccctaaacacgttttgctcaggcctcaatcctaacggggactcagatacggtccagtagtcccatggctccccagatgcccctgcaactgggccggtttatttgattccgcacttgctactacacgcgggaccacctttacagactatttccacggtgtatgttggggaaaaagatagagttcactgactgagagacgtacttctgtaggaacaacagcatgtagctgcttgctgtgacaccaaaagagcgtgttttcttgacagacagacaacatcgttcctgagtgagaaccaccttctccgtgacaccaccgtaacttacaagcgtcgttatttggtccgcaagtctcctcatatctcgtgtttgggcttcaagcagaacttcagccgaaaggaatccaggagccagaaaaagaaaaatcagatggatatggataaatgtcgtcgttctagacaaaacgtgtccaatgggcgctgctcacctaacgcgcctcgtgcgaatgtgtatgccagagttttaatatcccatgcctggcctcaacgtatacacaacacaggcagattcttctcttctctcgatgacacgatcaccgcacaatttgtagtactctcaactaccataaaacaccagctcgttatttcacttaatctccgaaacactctgggcatctctcctacaggccttcactagaaaacatggagacactcagaacgctagacccaatcatcggtcagtaagtacgtaatgatatcctgtgaacgtctccaaatagacgttatacgtatttcgtgcgatgatatcccgagataatttgatagatacttgcgctgggcccacgatactacattattcgaaggcgccacgcagaggccaacgctgagtgcaggtagaatacaaggagcttctcgactgtagaggactgtttagctagttctcttgagttcatgactgtacttttttggttctcggtgaacacattagaaaaatggattgagacacaagagctataatgcgtaaactggcgtggtggaactctgtggcagggctggagctgtgttgatgaatccatgacaagagtagaacgaccttttttgcatgatcgcgtattgttttcgtcacctgtcgtgcacccactgcaggggcatgacgccgtcggtcaaacgccgctggcgacaggaatgacaggaaagtgtctgcgtcattccgtcctcccgaaacgggtttgaaaaatgggacgacaaagctgcgaacccgcctgcaccagggaaaagcagctagatttgttaccgttagtttctagaaactgttgagggtggcacgcttctaccacgagaaagaaactggtgtagttggcctcacatttttgcgcgcccagtgtctcagcttgcacgcagcggaataacttcatggcaccacccggtttgcacacggggggggtgacagtagaggaggtcacgtctcccagtcccactgcctcccaaagaaccaaaaacaaccgtgccgaagaagtctgttcgattgcatgatccacctctggtattcgggtcttcacggatatcacctgttgtgaaacaaggcttccttcacgattattttccggtaattttcgccgtggcagcacgtccttctccaaaccgatcagttgtgtctccacagccgctcgtggagtagtcagaaacttttatacgttacggcggttctctgaatctcttcagga

SEQ ID NO: 2429 - DNA, 3642 bp, Toxoplasma gondii
tattctcccgggacactcgatcgcttgtcggtgaaagagaggttcgacattttcctggaattctctgccgcaggagagcctgacgcgcggagaccaggcagctgctgtagctgttgctgagcagtgtggttttcgccggtcgaaataccgtgaccggacacggaagaaattcgcgttccctcgaagctcgacgatgcctggaaagtgtccgacacagtagaagcatagcgggaatttcccggaaatgttggagtagcggcgaaagacacactagtatggtcttggcttattagccgcgtggctgagttcaactgcacaggttggccgtgttgagtctgtgccacggagaataagggagtgaccggattttgtgtcccagatggcgcagaccccgtcatgtccgtgggtgggtttgagtggaacacaggtcccatggaagacgggttcgtccacgaaggaactttcgtctctgcgttctgagatgaaacggagggtccagacggtacagcgctgctgccagcaagaccattcatttgtgcgactactcgaccgctagaattgtaaccgagcccttcaccgcgctgcagctgaaactgagcctccgtagccccgttccagtaggcctccattgaggaagagcgttgttttgcttgatccttcggaccggcctgacacgacatttgggacgttggaaggccaagacaaaaggcaactcagaaaagaagtgaccacctcatggacgagcgagatactgaatgtttgaggttgtcttcgcttcttctgtcccgttgtggctttagctaccccggtcaaccaggtgtagcgcggctgagacaccggggagacttgctgagtcccaaatgaaaaacagatctcggcaatagccgatatgagccaaaataagtaaaacactggtcctggatgaaaagagattgagaagtccggatatgcccaaacggactgagaaagttgcgagaaggggcgatgtcctgatggagagcccacgttgaaaacgggtaaaaggttgggcacgaagactgcgcaaaagtttgaaaagtgccagagaaacagaagcgacagcgccgcttgcgaagtatacagaggttcttttcgttttctgacgaaatttacttcgccgaacgaagaatgaacactaggaaagcgagaaaaatcaagaacgtgaaattctttgcaggacacgcgcgcggccagcgagcggccagcgagcggcatggcttgcgcggtgagagtcatgaacgcccatcaccacgttgtcgcggcaagtggggttccaagacagggttgattttttacgctctgtgcttctttggaagaagttacagaaacaaaaaacgcaagtaacgacatttcgtgagcatcacattctgcattggacgcctttgcaactcaacgcaattccacatttttttgccacagctagagcgtgttgagtaccgctcgctgccgaaagtgctgcaggcccgcaagttacttcgaacatctcgctgtgcttgtcttttcacaggggagtttgccagccagagcgagcagatgcttttcgcgcggttgccgtcgcctattcctgtacgcttccgtgcacggttactggtggttgcgctgtattcactgtccgtctcaagctgcgagttcggcgtgccctggcatgggacaaaaagacaccagtctcttcacagagaaatgtatcgcaagacactgataaatcaatcagaagtgtgcgcaccgcctccacatagttttcttcgttatattgagtcgctccaacgcgtgatgtcgggaaggccttccctttgcaggggtagtcatggtcacagtagctgtgcaagacgaggaggattatgcaggcgcgtgtatgcggagggacacttgcaatttgaatcgcggcgaggtgccgaggagcgaaaagctagagcaacaacggggcactctgcttgcgactctaaagtcgaccagacgaaacaagcggaagcccgtctgttcaacagagcacacttttctgacagacgttcgagagaattcgcgactcgtgtgcccaccctcagggcaacactccagaagcactcagttcacggttctgtcaattgctccctgcatgtcagcttctcatcctgtatgttccgtctggactgccaagtagactccgcaaaggccgtgtcgttttgtcaccaaggatgtcggtgtgtgcgcaggtatggcacgcttggcgtcccaggtagcaatacgtcaacgatgaatggcagtaccacacaacatttcccggaattccgggatgcacccaagcagtcacacggaaacgccaagcacacttgtcaaacttgcctcgtgcagttctgctggactgctagtcctgctttcatggtgtcattatggcttcaaaatgcgggccccagaatgtcagcagcagtctttacagtcacggcagaacggttcatcgctctcaatagtgagtgatcattcacactgcgcagttttcaaaatgtgccacactaaccgggacaccttgagtcgtgaatgtaccttcataaaagcacacaccctcgtcgaaggcactcattcgtttatcactaccacacgaacgtcgctgtagccttatttagtcgtctagaaaaaatgccacgttttaatcttgtggttcagtggatgacggcagtcggtaacccagaccttcaaaagggtacttgatcgagccgtaggtatcgagatgtggatgaagccactgctgtctccgatgtgggggaagcatctatctcgaagttgttacgagtttcccttgccaggctgaccgcagggctgagatgacgaactgaggtgtaagatgagtttcaccactggaattgattcctctgtcgagcttacaaaggcgtttcgcaggacacacgaaaaagacccaagtgagaatggagtgttgcaacacaagacattctgaacgtcgacaaaagtgtgattgtgaaatttgagttaccgatgttgtgacatttcaaagtacaagtgcatttccaacgataacagcaccaggagtgtctaggctcggtattagcttgtattggttgactggtgcctcgcctcatgagaactggagacttccagttgtcttgctcatgtcgcgacgagatatggatgacgacaagaaagaacgcttctgcatgcatattgtcagtttgcggccataccactttggttcccaacgagtcacccatattggttttcaacgtgatttgatcactgtttctctagactgcagttgaaacatacgcgcccatcaatgtccgcgtctctttaacgatcgcctataggtgacgactagaataggctttcgctcggtgtcccctcccgctcaggttacttcgtggttaccatcacggcaagcggagcagattgtagtatgcggccgactaggcggaagtgcttttgtgtttttcttgtcattgaaaatgacaaaagggttccgaacgacttgcaacactctagaccagtcagcagcaccagcgcacagtggagacataaagttgttcccggttggctgtgtgtgaaacgctttagctagccacatcgcgtgagagattgagcctgtatggaagcaatctacaggaccagatcattttttattatgctgcatttgttgca

SEQ ID NO: 2430 - DNA, 4202 bp, Toxoplasma gondii
gagattcgtgacatcgagggaactttctgtcgggccttcctcccgttcatcccgcgagcgcacgaagccacagcaactgtccccgatacagtccgactctccccgacagagcgcacagcctcgcggcgtctcttcgtttgcgtcgtccgtagcctcttggcagcaggtcgactcattctcctgaagaatcgagagatcgcgagaagtctcctcgtcgtcgaagtcgttctcccccgtcttgtccttcggcctcgacactgcaggcagacgacattgggaggccgcctccgtgtcctcgttcgacgcgttctctaaatcattcgcgtcctggacgacactcacacgccaactcgagtgggcttcgaagaaagcccactcgctctttacgcatgcactgtctgcgcctctcgaatccgcgctctcctgtgcagacgtgccatcgtctacacgggtgaagtcgcgatcttccgcgacgcaggtgctaaagtcgtcgctctcgccctcactttccccctcctcaccgccggtggtgaccaccggggtagaagtcacgagcgtttcacatgagactccagtcctctccggctctgtcgaaacgtcgcgctctacttcgacacacatttccgtgtcctggtcggtgctggacgaggctcgcgacgtccgcagggaggaagccatctcgggggacagaccggacaacatgctcggaggcagcgagggtttagcggaaactccagcgcaaagaaacgcggcctcccccgtttccttctcgcggctctcgccagaggacagtttcccagcatgcgcgtcggccggcaaggtcagcgcagcatcactggaaggagcgcctgcgcctgagtcacagtacgaagcgacgggctttgcggcagacggcggacacatggtgtatttgagaaatggtaagacaacgtgggctcgagttctgcgcaacccccagccaaacacgcggcgggaacagactgagcgcgcgagcggaatgaggactcaaatgtccgagaaaaatgaacgccaacgacgacagtaccttggactttcgcggtgtcaaggaaaaaatcgagctgcgcaagacatacccgacgacaatcgcgcattccggaaaagagccgctcgggtctctgacctagagtaaaagcgcggggaaacagcgacgtggaaacgaatcaggccgaaaaagcgacgataacggatgctagtcacaaaacaagatgttaataaaatgcagccccgcggagagacgcagaagcgaacttaggcgggctcgcggagctcggtcatgtcattcacgtcaaaaaatcgaaatcagtgacaagaacttgtaggaaaaaacgttggtaaataccccagcaaatgccgcgttcttcctgaagcatgtctcaccagagttgagactgctcttccattttcggggggaaacgccgtggggttggagggcgcaaaaacggagcagagtcagcaactgtacaacttgctcaaaccacgaagatcggaaacgcttttcgccactttttggctaccggaagtcaagaaagcagtcgagctactccgttcgcgtcgattcgccgaattccccaaaccccgcacgacagccacgagtcacgaagaaacgacgtggaacagcaccgcgtccacgcagaccacgcagccaataggaagacggcgctctttcaggtggtcggcgttcaaagacgcgacaccgaacgcgtttccgacaagattttccaaagctgcgtcaggtttgttcgcgagcaaggatcgagttcaaagggacagcgctaaggaattcacaatttcgcagtttcccttacctcttcgcaacactttcctcgcagtttcaagaggcggagcagtggctaagaatgcgcggctccacctcgatcttccgtccgaccccccaaatcgcagttttcccgacagactacgcgcagccaggagtagagaagcatggagctcgatgtcgaggcattctaaaaagccaaaaatgtgcatgcaaacttccgttgcaaaaaaacggattgaacaagttctgcagcaaacctgcctgtctggcgatttgcctcgtggaggtcgggtggcaccctccaccccgaatcggagctggggggaacgcatgcactttctcacaccaaacccccggcgaagaaaccccacagcaagacacgcaaccacttttactgccacgacactgtttttccacgctgaaccgactttcgagcgacaacgaaacgttcaccgggctgacgagcgcgctaccgggggactgaggagaactggagctcgacggacacgcgcttacgacttcctttgtgtcgagccgccgcggatgagaacggacagtctgtttcatgtgccaagtcgtgaaactagaagaaacagagactccaatgccgatttcatacaagcacttctgcattacagaagacaacgccttgcgctacgaacgcacacacccgcgtggactaacagctgactgcgaggcagggtggcataccgaaaggttcttgaaaaatcgagactacaaaaagatacaccgaaacgtgtcttcgctttggatcagaccgacgaacatgagtctcgtttcgttcacagacacgcctgcactcgagagtaatacgagccttcaggcacccgcaacaccatcaacattgcgtgcagatggaccagaggcatgatgcaacaaactggtcatccctgaagcgccagatccacttgaagaattcatcgttctgctcatgcacacccttctccgacataatcgtcctcaactcttgaacaatttctcacagccgaacgcgatgggtggagaagggcacgcattctacaaactatacacagcgtctttctagcgatctttgcttctcgagagtcagttgaggttcagaatcctttcagacactagtgaaagaaagaaagcaactggagcccgtacacagcgtggctgtacttctggaaggacaagaatctcgacgccttcgcgcggctggaaatgccagccacggggaggaacaagggggggggggccggagctgtaacacaaacaacaaaccgtccacagtttccaagtgaagggtcaggtccgctcttcactccctcggcaatagagggaaataaagcaggaaatcggagccgatgcgcatagaatgtgacagcagcgtcggaaagtgtatgccgttctgttcggcttgcagaggcatgctctgcgtgacccaggagtatgctctgcgtgacgggtgtgctactgtggacgacgagctgcacagaggcaggcctgcgtccgtggaatgaacgtggatgggcgatagaaaacaagcaggaatttatcagaaacaccaacacattaaagaaactctgacgaacatgttactcgaataaaaaaatgaatgtgcttgttttacgtggatctccacgtgggtctggtgacgcttctgttgtgtagatgcgcagacggggtgagattctcaggggcggttgttctctttttcaccagtcaaatgctcagtaaaaatattgttactaaggaaagggtctttttcaactttgttaagtgcatccggtcgaacgagagtgagcacgtgtgccgtcgggcgtggaattcccgggcacacattaccgcgatacggaagtcttgccaacttctttctcccgtttcctccttccatgtacgtgacttcccgttttttaactttcttctacaggtttctcagcctcactggcactttcaagcgcttaaatctcgaaaacaactagcctaaacgggtatgggagatttggggtatatctgttccgcgtggagggtcaggagtgacaagcaccgttcttgccgttactcactgcaagtttcccgtgtaattcgaggaccagcaggccactctgcattgcgttcctttgaggttaaactgcctttcaaggcgtgtcaagattccatgcttgcctccagctgcttaaccccgttctgtgtgacctccacgtgctcgcgtgctccgcctcggctgtctgggaattcgcgtgagttgagggaacttctgtattggaaatcccattcattgtgtctgtgaacatgcactcttcgtgcgacgtcgactcgggaatggaggtgaagtttccttgaaagagtggacgtttgccgggcaattccacagacttcttgggcacactggtataggggttgagcgcgaattcgcgca

SEQ ID NO: 2431 - DNA, 919 bp, Toxoplasma gondii
tgtctataatcgactcccgcagtcgctcaggctcatgaaatctgtctgcatttcggatgctggcttttgctgtagtgcctgagacggcagttgcccccctcccgccagacctctgtgtttttcgatcgagacaggagatcggacctgacacgaacggacggctcagcacccattataaataaataaacaaataaacaaatacatacatgcatacatacatacatatatacatatacgtacatgtatgtatttatgtatttatatatatatatatatgtatatatatatatatatatatgtagctgtagctgtcaatttgtgttggaaaataaatgtgtgtatatttgtttgcctatttgtgtctgacctcttcgacagctatttcgcagaagggattgatggagtgcttgagtccttccgtctgcatcgtcgttgcgcctgcctggacgcgaggcttcacggcgtagtcgagagtcctcttgacgcatacgacagcagtgtcgagaacgcctttcatcttgaagagttgaagaacgtcagggttgagtctctgcttcgaggcgccaggttcgcgtactcggggaggcgagaaaaggatcgctagctgggtgttggacgccggcgaacgctccgctgtctcctcctcgcctcaggataaaaaaagtcttgtttccaggaaggcgctcttcgcttcggagctcgtaggtagtcagggagaaaggatgcgcacttcgcgtggaagtcgtgagtcctccgtcgagtccccagcgacggttttcgcatccgtcacaatgatcaactcgtagaaaagtacaagggagcttgcgtgtgcgttgaggaaggacgtttcaatgacacccaagagaagcagaagagcaacgaagagagaagaagcgaaagaaaaaagaagagagaggga

SEQ ID NO: 2432 - DNA, 1917 bp, Toxoplasma gondii
tcacaacagccgatcgacaagatggttcctaccatacttagatctacgttaatgtctatatatatgtatctgtatgaatatacgcattaatatatatatatatatataggttttagaagttccacgttaaccacccagtgtgtagcctgtctctcaaggcctgtgccctcgtgctcttccttctccgcaaatcagatatatttctcgcatagtttgcacttctgtgtatacgcgcacggacatatatccatgtctatatgtatatatattcctttcaaagttgcgtaagtgcactttcgcacttacttgcatacatatcgagaccaacctcttcgagagttgtgcatctgcacctctgtgcatatttacaaatccggctttcgaaagcaaaacagaaagatccaccatgttgttgcacagaggcgaactgtgctgcggccaacgatttaaacgcatggccccccatgcagaaggaaaccggctaaagcacttctttgcgtgtgtatgtatgtatgcacccacgttcgagttcaattagctgacctgtggtgtttgccacgtctgtctcgctacaaatatgcagaaagacacatacacaaaaactgatgtacttgtctgaaacaatacttgcggaattgggttctcaccacgtctatgcagttgttgcacacgccaggaattacgtgcaaacacatctgcaaaatgttagacgggtgaaaatacgtctacgcctgtgaacctatctgtagtggtgggcttgagagaacgatccaaccataaggcattcttttcccctgtatccacttgtcaccagtgctatatttggcgtttcgcgtctgtggagatcccagcgtttttgattcgtttctgttgttccctactttgtgccctgccgcctctgtggtaaactcccccgactttcctgtgagcctttagactggcaccaattgagtctacgcttccaggtccgtttcttcgtgaatttccccctttaccggttgaaaaaagtcgtggggtgcatacgatgtgctctcttggcattccacgtgtgatgtcgtgtcgcggagtcaacgaagttttccggatagaacatccattgacgagactgatactgttgcagctttgttgacatgcgtggtattcttgggcagattcgctaattcagaagattcttatgcgccgtgtctcagtgaagcgaatgcgacagttaccagagtgttgccgacgtgcttctttcccgctctagcacccttcgagaacataacatacgaaatgtggtgcctagtgaaaaaatctccccatggaaagtgagggagcaaggaagcaacacaacttgcctttctgaggccctgcacacctggagacctggagaccagagacatacgaggagagggagacacagagaaaaaaccaagggggagagacatcagggactgggaggaaagatggcaagagggcgggcggtcgcgatgtgaacgagacaagtcctttgttgtgcggtttccagctggtctgttcttcttttcgtccttcgaggtacccttttctcgggagggcccgaagggctgaggaggcaaaacacaactgcatgcagtgattcagagcctatcctccgatcgtcatttttcgctcggttttccaccgccacttttcgtttcagcatgcacacctcgtccactgcccagtgtattcttttcctcttttttcgcttacccctgccggccagagacgtctggtttcgtcgaaacgggctcgacagggagacccccggaggaaaaggcctgggttaatctactgttttctgagaatttccattttcttcttcttaaggaaacgttgccaggtgtctttgctgagtcgcatttttgtgttggcgaggagcggcttttctctcccctattacccgcacagtcaaga

SEQ ID NO: 2433 - DNA, 4746 bp, Toxoplasma gondii
cacttaaaatgtaaatagatttaagaagttgagacgctgcgagcttcctagttcacacgccgagcgggagaacacggatgttccccacagaaaggcgatccgttttcttgaggaggaagaccgcttttcggtggacgcgaagagcccgcggagacaggggaagagaggaacgaggagcctgggaacgaggaccgaactcgagcacatgaggagtgtgaagcgtttgcgaagattcttcttagtcgagtcccggcggcgcaggagacaaccttgtcgagacgaggcagtgcggcaggccttccttcgcaatacatctgggctcaaggtgcagggcagagagccttcgagagcggccctcagttccacgcgttgacttttctggaaagtccgtggcgagtcgccgcgtctgacgagaggcgcttcatttctcagagggttcaggttttccccgttctcgcggagggtggggggggagagggtcaggacgcgacaacggatgctcttaagaaggaaagaaccgcagcgaggagagtcttttgagcaaccggagacgggcagaaggcgccgggaaggcgccggacacacacttgcgctctcctcgattgaggcgcggaaaaaacgtccgtttacgagggcgtggagcggcgaacggcagtcttcgagctggaaggggaacggacggaaggtgcaagggtagggggacaccggaaaactcgatttctcgaggcctttgtttcccctggaagcagtaggaagtggaagacattctcccgcagagactgacagacgagaaaaaaaaagacgagaggtggtagacagagacgaacgcgaatcggctgcggtgtctcggcgaagaaccccccgcgaggtgccggctgcttgagcagcgaaagccgtttttctggaggcggtggccgtcgttggcggcggcaatctctgttgcaggggactttctcggcaaggagagcgcagaggaaagaagtcgggttttctccgcaagaaaggtaggagaaactgggagaaactgcgtttcggcggcacacgcctagcacggccgagaccttgtcggcggcaagacaagcgtcgaactccaagagccgttcctcggagaaaacacgagaaagaaggagtttcgggggattgaactgtcagcaaaactctcgccacgatcgtccgcagcgaggcgaagtcgagaaacctcctgaacgtctggaaatgccgagaaaaccggatcgggcacacgcagggcaggcaaggtcacacggggaggcatgcagagggcgaaaaggaccctgtctgcgttctcacatgctcgcgtcgcgttcggtaaaacgcttcgagctctgaggaaaatgggcttcattccggaaggcgaaaagcagtgacttcttttcacgtttgtgcaggagttccagtcttccaaagagccggagaattccggcttctcttgtttgtgtttttgtgcacttcttcgctggcctatcctgcacttcttgtgaaggcagcatgggcgtcagcaagcgctgccgaaggcggtaaacagccatgatgcccagatgcccccaacggctttctagactgtgttcacctttgaaacgcacagttctctgagagtacagcttcggagacgtgaatatgccgacgcaaccacgccctcgttccgcgagaacgcgcccgcagcagagacgttccagaaaagagtgattgagaacggccgggtcactggcgacgctcgtctagttgagaagtgtcaactgtgcggtgactctgcaactgcaggcgcacaacatctgattcaagaaggcagttttccccgtgttccttggcctttgcgcccccctggcactggagaggacctaggttctttctcgatttcggccggtggaagctacagcgtacctcaacctcactttgaacaagcctggccctgacagttctgtcagtttggtgcatggaggggaaaccaccgaagaaacgcgaaggacgctggggcgcagaatcggtgagtcttcaccgacacgagttttgtggtggatgtaaaatggcttggcaacttgtcaggatcatgctgtggtcgacacagatgcacaagagaaaaggacgctgggctagggtgaactggagcacctctcaagtgttgcaggaaacggcgtttttctctcggacacggacgtgaaagactatgtgttttccgagtcactctgaggcaggatagctcttcgtgacaaaaggtctgagaataggaaggacggcttgaaagactcgaggacgcatctacttcccatgtgccaatggctgtagtagcgagtccaacatgtatagaaaacccgcagatacccccatcgaacgacgcgcaggagcaacaccggaaactgcatttgacgtagcagaagaggagtgtgggctacggaagaacgtgcatgtgtgtcccttccctatatgtgtacgaaatcgaggagcgctctgcacaatttggcacagatgagcttctgcaccgctagccttcgccaccccagaagaacaccgaaaatatgtgtcactcgcggcgtctgtggcggaagcaccgagggaatgcaacatcccccttggtggaacaggaaaacgctcttaatttgagttgcacatctacagaaaacagtgaccgagaaaaaggctgctccagtccagttagtggatgttcgacgtctgcggcatgcaaaaaaccgcaacttcaacgcggtcgcctactggcgaatttcggccttcagcaaaagaaccccgttatttcacttctttttgtctttgctctgttccgccgggtgcgagcgaaaccgtacttagttgaggcagaaaagctgcgagacctagggggagaaaaggaccttggcgtctcctggctgccgttacaaacatccttgtgatcaacattactgagagactctcctctggcaaggcagtgatgcctgttatttcagatgactgcttgcacgtccttttgaaatgttgcaagtcacttgcatcgaagccacagtcactctgtttcaagggcagaaaacggagggagcagttggtctggttcgtgctagctacccgtccagaccccgagcatctgcttgcctttctcgttacggggcgattggcgcctgtatccagagcctcctcaactctagatgtccttcctccgtctcagaagactatggtaactcggcgtcgtacccttcagcaggaaaaacgactctacagcgacgagaattgaaacgcaaaggttctcgaccccagcgcgtccgcgcaccggcgtcaggtgccagtctcgctgtctgatggtagcacggtgaccacgcgtcgatttgctcggacgcccaagtttctctttcgtcttgagcaaaggctcatcagcggaagatttggcgcctcgtcttccttcggaattttcgtctgaggttgcgaaaggcgtttctcctcaaacgtttctgaccagtgtgccgccgcttcctgaggaaagcgcaacgcaaaagatacagaagccgcgtctcgggaacaagcgccgacgtcgtgcgcccccgtcactgttatgcttatgaatcaccaccgaagagttcttttgacgcttcagtcttttgcatctgagtccttctgtcgccagctggtgacctaaatttgaaaaagatttcacgtcgcgagtctcgacgtgcgacagacacagccgcctgctcgttcgtgcgcgttgtcttggtattcgctcgactgcatctttctctgcaactcgcgcgtttccgtcgagctggtatcttgacattctctccttctgtgtatttgccgttcggcgttctcgaggaaacgtccaggtcgggttggtctctggaaaacgagcatgcaacactgtaaaacctcttttcaactttcccttcgcgcaccgcaagattgcaagatagccatttgcatcatttcatccgagaggttctgtggagagagaatcctcaacaggcaaagaaaacaaccgttttcggtggcagagaggatgtgctcgcgacccttgtgccacaagtgagcaatcgggagcaacacagacgcaaagtggcctaaatttcccgttgcatttttatctttgggactcctcggacgatccaagtccctggctctctggaccgttccttcctttattttatcctgtgcatcctccccgtgtggatgcatccttgccatgtcgatttgaatttcgcaggaaaaacggagaggcggtagcggcgcgtcccgcagctgggttggggaaaggccggattcttcgccgtgacgttatcgtctcgcgggagaacggcctctcctggtcagcagctgtcactgtagagagtctgtcagctgcagaaagccatgtcggtaaatgcgtcgaagggtttatcaagtccattggagcacagcgtgctggacgggcaggctaccccaagtggcagtgtgggtggcattgacagtgcctctgcgcaaggagcagctgctcgtgaaagtcgtctgtgtggcttacacagagtggaccgaaggagtgcgatggtagttgctgaggctttgtttctggactaggaaaaagcaaggtgcgatacatgcccggcctgtcggcgcgccagactgcaagcgaaagactagtcagagctgccgacacgcatgcgcagtgcgacgtctcaggtgtcactttttttcgcgttgcggcacattggttcattgaagattagagcagaagttttccgctgtccgtgacttgtcgcgcacgacacacaa

SEQ ID NO: 2434 - DNA, 2419 bp, Toxoplasma gondii
gacggagaagcgataagcgtagcaaggcgctactggtcccatgttttgcttgctctgtcaattccaactcccttcctccgcgtggaagtgaaaagaaagttagcgcctgccctcacccgttcactcatttatcccttatcgtcctcatgtctccactacccccgacgcagttctcggtcgctcttcctccgacttccgcgcagtctcatccccccacctcccctgccgcatacgcgttggtgttttccaacgcttctcgaggcctttgttgttctcgcgaagccggagagaagctgtctcaggagtctggagccgtgcgtgtcgcttaaaacggtttttctgcggtcattgcccctgcagaagtcgacttgtcagtggcggcgaagggggaaagaacgaacgggtgtttctggtcgtaagagaagaggcgcgccttcatccataaactcatcaaggtctgcttggggtctttttcgtcgacgggccgcgggcagagcgcggcgtacgcgaaatccacgcgccgcttctgctctccgcggcagttcaagtactggggaagagcctttaaaacatcagcgtcatcccaagaaagactctgaaaggcgctttccatcgcttttggctcctgccagcctgcggccgaatcgtaagctgcaagcagtttgagatccccgagcagacggtccatatgcggcgacgacccgctggacgcgaccgacgcagacgcagtgggtggcgacatggtggcaaacggggcgacggggatggtaccagcaaataacagaaaaagcaaaagtgggagagtcacagagagagccggacgagtgtactggccccgtggaacagagcgacacagcaggtgcacggcgaaaccactgaaaaactctgactgtatctaaacgctgtactgggaagcgcgaaatacagacaagcgaccagcagaagactcccggagacaagaagctctggagacactaacagcaactgtgcacaccaactatgcaaatcagcgcagaatcagctttctcttgcctgccagaaaagtcaggcatgcaaccaaaaagcgggatccgtttcgctgtattgcgcttcgtcgcatgcgacaaccaaagctgctgttttcgcagcgttccccgcgagacagcgcttttctcatcaaggctcacacgcccacccccctcgtgttgcttccaaggaggtgggtgaaaggacggtttcggcaagccgcttcgagcagtgtgtgattggcgcagctcagcgcatcgacgctagcgtaggttctgtactgatctcttcgatccaatcaaatctcgcttggtccatcagcccagcgatgttaattctactgtagccgacaaagtttcggcttgtcgcttgccttgttggtagcacaggtcctaaaaaaaacaagccgtttcgggagcagtggctgtggctgccgtgcctcagatcaatcgtcagagttgcgtacgggggagttctgtacagagctattcgtccgatgcagttactttgcatggcgcatatgccgaatctaataaccactatttccgacaaagttacggcgcttgccttgttggtagcacaggtcctacaaaaaaacaagccgtttcgggagcagtggctgtggctgccgtgcctcaatcatcacagttgcgtacgggggggttctgtacagagctattcgtccgatgcagttactttgcatggcgcatatgccgaatctaataaccactatttccgacaaagttacggcgcttgctttgttggtagcacaggtcctacaaaaaaacaagccgtttcgggagcagtggctgtggctgccgtgcctcagagcaatcatcacagttgcgtacgggggcgttctgtacagagctactcgtccgatgcagttactttgcatggcacatatgcccggatacaaaaactaatatttccgacatagttacggcgcgtcgctatcttttttggtagcacaggacctagaagtcgtttcgggagtagtggctgcggctggcgtacctagatcaccgaagcttgtgggaggtttttgtacaggttttgtccgatcccgtcgatgttttgctcagtccacctggccagttctaatacctagtattgccgacagagcctcggtgcgtcgcttatctcgtcaactcgtcgcattccatttcacccgctatcgacgcttttctggtgcgcgtgtatacgccagtacacggttgtccaagtgtgagcacaccgtcggttaagagacgcaattccagtccatggatttgtgacgcagctgggtaaagctcgtcacattgaagacagttttagtacttccgaaatttggtttcgcgccctccctctagtctcgagacctggtgggtggattgttttttttttacgcacaactcacgtcactctcccaaca

SEQ ID NO: 2435 - DNA, 1678 bp, Toxoplasma gondii
accctccgctgattatccgaggaacagtcatgcgttttgtgtttcttagcattggcatatccgctgcctccttcgatccccgatttcgtgcgttctttgctcgtgtttccagtttcacggactttcgtgacacatccactcctcgaattacctgcgcttcgattagcgagtagctgcgtcagctggaggctggcgactgcgcacatggcgaaacgcatgtccggttcggctgcatggttcggtgaatcgttgcactggttgttgaaagctccagtgttctggtcttgcaaacgtgcgagaaaacgctggatcttgttaagtaagtgcggcggcaaagtggaagggcccgcactccctaatagaaacagtatctgcagcgcactcaaggtcgatagactcgttgctgggtaactggggtctggatgtggcgcaaagccgacgcagcaggagcaggctgcatcttccaaagactctgactgagggtcggcgctgttttctgtgccttccacgtggcgactgcaagcaagtgttcgtttgcatttcatgacaagtctaactaaagaggatcgctgcgtttcgcctagaaaggaagtggacgcttcctcgcggttacccccgtcgggtgcgtcgccgaatccgagtctgcctcttttgtagtcattttctaagagcgccaaacccgcgagcgtccagtacactccactgagcagaaaggactctgcttccacagaatttatcccatcactggagctttcttcttgagaaaacggatggtggtgagcgaaatagtcttccttgtccaatttcgaactctccgcctctctctttcgcagggactggaggccggcgcctacaacgcgctggagaaagcagcggtgccgagcagcagccaggggggcctccaccaccattcgctcggatcgtctgaacacacatcaattagtgaagcgaaaagcaacaagaaagaccgaaaccgagaaaccgtaacttcgtctgcggcggaaaacgagcatcagagaaacagactgtcgtcactccagcacacatcgcgacagacacacagatcttgaaagcgactccgttcctaagtagagggcaggacccgaaacggatagaaaggacatttgtttacaggacgacaaagactggcgtgtgtgactctgaaggaagagttgcgacaacaggcggctgcaacggtcgcctacggaaaaccacacagttgcggtaaaaagacaaaaaccatgaaggacttttgcaggtgaatcgcgcgcgttaaatcgatgagtttgcgtcgcacggagaaattctggaaactttccttcatgtcgttttctgttgtcggttggagagcaaagccaccacgctttacattttaccgcctgcatgtgtgtgtgtttatcgcatgcacgcaaaatccatcggtaaaaccgcgagactccacgtagaaaacgatactttcagaaacatcacttcttgggattctctggttttgaagaaggactcctttcagcagtcactgcggtgtcgcttcgtgagactttcgttccttccctcttttttctcgttgcctctaaccgactcttggcctcttcgtgcgcttggtccttctctccctcacagtttgcttcccaacttcctcgtggtaattacgttctgctcgacttttgttctctctgca

SEQ ID NO: 2436 - DNA, 1773 bp, Toxoplasma gondii
agcatttgttgatgtatatgtcactacatactggtgcacacacttcccaggaaagcgatatatgcatattcatgtatatatatatatatatatagatatatatatatatgtgtatcgtgacgtagcgctacaaccctttcgggtggcgtccagcaagcgcgtaaacgtgacccgcccacaggggagggaaagaaaacgttcgatgccgtccgcattgaggaagcattctttctgcagtcgctcaaatcgaggatctacattggtgccagcaaacgactcggtttcttcacgtttccaaggatttgacttttagtgggacagctgagtgcacatgacaaagagtcctgctttttgtgcaaaaggaaggcaacgcaaagtacctcaccacagtcgtttctgtttcaagatgcgaaaagaagcagtgctccgcgaatgagaaactttcctctcggttgtatcggctacgttttgtcgctttccatgagcacaaacacggtgtctcatctagatacaaacgcattttcgacgcttaccactcttctggaagtgaacagtgttttacgacaaagttaccaaaagtgcacggtggtactactgacactaaaggaggctacagagcgcttttctgttctttttggagacggtcacacaaaacccccaggctcatgcaacaacagaatagaatgctgcatctcagagcagacgccgtctttcctcatggtccccgtttatcgagaaactccgtcgagtccgtatcggaatggcactcttagaaacgaggaacgaacccagaaagtggtaacgagtcttccagtgtgtctcaaaatctgagcaaatattagcagtactctatgtccatattttgaaaaaaaaatctgggccaaaaaggcgaccgcaacgcattcatggtctaaatcacaatctatagccgtgtgtcgctccggcagccgctactgcttctctggaaagaacggaaatctgcagaactaatcgcgaagttcgttgtgagtgcaacatgcatcgcaaaatgtacagcaagaccatcatgctgcgaaacgagaatggtttgttccccgtgtgccgcgaaccttgtttctgaaaccagcgcaatcgtccaagatgtacattgtttcatgtgctcattctgtgtatgtggcactcgggccccagtcacgaatcgagctctgagaaggagtcaatgacagtctgagtctttcttctctcgttttccttgattctcttctagtctggctgtgaatcccgcaacgatgcctctatcccgccggcttccgtttgaacttttcacattttcgaaagcgcttactagctagcgaatccagaatcccaatttgtgtaggtctgatgtggactgagcgtagaacctccgtaaacgcatcgagaggacgccagggcggaactccagttatccacgtttcccctttgtgctgaactcgtcttcgtttgtatttcattttgtatttcccctttggcactgccagcacatcggggttgcacagccatcctgtcaaaaaacgtgaggacgcaaagctgtgtcttctgctagcggctgacttttgcttttgaagacgctcttctgtcttcgcgtcgatgaacgtggattccccctttgtcaggtaggaccaacacggtttgcaagcgagttcaactttttttcatatcctatgcaccgtgcagcgcgcaatctgcaatcctcggatacagctgggaaggtcgtttgaatgagcaaagtgaaagaacaggaaagctaatcca

SEQ ID NO: 2437 - DNA, 3727 bp, Toxoplasma gondii
ttgtcaacttcgtctgtgttcctcttcaaggcctcaaggaacttgcaagcagggtttggacggtacagcaggcctgcgcgaggtgccggtgacggagctgacgagcctcccggcattctagcgtgtcttctacggacaaatcgtcagaacagatggacccagggcaaatgccatcagtcggcaagagagcggcagcaagaagggaatcacaaaagggcgcctgcgactggggatgatacgcaggcaacacgaggtgggagaaagacaaataactcagacgaacggaagacaaagcgactgcgcggggatatgtgacagtaaaaacaacgcagaacggggatttcgtggaaactatatgcggctagtagcgatgaacagactctgtgagcacagaagagatacggcggagagcagcaaggcgacaaggggataggttgcactcttttgacgtgaaaacaaggacctgtgaaagacaagtattgtcccgatgtgtggtcggtagcacgcacaagaagcaggggaggatcgaacgaagttggctgaagccgtgggttaactagctaggagtaacgggaaagggcgaacatcgctgtagtgcagttctctcgttttggtgaaacggtggaagaattattaactgcggacgatctgactaacaacgcagcatttccaccacctggttagaagaactcccacagatcgagtagtgaaacgcgtggctgccgaaggatgaacggaatctgggacgttcacgtgacgaaaagatgtttgagaataacgggggtggcaaaaaaggatagaaatttccacaggaactgcctccaaaagcaactggcgtaagacacctagaaaggtgcagtccccggacggaagaaagggtcgcaaagaatttgttctcagcaggacgcaggccactggaggtgaagtttctgggacgtcgctcatagaagccggttgcagttgtgtgtggtctgtttccagaacagcatttatcaccggcagataatgtacatgtccatgggcgtagacgcactgcccgctaacggggctacccgtccttcgcagaaatacacagggaaacgcagtcttgtgtgcctcagagtccaccacgttttgttttgactctcaccatcagaaaaagggggaggtgaattcagtgacagctcccggacgatggcaagtgagttgcgcttaaaaggagaattgtgtgttagcagaagccttcggactctcttgtgcgggaagcgcgagtgtcactacggaagaaatctgcacgccggaaagcgaatgtatccagagttgccaaggagaatcagacaagtttcattgagactcaacgagagaaattacatcaacggggtcatccgtcctcctctctcgatctgccggctcttcctgctcaggaactcatagagaggcgaggcgcggtcttgtcgagttacccggtttctgtggcagctacggtaccgcgattgcccagcgctggacagcaaccagacgcaaacggtaaacagccgctacaatggcgggtgagaaaacaatcgatttgggaagaggtgtggacgggagagtcaatatctgcatgtagtaaggagtatcgacggacttgcggctagcaagccgcttcgaacaggctgtcccgcttgagaggacggccagcgcacggcgtagcgcggcaaccttcttgcagtggcaaaatcccgcgccagcttttcttgccccgcaaaccacgggtggaggcaacgggttgccggaaatcgatgtccgcgattcgtaccaggcggtctcgctgtgttttggacgaacctcgggagaagccgcgcgacactacccccaagaaaacgagggacttttcccaacatccaacaactgaaagaaagaaacagccgagtgtaagtagggatggaacttttaaggtagactgtttgtggtagtcttcggttcaacgcagatccctcaccgcataaactcacccactcttcagctgagccagcattatcctcggatcgcgacaggagaggttccgtaggtccccttaccggacgaatagccaggggatggctctgccgtggttgaggtctcagcgggacctccgacaaaagggtttgaacttaccatcggtcgcgcacttatcagtttcttatgtagtctggggagcttaaagatatctggaagcgtctgcttgcactttctagaagggaagcctcacctcagtctaccaaacgggctgtcgtaggttggcggtggtcctaggcgttgtactctcgagttaagttgttactttgaatgaaacacttcaccaacagtagcgctgccttacatcgcacttcgttcacgtaggaagaagggagtctgggcgtctgtttgggcgaatggcggcggacactcgcttcagcctcgtctcaccgtggcgaactagttcctgagggcgaaggtttggggtagggtgtggtcgcggtggtggttacgacgcgttctgtgtagtttcttcccgctaattatggtatggtgctttgtgttaagatgtgcctcaaaaggtatggctacagagacgcgtggcaacgccacggaacagcctgcgaaccgccgggagcaatagggaaagtgaaagagcgactgttagtttgccgatacaacggatgacgatgctcctttcgtcaggactcggagaagtttcatcgtgtgaagctgtagacaccatacatatttcatcatttccagcgttgccagtcttcggtggccccataagcaaagcaaacgcaaactggtcactaagaaggcgacactgaacgctgacagagaaattgaatcagttcaccaatcatgagcaattacttctctcaaaaccagcctcacacggagctgttgcagctccttggcctgcttgatcagtgtgtatcgtcagcttaatacggaaaatgacacttgctgaggagggcggaagtcctgctggaaggcagtgaggtagataaaacggacatttatcggaaaatgacacttgctgaggagggcggaagtcctgctggaaggcagttaggtagataaaacggacatttatccaccttttctctcacggcattgtcgtcggatgctcggcattgtatactgcagaatctagggcgacggattcgtacacttatcaactcatggttttccaaatttcatatgagcaacgatcccgtgtgagctaggtggttctccttacccggagacatccttggtaggcgttgtcaatggctttgtaatacgcatgacacaaaaatgaggtagctccatcaggagtgacagcgagtctagatgtgttcgtgtatccttgtcgctgtgggcacacgaattctttcggctacaggacgctgtggccgatgccacgcatcgtcggtggccagaaccccagaaaaacgaacgcccgcgcaagtgcgccttcaaaaagaaggcagaattcttccgttcccttttcgggagtttctgaagagatgatggaacagagtgtgctgtcaccacgtactgtgtgtgcacggaatcttcgtggatggcaggggaaactgttatctcgaagcacatgcatttcctgacagcccaggactctgcagtttgctggaaagtgggcatgccagcagtacactttttactcagtgtagagatggtattcctgaagagatttttggaggacaccgactagtgcctgattctcagcgtttgccaggtggcccgaaatacggcggttaca

SEQ ID NO: 2438 - DNA, 2967 bp, Toxoplasma gondii
ctgtgtttgtgagctttggacaaactccgctttgcaagagttggcttttcttgtcatctcgagggtacagagttccctgaagctcaggtgaacgagtccaacaaacacgaaaacatgcacgagcttccacaattgttgccgcagcattgacttttcccctgtttctgtcggtacctttagagtagacagtgagatgtccacgcattaacgaatcatcctctcatagccagagaagcgtgtatgcaagttttcaacgatcgatagatagaaggggattcactctggggtaaggatacaacgtcaaatggtttcatggtacaaaactcggggatggagtgacttagattaagggatgtgctcaacggaagcacctgaaatggagttcgtgttgatttacgtcagcggttaacggttcggaacgacctctgtacacctagctgttgacccccatttaaacacagcagttaccgtagctgcaggtagacgcgaattcgagacttgtctcctatgacactgcatagcacataagattcacacaaacgtgaggtctgtaggggcatgagacggtaagagcagcttaagcgtcccgcatctctcctcccctttctcggagatgcccacatacgttaaagaaacctagaatttctcgtgaacaaaactatagaacgaaccctgaatatatggatcacagttcggttggatgtgagtgcccagcagcccgtcgatccatttgtcttccccgttcaaatggtgcaaattctgtaactgtgcactgtacatggctttgcctgtctgtaccgatctagctgcatatctatctagatacagacgcgtgattagattcgcaattacacctccgtattcgctcttttgacgatgaaccaccgtttcccagaataggttgtcctgccagcatcgtcgctctcttgtggagtcccgcgaagtgattctgaaatctgagttgagcaaaaatagagggacggcgtactgattgttcccgcggtctgggaggtggagcgtctgattgagagagtgcaaaactcacaaaactgatgacgtcaaatcaagaccactaccgacttcggaatggataatttgagttacgaattcaaaaccgaatcacactgggaaatatgccggctttgtacggaggatacaggaagttctttgtaccaatctgtatcctccgtacaaagccggcatatttcctagtgtcggcgtctgaacggaagaatcgttgataaaagcgaactaaggatttgggggattgatcaagacatggaaggagccgagacagaacattcaatcacattccagaagacttgagacagtgaaacaccctggcgaatgggaaatctgaagtttgtcgtgctttgacgtttctgttgtctctgacaccaacgacgacacgcgcaaacccgcatgctgcagatgagcaagaaaagaaccgtaaaaggatcgattctgtcaatttgtgcatctgagttgaaacgcggttatacatgtaacacggtaattttccggttaaagccccattttctttgacacacacgtctctcctcgccccaagtatgatctcaaagtgccaaggaccgtgtagcatgtaaacgcgagttaaagcagccgctttggcaagtgaaatcaaccactttaaccttgttcatgggtcaaacacggaaagagctctttgccttcaaggtgacacgggttatgagctgttctgagggaaaagacgtttctcctgtttactcttttctggccgacgctgacaagtgacaagccaaaagtggctttgccgcgggaacctatctcccaccaacctgctgggatttcctccgattcttcgccttcacttttctggtctttttccatcttttcttgtcgctgaagaaaacaactcgagtctagataccatatatagacatatatctgtatgcgaatgcacacgatcaagaccatcatagatacgcgtgtatattcaaatattgccctgatcctctttcgcctacagacgaggacaggaggccaacgaaagacgggcagggagttgcgtgtacttcttcatgctgcaagtatctcaaaatctcctgtacactccaaactgcttgaccgctctaaaacagactgtgtgttggtgtcctgctctctcgctccgtagccgcatacaattaacacaaatgcgtatctgtagctacaactactccctacatttacttgtgtacgccagcaaaaatattcctgtcccgctgcagcatgccggacaatatagaagttcagcaatcgcgttggtcttgagttttctaactgcgcaactgtttgcttgatttcaccacaagatgagaccgcatgttgtgaccgagagcagggagtctgtccggacttcccctaagagttcttgtcccatttctccatgcgtttctccacctttgtccaactgttgttcaaagactcgttcaacaactgtttctcttcccgctacaaaaccgacatgctgccggtccaagtctccaagtatctcctcgcttcctgggggtgtggaagaagctggaggtacctgttttccttcgttggtttgttccccacgtacttcttctaaattgtgtgctgcgccaaaatgctgtcattcgaaacctgcaggacttctgagtctccctcctcaggcacgtacgtgctgtccccgatcgaatgtttcgtctgcaacgcctgccgacgcctctgtggcatctccctcgccttttcctaaaccgcctgctcataccgaggaaacacatttgtctgcagaaattcattcccagcacccggctgttgctcgtccacctcttacccctcctcttaatcctcctccgtttcctctttctcctggccgtgacagggatggtggtaccacgtctgcgacgcttccctctccgtccgatgaaacgtcacctttcctcgacttggaggtctggcgtatctcggttgccggaa

SEQ ID NO: 2439 - DNA, 3199 bp, Toxoplasma gondii
ggtttcggagatgaccttgcggcctcttttgtctctcttccgaattcgcgggcgcgcgtccacgagcgagttccggacgtctcactccgcaagcactcccagcgttctgtttctcgctcctcttttccttcttccttctcacgcgctgtgccttggacgcggacaccaccagctgatgcggcctcgcttcttcgaagagaaacgccgaacatccactctctcttgcgcgcgtccgttgggctctgaacgaggagtgcgaacgcgcaggagacgcgaagggcgttggttctcctcgttcatcccctctcgcgcgttcagcctggatgcagggcgcgcgcctcgcgcccccagaggcctcaagagagaagtcgcgacacacagccttctcgactgcggctaaccagttatttgcctcgagtgtctgaacatctccagagcgcaggagagaggaagccgccagcgcccgcgtcaccgcagagcttagactcgcctgaatgcctagggaagctgcgtcgagaggcgaggaaagacacgcgggtgtcctgaagcactgctccaagatgtctgccaagaactcttcacactggacgtcaggcgagtacgcacaacgagtttgcgaaggcgcagaagatccggggaagccggcatcggaaatgtcgacggccagccaccacgttggacgaccaagtcgcgtctgcaaggactcacgggcggcctcggagattcttcttccacgcactgcgagcacggaagcagcagaggaagcagagtctcccgtcgacttccacgacgtctcgttcactggccaggaagacgcccccaccggaacacaggtttcagatctcttgcgtctcgccgcctgtcgctcttcctccatgtctacgtcggccgctttcctgctttgctgcgttgctggttcgtcggtcttcacccctctctgtcggtggtttgtttcagcagcgcgctggagggctttcgaggatcgacgttcgcgccggtccgatgaaggagttcccagctggaaggcgaaaaaaacagtttgcacggagcgaaacggaagaaggaacagacacgacggccttccattcttcgagttccgtcagagaaaagtctcttttctcgagactctggagaactgcggtcccggcgaccgccatgatcctggaactcggtgactccgttgacactgcggtgtctgtacacctcacacaccggcaacttggtcgcgcatgcgacggttccgctgtcttgatttgcggtgcaaatcgcccttgtaacgcctttgaaagtgaacgtctcttcgcgagcgatgcagtgcgtaatctactttctccgcagcctccttcccgtgaaggcgctcggcggacgtcgcgcaacgcttgtcttgccgcctcaggtctgcgcgaatggcgcccgcgcagctcgcgaaaagatcgagcttctaggcaaagcgcagctccctgcggcgaagaagtgtgcggaaaactttgcggagtgtctgagaaagaaaaatgagttgtcgaaacgggcgaaaacgcagggcaggaccgcgttttcgcgttggacagcaagacgcgaagttccacgcgaaaccgcggcttctcctggggaggcaggcctgcacagccacagtgagagtttcatgtcaggagcacattctctgctgcgcgggagtcagttcagaaggaatttcgaagggaagcacagaaacaacgcgcgggagatatgcgactcggactacgggagcagcgacagcacacatgcgtgagcggaggacgcagggagactcgaccggaggagggggggaagtcgattttccaaggcctgcagcttttgctgtttctggattttccactgaactttcgaagtttgttttccccgcgcttcgctcagagagacaaagaaacgcggacacgatgggtagatttcatgaagaaagcgtcgcgaccgagcacacagaaaaccggccagcagagaaccgcaggtcggcgccgatgtttctgtcgattccttctccaccaagagcagatttctgtttatttcctccgcgagcaatcggcttttcatcacaggctagcgtggccggcatgaccattgtgcagatggagtacacagcctcgagctggtctgctccgcaacacgcacttgactttatttccaagcatattttctagactccttgcctcttcttgggccactctgtgctggatatcgtggtgaaagggggtttttctgtctggtctgtcacaaatgttctgaagaggagaggtcataactcacacgcttgcgggacttcgttccatctcaagccgaaaccacattcactgcctcagcggtggtactctgtctgtgtcaggtatcattggtgacgaagacgctcgaaatccaacgcctgtggctgtcttcagcagtccgaagagtccgaagaggggtgcgaagtcaccacaaagaacgactggcgtcacacagaatgggcgtcgcatgcttttcctgtgtgccctccgtctgttttgtttacgtctgccaacgagacaccctacacatttgcgtagttctagatgcgtagtgcggctcgaagcgtcggtacgaggaaagcgaagagaaacgaacgaacgcagacaggcaacttgtttacataaacgaggtgtcttcgatgggagagaggccagcagcccgtagcgggtgtgaggtctcgtagcgtctggcttcccgaatagccgcctcacaggtgatccgcttgaaatttggagcttgccgactccgacagagtcgccctgctcactcgaacgttcttcgcttttggtaagttgactctcctcgtctcgttgcctctccaggggactcttcttccctgcctccttctgagagacgtccctttctcgcgccgcctgtgcgagcagttccaggatcttctcgacttgcatttaaatggttctaacaactctgcaggtgttgataccgcgcttaacgtggagtgaacggtctctctcgccttctacgtcgaccagaaacagtcgacatctgcacaaaagcgcgtcaaccgtccggtcgccgacgcgatgtcctccgtgtacacgcaccagaggaggtcgataaacagtcgtgagtttttcttcgtcgtctcgtcgacgagtgcgacgaacagtgcgtcagtccatttcgtcgggacagagacagacagaagtccggctcaaaagga

SEQ ID NO: 2440 - DNA, 2944 bp, Toxoplasma gondii
taaaagcaactaatttcgtggtttacttgcgaacaattgctgcttatggcagtgtgtgattggcaccctgcatataaatgtcgtctctctcggggtgttgaatttgtcagctggagcgtcataaggtgctgtcttctaaacggactgattgtgaacgcaagcgaacagagcgacaaactgtagtattgcactcgtgtgaaaaacacacacggacagtcgaatgacggatagtcgctgtatgtcgcgattggactgcaacagcgaatgttcaaccgaaagacacgaacaagcgaattatgtagtggatgaagggttgttgaatcaacatctcattaggtgcttagtggccagtgaaacgcattgcaagagcccgtcttgcgttacagtgccagagcccctcttttttccggtcaaaacatgttagtctgcctccagtagtgtcttgcgggtccttctggttttaaggcttgcaacaaggctgaagcgagcagctgctaacagtgatccacgtccatttattagtcaatcagggttgctccatgctttgcaactagattgaagagtgtggcgagacctctttgctttcgttcggtgattgggcatggcactaagctggtgcaatgcgagaaagcaatggcgtagccaacccgcaaaggagagattgtgaagccgaatcagccggcagtcgcgcggttccaagtgacctactgccagctacgtcatttctctaagcaaaaatcagtaaacttcaaaaaacggtgcttccttgcagtttggacacgccagccaatgcttaaactgtgccacctagcctttgacatttagcggggcactgctgcgtgtgcacgttgcagcttcatcctcagtgaccccttatgccggttgcgtcacactcgaccatgcttcttttcacagaatcatattccttcaggcaacgacctgtacgtactgatatcctagtctgcagactctctggcgagaactgctttctatctgttgcttcatttgttgtctaaaacgtactcaccagactaggcattagaagtgctccagtacgcagggatgggtcaggcacacccgttcttacaacattttgtgttaaaataagtcctgttctcgctgccgaaaaatcttttacttcgagaacttacttttttcgctgcgtcttacccagtgtactcgagtgactgatccaccctgaacgggttaacactacgggtgctgccttgtcgagagcgcttggagtcaaacacgacgcaggttgaatgcgttggttgcaaaatcatacacaaaacatggcttcacgggtaggggagtagtaacctttctaatcccgttgactatttggtgacaactgcattggtgggcctactgtggactctcgccagaaccattctattttcgatggacccacgttcgtagaagcttgtagggaagcaggaacgagaaaaatcaaggaacccggagggttccatttccaagactggaattgagggactgtttcactgcattttcaggagtgacgaagacagtatattcaggatacggattcttaaacgtatcccgtgtacagtttaaagggaatggagcttaaaaatgtcccttctttgtgtccagtttcataaggaggcaggattgcatttctgctctcggtcgtacacagcatcctagctcagcttgtttctgttgcacaagttctcacactcgtgcaaccccgcatactgtttgttcgacgatcgtgaactgtgctttttgtgtcggctgctataaaactcgacatttttcttcgctttcccttgtattggaactgtgcaagatgaataagggagcatttctctttgccggtagaccctttgttttcccgcttttctcggtctgccttgctgtctgacagcgtccttctgtcccctaaacctctctatagtcaactcgatatcgattgttgttcctcttatagagtgtttccctttgtatcgtgattcctacctccagtttattggctattatgtgctacacggtgttctttaaattttttgcttccgcaccattcctgcatgttcccgttgtcacttgcacttgccttctaggtacaagccattatcgggctctcaaacctttattttccacccctcgttttccccccctttttgtcagaacaccgtttcccgttttcttttcctgtgacggattttatgaaaggaagagtgcacaacggcgttccaccacggattctgcactaaaacacgcccgatcctgcttcttgtgtgtcgcactcgctgtctccgcgaccttggcgttcacatgcgtttgctgtgcacataatacgaggataaaaaacagctcgttgttgcatcgagtctgcgaacgtacacacaatcaagccggaattacccgaccgaatcgaggctgtggcccttcacttcccatgttttaagccaccacgtttcattcgcccgacagttctgtcaacccggttgaacgtgaaccccggggtactcctgctccaatgcgaaggttttaaccgtcgtcttgtttccacaatgctcaaatgtgtgactggttggccacttttccatcgtgaaggcactttgacgttatttctgggtgtggctcttttttttcgaagtgaagagcgtgccgtcgctgcaagtgcctcgggatccggatcctccttttcgtccgttcagcctatccgtctctttgcgtcctctcatgtggttgctgtttgctgctcttcactgtatatcggagtctacagttcgtggtgtcgtcagggcttggtctgccgcgggttgcacattttctctgggagtcccaccagcgctcggtttcgtgacttccggattcctccagtttaaaaaaattcctatgggcgcatctgcctcctagcgtagccgcggcgaacgggttttgtcttcgcttcttgttctttgagtgttcggga

SEQ ID NO: 2441 - DNA, 1372 bp, Toxoplasma gondii
tctccttatctgtctgtacacctcacgagactgttgctcgtgctttccccaggcctccgacgctgattggtccagcgtactgcctctgcagtcgtcgtggcaggaaggagaagacgaagtctctgcatccatcgctccttctccgcatttccgatcgacgtctcgtttttcagcttccaaagcatctaaacaacgaagatggcgtccgtctccgagtgtactgcgagtcccgcgatatacacccggagtcgcctccgagggcggcaggtgtgttgggttgttctttggagatctcaagagtcgaatcggagagcaaaactcagacgagggaggcgctccagactgcttcggtgtcttcaactgcgactcgttggtttactcgcgagacagccggtcgcgacgccgagttcctgttgaggctcccgtcggcgagcgcgacaggtggtgaagaatgagcggagggaaggcggaagaagcagatggtcgaccggaaggagcaagaacaacgtcactgatgagcgcggttgaagcgtacttgtgcagagcagagcgcgtgcccgcagtgtgaggagtcgggagcggtaaagagatggaaatgcggagggaaaaggaagcagagaaaagtctggagaagagccgcaagtcttcgacaagaaagggaaggcgaagcaactccgcggaagaagtcgccagcgggatatgggcaagaccgacaacgtcggagaatcccgaaggccgagtgtgcggtctcagcagatccacgagaagagcgagagcggcggaagacacagatggggcagagagagacgcgaaccactgttcctttaaaagcttttcatcgagggaaggaaatcggtggaaactggacaaaagcttccaagagagtcttcagaaagcagtgtgcacagttacgactcggagcgcgccggcaggtgggcgcactcatccctgttcgccgggaaaaaaagagagaaaggcatgcgtttaacacaagaaaggcagatcttttttgcgggtcttctttccttctttcactctggaaacgtcgcgagcgacgtcggctaccaccggtgctcaagacacgcggtcaagtgtgtgcatgcatcaccttttctcaagttcgagagaatctcggcaaaccctataaaacctcgaccggcgccaggaagaccctctcgctcgccttcgaaaggtgaaaacagcgcagcggaaactcttctcaaggtggaccgcgctcttccacgccgggagcgagtagagtgagtgaagtgagtggagtgagtggagagagagtggagagagagtgtagagagagtggagaaaaacaatcgcattctgagaaaggagaaagtttcgtcttcttggcgaccag

SEQ ID NO: 2442 - DNA, 1701 bp, Toxoplasma gondii
tcaccgttgtcgtcttaacacgctgtaatctcaagttcagttagtttttctgggaacttgcgggcaaatccggttgccctggaatgatggtaggtgaagcgtagggcgatacacgtcaagcgaaaagaatagttcgcagcgcagtcgttagcatgcggtggtatgcttttcagttcatctatgtgcttacatacatgttagatctggactgtgattagtaccgaaggaagcttcgtgagatacacccggtgtactaagacgtgaatgactgagagagaagggtggattggaatcccacagttttctctcccagttatctttcagttgccacccggaaaatgatgtcactgccgctttcgcatgaggatgatataccggataccagctgtctctgatgaggcggtttgtacctgagagaattgctgtaaggagtaacagttcatcccgatatagcatgtgaaacctacctttcttggctagtgccatgtatggggcgaaagacagtcccttatcaatgcacaaagtaaacctccaaggtatgtaaaggggatgtgtcaaactggatctgcctgtgattccggctcagtgacaccaggcacgacacagttcgtgcaacaggttgatttcgtgcctcttttagagaacgaagggctaacgcaacagtgagcatacacatactgcctgccagacaaccacgttattctgtagtcccctcactcacgacagccgagtgcacgctatatgtcgcacacccgcagaatggatttatatttcatgtgaaataaacactaatgcttgtgaaatagcgcctgacagaggagcgacaacgcatcactcccctaaacactgcacatgcagcgctcagcaaacgggagaattcgttaccgtggagtttgattcaggcgcgaattgagatatatgagaagtggaatgctcgcagggtcctctgaccgcaacctactgttgacggttttcacaggggaagagtgatgatgcatgcgccctgggttaccgacatcagacatttcagtcttcgtgaatacacttcttcccccatttccaacaacttgtcaggtctaccatacactggcgaattcatttttcgagcttcaccctcatttttcttgcggttcggtcatttcagctgcatgtgcactgtcgtttgttacatgcacttgagtgtgcatgcgagagcgataacggcggcaaattctggcatcatccggaagaaaggcccgaccgttctcgacttgtttccacttgaatcaccgagtcaaatttttgaacagccaactcgttagtgggtcttcggaacccatggctggaggagtatgaaacagcaaagtatcatctatatcgcgacggtgcgtcattgctcagaactcagcttaaaaaggcaagacgagcggtatcccacgaactgaggtctgtcttagggggcttcccacaccattcgtcgtgggaggcctcctacagatgtcgccgtattccgccgtgtttttccggtttattagtgagccaatgcttttgttaagaaatcagcgagttgtggagtacagtgacacttgtccactcgcgcgaggtcacaacttgcttgtagtgaggaatgctgaacgcgcgatcaccgtctgctgcttgatctgatttgccttcggccgaagagagagagctggaaatttttggaagcccccttctgcataa

SEQ ID NO: 2443 - DNA, 1570 bp, Toxoplasma gondii
tatatgctctatagcatattcgcgtatcgagaggtttgcgtaaatgaaggaagcgaaaaagagaaatgtttattgatattgctgcaccatatatatatatatatatatatacatatatgcatatagtcgatacctttgtgagagggagggtgtcgggagaccgagacgcgattctggaagacggagaaagatttcaaggtagaaagcgagtcgagagaaagtccctgagaggttcgctgaaacttgtcacgtttttaaaggagactttgttcttcgttccttttgggaagatccgttcttctctctgttctgcgtcggaaggagattttatcgacgaatcccagaaccagtgaggagcctatttcggcgtctccacctgtctctcccctctaaagaaacgcacctggaaacgttccctgcgtttgcctcctgtcgaaactttgtctctttttttctcattcgctttccttacgtcatcctcactactcgttgcggcttctctctgatggccgatgcacaagggcaggcttcgctgccaagaactcgctctctgcctctctctctgcttctgccttcctatacgcgctctctgctttcttctctttttcttgcgcatcttccccctgtccctgcttcgctctttctctcctctcttcgctttgccttccctcttcttctctcttctttgtcctgctctcttcttctctttcttctctttcttctctttcttctctttcttctctttcttctctttcttctctttcttctctttcttctctttcttgtctttgtcgtatcgctgtcctcctttctccgcagcttggaccggcgtcgagttgccctcgagcgagggattgcggcagttcgacttgagtcgagttttccagaattctttcctctgcgcagctgctttctctcgaccgaattggagagcgcaaagaaagaagaacagatgtccggccgttgtcgtactgtgaaggttgcgagaaggagatgcgtcaaacacagatggcctcacccttgcatgcgaacggtcagtgtgcattgcaacttttcgccgaaaagaagggggtcgctgcggctgtgtgtctgctcgcagtgcgccttcatgtctcgacaaatttcgagaaaaaccgaagatcgctcctttcgaatctccccaaactccagagaccagtccgcgagagtcctgtcggatgcagcctgcgttgtccttccctcctcgttccgacggcgagacctgacgcgtcaggatctccagtgtcttccggccctccaggtcgccgtcctcgtcgcggcttctccctctttctcgcgcggcctttgtttcttttttttggctccgaaacgtccaccactgcctctcgacgccgttcgcaactctgcctcgtttgcggttcatgcgcgcagaacgtccgttctcccggtgttgggacagcgtcttgtgcccaggaactgtgagaggctgggcgagacgcagaggagactccaacgtctcccaagtcttggaggtcttggagggcggcagcttccttgctgagaagagagaggcgcgagccttttttaagaa

SEQ ID NO: 2444 - DNA, 3094 bp, Toxoplasma gondii
tctttttcctctggaaccgcacctcaagattcactgctttttccagagtctcttgaacggtcgaagcatctgccaagtctgcttggatgacttgtatcgccatagaaattgagtggttcttcgcctcctcgatgcacagggactgtgcatcttgcagagttgagagcgtccgggcaacgagagaaatcactttcgcgcgtttccgaacacactccaaggcgagggacaagccaatgccttttgaccctccactgatgagcacatggcgcccttctatgcgatacgggagagccaagtccaccctccagagcggaaagactcgcgacacagcgtactggaagaccagacgaagaagagcgaggaagctgacgggttgctgcgtctcaccgtcgcctggtaggtggttagacagtctcgcgcccctctttccgttctgctctcggtcgccgcatgcttcttctacacacgaggaagcggattttgagcccaaggggaatcgtacagcagcgacttgggcgcagtagacaaaaacgaagagaatgagcaaagggactgaaaccagcagagaagcgaagccgctcgccgtgcctccgagcgccaagaacggcagcagaaagatagccgcgagtgccaggagggtagagacggtgttgcgtgcgacaaacaataacattttagagacagggggaactgagacagagtgcagcgacggaaagagcacgaaagcagttccaacacgcatccaccaaccagctaaaaaacgcgcttccagcgtggtagaagtgacacgaaaggtgaagggaaccaaacttctacatgcacatacatatgatatccggtactacacgcacacagatggccaataaaaggcaggaggatacagagataccttagagaaaaacttcaacgcaactttatagcgacaacctttatgtgctaatccattctcctcagtttctgctagacaatgccactctcacaaacgattggaaaaaaggaggcccgaacgaattttcgtcggagggtctcgacaaacctcccgctgcccaatctgggcaggcccagcttgggttcttctacctgcaggcggaagtgtattctccaggcttcgaaatctcttttctcgttggtagttccaaaacagcttatgcgaaacgcggtcacgagaaattcatttccaccacacacagatgcgcacatgtacatgtctcttccgcgaatgtcttggcggctggacggtataggagaggtcgacccagagctcagccgccacagtcgctttcagcaccctcctcactttcacttccctgaaaacagaaactagagctgactattaacatgttcagacagaaaagagcctgcattattgccgcgaaggtggaggatagcgtcttcactgagcgggtcgacgactcttcgctggcaatcgcggggcccgagtcccgagagttatgtcttggtgttagatgtgattttctcgcaaaaagagcgatcgacttcccccggaaaaggcttgaaaaagagagcgcgcggagattcccggcttccaaaatgcaactattagagctcaaggaacaccacggaatttatctgctttcttggacgcaatcgtggcagtcgagcttgcgtgcaccgcacacgaaaaaaacgacccatgcgttgcaaaggaaaattcgcaaggtacctccactcagaaggttcctttttccttaggtgcacatagaaagcgaataattgaagcggtcggacggagttgcgctgtctagcttcatgcagtcgcggtatttgttaaagggaatctaggtgaaacgcgcgatgcgcaacaccggccgtttttccacagcgtgagactgaagtctatggcacgagagtctgttgaaatgttccgttcctttagcactacgccagaaccaagcacgttgtccgtgcagtcaagagaagaaacgtacagttactctcgagaaaaaactcgagaattttcgatgacgcaaccctgctcacttagaccatcgcacctcaggtgacgacgtttggttcggggttgggaagacagctccaccacaacgttcaaaacgcggatggaagtgataacgatctgctcttaacagaatttgttaatgtgaaatctctgcgtcgattctgaggctttctgctgactaaaaccgctgcgcctagaggagagtctgtagagcatgagctcggaagctcggcgtggagtctcagatttgctgctccgaccttcgggctatgctccatcccaaattcatcttgatgctttttgcgcagcttgcttaaacaaatggcgactcagttggaaacggcgtatcgaaagacatcgggagccactgtgttcggactctcacaagcgcgagtcctacggtgtcagggcggaccttacagttgagatgtcgccccacacacataattctatcgaaataaagaaaggcgtagcaatcagcctcttcgaaaacagtcttctttctgtcaccttcttggtagaactgtcttttctcctctacagttatccacctcgaagcagtaccgcaggtacactgattcgggcaggtgggcgattctttgaatgcgtgcaacgatatttaatatctcacctgacgttcacaagtttccatcttctcagcattttctcaggtcaacaaccacagtatctcctccaaatcaagatggctgcgtgaccaaagtagacacggcgctgacatgcgtagaaagtgctcgtcgttacttgttacagtcgtcatacctataccccagtgccgaggctctctatgacagataaagagagtctcagtgactgcgtaatgcttgggagccgaagcaaatagatgcggatatcttgctgtcgaaaaattcagttgcctggctttctgaacagcacatgcttctgtttttccacttctctcacaagcatatcctcgctgaccagccgtcgatgtggtcaggatgtccactgctcttttgaaaagcattcgctgttgtacaagaaactcgccttttctcctctgccacacttgcgttgtcttcctgaaggaggacaaccgtcacgtttcttgtgagctttcctgaagcaatcagaaga

SEQ ID NO: 2445 - DNA, 2486 bp, Toxoplasma gondii
gctcttctctcccttcctcttgtgctgctgtttttcttcgttcagcggcggcgcttgccgagaggctctccgctttctcggacgctgtggaggctgcgaggttggagcgcgcgcgagggtcgacgcatttggcgacgaggacgagtcgctgcgagaggctgttctcgagctcctcgcctctgccgcattctcgcttgaggtgcagagccggcaatgggcagcaagagatttctgcgagcgacgcgtgagcgccgggcagcgcaggaaaaggactttcttccggtgcggggacctgagcggactcgcgagactcagccgtctcagaggcggactcgcggctcccagaaggcgaacagagacggtctgctttgcagtcgaacaccgaagcagccaccagctggtgcggagacgacggtcgctgaggcatcttcggaaagcagagaaaaacttgatcaagaacgagagaaactgccgaggcaaggagaggcgacacagagacaaggggagacgagacaaaaacgggagaagactggccgggagaggaagcaagactgaagaaggaaagaagaaacgcagcggcaggacgagggagcaactcctgagagcgagaggaagacagagagtcggctggagagaagaaagccgcagggggaaggggagggcaaagcggaggcaagaatacgtctagctctcttcctagcgactcgcgacaatggtgaagagagaaacgcgctgggggagagaaagtagagaagcgaagccggcgagaaaagctgagctctttgtgtcggcaatcgcagtcccttctgcgaactgaagcctcgaaattgcaaaggcgccgcgaagaactcgcagaaacggatggaaggcgaaagaagcccaaatggggacgacaaagaagaaggagaaggagaaggagaagaagaagaaggagaagaagaagaagaagatgcagaggtcagagtgctgaccgccggcgagagttgagaggcgaggggcgctccgtctgaatggcttctgcgcgatgagaagaaacaaagtctttatgaaagaagcgcgtcgaatttcttatttcctctagacagctctgcgttctgggagagacatttgcacccgcttcgcggcaagtgcggtgtctctctgcagctctgaaactgcgaaccgcgagggacgacgagttccccttttcgcctggcggaaggacgaacggaggatgtaccagaagtgaagagagaagagagacttctctcgggagaaggtgcagtctcgctcttcagaaaaaactttgttttttcaaatcgcattcgctggtccacaccggaaacaccgccgagacaaccatcgggcgtcgaggagaaggagggagtcaggagttccctcggagcggaaatggtctgtacgcgttctttctcgctctggaaacaacgctctttttcttttctttttcagagaggaagagactcgcgaggcgacgcgttgtgtctcgcaccccccagctccacccttggtcgtctttgttctcgtctccgctgtgcatgcgttttttccgcgaaaagacgcccggcgagctcggcgctcggcctctctctctcgcaggtttatcgacactcggacgcgcagagttcgttgtccagtcttctcggaggaatttttttgggactcgctgagcaaacggaggaaaaggtttccagagaaactcaaccgtctgtctgtgtctgtgtctgtcaccgctgctgcacgcagcttcgaggatctcttcagacgtcgctctgcgaggatgcggctggtccgtcttctcagtcgagtgcgacggtctcttcagtactgcttctcgcttctcgcgtctcgcttctcgcttctctgatttccttcgttcttctctccgagtatccaccagaaaggcctcctggagaagaggtctttctgatgcgcgagtctccttctcttccttctgagcttctccggactccacacctgcatgcgttcgacctcggtccccgactccgattaaccatctttgtttctgcgtctcctctccttctttctcctcgccgtccgaattcgctggtcgcctcctctccgcctgcgctcttcgctcgacagtcttcggtggccggaggagcctcggaacgcggggcggtctgaggcgagtattggcgagctctttctcttctttgcgtgggcgcaaccgcagtttctttcttcgagatccactgttgtcctcaaaatcgttcaacaacaagaggaggaggagaaggcgcttcgtttcgcggagcaaggcgccgtcgcagagcgttcaggcgtctcctccatcgccacccccaactccgggactctcttctcttcgtcggtctccctgtctccggttcttctctgaccttctcgcttccgcatccttcgcgccattccctttcctttttcgcgtctctcgtccgtccagtcttcgagagcgcgcaggaaccgcacctgtgaagctcggcgaaaga

SEQ ID NO: 2446 - DNA, 1666 bp, Toxoplasma gondii
ttttttcttcatctttttgagacgaacaaataaggaaattggcacagatggcgacggcgcgcctcgctcacgctctctcttggggaaggcagaggagagagatgcgaggaaaacgcagaaacgaagaaaacggagatgacaaagaagcgaggactctctcacattgtcgttcactctgctccttcttcttcctctgtcctcttgtgcatatcttattcctccctcctccaagccctcttcctgctctctgcttcctgtgttcttcctcgtttcctcttccttatgtcttctttccctcttctgcttgctctcttttttcagaagacgacaggcaacgagagaggtgtggaccctcgtctgtcattctgtggacctccgccacaaagggaagaagaggacgcagaggaaagacgcgggattttagtgaactcgttttcttccacgaaagagagatcttgtcggagttcttgcagacggtggccgcgcttgttcacgataccctgagactcctgtattcatcatcccccaacctccctctcgccaaaaatgcagacactcagcgaaatggaaagctgcaaaaacggaaggcacagaggtcgatcaagcgaaggagctgcagaccggaccgagtcagctgtacaaacacgtgagtccctgtggacaagtctgggctcacacagatgtagagtcacctagacatttatatacacacatgcataaacgcatacgcgcatgcatgtacatacacgcttacacccagacacgtacaacatgcacatttgagtgacatatctgaaatagtggaaaaaagcgaacagcaagtgaactgaggtcgtttccagcgcagctggataaacagcgagatgcacacgcatgcaggggaagagaggagctggccactgtgtagcgacggctgcgggcctacatagacacgaattttcgaggaagctgaacccccgaatcctttctcttcctccttccgagagatgtgactcaagactagacgaaacacgttcaagcgacgctttcactcttgcaaagaagccccagtggattgactgcgccttctcgcgcggtccactgttccgcatgcaccgcgttctctcccgtgttcggcttatattccgacgcaatctgagtcagtctcgggaggagagcccggagcattcgtcctgcgtttttacaccgctttcccgaccttcttttctccgttcgccgttccgtcgcgtgtacatgcaggagttcacggcgttgtctgcttatttgtctttcgtgcttctggggaaatgcgcttcgcttcgtgatctctgcccctcgtcccctcgtttcttccgggaggagctccccgagaggacgcgtttcttcggcagaggcaagtgagttttcgctgtctctgcttcattgtgagtccccgtctcgaaattattgccgtaaaagtcgaggaaagcgtctcgcgctcacgccccgcttcttcctgctctgctctctcccctccgctctcgtcttttctctctgccatttgcttgcttggcggcaggaaaccgtacaggggtgtcgagcgcgagaggaaaatacgagcaagtgaacaccgcagaacgaggaagagccagggtccgcagacggccagaccgggagtggcggcgaggaagaagcagacaacgctgaa

SEQ ID NO: 2447 - DNA, 3239 bp, Toxoplasma gondii
agaagattggagaaagcggataaatccgattcttcagagtccttttcgctctcttcccaaactcttatttgatctttttctccgtcagcgtagacctcgcagtggcttctctcatctcgggcacccttggcttggcattgtctcgcgcgtttgtgtttgtttgtgtctctatctttcttgtctttatctcgacgatttgccatgttcttcgctgcctcatggctccaaagtacgcaccatggaaaaaacgcgaaatccgtgagtcgggacaacacagctgctgagaagccgttccaccttcacaactgtaaacgcgcctgttgttggggtgcagaagactcagttcgccgctaaacagaatccaaaggcttgcgatgcctcccggtgtatcgccttcgctctttgctgtcgactctctcggtctcgactgcgccctcagctgtcgaactggtaggagagcctctctagctttcgcgcatggtagtttctctgcacccacccggtctagttgctgaagcggtgaagacacagagttgaacttcgtagctccggcggcgtgtgaacaaaaacagggtctcctccgttctgccagatgtatcctggggaggtcaaagaagtcagacaagcacccccgcaaggacccgacgaccagcttaaacaaagctttctccaaaaagggcatggcaacgccgtgtcacacgtcggttatggatacacatttctcgatgttggagccccgtaacggtaaacgttttgtacgcatcagtcaacggggggagaaccgccgtcctttacatctcacgcatcgaaagaaattacttcgaggatggtagtatgtgttgatgacaccccacaaactggcttcagccagaacagaggtaatcgcggtgatctgcgaagatttcggtaattgtcacgtgggaacctaagcacagaatgagacttaagttacttccctcttctccgctggaaaggtccgtggacagtcgatgtcgcctcgacatcgaaggcaatctccactgccccagtcgcatgtgctcatcctgtccaagtcctctcaccatcgggtaatcacaggatttctgctcgactgtttggctgtcgacaatcctctgtatctgtgcacatttttcacactttcagctaccatcgatttcttttttgaaaagactctctcggagaccacttgggggggagttcgcccgtaaggatggatgctcaacgctcaccatggcgaatcaaaggagccgtggcacaaccggccttcggcttgcgttctttgctgatgatgatcgattcttcctgagaactttaggggagacgaggagatactgaagacacatgagaggatccggcctgttaggaaaaagagacgcctccctcttttcactaaaagcaagaaacgctagttgggttttcagagacttgtggcatgtcctctcatgtagttcctgaaacctacagcggcagtgaaagaaagtcccatctcgctttctcaagcctcagttcttgtcttctacttttgtggtacagcttaaatttgggtggtgaggttcaaaacggaactcctcctagtcaattcgtcatccagatgcaacgatatgatgtccttactgcgccagtttacatcgggtgttcggaagtcgttctcccacttgactggtgttactaaggtctatatcgcaggtagttgtacagagagtgaacaaaacaggaacttggaaacgggtctctccctcctacctttcagaaggaatcccgcgatgaaaaagatacccgcacatcctcgtatttgctacggactctggaactttcgagagcctcgcttcgtcgctctgtgtgccgtgagcaccacgaaaaatgaaaaggtgctttctttgtctacatcttttttccgccaagagaagacaggcgcttggttcagtctttcttcacctctcttttctctccaccgtccccgtcttacttcctccctcaccgtcatccgcaaaagaaacgcctttctctgcgctcttcttcatctgcgggaacgttcctaaagaaccagtccacggacattaaatccctctgccagtctttctcctccttccctcccttttattttgcctcgtcttgcctcaaatgcatgcacacatacatagatgcattgtggggatatatatatatatatatatatatttatacatacatatacatacatatacatacatacatatgcatacatatgcgagcttcagttcttctttcacttccaggccacctaggtcccttttctcctgttgtcttcacctgcctgggctgtttaggcgtttccgtctcagctttttttccggtcgccgtccttctgcggcagtcttgctctttcgcttgctcgtctctccagcctgacgccccccactatgggcacccgcggcgccgctaaccgcctcgcgtccaaaaaggcgggaggagaaaaagcggaaaaggctgccatttgacaggaaatagtcaaacctgaaaaaacatgtttctgcccaagtcgtggctgaaaggaaacgatgtggggtgttcgacaagccacggaaggcgaaaacgcgagcaagtcagactcaaagtcgccggcgaacaagcggttcgttgactaaaacgcatgccctctccatgcatgcatctgtctggctgagaggatttgacgttttttgaggaaaaaggaaagcgttgacactcagaaggaggctggctcgctcgttccaccaagattttctctcctgccgatcctctgtctctctcagagccttcttgacgccctgcgaggtttcgcggcggcccacactctccccgcgcctctctgcgggcgacagactttggtgtcggaatttagggtccttcgatttgttttctgctcagtacacttccagtttttttctgtgttggtttctcgtgccgtccgtcttctcctcttgaaggggaggcaccctggagcctcatctgcctcgagcaaggaggacgctctgctgtagggggtttgtcgttttctcttcccgctccgtgacctttcagcttttctctcttttcagcttgttttccttctcttgggggcacccagcgtctgtttcttctctgtcgcgcgttcctctgcccctcattttccgcttcaacagaccctgtccctctcgcttctttctgttctcacgcatttctccgcctttttcttcccgctctcgcttctctctgctctctgcgtttttctctcttttcga

SEQ ID NO: 2448 - DNA, 2243 bp, Toxoplasma gondii
acatgcaatttcttctccaccatcacttctcgcacgactttgtggtcctcgagcaggcgcccgaaaggtttgccggcttcgacgactgcggcgcggactttctccggcagagcctgcagacgcactaggagcaggccgtacgaaaaggccgggccgatggcgccgccggtgtccgacctgctggaaggcgtccgcggcaaactctcaggttcctcccggactgtctgcaacgctcgactgctctcaggttcacccgacgagggctgagaactcgcctcccttggcgcagaggccgcagccgctgacctcgcgagcgcggaacaaggagacacatgcaaggtgatatgcctcaagtagagggagtccccgcgggagcttccggcgccgtccgccgtccccgcctccccttcgccatccagggcgaggacctgacgccagtcctcgtcgcggtgcagcctttcctggaggtcggtctttcgcttttttccggctgggcaatcggtgcctgcacttgaatcgcgcgcggcgccgtccgcaggaccgtggacgaccgccagtgtgcgaagaagcaagtccgagtcacacaggcgcctccccaccaacgttaggttgcagcgatgcttcagcatcagccgaaagactgggcagagaatctcgtcttggcgcgtgtcaggacaagccgccgcgtcgatatcgccggaactcgctgcgaggacttccgcagcgcggcttccgtcgccgaggtcactgctgccagcggacgcttcgcaggcagcggcgtcgaccgactccgcagacgcaggatgcgatgcacctccctttgctgctgcgtgaggcggcgcctcacgcatctcatgagacggaagagatctgccgggtgtagcggcctccccgtcgtcgatggcccagaacgaggcagctgcgaactggctcttcagccaagtcaggcgacggccttcctcagactcatccactccagcgcaactcgctgcgccgcagctgcttgttgcttctgcggctgcaccactggcaaaagcgtcgcgttctgccggagaattccctgaactcgtttctgtggacgcctccgcctccccccaccagctgtacgaactcggcagaaaaaacggatttgcccgggatcgcgcgacgcagcttgaagctgcagcagaaactcccgagtcctccatggtgctttgccgccaaggtcctgcgccgtgtccacaacccaagtcggccccagacggactcttcttgtggaggaaatgctccgagtttcctccctcgcgcgtctggagtgtcacagttcatgaacgggatctgtccgccttttcgctcgcacagaacaagcagttacgaagcccccagcccagcgaccccgaggggaaaaagcggcagatgtcgccgcttcctcgggtctggcgcgtccacaccgaagggaaaaatagaaccgtgccgcttgtcttccagatgggtgaggaaaagcggcagaggacacagaccatcacacccagcgagagaggcgaaactcagcatccagattggcagacgctgtgaaagctgggctcgggtcactttgggactgcagagaaaaacactgcagatccagaagaaaaggaactgaacgtgatctgctttggcaatccacccctcagccctgcacacgaacaaggaactgcgaaagacacgcgatacttccgaactcagagctggcacgatttgcgacgagagacaccgagaacgccagagtggtctcgacttttcgttgagagttgcgttgaggcaaaagcggcgaattccttctcgcgttcttttccgacttggagccaaggcgggaccgcaaggatttccagtttcttcgcacgaaaaaacgaatttcttgtggcggagttgccgcaggtattatggagggaatgcggtccgagacgtcgcttctacagaagctgcctggagtgtcttgcgaaggagacaccacagcgaagccgcttcggtgcgggacgaaggacttcaacgttgaaaataatctgatttttcagtcttgaagatccttgaactttgcatgttgagcaaaaacagatcctgcaacgaaacactcgacaaagactccaggagagtagaaatggatgttgatttctcgtctatgtcccaacgtgaggagacagctctcacaaaaagacagcatcgggcgaacgtcgaccacaaggatagacaccccgaagccttggagagcggcaagtgacaacgga

SEQ ID NO: 2449 - DNA, 4300 bp, Toxoplasma gondii
gatgcacgccagtgaatgctccctctaataatcatccattcatcaaactgggtcccttcacgcgtttgccttcagacagaggaacaaattggttttacggaaaatctgtgaaagcaaaaacagggtttccgctcagcaggcacactgtataccaaatggcgagcgcgaaaccgcagggaaaactctatttagaagataggaagatgtgcctatctgttttcttggacatgtatggtgtcacttttttttcctcctagggcttgaagaggtcggcagggaaagacaggcgccttttccttaccttcctttcttccggaacagaaaaaaatgaccaccacagataaacgaagagagggaaattgcagtcgggcctgctgagtgaggacagcgctcctagagccgcaattgtgagcatgaggcactcggccacttctcgtgcgtttgccatattgcctcttgactgtgtcgcgggaaaggaagaaaattcttggctagaacaaggcaagcgtcgctttgcaagcagaaggacaaacgttacgcacacagcgacaaacacagaatccaaaatgtgacggcggaaacaggatgctgtcgatgcaggagaggaaggcggaagtatactggaagatgcaccctctcgctcgaatatccacaacttcgcggagctacttgtagaggcctttcggcatttaacaacagctgcggaaaacttccagcaaatttgcgttggaagaagaggggcgccacggcgtttcctgccgaaaagggaagctggaatacagattgagaacgttacggtaaggtactgtctttatgggggattcagccaattggagccagcgacacagccgtcttgaccttctagagttgcaacgggaaaagacaggcgaggattctgctcaacagaaactctctcaggatttcgtatctcagctggcacggacgctgctaaaaggcacttttcagcttgctggactaagaaatgtgtgacagcagagtcttgcagagacaactggaaagacgcgtttgtacaagagacttgacgacatattctgctgaagtgaaagatatcctcgctcctctgtggcatggaaaggagaaatcaacaacgaagggagattcactagagaccgggtcaacaacgactttgagaaccacgcagtcaaagccagagggccagaaaatgtggccagtcccgtaactgcaaaatgcttggatgttgatgagctcagattaatctgatacggaaaacgacttttagacttgagtgtgacagtcgtgctacgagaagttcccctttcacaatttaggcggtagaggcagctgaagcatgggtcaggggtgacacggccggcgaggaaagtctagaaacaaactcgcgtaagacgcgaaaagatggcctaaaggctcaaatttaggaggcattcgaaaagtgcgctacgctcgaaagttgattccaatatgtacctcttcaattgtactattaaatgggcaaacacctgcccagtggagcaaacacttgaaaagacggaaatctctctggctactcggtcatatggggcaagacataccctcccttcctcgaagggttctgtgaacaagacacacaggaaattcaacgcggcgggaaaggatatgcacagcgatgtcatctcctgagtagcagaacttttttgatgaatccttggaaagaactcccaaaacactttaagatacttggtcgttgagagagttttcttttggttctggtgcggagccctttgtggaacacgacgggtcgccgcgcacagcccataaatagtttgcgctggcgtgagctggtgaccaaagactctgtccttgccttttttatggccctccacgtaacaaaatagcgatggattcaagggtgacataccaatcatcatctccatgcggcaaatgaaaggaacggcaacacaaattggttcatctggcgtatgtggggtaacccagaatctacagagcacatggccacaccgactttctggtaaggcttatgctaggatgtgcgttttgacttgttttcgtgagaacaaaagagctttggcctgcgggagagatgcttcctcaagacttccactttggatcttttgctcgcgagcttcacgcccgaacttgtaacacttatcaagaccctggttcagagccagaggttcttcagggctgctctgaaagcagtacttgtgttaccacgtcgatggtggcgcatggaggtccaccgaaacctgttatacgaccacattttgttgtgaagaaccaagagaatgccaactgatgccagcgttatgcaacaagcaggaaacgattctgtgtttgttcctgtatttgacgtcgctgccacagcatctactgctcgaaagaccacttgcatgttcaaccagaagcagtctggatgcttcagctgcgaagcaaactgagcttttgttcgtgagccttaacctaacccaaacgcgttttcggtacaactgtaaacgtggtcggaaaagtctaagaaatgctccgtcatgccttcgcccagtcacattaccgcattccacaattttgtactttatgttcccttacatgcaatcttggtagccgagacggagagctagcgacttgcgcccccatcgaactcataagggctaaatataaaaccgtcccttgccttctcagtcgcttttctcattcgcctgagtgaggcaaccggtaaaagagcactgaaacgctaactaacagtgcacacgttcgcgtaacgccattctccctcgtcagctgcacaattccgcctctaactgattcgtccgagtgttctaagagtggccatcggctagattagagatgagacgtgaaagtcccctttatagcagcctttgtgcaggtagctggtcgttccgcttacagatatggagcaaggttcctcgatacattcctcaaggtaggaaaaggatgctctttacgtggacctttcagagcgaccagatatttgctgtcacttgtggtgtctctccctcacaactatcacttctcaacgagcgatagaactgcgggtgcaaggggttcagagttagaatctcagtttacttcagtcccatacagctcttcgcagaaaggatggaattttcgagagaagggcaagaaaagagacgatcgcatgacacatcgacggtgtcttcagcgatgtcttgggggaaggggatatatgtgtttcgtacggaacgtggacgtttttgccgacttactccacgcgggattgggagctcttccactgggaaattcacttagcctgtctgtaatggtagcaggggagtgctgcaaagccggattagaccctctgaatagaaaaaaggtttacacaagtagagtcaggacgcctcttatgcatggcaagtccgcttaccttttccatcaacagcggctcctgtatgccacggaattgtggtatctcccgtgaaagtgccgtatatgccttacaagagcggctggtgttgcgagtttctcttcgcctgatgccttctagtagtgcccacttctcgctgcaatctcggaaaaggagacacgcaacaaaacaacattaactggtcatgtgaggtctgattctgccccttttgctctggttctttcttaaattgccgcgtctagctatggtcatagcgcttttgcggctatccgtagtcagctgtcttgaaaataacgggacccacggagatcgttggggaagcccaggtgggcaacagatgtctggaacgcgcatttattttcgttgggttttctgtgggaccttgtctactgacaacttcggactggaaaagccaggagactggaaactggtaaaggggaaggctgcgcatcctgatgtcttggcgtggccgccgtggcaccgcggcgtgcgtcgcgacgcgatacgagggcgtcggagaaagtgctcctgcgatacgcatgctgttttgagaatcatatttctttagctcatgccagactccacctgtggctgttcgtttcacggacctcggggagaatctcgcctgcattctcaacaggccgccgtatcttgcggaaccgcggcagttgacccggacgaggctagtctggtacaagaggggtaggtgccagtgagccatgcgcagaagaagttgttcttgttcgtctctttttcgactcgtttttgttggtgaatgacgagctcattcgaaaggcacactttgccagttcatacatgttttctttctctgctgcggctcgctggcagcctcagtcgattcgatcacccgcgagagatacataaatttccgcggaaaga

SEQ ID NO: 2450 - DNA, 2470 bp, Toxoplasma gondii
ttcgatcttcagtggtgaaagagcaggacagacgcgcgagtctttggtctacagatcgaccctcgaccaggtgtagagagagaaggatggagctcgatcgtctgtaccaacgggcttcaactcgcctttttttccgcgtcgacagacatccagggatgccgagctgacgcgctcacgccgactctctgcgggggtctgccgcaagtatctccttgcctcggaccggaaaggcctgtgcctcagccgactgctctgctgggccttggaggcggcccgcggaaagcgagggccttccccacaagtgtctcctccagggcggcggcgcgggtgagtagtgctggaaaaactccgcaggcgtctcgcaccggctctcggctcgcctctgacgaagtcgctggagcgaagacggctcggccggtgccgcggggcctggcaggagactggcgggaggttggttcttctcgcgagaaaggacgcagagagaaagccgcgtcgtcgctgcggaagagctaccggggagccggtgcgaccgcgaaggagaaagtgatttcacacaactcacgaaggaaaagccgagcagctctgaggcagagcgagtcttctttggaaactggggacgacgcttggtgtcgtgaagagaccggaagcgacgacttggttttccacggaggattcttgaaagacgagactagagagtccgaaggaaaaaaagaaaacgaaaaactttcgacggggaacgagggagcaaagacacgcgaagacggtgctgcccgtccagctgcatggaaagacggggacgccctgccgtcgatttctttccgagaatcacgcaagacaagagagcgaagcaggggaacgagccggaaaacgcagacctgctctggatcttcaagcgtcacttggaagaggaaagcaagtgagcagtctcgccctgctcagttgacctgagagcacgcaagacaggcgcgaggcggccggcaaaggagtgcagagaaaacggaggggagaagagagaagagaaaaacgaagaagaaaaagaagagagggggtcctctgctcgggccgcgagagagagaaggttcagagactcttcacctgaggaaaacggctggcgtaagggatctaaaacaaagaaggaaagactgcagacatagctgcagcagcggctctcagctgcacacagagagagctcaaggaccaagacgaggaagcagaaacgcgagagaatgagtgagaaatgaagaaggtgacggtgcgacacagagaacgaagaatgcgaatgatgccgaacaaatgtcacccccgtacaatgtattcttgcgctcgacagactcctgagctccgagcgtcgacgcctccccgagagaaagtgaaggtctcctaaacagagaaacatggtccgttggttcctctcatttcgctcctgtccccgccgcttgccgctgtctcatttctcgcctcttttttgcttgtgcgggtctccttctccgcggattctttcatcaagagtctccgagcggagacggcaggcgcgaagcctgaatttctccctttcctctgcaacgcgaggctttgtggcggctgcggagagacgaaagacagaagcggcgagagccttgaagatgcgttttctacaactccgacaaaggccgagaggcacatcgacgaaggccgacgaggctggaaaagaagcgagtcgaggaaaaagttccagcttttttttcagcgcccccgaagacgcatgcatccgtggagaggcctcgaacggttcctccacgttgaacggcgttcccgtgtctctttgtttctcgagaaaacctgaatttgaagagttctctgccagtgtgcagagccggtgcatatgtttcctccctgcgaaagcagcgacatgcacacatctgcctccttcggcgcgttacatctgccggaacagacaaacagccgacgaccgcatgcgctgtgctgactgatctgccgaggttctttgggtctcccttgcggaggtctagatttccagcgtctcccgcgtttctctctcgacaacgctcgactgtcgacagggcgattcgcgactctcttggcacttcctcgatgtgagctgcacagaagtaacgcctcgccgtccgggtgccgagttgcagcagccagagtcgtcatcaggtacgcagagaccggagagaaaggcattcagagtcgggaatctgcgttccttctggcttgcggagaaaacaaaggcaactgcagagagagacgacgagttcctggggcgcggcgattcctttccgcgaggagtccagcggacgttcacgtcgagaggagcagtgtggaagtttgcgcaggcagaaacgcgcgcggtcttcgagcttgtgtgttttcctggtgctctgaaaagaagagcgagagagtcggcggagcgtagcagaggcaaacgtcaatggccgagggagctccgatacttgacgagcagcta

SEQ ID NO: 2451 - DNA, 1710 bp, Toxoplasma gondii
tcatcattatctgcattacattttctagtcaatatgtgtctcctgtttattcctcggccagcaactaagaagatgagaccttcgatactgtcgtggtacaagcttctgctggcagagggctttgttctctggtaggtgggcgcttccgtttcgtgcttatgacagacaccttccccccccttattgatgggcgatgtgcacttgattgattgaatatgtgacgcgcaggtattctcttctacagttatgaatatggaagagatcactggatgcgtattctgcccaagcaacacactaggcaggtgcagcataaccagcatcgttttctctgtccccttgcattgtcagaacagagcttgtacatgtttctcgtcggttggcgaggaacgggatgccgtaatcgcttgttttttcagctgtaaaggtggctgtgtatagcgctgtgcgaacacagaattcactgccaactccagagtgacgtgcagttgacaccttctgctggacgtctattggacacacctatcactgcgacgatagctcgattttaccgtccggagtgacaagatagacacgcagtgcttacttgcaaaccagggacagagcgtcgtatgcttagcacgagcaatcattaattcggagtccagcgaacacccattcgaacagaggctaggaagggtatcacaacggggatcctttttagtcaggtgatgtacagactgcggaccacaaaaaaccaatctgacttctcagggcgattcagaaacgcagaatcggtgttatctagggaattgacactgcatatttttgccaacctaggtagctgcggcagaagtgcacgcatttttgcatgtagctgccgtgtaaaggggctcttattccagttgtgcgccgctgtggctggccgttgcctgcacagcaataaaggtgttggcgacggtacggacctttcgagaatttggggagcaaatcgttcttctgagggatactgccagtttcgttccgccgctctccgcgccaagacatactagacatgaagaacacaacgacgagagactctcttggaatcagctggggcagtttcttggcaggaggcagcggcccatatgttccactggatctgcattgcaaactcttccacttgacggacgttctaaagttcgttgaaaggaaatgtgccggttgtgtgttgtgcgacacagtttctcgaagtgttattcgacagaccacgagcgcatgcatgcacacaaggtacatcttcgttaagagacaggagtggcggcggacttgcgccgtgtggcttctccaagttgtcacgtgctgagctcctcgaacaatccttcagggtaagcccttggaaaatatcctgcggtcgtcaaatccattgctccagaacgcgggtgtctccggttgtgtgagcgacaccggcacacacgcgttgagttcacagctccatgagttgactgagcgtcacttttccaaaccaagagacagtgcaagctaggcatcttcaatttttttggggtagcatcgcggattgacacgttcttctcaacggtgtttctttccggctagccagacgcgtgcgttgtttcctgaaacaaggggtaaacaaacatgtgagctcgtccgtctccaaatcggctgccctctggcacagacagagcagaactgacgtcatttcttgcaagcgtattcccagaacgacttcca

SEQ ID NO: 2452 - DNA, 1838 bp, Toxoplasma gondii
gtgagtcagaacatggacgaggcaaccatctcatatcctatgttgctggtcaagatggacatggctgaccctgggctgctgagtgttggccgttaatgattctcccctttctgctgctagattgcgactatggggaaccaacagccagactgattcgtcccaagtcttgtctttagaggcagttccatcacctctttgtttttgctcggcagcctggggaaatgagactgctgcgattcaaggttttgtcctgcttctgatgctcaagtcctcctctgtttccttgtatcttcaactgtctgtgcctacgcgctgcttatgtgaatgcacacatggctacatactcatgcataccaacagccatacgcatacgcatgtttatatacatatgtataggcgcctccttgtggttgcaggcctcatctgttgtggtcgtgtggtatggagcgtgtctgcgatacatcagatatcacccgtttggttccgaagacaccgcacctctcacgaaaggtggtctcaagctgcgagtcactctcgagcctgtcccgccaggggaaagagcagctgaagcattacttgaaggttagcttttttaagcatgtgaggatcccttctgaggatataagccgcccacgcgatggcaaagtcagtgacttccattgacaggaacgcatgctccttccgcacttcttaacacccatctgaaccgtgatgccacatgcttccctcaacccgccaggggcaacagtagaatcactgttcaactctaggctttaccgtttagtaccgtgtagcagaaacagagcaaaatccagtgcagagcgggtttacgaccccccagaccttgcaataagctaaggtggtcagcaattcacaaatgactttggaatccctcgaaattttcacatagttgtaaaagcagtgttctatgaagtggttccagcagtctaccgaaacatagattgctcatccctttcacgactgcacgcagctatgtccccgctgatagaccgtccgaaagttaacccgttaacccgacgaatcgagaaagtgccacagagtgacaactcctcctaaaccactttcatgtgggtcctcaagtacaaagatcgccgcgaaatttcccatctactgcaagcgaactgtcgtaaaacctgagagcaagttgtgtttctggtggctggccgcgtacttcttctagcaaaatcctcatcctaaatgtgtttcgtaaatcggaagacccaacatacgccgaatgacttccccacaaaaaggctgtgaacgtgtagccatggggcagtcacctgtgaccagctggtgtgtcgtcgagttacggtcgcctctataatgcaaattcagttcgtcgacagcacagagtgactatttgggcaaatagccgcgctgcatggaacgcgatcagacatctagcaggcattagtttcatttttgtctaggttacgaagcactggtgctgcgccgtcagcagcttcgagctgcggttgacggagatccgtctttggttaccctttatcgtcatttgcctacgactccgggagacctctatgctgcaaaccgcgctgaggagcgagcgtacgcggcttccgccgccgcagctgctgtcgccgcaatgccagcgcctgaagcagcttaccacagtggagcactgcagccaaggagttcgtcaactcataccaaaagagtagtgctactgagagacaagaaacgccaggacgttttggacacgagactcggacgtagccgccccctcaccgcctgcgtgcgtcttctcattctacttcagagatgcggcgccttggtacccgaaagccagggtccca

SEQ ID NO: 2453 - DNA, 1872 bp, Toxoplasma gondii
cgttgtggcagcacattgtagacaaggcgagtcatggactacacacgggatacgccgatccacgtgaaaaggtagggtagcgctgcagtcgtgccctgcgacgaagtggttcctcgtctataaagcgagaggtagaaacaagaacacgaaacacatgttgtaacggaataatggagacactgtaataacaccatggattcgaggtgcagacgccgacagcacacaccaggatagaggtgctcttagcgcctccctgcaactgttacgacaggtgacctggagcggaactactgcgaaaaagtcgcaagaaggcaaacagtattgtcctcaaaaaccatcacgcctaatagtgtgcagataacgactatctgtgcgccacgcataacccagtaagcgcaactgtggaactcgcaggaccagtgcaatccggtaaccctgctttgagtgttaccgaagctcaccgggaatcagcctgcgccataccgtcacaggcgggccttgtaggagaggttcccatgcgtggtcaacacgaccctgccgcacttcctgggcaaagtggaggaacttgtcgagctcggaatccgaaattgtcggtgggacccgtctccgtttcctctttctgtttccagctgatgagctgggagccgcggatctccctttcgcctcggtggccgagtacggaggatcagaatgaagagccagctttcggtctcgtccgtcatttttctcagacgagtgattttgactagaagaataagagaagttttcccgttggtttaccggagagggatccttcggaggctcaggcggtgacaggttatagcattcgacggaaaggctcgtgcacaggcagcaacatgcaaacgccgcaacgagtagctggcagaaaaacaacgtatagaaacgcgacacagagctcgtcctttcacgagacacaaacgactgatggggataggctacttcattactctgacgagatcgagcgtctcgccagccgtgaaaaatacttcgccggtgccggtgggtgtttttgggtggcgatgagggtagaaagcacgagacagatcctctcaaattcagcctgtcatcgtgaaaggcattggaaaaactggtgaaacgaccgcgtaatttcccatggcaaggatcgcggcaacttgagagacagcgacgtaaagcagaggagacaggggacaggcccgctgactggtaaggagaggaccggggaaaacgcctcaccacggggtcgttctcgggatccccgtaaggtggcatttttccagacccaaaattctcctggaaaagggattcacctgcatagtccctatgaaaccacacgaaagaggaggaaatagcctgctcgacagagataccagctaaactcaccggctcacggcttttttacagagtgcggagagacacgcgcgttccaaagtccccggaacctgctcgttgagagcgctctggagagatttcgattcgttgactttgccaaagttttcagacaaaacgctgctgcgaaaaccagtcgcacaaagaagagacacacgtcgaacgagacgctccacacgcaaacttaacagttgtagcacgaccgcgtctgcaggggacactgcatgcacacagccgcttctggagagtgaacagaacgaacggcacacgatgataacttcttctacaaacatggaattcgttcgttatccctcagggtaagcaaaaatgaatgctgtgcacgtatcatcttgtctcagtgtcgtttcgctgccacgtggtatttcttccccttcgaacattattgcatatggcaagttcactcagacatcagcgcggcagtaactccacataagattgctgtcatcaaaacacgtacaacaa

SEQ ID NO: 2454 - DNA, 2646 bp, Toxoplasma gondii
tgtccgttctctgtttattccactcgaccgacatttcctatcctttcttctgcagtgaaggaaaggtgaaacaccatcagccggagaagagaggaaacctgacaaaaggctcccgagagaaacacgaaaggcttcggtgtgtcttttttctgatccgttttcttctctctctctgaatccctcccccctctgcttctcctttcttccccctgtcgtctttctttccattcttttcagcttcccggcactctctcgtctgcgcattcttcaacgttgcggggtagctgtcgcgctgtagccgcgcgtcgccgtttcgacgtgcagagcgccgccgccggcaaccggagggagcagagcgacagtcgcatgagaagcggcttgtgcccagtcagttaaatgatcttcttggatcggaagaagcgtttgaagtagtaggcggaggcgagggcggccaggacgaggagcatcatgttgacgaggcagaaagtcatcagacggttggcggtactgtcgcttgcctcgcgcattttgctttctttttcgcgcatgtagagcacattcgcgtggtacagtttcaggcggtcttggagtcgcaggagctgcaccatgacttcgtccaggtgctcagccttcgcgatctggctgtagtccctggcctcgggaccccacaccatcttgaagtccacagcgagcttcaggcgtccagtattggtcacgcagaacgtgtgagtgccggtgagcgccgtggtgaacgccgtgcgaacgtgatctttcccctgttgcttgaagatcggggagtgactcacggggtcctccgcgacgaccagcatgttcccgccttgcgccgtcgccgccgccggatacgcgatgtggaactcgcccaccacgagcacgtgtctagacagctgctcaccgacgcaacgcttctggccgggtgcgagctcgatgaccgcttggaaggcggccgcaggcggagtcagcgccagagacgccaggccgagaccgagggcgaagaggaggaaagagcgagggcaagagcagaggccgcgggatccccgagaggatcggcgagaagcagtgagttgagacacagacatcttgggcgcgcggaagggtatcggccgtaaagagagtgtgcggacagatgcgaggagcggcagagagggcgacgggtgcagcgagggagaggcgagaaggacgagaagagtagagggcgacagaggcgaaaggtgttggcttcaggcagaaagtaagagagacagagaaaggggggaaacagaggaagaggaggacgcgctttctgacctgcgatgggagagacggggggtgtgacggcgtgggcgttgacggtcacacagagagaggagactggaaagccagataattcaagtggagtcgacgagactggcgatcgcacacagcggacgctcgcgagacaagaagacctcagaaagacaaaaagcaaacgagaatgctgcaaaaaaacgctgcacgcctctcgagctttccttgatggaaaacaccttgtccctcaaaagacgggtcgagaagaggcgccgacacagaggaactgagactgagaaacgcgctgaaaacctgggagttcagaaacgaccgacttctcttgccccttccgagagcggtgccacggtgaaaagtggaaagagctcccaagacaagagaaggtcgcgagcgccacagaggtggctctcttccaggtgcacgagacgacggcggcaacagcctagacgcgcgaaggcgtggttccctggacactcggcagaaagtgaagacagacacgtttgtgtgaaggcaaaaaacgtcaaaaacgctcaagaaaatccgaacaggcgccgccatgcgcggacggggggcactatgaccgcgcgagccaaagaagacgggatcgcctgtgcatgtgcgaaaaagaggcgacgcactgccagcttttactcgaaaagaagtgcggagaaaagctcgagatgtttctcgcgtgtcttgcgaaacgtgtgcgtcgaacccgggagtttcccttgggaaaacgactccagaaagtcgactttcgcagtattgcttccctcttctcggctgcctgctctcggggctgtcgccgtcgcagctccggtgtacagacacccgaggtgttcagaaggggatgatgaacccgctgagagagtgcgggcggccaaaggaatgtgttcccgtgtaaatgacctgttcccggtcacttcttcagaattaagtgcttgaagggctcgcatcgtgaagcagaaaaaggatcgcagtccgctgtgggcagaacggtggcgtgtcaccgccctcctgtcacgatacgtcttgtcctgggggttccgcgggatcctgggcattccgtgaaaaaggtaaaaactgcgacactgcgcatgcttacttgatgcctttctcgtcaatgaccttggaaacgaatcgatttggtccgtgcaggcctctttcccgtttaaaagtccgtctgccacgccgtatacggcgaccttgagatgctgcgagtcctgccccgtgtgtgtgcttgggtgtatgcacacctgggtttcgcgtagtggactgccgtccatgtcaaggacctgagaggtttgaattatttggctaccaacgtgccagctgtgccta

SEQ ID NO: 2455 - DNA, 3731 bp, Toxoplasma gondii
cgtgattagttcacttagccgaaacgatccttttatgtgggagcaactttcttgaatataaggataatatatgtgctacaataacacagtacgtacgcagtcgaaacagggtggttgggggtgaatctgtggctgaacaaagctctttacgggacacgggaggataatccgttagcagcgtgtttcacctgacggacggtcgtgtctgtttgatttcaggaccggcgatttgccaagtgcaatttggttcggattgacgggggcaaagtggacgatgtcccagagttcgaggctttggtgatggtcaatagtgccaacgaagtcgtcagcttcgagccagctaaggcagttcccatgtgcgatcttagcaacagcaacctggcttttgttccttgcggtgacaccgcggtccgccaggaccacacccgttttgtgttcccgctgccggacgcagggaaggtcccgctgcagaaaggcgaggacgaacagaaagaagagggtgaatggaggatagcgaaaatcgcccgcaccgcaggcagcatggcttggaaagcagcttcatccaccgtggcagcaggaggcgccgtggtaaactacatgatgggacgatctgcgcctcctgcagagtctttgcagcagaaactcatcacataccaccaaaagggcatttcgtacagcctagaatgcatggatcctgtttctgagacaaccatgaggagcacgttgaatccgcccctggcttcaatcattggacagggattcgctgctgtgctggaactcgaaaacagcgacgtcaacatgcactctggagggccgtatccggagagggtttaaaaaaacgagggtgttctgacctcaacttccttaccagtggcagatccgctggtcttctgacatgttgaaagtttctactcagtagagtccaccagcgctcaaggcctcgtggtgaaaggtatctcgtgtctacactattggccagtctacgtgtgtacgtccgtgcgtctgactttgaaccgagcggtaactttcccttttcttttttctctaactttttcaaacatgattggacctaacggcgttcaactgtcaaaaatcacaaccgaacggacatgttcctctcaacctcccttctgtgttgagccccgggttgagaatatgctgtaaccgtcctccctgttctacaaggtcccgctttttcacgcgtagaaatgcgagtgggggggcgactgtggattcgcaggttcttgaaaactatgcaaacatttgtcaccacgcacccttagtcggcaagatttcatatacaatgctacagggagtcatcgcctcacactcgatggtcgagccgtcaaatatgcatccaacgtgcaatacggaattacattttgtgtctacagatacagaacagcaacagaaaatggggcatccatttgcgctgaaaacgggatgcatataaagtgcgtagttgtgtaaaatgtgctcaggctgcttgcgcagtccgccgagacacccttttgcatcggcgtctcgtcgcttccttctgctcggtcgtctgttctacgccttcctcgaggaagagcttctgcgagtgtctgcttcgtttgctgcttatatctgaaattgttcccacgtttgtacttcgacgtttttctaatcttgaagtgttccgcgaagacccccgaaagagtggtaggagcacaagtgtgtgtcagtaagcatcccgtgcccttttgtcccctagaacacactgcctacctaaaatggcgtcaattttcatgtagtgcattggccatcccattccagaagcgctgaagtttccatctttaccagctgcagcttccaccgctgtgttagcgagacgggacaacagagtgtctggttgttgacgctgaaccatgggaagactttttgaaaagctgggggacaaaagtccgaatctatatcacatcagctgcattttttcactcagagcctagattcattgcattaccatgcctcttcttgttccgttttggaagaagcttcagctgtgttttttgtctgcgttctgcgttctcttggcttgccgtgttcaacccccaagcgctgctttgtgtcaaccgttgtcggcacctgttttccttctcctgcgacgttcgacttctctgttctcccaggggaaactccatctttctccggaatcctatatacaattcgaaactgagctttttgcccaacttcgaggacgaaatccagtgactatgtcgccttttcgactctctgctgtgccacagcggggctgagaaactaggcagcctacgaaaagattgccgcccagtttttcttcccgtgctgcgttccctaccctctcgaaggtgattttgtcgtgtttgaccgttcagaattcgagaaagctcgtgcataatgtcactgtctttatggacgcgtatcttccgtcagctgcaggtacccctttgtatggctgtgtatgctgattccgcgcacctctgcatgcactgcgatagaaaagaaaaaccgtcaacgcggaagacagtgacccctccgccactttgggctttgtctttcgcgaagaaccactggaagaactgttgtcccattctttctgcctccagttaaccttcgtgctcacatagcgaagaagacaactcggtcgggccgtctgcaggcataaagtgttctgactttttcgatccagtcaccgccattgaggcccaggaacgcacatagagaaatttatttttgttaggcgagtgttcgtgtgcgaaaattgaaggtgaaaatccgtgcgtcgtatgcgtggccgggtttggccgacgtacggagcgaaaggacgcagataattttgaacagggaaattcaatacccaagtcggtggttctcatgaattcctcgtcatctctggagccgccctccaaaactaccagtgagaaactcgtcggccgctctcgtctgtcttttaagaatttaactgcctgcccgctgaaacgaagtacggcttccgagagagtcgctgagcgactccatcggttttttctttccacctgtcgcaagctgtgggttagcgcacctttttcgcggcgatatcttctccgtttttcgaaagagctcgttggtgcaacgcacagctgtgtcctaacccacagttcaccgtcgaggaagcctccgtaatagaagccgacttcattgtgcctgtctggccctccagtgtacatacaccggagaggggcgggctgccgcaagcactcgtcggtcttgttgttccgttcgaggaaatggtgtgctctggcccgcattcagaagagcaggcgtgttttgcctttgcttttcagtttgcgaacctagaggctgccagcagcacattttaatttctccttctttgtttttggtttctccctgtccgctgctgtttgccattctgtctgggcgtggaggattagatgcggcacccgaggtctgcagccagttctcgccagcctgccgtacttctgtgcagacggcctttggaagaagcaacggagagactctgggagaaaactcagtgcaggttgagaacgctgcactctcgacgcggctgacggagtgtacgtacaccgcgtcggtgggcagcgaaggccggtcgtgcattaacacacctacctatattcacggttgctcgcttccttttttccttcctggcagagatccctttctgtcccctacatcttctcctttctcccttttttctggatccaaaa

SEQ ID NO: 2456 - DNA, 2932 bp, Toxoplasma gondii
acaactgcaaagcgtttccttaacagagcgcacggcggtggattccgtgaccaacggtccgtccacgggaagcagaagagaagtcacggtgtctatgtcgatttctgtcgaaaaggaactggtagcggaatagaacgaagagcagccgactgtggtttcccagcaagtcgagcaggtcaaggcgaggaaaggcagaaacatggcagtccgtggtggacactggttcctgcgaaagtcccgttctgcgcaaacagtgaaagggcaagtctgatgtgcgtgtcattcggtgtctctctgtggcgtgcaggcgtgacgtacggccgcagtgggccgctcttcgaagcgtacaaacgcgttctgatgggggaggcccccagcaagacgccaggtatttgtcttgagcgcgaaactctcgcgtcggcgtcgtccggcactgcggaacgacgtggagagaagccgacaggcttgcctgaaagtgcctctacagctgccagttttcatgcaagcacacgcgaatgcgagccgcccaaagccgccttgttttgcgtcatgaacggcgcgcttagcgaaggcgtgaatttccacgatagcctagccagactgctagtcctcgtagggttgccgtttcctagtatcaaggatccggagtttcagctgcgggcggctttcttttcatctgtgctcgagcggacacagagaaacgcagacacacacgcttctgtcggggaaaaacgcgagagcgacacaacacgcgtcgaaaaaaacgtcgacaaaactgatagcggagcagcgcgcttccgggcggcgcaaaccacagctcaggagaacagtgttcatgggcgaggagggaaccggagcatggacgctgaagcctcgaccgtgaggaagcttgagagaaaaccccgctgcgctgaaccaactcccaacggccgaaccagctacggtttactccactgcttacaaacagttaaccaaaccatcgggagagcgatccggcacagccaagactatgccgcagttttgctcgttgactgccgctacactgcgaaacacatcgagacgcttctttctccgtggattagagaggctctcgacgcctcccgcagagccacagaggagtctatttcgcctctcgcccgggactgggcagaggaggacctctgccgagatcgcttcgggacagcaaaggaggggcactccgccaggccagatatacccgacacgtgcggcgggttgaccacgcgacttgccggatttttcaaacttatggcggaacatgaaaaactgaaatgtacctctcgtgactgcgtgcgagcatgcagttagaaccaagttttcacggcgattcgacgccaatctgtgttttgttggattcaacggcttgctgcgtccgagacgttttcagtgccggtaactctagcgggacgtcgacttctgaaggagttggttttcctcaaaaacagactcgctggagggttccgctagcaaacaggaactcttggaaacagggatttcgagtgcttctctcgtcagcgacgccgggcactggatgtctggttaacgaagaacgggagagcgagctacgtccatactctcacgtagacgtatgttcctcgagtgcgacagcacaacatccgtctttgaacacgccacaaagaaaaaaacacattcggcgatgcaggcatttccccttccatgggaacgcaaacgctctacctcccccgtgctgctcgagctgaaatcgtagaacgcgacaggcgtttacctgctcaatgagtcctgacaaacaatgacggttgtgtcaacttgagtgcactttgctttcaacagatcagatttccacccgtcctggttttcgtggctcgccttcgagaatccactgtgattttggcaatacaaaggagtcaaacgttgtggcgacgttttgcacacagagttggggtttccctccatgtggcttacaagtggctctgctttggacgataccacagagcgcatagatgcaatgcatgcatagatggcagtttcaaacatgggttgcgttgtccgcaaagggacaaaaaacagcgtgagggcctcggtacccgggcgtgatacccagcatgaatgggtttttctccgtaacagtacagtaactctgtccgagcaacgaggacattttcgtgaggtatgaggctcgtttgcttaacctatttagcaccacaaaagattaagctgaacctcccagagagtcctacactacacgggacccacattaccctgatcagctctgtggtgttggtttacggcagggacgtcccggtcataacatccagcgagtccttcctattatacgtattgctcaggcacctactcgtgataacaactccctctgtaaactttgcttccacccagtcttttgcaaacaccggatgcattgtagaaggcaaatatgaactctttctctatacgtttatctgcttaccgctgacttgagggggcgggtatttcgtgttggcagggccccgataaaaggtttgtcgacagacatcagagttccaataaacgcgtcaagagaatcactacatcctgccatgctgctctccaccgtgtctccgaagcagacatcagtgaaacgctgtgttaagggtaatggtacccgtgattgtcacgactttccggtactttacagtcattaggcagtcagtgaatataagattggagacgaggcgcttccccaaattggagcttcatcactcgcatgctctagcatatcatcgagaggttagagacgcgacgcctttcggcgtgacaaacgttggcaagcgtgtacttggaggcggtccaccgtgctcagtcgaactggggttgccaccaaagtaggcacaactactgcaattgcagtacttttagcagaaatttctttcttgggggtcgcacgtaagaggaagta

SEQ ID NO: 2457 - DNA, 1992 bp, Toxoplasma gondii
cgattgaagcaagcagctctggatgggtcgagagcctgtggagagactctctcgatgtcgtccacggagaaaaggaacaaaggcgttgcttctctcgacgagaagacctgcgccttgtcgcgtctctgggggatttcttggagacgcaggagacaacgaagaagagcacgagggggaagaggcagagacgcgcgaagaagggcagggaggtgaacagcgagggacagaggagacggggaaggaagaccggagagaggccaagtgaagacgagaagagagagaagagaaacgagaaatgcacgtggagttgtaaaactgtcgaggtggaagaggagcgccgaaagaggtgccgagtctggcgggagaagaggaggaagaagagatagaagtgacggccgaaggagaggtcaggacagacctgataggatgagcgcagccgggcgagggagcaacggaggagaaggaaacaggagaggaagacggagaggaaaaagaaggtgaaatcggagatgtcggctgtctgaaataagacttctcacaagggggaattgtaacagaagaaaacgcgttgtctaagtttctttccccccagaccttctgtcggaggcccgacagagaggagaagaaagcacctcgtgtcatctttcaaaaacctgtgccagtcccttttcggagaacacacaggggacgagtagacgaagaaggcgagaagtggaagaaaaaagcgctgaactggaataacgtagggagagaggggggtcgcacaagttccagttgaccacacggctctggatgagcaaattgaagatattcggcaactcgggtggctctgacttttgattcgtgtcgagctagtcgcttctcacgtattccggaaaaatttccacgcgtacacaagctggtgtttatccgtcgccccccccagcggtgtgatcgacgttctcgtagtcccctgcgttttcagttgctcccttttccgagttgtgcttcccagaaagacgatcagacaaggaaagacggaaggaagcagcgacagaaagcgacactgcagacctcaacagaggcgtcgactcaaacttgattcccgcggccacgttctcctccaggtgtacatacacctaaggcgaaggggcatggcaagcggttttcctcgttcggcgcacggagcgatgctgtggagaaatgaggaacagaacaagaggaacgacgcagggaaacagaagttcaggctgacaaataccctccgcttttccccggcgaagcctcccgctattattttccagtgcatgcgaagacaccgagagagcagttcgcaaaacactgcttggactttctctgggttcttttctttctcttcgttcccctttttcggaagctctttctgctcctgactctttacattctgcatctcgctgcatgtcaatgctcctctaccttattttgttaccccccttcctcccgtcgcctgccgtccccgtttccgaggatgacacccgccagctctgggagccagccgcggtccttgcccctctctggaaagcgcgactctttcttttttcagttgtttcgctcacggagtcgttgcgtttcttgtctgcgaactctctccagcgcgcttttgcctctccggttgtcccttcaagtcaaacaggtcatccacgcctccggccgacacctgccgagacgcttctgcctcgcttcttcccttccaaggaaacctgcataatctctgccaccgtctccgcgggggctctttgcgggagttgccattcttgtgtgaactctcttcggaggagcgaagcggggcaagataagtgtgatttggttctactctgttgataagtcaaaagatcgaaggtctcatcgtaaaattgcatgtaattatactccttgaggaggtttgggaattcgaagaagctccgccatttaaaattcagggccttgacacatgcttctccctcaggctttcatatgtttctctcaatctaaaaa

SEQ ID NO: 2458 - DNA, 2651 bp, Toxoplasma gondii
gtctctgaagctctctgggagggtcgacgaataggaggaagaagaagaaagaaacgccggagaagaagaaaagggagaggcagaggaagaagggggggaacaggaggaagaagaagagacagacgaagaggaaggaagtatcggcgaagcagtagagggagaggcagaggaggaagagggagaagatgaggaggaagaagaggggaagacaggagaagaggaggacgaactgaaagctgaacgagagggagacacccgagaagagatagaagagagaggagcggcgacggcgtctgtccggagcccaacagaagcccccgggggagataaggtttggggaggaataagcttgtgcatggtgcttgctggtcgcgtttcatataatttcgactttgaaaacttgaaaaacgaggtcaatcccgtggagcctggagtccaggaagccgagaaacaaagaggcgacagctgcaagtagagcgaccgaaacaaactcacgaatagctagcaacattttcggcgaagacggcgcacaagttgcattcaaagatgcaggccttcgcgcgacgctgcgacagaaggggaacatacacagagacagaagaaacgagtgacgtggacgacgaagaggacaggtagcgtgaagactcgcagaagagaactggccgaacacagctagaggagaaggaggaagaggaggagacgctgtgaaggaagagaagttcagtgtggaggccgggtgccgggagagcgatgcgaacggaggaacaggaaaggcaaaaacaaattcaagggaaaaggcggcaactcacactgagtgtatacgcgcagcggaagacgaagacacccccggaatcagacgaagcacgaaagaaatgcgacgacgaatacagacggatgagggggaagggcttaacagcagctgagtaaaggaggagaaattcaagaggaagagagttcagcggaagtagaaatgagcgagcgcgaagtacacacggcaagcgaggaaccgacgcgccgaaaaaagaagagatgaggctggatcacgaggagaaggcgaaaaaggacgatgccgtggcgcgtttctctctcttcagtctccgtcacggccttctttggcctgaaaacttaaacacagttcaagcaggggaacggactactcgtttttagatgaaggaaacggcgcgttcctctgttcccaagacacaaaggcggtggtctgttaagtgtgcagtcccgagacagccagcaattcttcttccgacagagaaaacggcgtctcgaaatgccacgaacatccagagaaatctgttacccgcccgccgcaaaaaagcgagacgctgtgtatgtacacttgagcgtcacatcacaggttcccgctttccagaaggcgcagcgccgcagcggctgcgagccagagcttgcttttctcgtggttttccgttgaaacgacaatcgcccttgcctttctgtcctctctgtcgcttgctacccctccgacagcagcgagattccgctttttgcggagaccgccgccttcctggttttgctggcttatctttagaacgctttgtcacagctaccctggagagcagctcttcgcgccgcgatctctgaactcgatcttcttgtcggtgagagggtctcgcccgcgccgaaaaattgcgggtctgaagcttgtccgcatgcgccggtttttcaaacagactgcccttttcttgaacgactcagcctgttttttccgctgcgaaaatctcctgccttttcacccttgtctgtgtccttttttgacgctctgtttttttctcgcgaaggggaagtctgctctcttcgccaagatctccggtgtacagaggcggggcggagggagaggcgcggcatcctactttcttcgaccggaaaacagtggaaggaaaaattgacttcggcgggagcaacttctttcccccgtttttcggctatccttcttcgagatcaaggtggcggtcgtccttctcgttttcctcaaagtgtttgccgctctggggccgtcgctgtcttcacgcgaaggctctgcctcacacactggaaagaggcgcaaaagatcgagagcaattgtttttcttggcattttcttcgtgggttcacgggagattttctgcaaggctcctcgcttccctacgcccgtctctttggcgccttgcccgtgggagcacggcgggggtcgattcatgataccatagaccctctttgtcgacagccggtcaatttcttttctcttttctgtcatatccaacaggttgctgcagtgtccgcagacgagtcaaacggtacagttttctcccgcattccattccctctttgctcactgctctctcgtctgttttttcccctccctgcccttaacgctgtctccttcctcgccgacatcgtctacagcttcttctgcctgccctcattcttctgcagtctgtctcttcctttctaagtaaaattccttctcttcaaataaattgcgacgtcttgcttcttgaatttgtccattttttcttctctttctcccaggctctagtcgtataaatctcgccgtaccccactccgtcgagtcatgtgtgtagggttcttctgttagaagctttctccgtctcttctccaagaccactatcgatcaaaaa

SEQ ID NO: 2459 - DNA, 2377 bp, Toxoplasma gondii
aagatggcagagacgagaccgtgcgaaaagaggaagactctgagagggggagagaagaggggcaggtgggcggcgaatgaggcaaggccgtatgagagactggagagtcggagagatgctgtgaagagagggaggaaaagcgtttgtctggtcgctttgcccgaggaggaaggaggcctcgaccaagatagtgtcgtccgcgagaaggtaatcctccagtgggttgagagtcaggcgaagaaccgcgagacgaagacagagtctgagaagcgagcgggcgttcctcagacggcagcggacgagcggaaggagaacaactgggggaagcggatggcgaagaagaagagcaaggtataacgtcggtgatgtctgtgggcagcccaggcacggccggcagagacgatggaggactggggagacgaatgcactgttttttcttcacttcttcttcattttcatcgtggcttgagaggtctggagacctagatgtctctccggacgccagtcgctcccgcaccgtctctccttctctcggctttgcaagcgttcgcagagttccgccgccacgacaccctcgaggcgtcgaagaagacggagaggccgcggatacgctcgactctgcgcgcgtccggttcaatctctccggcgcgcctcgcccaggcgtatgtacacccgatgcgtcagccagggaaggtgcatgctgcacgaggggagaagaggcggcgggagaggagacggagtgaggggaggagaggtcggggggagggaggcctcgtcgagcctggaaggcgaagaaggcgaaaggattgtctccctcgttcgccatcggaggagagacagcagagggggacgtgtacgggggtcagaaggtgactaaaaaggtcgtttgaatggagcgtggagaggaaaaacaggggagagaagagaagttccgggcagacggaaccgcggggagaaggaaaaacgaggggaagggaaatacgtcaaccgtgctggcctctgtcctttctctctttctctttttccttgtctgctctgcggcgtcgcttgagcttgacgagctgctcgcgctccgtggctcgtttcttttcctgggtttaacgtcttctccccatggtcgacaagagccgagacaataggtgcaaggaagcgaaaaggaacagcgacaagagcaaaggattctctgtcggcgtttgcggagctagagccgcgagtctctcttgtgtgcggtttccgtggtgtagccggagacacggtctcccgcgagaggtgaccacgaaggagagacgagggagacccggaagaacagagtctgcaaaaacacaaaaaaaggagaaaaaatgaagaaatatggacgacggtttgcgggccaaaggtgatgttagagtctctcgcctcttcttgttttctgcctgcgtttcagggggtatatagagcatgcgcagtccgaggagacacgcggacgacagcgaacacagaagctcaattttttcgccgcttcgaggagaagaagtccaacagcgtcgaccgtcgtttttttttgcagaagaccgcctcatcgagttgatgagttctgcgtccactcgaatcttcaactccgtcgtcttctcgccttcgaattcgacgaagaagggtagagagagacacctgggggggggggggcatccgagcgagaacgccctcctctttctctgtctcgttccacccgagtcgtgtcttgtacatgcttcttttcttttcacatttttctctttgtttaattcgctgcaaagcgcccccactcttccagttgtccgtctcggaccgctggaaatgaagaagcacgaacgtttccgccgatccgtcagaaagaagaagaatttaaggagacgagacgcacagcagagagaagcgtcagacacctcgagaaagcgtttcatcctcctcctttcggattcttccatcttctcttctttcctccctcttttgatcctccctcgactttgaatccgttcatcactctctccccctctgtcccccttctctcgtttaccgcgcctccgggtcttctgtctcctctttgcctacgctaaaaagcgacagcgcctcggtctccattgcggcctgttcgtctcggcgcgtcttcttctcttctctcttctctccttggttttccctcttttttctcatctttctgtgagtctccttcgacatcaaaggcctcacttcgactcacgctgctctcttccgcttatgcgtgcgtctcgtttcctcttgcgtcttcgccttcgtctggtctaacggagccgcttttcttactcttctcagagacagtctcttccacttgttcctcttcttctcttcgtctccctccgctctgtcttatgctttgggggaa

SEQ ID NO: 2460 - DNA, 2172 bp, Toxoplasma gondii
gtgtattctcaccttcttcggaacacatccgacatttacgcaggtgcctccgagtctgttgccgtcggccagacccacccgaacgttgtacgttgccgcgcgtcgagcgcacgcaaggcctccgctgccgcctccgataacgaagaggtcaaagtgtcgtcgcgctgagagccatggcagagaaacaaagggaactcgagagcttctgcgcatcaattcgtgaagaaacgcttgacaaagaggcatgccgtaggtagaaacgaccagcgacgagaggtgcctcgactgcgcggggtccatgtcgctagaggtaactggggtgtctctacacaaccggaaacgaaaggctctcatttcatatacggagaggccaggggcaaatgacgccgagggaagtcgaacagccgtcattcataaggaatgaaaaacacttgtaagtgtttctgggaagatcgaggcaaggacagcgcgcatcccaagagtccgtgcagaattcgaaggggatgactgaagtcaaaagagtgaataccaaaacacttccacggtggccttgagaaaacagtaagagactctgggtatgcgtcgcggccaccgctggtcagattcccagtgtatagacatctgagatgacacaccaaaggtaatttccgatcagccggcacatcggaacagacaatctgaacagaacatttgaatagcttctggaatctattcctcgtaccacgcttcgagtttagatcagcgaaatgagggcttaaaacagaagcgcgctttgtcatagcgagtgtcgacgcagaatggccaacggaatcctgacgaattgacctacttgctgcggccattttcgctgccattcgtgaccagcgtgcagaacagccgtacgaacagttagtttctccccgaaggaaccgcccgacgaggaagttgctggggacaggacgggaccgtctaccacgaaacacaccgtcgttctcagtgacaacaacggaaaagttggttaaagttcataccggtgcagatgcactaactagccagaagagccaagaagagatgcttgacaactcgcccgactacatagggtagaacatttggcagttctggcagaggcgagggcaactcactgctgtaatacggtggaaatagtttgtaaacggaagcaaagacgaagcccgaaccaaggagacgacctcaactttgatgatgtggcctggtgacgcgtttccgtttccttgacacacagtttcgcacacggatacggtggatgcatgcaaacgcgcattttcaatgcatgcgtcttttgcgagggactaccgcacgcaagcggagggaaatgccatctattgcactgtgccttttcttttacaaaacgaagatattcagttctttgctttctaggctgtgacaggtcacgcagcgccttcgtgctcgcgactctcaagaaggtgtgttggtcctctttgcgagcagctgcgaaatggtcctcgttttttcgagaaaacaacttaagtctagccatttgtaaatactgtgttaaaatcaatctccttcttaatcttaaatttccatatggtgcctcttttcctttttcaccgtcaaaattgactgactggcatgcagtacacgagcgcatgcgagactgccaaaggacccttgctggctctgacagtacattttggagagttccaagtcttccccaaagccaatttattcgtagagaccccttgcttcgagcacgaatcgctcttgttgccgtttatctgtcttttcgttgatccatgtctgccctctaaattcgtcggttcgggactcgtggttcaccggtgcatgcaaacgctggtcccctacactccgactttaattgcgtgttcgtatcgacatgtttgagaagaaagagagcagtagtttcgtcttatccgaatgaaggcaggtggtgttctctcgcttctcactccagcccgagatacaacatcgcatttccattgtgacaaaaaaaaatccaacagaaggcgcggtgttgcttaatatacactcgaacaaacggcggattagacattgatagcgtgttttctaacttggtcgatggttcacaacttccgaaaaaaacgaactgtttcatcatcggctcccgctcccgcgtcaaacaagagttccttccgccctcggtgagcacca

SEQ ID NO: 2461 - DNA, 3091 bp, Toxoplasma gondii
ccgtttgcacactctgccgcttcaagctctggactcttttctctccacgtgtcgaggttcccggcgggttttttcttgcttctgctcaccagatggtctgggtgcgggaagcaggagagtcgggagttcttctctctcggaggaccaaacaatgcctcggacttcgtgtctaggttccatctctctgccttttcgacgaggaacgtgagagcagggacgcacggtgagcggatggacaggctcgaccgcgtttgcgggcagctggcggccgtcaacatcccgctgctcagccaatccgcgccgctccgagggcgggagccgattcgactccgccgcgagcggaaacgacggagacttcggagcgaacggaggcatcttggagggaaagagaaagacgagttaataatggtaagtacggaggaagagaggaaacgaaggagggggaggagggagacggcgagagcggattggaggacaagtagagagaaatagagggactgagggacaacagaagcagagaaacgaagacacagaagagagagaccaaggcaaaagccaggcgagaaggtgagaagagagaaagaaaagatggagcagacgtttttaaaaggtgaaacagagggagaaagactcggacgagcagacaaaacgaaaggcaggacggaaagagggaaatcgagaattccgaggaaaatgaatcaagggacagacgcacgtagaaagccgtggggaccgagggaatgggagggtcctgttggaagagagaaatgaacagaatgtgtctggttggatagaaaactggaaatgagaaaaaattcgcacgggggaagaacggaaacggcgacacgacgcaacgttactgaaaaggaacagaggaggtcggtaaggcgaactccaccggcgaggcggcagacgcaggtgaacgcacaagccaaagtaaaagaaggggtaaaaccggaaagacagaaaaacaatgaaaacaatggagcgaaggggaagcggtaccggccgtcatgaaaggaaatcgcgttcttacgaaagcagaccggggatacagtgaggaacgggaaagtttggtccccataacaggcagaggattgtcagaggcaacgcgaacactgccaagaacgaaaggaaattccgaaaaaaattcggaaggaaagcggcggcacacgccacaagaaataacagagaaaccgccgtcctgtctgcctcagtgttgtctcagcccctggctcgtcggtgcacggacgagggcaggaaaccaattccccctttttcccgcattccggtcatgccgtcggttccatcctagcttttcccttagaactctgctgcgtgtgacagaagccaagaaatggcggcagagaaaaaactccaagaaagctctcatcgccggcggtcgagtgatccgtgccacggcgttggagatccgaaaggcgcgttcgcgttgcgctggtgtgtcccttgccaacgaaaaaaggacggaagacagacgaagagaagattccggcaggcgtccgtgattcttatacttttctgtatctccgccaccacgtgttcagaattttgcgtttgccaccccgtttgtttcgaaaagcgcggttactctgctgtcttggctctctctgcagtgcatgtgttcgcggcagcctcggcgtccacgaaccagccaaggtcaggcgggtgacagccgaacggagttgtcttccccggcggcggaccgcttcctagaaaggcgtcttccagtgacttggaaagcgtatccaactcaattcatgttgtaatagagaaatttttgtcctgtgtcggggaaagcgaaacccgcgcgcgaaaaagctgaaaacccgtggatcccacccacagggtcgagtgtacatacacgcgagccactcggtgcccgatcgggcacggcgtctcgctcgtgaggagcacgagtcgggttcgcacacttcgtttgtttgtcgagtcgcggagtctcctttcccttcggcaaaagcaacctgtacgaagtcgtctttacagtaagatcattttcatgtgtttccggccactttccacaaaagtgtagtctgaaacttaaccgcagccggacccaatggcacctgcagcgacccggcctctggctcgcctctcgcagtcgccgtccactgtcgggccgcggcgacgggaactgtagcccgcttctcggggagtttcctagattcttcgcgtcaattctgttgcgcaaaggttcgcaagcttctcgcgtaagcaaatggatggacagtttcactcgacgcgctttgttgccagcaggtagacagcggacggcgcggtaaaacgccccccttcgcggcagccggaggcgctcaggcgcaaaccgcgagcagcttttccctctcagagaccagaaaatgacttgggaacaggtgtaaaaagcagatgaaaggcagacaaacgggttgtgttgtgtgcagaagcgaggggccggcaagaggcgcgatttctccgacacagtgcaacttttcgccggcttttttgccaagtgagaagcctaaacaaaactgctctggccaccacactgtggagggtgtgtgccagcgtgtgtaaaggaggccaatggagtaagtcctgttattctgatgcaagacttgccgtccgcaagttatctgtcgtctcttcggctgtgagaaagacataagcacacggagcctacaaatatacacctctctccgctgtctcttgggtcctttgtcatgtcctttctgccagcgcccttgtcgccgtctctctagtctatcacccgcgtccctcgtttctttcgcgattcgtctcctagtcacctgcgactgtgacttggtcgatgactcttcaaagtgtcctaccttcctgtgtacaccttttctagtttctcttcatttcctcaccatcgccgttctcccgtgtctcccgtcggtgcgaagatctcctgtctccgccacttttgtggtttttttccaaagagcgtccggcgctcctggctccctcgtgccggcctgctctcctcacgagaccgccctcccccccccgccgacaaaagtgaagaactgaaccacaatcaacagcaaaa

SEQ ID NO: 2462 - DNA, 3583 bp, Toxoplasma gondii
ggttagttggtctcacacggaatccgatgatggcgagagaattatttgcccacgtaataggcagagaacatgttggaaatcaaccgtatcacttctttccgtcagaacgacagctgtacagattcgttggattgcgtagtttgggacgggctttgcaatttcggcggtacaatgaggcgatggggaacgctggtgtgagggcacaagtcggaatcagtttgtggacagtctctttgctggcgttgacagcccttctcgcgatacggttgggtagaggtaccagacactttgttagaaatcggaaacgggtgtccaacataaagggggaattacaacgacgtccaattattcatgaagagcaagctcccgtgcccgagctggaggaagcggaagacgagtgttccaccgtggacgtaacttatctcagttttttgtattgattggtgaacgcgatgttgctgaggactgccaacactggcgcgattcgcagtcgctcaagaccccgacgtatttacgggaacgtccgcccgaacgcgaaagtgagatcgtttttcttttgtcgtggcctgaggtgtgcgtttcagtctctgtgccatcagtgcccgttttcctttctggttgtccgtagatagaggcaggatgcaatgatgccgttgcatattccgtggtcagtgttttttgttggcctcaccaccacaggcagctgttgaacataccaggcggatctccaaataaagccctgcagtgtcccctcggccgaatcctaaagccctgaaacctttcatttcacacggtgcaacgcatgcaatacctatcatacaccaactgaagttagactccttgtcactaaaaagccatgcttcccaggttcttataaatgacctcttgctcggcagcatttgcacggtggttttaatggttgtgatgtttttggtaaggcagctgaagcagacacgacggccccttcagctttgtaaagaaagtacagagtacatgttgcattactgttttagataaccctctacacaagtcactggttatggcccaagctccaccgtgctagcatggtttcgaacgccctcagtatttctgtgaatctcttctgggccccgctgaagagagtaatccaaatgacttttgtagagcagacagggtggacgttcaactgccggctttgtatcagaggaagacatgaacgagccacgagtcagctgagcagcgaggacatctccacacatctaaaattagcagttgtggagtggtaattcctgtttcggattccttaattgaatgtatcattatgcgcttgtagagcgtcctgcagtcaggtatccactagcctcgtggcgaatgagcctgtgctttcaagggcaaggtatctgcattcatagggaaaacaccttttctgcctatccacgaattgaaagacatgcgaataacacttggctggcagcgtgaaaacaacgcaatacacaaatagaacaaagtgcacaactgaacaccacgtattactaaaaatataattagggcaatcggggacccttttgcggacaacattgtgcaatgttgcaaccattacgtaatatctggacggcatattatgacgtttgatgttcaaatacacgctgggcaccactattcttcattcatttaacatacagtagtgaaaggcaatatacaacttggatgcctgccaggtttgtcagagaagttgctgtcgtctggcaggtgcacagtgaacgcaaccgctcatttgcgtggcttaccttcggcggcctagagaaaatctgcctccgtcgtagctgatctaagagcaacgggcaagtgaagacgaggttttacgcaaacatcgggagccgtctgacgcgtaatgctccgagcgtcctccgcgaaagattgcaggaaaggagtaagggcgaaagcagatttgactgttggtcgcgtcacttgcagagcgctgcagaggagatgtctctctccgttgggcagacgaccaaaaccgtcgacttgttcgaagacgtcttccccggtcgcacatgctgtacagatctcattcccttcggcagtttgcttcctgatgctcgttttgcccttaggtctatctttctatagtgacgataatggggacggcctttccactaatgtaccgtttaaaactgcccgtttaaaactgcccatctttactgggacttactgcgcgtttccgtgacgctcccttttctggagaagcctagtgttggcatcgaccggacactctgcgataggctttctcgactttgcaaatacaccaaaagcctcctcctctccttccgatactgtatcgttgattcgtctttagttcagagtgtgtgcgtgcccaaaaaattcaatattcccgtataaaaacgctgagagttttcaacgagaaccgccgacaacttaccctgctgctgcgccactgatagcgataatgaaaccatcttctgctctttttgatacatagagggcgtgggatcttcacagtttctttttgtcctcgccaccaagaattttgggttttccatgaaatctggaagaagaggcttgacagtactgccacaatgacgacaagtagccgtctcagcagtatgatctactcgccatttctcagtaacagtctcgttgttctacaacaagccttccggtgccaattataccaactcttttctgaaaaacgactagcgctcgcctcaaaaccacgataacgcttggcacaaagactatcgcatgtccgccgtacaacaccggcaacactacgtgcacaaaaagagcgtagccagatcgcgtactgtaatgaaagtaatgcgcgcatggtgagcacttctgcagtggccacactataagtagagattgtatctggacaaaagatccgcgatccagaactgtgtttttcaaatcgaaaatcgagacatgaacacaagacgccacagggtgtgtgcccgccgatgtgcgtgttgcctcggagcgactatgcgccgaaaagaaggagacaaagaatagaagtttcgccgaaggatttgtgaagtcgtgctttcccatttccacatagatctgaggatgccttggcttttttctactcaacggaaagatcttttttgcagccccagcgttccctaaggccgcaactggggggccttaccactcagcggctgtttgccgcacacaggaggggttaaagcaccttttacgttttttctctccactgctccttggttctgttttcctgcgcgtatccccgtttctgggaaccttcccagctaaatcttccttcattttgctgcgggaaatccttttcagctcgtgtccccaactagactcgcagatgtctcgagatgtcctgcgttttcccgcaaggcaagtgcgcaagtgtcttcttccaatgccaccgtcattcctactctgctcaggtgggttgactaaagcatctttcattgagcaaaagcaagaatttcctctgtcgactttcgcaagtgacatgtcgcgtttgggactccttccaagcggaaacgatgcggatttctgaaaagctacgcgggttattcgtacgcaacctgagaacccgcca

SEQ ID NO: 2463 - DNA, 2747 bp, Toxoplasma gondii
ccgcctgagaagaggaacagaggccacgacaccaagaagtaaaaaattgggtggcacgcctctcaagcttggaaggtcactgacaaaagattaggagtggaagccgtgtttcctgcgatgtccgggttcttggcatccgccatccctaggcagggcacgaacctctacagttgacatgcgaagctttctctgcagcggaagtgttggaacaaagggaaaatggtgtcgttttctgccgtggctgcggccttgagtctgccgcttgctcgttcagctgccagcgaggaagcgggcgcctggccccagtcgtgcttccctcacgaactgttcccctgtcactctcgcttcccagaaacgattcctccagtgtacggagggagacggaagcgacaaacagtgatgaacaacgggaaagagctccccagaagaaaacccaaacctggcagtgaagagggtcaggcgggtcgccttaccaatctcgtcgaattcttctagttcgtcgtcgggttcgtcgaaagtgtcttgctcctctgctccgttggaagcatgcaggagagtcgactgctgggaggccgcctgcttcacctcctcctgaccggccttggtgctgtccgccgccatttgttctctctggggcttctgcgagacgcgttgctctagtgctgtccgttccgcggtagtcgcagtggcctctacgtccgcaggaagcaaaactgctaagacctttttcgacaatcgctgctccagatgtcccctttttcgcagaggtaacctcggtcgcttgccttcggtgatgcggcactttttgccggaaatcctgttggtactgatcgacgggtctcctgctggagcgtttgttttccgagcaagcaacaaactcaacaaaatgcgggcagttgcgcagctaacactcgtttgggaccgtgtctgtcagtcgcctctaaaagagtgacagtgaggcgcaaacccagacggccctttctgttgccgaggtgcatgtgcaggagagccacgcacacaggcggattgtccatacaaaaacacgggagagaacagcagtgagatcagtgagatagaagaacatcagcaaatcaggtggctgagccaacaactgcagatgaaccgcacaaagacggaaaaaatagcggacgacaaaatgtcgggatcaaggtaggcagctgcgactgacactactcaaacgtccggtggacggcgtcgttttcggaaagaaacgaagatttgttcccacacataacgccccagtttctcaactttatgcaggtggatacgggtgattgtgtgacgtgtctttgtaggcgggacaacgctgcagcgggcgtgacaaagggaagaggaatcttgcaggctcgtagtaggagggacggtgcatgcgacaggcgacagtcaaagccaaaggcgtacatagtgagctcgtctttcctctattcatatctacgccgtgagacgaacgatacagaagatgatgctaattttaggtccaacaccagaacaatgccgtctcagtttgaaaaaaaggtggaaaccggtgacttccagaagcattttgctcactgaaaacagcggtggacggtggaacgtaggaagcaacgcgaaagaccgctcgaccttcagtataaggccgactctgtctcctgaccctgcaaagagtagaccggcagctgatacggaataattagaaacggcatgttgatcccactaaagtaaagaggacaaaaagtaatccacggccattagggacacgctttttggcgtgtcacccctcactctcgcatagagagcgcagaataccagccaccgcttcaacataaaatccacggcttattttcggcagagcccacgcccgttccctaatgagggacggatatctacactacggtggagttgctgtgtttctttgttggcgtgtgcagagaattcccggagttctgcaaataggggaaagcttaactacgtgaatcacttggtactatgcgaagtatagcacaagctccttcagtttttcttctgagggcactgcctgtaggatgcgctgccgtatgttacggtcaaaaaagagtgttttctgattgtttacatggtggaaaaacgtcattccatgaaagagtgacagtttcattgaagaaaagttaacgggcgcagtggcgtttttcctccagtgcatccaaaagaagtccccccattccccgcgatgcatacagaggaagactatggatgaagtcggcaaagaacagcggacgaccaacgacgtagttttcgcgtcccgtttatcttgtcagtcgaaagagtcctcgtagtctggagaagagttgtttgaaacgtcttgtgtcacattcgaacgcggtgctttgatgttcgattcctgcaccgttcggagcgtctttaacagctggggaaagatccaccctttcgcttggcgggttggctcgttgaaggctgaactggcttttgtatgctttcagtaggcgtctttttggtcacgcgacaccgtttttaaaaccctgtctctttttgtatggatggtaacgtttttgtcttatcatcggttcatggctttgttgctttttcttgattctctgggtgtgtggttgtatcccgactggattgtcttgcgcacttggtagtgtgtataattatatcttgcccttggtgaatctgctaaatacgtttgcgctgaatacgtttttattgttgaacacagtctgcgtcactgccttcgtcatccacga

SEQ ID NO: 2464 - DNA, 2311 bp, Toxoplasma gondii
ttgttccagcatggagctttatgtgagacagaaggttctgccgtgcgaagatatatatatttttatgtccttcgtactgctgtttttactctttcatatacatatatatatacctacatatatgtatctatgtatatacatactatatatatatatatgtatatacgcattcaggtgtatccaacattgtttctggagtgtcggagaggtctcgtgatgccagaccctcttcgcgcagattcgaatgcgagtgtctcggctcgccgaagaagatgcattctttgaaaatgaaaaattcaccgtcagaggcaatttgcaagttcgccaagagtatcgagacgcattcggcgagtgcagaggacttctccagaaagaaatcgcaggtcttgaaaaagtgactcttaaacttgcgtgcacatctggagctcctcgaactccaacaacactgcttggccgatactccagtaaaaaggacgaaaaagactgaaaggaatttcagaagccattttctggaaagaactggcagactgccgttgcggacaggagaacgcgcgtatccgacgcactcctgcagcgcgggaggaggtcttcgagaacgatcaagcgaaagcaacctttcagttcagaggcactcttccccctgcgagttatctgattctgtcacccatcgagcagaaaacttgtctctgtccccgattttcagccagaaaaacaaggtggaccatgtgccgttctagcaccacgacgaaagattttgtgtctttttacagacgagcttcaatccgaaagagcgcctgcaaacacacaccaaaaatcttcagtcccccggagcctgactaaagctgtaggagtgaaccataaacaagttcgcaatgatggtcgctgaaccgacgctctttcctttcttcttgagttttcgtgagatctcttgtgtgtttgaaaagatctccggcgacaagacagcttcttgcttttttcccttcgttccgaactcggcgaccggaaacgagtgctttgcgcttcgattatattcggacctacgccggcgcaagctgtgactacctatttaaaacagagacttcacgatacacgattgtcaaatggagagtcacggacgactgggaagaaaaacgcctgcgagatggcgcaaggcgagtacacatgtttttttgtaagtacgccttttttctgaataagaaaaggaattttgtcggaataaaagttttttcggagaaaacgtgtttcctcggatacgaacttttttttagagtttaatttttttccataataaggctatttttcggaacaaagacttttttcagaaaaaaccttttgtttaagacacacgtttttgccgtgatgaaagaatttttagggattaatggactttttcaggataaaagatgctttttggaataaaaaggcttttaggaatgaacgtttttttcagattaaaaagcttttctctcggaattttcataccaggcacagagacagctgtacacccgtgggcctcccctgcctccgtccttgaaggtgaagatcggcaagaggggaagactggaggaaaaaatgctgaagcaacgtgagagaaagaaaactgagggacggaaagaagacctcaaaagaagaagagagagaagaagacaagggaagggtgaccagcgagagcagagagagaaagaaagagacaaaatggagacatcccggagcgaaggactgctcgaaaaaccgcccttgtcacttttcggtcgcgatgaaaccgtttggaaagcttctgtggctcgcgctccctgagtcttcttttctctcttgagtcttttcttttcaattcttttccttggttttcctgagatcttctccttttttttcatccccttttctcgagctgggcgcgccgcttggatctgttgagtccattttgcactcgtcaaatgagcacagcgtgcacatgctgttcttgtgcgattttctcccttttctctttaccgtttctccctttttttcttttctcccttctctgctctctggctttctctctgcttgcgcctctctgcaaacgcaccgaacagcatcttgccaggtttttcttgagtctcgggagccggccttcttttctccagcagcgacgaggaaggagagctgctgctagagaactgcggaccgcactcacattcgactttctccgcttttccctgctcgccgcacccctcctcgtctcctcttctgccttctttccttccttggctcccagaagaccgaggggagaagcaggcgcccgtgggctgcgcgcggagatgccccagacgca

SEQ ID NO: 2465 - DNA, 1931 bp, Toxoplasma gondii
tatgtatatttatttggatgtatatgtgaagcgcgtgagaacgcagagacgtttgatgccggggagatgactggaggaagaggttcaagagtcgagttggtcgtaccgtatcccagtatttgcctccgacgcagtgcgtggacgtcgcctggccagcagatgcgaggcgtcgagggtggagtctggaatgcggagagaaaggggaagcgccaatgaggaaagggcgtttgactgcgccaggggcgagttttgtgttttcgtgtgaatgctctgaatcgagaaaaggccagaggcagaagtgctcccggcacagagagagaaacgcgacggccgagaccaccacgaaaatccccgtgagacggaaaaacagcggtttccgaggagaaagcgcgttcacccaaaacgtccaatttccttcgcctgcttggttcccgagcgtcccgcgatcgccttccgaaggccgagggaggacaggcgcgttcgccgtgctgcctcgacttcgaggctgactcagtggctttgtctgcgtctcccgggtgcaagctccttggtctttggctggactctgcccagcctcctcgttttgtgtccatgacggaagagacactgtgcctcgaggaagaaaagaccgagaagaggagaggcaggaaactcccctcgcctcggcgctgtgtctagacatctcagcgaccccgaggtaggagaaggaggaacacagcgagaaagagagacctagccatgtgtttgagaactgacgaagacacagttgcgtttgccgcctcctttgtctctctcctcactctctactaccaggtaccttgctcgcgccttgtgctcgtttgccgccttcctttccccctgagagttccccggaactcccgtcattcctcttttttgatcatgtgttcttgcgagccatacaacctaaattcttttgctctggtagactggcagaggcatcctctgtttctcgcgaccactctctttcctcccttcctagcgaaaatcctctctgtcgccgtcggcataagaaacttgcttcctgtcttgctctgggatgggtgcctctggagtaagcccttgttgaagcgaagcaactgaagaaaacggaaaggtcgagacagcaggagaaatgccaagagaagccaagcgcgattgtggagggaagctcgacgcgaagaggggagggaaccgcatggatcggtacgtgcacggagtacctggaatttagaagaacgagaagtcgacgggaaaaaaggtagacgagaacgcaagtgacttagcggaagaaaacggtgcgaacaagccagaccgcgaggcaatgtatcgctgggaattctccgctacgagaaagcaaagtcgatggtggtgtacgcgaaggaattctgctcaagtccgaatccgcctaactcctgtgaactactagtttccaacttcaaccagagatctatttaaacacaggaaaagccgactaactcgccagggacacacttcagcgatcgacggtgtacccccctggcgatagccagcgtttcgagcgtgactcctggcatgttttttctcgcgttgtggtcaggtccgaaaattcctgtgttacatcatgaaactggtctctctgggaagagtcagtctccggtggacagagattcacactttttgttaaattttgactgaagaggctatccttttgccgaccctcctcgccccttgggtgtgtcgcacgagacaccggaggaggctctctgctaagggcgcctgcaagccagacaaaggaacgacactcttgtggcaggtttccaaagctctgtggttagaaggcaatgcgtgcacacagaattgcgatgcgagctctcttgacttttgaccgtaaaggtctgcgaaaaagaatcaagagggaaaaggggcacaaaacgtagccagccgcgacggca

SEQ ID NO: 2466 - DNA, 2028 bp, Toxoplasma gondii
aggatgcagagagaaccatctaagccgaagaagagagacgaagaaaagaagacaggcagaaaggcgcacaccgaaacaaagagacattgttcattcatgcggcaattgtggtgtgtgaatcgcggatcgccctgctttttcctactgagtcacggcaggcgatacaagtcaaagaaccgctgcagatagggaggcgaaggggctctgtacagacagtgaaggaatgcgaaagaagcgagaagaacaggaggtgggaaacttcttgcggagacgcgctatccatctcttacactggggaggcatccgtttctcgatttctcgaactctcgagactcttccagagaaagtttccttggccgcgacaaatcgacgtctggaactctctcttgctcacgctcaatcttgaacgaaagagcgagaaacaaacggcagaccggggaaagagcgtagaggggtcacgcatctgcgggcgctcggtttttttggtgtatgtacaggtgcgacgctcgacacgaagggacaaacagaaagaaggtggactttgaaaaagcgaggagagagagcgaatgggagacagtgggggagatgacgctgaacgtggaggagagagagagacagaaatggagaagaagcgacatgcaaacgaggaacgcgcggccgaggacgcttgagaagcgggcgcaccgcgaggaaccttttacttcgcgggacagaggcgctttgaaaagccttgagaggggaagagaggcaagatgtgcggaaggacgcatgcaagccattacagagagaaacggcagaggctgaaacggaacgagacggtgagatccacatggacgactgcacagtagcgaagaaatgaacagcgagtgggaaaacgagagaaaaaaacgcgagaaagacgacagcgagatgccggtgaggcgtgtagcgacgtgaacgccctagctgacgaacggtctcatgttgggcttggagagacttctgccatagaggaactgatctgctttttgaggcgcgtcgatcggcaacaacagcgggggctagccgggtgaggaggacgctgcgagcgaaattctcgcgttcaggagggcgttttggcccagtttgaaattccctacatttctgaatgtctttgagaagaaggggacgcatccacgacttcggggaaattcctcagacctcgtaaaacttcagaagtttcccacggaccatgtcgcgacggcgcacgtcttgcagctgtcaagacaccccctatataaaacaagagccgccctcgagcaggttccctcagtcatctctccgcgagatggcaaggctcaaagaggtgcggcgaaacaagacagcttggctatttccacgagaaaattgacgcttcaacacggtctcaaaaatctgccttccttttcagacactcgtgagctgccagctgtccatacacctcgacacgcatgcctgcgggcaccgatcgtgacaccgcacgagtcggaaatcctcgagcagtgcaatccgctgctcaagcaaagaaagagaaacgatggtaggggagcgaaatgccttgaagcgagaaattcacttgcaagtgcaaagcgtcttccttgagtctggggcaagaacatctcttcagggaactgtgtgagtttttccccgttagaaaggagatcgagacgacgccacagcgagagggagttcagtgtctcttgggctgcttcgaactccctggggaacacctgggcagcgcgcgtttcactgcatgcgctgcggagtcgagagtcgaaatccaggtatgtccttcctttttttcacatgctgcgcgtcaatctaggctttgagtttttagaaaaaagacgaaaagagaaaacggaacgatttcgcgccttctcgcgttctcctcgcgagggctctccctgcagagagttgtgtgaatcactccctctcgcaggaggggaaatccctgcaaaggaagaagcaaattcgcgcgttttcacagcattttctcccaattgtttcgcacttcttcgaattcaaaaa

SEQ ID NO: 2467 - DNA, 2262 bp, Toxoplasma gondii
aaatgtgccaaatgtgtttacctacacgtgaagggaagaaccagaggtaaattcccggcgttccctcgaagagcgtctgagcaagggtcctggcggttcacctctacttgcgcaaacgaaagagatcatttacctgcctgagttgtaacaactgagggacccagcttgtaaccggatttccgtgggatgagtgggcctgcctcgtcaccgtctcttcccgagttctgctccctgaggaacattgggcacagcgacagccgaccacatgaaccccagcgccacataaatgattatcgccacggttaccttgacttgaatagctcaccaaaaaaattaagggttgcctatttgggattagccaacgggagttcatagcacgctatgactgtacttgcgaatcataattccccacgccaacagcagcagaacccatgcgacaacggttgcaaccaatggaggtgggacaatggcacctaagaaaaattcagcaagtcaagaaaatctccatagttgttgctgaagagagtgcttcaaagaaaagggcgatttcaccacaaaccaagagcggaacggaacatcggctgactagtccactgtgtttgacgcaagttcgagccggggtcctgctttggatcggtgaacttccttcaacgagccacgtgacggagttttacagttcccgaaacccgaaaaaggccgatgaaattcagcaatagaggcacggttatcgcgtacatcaccgctgtagattgcctggaaggaaacagcggaaccgggcagctaggctgccatctttttccttgtgtaaactggtgacgacggctatgcgaaggagtcacattttgaactcacgcctcgattgaagtcttcattgttgagaagcatctcggcgtttcaccgcagacaatatgaagtgcggttcggcccgactcaaaactccggtgcaaaaggcgacaagagcacagcagctcgtgatgattgctgaccgcgttcagatgaggagaagaaacatgatacacagagttttctaatgaagagctggactgtcaaatgcccagcgcgaaatggattgcagtttttacgagggattgaaaaaaacgggtcgtgtattcgagtcctagctgtcttgccagcaaccgcatggtagctagcaaagagttatcataatttcacgtgcccatatatgtagaaattcatgaacgagcaggtctgcgattaaaagcgaaagcggggaataccttggtcagttacttgctgtttgaccatgaattaccacggcattactgtgcggcggttccgcctcctcacccagacaccggatctgtcctactgccgcatatactcaatccgctggagagctgaagggtaggcgaccttgcgcggtctatctcctaactttatgcgaaagaatcgttgcggaaagcactaaagcaaattttgtggaagcggaagaaatagtcttggcatcaggagaggacgggtgcccggtttaagcgtcaccggatccggcgttagcgagaagacaaaccctgttacgccacacttgcatgcaagacgactgcaagctgggtaagaagatttgggaagacaaccaaggaagccttcacgcaatgcagttggggtgctgacgcagtggaatcgtgattccagcagccccctccctgcaaactccctgtcacaagtcaagtcatggcattcggggagaaaacggtaagccgtctacgagagataggtgtcgaaccgaaaacctgaatcgccagcgtgtcctctggttattgctactaaatttgcagaccactgggcatcggccttccctccagcgcgggcaccggcgtttacgctgtattttgcggaacgcattataagccgtgcattaatcggggactcagactcggtcgtcaccactccccggtaatgctggacgcagcctctgacacagtccggccgggcacagagggtgtgcgtcttcgacaaaaccctcccccacaaggcaacacggcacacaaaaactggcgcacatcggcatgtgcctgcgttgggacgcctgtcgcaaacgtcgaattaattgcataccactgtattgaaggccgaatgttgttgtatacagtcttagacaactttgtatccgctcgcttttctctttggctcctaggagcgcttcggccagaccgttgtgggtccccccggtactgacttctgttgtttttctgcggcgctgcagaagccccttgtttgttaaactgttttttttgtaactcaaaa

SEQ ID NO: 2468 - DNA, 545 bp, Toxoplasma gondii
ggtacatacaggcggaggtcgtttttagagaccagaaatacgagggagagaaaagcagaccaccgacccagggggaaagagagagatggcgacaggaagagagaaaagcacaacccaaagagaaaatgagggagacgtagaagcaggaagacgaaacgtaacgcctccagggaaggggagaacttcgaagaactggcaaggacgctgaagctctgtcaacagaagcaacagaaagagagaacagagcagacagagcctcccgccagctacagaagagacacagtttggaaggaaagaaagagagaactcggcgagaattgagaaggcagcttctaccacactcgaagttggagcattgaggtgaggagaaaaaaaaaagcgatctgtcagagacaccaggaagaagagagagaagaactgcacccgaggttttcctccgagaattctcagagttcggaaagaaaaggcagcgctcaccattttggaggcaggataaggagaggagaaagcagtccgaggagaagagcaactgaggcgcgaaccga

SEQ ID NO: 2469 - DNA, 3264 bp, Toxoplasma gondii
attgtggaggcatgagcggcacgagagcgcagaacagtctagaaagcagtgcaaaccatgagcatgaattgcgacggtggggtattggctatggaaaggacgaagtctcctcgatccttttcgcgtcctgaatacactggatatccgtgtctttaccgctggatagagccgtgggggactgccttcacaggcaatttgctgtagatgcttccatagtcgtggacagacaattttgaaagtgtttttctggccttttcatcaaattcgaaacccgttttcctacctcctgttacactaaagtttccagaaaattgttacattcacagaaaccttggaggccacagtgtcgtgcaccttccccggggccaacacgactgtttgctccagttggatttttgttatggtgctctttgatcaacaacggcactttgctgttgcagtacgcagtgctgttcgccggaggtgatgctggtttttaccgtactttgttccccttcatcgttgtgccatgaatgggcgttatacccgtacgattaccactaggagtgacggcattgatgcagtaagggaagttttccagtactttgtttccccttcagcaactgtcgacatgccatctttcgaactgactgactgtaactccggatgttccaggacaggcagcagtcttccagtgggtcagtttccgaagtgaaagcgcgggaaatcctcacgcaagaagaaattgcaaaagtaaccaaaagaggtggcacgtcgcgtggaagggtcgccacagtttagtggcttgtggaagcaaacactgtcgtcgtgtacgctgattcccgttgttatacaactgcatggtccgaacggttccacttctccaatcactgccatccttactgtgctctgccctctcggctgcacgatgcgtacgagggcgagatacattgttgacatgcagatcgacggtgaacaataatttgccgcgctgaaaaactgtcaagcctgcgacgctgggcctcatgatttgttagaagctacctcgtcagaatgtcagaaatttacacgagggaaaaccggaaggtttgtctatccggcttcggaaggacacggtttgcttttggagacaaaacagtggtatgtgtcatggtcatgaatgcctcggttagattcgcagctatcacgatgcttccccaacctttgcaggcattttcgactggaccatttccctctgacagctcgaatgaataggcggttacacaaacatgtggatcgagagatggtagtctacgacagacacgcacgctcttgtcctctactttttcaacagccctcccctgtaagcagagccactcccaattgctctcgagcatcttacttgagtggattctgtttattttattggaaaacgctcagcgagtaaaacgatatcgagattcaactggtttctatgtccgggcggcccatcgaggtagtttcgccaatggaacaaccgttccgattgtttaggaagaagaattagtcttttaaaacaaaaaaaacagagccagagactcgattttcattgctaagctgaattttactaaccaacctggtaggcttaacaccccgacagtcttgtgccgtgatacatgatgcagcctgggcttggcgatagtagcgcaggctgttccgtatccatcagccatgagtgcggattctccgaatccccattactacggtacggcaccatcagataaacgtctcgtaccatatatattacttctgtgatcccagacatttcaataagtcaagagttagccgggaaggtggcgtctaacaaatctaagcgcgcatcaaaatggatacacacagaagcaaccatgactattcgttggacacccggtaatcaaagcattctacactactccagaatacagaagtttctgtagtttttctaatcgtttgctggcgctcctagatgtgactactctctcccaccattatctcgacacgaggcagatctcttcggggcacatcgtttccgcatctctggagacaaaccttgcggtctggtttcgccgtcggttgaagggaccaaaggcttcgactgcaattcaagatacaaacaactgcgaccaaaagcccgagggttcgacacatcttcacaattggcttccatgaaacagtcctttcttcgcgatgcctgcacgatgcccttttatccgggcatgctatgtcacctgtcagtccacccggaagaaggttcccccgcgggagcatgagtgcgccagagtcacttctccagcagagaagaacgagttgttcttccccataacgcgtaacctcttgttattcccggaggatttccagagtcaatactgaaagagaaaaacaggaaggccgctcccagtgcagataactgtggggtcgataagcagcgactctggtgaatgtggtgggaggggacgaatttcgagggtgcggggctcaaaggggggaacaacttctgcgttttcgttgcatgtttccgaaactccttcacgctttacgagcgctgcacatctcagaaatcctcagaaagccttcttttcgtttcgcctgggcgccgggagacgtcggcgaggactcgcgagaatcccgtcgtgcatgtcgcgaggcgggggacaggacagcgtgtgttttgatcgcatctgaatgccgacgctgtgctgtccaacggatgggtttcttccgagaaaaacgcagcagttgacgtcatttcttttcagcgcgcctgtatttgcagtgggcctctttcgatatattctttagtctgtcaagagtcctccacagtctgcgtttccctgtctcttcgcggggctgcggagacactgcggagacccacctgagacaagccgtcggttctttgttttgtgtgtgattttcctccaaaacgtgttggtaaacgcgcgcaaacgcgcctcgcctgccgccatgcgcctgcacggagaatctcggtggcgctcatcctggcagttgtgggcggtcaggatctagagaagaaaccgttcgcagtctcaccctgcttctcttggctcacgaaaaagttcatcgagatcctggggctcgcctcgactcccggggccagcgaatcgactgttctttttgcggacgcgttctttctcttcccacttcgcgcgactctcttcgggtctgtcctgtcctgaagcagccgcaagccgaaactgtttgtcactcttcttcctggacgagacgactgtctttttcctttgtcacttgactgagcttttgaaaacgaga

SEQ ID NO: 2470 - DNA, 4328 bp, Toxoplasma gondii
aattcacttgagttttcatgacaggtacacacaggcctgggctctgctgttctttttgtcccatgcaggcgctgccgctggcactgtcgcggctcgaggtccctacgctggctgcagcggtgttggacagtctgctcagtgaccaggcgccagcagctgtcagtcagttgtcgattcacgaactgtcaaaccttgcttatgcaatcgcatgcgtctccaccaattcccaagttactgtagacacgcatccgtcctctgcggactcaggctcttgtcatgagcagaggccggagcgtttcgaggttggttcatcggaaaaggagtgtcagtctgggatgaagatgcaactgcatccggagcatagaagcgtacgcgagcaatataatgcatctgaagttgatccgggagaaaacagcgccacgggtggaggagttggagacccttttctcggaaacaagagggagaataatacttcatttaaggttcttgaatcccggtctgtatgcacacccgaggaattgaggcgtcggtcgactctgttaacgaccatcttacgcactctgtctcgcagttccctgaggcgccatccacttaactcgccgttcgaacgcgcgtggagacagctgaaaattatcgacctgtatcttcagttcaatgtaggacctctgcgtgtagatgatgaggaagcgcttcagtttctgtctcttgctcggacgaagaagctattgaacctggttcatgtgtcccaggtacagaagcgtgttgggcgcttgcttttcgatgaaggactgatgtctgaaatagacgttgagtacccactggggccttacgtcttagactttgcaataccgtctcgcaagcttgttgtagaagttgatggggaagcccatttcttctttggtacaacggtgccaactgctcagacgcgaatgaagcgcgaactgcttgccgctatggggtggcgcgtggtcgtcgttccgcaggaactttggagaaataaaaggaaagggaaaattaaagaattcgtggcgagaaaggtgcgagagggactcgagatcgacaacagtgacagatagaagccatgggagaaagacggtttgaagcagaaggaaaacgcggggtgtcatgcatttccagaagaccacaatgaagttttaggggaaacaaagtttcttgcacatgtacattttgtattgtctggtggagcgggtaggctcagtcggggaagggagaataaaacagattgtgtttccactctaaggtgcttgtattctttttcctggagagacccgtacagttgtgaaaactcgacaaaccaccgtcccttgcgcttcaccggcaccgatacatttatcaggccctgcagagctgcttttctaagttgttcatggaagctcttcaaagaaaaagatagaccatatgacagtttgctgcagcaagttccagccacagaattttgctttaccgtgagtagaagtgcatcaaacagaactgctgaatgagactcgcagtacatccttggtcatgtcaattagcaggttggacttcaatcaggagcaagcgaccttgttaaacgctggaattcagtaaggtcaatcctttgaagaccgattttaggtgcagtcctcgttcctccttcccatttgaggacgttctggctttatacgcctggggactctttaatgaatatcagttcgggtttcgtgactcgccagaatcccgccagaagtctggatgtacagatagatcgaggcattcaggtggtggacaagtattttcgaaggttttcctcggtgaacgcttcaacaacaaaccgactatcgaaggcagaacatcggacctgctgcggagcaacatgcgtcgttgcaacaggggggaaagccataagtaaagcaactcctgccgtaaactccaaaggaaacacacaccatttgagcgattcatttatcccatctacgagaatcctgtagaacatttcggatggtctcgtactacaagcaccgtagctcagtgggagagtggggggctcataacccccaggtccatggatcgaaaccatgcggtgctactcttcttttccatccgcttttgagcattattcgctttcagtggaccgttcatcaaatcggattgattgacaatatttgcggattttacatatctgtgtcagtttcgtttttaccacctttttggcgctttggggtttatcacaaagtcacagtcactagtgcaccctcctggcgggtacattcgtagtcggtgctgcacggcttttatggcatgccactgtgtgaaaagttgcctatcaagatgaattcataattcttcaggtataaagtccaattcctcacgaaggcaattcatcctcatttcctggaaccctgccttcgcccatggcgtaaggtcgccagccgcagcccctcttcaattttcagtgcttactgagatgctgtgacacatggcagttccctgttattagtttcccgtgtaagccggacgacagcacaacacaccttctaatctatgacagtggacaactcctgaggctgggaatttctggcaggcagggtctagtacagcgtgcaatcagcgtgcaatggtactccgtcctgaggttgcttcagacaccagaagtagcagcccttattgcgtcgctcatgaactcccacgatccaatcacattccccttaggttttacattaccaaaacaaaatagagtgctgctgttcgctggcaagcaaaaatgaggccttgtttctccaaccactctcattgacaccggtgccggttcctgtaggcacctagccctcttcagcagttgtccggttggaatttctgggataaaacgcacagatttgtcacgtggacagtaaacattctctcaaatgagaaaagaacgcattagaagagaaaaagggactggggaatttttttatcccatacggcgttattgccactggttatatgaaagagttgaccatgcaacgggcctatggcgcaatggtagcgcgtctgactccagatcagaaggctgggcgttcgagtcgctctgggctcaactgctcttttgggggaaagaaagcctttcttaggactttccctacttgttctccatgctcttcgtttttcttagtatttgtttcgctacgggttagactgaaagtaaggcgtcaggctttctggttttgtcttctatcgcgacgtggaattgacgcttacatctacgggcgccacactctgacgtggtaacaccacttgacagactcggactttctctcgctgtaatacaacaggtaagagtgatcaatatattgcttctagagtgtagccgatgcggaataacattaatattttagaatattagaattcaacacttgcagccaaacctgtgaacccccacccggccacagaactgcgatctcttcgagtgtaggcccgagaccagagcagtgtgcaaacgggaaataggcgttgttcgagcgcattcgtggacaactatacttaagactctatgaatcttgtgttctcacatcacagccatgcgcggtgtgcgatcgggcatcgttctcttcgttttctgccggcgatttgaaaccctcgaagcacacgcatgcatgtcccggtcggtcaacacaacaggcaatcgggcaggacgagcgctttttcgttgttccgcttttctgtagtgctacgcagaccgtgtaaccgtcggtttctcctttcgtttgtgtcatttcaagagacgcctgaggttcggagcaggttggcagtagcgtttttcgcggcttctgcccccgtgtccagagatccagccaagagagacgcagtaaatatcgactaaagacattctctctgcttcccgtttcgtggccgaaacacagttgtcgcctgaaaggatcgaacttcagtcaaaaggacagaaacacgttcgtgaggtggatggggaagacgaaacccgacgcattaagtctttcgccgccgcgggtcaatgccctcaaaagggggctttgtctctctcaagcatcgtgacgaacgtgatctagacacaaagggcgacacgccgttttttcctgtgtgtgctctctggatatctcccggtgaacgccgtgtctcttttcacgggtttctcgcggctgtgttctttcctttaaaaaacatattgccggccctcttcacgccggcattttaaactctctgttctcccaggcggcaccgaaacttttttcgtgtctgcttaagagtctcttggttttggcgttgaatatttttttctcaggcgttgtcctttggctcctccgtttcaccagagtcactttccgtttgcagca

SEQ ID NO: 2471 - DNA, 3062 bp, Toxoplasma gondii
ctgtcgcggaaggtagaattttccgtatccctcgctatgaatgatttctctgctaccgcctcgtgccagcagagagagaaacaccgcatcctcttacccaggactccgcctccagcccccatgacggctgcccgcgccagacagccctccgtgaagaaccgttcgactttgttttgtagcagaatctgttgctgtatctgtttctgttcgtcagtcagagtcgtcgcgtcgggcgtcaagttcaaggttcggtatctgtcgcccaagaaaatgtccatgggcttctccaccggacgctcggagggagaaaagggaaccgcaaagtcagagatagaagaatgggtcgacgggttttgctgaaccgctgcgggcgacggagcgggtgaagtgggggacaaagccaggggggaggggggctctcctctggaagactgaaacatcttgtgaaggatcgaacaaatggagttaaagtgtgccagcgagaacggatcagaaaggaaaacaacgcggaaacgcagccgagcaagaaccgcgaggatctgcccgtaggtgaggacggaagagctgtgcagctacagcggtagatgtaggggcagagtcacaggcagggcgaatgaggtcttcgtgggtctttcaggtgatgtggaggtgtcggagtgtgggtggcctggtgtctggaacccgcttcgcatatagaatgcgtcgcaggaaaaggttcagcacacgggacaacgaggggaagaagccagtggtaatccagacgaagaaaactaggaggtacagagggagaagggagacaatcgaagatagcggagtcagacaatcggacaaacaatcagacagccgcggaaacgggaaatgaagtcacagattcctgaatgtcctgtcggagaacatgggggagagaaactggtttttctgtgtctttggctcttagcttcgtggaattgcggtagggcgcagagagcgtctcgggcggagacacggggaaaaaaaggtgctgaataatcacgaaaattgtcaacagcttcccctcgctaacaatccacaggaaaatagctgtgttgggtttgacagacctcaggataatgcagattctgttgttaagtgtactcaaagggtaagctacaccttttcacacgcggcgaagttgagtaaagaagcgttctctactgtgaaaagtacctgtagctgtcgatggcagaaggctttgccagcgcgcaaggcatacaccgcgaaaaaaacgcgaaatgcctacgctgcgtaaatctacaaaaaataattgtcttctcgcaaattgtcctctaaaaggtgtaggtactttctggtgaagaatccggtagttctttgtcccgcacacaagacgtgtcgagaattgcgtgtccctgccagtcccgttccgtcaatggtgtccctagggtgtggcctgtggcaggtaagcgtcgttttccgactgcttcctgatacacagactaatccacgaacctcaagaaacatcttccagtgaagaacacccttgtccaggcatcctcctctgttgtcttgtatgtgcccgcggtcaaatcgagaaaggcagtcctgtcttccggaatgagcttttgaagagggtggttacgctgttgggcgcccggtatgcagaaacagcagcggtggcactcagcgaaagagcgcgtctgtgtatccagatagttgacgctcgcaactgcatgagttcttctaaattatagattgtgcgacactgtctatctatagtaactggacaagcgtgtttattatccctgtgtgcttcgtatgcctccgtggaccgtagtcaggcgcgtgtgtcaccatgatccacgattcctctcctgcgcagacaacggaagcgactgagaaactagaggagttttcgcgtgcacatggccgaggggagtgtatgaggaatccagggcttgcacgcagtgagaggagacttcgtgcagcacgttgagaaggaattgctgttacccaagtgatcccctcgctagctagtttgtggcggaagggtcgtgctgagtaccgaagctgcgcagacctgcctagctgtcgatgcttgcctgtttgtccgtgcgcgcgggtttgccctggaccatggataaggtgacggaaaattcagggtttctacaaggtcttgtgtttgctgagaccttttttcgccttactctcagcagacgacaatcggtaacccaaaacacttgcgccaccttatatactttccgcgatagacactggcgtgcactgatcgcgctgccagtccaccgaaccacgcgatgcaacggtcgctgccgtcctggcacctttttctctgtttccattgcagagttttgtcgatactatgtgtctgtactgcgtgtactgggaatatttgtcccagtattttgttggaaaagccacggtcgtcttggtattcctttgtcgcggcattttcgtgagataattttcgccgttgtcgtaacgcctctgtcacgcctacaaccgacagtcttgtcaaaactgaagccaactagcggagcgccggtgcgtgtcggaattcaccagtttggagacttgttgcttcgcaccctgttctttcaggcatctggcttcttccttccgaaatcatctagcttcctttgctcgtccagaggtcccggattctggtctcctcagtcgtaacgctacaccggctacgcgagtgtgtcgctgtcacaagtcttgtgtaggttcttgatgcctccttttgccctcggggattgctggtcaagaacggatatctccagtttttccagttttgggacaatggtggagtgtgcgtgcaagggacggaacttagcgtgaaacttatttctgccaatgctcaccgatcaaccttcctttttgtctcgataccctccactgttgcttgctagctggcgcgttgacgggagcttctaccccgagaggtgctccttctgacggggtgtctgtagatcggttgttttaccttgtggacgccgatcctcgtcctcaagtctcgggggaggaagaccacaactgcatctcgttcaacggtttgcccaccaaga

SEQ ID NO: 2472 - DNA, 1747 bp, Toxoplasma gondii
tctctgaacaagacagaccgctgaaagagaacatagatggttccaccgtctcagcgtcacggttcgcttctcctctctttccttcttgtccagacagtggctccatcttctcttgctcctcgctacttagtgcatccgcagttccagcctctccctcgttcccgtcgccggcttcctcggtcttttcttcgtttgttgcttctcctctcgctttttgttcgcctgcattccagtgccgttccaaatgcggcgcgcgagtcccagcagcttcagcagaagaacctcctgctctctcttcaagaggagccaggtcacctgaggaggccaggaccttcggcagaagaagcagcttgcggaggatcgcgagcaggcgctggcggtcctcaagagacagctcttcttcctcgtctcctgcctctctctcttctgctgtggtgtctgcaggatctaccgggtcgccgcctgcctcaggattttctttttcgtctgctgtctcttcgtttccctccgaccggcgaccgtcatctgcgaaagtcaaagcttgcctgtctagagaagaaatgtctgcttcgttcgagcccccaggtcgccgagtaaactctcgcacaacaggagcctcctcttcgcaggtttggtcgcgagatgttgtggatgacagtccagtggcggccttcatgttgttgagagagcaacggagaaacggacacagcaagagcgctttgatttgtggtttctccaagcagctcggggaaaaagccgctgagtttgtttcaggtctcttcctgcttcctcagagtccttttcagcgaacgctttggaacgaacaccgcttcagctgctgtcgcgcgtccagggcgcctctgacgccagcatttgcgcgacaagagcgttgctttgccggaggaaacaatttaaaagaagagagcaggaaaacaggcgaagttctcgaggaaaaacgaactttgtcccggccccgtgagaagacaccgagaaaagtctcgcgcaccacagagggatccctttctccctttcgcatctaagacgacgatgccaagactcgagaaaaacagtcgacaacaacaagcaacaggaatccgagaaagtggagagacggaggagaacaggaaggactctcaactcactcgacgagacgagacacggacgctgtgtgctatatccgaggagagagtgctcacgaaaagaagaccttgtgtgctgcgtcgaaagacagtctatctttggtcgagaagaagagaaaaaatgactgttttttcgagtctcttgagttccttgtcttcgctgctttctgatcctcctattgtttttcttctacctcgtttccctagaagatgtaaccgcggcgctgtgcgacaaagcgaacgcttttcgcatggactttctcttctgcgtcggcttcgttgtgtgtaccactctgacttcgttctctctttttctcccgagttcttctcgatctctgcgtccttcagttttcttcttccttccaaagatttcctctcccaactccacgacgtctgttctcctccgtctccccaggggtattctcttccttagttcctcgtctctcctcgctctgttcttctctctttgcctctcctctgattctctcgtctgattctctcctctgactctctcctctccctccctcttctctcggcttccgtctgtgctgccctcgttctgtcccccttttctctcatctgcgcgtctgcatttttttctctgaaga

SEQ ID NO: 2473 - DNA, 600 bp, Toxoplasma gondii
catcaggtggagtgctggaaaggagacgtctacgaatttcgagaaggcggagaacccgatttttcacacagcgttttcgtctgtcgcgtgtacacggtaggctactaagtacttcctctgctcgatgtacttttcggtgggtgtcaccggcagtcacagccatctaactgcagaactcgaacagtcgtgagtgaatatgtacggcaatgttattcagagtgcgacggttctgcaagaaatcgaaaaatatctgtgttcttttcaggacacagccactaccaaggaggcgtacaacgggtgcttgctagtacatgtttgtgctcgctcatccttgagccaaagaacgagtttgtcggatcttcggcaggcagcagctcgtatgacgaagtgcctgctcaaagttcgcgaaactcttcgaccgtgcgtgaagctgaaaaggcgccactctctaagcataggcgaatcaagtcttgccaagtcacctggagtcttccccattccgggagacggccgtagaatgtaaagcgactcaagtatgttaggagcacccaggggtcttcggatgccttgagctcgcgcgtttacttccgtgccttggca

SEQ ID NO: 2474 - DNA, 4902 bp, Toxoplasma gondii
ggttgccgcctgaggtatttgcttcgctggcgcaaagtattgctagcgcctattgatctagctatatacatgcacactaatacgcctgaactgtactgactggagttgtgaaggggtagtcgttggcttggtcaactatcgatccagaaatttgctaaaccggagaatttttggcaaagtgggagaaaattcacaccctgtaaaagacaaggtgtgcccggaatagactcatagatatcctgagtgctggtacacaggaaggtatacaccagtgcataatgcaaatgcatgtccgttaaaggaagaaggagagattgctgttcttgcgtctttctcgacatacgcagtgggcgaaacaacccttaaacacagacagaagagtgaagcgcagacacagcgtgatgtccttgcctcccaagctgctacacggagtaacgcgacgcagcgcgaggattgactctccagagaggaaatctgctctcacagccatgtgccgacgccggaaatggtgcgacagaaaagcaatgtatatacaagcagattcccagtgtgacgtgggatgtgagcggaaataacccacagatgctaaagcggtggaactggcacgcatggggttattatggaacagtttttcttaaagcgcgcaggggctgcagcgactgcgggagtgagcaacgaagaaattggggagctggaacacgcacgatggtagacgaaaatggaacatgggggtgcctgacagtggggacagacgagaaaccccagagtcctcagaacgcgggtaacgggcgactcccgagagcgcttcacgccaaggaatgtgccacgaaaccatgtcactgcggagaggtgaatgcccctgcaagtgtgacggtgagtcgcctttctgtcttgactcttcggaacctctcctggactcgaaacgccgcactcacgtgacgcaagatcaccgaacacgcacgaaagacacttacaaccacatgacgcgaatacacatacacatcattgcaaacacgcaaacacgcaaacatcgacaaaaatggattcgcctagaaacatcaccacacacagaggacgcattcacaaaactggaggcgatggcgcggcagacaggccgacggacgacaacgtcacttctcagattcagcggagaggcggattgactgcaacgggcttgtcttttttcaacgggcgaaacacgaagcacgaggtacgggaaaagagtgaacgtgttgagaagcgagagccgacaggtcgaataagagtggcttctggatgttttgcgggaccaggcgctggcatggggcatctacgtgaatgttggcagcgaaaagatgtgtatgaaaaaagcggaaaagaagggacacagatggttccggcaattgctgcttgcttccacgtcctcaacacaataatatgccttttttttgtttttttgacctctctcaacttctccaaagctggccccagctcactaccaccacagagattccctgcatactgagagaaaatgctagacatcaccatcccctgctttttcgtccgctgcacaaaaacactacgctaccaggcttatatacgacacaacgtacggctgaatacacatacttctacacatttacacttttgtcttttacttaatattgcctttttcccatcgaaaccagcattctttttctttttggtcttgggaaactcgacggagaccagcgtaatagataccgtttttcgtttccccgcgcgaaaaccttcacacgcctagggtgtcgactagctctcaggtgtccattgcagaccggacgattgttccgtcgtttacacaccgacatagttctcttaccagcacaaaatcaatcagttccatactggaggagggcatgagcttcagaaaaacgtgacagctgttgcagttaactaaagtggctaccgcgaagcgttctgcggcctcgtgctcgaccagcatctcgttgactcgcttcctacgacgactacagatttccaagcggtagatgaagtctctaattacagtctttttatgttcgcgagtcatgttatgcgtgatgacaattacataatcagagttctcgtggaaggaaaacaagaaaatgtggtccgacgtaggccgccagatccttagcagacttggaccccccctatttcttagcgaacgcggacagcacctagcaacttctacgatactttttgtaagactcagaaaacttccactatgctcgtatgggagatcgctgtacacgagagatggtctgcgacaagcactgccacaccgcttcgtttttttgcctgctttgcaccttccactgtgcgcgaatgcggtattcgtcgggggaggttgacatctaaagacattcccaaattcatcgcttcccgctccattgagagacgggttttgtctatttcattactttgctcaccgcaaatggtctccagcgaagatatctgtttgatagcgcagtggttcctcacatgtgcacacgtcagcagaagtaccaaagacacgcgacggtcgctggaccgattctcatggacattgaaaatccgggagacgtggatcgtgcgggaagtggagctcggcactcgagaagaatgaagctggtcttcgatactaggttctttgcacgcttctccgagtgggaatacacgaacgtcacaccaagaataactctcgataccgcctgctcgtatttcaatttgcgttatacgtgctcttcgtgtcgtcaacttcattgttttgatatccttacaaaaaaggcacgagaaatgtatatattatcgacatgcacgtatgtgtgctcccagcagcgcaagttcccaacaggcctttcaaaggggtctttccgacccggggtacggtcgcacacgacgccaccctatgcaggcttcactaggctgattatgtgctgagagatttgcagtatgaactagtccgaaaaaaaattcatcattccatgcacccaaaaattcattggttgaccatattgtttttttgaacaactgacgacaaacctccacggcaatggaatgctgcagtcaccaaagaacttcaggacctacgccacggcgctcgttgagtgtttttcgattctaaacagtttcctttgtttccacaaaaagagaacattgcttctctctttacagaaaagccccaccataccactaaatcccccagtatcttatgtcgttcgaacagcatgagaaggtgggagatgcgtagagtccgtacgccagcaggacctaatatccccggtactccttaaaatgtgacacccaccctttctcttctgcataccatctggcgtgcgacaaacaaatcgcctccagtctcacgtcataatatccttcgagtctacatgtaactcttgttgcaaaggcttacctaccaggtgcgcgttgaccctcattccctgtatgaattattctgtgaagatgcatccgttggtttagacacacatacacaggcgcataagcatacatgaataggaatcgttcatgcgcatgtgcgccccttgcctcccttcagtctctcgttctctgtttgtgccgcggtcacgtgtctcgtctcttgctggacactgctttcgcggggcaggtaaacaggacaacgagaaacatgaaccacagactcatctgcttatgagaacggacactgcagaagcctccacaggaaagtctgcattcgatttgatggggactttcttcaaacgagaaaaatttccaagggaggccgctgcgagaccttctcgcgaagccgagacgtccaggttccttacagcttgaagaggcaagcgcgctttctggacgctgaaaagatgcaacacagcggccgaatcgttcagcatacttctctacacttgatacaccctcccagtagggagacaatcaaacaagaacaccgaactcgcgcgtttctctatgtcaccgcttgtccatctcaggaacctttgcggcgggcagccgacgcatgcatgcatgcaggggttttcggctctgccgatgtccaacaccttcatcccgtccctctgtgatgagatgttctttagggaatcaaaacagagagagaatgccgaaatggcgaagagacgaaggtcgttacgtaactcgtgctccacagtcctgctgtagaattgcattacatgggttgcctcccgtgtgccgctcctcttcttcggccgtgttccgctagaactgaaaagcagaagccaggcggttgtgagtctctcggttctcttttctgtttttcgatttacctggagtcattgtgtcaggaaaccaggtcaagttgcttcatgcgcactcgaggagcgcaacttgcggcagtctctgcgttgagcacttctttctcgcattgcacatcgacgttgtgcctgcgaattcggactttgaagctgcatgctgccacatggagacgattttttacgctcggcgtaccacgaggttctcttgtttaggcggggcaaccttctgacgcttttttttccggaggtgcgacgtctcagttgtttcagcagacgtttcgaatttccttgtcttccgatggcgaaaaagtttcggagaaccccttagcgactggatgtgcatctgtgcgcaaacgacttcttaaaacccaagtcaacacctgtgttcgtattcaagcatatacctacctgcgcatgtgtaggtactacccttgtggaagattcttcgtaacggtacatgcactgaaccactgctgagacggtcgacagacagttgtagggctctctcctgtgaaaaaagatgagtctctgcggtggcatgctcagtgtctgatacgcctggaacctgtttgctgctgccgcgtccagaggttccccctcgtctcgtttctccctttcggcacatcgctccctgccccgctcgtcacca

SEQ ID NO: 2475 - DNA, 3695 bp, Toxoplasma gondii
aaagcaggtctgcaagcctcgtttgtggagctacatcgtttccttactctttctcgacgcgttccatggcagcgccgtcgtctccagaatccggcaggtgccgatcgccagatgcaaacaactgcggcaggtgttctcctcctctccctgcgtgcgttccgtgtcgtccaaggacttgtgcacccgaggggagaaaaacagactccacgacagaaatccctcttggttccagcggaacaccggaccaggctacctgagagagaggtgcgagatacgggattcttccgtctgcacgagctccgataggggtcgtgccgatgagcgggaaccacaaggcagcggcggaaaacccgcatctctggaaaggaggttggccctcgggaaggcgacgccccagcgagagaacaggcggcaagaccgcagagcggcatgcgcgacttggagcagatgcatcttctctggctctaccgcggacaggggggataaaagaaaaggaaagagggctagctcttctcgtagaagtcgggaacacaaaggcctgcctgcatttccgcttgtaactagagaccaccctggaggcgcatgctacaggcgcaaagcagcgaagagtgaaatttcgagagtgagtgaaatgcgaagttttcgggcctgtgatcccgtcacatgagtcaggaggctgcaagcaaagcgcgaccagtggtgaagagaggaagaacaacgagagaagaaagacagagaagcttctcagccccatggtctttcactcgtgggacgactcccagacgccgtgcgatattgaggccagtcatcacgcgcaggatcaggaaagtcacgacagccaaaaggggggggcaaactgaccacggcaaggaatggaacgcgaggcataatccgtgaaccgccggacgcacagacgtgcagaacaaacacagagaatttactgcatccttattgatgcgtacaaggcatccactggcatgatagcaccgtcattcctcctgaaaaacgtgacaagaaaagagcattcaccccctatccagggagtggtgtcggctaggcaagggggacttcagtcgacggagttccctgcacatcgggggggtacaggattgcttgcacttgtcactctgcttatacccgtcagccaaaatggaacacagacaaagaaacaagccgatcagatttctccaaagtcaatctgcgttcctgtacggatgcgttcctgtacggatgcgttcctcgcatcgttccactggcgacaggctgtcacagaggaggcagacacaacgcggacgtggcgtctttatatttttgaagcgattctacaaacgagaggcagcagcaatgcccgaacaattcggtgggaaatttagcgcgtgttccaagcataaaaaagcgtctcgcatgcgaagcaacttcgcgcttctttttttaccgacagcgaacgtccgaacacaccggttacgcacgccgcccgtagctccccataaagggagggcggcaaagaggcaagtggccaacacgtttgaagtgaaaacaagacccggcacgttcatgggttcagatgcacctcggtgacttggtacagcatacaaaagccccacccggcatttttaaaaagagacgtactaccaaaatcgaatgtgtctccctctgtcttgtgccatagacgctcaccgttttgctccactcccttatattatctaactcgaatcgctaggcatcgcgtgtcgttttgtctcgctagcttcttctttgacatcataaggtgggggctccgagcacctcccgtcacggcatcgcagcggttgtcacagaacgcatcaatctttcgccttttactaaagattgccgtgtgacatccgcatcaaatgcgaatcaagaatttttgacggcgtctcgacgccaacagttcctattctggactccatatttcaaatgtctgaggtcgattaagcagcgcctctacattttgggtttcatattaccttttattcctgttagaaacacagacctggagcagatatccaacatttacgattcactttcacaccactttcgaatataagttttaagcatagctaaatatctttccattggcaggccttgtaaccacgctactacccctttctccataacgtggactcgtcccttaaatactacaaagccatcttcggcgtctcgacagttgcttagcttcaaacagtctactaccttgcaatcgccctcttttggacctctgccgagaagtttacaactcagctgaccagctcctccgtcgccagagaagcgtctgtcaggaacgtcagccataattgagactctccctttacgagatgccacgtacaaatcataatcaaccggtaaaatgttggcaattaccccgattgagggccttatcgtgaggatgattgtcgttagccccggggggccccagaaattgccgccgaccctttcgggtcggcgaacgggaattggagtagttttcaactagcaatcatcgcgcatccgctaggcgtcacttgcagcgacattgcccctaccgcaaggatggtattttttcttccactgagcccccacgtgagcaggttgtctctggagcataagcgtgaaaagcatatgtcgttatgtctccctgccattgcgatgcgccatttacagatgatgtcctcgagtggactccagaagtattagcgtaatttttgcgggttttctttcccggcgtttggtatggtgttgctgaattgctgtgtctttctcaggggtgggaacgcagggatcatctttggtgtgtgtagcaaccctactattgtggagctctgtagttaccctgtagatgaagcgtagtgtgtgcaacaacgagcatgagcaccaagcagctatcctggccaaccttaccatcggtggatacggtcttcaatgatctggctgcgcgttaaattgattcttttccgttaccgccctaaaagaagttgacaacatagcttctatcgctcccggcgttccttgagcggaaactgtagtctagacctacgacgcacatggggtgcctctccggttaagcgttgaaacagacactgtctttccgccttcctctaatatcttcgtgcttagaaaacatccttttaacgagacatagcgaggcaagcctcgcgcccaacgccccgttgttagtgcggctgcgaacggcgatgtgcctttagctccatttccccggtcgtttttagacagttcgtctaccatttcgacgcgttgaagtggagaagaagaagcgctctgtgttcattaatttttgtgacctgcctgcggcggttttcggacgtattcgtcccgccttcaaaaactcatcacacgttttagtgcagtgccgaccaccacagactcgcagtttataaggttttccatcggggtctcgcggttgtctagttcgcatgtattaaagtggacgtaggtgcgtatactgttttatctccccgtgttgagccatgacagccttccgcaatgcccctctcgccgctgtgttgtcatcttcgccccattaagttaacacagccagtatcccgtatcacggctacgttttccaagggttttcttccccctgtgctgccagacggacccgaagagtgtcagtcacaccgaatgaccttgcctttcgacacgttagccctaaatcctgttctgtcattttttaaaaa

SEQ ID NO: 2476 - DNA, 871 bp, Toxoplasma gondii
caactgcacaacttggctggcacactccctcaaaacaaagacggtggacagtctccagatttgcacaagtggatggccgaaatcccacagctcaccgtgaacggcgaatcggaccgcagacttgactacggcgacgaattctgcagggcattgctgaatttgcgactggtgacaccgttctagaaagttcaccgttgcatcgaaggcgaagttgtcggtgccctgcagcagtcacgactggtacacgaactcaagtgagacatatgcacacgagcatgttaacgagtaaaaaccgtagggccgactatcacaaagtggagtatgcagaagagagacagagttttagaaaaccagcgtcgtcgctgtactcaacgccagtaccgagccgccgatgtctgctgcacccagtggagtgtgaagccggtgctgctgcagagcatggcctacctctcctttgcagtcccacaacagggccaagagatggcatacaccaagggaacattcttcgaacgaaaggctcgatatgctttttttaagctcgttgggagtcctcgccagagtggatgcccgagcttgcaagagttgatgaagtgtcagcaggccaccgcctgccaggctagatgcagaaagccgagtaatggctacgtggatgggctcgtccatttccagtggaaaggtgtacaagtaaaagcctaccgcacagacggctagccgaaaaactttggaaccgcagttagagggaatttcgtactgtggtgtaaggaaaaactctagaagtagcattgaaaacgtggcccgagggaggactgtaagatgttcatggtcaccactggatgcaataggtcattgtgaccgcaagatagcgtccgta

SEQ ID NO: 2477 - DNA, 3988 bp, Toxoplasma gondii
taagactcgcgtaccgcacggtcttcgactttgtcgtcgaagctttcttgacggcagtgggcggctgcgccgaggaagcagcacgagggcgcggcctgcgggggcgtgaagaggtcgaggaagagactggcggtgaggacttccgggtgtttccatagggtgtctcgcgagacaggcaacgagcctctggcgcaaggcacgagcagttttctcgcctccgcgtctgaacgcgtcgtcgctcccagcccactcaagaggctcgcatcgtccgcctcactgggtgtcactacagacggcggctgctcgcggctgaagctgagagccttcgcagcgattgggtcgtcttcctcgacagccaccggcagcgacttctcgcgacgaatctgctgaatcaactcggcctcgttctctgtctccgaacctcgccccttcctctcgcctttctctgcgccctcgcctcggtcgactcgctctcccctttcctcgtcttctcggagggagagccggccgtcgacggaggctggaggcgacgagtggagactccgggagaaagatccttggcgcacaagcgtcgagagagagacggcctcctcgcgtcgctccacgagtcctgcgccgttcactgactgcccaggtgtacgcgcaccgccggcaccggggatggcgtccacgcgctggctgatggtcgaccgcgaggccgcgagacgcgcggcgacttccacagggcgtttgaagcggtcggcgagcgacgcgtgctgcggacctgcggccgaatcggcttcctccgtcttctcctctggggctctcaagaccgtcaggcgccgtcggcggaggtcgccgactgtctcgacacctggcgaacctggcgcgtccacaggtcctgccttccctcgttcaccagtctcgccgtccgcagtcggtgcccccgaggaagaggagaaggaggtcgagcagcaactgtcgcgctgtgtcgcctttgcagccttcagagggagttgttttgcctcgccagttggcggcgtctcgctgtcgacaggcgcgtcgctcttctgcggggaggcggagagttcctggggctccgctcctctccccccgcgcaaagcctccgcctcatcgcgagtcggcttcgctgccttgctcttgcatgcacccatctcgcggaggaaggacgcgaagatgagggagaagagacaggaagaggggcagcaaagaggcgacgcacgaacaacagtcggcagaaagggagcttccaacgggcgcgaagaagcagaaaagagaagaaagagaagagagaaagagaggagagaaagataggagagaaagaggggagagaagcgcgggaagagtcggggaagaaggaaggattggcaaaagagactcctgaagaagagagagcggtcgactcggaagaagtctcgctgcctcagctcggcggccaggttccgcgccgacggaacagacacagggaggctgagagaagaaaggcgaaaggagtgaacactgcaaagtctcgagggcgcttcagccgaccggcgccacccccaaggcctcggcgagctgtgtcaggagccgagcaacgcgcggagctcttggcgcccctgcctggcagcgacgaggcggagagttgaaaaggcttaccgcgtggaagacgcaaagtccgaactccgggaacctgggaggaaacggcagagaagccagtcacttcacggcgaaacggggagctttgacgacacgacgcgaacgccgcgaagagtcgtcgactgcatgtcccgttcacgtgtacatacacctgaaaaagtgacggtgcggagaccggaaaagaactccgaaggccgtggacggcgaaagaagcctcgcgcgttctctgctgtttctctcccgtcctcgcatcctcgcgttccggtcaactgtcgcatctctcgctgcgagagaagcgcgggcgggaagagggcgcgcgaagcacggagaattggcggcaagacgcggagatttacgtattgaaaaacggggaagaggagcagaaacgacgcgaaaaaggcccgacgccgcgttctgaaagcctcgcgcgtccggcgcgcagtgcgacatgcagctcgcgcacccactcagctgccagcgacgttcgtcaggatttcttggaaaaagagcatgtagctccactccttttgaggaaggagaacaagacttcgcctccaaagcgcgaacgaaacgcaatcaaactctccccgaaagaaactctgccgtgagcgacagactctcaggcgtccatctacaccttgacgtctcccgcggcaccccgcgaggcgcccccgcttgctctgccagccccaagagcagccccgagggagcttcccgcaaagaaaaacttttggaggcgcccggacaaacttttcgacaacgaatcaactttcgaaaacctgactctgagaaaggcctttctgaaacccaagtctcctccccagttctcgacttgaaagaaagcatcatccacgcagctagcgtgtctcgcgaagaaccgcgtttacacacctacatacatacgtacatacatacatgaatacagatatgcatatgaatgtatgtctgtatacatgcacatatatacaggcctatacacacatgcacgcacaaacatatatatatatatatatgtatatgtgaaatacatgcatggttttatggggcattgtgtgtcctgcagagacagccgtgaacagctttcagaaggatgcaggaaggtttttttcgcgaggcacagtctggggtgtgcagaggtccgtcggactattttgcgaactgagagcgggtcccgcttttcatgttggccttcgattttctctccttttctgtctcgtcccgagggctttcgaaggaagcagatgcagcgttttacggcgctcacgagcagcgtaaccgagagtaccggcctcacacaccatggagaaagaagcatgcgtgtatgtacgggagcacataagcgtttccatctttacatacacgtatatgcatagaagtatgtgtgagcagtcgtgacacctttccagccactaaagaattccgacgcaaaaaaatgacttccctctgcgggacaaggcgtacacggtaggtcctcggcatcgacacaggcaagcgggggatgtttgcaccctttatctcaaaaggatgatgacccatgcattatatacgcatctatctagatgtgtggcactgaagaagattgaatatatacatatatatatatatatgtttataggtttatagatgcatatatttatgaagagcaagaaacgttttctttcaagcacttggatttcttgtgacgaggcgcgcaccctcctccacccgagttgggtgcttcgtttttttctctccttggctcgagcagcatcgcggcttccctagtcgaaagtcaagaactgattcttctgttcaggcacgaatccttctgccgtacgcaaacgtgagacgcgtggggtgtacagacagtcccggaggcagctcgtagaacagcagatacacggacccaccaccatttccaccttttcctctctccgttcgaaatacatcttcgcttccgcgtccttcgttcttcatgaacacacattgttacgagtgccacaacacagatactctacttccgaagttacgtacttgtgcatgcaaccgtgtgtgcgtcaagcactcggaggctctttgcctcagatgacgacggcgaccgacagagactttcctcttgctttgttttcctttctgtgagtttcgcttcctctgacactggctagaaaggaacagagaagagcatgcacccagagaaaaaaggacaacgagggaccaaggcctgtcgactgtgctcccgagttcttcagggtcgctgattccgccaccgcagtcgactctgctctaagagtagcgttcggcgctgcgtctcaaagattcagtctaagccgacgtttctccaagaatgggcgcgacctccgatgtcgtgaaa

SEQ ID NO: 2478 - DNA, 2803 bp, Toxoplasma gondii
gccgacagctctcaaaatgccatgtttccaggaaagtttctccgcagctgcgactgtgtgacctcgtcagtagaagcgcatgtctatatgagggaccagttgtgtcgcaacgtggttgctggataacgggagttacatcgctcggatgctgccattccaagatctaactcgatctcttcccttgttattctagagtgactgcccgagaatcgcggtcctttcaacgtcacaggtatctgttcctatcgtgcctgaatgacaggtctagcacattgtgcagggttaagagtaattcaacccgcgctccgttctgagagccatcgatctgctttcttcaaactaaagcactgctgaccacttgcacacctccgcgcaggtgctggctgttttgtatgtgcgtaggagcacctagagcacgcgggcagacttgcgttccctcgtgctctgaccttttctgagatgctggtgagaacatacgcagatcatctagttttatcgttctcgaaacgaacctggcgatgcctgaacgctgtgtaaagggtgctgcagcgctaaattcggaattggttcggcttgaacattctctccatcttgatggttctaagtcctgcggaccttcgagaactcatgctcctgcctctatcttagtactatgcgattccgctttctcagagtatctgttcctaattcgcgagcagtctgagcttgacgatgaaccctccattaaggacataatggctgttagacctgaggccagcagaccagagagttggcagttggcgttttcgggtcgccgttggcacgcacaaggccaggtgtttctcaagctacactcaacataattgtgtgtctgatcgatttgcttggaggtccgttgtttatctaaagaatggcgaagaaggcgcagcacaatgtacagcaaacgtacaaaaattggttgtctttaaagttatgcaaggaaggatcccggatgcccttgattgtcttcgtcatagtgctgcattgcgttcaggttctatggacacatccacctttacttccttgtcttctctgccttcaaaacacagggaactctgagctggtacgcagtctcagctacgctaggcttcctgtttactctgctataccgcagcttaaccgtggctttcctgtttcgtaacctagtccgtttgggcttggcgtttcagaagacgtgataggtggaaagctgctgacacacaaagtccttggtgaaatgctctcacattcggtccctgcgctggctcgcatgcatcgagaaacgcaaaaaaagaggcatttcaggtccgataatcccgcgtgcgcgacatgcgggaatgtgtgccgcgcacagctattcgcgactgcccgccaacaagctcgcaaccgacgcgtttttcgtcgattttcacagtggaacgctgcgtttttcgcgtccgcatagtttggtatttcgcaagggccgtgtgtagaaatgctgtcgaatttccaataacgaatgtgcgagtctcgcgggtttgcttgtgctcctagtcctcgtgtctccagcgcgtttgcctgctggacgtgcaggctggaaaagtgcctcagcgcggctgccgttctctttgtttttctctgcagccggcgattacgaagcgcactctcgcttctcactttgtttgccccgggatgcgtgtgagaaccgccctttttttcattcgatttcgtccaaatactcccacttccgaatagcgcattcgcacttcaccgtggcggcctgcacacgagctgtcggtacacccgaaactgtcgtggacctcttagacaaagcgcttgtgcacgaatcactcttcacttttcaattttttttcacgcggagtgaccgctgtataactaaggaaacgaagctactgagacgcggtctgccgacatcccctccactgtgtcttccgttcccggtgtcgctcctgtttccgaactctgcctatacgttcgctaacggcagacgctcacaaattttctcaagttacccgtcgatctgtcgaattttctgcggcggatcgggctctttcccccgctgtttactctcaactgtccgagcgggaggtcgatcttgatgctgggaacgcaccgggggacgtgatggtacgttttctgctttaggctgagcggcgtcgttctgcagcccagtggtcttttctttgtcggcatctcagtccgttccacgcgaagaatcatgcctgcctcggaaccggccgcatcacccgcagctgtaccttcgttgaacgccgtcttgtccacgccacccgtctcgtctcccgcttcgccccctggagcgccgtacttcctggccgtcgcgggggcggtttcctcctggttgatgcttctgtgtgtcgcgcaagagctgccgtacgacctcggcgagactctcggcgttcgctttcgtcgctggctccacgcacatccggttctcttcgctccgtggactgctttccttcgctggctaggtcgcagaaggcgcctcgtaggtctcggcgacttcattctcagagaacatcttcgcctcagtggctgattcgaaacggaaaacaacggagttctccgaccccctcttcgtcgccgttgtttcgattcgccggtcgtctgcgttgcttcctcgcgcggagaaagcagagaaaaagcctgagcaaactactagacggatgtgtcttcgtctaagcccagcagcctggcgacctgtggggctttcgttcgcgtgatctgtggtttcctgattctcggtctgttctgttgagaatcagaaaacgcgtgcacgctcacaaga

SEQ ID NO: 2479 - DNA, 3366 bp, Toxoplasma gondii
aagaagaatatgaaggattggaacctgagcctgcgtaggcgtgatggggaaacgcgtccgttgctgagaacaggtcaaagtgtaaagagaaacttcgttgcgtccgtgatagagccacaatgctggcgtgcatgctgcagcgggcaggcaactcaagacatgatgcaaaagcaagcgaactgttcaagcgtgtttgacagtgccggcaggaaaagtgcatcttgctatgacggtaccggggacttccgcctacggccgtcgaaggcgtctctctatccttcggataaaacaaacaaataataccgggagcagaagaggtccatgccgacactgccaatttgcattaaaacagtctctccgaatttgtttccttttcactgtaccccctgggcaagacgaatcagaggaagatgtgttctgagccgagggttcttttcgttgtactcgccagcggggaatatctctgaatcagtatttctgctgacagtacacgccgcaccttcagttcgtgtgcggcagtttctggagcagcttatccggaaactccaatttaagaagctccacgcattttcttggcatttccacatttgcacgtttaacacggcacacgtgctctgagaggcgaccaccttacgcatcttgttaaggcacgcgcgttactctcaacgcaacgcacttgtttcgccagagcaatttgtcgctaccttcacgaagactgctgatgacgtgctactgtcgatcagcgtccctctatttgtgtgatgagcgaaatttctgctgccgcggtcgtcggtatctcagcctcacgagcgaagtacatggcaacgtgtaattcatgcggccagacaccggtagggaaactttaaatgcattgagagacgcgactacccgtgtagcgtgcacgtttctaccgtcaactccaagacagaaacaggagaggtgaccgaataaagtcgctcacaggatgtgggagtctgtcacacgggtactgtaaaagcggatttgtgacggacaggatcaccccctcagtcacgaaacgtgaagaaacgaagagaccggattcaagctctatggcgttagcagagcgtagttatacgagcggtaacagtaatccttacattatgcgtaaaacctagagcatatccgatgtgtctcaagctgtccagcgaggtggtggttcacagaaataaaaagaaacttggttgttcatatctattaagtgaagtcatattcagaataacctgggtactatatgtccatgcgatggtaataatagtagacatcaaatcagctaggtaatccgggatcctgctttttaagacttttgccatacaacacagtctctacccagcactagaaactatggtcactagtttaaattgatatcatttgtgctcaagcggtttgccctttttgcgtctccagatatttagacaggcaaataaactccggatacccgtgttccagtgattgttcctctccttttctatgcatctgcaaatctccttcacagaaggggagtggccattgtcacctcaaatagcaaaattcatgagtatgtgtagtgtgtctcatcagccttgtcctaaccagcgtattatagcttcgctttcttgtgtgctttagaggttcttctgtgttttaaagtgtctgcctctgttgagcagttgtggtcggacagctgacgcggttccagcgtgccaaatcagagctctgagaaacactagacatgtttttgagtgcaaaatgtggatctttgtgcaggcgactgtacttggtggtgtgaaaagttcgggcatcgcttgtgccgcacgaccgccggagagattactgaaggttacttattaaagtgaacccttttgttatggatcagagaggcagaaacacgactctcgagtggcacggagataactttcttggctttctcttccgatttgaaacgaatctgaaaaggtcatgataggacacttgaacgctgaatgcggccggaatgacacacacacgcctgacttgattgacagaggttgatacagaaagcccttgttgtgagcgcacatagggggataccgaagagtaaagagtaggacttgccggagaaaaagcgaggaaagacagtggaaaggagagagatacgatcccgaaaaaaagagtcgatgcacactggaaaaacagtgctgcacttcttagtcaagcgcacgaaatctcgaggttgggtcctttggtggcaagcttgcaaagctgggcgaagcctttgttcatttgcaagattgtcggtaggcgaagtcctcgacttgccatgtgaaaaaacgtcgtttttaagtgtcattctgcgttttttccggttctagaggtgaccgcgccgtcgtctagcgatgctcgcactgcagagcaggtgtactgccgttctgcagcgtccaaagtgcatttgcttttctccgattgtttcgcttcccctgtctggctgtacgaggactaagttgcggtgcgcttaaacattacactgcacgcatttgaatgttaaaatactaccgaccatgggagctggggggatctagcatgcaactctcttcatgtcactaggagaagctttcagattgactggcggagaccgctcgacatgaatgcatcggtcgaattcgaaatactttatcgaaatcaattgtactcggcagaggtacttgtggaggtctgaaaccagaagagatgttgatgtttcgtcttttcagcgtcgttcttcccaagatttcctcaccagctcgggacgccaacctccaatgaaaacagatcgagggaaactgcagacgggctgacgggccatcgtcgtcaccctcagtcagtctcagccactctcaccctccgccaaaatgaacttggtttgttgttttctctgttgctttctcattctgacttggtgttcgtctcttcgcataacgctcacttacgctagagaggctgtaccaagtgcgagttcccaggaaaacgaacgaagcagagtgagtgtcgacgagaaagagaaggcaccaataccggcagaccgtagacagagcgaggacgtgtctttgaagcctcaacagaatctcgcacaagagcagacagagcagatccggcaaaaaaagcctacccgtcgccgccacaggaaagggcgaaagcgaacggtgcagctcttagagtcttctccccgcaaaagaaagaagcgcgcttggcttatggagagcactttgatattttccggtgcggctgctgtgtttttgcttctccatttcatcaaaggtaacgccacggagagacgtgcgagacacagaaccctcgatacccctgaattgtttgtgccgttggagattctttcagacattcccttgcccttca

SEQ ID NO: 2480 - DNA, 1758 bp, Toxoplasma gondii
gaatttcgaaaacactgccgcttccgaagaatactttgcgagatgcagaggaaaggttatgccactggcaaaagcactttttcagagccagaagcgatgcggatgtcatggcaacgtctcgcgcagaaaacgggatgtacctcaccagccaccgcagattgctaatgtgtattgagactggatagcgaggtggggggaacgctctctcttgtgccttctccagttctcgtttatcaacactgtggcgatcgtgcagactgaggatactttgatttgtaggtttatcgtagggataaagaaggtatcggagaaatctctttccacgtagcggatcttgcgtttacccgcgcatgaccatcaacccacactggaataaaacaatgttcctaccagtttcgttgctgtagtgtgtgaacgagtttattcgctgtgtgttaaagcattacccaattgccttccgatgacggatgtccttgcaaaccgctgacccaaatgacccactacgattaggtagacctgtaccagcctggaaatgtgtaacatcaaagaaatgtattccagtctctgtttagaagaaatcatcgcacagaataaaacacttggacgggtggctgtcggcttttctgaaaactacgtgcgggatgtacggttgcggatcgacgcaacttccgccactctcaagacgaagaaggcagatctgcaagcccttgttcgcatttctggaagattcacatattacgcctccatagttgttctgcaatgcagaaaaaaaagcggggaaatggaaggcgcaccactaatcaaatcatgtcgtacaaaggaactgcttatctttcctttacggactgtgtaaaaatacctgcccccccctccccgagaaatcacctccggaatttctctacaatgatatgcctgtcagtctgttcttgaatatatacagtttggcatagccagaaaacactagaagatatcaacatctcaattcaattgttatctacgccttgtagtcgcgtccggatgtgcacagggcgagacaatcgacccgcgtttgctgggacatccacgcttgtcttgtattttggtctctcctgttgctttgcttgcctttctcccacatgcccgacggcgagatgtctggagtcaactgtgtgtttttcaattatccttccgtggttaatttctctgtctcggcagccgcctctcgcgcatgcagaccttatccagtctagtgtgctggcccgttttttctcgcggtcagccaccgatctggaaaaaacgcggagagaaacacaccccccaagcaggagggtctccccccagacatgcgtttcgtttttctgtcttttcctgcattttctcggaagcttgcttttccgtcttggcgagctttcgctctcttgtctgcacacagttctcaaacgaaatgacaagcagcgaaaagcattgccgccgacacacacgggtgcgcgcgagacgccgccagcttgctgtgaatccgagctgaagggtgccggtcccttgaacattttctgtttctttccagtcccgttcttgtcctcaggccatgttctttccccttgtctgtcggcatctctgcatgcgacccttcgtctactcctcaggctccgccgcttcctttccagcttagactccggactcgaacattgttctccgtccagagcttttccgttcttcctcctgtttctctcctttccatttttctccttttcccggcgccgcgtccttctctcggcacca

SEQ ID NO: 2481 - DNA, 2194 bp, Toxoplasma gondii
gataagacgtggtattgggacgccagtcggcccactttttcgtttagaaaaacccggaaacacgtagaaggcagtgaacgtagacctgtatgcgaaaagagtcgtcttctccaagtgcagggagaaggtggaacaagttcggggtacgaccacacgcgtgtgtggttcgagtgaaaaacactgcgggaagagaagggaattcccgcagcgcaaaaagtatgtttgtgcctgctttgcaaagaggtgccagacactgaagtttcggcttttccctgcgcgaccaaggaaagcggcagttcgtctcgaggagcccactgcctacttgtgataatccgaccagtccagtaattgtttcttctcaaaaagaagaaacttggtcaacgaaaagattatctcaccggctgacttcctggtgcgcaggatcagaccaaagagttcgtcgctggtcctgggaagcacagatcgcgttagggcggtttaaaggctatttatttgggtggtgtccgtaactaacactggcgcggaggcagttgaaacaagggagttgtacgggaagctctaggcgaaccgagttctgaaacacggcgttggaaacccggttaacgcgaaaacgtggagctggactgcacctgtgttattcacagatcgctcttgaattgtatactagcgacgaatggcactcaaaaaaagccagggtacctcagatttcgattcccaagactctgagccaaacgggcgctgcctcacatctaggtttgtgcaggaacggtcagacgcgttccctttttccggtggtgccagcagcttagtttctcttctaaagatgtgacgaaacaacaaaggggtttcccgaggcatgtgtcggtgtggctctcatacttttgcctgcgttttcttttctcttttgctgcgtttcatggagacggcgctctctcagtaggctgcgtctgatgaagatctgagaaaccctgtttctctacacccctctccattttgtctcaggactgccaatggcgttgccacgggtgtcctaacacccactgaaagagaaagtctagttttccactttttctcgattacggggttttgatactcgtggaaacgtagctgtaggcaggttggctccctcagtgctaacttcgctttcgatttgagacacgccaatgtaacttattgggatcggatccgacggtgtgctcttcaatgtgacactatgagttgtaaacgaaggacttcgtaacgcgaaatgcgactggccgcaacacattccggtaacgaagggaagatttccctcataaaaggaaagtgttcaaaaccaagcaaagcgtgtgataccagaagtcgtttgcatttcccgtttccttacgagagaaacggcgtcgatcggaaacagctttcgacagcgctgtgcatgcttgcgtcccgagcgagagacaagcgaacaaaagcaatttctcttccgtcgaaacttccaagtagttccgagagtggcgggtttccttctatcatgtggagaaagggactccggaagaaacgacttttctgtcttcttttgctcgagtttctgtgcagcgcaccacctgcgctgtgcgacgaggaaccttgggaagtgttcatgcctccaatgcatgctgttctttctcttagagttgcttcctctctttcttctctctttctcctctctttctcccctcgtttctttctgcatttctcgtcgagtctttccactggctccgtccctttctgagctacaggaaggcgccttcgtcttgtcatttgcccaagcgggtcgttggcagtttcggtcaggtttgtggagccagtctgccctggaaagagttcccttaaaacattgtcctcgagaaaccaaggcactccgcttgtggctccacctttgtttcaactccatctcaacgcgtccgtccggttcgctgtccgtcggtgtgcctttgccagcgacacccttcgcgttcaccactcttttccagatcgcgttgtctgctctttcgctcgcgactcactcttgcggcatccttcgcggtcgtctctcagcgtgtctcatattgctctgcacgcgggtctgctgcctcgattcccttgacagcggactttcgcagcgactcccccattttgaggagaggctctcgccacggcttctttgtttttctgctgtttccccgggcggctgcaagca

SEQ ID NO: 2482 - DNA, 3053 bp, Toxoplasma gondii
ttacaaaacactcaataaactatcaaacggctgcgtgcgtcgagaaagctaaaatttcccaggcaggcaaacctcccagcccctaaatgttgtgccagtaagagaaacaagaaaccaaagactcccacacagggctttctggttctgctccctctgctctctgagagaagcgaccgcaacctggcaagagtatcgcgagcacacgaaggacttttcgggaaaatttccgagtttcttggaatccccgcatgcaaacaaagaaaatctcgaggtcgtcacagtttaaacaccacatacacagttactgaatcaaccttagcagaccgtctgaagtccgttttccccggtacaccgacgtgcagttagttacacctctggaccatgagaacttagccgcacgaacccacgaaccacgcctcattcaagtgtctcaacaccaaataaaaaagagaaaatagtggccgtctcggtttctgtgctgggaagtctgaccgtgtccactacgactcgccagatcgctgcggcagcgctcgcggatttcctgtgggcgtggaactcgaactgaaagttcgactcccgaggaagagcctttttctcagaacctactgccaacttgtcgctgaagcgtcaccatcatgttgttgtcgctttcggcgacactccacccggaggtttgcaggaacttcttgaggtcggcgtcctgttcgtaggtggactgttcgtgctggatctcgctctgaatcgttttcaggaggtccttggaagcagcttctaccgagctgtcggcttcggaagagaaagctcttttttcagccgcaaaagcggagctctgggtgcccgtgagcggggagaagaagcgactgtttgtggctgccgccgcgagacccgcgggggctttgaaagggaccgctccgagtctcccctcgcgcagcaccgcagagcagaaggaagaagagaggaacatgcgctcgcgggagctcgaaagaaccccaggaaggcccagtggggttttggaagaaaagagacgaaaaacagaggcagaagtcgccatggtgatgaggcggggagacagcaaaaacgcacgggaaaggcgggaaggcgagaagcagacgacaggcaagaagaacaaaactcgagcggaaaaaacgacggcgcgagaagaaagggactcctgcgactcggcgaccggagagatttctcccgcacaagcagctctatgaagaaagcgcgaaacaggggcggtgaaacgctgagagagaccccgcaactttacgacgagaaaagtggaagcacaggcggcgtgtgcgtgcaagaagacttccggaattacgggaaaaagagcgagggaaagaggagacaaacacgatgtcggccaggcaccaacaagaaaaattcctattgcccgttaacagtggtgtcgtagcgaaccccacagtcgtgtctctcgagagacacgccaaaggcacactcgagacctgccaacttgttgtcccccagactccagccccgtttcgacggaagctggattgcagatgtctttaaatgtgcacagaaaaggagacgacaccaacatggagaccgtcgcatttgcacagctggtaggtacctgttcagggtttccaatagacgccttctgccgctcgatacagttaatgtgacggtcgtgtgtagaacacaatcgaacgcggatccggtaaacaccgaccttcaaaatctaaaccagcaatcggatacaagaagcaggaggtgtgtatcttactgcagagtcaaaaaaaacgtttttgcaggaaccaagagaggaagagcgggactgccggaaccacggaggcagctgagctcagggcgagcgcagagacacagatacgggagcgaggaaaaaagcacatgaatgaaggaagatttttcgagcgcacatcttaggcgaggcgtatatgccagctaacatcatatactccgcattcttgtgtctgatctgtgtcgtcggtgacgagagaggtgtgtgcacaggaacacggctagatttggagcatatccatacgcggaactacggacgcttatgtgtagatgtaaagaggcagatccggaaactgttctggagcaatggtcgtcagaagaaaagagatatctttggcagcatttcaagctaagcatgaagtgtgcgagctttccacgtgaacgccggtatgtattgcgtgtgtccgtgtacaacaacccgtggggatgtaatcatagagatacaggtatacgtaggttacagtaagccttttgtagtttgtgttgacggaatttcgtttcaaagctgaagagctgcggaaacgagagaaaaggagaaaatgtcttcctcatgcccccccccccagccgcctttcagtggagccgcgcgaagagccagagcgctacaaacgcgcagcggcggggacggcgggggcggggcgagagcggaaaggtactggcagagaaggaagatccacgatatcacaaaaggggcatttattttcgacttccccatgcaagattcggtagaaagagtctgatctgcaggcgggattagacgcgagagaaacctgggctcagcgttaatttcggctgtatatggagctgagacaaaacgacaagagcgcattgaggagtcgcttttttcaggcattttctgtggatttttcacgttccacgcacgattaagtgcaactgatgagatgggaacagaaaagtgtccacgttttgtttccggtgaaacacctcggaaatctgcttcgtcttgacaccgtctacacggcacacgctcctgccgcctgctgctagcacctgcaacgttgcattcctcaacgccattgcgtcttcatgaaacgtctcccttttctcaacgcgtgcatttcaccctgttattttctcgttgagtttttttgaaagctcttgatactctgagggaaatcgtcgtgctagagaagcggcttgtctttctgtcggaaggcagggaacaggactgcgtttcagggttccacggatccgaggccgcattcggagaccacattcgtgcacacctgttcaggcga

SEQ ID NO: 2483 - DNA, 2430 bp, Toxoplasma gondii
aactgctatgctgctaccataaactctaatggtgcactgattcaacttccgcacattagcagcaaagtttctcagcagcttttttctgttgtagtgtcttcattggctgattaacaggaatacacgtgtgttaaaaatactgcctggtatttgatcgattgcatccctgatttacagctggtaccagctgactgtgccagtacatccagcacgcccctgatgtactggtggtgttcgacattcgcagtttgcacctgtatcgcaggagggtgagctttgtcagacaagaggcgatatctgaaggatgccgacttttagtacacgtgtctctagcataacagtcccagcgcggcttagagtgcctcagaccttcacttctctgcaaacagccctccacaacatccgtcacaacccactgctgtacttcccacttcaacagttggtaacgaaagatctctaactctcctcaaccaccgaactaggacgagcaggtgacaggaaatgaaccgttgcgcacagtgcgagtgaagttcggccacctgtgcaaaaaacttgcgaaggctttctaccacgtgtccgtcctcataataacatgcgtgctcgttgggaaaactgcggaactgtattatgtgtgacggcgttgccgaccttgatgatgtgggacgaaagcggcagctcacccatgtagtccaaatgaatgagactcagccgtctcacaagactgtgcgcattggcgattaaactgttcaaggctgtggaagtgcattgctctgccaccccagttacagaacaaagaaagcaacggtttcctggtgcgcccgatcgaatccgttcgctttcaatctgacgcgtttcagcatcagcggtggacgcttggtcttgcaagcaggccttgcttcgagctagatcgcatggtacaggaaagtggatcgtaccatgaattcagataccctaggacatgccaatggtacagaagaggatattgcttcaagtgacaggaagtcaaaatgaacggaaatatgggcaactgtaagggaagcgactacgggcactggcgtgcccggtagctgtagaactgtagggtaggaaaaaccatcgagcgtcgaagagagttgtcccgcgttgcgccacgtcggactcagcgagccagacctcgaggctcttgcttggaaacgttgctttccattagtcttctacagtacgtgacttcccgcaaacgtttcttttccctcattggaggccgccgcattttgtgccttcggtatttttttctccccaaatagtgtaaatgcgatggactcaacagctgaatccctctcctagcctgtagtttcaccagatgtgaccgatgattctcgcgaagctgtgggtccggaaggcttgccgtcattcgtcttcgtagtgccatttaaaacactttgagggatcaattctcgtgtgtctgttgtttgtaaagacattttattggttactattcgactaaagagcaagggaaagccggctcatctgtacaacgacacaactctttgtatgtggcaacgctgttacgtatctccccctctaagagttgtggcatccttctgctgttataggacacaaaatattcgcccctgcacagattacaccattccccgtgcttacagcatggctgccttctgcttcgctaccgtcgccgcccctttcttcgttcttctttggaatgaccccgccggtacgacccagcatgtggggggataaggataagatttgaagtcgatcctgaagcagacaaaggcggaatgacgatatccgttttattgtggcacacgccactagaacagacgctgaaagtgtgtctgtgtgcagagcggtcagggtgtcatgtgcgtctgcgccagtaccgtacttgcaaccgttaccgaattcttggattcgactcactgctagtcagtgacacttgaggcttgtgtatgcttttacggcagaatatgatacgaactgctgaattcggattcagatttgaaacctgggcaactggggcctcttaagctgaccgagcgaaggtagaacattacgatgtcgcgtgccgttgtgacacgaagttccgtccccgtgtccagctgccgtgtaccaaatgaccagcatgccagcgataataacgaagcggatagccgggagggacgtcttacatggcttccgcatgctcagatattttaacggtgaacactgtgcgtatcaaaaaccctgcttttgcagttgcaacgggtgtaacacgttttggttcgaaggcctcttcacacctcgataaccggcgaggagcgctagaacctgatgtgatcgcgacacacgtgaatgacatacaagtgcacgagaagccccagagtctcgttgagcgtaaatcctgcgaactggatgatctcaggcagtcaggtgtaagccctggagcccaga

SEQ ID NO: 2484 - DNA, 2448 bp, Toxoplasma gondii
gaccatcgccaacagggcatcgcagtaattcaccgatgtgaaataaccttaacgtcgtaggtattgaaattcaacacttttacctgcatgcagcaatccagtggggtggcagtgttgtgtactcttgaaaaactcggctgtccatatctcatagccacactttctgcgtggtgaggaaccatgaaaaatgcctagacgattacctgactgccgcggatgtagacttgctcgagggacacgacgcgtccatctctgtgtgtgacggtgacggtctggagcaaacagttcatgttgtcttcagcattttcaagaactccccgatacacctcgcctgaatataaaaaatatgtgcaacaatggaattcttggaaattcacttcgaatatcaccgactctggggagaaatcacggcgttccttcacatggggagacgtgcatcacctcaagaaataaacacacacagaaagatacaaatgtggacgcggttgttcccgcctgacatacgcaaggcagggagctatctgcatcgttttccatccagaacacataaccaccgacgtggcacctttcctcgagaccacgcgtgtttcaacgcgacaaagacatccccatgcgctgccatcctcagtgaggtcactgacatcaggactgtttgcgttctgaagcaattttgtcgattttctcggctttcccctggtgcccgggagagccacgacgaggagtcacgggattgacggcacgttacactacagaggaaacgtgcgcggtaaatccgtctgagcaagcatttggaaagaaaacgctatgaaagcgcaaaccgtgtttctacttcagaacgccgtaacacgcagcaagcgggaatccaggacgcagcaacccgtgttggcgccggagacctggttcttctcaaagtccacaagggctaaacgaatcactcccgaagagacagtgtttttccgcacctgacttgatttccaccgtcacagtgtggccgagaccttcgtagagaagcttgacaggagttccgacggttgccatgttgtcaggtccggggtactgaatggggcagtctgcgaaatctatgagacttgatgaagccgagaagacgttctgagacgaagcacaaagaaaaaactgaaagactaaacggaaaacgaggaaaacaaaacacaagaagcgtctgggcgcttctgcgcgcgcggtagaggaccggcaccacccacgcaaaggatgtgctgtcggagacaaacggggcggaaacggggacagagtcacaggcgcagagagtcgcaagaacccgatactggtttctaagtttcactttacgatttgacgctggacacacgctcgctttgagtcggaggcggataaaacagacaccagttacagggtgcagacgcgcgcggcgaccaaagcccagaagcacattcaccgcagaaatgaaaagctccgaactggaagcgacaaaaaatacgcggcgattttcccgttttctcggcgttttctcgagcttgcctcatgcgtaatcgcgcgaactgctgccaccccacttttccttgttcgtttcttctgttctgtgtcgtctgtaggggtttctctgcatgcgctcctcatccccaataaaaaccgacggcgctgcgcggccgccaagcgactctcaaacacgacgccggtatgcgtgtgtttctgaagttacgcctatctttcttggcattttggtttcgcatctacctcagatctcggccctgttgaagcaaaaagtgtccttttcctgcgggtcggcgtttccgcagaccgagaatagccctcagcccctcgtggtcgtgtaccttgttccacaaccgcctgttgagtctcgattgcgcgaggcccccctcagcagaaggtaagcggctctcctctccaacgagacaaaggggcgaaaactatttttgctcagtcgctcgctattctgtggagaggtctgtctggaagcaagagctctgtagccagcacacagacttcccaagtgtccctgatctggttgtaccggcgcttggactctgttgtctcggccccttttctacgcgcactttcatcgcatctttgagtgagtgagtctttttcatgcctccacctattagccgcgaaaacgaagtgtttgctggtgagagtgttgctgtgaagccccgatttcgctcgttcgtagcctccacggctaccacgcgcacaaacatacaggtcgctctcagcgtgccgcacgcgggtacgcacatacaacatacatgctcctgtgtgtccgtctcgaggggtcgactgttctcagagagcctgctgccgttgggtgacactttttttcgtgtctcgcggtcgttttttttcgttctcgtttctcgagtctcctccactttccccccgtcgtctctcttctcccatttcgtctttttcggtcgctgcaccctctcacaa

SEQ ID NO: 2485 - DNA, 4887 bp, Toxoplasma gondii
catggaggcgctgtcttacaatagaagtcgcatgatgtctgctttcacatatctgaagggtggaataaggacccacacatcttgatccaagtcgccctgttgtatacgggaagaatggcgttgtggcacgagatactgtagccgtcccccaaaaatgtgttgacgctgaggaacgctctcactatctccaagagcgttaacgagctaatcacactcggcaacaagcagcagcattccgttgctgcagatgcaataaaaacaggacgccttatgtcggcatctgtgtaccagagcttgatatacgggagcgagttttgtccggaaacagaaatgttcgcggcgatgtatttggcgagctcatatcttaccaagatgtggaacagattcaagtggagaaacagaggacagattagtctccagatttcgccgacacgaatgagctcgggaatgtttgcgccgaacatcaccagggtttgcctggatggtgtatgcacacagtgacaacgcgaaaggatgagacccaatagaaagcgtgcagaaagcacccgacagacccatcgggtggctggcactccacagttccccgcgtaactgcttgaggcctcgaaatcgatgtgtaaccaccgcagaagactcgaatcgaatacacagtgaaggggaccatccagtgctcattaacgacactgcacgacaagaagggcatagtcatgtcctaataccacagctagtcggcggactgcactacacagcactgtatggtcttggtactattgtgaagacacgtgatgaaaaggatatccagaacacaaattagcacgtattgccgccaccgaattccttcggcagaaaacggaaaaaactgttctttttgctgtcgatacatcccctcagatgcccctcaatcctggcgaatcgggaacagcttttccagcttaatttccccttctgggagccctgccattcgatgagtccacgaacgctgcaccgcgaacgtaaggcgttctaatccttgctgcactgacagcccgtcaaaagcaggatgcatcgacggcatcagcgcctccctggtttgttgcagattggaggcagcgggggcaaagccggtcattttcttacggagttggtgccaggatttcattgggtgccaggccggcagcgagcgacgcgatgtagactgcgatttgtacgaaggaaatgatgatgattgggctcttcaggtgtattcccgggcacagccattgaatccaactgacgttttcgccagattgagttccagaggggaaaaagagtggcaacggacttcctccctgtcgtccttccccttcaagtgcagaagagccgcgtggaggcgacgacgcataatccgacaacgtccgaatgttggccatcgtgttcccgctgtgcagcgcgtagcagcagcgtcggcctttgaaccgctagaaagaagacaaaaatcgttccttccgacaaagaagaagggaaagggaagtgcgtttctggttcgttccatgggaaaacgcaacagcccaggatggacagcttgcgatatcccatgcgaaaggcagggaatggcactgctgaatcaaacaaaacgggaaacggcgactaggcggtcccaggttgaaagacacacgggtggcagagcgggtacaacaggcgttttgcgaaagccgttgaaaaccagatcgatacatgcgaaaactatgtccgattcttttttcttgaaccagcttctaacgatggacctgctttcttgcctggaaatgtcgcgcttggcagcgccaagtgctagtcggtcatggatgcgcaggggaaagaaagaagacagcttcccagcacaggttttccaagtcagttttgttgcctagctgtctccggcatgcatttcgttgtgtatgggttttcgagaacgggaaacacaaatttgccgttcttgtggttatccacgggttcacgcgatctaggacaagaaccaaacaaaatcgattgagtgtctgtgcatcgagcgacgcgtgcatgcgcgagaagaccccaggaactgtcatcctcggcggcggtttaacttctacacgaaccgctaccggaaattaagaagacgaaagctcactgccacaggagtggagaaggaatcccctcaactatttgaatcctgacacctgtaaccgatacatggcatctcctctccacctgcaggctgcacagcttgggatggagctgacaccggtgtgtgaagaagacgagcaagaaaggacaagagcacgtagccactccggggtcttaaatgtgtcgcaaaagcgtcgaatacgtgagccggacagcgctccaacgtcacatcttcgaggagagcttcgagcctctctccctagtgttgtttctcagctgaagggttctggcattaaacgcggaacgtaaggcgctaccgaattacgggaagctcataagagtcactacacagtcctttcgcctctgctattagtaaaagattcagtatgttggacgtattcgacagtcgacagagcgtgatacaacaccgactgtgtcctcgccagcagtaaatgagttgctagaggctaaggcaacgtggacaacgatgcgaacgacagaataacaatgcagtggacgggaacaggaccgtaattgcatttctaataatactttttgtgcttcctttttcgagatccactggactcaaagataaagcacagtgaaatattcttccgtgataaggtgggcgaatagtagtgccatcttcaatcgcgagcaacccttcaaaatgctgaaacaaaagacgccacagaaaaggtaaacgtattcatttctcgaatttccttctatttgtgccagcattctgaggcgccactcgttagcatgacgctgtccggatccacgaaatgccaggcgtccctcctagtggttgacgcagacggtcgtagtgaagcaagtgccagcgtcttttggtcgctccaggtgcgctcaagaagagattcaagcgtacaaagtgtaacatacgatcgaatttaaggaagaagaaaagttgatttcgaagacaagtctctcgcgtacgtgcaaaaagggtgcgcataactacgtagaagccttcctctgattacggtccgaagtcacacactggtaaacgcaaatgagtaaacgaagaggagaggccgcggtgctttgggataaatttgtgatagataacaggaaaaacctatttgttgcgcttgctgtcttacgtagctctccgacgacccccaccccattctgcacgttccccacatgtcgtgtcagccttttcaaaaggcttacgctgctacacagaaccaggcttgagcggcgtacatagcgatggtatgtcagccacactgcttctacatcaggaaacggcgttcctttgatttgcttgtcaggagagtgtcaaagatagaactccgagttcttgtttcgcaatcagaaccttcgtgcaaaggcagtatgcaaaccacgcgcctttgagctcccagtgatcctcctttcaatgtcaaactacaaggacaccggccatcaagctttgctcttcttctctctgccggtgctgtcagctgtgggactcatctttaagtatcatgccccgacttaagtgaacatatgtgatcggaactttcggtccatctcgatccttatcttcagatcttaccctctatagaacgcatgtcggcttgcccatacagtgtgtttgccctgacctcaactatacgtgactgaaactgcttttctcggaacggatctacatcgtcaatacgttaggaaaccattcagttgcccaacatggtttgatcagtacgacgggtttagagccgaacgtgatgtgcctcgtcagcggcctgttaacataatgaggggagggacgcaggcagttgtagcacgctttagaattgtctgaaagcagcgaaaacaaaaacaagacaggctcatcactatcaccacatctgcacactttccgatacgaactgtccgtgtggaactaggtattaaaagcacccgcgtatgaacagtgatcgcgaggcgggagaacgcatgcacgaaaacatgctcgaagaatccccaaacacacaaaaacactccaatatgcttgtcttcctgcccccgttttcactgcatttcgctacggcacgctcaggtttgcctcagccctttctctagctgattcgttaacttttgggatgccttcgtggctactcgagtctagctgctgcaacgcatgcaaagctgccttttcttcgcggcgggtcacgacagagatacgctgaaacgaaatccaaccaactacgaattgtgaattttgtaaattgaatgaaggccggcaataaaggtgttgcataccagccgtctgcatcttctcaaacgtttctattacttatgttcccagatcgtatgtcaccgtctgtttgggcagtcaggtcgttcttgcagccagctcgtttgttggagcacacgggggtcggtacctcacattgatgtgaagatcttccagagggaagcagcctccaccatctctgagacggagggaattctccttcacatttgcaacctaccgactgcacagggtaacccctatcgactcctcagtttagttcttttggcatgccgcaacgtgtgttgattcgtgtccctggacaccgacggattattttcctcactttttggtccgctgtgccgagggtaaagcacttggtccgtctttgaagctgagttttttgtcggcattcgaggacgaagctttgcaactcttcaacggggaaattcagagcctcatgcgctgcctgcttcgacgaattcgtctccaaacacatcccgggcactgattgttttcggaactcgagcagctgctcttctgccttcttttcggcgtga

SEQ ID NO: 2486 - DNA, 2646 bp, Toxoplasma gondii
gccttgcaatcactggcgagatcatccgctcagaaaaaggcagcgtgcacttgtccgacaagcgaaaacacccagggtgaaacctcgccagcgaaacaacacaagaagagacagtccgctgagggaaaaaagaaagggaacgccttgccggaagggaagcgaaaacgcaagcagacattcgccgggtgcggcagccagagctctcaggagtcgccccccgcttccgttactaaaaacgagcaagcggcattcgtgacagacaagccgagcgactcgccgcgaaaccgtggtggagtatctgagatccgagaggaatcgcaatggagcctgactctgatagaactgccgccggtgaatcctcttgcagaaggtccacaggtggcggcaatcgcgccagatgttccatcgtgcgacacagaaatctccggtatacgtacacctcagaaaattcagtctgcagagccggatgagcggagcagcaagcgtccaattagctcagtcacgccgcgatcgagcgacagtagtggaggtgcgaggccagcgcgcaaacagcggcagaaaaagcatcagccgagacacagaaaaactgctgcgcagctctgaagactcgcgtgagcagctgtagcacagatccgtcgagacagactggaagaaaggaaaatgacacccgatgcatacacgctatggcggtgcagcacggaacctagactcggggaagcagaaagcagttttgcgggcaggcgtttcggggaaaaagaccggagaaaactccgcgttccgcacgacatggcgacacgattatgtctgttcttgttaagctcgcgtctttgtgtggtgcacggtgcttgttttgtgtgtggaacggtttccgctcgcgtctcgcttgcgtgagtgccgagaaatggctgtgtcagcgtgcacctcaggatgtaaagtgacaggtgcgatgccgagcattggcaagcaacgacagagtcgtccgaggcggtcagtgcgcagaaagtatgtcgtgtttctgtccttgtctttgggtggcgatacggatcactccagtgttctaggcatttcatgtttttatcggaatggaacagttgacagcagtaatgcgtgtgtgttcgtgctacgattgcggattccccctttccgaatgtcttgcgagacattctcgaagatcaacaaatgtacagctctatttgcgtgttcaagctcatatgagttcctgcacgtcacgcggtagcttagagacacagagacttttctagatatttcgcgcgtttgaagtcaagaaagtcaggctagagagcttcttgtatcgtgggttcttatttgaatgctcatcgataacaacaaacaagtcaggcttctgtcgcgtcggcctgtaatgctgacaacgagctgctgcatgtgcttgcttgcacatgactggcacgctgtcaggtgtcacttttcgctgcatgcgagtgaaaaaaacgggaagaaatttccatcctcaagaaatccgcttcagaacagaaaggtccactttatggtgacaaaccagacaaaagcttcagaaacacccagatggctttcaattagcgcgttgttccccttgatgcaagagcgaggtagacaaatcacatgtttcttgggcaatttctcagattttttcctgctctccgattccatagatctgagcgaatccttccttctttgtttcttctttaaaagcaaaaacccagggcaatcgcatcgctaactcctttcaagtgtctgttcaacaggattgtgagtgttttcgtgttttgagtgaaaccggcacactttgcgccgcgctgagctcagcatttacttttccttggtactctctaactcttagagaaagcaagaggaaagcaaactcgaaaactttgaatctcgcacagatatgcatgcccttgaagcgtgctgcccacgtttcaagcgttgggctgcgttgttcgagctcaacttcttaccttacgtccgcgcgaaacaagccccgttggttaatcagtggcagtgcgtttctctgtcctgtatctgtctctaaaaagtcgtgtatcccgtcactaacaatcaattacagagatttttccacagagatataggattcctttctctggatatccccgccaggctgcagtttcttttttttcgaagaaaccgacaagatttgcttttttcggtgcatgcgcgagcctcttttccggaagtatctggaggggcgatggatggcctcccgacacaacaggagataataaggaaatgtcagaagcacttcaacgaaaaatgtaagcgttcaaggcagacgcttccttttcgcttcgtttctgtttcttcgccttcttcaacatcttcctctccctctcaatctcgtgcgcttctctgctgtgtttttttccttcttgcagtcctcggttgcttctcccccttcgcctcgtttgcactcccttccttaaagtgtttgccaggcctatgtcgaaattcccctcttgtcacgggtattccgcgccgccctccccttgtcttttttatctcttcgctttttccggcggtttctgttgcttgtgaagagagccagcaccgccggggaacaaaacgtcttggttgttcgaattcctcctctctcttcatcgagaattgaga

SEQ ID NO: 2487 - DNA, 2099 bp, Toxoplasma gondii
gcgttcctcggttccatgtgcaccgaaacacctgcccatcagtccccacacatatatgttctcccgaccttatgcatacctctctctctctctctctatatatatatatatatgtttagtagcttatctatgtatctatctatgtatctatctatgtatctatctatctatgtatctatctatgtatctatctatgtatatatatatatatatatatataggtacttgtgtatccatgtgcaacgactatagatacatgcatacatgcatatacacacatctatgtagattgatgtaggacgagtaacgtgcactgaagagaggaagtctgtgaggcgaactgcatgctgttgcgccagtgtggagcgcagatgcagggagagttgtcctcacgacttcgttgtgtttctgtcgatctcgttctgcgcatgcgttctcacctgcgtggtggatgcttgtcaggtagagcgagttcagattcgcgactctccaggaaaaccactcttcggcgcaggagagcttgtgcgaagaatcagcgagctcgacaaaagaaggcactcgcccgtaccaggcaggaaagtaggcaaaatcctccggcaacgccggcgtgcgaagactcatgcttaggaccgaacaacgaagaaaaaaatcgcgaaggaaaaggaggatgcagaagataaagagatggaagaccgctcttcatcgtgcattcgacaagacgatacaacgtagacacgtacagctttgtggctgtatgcacaggtggatgcctggctctacacagatgttagaaaacagagaagaacgagagacgcgagcaaagtccttctcgaccttagatcaaagatgaagagtgggaaggccaagaaggtacaagaagaggagcccaaatattcgcgttcattgcgagggttgcttctggaacgaagcatttagagaatcgagaactcagccgcaaagacgcagaacgaaggagtaagaagaagaggaaccctcggccaagactggcagagatgcgaatgacggttcaaaggaaaaagtcacgctttcgttgtgtctctccgttcggctggcgccgtccgcctgctgcccctccggcacacatcgcggcgcgcggcactggggaaaccggagaggcagtaggagaagcttggcgccccccgtctctttcgaatcaaacgcgtcgaatgacactttaaagactgaaacaaaaccacgtttcagcgcttgaagcgacttgtttcgtgtgtctgcccgcttggggctttgacctcggcggcttccgcatgcaaccgcgcgttttttcgcgaacctagccgcgaacagacgacagcgtcgagtgtaagtcacatctcactggagaagccaagacggtgtgcgggaacctttcgaacttctcttcctttcttggtcactctgaattcgttgtgcccctcttcgacagcctgggggtggagggctcctactgtaggacccagggcgtaggttccccaaaatgcctcctctccggttcggtttgcgaacctctgccccacagaatccccgctcgagggtcgagtgtttcacattgacttttctcgagagagaattcaaacggaactgaccgttttctttttctctgcaattctgcgcgagtgtcggttcagctggtcgaggccttcaaaaccccctttcctcgcccctctcccgcgcttggtcgggcaccgcaactctccgattgctccgcaatctgtccagaagtctctcttcttctttctcgttcgtttattttcttacctccttcgtcgcacttcccgctcttgtcttccaagcactggcccaagacgcgccacagcaactcccttttttgcccatcgttgctcttcatctcaactgtcagcgcggccttcaagactcaagcaagaagaaaagactctctctctctatatatatatatatatttccccgtcttgtcgtttcctccttcattctcttctctcttccctccagccttcgtatttttgtcttcgatatcttgtcttcttcactgctcttgcttttgggttcttctcttcgtgtttcttgtcttctcgcgtccttttgtctctttcttcgcggca

SEQ ID NO: 2488 - DNA, 2846 bp, Toxoplasma gondii
caatgatcgcggaaatgccctgttgtaccagatccggcatttcgcttgagcgtctccggacagccagtccagcaggtggcgagcttgttgtcagcgagtggcgtatgcttttgaggttgacgttgcatgcggcctgggcggtccagtctgtggttttctggaaactaccaagttgcaaagcgttgtgttttgaagcgccaacgccttgacaccttgtgttggacctgtttcgttctggctcgctaggccgtccaccgtgggagcggcgaggggctgtaactgcactttttcccgctcacacagcgtcgtatttatcttcgcactttaagcagtgtgctcactgaagcgcgggtgcgtgaaataactctcgcgcgcgcaggcgaacgaatggtcgcgcgagacatcaagacaccttccacccacaccactcctctgagaaatcgggcagggtagcgtttaaaaaaccacagaacagttgagtactgtccgcactcaccaggcctaaaaagcgttcatccagttcctcaacaggtgtcaggcgaacaagaatccgacctgtagattccggtcagaccagcactggaacacaaggaaagagcatgtcgctgttcacacgtcaacagcattctgtctccctgtccacatgcatcgagaaactgactcgtccacatgccagaaccaaacaggcgtctgatgtacgaaagtctggtttctaagtgggaacctctggaagatgcgaccttccttgtggcgtctgctattcagggacacttggatgtacatcgagtgtcgtctccgcattcgccagttttcttgttgtagtttttcatcgttcggatgaaaggcttctttttcctcattcgggggcctcagcatcgctgaggaacacccctggctgggttcgcgtccaacagatggaaggcacctgcatcttgctgttctaaaagggtcgccgagccagacctccccaactagagggaaagatgaggtccttagacggtcagtttgtggttcgacacatggtggagggtaactggagatcactcacttactcaccactctcggaacaacagctgcgcttgcgtttgaggaaaattgcctaacgtttgtcgatttctcgtagcagcagccaagtggccaggggacccgttgccagacggaggacggtcgactacagaagtgggggtcacatacctgttgcagaactctatattgataccgcctccgcttaactcgtgaagcagtaatcgcttccgtttgcacggaactcaagtccacgtggcgtactaccaccgaaatcggcataccacgggttgaacgtaaacacactgcaagtcccgcgcactgcgaggcgttaccgtcaaaagattcctttcctttttctgtgatttgccgctgtaggagattgagcagttggcactcagcattcgtgagagtttactgacagaaagacccaacctcttgatttgatgaggccataagatctaacgcgtgtggcaatttcgcgtagctgatctctgggactggacggcggcgccgagtggagtgccacaaagttgtccattaacagagacagccgcgcgcactccaagcacattttcttgcagagagcggttctgtcgtaatactgctcagctgcaacgtacctaacgaggcgctatgaaccgggactgtcttcctgaaagaatacgtaattaaattagttcgctctcggttctatggtgtagcggttagcactgcggactctgaatccgccgacctgggttcaaatcccagtaggacctctcttggcgactggttgcatgcaaatcgcgttacttctgcatacgccgaccgcggctgaacactacagttgaaactcttggatgctacaactcagttgattctgtggctaccgccagctggtgcacttatcgtcgtcttccgctacgttcttctacggtggccttagcacagaccactggtccatctgcagtccgttctgtacgttctggaaggtgctttgcgtatacaatcctcagaacaggtcgatattgaaaattttcgatgacacacagtcgacaccgaggtagcgttgtcacgaagaatgaaacatgctaccacacggatacatctcaacgggagcgcacagggcgtgtgactcttgtattttcaccggcgaaagcgagacctcagaaagccagaggcagcgtggtcaagctagagcgaaggaaaagtgagtttgcatctgtttgtcactaagaaacattcgtcaaccggggggcagaccgagaccgtgtaaccatggcgcttattcgatgtcccaggaaagcggggattacacgcccgtggcctagacgaatttatcgcacgctacgttggcctgagactaatcgatggcaagatagaagaacatcggaagactctttgcgcttcaaagccggacggcgttgttgcctctcgtgaatcgtagcggcgggcggtagagcccaagaagccatggtgcacatatatatcgatgtgtagccagcaccgcagtcccgagcagcgatgactacgtacccaagtgagaaaacgggctattgacactccctggtagtcgagcaggtgaaaaggaaccgattttgtgtttctttcgggagcttgctgaagctggaagcgatatgtgtgactatgatgcgcggagccatctgacaccagtaggggcagtagagagacgccatctgcctgagacaatcaatcagggagaaagagaatagtgagacgcaaccctggcccccaaaatcagttttcgctagggactgagcgaacagaaaaggacattccccctctgagacgcaaagctcgatgtctgctaaaggctgtca

SEQ ID NO: 2489 - DNA, 2760 bp, Toxoplasma gondii
gctaaaacgttttcgattagaagggaaagcatgcgcttcacccgggactgctgtccattagttgacggcgtcactccatcgtaccataaacggggttttaggaagagatcatttcagaaaacttttccactgacagtgcctcattgaaatgccgcgcaaagcaaaggaagagatcatacagaaatgcgactttcttccgacagaaaatctgaagcgtttgctgtgtctgtgtcacgcatggcctacagagtcgcagatccagtgatgaggttcgtgataaaaactggaacttgttccccagtttagaacataacttccccactagcgccacaagatggaaaccatggaaccagcattgtcgaccgcgacagcaaatgacgcgttggaacacggctagactttcttttctacagcatttgcagggcagttccagattgagcgcaagcagcaaccctggctgttattttcgctctaaaggtaccaaaggtaaagcacctacaaagccacttgagagcaaacgactccgccttccagcttctagaaaacctacgaaagaaactagcggcgtgcacactacttagcaatttcagttgagagcagggaaacaacgtcacgtcgcatcttgcactgactctaatatagatagaagtgtcgaccttgactctctttttcaacagtttagcgttttttgaagaaacgaatgtgcgggctctgtaccattccagcaaggcctcaacgaacgactcagcctttctctcatttcgtattaccggatcatgcacgcaaaagcagcgtggaaaacagtgggtctcggttcaccgcatgcacgctctcttgtgtttttctcgaccatcgtgttaaatgcgtcaggtgaaatggtgtcccgcgtatctttgagagaccagcagttgcatgcaagctgtacacatatcgcgatattcgtttcggcaggttcctgtctcgtgattgtctgtgcggaaaatgcccgtcggtcgctttttgcctcttaacagctttcattgcagcagccgagacagggtatttctctgtcaactctctatttctctccaactccgctctgaagtgtggcgacaccgtggaaccttgaaccgctgaacacacagacagtccgaatctaggcgaaaaaagagctctgttgcatcagtccatggtgttaagtggttctacttcctcaactctcatcttaactccgctggcactggcgaattgggaccgtcacacatccttcgaacacacccgacactaataacatagagaccagagctacaccatgtagtgtaattgtcacagtattatagcaaatgctgtctctgtacagatgctccgcaagtcagaactatatatctcaaaccgaataaacagagacattatagtatctgcgatcctgaatagggtagtcatcgtctatttgagaagccaacatttacacacaagctgtaaaagtatcacgatattcactgtggtactctttcctaatgtttgtctgtacggaactcttaggtctatctctttatatattttcaagcctcttcttatgggatgttgaaaataacattggaaaccgacgggtcattggctgtttcgtcgtctcggcgtaatggctatcaacaacttcttgcagccaagttccgtatctgagggggcataatgtctcggattgctgagggtgtcgatctaaacttttcgcttttgaagtgagttccgtctttgcccgaacatgaagaaaacgctcgaagagcacagcaaaacccagccacttaaacagtgtagagcgcctccaaaccgagtttttgcggaagagacgacctccaaacctagttggggagaacgctccaacgaacaatatcaaatgaagcaaggaaaagattttgagctgcgtcgtagaaacgattcgctttccactctcgagctcaacgcagcggccgcgtcttttcagtttgtacagcacaaaaacgttcaaccacgaacgcgcgcgcacccctccattgccgccatttgtgtgactgttcgacgcttgcgaaaaggcgttttctctcgactcgcagttcggcgtttctccgctttctcttcttctttttcttgcatccttctgtctttttttccctccccgcttcttcctctcttccgtcaaatcacacgcgccttctcaagacagcttgtttcgtgtcttgcagaaagcctcgtgtgccttgtcgctgccgccgagaagactccgactggctagcttgaccttttcttgtttgcgtttccctttcgaatctgtggctttgcagaattctcgctgagaaactggcgaaactgccgggtaaagcgaggaaatccctgaggtgtatgtttcagttcgctcgcgacacagcggcggatgaatcgtcggcggcacagagcttgtctcaccaccctcccgtttgcgactttttacagggacgcctttggtatttttcgttgctccttccttccactctctctgacgaacggcagaaaattccctccaaaaactatcgcactgtgatccttccacctcgcctcctcttggccgctcgcggctccttccttcgagccttcctgccgttcccccggctccgaggcggtcttcacgacagttagccggaaaaggcaaaaagaggcaagaccgacgctctccacctttttctgtcgccaaggttgaccgttgcccgtcggattttccccctcagctcgctcgcctgcccgggcgcggcgccgagccacaagttgccgaga

SEQ ID NO: 2490 - DNA, 4424 bp, Toxoplasma gondii
tatcggtaacggattcagcagtaagtgtagtagtggtctcagcgttcccggccaaagaccctgcgcggtgatactccagagtaaggaggtgtcgcccagcaaaatcgtgaattttgtccacaagaaccgacgcgctttcgaattctgtgacagcgaagataaccacagtcccaattgggatagaagactatgatgtaagccaattcaatgactaaggtcatcagttgcgtccgacgatgtgctctacgtggcgacgataggtccttgcatggaaaaaacacgatgcagacagatttggaggcatcagcaagtcgacacagaaacctgaatatccgccaagcggctacaacctgaggctcacgcacagaggcgtttgataggcaaactcttatactatgcttcgtgtggcagcggcggccgctagtcaaagaggacccgaaccccctgcggtcacttacctctgaggcaaaggccgtcgttattcaacaaaagacgagagtgatccgataccttgacatattctatgattgggaagctgagcaatgccaaacaggaatcccattttgccatctcagctgggtctataacagcggccatgtccgggaccgtgagaactggccttcgagcatgcaaaccttcgatagttccatctttaggcatctggcccagatctgttctcgtcagaagtccagaagttgtggttgttaccataatgtaagaaggcgcgacctcaccgtccacgggtggatcatgcgatgaattcttcacctgtgatgagtcaacacatggcgccatgagtgtgggcgaatctggtagagcgaagccttcataattgaggaaaaagccagtgaaaatggaacatagcagaagtagtacgacgagctgctggctgggccgcttgctgtttctgaaacgcgcacgcatcgtggagcgcaatcaactactggagtaggaataactggaacatctgaggccccactcctgtctgccgcctccctcaactcgctcccgtaccgcttaaacctgaactggaagaagcgataatcattcagctacggaaaagtgggaggtcgatgcattccacttatgccttcgcgcgtttgtgtgacacccttatgagccgcagaaatacacggtgtttgttaacaattgagcgtcagttcgatgcccacgaagttcgttacttgatagtcgaacacgaatatgaacaagcatcagcgacttctcagctcgcatccatacgtcgaaaaaaaagaaaaatcagtcagcagacacactatccggcagaagtgtgcctcgttcgaattgctctacgcgcacagtagcgatattgcaatgcgacggctcgttgtctaactaacgtcagcaacacagcaatcagatgcagtcgcctcctgctccggcgtcactattctcgttctgtaaaggccgtttttttttgctgggtgtgaagttgctttgattcgccattctgctgatggcaaacagttaacgtcgctacaatcattgacatgcttccttgtctttccgtagttcctcactttcgacgcccttggagcatgcagaagaggtggaactgaattcgatcagacgacgagtggcgcacgagtttttcccctcgtgatctgcacactcacttcatgctcaaagccatcccgacccgcacttgcgtttcgctgtgagttttgatcgaagaaaggtgggttcgaattcctgaaagtccagttttatgtttgtgtaatcaattacaactgtgccaactgcatttggagtaaaaaacgacatacggtcgtttcgaatgagctagtcttggtctttttacagtgggacagacaaaaaccggacagcttcattcagctgcgagacatgctacgttcaataagtggcaggtatgtagcgatgtagaaaaaatgccactacttgttccactttattttagtgctacctgcagcctgcgacgccataacgttgttagttagctgataatgagagctcatactgtgcacagagaaggtggttcgttgaaacgtggcttgtaggtgtagctgtacgtgtacctgtctcctgtgggtagtgcaccagcgcacccgtgtctggctttgcacgttcaacagcagcaataagacatccggattttttccaggttggtaaacagtaatacacaacattgtgccagacgccttcagcattctttctgccgagttatatggcgccactctcttcgaggaagccggggactgtactttgcttccagtcccccccatcccctgtggagaacgcttttaccgaaagcataaggcacggcctgtcatgggaagcaaaccctgacgcttgctgtggcatggtctggtaccttggatcgtgccgcaactgtttttcgtgcatgcgcctgtgacactgcttgtgccttcttactgaagcctacacgcagatgttcttcgaccctcgaggggcgtgcaactgtcctgcataagcatgagcccacctcagcggcgcaaaatgtaaaggaatttgcattcgcgagaatgcgcttaccttgtacgtatcacgaatggcgtgtcgctccttccttctggttgtatatggattttgttttaacacctctcatagctcacatgggggggggggcgttatacacgtttattgggaccaggttttgcacacttgattggtttggtcaaatgaactgccgaggtgtcgagtatcacgtaccatgtgctttggtgctctgggcattaaactgtgcttatgacgcctgtctggagaacgtggaatgaaatttacttcctagtagtaatgttccgaagagaatccgttggccattgcctccacttatataagcaaccgtagagtcaggaggcgcatgcatgtagtgacggctttgcatttaagtagtgtagtcgtaggctttcctctacagtctggcaagtgttttcctctccgctggtgaagacacagcaggcgccttttagtgttgatatagcggaccgaacagttccctagagattctacgcggccgcttgtctgtgaaacagcatttgtgctgtctctcgcttcttcgtcaaccacctcaagcaagtcctgtacaggtcttcctggtcgttcgctgcccagcgtcttgttgcgataccactgtcgaattatgatagttactcattcacgtactggtatttctctgacgtgaacaaccaccttcgcgaagactgtctgaaaaacgcccaaactcacaccatcaatacggaacgagctcttgggcacatcttcgcgactgttttcccaatcaccacagataagcatggtcatcgtggggccttccattccgctggcaaatatagccaactgatttcaccatgtaaaaagccacccacggcgcaaagagtcacccgtgagagggggcggggaggaggtggggttgctgaaaagtatcagaagaaattatgtgtgttcataggaatatgcgcattttcctgacttagttcgcgtgcaaacatctgcatctcgcatggaataatcgctgggagccaaagcttccctgtttttttagtacccgttgtttaacggacagatacccccgaatgtcttgagaatattcgcaggaggggaacctcaatgggagggtgtagaccgtggtggtaccaccgagacaccgcgcaaagaaacgctcactcgcggaaagaatggaccgtctcccttgtcttgaccgtggcgagtccccttttctctattttatcgatgacaaacaacatggaagaaaccttaggatcgcttcgctcccaattttagtgcacggcacaccaagtcgccacgtcagcacgcgacgtagagggcagtcggcgacaccatatcgcacgacctcccccctctgtttgtcattcttctttgtgatttttccctgttgtttatgcaaactggattcgatatgaaggtattccatccttgttttggaaccgtttccgtggtagtgaactggaaggccactgctttcgggtgagtatgagtatccttatacgctggtgctcggctgtgtccgagccatcagtgtgacgggccgttgtcgcggcttctatcctagacatgaacttcctactgcgatacattgcatccttctttctgtaaaactcccacggtgagcctgcatcaacgagtaggcctgacttggtgctgttttgtctccacttcactttcgtggctcctcacgttctcccgctgtccaatacccagcgtaggcacgttgcgtcagaaagaagctcgttttttctgtagagaaaggtgtcggacttttttcctttcatatcacggggcgcattcttgctggctcccaggcgaagagagggacaacctgagagggagaagcacagtgagccgtctacgcgggctgcttctttggttcgtcacgcctcaccttcatttccttgttgacacaa

SEQ ID NO: 2491 - DNA, 1643 bp, Toxoplasma gondii
ggtatatgcattcatgtgcctacccgttatgctacacagcaatatatatccctatacacatatgcatatgtgtctttatctatatgtctgtttatatgatgcatgtctatgtgtatgtatgtgtgtgaatatgcaggtgggcatctgtgcatggaagtgtgaattcacttacagaggggaatttccattcttctaagcaaatatagctaaccattttctcgcatagttagatgcttgtgcaggcgtttttgcttgcatgaacttgcgtgcatgcgcctctccagaaaaatggcgtctttcgcagaacgtttgtgtcgggaaaggaacatggcagagaaactgctgtgagaagaggcgaagctttctttcttcaagaaactgtcacggacttctttctctggaaaaggagctcgtgtcatgcaccctgcgcatactggacgcgtttgacaaagacgttcttgatgggtgtacaccgatggaaagcagacgaacataattgcgaacgcgctcgtgagtgtgatgtcactggggtacacaggctctcatttcgtcgccaagagtcacaaactgatgtccctatgtaggtgtacacttctacgttcacccatttccaaatatgtatgtgtctctgcatattttacgtccacttacactttgttctgactaggcaatggatgaagagaagtgagcgtggatgtccaaacaaagttccgcgtcagtggagagtttcgcgtcgggcattgtctccttctctcgcgaattgacgtcccccgcctttgtgcctgttccactgaatgtgaagcgacgcctctcctccggtctcgccttctttttcttcgctgttcgtctttcgctttgaagtcactcttcttcgcactttgcctccaactctttgctcgcagtccgccgccaggcagcgagttctgcttccgctgcctcgtgctctttggtctggcagacgagggaagaggcgaaggaaaccgagaagaaattcctttccccgaaataaaacgagcctgtcctgcgttactctgccaaggagaaaaaatacgcggaagccgagtcttggtgcgagaacgcggaaggcagtggattttttcgctttaccccaacgtcacgcctgacgagcatgtcgctcatttgcctgactccgcgtcgggtgtagagtgtttgcgagttgtgttggacaccgttttgtttttttctttttctattcgtttcttttccgcgaactctgctcttcgctgtggtgagctttcagcgtctttgcagtgtcttcttcgctagctcccagggacggtcttcaaacgctgttccgcgaaagtcgactgacgcgtcgttttccccgaaccgtttctctcttttctttctcctctttctcttctctctcctctctttcctctctctcctcaattctctgttttctcgttctcgcgaaaaatcgcgacttctccccggtcgagactgagacggaagtcctgtcttctccaagttcgagagaagtcgaggcggcacccgggtctctgcctcgagagacagcgcacagagcgagggagagaaagcgagtgcgaaagagagacttttcctaggaaaacggaaaacatctcttttcttcaaagtctccacctcaacgcaactcaaaa

SEQ ID NO: 2492 - DNA, 2309 bp, Toxoplasma gondii
tctaaaaaggtacgaatgcattcaaaatgggcatcttcttcttcgcaaagagatccagcggggggggggcgtccgaggtctggggagttccttggggcgcgtgtctttacggcggcttgcgcaggaggagaaacgctctcccgcacagatttggtcgctcggctgtacaccgcgtttactgacaagtcgaacagaacttttcttgtgcgagttgacccgctcgctcagaggaagtaagcgcgggtggaaaagatggcaccccaaagagttcagtggtagtttcacactgggaagaagagtgcaaacaaagcggagcaagtgccccgagcgagaagtggaaagacagtgaaacatccgttccaacagccaccaaagggcagagagcgcactgcaagttttcatcgaaatctcaccacaagcgtcaagtatcatcccctcgcccccactaccgacatgtgtaatgctgaaacaacaatcggctatcaaaagctcgaccttcagattgataacttctacgttacaccggggtgacaccgctcgcctgcagtgcacgcaaatcaaagttgaacactcaacaacagatgtctctctgtttcgttctttcctcacgaccccttctcacacagaggtatctctctttgctctttctcacgttgttcttttctccgtaaggccttgctgcggaactctgcacatcaccgctctcaagcaaaagggtcgtttgtcggcaatttgcatgcgctgcggcatctgatacgcacaaatatgtgctcgtctgctgcatgaacacagaggctctgtgtttctgtgacagccgccattgctcgagctcggcccatgtacgagatgcgcatcagtgtccacctaattcgcatgaggcttccgaaggtttgacttctcttctgtaccacccttattctcctggactgcgcgacagagctgacattgtctgcggagacaagctagtggagaaagaaagctatcaatgtgacaatagtgctttattgtggaagatgtgtgtccaggtggtgtaggaatgcttgttgctcaagtcacattgaaaggttattcaagtgtcgcgcgaatcttaccgtcttttccaccaccgtatgcactcggaacagcagcgtcgacgggggagattcacttcttcaaactttcacagaaaggaggctacacgaaggttctgtctcgtctgcacagaggcaaaccagccagctgtacggctgctccgttcgacctccctggaacgggggtttcagcagcatttctcgctatttttctcttgaggaaagatgcacagatgcactgggaagcgcagctcgaattgagagttttacttctgtgaatttccagacacagaggccgccgtcacgtctggagaaaaaagcgcatttttgcgcgggtgcggtgagcacagtaggtgcaggtcaccgtgtgtcagcgagggtctcgtaaactggtgtttttcccgtcgatttttcgtgacgaagtgcttctttttttctctgtccacgcaggctttgcgtcttcgaccttgttccctttcaccaaccaaaagccgcaacttttcgtgttcgggcaaaagctgcgagagtctgtcgaaaacgagaagctcgccggtgaccgcgggaaaagttctcgcgtgtgttctgctgcggatgcaagcatccacgtacccggcttgctcttttctctccagcttttttcaaaacattctgcggtagcaaagggtgctccttctgtcgttgtcagtggaagccgagaaagtcgagaggcagcgaaagtgtgcgactgcagatgcgcgagtcaagggaaacagcgaggaagcgaaaccgcagagccgcgcgtctccaacgattgctggcgtgatctcattcaagacacagagcgtcaaaaagaaaccgcgaaaaagcgttagcgcgtctacacaaaaaccgagtcaaaaagctctcggttccgtgtgcacactcggtcagtgcacttgcttcttttccgttccctttccaaaccttctgcttccgctcgaaaaacgctggagagaaaagagcaagaggtgggtacgtggatgccagctcctcccgtcttccgcggcaagcttctttgctctgacgtcttcttccttctctcctttcacctgcactctccgaacgcagtgtcggccgatcgcggcgcgcactggctgtcggttgtctgtttcgccgccgcagcgacatccacgttttctccactgtttttgtcacaggttttcgagtttctttgactccttccgctgcgcgaaactttccagactttgctccgccgaaaga

SEQ ID NO: 2493 - DNA, 2011 bp, Toxoplasma gondii
agtttttcggcaggaacagtttcgatagagatttcgctcttgcatgagagttcgggaacagcgacggccatggctgcgtgactacgggtagacatgtcaggagcagagtcgttgcacccttgacgtcaaggtacagagacctactgcagtacatttgcatcgtgcacgcacgtcgtggaagattcaacttagatagttcgtggtaggaaaaccttctgcatgtaaccatcggcaagcagctacctttttcagtaggcaaactcacccgtccatgcttgagcatcttcaacagtgcgagggacgaaatgtacacctgctcggaggtatcggccatcggttggtcgcggttagggggaccaactcccattcccccaaactgctgaaggagtccacgaaggttcgaaggcaggcccgccattttgcttcgtcttatggaagagcacagcgagagctgccagtgtgtcaggtaagatgcaaattcgcggcaagcgtgccgaagagacaaaagggataccaatcaacttccactttatccacagagaacggcacactactgcaggacagccgacaaaattgccacggggagagtcggcgcaaatggcagcacggcagagacaccactccttccccgggaaccgcagaaagacgactttgcaaagagcaaggaaaagtcacggcccacctaaagcacgagcatggaagaaagtggcttacttcgatgaccaagacgaggggaaacccgaccggaggttgcaaatggacgcaaataactgtggaaaaaacaggattaccggggtgtacacacaaacgcgacgctacaggcgctgcagagtctcctgcgtttgcggaaaagacaacgccaactgacgtcgaagaagcacaggaaagaaaagcgccgtcagcacagcggaggactaggagaaaaagtagggaaaaacgagaaggctcagaagaaaaaaagtggattgcctgcacgtgcagcagtgtgtctacacaaagcacagctgacaggaatggcagacgtgacgagccgtttgccacccgccaaaaccgcttcaagtcctcaagaaacttgttcttttcccgatttccccacacagtagcgcaacgccggtgaatttccatcaaatatgctgaaacgaccctctctccgaggaaaaaactgcagtccttcacgagagcccgaacacgcgcacgcttctgtgcggcggtggtgatgcatgcagacgcaatcgtaaaggtgctcgaactcaattctctctcgcgaatgctcagcctctagaactcctgacttatgtgccttagcttgcgtcctcgttcatttgatcggatcatttctcatctatgcagcacccttaggctgtccatcgcaccacgtggcctcacgaaaggcacacaagggggaaagtgattccagtcaaatctgtactctgctgctcgctctttgccgctcgctcttttcaggacttcctggtcaccagctctgccgcacgcgcagtttttgcattatttcttcatgagggacgtgccgggtctcactggctggtttttgcgggtgaatgctgccgctcaaggccattcgcaacgacgcgctagagaaatattagcttttaccttgcctactgggactgcctccttacaacaacgaccccgagagcacaccgctttccgttctgcggtccgtgtttgcctctttcatgttctgtcggagcaaagaagtccgttcaccagggtagcaagagaagtgtgtggaaagcccctctggcttgtgccgcccgaaccgagggggaaggcgaagaccgaactgagaacggctgtggccgggggctgaagcgagagcatgcagaaagtataaatacaactcaatgcatgtaaatcgccacatgaaagcgaaatccaaatctctgtgcatggaagtgtccatggctgttgccagaggactgacaagggggagaccggaaacagtgccgtgcgccgtctacctcgcgtggaagcgaagcaagcgcgacaa

SEQ ID NO: 2494 - DNA, 1743 bp, Toxoplasma gondii
aaccgtgaaaacgaagcgccctggtgtgtcgcgtttaatagcttacgtggacattgccttttgaagcggctcgcagggttgcacctgtatgtagacgcaggttagagcacagcttggcagtgcgtaaatgtcagttctgtttcacaacggttcgctaggtttccgagtccgtgggtctccgaatagcagtggtagaaatccatgactatcctgaaaggcgtggaacctgtaccggcagatgatagtgctgacgttagctgaattgggtagcggcggatgttcgaagatgagacgcttaccaactaccattcttgggaatgcctccttcccagttaacagtgtggaggtgaggggtttagacgccaaatgtatctttggcaaatttggaacgacagaaaggttcgcggacggtcttccgtgcgctggagtcacagtgacgttgccacgtgtcaaatgacatgcgaaacgcaagggaagctaaatctttggaagaacagcagtaggttacctcggtcgttgagtttttgtgcgaaattgaggatttctgggccgcggctatcgaatttcgtttgagccacgggactgcaattgacgaccgacgcagcgtgctgcacgccggcacgaatcgcttgcttcagaaaggtcacatcgcctaaatagtggagagagtgaggcatcgatttgtttttcacgcactcaactgccccacgcacaaatatgaggaccccttataaatcctaaagcgatttccaacaaccggtttcgttgaaaacgggcgaagagcggacgcgtcagacttcgcagttttgttcaggtctcctcacactcgaaaaaagagaagtcctctccaagcgagggcagctgaacaaagaaacgaggcttctctgtaataagaccgcaattgtcgaacgtgttcgattcgccaagtgcaaaccaggagggaaacgtggcggttacagaggcactggaagtcgtaacgcctttttctctgggttgaacggaccaaaaggccggtgaccaggctgccactgcatgcaaagaatctcgatttttagactctctctcttttctatcagcaggacgccctcagttttgtttgctggagcatgcacctttcgtctgatcgggggttcgcccgcaaatcatacagcaatcgctttgcttgtgacacacacgcaattttattaaggccgcgcaaatgaatcagactgcactttttcgcgggtttccggtctctacatgctgtctgcaaaaggcatttccttcaacttgtagacaaggtaccagaacacgtgatttctggagcaacgctctaactcaactatgtagcagacgcaggctcttgttggaatcgacacagttatgtgcacccgaaatttgatttcccgaaaatcaagccttacccttgctttatttgaagacggtcgaatgttttcgagaactctacataaacacgggccagcgtggccaacggagcagctgccccattttcctttgacaccaaacaccccgggtacatcgagacgacacgcatgaaagcatcacacaagcgagacttacttttcggctttcattctccgaaggcacaaagaaactccatagacaggaaaaagaaagatcgtcgcaatttccctgccaagctgttcttggggccaatctgaatcgagacagagcagcgtgcagagcatctagttgtttagcttctcttccacgactgtgaaaccgacgctttgtctcacaaga

SEQ ID NO: 2495 - DNA, 2009 bp, Toxoplasma gondii
tacaaatctctgaatccatgcagaagcttcggcatcaatgctgtcaagctccttatagtgcctgttcgttctctgagggtcttttaccctgtttgagctctctgggtacgcacgaagtcacgacagaactgttgtgggagcagacaaggaaacaaatgcagtatacggagcaatgggtgatcagttctccacgtccgtgaaacaacagtcaaagcagcgagtcagcccttttcatttttccgtacgcgccaccctgcagcgagcatgggagtatctggagagaagaaagttagtcgtgaatccggagaatgtgatcgctgcacaggcaaaactggtttctggtgcaaatagaattcacggagttgtctctcgtggcccacctcaggcctgctagggaggcagcgggaatgtcaatcgtatgccatgtttcgtctgtatcaaagagaagaatcgaaacgaaactcgtcctgtttaaacaccccacggtaactgaacatttacgcgtgcgcaaataaaattggtgcgagctcagtgttgagaaaagtaatcatgtgtcaacacagtagcgatcactgctgtttatatgtgtttttaacaaagagcctttggagagagccagggtgtatgtgcttgtccaagatttcgtattcgcctcatctatatactccgcctcagcgattgaatcctgacagtacttgaacacagaaacggtaccagtgtggtaggccagaaagcccgtaaacgaccgatgacatcgtcactgtcgcaggtccccctgtcacaattctccttttttaacgtgtttatcctccaggatcccaaaacaacaagtataccgttttcgtcgcctattcaacgccaccgcaccgtaaaagtgagaaacagtctggggaacggtctaaacattgaaagaaaaaacaacgtatttagctgaactgtagtctcttctatggccactactcagcgtctatcaaacgtacgttcgtttcctgatctcctgtatatcccagttttttgcctcttcataggggcagtgtctgtcaaacccacaatcttggacgtggtcaccacacgttactggtttgatccctttctttccgggccgaaacaaaacgggtctgttgcagcttaaagacagtgaggagcaaaacacgccctccggtagcagtgactcatttctcgagacggaacccacaagccaataaagatgtcagactcccttgaatgagagagaaacgctgcaccatttgtctaccggagagctcccccaaggtttcttgccgctgccctctttgtatatgtgcgtaatggaaggaccagggtatcgcacatgtttcctgagcgaaacacactattcttggtagataccgccatgacgaaccggcacagaatactcgagtgcaaatctctgtggtacgtggtagccgtaaaacttatgggagtgagctagacggtcacagtctttcgcttacagcagctacgtcaagtacactgctgctttttggctgtcggcagtagttcgctccgccttctgccgaaaagattgcactccggggaccagcggagttttgcgtcacctgaaatctatttcctttcggcatccgcaggtttgctcagttcaacgaagcggaggtatctacatttactcgtagttggctgtccggagcgtaaacacttgaagccggtatttctgaaaaaaacatcgctgttatcttacccgtttcaagcagagcgggctcctctccgaagtcgaggcacggcacgcgtttccccggaccctcccatatctctgatagtaatggcagttggtgaattgcctatccttattgattttctgtgcacatcagaaattccatcctcaccgataaataccacttcagtatcgtgctgtcttctatgtcgtgtggtgtgagactaggttgtcttgtgcttttgcggtgtagcaatcctcgtccgccgatgttacgcgaactaattcaccacttcgtcccgctttaggattgacagga

SEQ ID NO: 2496 - DNA, 3505 bp, Toxoplasma gondii
tccatcaaacgggctgtcttccctcgatttcagaagtggcgattttcggtggggatgtctccaatcggtacactggactgcggaagcaaacttcagctggtgaacaggcttgctcgatttgttcctgacagaaacagaggcgccagtctttcgcgcggcccagtgtcaagccaggaagacggcgacaagtatatattcactgcacagcaacaaaaaaagctttgctcggaaagtgtgctgcctgtacacgatctgccctaggcgtgcttggtcaccgaaagcctatacgaactcagttgccaggctactgtagcgcatacctagtcttggcgaaaaatgtcagttgatggcaacacttctccataacgtagttccggactaagactctgattttcaacctgccttaacggaatgaccgtatgggtgtttatcagctccacacccgtatgcgaactgaggctacatatttctacgctgtaaaaaagctaatcacatgccttaagcaaccacagtaccaacatactggagacgcacatccttgaagctcatttgcaggtgtcgtaaaatagctgcgcccgccacacgtgacgatgacatgcgtatcaagatgacttgtttccttggttttttaaagtagttctctctggatttagatagctctttaaaaattggtagatttgccgacatgctcaagagctctgactctacgtaacagccaacattacggaagcgaccccactattgcgaacgcaaccacatgccgtacctggctttaaccgacaggaagacacaaaacattggaaccagcaggcataaaaaactcgtcgtcctcccagttactcgggggatatgatgtccggttcgtggataaatccgacttagacctagaccgcaatcttggcctgaccagtatcgattcttttatcacgatgaactcttctgtgtccggccaacagccacgggcatccgaaccaccttttggggatgtggcgtttctctgcttgaactcatcttcttcctgatgactggaaggagaggtttggatcaatcgcttccatcacactctattctcgaaaataccgttcaggtactttgggaagtgatgttacggtccggtggactgagattatgctatctgggtattctggtaccaccaaacaaaagccgctcggcagaagagtgatccagttaattatgatcgacaattaaaatccgcagtagggtaacgactccacgtgtctgcgccgtaaactttgttagtacacacaccgtacaattttgcagaatgatagactctccaaggtacaaaaaccgttgagggcaacgattcggtgacagattttgcactcaccaacacccgcctctccccttccgccttgagagtctctccctccttcgacgttcgaccacactcagtgaggaagtgacagcaagtcacttcggttttcccgaaggcaccgacttcgaagatcagcgagtgctttctgggtccgtgttacccagctactctatcactggcgtgagtcaacacaaaaggtagtttgtaaggcaaactgtcgctgaccagaagctttgccgtccccgttccaagttccggctacgatatgcctgatgcggtaaaaacccgtgtgcactggcgactatgggaaaggaccttgggtcccgaaaacaaagaccttcaaacttaaccagttgtccaattcgcagtggaagaagcacatcaacaattctgtctcggaggtgattactcccagagggtaccagaaatcagtgatcatcctagcatctgaagagtagttttctctccatgttaacattcgagcgccactattcgtccatagatacgacaagtgaccaaatgggaaccttcacgaagatcggtagagattccagaagacagtgtcgacgcttgttgcctacgaggatgggaaggcggagacactccacgtatccctttcgaaaagcaaacggttgcgctttgtgcccaggaagtgcgtctgatcgtggaggcatagcagtgggcattgtccgtgactttcttacccgtgcacacgcacaatttcaggagtccccagcgttgggtctcgcggccaacgcacccggcagaattgcggaatctctaggcactgtgcgtttctcgccagcttttcttcgtctcatcagcgtcgccccacgggggtagctccggaatcgaacacaccgcgccgcgccagagggggatctttttgccttggtgtccaggagtacgccctaggagtgttacgtccaagacttgcgtgaaacacgttaaaccatcgtttttttgtcgcttctggggaccacagaaagcgggaaaagaccggggagagaaggcggcacctacgcgacggcctcgcagcgggagtctcttcgtcggatccatcgggatcagaatggagagaaacgatagagtgtcttagctgcttcctcgtgctttctactttttgttctctacctttcttcgccgtcgcgcttcccgtcttctttttcgcgtctgcggtctagactgccacgcttgtctgaggcgcgaaaccagctcgcagggtgagctaggcgctctgcctatccgcgagaaccgttcttctccgttcagcgcagcactgtcttcgccgcgtcccccagcctttttccgctcgctttttgtccactcccgcatcttcactcgtcactttgtgcgccctaccttttctgtgactacctgaaggtgagacgctgtaccccagctctccccgtggtttgcgaggttcgaaggagcccctgttgcggggaatttcccttgaaactggcggacgagaaaccagagggtttctttgtctcgcttttagacggcagctgcttctcgttccttttaccacatgttttcctgactttttgcctctctggaagacttcaccaggcgccctaggggtgagttgctccccagggcgtcactggaccgagggatcttgtccccctcgagtctcgccttttctacttcatttagttttggacaccaaaaaactcctgtgtctgccatgaggtagttcgtgtgccacccaggggaaccttgcaacctctgccttcggagtgtctcgtttgatgtcgaaggcgggtgagtatccggaaacctttttgttttaagatttgctcgttgcagaaacctgatttccctggttgacctctggcctccatagcagctgctccacggttcactgcttcgctcggtagcccctgctgcccgcattttttttcgtttctcgactctgcacatttgcaccactatctctgtcgatataccgtctttccagagttttttcttcgccaccgatccccttcccgttcgtctgcggctctcggttccgttggttcccctgtgtgtctctgtttccgtgtctgcgttgccttttcggcgacctgtctcagcttcgagaggggcggttctttcgtccctgcctgggggtttctgcggacgagacccccgcaacttctcaggtggaaatcgacgcga

SEQ ID NO: 2497 - DNA, 2963 bp, Toxoplasma gondii
aaaagacgagcctgcggacgcagggagaggccgtagaattttctcgagtgcctcacgttcctgttttctctttgcctctgcagatacaccacagtgcggtgtgatgtcgcctgcgagagcctcggcaaggtcgtggacgagggccatcttgatacatctgtgaggccggggagacagcacagaaaccgcaaagcgaaggataacacacattcaagacttctgtctctctcccttcctctcctttctccgacttcttcttgttcttcttggctggctctggcctctctccgtgactctctctgtttctcggcctcgggcacagtgcactcgacagttgtacacggcttttgaaccctatgcgtgaacccctacaggtaagcatttgtccttttcgttattcttccagaaaaaatgcagatctacacctttgagtgggagggcaacgtcccccgtctcgctccctcacttgtttctgtccagcttgttttcgcgaatcaatttggaagattgcggatcagttccaatcaggaaggcgcagattcccgcgcgaaacgagtgctcggcgacgctctctggaccgcgaactccagagagcttccagccagtcctcttcagtttcttcagctctccgaccatgagcagaaaattcaacagcgagcagtagcaagtctctccgccctttgcgtcccccgaagaagcctcagagtgcgagccggggccagcaggcgcagccgaagagctggccatcttgattctctgaaggggataaggaagaattcacacgagaaggaacgaaaaagacgagaggttgacggtggacgcttgtgtcaggagaggcggcggccgcgagactccgacgaagtcgacgtggtgctcggacttctctgagaagcggactctgcgaggaaagacaagccacagctctgtgttcacattagtataactcaaatcaaataaacagagacattatagttcaaagggcttcaaaggtcacctaggtcgctctctcctacctgcgcgtttgcgccaaggcagcgactttcctgctccctcccccgaccactggcttttcatctggcatggattgattcaaagatggccacactgcgaagacactggatctgtcgaccgagctacttttctactctatccacccagtgttctccaaaaaaagaaacctctcctcgtctcgtttgcccgccccccccctcccccgaggaggccggcagtcgagggagcacaccggaaaggacgtccggaaatggtcaactttgacctgtgtttccagtatttgaagtggtctcgtacacagcttagcctccgatctcagaatttgcgaaatcctcgccttttcaaccgttggaaacccaagtttcggccctttcaagagagacgacacaacgacgcatgcaaagacctacggattgcttgacttcggcggagttgtttgcccgagaaccaacaaggaaacctgaaagtcccgctttcttgcgttagcgcaactgccctcgcgcaaaaacgctttcctttcctgctttcctcggaaaacaaaagtgcgtatgtgcgtgtgcccgacgtatttccgcgacacacaggagcgttagcagacagtccaatacgaaccttgacagttttgtgattcccatcaactagaaactctcagcgtcgcggcgacttgttgtgtcgcaataaggaacctaggcccttgtgtaacaacgaggaacctggacaaagcagttctggttcgcggatcatttgtacatgtgccctttttactacgacgggaacagtcagcgagattcctcccgaccgttctctgtttaagttgcgatatcttccgttccgtattccgtaccagcgccacttgagggggaaacgacgtggaatttgaagttcctttgtccatcgatcttcagtcgcagtggctcccgtgtacaacacaaattatgaaccgaattactccactctcgtacagcgccagtctccgcgcagcgcgtgcaaaaacgccttctgtctggtcacttgcctgctggagctcgaggctcgacggaattctaggatctttcctcgactgcatgtcggcttccgctttgcctttcgagcttcttttcttcgtaaaaggcatctcgagtgaatcaacctgcaagttatgtctctctgcggttctcgcctgtgtgaatttgtcgcgcgaagttgccgcgctgtcagacgaccgacagcgaagcccttgcatgaggcgggaaagagagtttttctagaagttgacctctaagcagcataaggtaaaaactttcttaggcagcaaagtggtaccaacgaaaaagagggccttgccagagaccggccgcctcggttgccgctacgtggtctggcaaaagaggttctccatgtctccgcaagacccaaacgagctatgtttcgagactcaagcggctaactttttttccgtgcttgtcgaggctccgtttgacggatctcttccttcctcgtcggcccccataaaaagcgcgactggtgcgttcgcgcctggttcggctcgcgtgtctcgtcgccaccgtcctctctcagaggaagaaataccgttttccaccacaagtgattttgtcggaaggggaaaaatactgttccgtgaccctattgagggacgttgggaaaggacagggaaagcgagagtgcgtccacactgcgatgctgatcgcagctcacgctccaagtgtacacacactcgacggcgctgcgtaaaaggcgacaccggcggacacgggagggtccacttttctttctttgtgtttttcacgttctttgcatttgcagattggcgcgcggtttttgctaactttctcttcctctcggagtgcgtttaaaccggtttccccctcgttttctcccattctctctcaacttcccctgctgtgcttctgtccatttcccccgtcctcagcgttcgctcaagtgaggcatca

SEQ ID NO: 2498 - DNA, 3706 bp, Toxoplasma gondii
tgtgtcttcttcatcggagatttgtttccttggttgaggaagagtggcatgcgtcttgatgacgtttctggaggagagaggggcgcctgggcggctgtcgttgagctcggatttctcttgatttttgtgacgaactgtttacatcgaaacagtctccgtcgtgtgacagcgagggtgcgcgaggcggagacgggaacctggcggcggtttgaagaggtttgtcgtttaggcgggggcgggttgctgtgctgaagcgatattctttcatgtgattgtaattatcacattataagcagacccccggactcagaaaacttcagaaacctagcggctagcgtgatggatgtaactgattcctcttcaccgctacttcactttttctgctccgtttttctgatgtgtgtattcgttcaggggaacaacggcatgacgaaacggaagatgcggcacttacaaaagcagatactcaagggtcgacggccggtgtcttaacgcacctgtgcgtttggtgcatattctggttgttttatctcgttttgtctttctgaaggctgaaacgtggttgacgacgtccttttctcatagaagcggggtcggatacgagagacgcatccctgttgcggtgaccgaaggcaagctgcttgctgtgctggtgtgaaaataccggaactcagaaacagtttcacggttcgtcgagaaaaacgctccggtgttctctgctggcggtgggccttcggctgtcacatggcagagtcgctcacaaattctcctctgcagataatacgttgtgttgtcgtcggtcgcgagatcttttaactccctgtcaggaaaacagagataattacgcaggaaaagctcgagccgttccccgacacggttatttgttccacagatcgcatgaatgactatgcacgtggtcgccttcgatgaaacgaaatacatcatcaagtcagaccgtcacacaagggggaaactttcgttgcgtgtcattggcaaagattcctttcaggtgctgctcgatttagccggggattctaacgttagccacgaactcctgagaaatgtgcgtaaatctcctgagtcttcttgaaaaactacgggttttgaactttccttatctagggaccgtaccgtgcgtgttacgcaactcatcagccgtactgcgacacaagtttcacagaaagagacagtggtacacgagaaaatccccgcaggcgggaggagagtctggtgaaaactttatccacaggtgaggagcaattaactcgtttgttttacctcaaaagctgacgcctcaaatgagaggcgcagagaaaggcgcgaccgctgtgccggcgtatgcagttgggttcttagcgtttcctgtgaagggtggaagtcacttgctcactgatatttccatttctcttagcaattttacaacagaaatttctctgacacctcagagctccgaccggtgttactgtcaaaatcccaggacctgccgttttgtttgaagagacgccaagagtgacgtcaggccgttagggaagaaacaaatttgcttttttccgcgaacattgcgaagtagcgggttttcaccttggagtgtagcatcgaattctatcggatttctgggttcaaatttctcgcctgaaatgcactacaccgtttggcgaagtttcgtcgaagaccagggacgcagaacaggcggtcgtttccctcgcaacgaaaagctcaaccccccctccctccctcacaaagttagaacgcacaggtctgagaagtcacagcatcacttttaattgattgcagaaggttgtagagcaggtgagcatcagcaatttattactgcactgttgcgccacgatcgggcggatgttgccagtctcgttcagattgcatgcccttgcagaatcaggggtgctttgactgaaaacgcgcaaaacggagaaaaaactctaaagacgcttagtgtatacaaacagtagcgctttctcaatttgtcaagtgccgcttttgccgacaacggcaggattcgaacctgcgcgggcagaacccaatggcttagcaggccaccgccttaaccgctcggccacgttgtctcccgtcctcctcctcctttagaacagaatcagatcccagccgccgtgatgtgcaagacaactgcacgcagaaagcaaaatctcggccataaaagctccattattggtcgattcagatgtagctatagtacctcactcacctgattatttactctgtctccagcggcgctactcgagctgattgaggccgagaagtttaacactcccttttactatgtcccagactccatatcaaagaaggaagtaaacattagtacaagtatataccagaaacagcaacaacgaatgtgaatcacttcgagcagcaagcgtggacggaccggggatcgatcccgggacctcctgaatgcaaatcaggcgtgataccactacaccatccgcccggcagtgactcgggattttctgtgcaatagcgtgtgtgaggaacgaaagctgcctgtcgtcatactcggttttgatatgtggcatgtacacatccgttgattctttcatcttttgagggagatgttgaggcatgaggagatgtcagggcagacgatgttcttcaaaatgctggctgctccagcgcccagcttgtcggtggcgtgtgtcgtcaaatcgtgaccgctccttttcggtcacagccatgaaaactatggctagtcgtcaagtctctcgaaatgaatttagtaaagtgtcgagccacatcctaaaattgtctgcaacacaaaggtcggcggcaattcccaagtctgtgtcatacgtgcgagcaaggatcaacagtcaggcaagcgcatgtatagtcaaggccatatgtaactaagtccctatttcggttatgtacagagtctcggtcccctgttgctctgttccatgcagcatcgctctagagatcgggaacagcgtcaggagaataggtgtcaagcaacagggagcttcgttcttccatacacccatgctactgcttgccggagaatactgtagaaacagaggcatcgtgaacttcacgttttgcgtggacgctcgtgagggatattcattcaacaactgttttctcttatcgtttgggaaatcggtagtagcacctctctgtggtcgcactgttgctaaaaaaggcttgttgagccactcatccttacttgagacaaatctgctaccacacacagcaaatcaggacatcgctgtaatgtgtctcacaggtgagtcaatgaacgaccacagcgacatcaatttctgcataaaatggcacggtcacagagttttgcgatccctggacgaaagttgagagcgagggaggtcaagatgtttgggggattctgtctcgtgccgatgagccacaaacgatatatttgcacgaataagtgcgggtgccacattcgttttgtagctgttccgcatgtctgtggttctccaagggagaactgtattaccgcactcaatccgatatgacagtgaccgggacgtagaacacctcctacccgtgcactgaagaaaattgaagtgaagcgtctttttcattgcgaaagtggtgatcaaactggggacgtctgggctgtattagttgtgcgatggcggaaagcagatgtctccggtgactgggacatagaaatcgattacaacgctaactggcactttaaacaatg

SEQ ID NO: 2499 - DNA, 2606 bp, Toxoplasma gondii
ggccgatatgcattcgtcagaagggaggcaagcatctaatctgttttttttttcggagaagggaactagcaatgcaaaaggagcaaagcgtgtaattcagtgaatcgataagaggtcgtgggcacggctcgtcgcttgcgttgtttcgccgtttctgttccagctcgccctgagctgagaagcaggcacaccggtcctttgatacccaactatgtaaagttcacagatgctgttttctacgttccgatacaatacgtcggctgaggagcgggattccttgctttgtaagcattggcttttgtggcaacccgtccaagaactgattcgctggtgggttcagtgtccatgactacctggggcctataagcattccctcttcggagtgcagctgacgacaactgcgtgcgcatcatggtcgtagggatcagcataaagccatgtcgacgtttgttttgtttcgttccgttctaacaagcaagacttcgcgacggggctagtattcagttggactgcgacatgacttctttcatggaacgaggactgattggacacgcgacttggtggcctactcccaccaggaaaaagtggctcgttctctgtggtattcttttagagttcgatcaaaacgaaagcgagaactttagcattttcaggaggggagtcttgctttgattctccatacaaatagagagatgtggcgttaggtagcacacgaaagctagctatcttgatttgtacttgatataattaccgcggacaagcattcagccacttattgaggaacacccatgagcccaaaaccataacttcggaatttcagtggtttgtgactccaaatccattatcgttattatagatggatggacctaagtattcctgacagattaaaatcaggaaagagactaccaaagggaatgctgtgacatttgtacagttagatgctagtatgatcagtactgtcgttctggcagtatcatcaagatagccagtgttgtagcccgtaacagagatcctgcctatccagctccagactggaggtttgacgtggaattcaagcagagtgaaataaaggtaaagttcacaacaacgggaaagaacagtccatgttattacagcgtccaatgtcgggtcaccctgaaccacatccaacttggagcaaccgaccgagttttcctccccacggtctccctctgtgtggccacgaatgtggcaggaaaaactcaagctgtgaataagaccacgtggagaggctaattgaaatctctagcgaaaatgtgcacgtttcatttcccaaaagagcgcactacatctgggaacaggaggagatgcagccgcgtgcccagcaactggagtcggtgattatcctgtcgcagaaagctgtgacacaactgccttcacaaaagtggagtttcgcctaaaagtccgtctcaaaactctgtaactagcatggagtaaagaaggcaccgaatgagggaccacccgtcctgacctcagtcaaagaagagccgattccgcccttcagatggcgaccgtttcgcaggccaactcttctcaacagtgcatgcaagaaaaaaaggaattcgacccgcttgttaaattccgacgtgctggtgaaacaccggtgagagcaatgcgttttttcatccattccgcatatgcattttgataaagaactgcttgcggcttctggcgtggggtggcgagaacatttactcgggcttaatttgcgttagtgcgctggaggctagacacagtcccattgactatcaagaggccggagacgaaacggattcttcccgttcctcagagcattgttcattcagactgtagtcctagaagaatatgtgttttctactcccgaatcgctgtcgaatcccaaaggagcactctaccccagcgattgtccaaaatttcttgactgaaactgtcgcttgcgtcgtgtttcgtctgggtacgtcgtgagcattgatcctcagttcgtccgccccacacgtggcctacggtcgaaatttattcgcttgatgaagaaccgagatgtttcctctctatccttcttgcaaaacgctgtccgagtcacttctgtgactgcatgcttctctgattggctcgtcaaagagctcgatactgtagtcgcccaatcagtccgtggttctcgctggcgcgtaccgttttcgtggtcacattttttcatggagaaaagggatccgttttgtcctccgtaatttgaatcagtctctaacatcctatacttttggaagaggtgtcgccccggccggttcccactcaacgagagcactgcccaactggaaagtcccgtttcctgggcaagctcgcgggtgtttctgtccagtaccgttttcggtgtacatacacccatctctacacagcaaaaccccggccagtgaaatagcgtccggcaatatccgtgattctcgcgtttctttttactgtttagcctccgagcattgttcgcctcacttctgctgtttctgttcctttttcggaaagcttcggttttttcccgtgtgtctcaagcggcttgtccccgccgtccgttcagacttaccagttgccgtgtttgtccgtccaagcgtcgtccctcggaa

SEQ ID NO: 2500 - DNA, 4578 bp, Toxoplasma gondii
gctgttagggcgtgtactttctggtaagtgccagtgttgatcaccccgaaacctagtgtcgttgtgaacatgtcatagtgggatcatgattcacatatatgtcatgctgttttgcattgcgtgtcttctgcgctgtgtgtagggcgagcaagcacaggtggcgctgaatatccaggcagacctgaccagttgcttcaattggaacacgcagcagcttttcgtttacgtcattgtcaggtacgagacgccgaagaacccgcgcaacgaagtgattgtctgggatcgcatcatcaccgaccccgatgatgccataatagatttcgagggcgttataaacaagtaccctctgagagacaacggccgcagtctccgaaaccgcacggtcactgtcgctctcgagtacgcgtatcacccggttgtcggggtcatcaaaagtggccacgtcgcctcttccacgtacactctgccgtcctcgtattttcggtatgccaaaggcaactaaagcacaggaaacagaacaggccggctactgagttcggtaaagagactagtaggtctccaaacagacggtcgcgaaaagacaccgcacggcggaacaggctttcccgctcgctgtaaaaaaaattcggataaacgcatggaacaacaaagcactttgagggagcaaccatggaagggcataaacaaggaaaacagagggcggagcctctcatgtaacgggaaccactggcctgaccgtgaaggcaagcgtctgtcaccgcactgtacggcgcaacaaaaaaaagttcattttggggtttcagtggtatgccaacgttcttcaagcattgtggaggtaaacacaccagtttcggacaaatgtcgaatttctgctgttctgcccgagcttatcttctggatgcagaggttattctgcatccgtccctgcgccgtctacgtgcctcggtaaacgattgagtgtaaggcaactctgtgatttttcgaagacgaaatccggacactgttcaagcgaaacggtaatcacaaagaaaccctcctcttcagtatgcccgccacccaaattctcacatcagtccgctgcggcctaggagcggaagtcccatcacaccctgccttagtgctgcgagcaaactcgcccccgatccactgcgaagcacagaacagaaatggataacaactctgtaattgtatttaccgagtccggaagtggtattgagcgtaacaacatgcacatacgcgtggaccaatcatggtggtgatagaaatgcggtggtcgttgcgatagtctgaggagagtggatcagagggtcacataagtcgagccggtcgtacccgaacgtgggaagcgcttctcgttggtgacgattagcgaaatctagatgtcccttccatgatgagtgctctgcgtttcttaagcatcgttcaatggtagtaaaaactttctattgctggtcgccgaatactctcttctcacttaccacacctgcctgctgcatcgggaccttctgctacctaccaacctccgtgtaaacctcgggtagcgttctcgctcacacttccactgaaagcactttttgcacgttcattggtttcccgacaaagatacgaatgtagctggtgaagatacaacgacagccgtcctaaatcaaactgacgccatagataacttgcgacttcttgcatgcaggctcgctgttgctgccgtcaaacgatcaactgtgacaggtgctgtggtcagtggtgtagagggctgattcacagtaattttcttttttacattctgcgcgacgtcttgtagcgtaacgacttaagtagagtcgcatctgtagtctgcaaactgcgatatgggacagaacatgaatcgaggaagaatctacatgatttcacgtgctgacgcgacgtgcgaacaccgtgagaatgggtgttttgtttcacgtgttgcgtaagcgaagtcaagcgggggagcattatcatctcggttacttatggtagtgccataatcgcgttctaaaagccccaaagtttccgcctgaccactgtcaaaaagctactgaattgttgctatgcttgtgctgccgccgcagtccagcttcataattcagagaatcatcgggaaagacacggtacttcttcgcaagttcggggcggtccgcacttgctgatagggtcggtcaaatttgatacggcaccagaggctttttcctgagaaggcctcctcggacacactcacgtgaagccactgaagattagagatatgcagttgcgcccggggcaccgggaggctcgggggtattgcatacaagaagaagcaagcgaatttgctcgaatttcgagagggaggacggcatgacacagtcaatgaggcactttttgaagatggagagatacggccagaagagaaggctgaagccataggggctgatgcagtttatctgtggaagtggcgcggaagtcacactttcgatcatatccgcgtggcgcttcagagcagttgacacatactctgcttcagcaggtgacatggaaagagtgttggtaagcaatggcaggcagacatgttgtagatcacggaatatcaagcgaatcgctttctgagaaagttctatgtcacacgaagagaccgatgggccgggaagccccgggaacggcgctgcctccagtcctgtcgcggaaacgcagggcgccgccagagctgcagcgagagctgacaatactggagtgataaacgccaaaagatttctcaggtgtaactctgaacccagtgccgcagaggcggatggcgtctgtggaagggacgacccaacagcggctgttttttcctgatcaaaaagatctatttggtgctcaaccagagctgaggcgtctccatttctgcctcccgtcgagcgggtgtcttcgtcgtacgagactgcctcggtagccagagtatggtctgcagacgtttctggcagctctgaatcaagaggccagggtggcaagaattctagcggaacaagaaggctttgcacagcctgaaacaaagagacgttgtggcacccaaagacaaatgcacgtgtgtgagatgagatactccggacgtactgaaaaacgcagagcagtgccagatgatctttcaacgttaaagagcaggaaaggcatgttatacagtacccagctcgagtcttgagattatccgagacaatcgggaagcctcttgacttatcatttccaaaacatcactcccgcctctttccacatccagaacaggaatgtcaggtgttcgtgcggcggcatgtggtaccgttgcacacgcgattgacagcacacacagcactgtatgctgataattcaatctgatttcctatagtagctggaactgcctcttgtcgcaaaattcgaattctctcacctgatgagaagtatccccatcgctcccctccacatcacgaggccgtaatgcccacggagcagtcggtgcagtctcagattcagtgcagtagccgcatccccatgcagccgcctctccgttctcttcccatgttgctgtggcttcagagcgggtgttatcagagggcaacgccgcaacggcgggagagctgccttctccgaacactaagtctggacaggcctcagtgaggattcgctgcgactctgttgtcagggcgcttgtcgctagggtatctacaaactgagggaagaaccgcgttaattgctgttgattgtcgttagatacaggcccctcggaggactccgcagtcaacatgctggggcatcctagcctggcaacgacgttagcagaagtgaagcatgtcgtcctgtggccggagacctgtcgcgaatctacctcgttggtttctgagttaaaccagacggtagcgcgctcgtcggtttctgaacgcggttcaccttgcgcctgcgttgaaaccattgctgaaggacacgtgctgggttctgacaaggtagcgaaactttcgcactgtgcgtgaaaagagtcggctggacgccgtcgttttcgtgaaagggtgcgacgttgaggtgaagcaagcgatgacaaaggcgccaggtcctctgctgttctgcacattgccggtcgcttgatggacccttccagcagtagtggcagcgaaagcgattgaaatgttggtggacaatgttcggtggcaggctgagacgtttccggaggcgtaggatcatgcaaatactcgggggtgaccccagcgtccatgatgaacacagtgatttgatacgagcctaaaaatgatgcgatcgaataatatgagggtaggagaccggccatacgggcaaagcctgttcttgtgagtcagaagcatgatgcaagagtggcatagcacgctatgtgaaaaaatggatccagacgtgttgacctaagaaaacgcgccaacaaaaggggaacgcctacactctcgagcaagcgaagatggttccagttcgttgtggtgttccctggtacttctgctgagattctacactctgggcacggcaagttactccaggacactcctgggccgatgacgcttgatagccatgtgaaaccacagttctttctggccttttgagaatatgtaggtaaaatttcca

SEQ ID NO: 2501 - DNA, 2324 bp, Toxoplasma gondii
tgtacagatgcacaaacccggcggtctttcccatgtagtagagacgcgcgcatgcgtcctcgaccatgcgccccgtcagcatgtcctccagcagcatttgacccacatagggcgagaccagctctcggtgttgttgctgcggcgagagacagctgcggtcgggagagctgaaatctcctgtctggtttcccgacctcgcagccgctgcagacagcgtacgtcgctctgagccgagcatcgaagggcactcgtgagagcgtgaggctgaagaagccgttccgccgcgagacagcggcgaaatggcgggagggtggactccagaaaggtgggcgctggaaggccgagcgacagcagctagttcggaactgggaacagagtgtcgtgctgtctctcgagttcgaggggaggtcttggccccgtccggttcaggaaacgacgtggacaaggagaaagacggcgcaggggaggtggaacctgcgagagttgcgggtgccacgaaggcggcggaaatgccgttcgagggagaagagagcgtttgtagaggaactgggatccgaggagacagacggaccctcgcaacatgcggcccaacaggcgtttgaggcagagagtttgtaggtgcagacgaaaaaaccgttgggagcgaggagggcgctgaggaaggattcagagcagaagcgagagtgatgcccacgaaacgcgagtctcgaaggacaggcgacgctacgacggccagaagaagaacgatgagtttaaaacgacatgcggaaggtaagagtcgacaggatgcaacacggcagagagaagaaagctcactcgtggtggagacacctgtctccctcgagaggaacggggagacacgagaggcccccattctgcccggtaatacaccgtaggcaggcctggtgcggaaaaagtgaagagtccgaaagcgtaaatgggacagaataagagaaaaataaagtatgcaggtggttgtcgtctcttcgatgtcctcgctttttccggccgagaaagaggcgtggaacacacacgcgtcaggaataccaacagtaaatggttaatcgagcaaatgcggccttcggtgcactcagacaaacacgaaatttcgggatttccgtctccattcgagagcgaaatgtctcctccaatctgtatgagtaataaacaacaaccgacagtggagaaaaagtccaagcgccgggacagagtgaggtttccttttgaactaaatggtttaacgaatttgagggcgggacggtgaacgtcgaaacgactgatgtgcacgcgaaacacactttctccgtgtcaaagtgacacactcacatatacttcaaaggacattgtctcgcttcgctgtaacgggagacaggtctaggaagacacatgacggagacgacgtgggggcaacagcgaaagcgaaaagtcgactagaaattggagagatgaggcggtgaaaaagtcaccggggaaaagggtgaagaactgctggcagactagagaatgaaaacccgagagaaggcacaaacatcctccagaaaagatagtgaaaccagtgttcaacgcgaagaagtgctgtgtgtgcgcctgcacactgagggttgcttggccgtgaagacactgccagagacaggtcgccggagagatgcgagctgagcgattctcgtgccgttccccagagaaataaattatcgaaatcacttgaaaggaaagaacaaaaggagacattcacagatgaactcctcaaaacgcgtgcctgtggaacgagttcgccgtctcgcctttcccaaaggcgagacacgacacgggtgcacccgaccttgtgtcagcagctgagaggctcgggtacacaccccggcactttggtttccgtcttcaacgatttaaataaaaacctattcggccactggtgttaaaagtaagttatggatttctgtggcatctgcctgtaaattctacggtcgcaaaacttctccgtatttcgctgcaggggcttttctagtctcccgagagtcttggagggagcgctgtcgatgccgtttcggaatataggccgaatcgacgccccttgtgaaaatgtagagctatgaggttgtttctgtagagtcgcggcgctcgtgttgtcttttcgcacaacgctcatcgggattctctgaaaacaggagcagtagcggctttacttcgaaggaccaagtcgttccgtctcacactcccatggttttacgtaagagaacgggaaaaaaaactagagagcatttgttcgggcagccgaatccttttccaaagctcagaggcgcaggatggcattgttggattatctgtga

SEQ ID NO: 2502 - DNA, 4969 bp, Toxoplasma gondii
agaaactcatccgcagcgttgctcagactcaaagaaaggttgccaccaggtgagagagaggctccgcgatgcgagtgcaacggaaagacaaggcccgagacaaaaaaacactccaacgaaacgatcgggacaaagagcttgcctccaatccgcctcacacggggtggccgtacctttacgcagtccgaacggcttctcaagagatcagcgccctgccacgtctcgcgattcggactctcgggaaacaagggcccatgctgcttgtctccatctggcgtttatatctgaactagagggcacacaggaaagcgcgggccgcaggccgtcggaactctccgtgtctagttcaccgaaaatcagttttccgtttcaggcgtagagaggccggtgtgcagctcgagaagacctctgtgagggggcaagtgtctctcagctcagcggctcatgcatctgtaaatgcgtctttcgagggcaggtcttcgagttacaaactcgcttgtttttctgtgtctcctttgtaggtcaccagactattttcctgtcatcgtggctgcctccggatcttcggagcgtcttcgctcgtcttgcgcgggtcaggtccttgactatcaacgccttggggactcccttcgtatcacccgtttctctcctacattccgatcaagcttctgctgaagccgttggtgctgcgcccagccctccgctggtgtctcccgtgtctcattcggcttctttgtttgcttcgggttccactcgcctctctcgcctgtgctgttctccttgttccgttcctctgtctcctcccggcaccgcttctctgtcttgtcccctttcttctgcgtttttgtcgccgtctccctgtgtcccgcggaaggacggggacgcggaggaagagctgtgtctttcgcagcaaacgcccgagaccggcgagaacgaggaagcacacaccgccgcgcttctccgccagccttcactctgtggttcgccacacaaggagacggggccgccattttcgcggggtccttctcttcgcgaaagcattctcgatgtggaagagacggcaggattgtggggtcccaaacgagcgtccgagttcctggcgaaaaagcagagacagtggagtgagcttcagcgtcgccggtcacgctcccaccacagcgcacaagagcggcgaggaagcgactggagcagggaggaagaggcaataatacggggggaagtcgttcgctcggagtttgccatttatccggcagacttgcacgctcatgtgctgtttaacgtgttgatgagtgaggcgaatcgagttgcgcaattggagacagcaagagagggaccacacagaagagccgaaggacagatggcaggggacgatcaagcgtgtgacgtgtctccggaaagcagagacagaacttaccgagtcattgtttttttctcgactctcaagagtctacagttccattatgtcttcttcaaacactatgtttttccggcgctcctcacgctgaagacaacggaccccgcgacgttttccgctctgtccacgtacccattcgtctcctcttcgtccggttcttatttatccgccacacattcgttccctttatcagtttctttctcttcttcgtctccctctgcttcgtcgacgtttcctccgccgccgctggtccccgcgcgccttccgaaactctcggccctgcatcacgggctcagtatcgagagacgtcgtgcagtgatcgaggctttctcctcttcatctctggttcctacctggtcaccttctggggtcgattctgctgctctcgcgccttcgcagttcgcgtccgggttgccgacctctctcgtgggccaggcaagccacaggcggctctcaaaaagcgggagagagcgacaacaaggatctcttcacggccaagagccgctgccccaggtgtccagcaatccgggctacgagcttcgcatcctttttgccacagatgtcgcggctacaggcgtcaatgtgggagttgttgactccgttattcacgtaaggaaggtagagggaggctgacagggacatggcgtttgaggggagagtgacaagcagcagcttttcagtttgccgtcggtcgtagggatagggagcgcaacttttgtgccgtttgggtgggcgggaagcgaaaagctttgtttgcttcttcttcgccctcttctttattgtttgcacacctttcgtgcagggttttgggagacgcaaagaaaggaaccatctgtgcaaactcagtttgatcccatttcttcgccatctgtcctgttgagtccgccacttcctcggcatggcgtgagcggcctcaagcctgtgtgggctcttctgtgggtctcccctggtgctttattgcgttacttatcgtgtttgccgcagcacacttttgcttgtgctagctgatcagtctgcttcctttctctcttcgacccttcttcgcgccgtgcttagatgttctctgcttccttcccatcatcccctccacttctgggcgtggtcgtctgtatcgctttctctcgcacgctacctgtctgttctcctgcccgccccattcaccccctgcccgtgctgtctcttccagcgactgcctcggttgcctcttctgtctctccatgctgtggccgcaggccgggatgccccgtgacccagagcttctcgttcagcgtctgacgcgtgtcgcgcggtaagcacaaccttggcggagactgcgagatggcagggaaaggaggcgggcgagatggagacacaatgacggggagatgaaggtcgagaagggaaagctggttgaaaaaagcagcagggtcaacgtgaatacgaatgcgaacggggagcatcatcggagtaggaacacctgatatcctgccgcagggcgccgtacggcgtcttcgcttaattcacacgtttccagatctcataacttcatgttctcccccctccccgatgcgctccgatttctaccgggttctgctggctccgacgaccgcaatctctgcacatggcttcccgcttgtcgcctttcggtttatcgtgtcgtttgtctgcctcaactgctggcgtcgcctcccactagtcctctcttgtctgttctcgctcgtatctgttgcctgtagggcacggggtccaactactgcgcctctctcgggttcagcagcccgtccacacgcgtctttcacttcatttgcctcacctccgtcttcctcgggccgcgtctcgtcgccaccatcatgggttctctctgatgcatgttccgcctcgcctctatttgaactgtccagtgaaacatccgttggaaggcagggacgaagcgaggaacaagaaaacgtcgaaatcgaagagaacgacaaccatttttggcggctccacgccaaacgccaaatcgggagatctctgcttctccttcatgacttagaaagccactttctttttgaatgcttctccgaaggaatcaatctcactgaactccatcctcggtatgcgttatctctgctgagcccgaatcgtgcgcttactgcggttttaagtgagaggttcgaacgaaagatgttccaggaaaagcggaaatgggaggacgagggacaaactgaaagggagactggaagcaatcggggcaggcgagatggcggcaacaaaagaagcagaacccatcgctcccactctcttttcatccgccaacgccgccgtcaaggggcaacgtgtaacagcaagacacaaagagacgtcgagagcctcaaaacaggagacgactgaagaagacgcaaagataaaaccccggaaggattttcttactccctcgcaggcagctgcatgtcggtggttttcgggagtatggtggcacgaggtaccctccctgcgcgcctctgccgaccttttttaccgctcgttgctcggcttctacgccatgcagtcgaagcgcctcaaaatcaacaagtaacggaagcagaataaagagttttacattcacgtggggatccagtctctcacggagaaacgtgtctttccactcgcgaagtcccccgtttatgcgaatgcatgtttgtccgtctgcgacgaagtccctgcatgggagcaccttagcccatcgtctgaattaccagtgaaggctctaggcatacgtgactgcagttttacgggttcttcgattatcacgattattcatgtacttgcacaagcggggaacatctaccagcggtgcgcgttctttttagtactattcgacaaaatccacaagaagctgtcgcttttgtggtgagcacgccgtttctgccgacaaggacacgctcagaaaccgacaaagtgtgtgagaggggtgcaaagttgaaggaccggtatcttgtacgtccacgtattttcccagtgtagtttttacccattacacgcgcatatgctggaggcacgactaggtgagcacctattgcagcacacgtcgagcggctgatcgcgcggggcagtctggcagcagatgactgcagcaactgaccatttttgttgagcggcagatgggttgataccgacgatacctgttccctcaggaggcagagacaccgacgacatcgatgggatcagctgactaattatcgataacggctacaccaacatcctgaacacccggagataacacagctggtattgccgaacagcggtgagtaatgggccacaactagccgacgcggcggcaccggttgcccttccgggacccacggtacgagctggttgtcgtcacctgagaaccattacaacatcagtcgaatataagcgtacagattcgtcactttcacttcatttgacttccctgttttcctccctcatcgcaggtctcgtagaattgcctatagtccaactccgtctcacctcccatccctgctctctcccctgatcggcagtggtactgtgtagcgagattgccaatcaattcccgattttccgaagattgttcgctagctgttagcaata

SEQ ID NO: 2503 - DNA, 1799 bp, Toxoplasma gondii
cacaaaactaaccaatttgtggtacattcacctgcgatattcagactgaatgcagacacagaaacgaagctcccgacttcgtctctgcggctcgccaccatttcattttctacagtttctcagatgccttctcaccttgtcccacgatgtggcggccaggatgctcttcccgtggctgggagcgtagcagagagatgagatgctgtctcgcggctcgtgccgcagatcgatagacatcttggagataaatggaggaaaatgaactcacgaagaatacagagtgccacggctcgtgtcgatggaggccggtgtcagcgcactcgcgtcaggagaaactttcagaagacaggaaatccagtcgagagacacacgcgcaggagttcgacgaacagtctggactttgcagcggcgtgactgcaccgaaacgcaggacttgcttttcgttcaccgcttggacaatcctggatgacacggaactcgaaacgaagtgtacgtacacccggcttgtgaggaccaaaaggcacggacgcaaggcaagaggagaaccgttaccagttgcagaagcaggaaaaagacgacagcgtctgtggagacttacgctgtgaaaactgagacaaacgtggagacgatacggcgagaaacaagaggtcgagtaaggaaacgtcgggcaggaagttcgtcagaggcggttgcagagaaagagacgggagcagcaatacaggagaaacatggagtagaaaggaggcgatgaggctgaagtgcaagagggcaaaacgacggcaagacaatactacgacagagactgagcaatgacggactcgcaagcgacaatatggccgtttcagtgggcggaaatgaggagccgctcaggagaggcagggcagcgaaggctggcaaggcagatggtggaacagccacttttctctggagcagagagagcacctgcttccattctttttgctgctgcgttagcgatcggttccgcaaagccggaggtttggagccaaacgatccgcgaagacggcagagtgcaaattcgtagaaagccaagtgtggtaccgagtgcaagctggttccttgtgttttagaagcggagtccatgcatgtgcacgaacagcacccaagtgcagacatgcaatcagcgtcttttcgcggcgttcctttggagagggcattctcacctcgaggcgatagcagccagacctgtttcgagaatcggaagctacagacgcggaagtataacaagaatcaacgatgtgcccccaaaccctcgcacacaaacacacatccgtcgcgcccgggttccgcatcgcatttcggtttctgaacccttttcgcgcgcgctgcccgtccgatttgggtttcttagcaattccagcctctagcgctccgtctcagcctagagacggcgtttgtctggcagctctctatacgtcgtttgcacgctcgggaggcggcggctctggccggcgccctcttgtggggagtcgcgcgacagctggggtcggatcgcatgcgccagcctctcgggatgacgcaggcgtcatccacagcgtttctctccaggcggggaagaggcgacgaaactgagggctgagggtggaaggcggcgcgaagaggctgtgcgcgggacccttttcatgcgcgctgttgtctccctgccgccgccctcgtctcgttgccgcagtacctcctcgcttccttttcagttcggactcgtcgctctgttccttctctttctgcttcgtggccgcggtgtcgcctggtgttttctgcccttccttttcttcgcgacaaca

SEQ ID NO: 2504 - DNA, 3686 bp, Toxoplasma gondii
gtgtgtcagactaatccatagacgggaggactgctgggtgctcaaatcagaggacagcagacagtcaaactaggaggcgaggggaaatgcccgggaatccgcgaagttaagcagatttgaggatgcagtagcggcgaaagaggaggcgaacacagcaaggacttcgagagggcggaggtacgcgaaaatgctggcggagaaggagtcgtgctctaggcgacgaagaccgagagggtgctggggaaaaatgtgctgcgaacttcggataggaacagcgcaaaagaataagaaaatggcaactgagagtgatgtttcagggaacagatgtggtttggaagagcggaacacttatttgtagggaattcgtaaccgtggtcttcgtaaacggaaagtcttcgagtgtcttgggtttctgtctcacgagctgtgctttgccgagccgcgtacttcgtctcgacgtcggcactgaagtgtttcttcgttcggagtcccgaagagggagttgaagaggggcaaccgttgcagatttttctttcccagcgactgccgtcatctcttgatttttaaatttgtgcaagaatctgtctgcattgtgggttttctccggtgacattgcacacactccactttgatagcaggacatcgctctagcacccgtctagttttccttgcggatatctattcttagtatttgagtcccgcacgtttaccatgtcagctgtaccgatcttgtctcgcactcttcctgccatccctcgtatccgctgaagtagaggtcagcccgttcccgctacgtacggcgtagcaacacagcctgaaaagctcagtgtttgcgtagtgggtttcaacaggccaagaagcaccccaaggaccacatgcatgaaattggtgtctcatgttagacgtcttctatatatcgtagctcgggcgaacgtccgtcatgcactttggacgtcggttgaagcacgtgtgaaggtcttgatttttacgcacgtggccagacctcagctaggacagagtaaacgccacagaaaactgtgtcgtgtatcgaacacatcctcgtttgctatgacagctatgcggaaagcgctgaccacttcagccggcccttctcacgcaaggcatcgatcgtgccctcgcgtgctcgtgaactgccaaacagttttccgcacgtccgacccagccgtggctttcgggtggggatatgcctgcatctctttgcttgcctctttcttcgtcagagtctaacattccgcgagcatagccgtcagaggccgccgagggttctgccaaaatttgtcaacacatgagaacgttatgctcggcgtgtacgaccgcaacgtcttgtgcgcatcacgccgtgaccccaggcgcttgttccacatcctggagctaatatttcagaaaggacaaggaggaacttcgccagcgtcgtaagcagatgcctacaaggctcgtagcaggttgacgtgctgcgtttgattctgccgatagcgtcattcggggctacgaacacggtaggatcatgtctcactatttgcgcagtgtttccgtttcgtttaaagcctgaaacgctgcccaaaaaattgcacaaacgacgcattccagcatatgcatgtccctgcaggtttggctgtccagtaaaggtctccaggcttccgtaaatctttactcccttctttcgacgaacgaggcacttttcggcgccttgttacaacctcttgtgtgcgagtgcgccaaatttcccgtgcttgactctgccgcggttgtacgtacaccacacactttgcctctctgtttctgtggactgtgactgcagcggccaggtgtgcgtcgggaccgccgcagtggttccgctctcctggacaagcttccccggaagcggccaatgcggagcatctcagtggaaaaaccgcaaaacggagtgaaccgggttgagtgggaaagactggacccgtgcgatgcctagctacgctccagaaccgataggaccggtacaaacgggtgcggtcgttttcgtctcgcttccccacacgcgacgacgcgttggaagactttttgtgctcttctcccacggttccttggcagtcagcactcaaactcgaaagcaagctgcttccggcgtcccagggccatgccgcttccttcagtacggtgaaagatacggccgccggggaagcgttgccttctgtgcaacacgcctgtgtgcggaactgctctcctgttcctgtcgcttctctcgtggacgccaagcgccggtgaccggcgcgatggtggtgaacgtcatcgcgcgcggtcagtcgccttttccgtcaccacacccgtcgaacggacgggatgaaggaagccgacaggagtggctaagtcgggccgaagggaaaaagcattcgattttttgttgcgaacgacgagctttgctatcttcctggatttccatggatgtatatagtaacgaacgattacttgtgagttgttttatcctttgtcgaatgattccaccggcagttatctttcggagacagagaaaaatgacgagagacagtggtgtccttccgcttccgcctcccggcactcagtggcatggttcctttattcgcccttggtggtataccttcgtcgtttggccttaattaatggcttttctgcccccttcccctagtcagcagaaacgcgaatggtttgagttgggagcacttgtcccggcagatagtggctcgaccgtcttttgtcttttctcaggagaattttgtacccgtttcatgcctgaaagatccagagcagcgtctttttcggcgtctcatctggttctcccacattggcggtgtcgtcctccgagaaggcaactgtggtggatgcttcgtttcgttcctggagttctgtaccggcctgtttctcgcctgctcactcacgacttctggacctccaccggtctttgccgtacctggttctctagcgtgtttcgagtgggccgcttccaaaaattcccgtgcattctcctgtcccgttttttatagcgaccctgtgttttagcgactgcgcgaacctacatcagcatcgtaggggagaaaagggaaacggtcggcaactgtgcaaggacgtcataacaagtacggaaacacttattcccttgttgcatattccctgtcgcggacggtgagcttgttctgtgtccagacgacccacaagacggtttttttatggaaaggacagtcgcagtttacgagcagtgtccgccttccttttccgtccaccgcgaggtgtttctgcccacgaaagggtggctccgcggcttggatgtgtccagttctatccgagatatcggaagtgtttcttgtacagtgatgcccctggagtgtttgactgacctgtagtgattccatgcattcgaactgactgtacctccatacttctttgttcgtgtgcgcgtgcctgtgtgtgtgtgtgtttctgagacgccatccgcgttttctctcaatctgcatcttcgctgcgggccttccgactgcacggtttttttgtcggcttgtctttctggtctttgcgtgggactgctgttgaccgagcgtttgcgtccgaagagggatatcaaatcagttgtccgggacgacggttccagaggtctgcaagggaggccgtcgtttctccagagttggaactccgtgtgcagaaacagcagatcggagcaa

SEQ ID NO: 2505 - DNA, 1484 bp, Toxoplasma gondii
gtcatgttccggttcaggtgcttgctcctgcctggagatgtgtctatccgtttctgcacgtcctacctgatctcgagattatatgtcagccactacacctgaactgttatacacgtctacgaatattctgcatgcacagaatggaagcgcgatttggtaggtcatcccccggtttgacttgttctcgaatatctagatgagtgtcactcgatcacatgcgccgcagttttgtttcgcactgtgttctcgtatactaaaagtgtcgcaaatatgtcaggtgttgctttcggtgcctattaagtagtttactgccacagttgagtgagaatcaaactaggcgattaatgacagctgctccaagagtaacagagcaatcttggatcaccggtgaccagaagctgtcgtgacagagcgctcttgtctaccccggagtaccaggcggtcctggtggtgtagacttccgctaaaggcgctaatgtgcagaagggtccgacaggttggatagcacacaccattcccaaatgaaatctcatcggtcgcgtgtcaggtgacgtctacacagatgtcgcttgacacaaattgtgtgtatactgagattacacaaacaccaccaaagcaaggtatccagtggacaactcagagtgtacagcgttctatgcagctggtacatgatctaaatatttaattatacgaacggtgacaatacgctgcacccctttggtcattttgcggcttgcagcgcagagcactgcgaatgagacagtagaagtgcgacagtgaaacgcctttggctcggggggatcccgtagccgaaagatatacaattaatatgctgactgggattcacgattgtgcgaatcttactctagtgcccaactctgtgtgttggcaaatgagggaagaaaagtcgccctccagcataaccattcgaccaatcggcggtgcatgcacggactggacccagcgagttgtacagagctggtcgctggaaagatgctaagaaggcagaaaagagctgagattttctggctaacaccgccactcgagagtcgtcacaggatgccagttccgagcatttccaagcctgggcaggcacgaattgtctgttttgcgtcatcttccaccatctgtcctgcagacgggtcgcggtaacgtccagtttgtctttgagaccatctcacgattccattgacgagtacgaggccgttacaacctttcgaagcgcagcctggcgtcctcagaactcaggggttcggagctctctcccgtttcgcgcgtccccttaattttccacttccctcggtgtgtgcagaggacgcaacccgctctttgtcgcgtctctgttccttcctgtggttgttcgggacggggaaagtctcgtaaaatatttcttcttcataaccaagtgcttcgattccgccagaacctctggcagagttgcactgtccactaatctactcttgcccgttcaaaactcttcacca

SEQ ID NO: 2506 - DNA, 1607 bp, Toxoplasma gondii
acttcagcaagaaacaaagtcgcgcagcaaggaagacggccgcgaaaggaggctcatgcagacagcaaggaaaagctgtgagcaggtcgagagaaccgagccatcaagacaccatctgcgaagaggacatcacgagaaacaggaaggaggaggtgaaaagagcgataccaagaatgaaacggagaaaaaaatgaaagaagaaatgaagagaggtgaagagagaggttgaggagatagagatatggcgagggcttgggagagggacagctccgcaggtagaccgacgtggagcgttctgaccggcgttggagatgcaggaaagcgcggcatgcgagtccagtaaaagaaaaaggagatgttgggtattaggtccagccgaggggaaacgtctctcctccggattcgcaagagaattgcatggcaggaaaaacgtattcaagactttcctttctctttcgtcttgctggcgacggttgaaagcgtaccggagagctgaaggaaggtcgaccggcatccaccgaggaaacgacatagatcgagaaatgtacgggagaagaaacgaggaagaaggacgcgaggcgcaggcttgcaagcgacgttgaagccagagcctctcatggcagggggcagaagagagaaatggagagcgcctctctctcctcttcgtcagaaaagcgggtgaagtcaaaaacagaaacgagaagaaaaagaagacacagaactgtctatctcccgccaagcgatggcgagtcttctctttccggcacatgcgttgagctgttgtgcatgcagccgcgaggccaggccagggcgcggtctcggcttgacgcagaggcgcggaactggagatgaagcgaagcaagacgaggtttcctcgtccctgtttccttctgaaaaggcgtggagagaccttggaaagtgcatctgagagcagcgaggttcgctgggagaaacgacttcgtctgtctgtctctctctctcgcttttctcgcttttttcatgcatcttctcgagtgggtgtgcgctgcacacttggaaactgtttttcaagaaagcagagaattcaactactagcaagcgactgtgagaggcgacagagacgtggatagcaagatacttcgctctctctttgactcttcaagccgcgctttctccggatttcctccagacttgtctccttgcagcctctccgaacttccaccgcgttcaccctccgcctcttctctccttttcgcagaccgagcagagcagcatttggcaccgaccgaatccggctaacctcacaagttgcgaatccagacctccgctgcctccacaagtgtctcgttttgtctcgaaaggcagttcttctgctgtgtctcctccttccatcttaccttttactctgcttcttctcttcctctgcttcttctcttcctttgcatgcatcttctttcctggctgtgtctttgccctctgctgcgactctggagttcctctgtctagccaccgactgcgacgatgcttcgcaggttcgctgcttcagagacgacttcgctcctgcgttgaggaagagcattcgccgtccccgaaagagaaatcgagcgacgacgaagcgcatgcaacga

SEQ ID NO: 2507 - DNA, 1431 bp, Toxoplasma gondii
cgcctcttcagactcgcaagcatcttcaaaagaaacgagaatcacaacctgcaaaagcacagaagaaacacaaaaaaattcgattcgcgtatgcttgtacgtctgcgtctgcgtgtgacgttgtgcataaacaagtacctatttatcgatataagtatatatatatatatatattggtaataatgaatgtatatatatatatatatatgtttgtgagcctgttatcctgaaagttttcgcagttcctttgaagcaaattggttacgtgtttgtgctgggtttctttttttgcttttttttgacgacgcctttctttctccgtgcttctcttttcgttgtttatttctcgttttcttttttcgcaagttcacttccgctcagcaatttcccctttgtgttgattttctctcgtctggtacgcgtccttctctgccgctctctctctctctctctgtctctctttgtctctctttgtctctctttgtgacggcttcagtcgctccttttctttttctttcacgcgtttttctccgttctccgcttctcgcgtctcttccatccttctacacgcaagcgctgtctcgtcgtcggcatttgtcgctttcgacactcgttcttttcaggtttctttactttctggttgaagggatgagcctggacggagcgcgtgaaggagacgagtccggcgtcgaggcttccgaaggagacggaacagcgagacgacggaaggcagaagacggaagaagaagttcttttcttcgccgcagaggcaccatctgagacgagaaacattttcgcagttttcttgagagactcgccttcttttcttgagagccaacacgagagcctttcctgagttctcgcatgcagacgccgccactgaggaccgatacaaaaggaaaacgacacagaaaaaggaacgaaagtaaccggatcgcgactcctggtcgttttgcatctaatatcaagagaaacatatagacagaaaaaaaagttgtaaatcttcacgaaaacgcaaataacgggtgttgaggacatgcatgcgctgaaaaaaatgcagtcacgcccgataccgctggccctgcgcatgcacgacgagactcacgaggtgcgaaggcggacttttctcgtcaaatggaaattgttttttttcagagcttctttgtcttttttgtctgtgtgcgtctctctgcttcctcctcttctctgccggcgcctccccacccgaagctcccgacgccggccgcatgcgttagctgcggagagaagaaaagagggagcgcagcagagaagaaggagagcagcagagaagaaggagaacagcagagaagaaggagaacagcagagaagaaggagaacagcagagaagaaggagaacagcagagaagaacagcaaggagaggggaagcacaagaagcgtagacggcagaa

SEQ ID NO: 2508 - DNA, 4884 bp, Toxoplasma gondii
gaagggcaaggaacacggaggcgaagaaaggaaggcgcttcagaaggtgcagaggagagagaagacggaagacgagggcactccggccggagcgaagagaagaaacgagagccccttcgtgagcgtcggtctctgagagtcgaacccagagaaggtagagacacagtcgctgcgacttcagaaaagaatcgatgtggtgccgccctcgacgagcaggcgacagctttgctggcagaagtccacggcgaaaagacggagtccgcagactcgacccgcgttgccagcggggcacaggaaaagccagacattgcaagacggcgaagcgatctcggctgaaacggtgaggaagcaagtcggacaggcagagagccatgctcagtggttgcctgtggtttttgtgcagtcgcggccagatggctctcctcgcctgcctcctgtacctcgcgtttctgaccgtttttcactggtgcatgttgcgggttcgttcgcgagaaaggagaaaacgcaaagaagggagagtcggcctgggacagctgcagaggccgcctcctgcgggggcagccgccggcccttggagccccggggagagagacgagtttcattgcggcagaacaggcacctcgaggaagccttgaggcctccctctgcaaattcatttctgattcctcgtcgccaaagctgaccaagtacacaagacacgaggagaccggagagcgacagagaggatcaactcaggtgctactcgaggaaaccaggcgaggagttctctggattgccgtgtgaggtgacggggagccgtgaagcaaccagcgactcttttcgagcattgaggggtggctctctgttcaggtttcctccgctgccgatggagcctgtgcccttttcttagcgagacacgacctgcaaatggtcttccaccaggtttttcagaattcaccatttgtgccagccgtcgacacattaaaggcccgtctggggcggacagtgcggtgcttcgtacacccgctcatctctgtctgcaaatgcgcatagactaatgacccagatgctgcgcgaaggctacagacatggtcattgagcgtcggaaacggaagacgacatcgacagttcaaacctgtctcgagtgtgcgtgtgcggggctcctttctttgttgcgcatgcgacagagaactaggatggacgcacgatggcgcggattttgacttgccaaaacggagacgacaaacggcggaagagggatcctgaggacgtgtatgaaaataaaattcccctctaagaaaggggaagtgtgcttgaggggaggaggcggtttcgagcagcatattctgtgcaagatgcgaggaaccagcgaagctaaaaaaaacgcatgcaccctcttgcccagaactctaccccagacccgttgctgctgctgctgccgcaaaaggccggtggaacccgccgccctggtcgacagccggagaccgacagccatgcgctggtcagcacctgcaagatcagctactctgacggatggaagtatgaatgtacgtagcttggcataccgctttgtgtaggcatcaacgggcgggggaggttgagatccgcacatgtatctgtgatgccaggccagacagggaggcgcaaaaaggctgggcgtgccacattaccgtgaagctgcagaactggcgaactggaggatggctgtttctctttgctttttgccatgtgaccagtcgcatttgctccgctgttctctgtcgtgtctcgcgacggcacccgtgtcgtccgattcgctattggaacagagttggtagttcgatacccacctccagcctatcacgtcacgagggaacatcggatttccgctcctctgttgccctccctaggactttccccctttcagtgctggggaaacacagatgaaattacgccagcctagtggcgtcctggagatttgggagcattcatccagctgtctagacactcaagagcccaccaccccggtttgcaagcgttgcagtctacgccagggacaatgttcaaacatcaccgacgatggaaatcttcttctgtggggtggctgcttctaaatagggacagcggtgaacgaagttgcttcttccagggaagaacggagcaaaatcagcaaaacgtggacgcaaagacctggcacagcgtcgccgcacacagccgcgtactgacgaatacagaacgatcgtgcttggaagccctccagtagggtgacggcaccgcatagacagcggttgccactcgatgcctttcttgaaaggaaaagtcatttcctttgtgctaatcctgtactaatactcggcgcgtgactggggagaaaacaacatagtgctttctctaggggtagaaaatcgtttgtttcgacgtgagcctggcacacactacaccaccgcattacgacagtgactgtttaacgcgtaaggagcgacttgtagtcatggggacagacacgcctctcaagtacggcgtcttcttcaaagcaaaaataccgatttcctccttcctgcgtcgcagacgcaagtctatcgtaatcactattggtgatcgattgagtccacgaggaatggtctgtcggttaccggagtgtcgtgtaacctctactgccacacgaagttttccctatagcaggcctcggacgaagagccctctgcccatgacggcagtacaagcagaggacaaaactcatcagggagtgctggatatgcttcaggctgctggtctatcttccacttcagcatggactgactgcatgacaccggcacgatgccgtgttgttgcgacggtgttactgttcgggatgtggactacacgcttgtacacgctagcgcactcggatatttatctacgcgaagaggtggcgcaggctagtcctttgactccatgaggtgcagttgtgaaggcgccccagcacggattccggctgttacttcttcctggagaagcgtcgggcgttaggttcgccggttccgcttacacgcggtgtacccttgtggtggagtagcgacttccggctccttgaaaggcaattgcacacagccagctcctcaccaaaaggcaggcagcgagaagtgaaccactgcgggaaacttgtagacgccgtataaggcgtgtctttctttgaaaattacgtggcgtccgagacagctctcggcggcggtacgccactccgatgccttgaacagagcggtcctccggacccttcattctctgttcgacacatctatagcgtagtcactgctcagctgcgcgtacagcgtcgattgtacggctgtagctgtcccgctgagtgccagacatatttttgtctactatcccttccctcggtgggcggcggttccgtaccgtcaaaagtttgacgctgtgcgctgggtttcagcgtgttgtggagaaagcgtgcgttggcgtcacaaaaagaagatgaattttccaggcgtcgcttccgccacgagcgagcgcctgtctccccacgagggaacactgctgtaggagggtctgtctacaaaccggcttggatggctggaaaccaattcggtacgcactttttctcgagggaggagctggaagaaatcagcccccctctaaaaagttgaacgcgcatcgaggatcgctcctcgtgcgtccgttttcgcgttaccttggtcagactgcctgggcaggaacccgagtccgatatggaacttcggggcccgttctctgcggctgcttttcacggagaaatccagggcttcttaggaaagccgccgacggtgtctggcgtgtttttcccgcgcgtcttcccactcatcttgcgcagctggctactgtatataggaggaaaacgcagctctccagaaagcagtgtgcagtgaacgggacgcggcagcgcgacctcgcgcgtggtagcttcccggcttgattcccgttgttcccttgtttttgtctcactggaatgagtgtcgttaacgaagaagcgtgtgcgttttttctcagcggacttgctcggcagagaggactgcgtggcgttcgctttcgttccggggttcctggcggcgttttgtttctgtgccttcgtgtgcacaggggtgggctgccgctctcgttgcagtggccatttcgctcgcccgccgcctgtcccgggtgtttctcgacgccaaaaagccgccggtttctgatgtcttttctcgagcttccgtcgtctcccgcttccgcgaccttccttctaggactttctcgcgcgtaacgcgtgtctctcagctcctccagcgcccgtcgttgccttttcgactcgcactcgcccgccacgggaaatgagattcccccgcatgcgctctgctgagcacctctgctcgccggccgtcacagcttcgtcttggatggtcttctccttgctcgcgctacctgctaactgcaggcccttttcaaatgtccaatccagtgtcacttcccttgttcaccgattgttttagaacgcttcctgtaggcgccttcgtcgcggcatgcatcatacccgcgcgtcgcgtgccagtccgcttccttccactgttcgtccccgactccgtgtagtttttcctcgtgattcctgccttagtgtctcagtcctttcgccgtcctcttgttcacccgttttcctttttccctttccgcccctccagccgtcactgttgctgcgaaaaggccgtcctcgcctacggggcacccttgggagtcggtcgaggaatcccacgggccgtctctctccacagttctctcttcgtcacactcccgctacaaagtccgtcagtttcttgccgtagtgttctcggctgcgtctgtcccacgactggcgttcctggtgaggaacccgacgcggaggtgtcgaatctgctcgtcgtagccgctcctgcagtcgaatca

SEQ ID NO: 2509 - DNA, 2377 bp, Toxoplasma gondii
aagggagacaagagcgagcacgaacgctgcgcaagagagtcgcagagaaggaaagcaccgaaggcgagcgcaagtccagcagccgttttcacacatccacgacagagagcgcggtgaaaaaagaaggatacacaaagagatgttttctcgccgctgtctctccctcgcctctctccttaccccgtgcgactgtctgcccggcaatgcgccgcgctctctgccgccgaacttcttggccgcgaggacgggggatggcacattcttcggaagttttcgttctttcttcagttcagctttcggcgaggaccatgcgactgtgggcgacgtcgggggagtgtcgctggccttccgcggcctcggtgcagcgacaggatcggcccgccacgaggccttctcctccagtgcatcctcggccaagatctccttcttcttccttgccttcttctcctcgatcgccttctcctccacctccttctctgtctcctccttcttctgcagcttctgcctctccttctcctcgactgacgcgagggggacggcgacggcctccttcatcgttgcacgagccgtagcaagaggctccgacggcggcgccggtcgagacgcaggcgggtcgaccttcgaatcgtaggccacaaaggcgctggagagtctctcgagcgtctctcgagaactctaccgggtcgcctcttcggaagaacagccacagaaggccgacgctgagaggatttggagaaagcgacgcagagagactccgacgccgaagcagagacaccagagaggcacaggaaggaagacgctcacttcagagaaggttcgcgaactggggacgcgcggaacacgcgaacgctgtcgctggagcacatacacagagactggaacagaggaaggagacgcgtcgacaccagatgtgtacgaacagctgcgaaacgcggacggacgaaaaagtcgagagagaagccgcgagatcaattcgtcgcagagaggcagacgaaaaatacgttttggggacaaaggggaatccgaagaggcagagctgtctcgccttcttctcgctgcctttcactcacgcgcgttcctctcgcgcctgtctgagaagctcgagtcgcttgtcgtcagaggatttctcctcagctgcggacgcatcccgtgacggagttcaaactcgggccgctgtgcagcgcctaggcgccttcgagagacagggtgccctttcaaggtctgcgcgttaacaggccgagtggatcgacgagtcgaagatcgaccgcgacaaagagaaatgcaaaatggcacagacgagggacgcgtcaaaggcagcagtctgcagagatgaaggagcgtcgcagaagatccctggagctgtggagagaactagggagaagaaacgggagggcgaaacgacctcgctgttaagcttcggagtgggcctcttttccgctcacactggaacggcgaacagcgatggtgcggacagagacgaggagctcagaggcgccggtcgcgtgcgtcttattgaaatccgggggactcgacagaaaaacgaacgcaaacagagagacaagttccgtttcgtcgcggagagcgctctacgtcgtcggcagagacaccctcgagtctctcactcgctctcagggggtccgcagacggcgtgggtacacatgcaacagcacccgagacaggcctctgggactgcgaaaagcgcgcgaatcgcgggaacgcctgcgaagaggcgtcgcgtgagagcgctgacaggacagtcataaacgttcgcgttttcgacacgcgttttgagcgtgttttctgaaacagaaactgctttttcggtccggaaacgccgctcatactatcctgcgcctcgacccagctgtatatacaccccagcggtcccgccggggactcgctgcgctgttcgtctgaccccacacgcggccgaaaaaggagggcgtggaggcggaatttttacagttttaaaaggatttttgaaggcgtccttcatgatcccgagcctgtttgaaataaaggatcgaggcgatccccgtctctgtcctgttctcctcaagtagctttcaacgcgtacgcagcgaggcggtcgattcgtcgatgacggcggtcaaccgcggaaaggcttcttctttttcatgtaggtagtattttgtgttttgagtcccttaccataaaaacgttcttttcttctctcctgcttgtctcggttgagagtcacagcctcgccgctacgcctgacgccctcccgcccacgtcgtcgcttcgactttgcatagtcctccgaccaccgtttccactcgtttctccgtttctctccgagccacagggcgtctttcccgcctatcgtgtcgccaagaaacctctgttaacacga

SEQ ID NO: 2510 - DNA, 4186 bp, Toxoplasma gondii
tttcttcgaagccctcgcgtccgacgtcccttgtccaggactcgatgcatctgacccctctcgaaccccccagctggcgcccttctcgccgcccgacgacaagccttccaggctctctccggttgctgcagccccagctgctgctgctgcactctgggcgcgccgctttcgagtgctcatgcccgaccccgcatacgcggcaggcgcggcgctcgattcccgtgacggcgggcgcggtcccgaagagacaggagggcccgctgacgagggtcctgaagccgcgccagccccgctggcactcgcgggtccttcagctccggcgagtccgtctcggccggagtggatcatgggtctcgaccgcgactcctcgcggtctctttcggactgcttgcacgcagccgagttcgagagctgctcgctcgcggtcggcgtggaggcgccctggggcgagcaggccatctccgccttggttgcactgagaggcgaagcgacagagggcgacggagacatcgaggggctctggcgagcgtttcggaagttttggcgtctccgtttcgcgttaggaagaccgtctgcgtgtgtcccgttcatctgctctacaggcacctttccgcgggcctctgctgatccgcacgcgttttccgctaccgcaggatctgtcgatccgtcgtcgcgacctcccgcgccgagtttcttgtctgcgtctgatgcgaactctctggacacgccgttctcgtccagacagtctccagctggactcgcctgcgtcacgccattcgcgcgcttctccggcttgatcggctccacattcttgcccgtcttcggcctggtcccccgcccacctccgtcccctgttttctctcccagagtcgatcgcagaaccttcttctcagtagggaaacccccagaagcggctgtggcgggtccagagctcccacatgtctgactggcgaagtcgccgtcactcgagcccaatgcaggtgaggcagtggcttcaggccgccggcagccgcgccgagaacgaggctgggaccccaggggttccagggcggcagacgaacagactgtcgcaaagtggggagacggggaagctggctgcgcgtctgaaaacatactgtgcgtggccgcatcttcttcacatgtttgggcttccaccttccccgtttcctcctcctgctttgctgcagacgaaccggcgccgtggcgtggcaacacacgacccgagtgagctgtatgtacactgaagccgccggcgtccccgcgctgcgcgggcaggggtgcaggcgtgtggcagtcagttgcgcttttccactgggcttccgccgcggatatcacgggttgttcagaggcagctgagtcgtcgtctcgtggcttgcctgagtcgcttccacttgcaggtttttgcggtggatttgcggcagctgcgtgacgagcagctgcctctgtctgcacgcctcgagccggaagactcttcgcatacggagtctttcccaggcactcggcactgggtccttctttattatctccattcgctgaatctccttgatggtgtgtttgcgtctccgttgcctctgacgcggctggagtttcccttcggcgtttcgactctggtgtggcaggcccgcggctcgcgacccccgaagcagcgttttcaccagcattcggagacgacttgcccaggagttcgtcctgaactgcctctccgggtgcacttcctcgacgatgtttcctcgaatttgccttttcctcttctttcggcacagattccccgtccttttcggagttcgcttttgcggatccacctacatgcggcgctggggccgatgggtggtcgacccgcacgtctgtgtcgggggaaggctctgaagatgaataattttcagcgaagtgccgagtttgaggagagtgagatgtgggaacgccaggcgattcctgcaaggaagacgcgagcgaagcgaggccggcagacgccgcagaggcgggctgcgttccggtcgtctccccccccattgcgggacagagcgctgtccttgtttacggacctgtcagtgcgcaaaattttcgcgggactgagaaaaacgtacgagaaactgaacgtttacggagaaacgagcggagaatcaacgtgcagacggtgccgagacagcatccgagacggggaagagagcggtggcgcgcgaacgggcaacggacaccggaagtggagagtggaaaacgacggatacgttgttaaggaaaaaagaagaagaaagaagacgaagagagtagaactcccgtctttgcgtctcgtgcctcttgccacaaaaaaagctccacctttctcgtgacaacctgctccctcctctggatctgggaacggcagttttcttccgcagctcaaaaatcgagctggcgacttgtgcagccacgagagaccgagaaacgccagctttttccacttttgtcgcagttcacctgcgctaaatgccacactaacctgcctgccgaaacagacaggtgaccagcacgccacagcacagcgtgagcaggtactaaagccacactccgggtgttgtttcggggtgtttgtcgccctgcacaaagcctcgcgttcgcaggcgtaaaggcaagctggagaaacacgcctttccaccaggaaaaacagattaggcacactttagccgctgctccacagtccacggttcgcgctacagcgagagtcccgtgcacccgctttcttcgccctcctcgaacaaacaccgcagatgtgtacctggagagtttcgcagtaagccggcacggggacgcgagaatttgaccacccccgcggcagtccacagaacacgttttcttcctccttcttttccttgcaagtcagaatctccgttatgactcggctatgtgccggaaaccgaggcgtgtggacggaaagagtggcggcgggcgggtcgaggctttcgccggggcatgtgcaagaaaagaaaaaaggctctcttgcgaaaacgagtcgcttctgaggcactccagactcttgaaaagccccgagagacgccgcgccggcagaaaagacttctcgtccgcaaactgatggacacttgcggaaaacgcgttaggtggcagtgcccggctaatttgtctcggtttctcagcgtacagatcttgagaagagagcgccgtggcagagaacgcaccccctgggagaggggaaaagaatccccgtttcgacctatatagcgaatggccgcgcgcgaaaaagagagccgtcctctcgacaggcttctagttaatttgcctgcgtcttctgcctcttgtcggcacgaagataaaaaaatgtcgcagataaccctccttcttcatagagactacataaggaacggtacagcctttcaccggtctccacggcgttcgcgccggtcccgccgtagcaagacaaagctagtcaaaatttgcttcctccctagcgcgtaaatcttggggtcgtcgaagttttgccgcgtcttttcctctcatctttcccttgttgtgaagaaactgcgcaaggtggcatctttcttctttgaagagaaaaatgagacgtagtagcaacgagaaacgagaagaacgggggggctggagagcgctgtgaacgacgccggttgttcggggctgcagcacgcgaattcgcgcgcgcgtggagggctcttcgccgatacactcaaaaacgcccggtattccgttttttctcgcgaatttctcctgttggcttctcagacatttccgacacttgcttattctcctcgatattctgtctacgggaaaagcctctgccgtcgctcctcgcggtttccctggggatttgagtccgtagaagaagatgtgctgcacgttaccattcgctgtctcctccgcctccgtggtgtctccgcttctccgtccttcttctttctctccgttggtctctttctcgcattgatcctgcgtcgtctcccacagagcgtccttgtcccttgcctaaaaactcgcgtcgaccagattccacttgtggctcgcggtccttctgcgcctccccggtctcccccgtcgctgtcttccccccccccctgtcctctgtgtttcgtccttcctctcttttcctctttcttcgcccgtcgtgcatctctacgacttttgcggcctccctgctccttcctcctcccccgccttccctccccgtctccggtgccccaga

SEQ ID NO: 2511 - DNA, 2014 bp, Toxoplasma gondii
cgtatttgaaccactgcctgggacgctttacggcggcggttacgagacagcgagcgaaagctgcaaatattcgaaagtagccgaaaatatccacttgcgtgcgtgcacagtttcgcggtgcggtgctgggtgctgtcctcggttcttcaacatgcagagttgcccgtgacagatcagtgtgtctgcgtctcgactcggtgcctgtcgctacagctttctccctacgacagccaactcctatcgttttctccattagcttgtgctggcggccaacttgggggcactgctcagcttgaaatttccttgcttagtcgcaacgcgcctgctagcctactagctcacaaggtcgtgtagcgtagccatgcccataatatgcaagaacatcccaggagatttcgtgcatggtgcgatacagacactttctactttccagacgaagagctgttcatcgcggggaaaatcattgaggagaaaacagcctaatcacaatgtacgcggacaacgctaaacgcatcttcggactcgataaaagactaaacataaagaaacacacgtatcgcgagccttcttgtttttaccgtttctttagaggaatcaagtcgggagaaaaaggcttgctgttgcggacgcaacggaaaagaccggtttgtaggcggggaagcagccgaaacataaaacagttctcagcgccgccagtaggccttttctggcatgtgcgtactacggtcaaagaacacaagagcaatttgaaatagactctgcgttgtgctcgagttcagggcccctactatttacagtttgtgcatttcctgtagaacgacaaacgacctcagagttcatctggattcctctcatttaacgctgagtagctcggtcagcggacgggttgtcggtttcaaatttcactttgtggcgctttatgaatttcaaaaggtgacagccttttgtctgtctcactgcactgtaaatccgccagtatcgtgggatgtggtgagtcttttagggcattctgtccaccaatttcagaaagcaaaccatcctacagtgtcgccaagaactgcaatacagaagggatgttgaaagtggagatgccttaccaagtttccaagccacaatggaagagaaactggacatcgatatgtgccagaggcaatcgtagctctcaaggtctttcgggcatacctgatgtctctggctgtgtctgctctgtatcttgcgtcttgggcgttgttctgtctcctgttctgccgagttctgcgcccctcagaacgagtctcactgaactgagagacgagagcaaatcctccgtcctcaagagcagtgacacgcttactcgagataaatggcaactccgattcaaatgagacattcttacaaaaatgtgggcggtttcatccacgattcactgtcacgtcgtcatgcgactggcatgcgcgagagtcttcttacccagtgcctttcgcgcattgcatgcagttgcacggagcgaaaaatcgtcgttttcagcactgtgccctgatcctgaaggcggtttttagcgacggctgattgaagaaagattcgcttctgcagtcttgttttcttttagtttactcgacaccttttcctgctctacacaccctgccgagcgcgcggaactgggcacgaagaggccttttgagttctccgtttttcgcaaagctgcgacagcaccgacgctgagtcaacggtccgtttttcttttttgtacactttcttatttctctgtttccctctactgcacgcattcttcggagtctccaccttttcttttcttcggaaggctggagtctccccgccactgccgctagcgcctcggtctaccgtcttcccccacacaactcggcgactcgaaacttccgactgtacggatttcccggccacttggccacgcgaactccggtccaagtcgctgtcagattcctcgtctctttctttctagtcccatctgcccaacagacgcgccgcgaaaaccttgtgtggggggctaaaaaaa

SEQ ID NO: 2512 - DNA, 4504 bp, Toxoplasma gondii
agaagagttgcagcctgtcgaagtggagtctcctctcctcgtcaaacaggtaaaaaagggaggtcgctttgccggttgcaagcaaacgcgccgagaaggcccagaaaaagatgtttttcaccgagacacatagagaaaagaagatcgccgtggagagaaacacacgcagaagcatcacaccgacgcaaccgaaaaaaagagaaaagaaacgacagcgcgcgaaacagaacgagaaagcgagaaaagaaaaagaacgagaaagagagagaacacagttgcgactctgcgggggttgaggaagtttgattgtcaaaagaaaagtgaggcgaatctgtatctgctgtttgaaagaaatctagtccggtcctgcaggaagaggaacaggcacaaacgagcaggaacacagaaagaaacgcgtggaagcaaatgtctcgacagtctcgctgaaggcggtatagaacgattttccgtctaggtaggtgaggacctccgcgcctcttctgtcgcagaagaactatcgactcccagatctcgcagattacagaaaagtcgatcgatcaacggatatacacgcgcatctccgtaatacatacttgcagatgtacgtacatgcatacagggagagagtgaaagggagaaagaaagagcttgcccgaagtagaccgaggacgaaccggactccgcgggtgtgtcgagagagagaagcagcttaagcgagtccgattggtgcagacagaaaggttagatacagcgccagagaggtccagataaacggatgaatagatattccgatgtgagaagagagtacgcgcgtggacggacagaaagtaatttgaggcgcggtctttgtcgaggatgccaagagcacagagaggcaagagtcccaaatcgcaaggagtggattctttgttcacctttcggagtccccatacacgacagaaaacgcgttgacgccttgcacaccaagagacacaccagcaagcagagcactgtggagacgggagggagccgttgtctcttttctttttgagatggacatttccttctttttccagtttcagcatgacctcttcagagacttgagattcggcacacaaactgaaggaatgctctaaaggtccacagaagaacgaaggagcagcaaacgaccgtggggcaaaaccagccccgctgcgaaaacgcgggatgcgtgcgacgcgtttcctttctttctgccaagctgcgttcgttcctttctctgcattcgcctccgttctcgctcgttgtctttgttccctgcccttctttttcctgtcctttcttggccactgatgccagagatctcgctttctccctcctcctcctcctctcttcagcggcattcgctgcggtgtccccgctctcacgtagttttttcgctgacgctcgcgattcgcggtggattgtggctcctgtccctgaggagaaggtcgagctgggaggcgacttgaggagaaggcgggaggtcgaaaaagccggatttccaggaggtgaagaaaaacgcagcaaaacggcgagagagaggttgccgctggcgacctgaagctgcagctagctctcgagctgtgtgtcgcgagtcgcgcttgttcgcgttttttgagactcacgacgacctcgcgtctccgctctcgagagcgcgcgcggaaaaggaggagtctcgtcgaagacgcgccgcagagcttgtcgggagattcagaagaaagcgtcgacacccttcaaccacccacaaccagacgcgaaacagcatgcacggcgaagatcacgcacagaaaaccttcgcgccaggcctcgcgggtgtgtgcagagtgagagtgtggtgagaagagaggaaggaggcgagacggcggcctagctgcttttcgagaagcctgcagagaagaaaaaccgcagcgattccgtgcttctctttttcggcaacaagagcgtcagaggcttcgcgtcgagttcgctgcgaaaagaaaaaatcgaaagcgtcgtgcccagcttcttgcggttctccatctgagaagcgctttgcagaaagaacgagaagatactgggacctgcatgtctggacgctctgtaaaaaggagacagaaggaatcctcaagtgtacttgtttttcccgtttttccggtcgtcgtcgcgctaaaggatttggagtacgaagcagccgtgccttctgctgtgtttcgcttcaactgaacacagtggcggagaactctctcacgggcgcagggagagagaggcgcgcgcgcagttcggacggctcccgatctccaatcgaaagcaacacaaattccttgttgcccatgattcctgtgtacagagtgcttggcaaaacagtctttacctgtttctggagcaagaaacaacgttttcaagcgacgcgatggtgtccagagtgagagggaggcggggaggaggtagctgctgccagcactgttctctccactgtctgtttcccttttagatgcagacagatatccatctcgagacattgtacatctaatcctgctaaccacactgaatctccacaagcacacatccgtcgtttttcgccgcaaacaattgccaactggaacgcatacacacctatacagacaatcgaaactcgaaacatagctttcctctaatttatacacacacacacgcatatatatatctttatataatatggttataacatatatatatatatatatatatatgcttatagctttctatgcgtgcactacgtcaatccccatctatcgagttgtacacgttggcatacgtaaatccatacttcacgttttttaggtaaaatacatatttcctaggagtatatacatagatgtgtatacatgatttgttaccgagacagggaagcggacaaggagtgtgtgtgtgtgcttccgtctgactacaagcgagattcgaaaccatgcaagtccttttacgccgggaaaatctctcctgagtgttctctcgtggaaatgagaaacatcgatgcttgagcgaggtccccgcgaagaaaacgtgctatttctctcgggactttcgactctctcctcagttcgtatcgttctttttctatcctgtggatcacggccattcgtacaagtaattgtatttcactgcggtttccatccgagattcgtaggaatgagaggaaacgcgttttagctaggaactgctctgtcaagatcaatccgcgagggaatgtcagagccacagagtttctgtaaagccgcttccacgtgcgagttctctattcactctcatcaaaagttggagaaaacgtctgctcacccgttcgccacaatcccgcgactctcccaagcgctgttttatttgtgttccccttttaatacctgagtgtgtgtgtgtgtatgacgtgtacaaaaacattcttgtttattcatttgtttatgtatacatgtatgcatattcatatctatataacactaaatatcgctggagcacgaatatgaaagtagcaatttccatttctaacatcacagctgccaagatagattcgaattgacagaaacctcatagtacctgtgacaatgaatgcgactccagctaggaaatacagacaaccagaacttctctgattgcaggagcaaatgcgtgctttcctgcttcgggtttccgaaatttgactttctgtgcctgagcattttacgacgtagctacaaatatatatatatatatatatatataggcaagtataagtagtggtctcgtttagaggacagttatgttttagatcatcgcagctgtttatatcgattgaacttgtttctgtaggataacataggcggagggagaagcaggggaaatagagaagctccagttcctctcgcctggctggagatgaatgttcctccggttgtgttttcagatgttcggtgggaagttccagcataataaagtcactgccttcctaaaaaatacattttacctgcagactgtctctgaattctctttgctttttcgtcatcctcatctttccgagacatgcgagacaacgaactaggacttgagtgggtaccaggaccgcgagagaggtcttcggaggaagagtgatttccctgtgttttgtgaaactggaaaactcttgaattcgccatgcatgcggtaagaaggcccagtcaggtctgaaggtttcagagaaaaatggaggagaaaaacgcacacacaccgtagctcgtgaaaggagaggtttcctgtcccccgcgacgcacccgagcttttttccttggccgagacagaggacttctcctttcattcgttttaaagagtttctcataaagaagagtgcctcgcctttcgttgtttctcgtccctttctgagagccgcggtggacagacgaaaaagaggaaagagagcgagaaggagggagatccgcgacagcacacgatcaagagacgcggcttttgagttctcgtcgcgtgtttcatctcagttgtcgatcctcgataaaggaggccgagaaaacgagcaaaccgagacaga

SEQ ID NO: 2513 - DNA, 1207 bp, Toxoplasma gondii
ctgcgtcacccgcctctctctcataactcactttccaaggacaataaggtaattgctcgtgccaataagaagcatgcgatcggctttaccctccacgatccggcgggtcaaacggtatcgaaaaccccccagtataccgctctccccgttctcccgagaagcagtcagcgtctcttccctggctctaagtgccgatgttgcgtcgtccgcaatcctgcttaggagtccggaaaaccgcgtttcgcccgcatgtgaaaaatcgtcagtttcccgacccccacatccgtctccgttatcttctgttgctctctctgtagcagaagtgcattcagatccgggcggaccagggtggaaggtgttttctgttgaatggctttcgttctgtcttgtcctttttggggagcttcgcgctcctaagcctgccaacgcagctgcccgcttccgcgcgaaaattgctgccgccgcccggcgcgcctccagtgaccgaggctgtcctcgaatctcggggcactctcccgagcaaaatggggaagctgcatgccgctggcaaaaaaaattgtcacgagagttggaggagtcgggagctcgcgacacggcagatgtctccagcaccggccgagaatgcggcgacgccggacacaggtcgccactcaacgtcgaagatcctcgagacggggaattccgaagagaggcatcttgcgatggaccggatgcggggttcgacacggacgatgtggatgacagactgtagtccggaagcagattctctcggggggcgctgtgcccgtctgcttgaaaccgggctgaagggagcgcagcggcaatagcggcgccagaggtagccatattagaggcataggaggaagaaacagcaggggtaagggtggtaaaggtaagctcttgtggagccgactggaaaagaacctccggaggcccgggacccgactgtcgcgacgagaaaccctgatcacaggcgtctgacgaaacagcgtacaaccgcactcgcggtgccactctgacacatcggatgctcgggaatacgcggctcaaacactgtacaagagtcgtcctcacagcctctcacatcaccagcagggagcgcgccaacagccaccgccgggcgtcctcataattccgtgtgatatcgagttgctttgacaagagaaagcgttcactcggtccaccgagggcggcacggcagctgaca

SEQ ID NO: 2514 - DNA, 2134 bp, Toxoplasma gondii
aggaccgggagacagcctcaacatctttcactggattcctgtttctttcactcgttgtgtaaaaggaacgatttctgtttcgtggcccaagccagttttttctcctttcactctcgcttttgctgcactgagaggggaggctccagcacggacaaggggaaactcgcctccctcccgttgtgctctgtcaatatttgtcgtttgtccgtccaaaacagactgaatcatggcgttattcgccgtctactgacgttgtcaaggctaaacgcgtccccttttcctggctgtcagttcaccttaaaaaacagcaactcacagaagactcttcaacagttgcggtgtcgctgcacatacgcgtgggcgtgcatagaccatatgtgaacacgtacagaaaaatacagctttcacatttagaagactgacatatgaacctttatctcgcttaacttttatggacgtttcacagcagatatatctacctaaaccctgattgcatgcgtgtcgcgcagatgtctagaaacacgtaggcggtcaggtgcttgcacttggttttttgtgtccaggcatcctagatctgagtcattgggcgggctgtccagcaaagaagccagaggaatagcacaacgaaggatatgaaaatgggtgggtatccgtcggcttcgcacgttgatattttcagcggtgcttctcatcgaaaaggatcgtggaagtgccaaaagctgtgccaaggaaaagctacccacattcatgtcttcggtccttcagctcacctacctaaaatcctctaccattaggtggggtaacagaaaggaaagtgtctcgcggcaagccagacgtgtagcaaccttgagtccccgttcttcttgcagcctgtgataatactctgccccaaatatctcagttcttttcttcagaaacgtttgcgtctcatgcgcttagcgcaggccgccgacgttgtgaagtttcttttcgaagcggacatgtgctggtaacatcccagtgtgtcaccacgagctaacatgtacgtcgtgctctccactgcaaaagtgaactggcatcctacacaaattcagaaaagcagagttcttactcttctgcagcggcgcgtgtgccttgctaatgtgctacactcctctgccggttctacatctggatgcttgccaacggcagttaggaccaccagacaaacccccaggactggcgctacttcctagttccagccccttctgtcagatacataccttccgtctccttttttccactgcaatgggcagcggccagcaagacttgctgcaactactctatgagtgtgccatctgcgaaagtggattaattcgttcactagtctttcaggcgcaaaaaggaaaaaacgtgtagactcgcggctatcagtagttaccctgcattgcagcaagcttgtgatgctttgctgcggttgaagagagtttcaaaaggaagatacgtgctgtgtctgtcttttcatacggcattacgcgacgtctgccgtctaaaaccacaagacggacaaaaactatcgaagccacatatgaaagacggtgcacggacactcttctcacgcttcgactgtttcgatggcttccgaagacgttttctcgcgagacaagcgaaccgcactgggagtgtgctgcccgcttcttccgggcggcgttcaagcaatacgtgggtttttttcgtgcgcacaacaaagtccctaaaagagtcacatgagagatccatatatgcctaacaatgcatctccctccgatcgtgtcctatgcaagactgcgtgaagggcggagaagcaacccacccaattttctgttttctcgttcgtgtccggagactaaccgcgaaacgcgtgcgcaaattagtatgtctgcgggggcccccaggaagccaagtagcgacggaaaagtggatttccttctttaatgcttttgtggaacggttgtttaattggaaacactttctcacagcgaaagaggaaaatattttcccgtcgcacaatctccaaactacctttcgcgctcgaacgacctgtctgtgctctgtcggtcgagttcacctttttcgccgcgcctcgatttcccctcaatactcccggtcggatatttacaagaaaaaacagtcaaga

SEQ ID NO: 2515 - DNA, 4781 bp, Toxoplasma gondii
tcacgaagtcacacttcggtattcgtgctgtcatgcctataaggcgcctttccttgagcagcttctggggcgattccacaagaacagagcacactacagagtgctaggaggaccatggtcgcaaggaagacattctttggcagtacttgatgaacccttgaaggtatctggcggctctccgtcgtctaattacgagttgcctacgtaacaggcgagactgtgttcaacctcggcacccacattgatcttccgtaaactctcgacccgaacagctatccaactgtgcatgtttagtgccctctgcgcttgggtcaaagtcaattcacgacactgtcgtacccctcaaagtccggctctcaacacatactcttgtggtgcagctgccagccgacaactacatatatatatataaatatatatatatatatactatctgtacaggttgggtttgctttcctctcttcacggaggacgcttagttggtgcgtcaagagtgcgacacataaaggagcgcacatatgtcaatagtactacgtagaatgcattttgaggcggtataaatgcccgacaactcgtgcatgtccgtgaacgaggcgagcagcgacgtcttgtgacctatctctgctccagaggtcattgaactccggtgcaactcgagatgggcaatgctagacacaggtttcacatcttacctgctggcccaagacaacgatcgattgctgagcagaatcagaaccctttggttctgcgattcgtgcactgagacactgaattacagattccgtacacacagagaacgcgccacgcactctccgcgcgtgtatggcttcgcgggtcttcggctgcggagagccgcttcttcgcgagtgaccaggcattttggggggcttttgcgcgagtctcacgactgcagcaaacagggagttgaacatgaagtagacgaggagtgggcagatgcatccagtggtcgaacgctcttctcagcttccacggcaacggcggaaagccgtgtcggatgcgtctgcatgaagcgtcgcctgtctatacacccccaatccttctggtcccgcggaccctgaacgcttcttcccttgaccgcgaaacggctgtgaactccacaagttggcggtatttctcgacggccacaccataaaatggcggagccgttgttacaagagggacacgatgcgtcgttcccagaaccaggcacctctgagcagcagattctgggaaacggaacggaggtaacgcggagtttcgtaggccgacgaaaataccgaagacaaacacggatacccgcggccggcggagcgactttcactggcgggtaaacaggaatcgttccttgcacactctgagggagagaatcgagatgtcgtcacgcgctggagaatgtggatcgctctagtttttaaaactggagactgccctttctgacatcgccaagtgggcatctcatttccttgccggcgagacaagacaccgcagtgaacgtggcagcgacaagaagtcgcttcgactgtgcccggctgcgcagcggcgaaaagcgcagttgccaaaaatgagcctttacattccgagtcaatcgacagaccctgtggctggcttaaaagtcataacatgtgtctttcccatggctgtgtcgtctttttgctgtcgggcaggaactgatggagtcccgctgacagaggagctgcacaccaagcagccggagtaagagtttcctgcgcgggcgcaagtcgaccgcgaagcattacttccgctgtcgcgagcacccatctggcaaatgaagattcaacaatttcttgcccctcagattctgcattttagtatcacttctgtatagtgggaagcaaggagagctttgggttcatgaaacgcactgtgcatgtttgtttgaaaaccgacgcgtgacgcttgggtcactgcataccgcaacgaatccggtcaggaaacacgaatgcgagtgtttggaaaacaagaactattttcatcagtgggaacaacacaccgggtggggtttcagcgcgctatcgtctaggaaactcagactgtcggtatccgtttaccaggcaattgcggcacacacgtgttagctatatacgtcatgctgacccgaatgaactgtaaagaacaggaacaaaccgtgaagcatggggatgaagtgtgatgaattggaggagcagagccatttctctttcgtttagcttcccaattgacaggagtcttactctttattccgtgccgtgtcgcggttcaagacacctttccaccccaattcgcgtgctgagcgcgttacgtgtttcccctcatctgtgcctaagtttattgagagaagcatgcttctgcgatatgcccttcgcatcatgtgacaggtttatgtgacacaaattgcaatgcattgtgcttgccgttattgctgaaatgtcttccctgggaggatctgcttttttttccactgtttgtatacactgtggttcaaaccacgtcagagttgagtgctgaggacacttctctcttcagtgttcagaagctcaggttttctaagctagaaacagggggtgtcgtccaatgcaaatactgccccacaaaaacttaggtcgcagcaatgccatcttgcaaaagtgcagtctcatgtcatgcgaccctgagtgtattgtcagattcttgcggtgttccctgttatcgacccggtttggagcatcatgagagttagcggttttttcattgcgacgtgtccctcatactcggacaaccagagttttgcgtcgctttgctacttagactggagtattcgtgacacttccttccctcttgcccatgcattctcttctcatccgaatgcgctgatgaccttgctggcctccctggggttctcaccaagtcgtttggcaggacacgagacctgttaatgcagatgttctctcgtttggatattcacattttgcggacatctgctttctttcgccaccgtcacctgtaagagccgtgtactttcctgttggttggctacacggtcgcaagctgcttctgacatcaaccccggtagaacacaaatctgctgtcagctgctaaagcatattctcaacaaatcctttgtttaccgcctgtaccgcaagacagatacggagaagtgtaggacgtgcccgttgagttcaagatacatgctgaatagtgacaagaagcaaacacaacgtgcgtcatcgggagactttttcaagcttctcatgattggacggcgtagttcaagctcgatacaggccgaccccttttgtcggtcacggcaatctcctctgttccttgtgcatagaacctaacatcctcacagttgcacgcttgtgccttccgcagacctatttgtcaaatcgaaaaataaggacttttgatgtctgccgtgaaagagaaaccgaccttcctggcatggatgtggctgtaacgcgctggtcttgtgagctgcaaagttttgtgcaagggcaacactttctctcgcttgcataggaaaaacacgagccgagttccattccgaagagcaagtgaaaggaatgatggcagtactcttttccggcaactggtagaatcccgcgtttcgtcgttctgagggcaacccggacggaaccttttcgcgtgctcgcattcgacgcttcgagctttcgagctgtcccatgggaaaagtcgaccgctcattttcacatagtcgggggtgttatttgaatgcagtagtttcacctctttgggaggcacattgccgtccacgcagcggtatattactgtcggatatctttgtttttcgccttcttggctaggtgaaaaacgacggcactcatccccagcgcctgcgtcttcaccgccagcgtcggacacggcagaacagttccccctgtttccctgtctaaaatgttacatttttgagcttgtatgacctggaaatcttccttacaggtcgtttccgttgtttgctgagaatcccgagatttcctgtcctctcacaactaggaatttgctaggggttgcgccccactaggatttgatttcagtgtgcctttgcttgcgtgatagcaggtgaaccagagcatgatcaggacgacttctgcggcagactttgtgaaatccacccaagtagagttgtgacttatttgtttgccgtgtgtgttaacaccgtgtttcacgctacgcgccgtcgtcgagcggcgagaaaaacttgagaaacccattttcagccaagcatcgtgagtgcttgtcgcgtttctaggtccgttagcagacgtgcagaaataaagtttagtcctaaaccataaacggtcgcgatgactcacaacacaccctgcaggtcgacgataccacgtcttgttcccttcctgacctgctttgaccgtaactctgctgtcactttaacttcgagcgcgcggaaaacctctttcgtgggtcgtcgttccgggttaagttgctctgcatctaataggggcgttcattttgcctcttcctagcatttctcgcagcgtgcgttcgtcgctatggtaaatcttgtgcaaaccaccctgaggtgtggtgagcgtgtgtcttgttggttgtcctcttggtcgacggctaaggcgctcgccgttcgtcgattcgaagcttttccattttactcggcccataatcttttcaggctacacattgttccgattttgtcgttccgacgttcgctgacgcccgccgttccgtgcgctcgaccctggcacgtcctgctcgcgggcacagggggttctttgcgtcgctccgaggttgttcttttacaataa

SEQ ID NO: 2516 - DNA, 2684 bp, Toxoplasma gondii
ggacaccgagcaaacatgtgtgcaggtcagatgggtggttctcgtgcctccgtttggccatggaaaatatacattttaacgcgatttaaaccacgcaagatgtaaacgttcctccgaaggggacattcccactcgacctttcgtctgtgacaaacaacgaagacttcttcccgctcccaggaggcaatcgcacccgtcgcgctgtcctgtggtggaggttttcccctaccatttcgacgatagaccgtttatcttttatgttgtatggacactcttcctcaacgcagtgtggagtgagtgcagcagagagtcgacacggaaagtcatgacttgatgtggggtccgtgtctgagctggaagggtttcggtatttgcagcagagttttgaccagcgtgtaggtggcgctgtattcacacaagctacactcatgcagagctcagcttgaacaagccgaacgttttccggaaggggttttgtcttggcttagcaactttcccgtttgctctattgtattcgaggaaaaaacgaatggcgtgttgagaaccaccaccagaaccacgtggtccaagaccgcctacacctcgcagactccctttgcagaaacgctcaaacatccaacgctgaagtcgaaccgccaaaatgccagactttctgcaaaactaagctgtgaaactccccggctgctctggtccgcacttctgcagccgtggcggcttttgttaaacatggatggacgtgtgcaggcgaaaaaaaaagtgcccgaccgtctaatgctgcagctgactaggaaagtggggaaacagagctgggcactgaatgccagttttttttctgctacttcctgaatttcgcagcatcatctgcacgggcacgggagctcaaataggagcccttttttggtgggtgggttcctctttgcggtaatggttttctccgagcggcaattgcatgttttctgcgtagaaaggcaccgcgagaaccgtggtatttcctttgcaaagacagccaagcgggacgcaaaaggcacatcacaccgcattcccaactctgcttgtgtgcactggtgctccgcagcgttgtggatcgatttgagatttgaacacttcaaaagctgccttccatgagattcgaggaaacacaagaagtacgaaacaatgctctgggcttgctggagaaaaagcaactcgtctttgtgagtcagaacacaggcgatccgttcagtgaagcacgcagccggtgtcgggaaacaagcgtaactggaagtcggttctgaaaaagtgttggaaactaggcagatgtaactgagtcgtgctttgcgaaagcgcaggagaaaaacagaacgacgtttcctcctcctttactagactatcaaacaggggaaacttctacccatgattcctcttttcgaggagtctttgcagctcccgttttggagctctccaggactggttgtttcaccgcagcatgccccaaacacaaactctcattgaaagggcacgttgaggaaatgatgctgaggaagcggcagagcacgtggacgtaaaaatcgagtgttgttggcaaagaagtctgccccctcttcaggtgcgaggcatgcctggtacagcgcagactccaatcctgccagcacgtcctataattcggaccgcaggaatttatcgatttcatggccgatcgatgatggccatctgcgctactccctcctgtgaaaatcgcgtcgaaacgaggccctgaatacatagaaacgcgaaccatagtcctaagatttcaccttagttctaccgggcggatggtgtagtggtatcacgcctgatttgcattcaggaggtcccgggatcgatccccggtccgtccacttttttaccaaatgctatcctttttagccgataacctgcaatcccctggacagcttcttgttgcgtttttttaagaagacattttattcactcaggaacaccttctttgtctcaacaggcatgcaattacaccactttgtcttcgcaggcgccgcatctccaagctggagtgtgtaaggataaaacctaagtgcagtatcctctctgcatttaatttccgattcctgacgccattgctctttggcagttttgtttttattgctcaattccttctctaaacgggagagtagctgtcatgctgacgagtcctccgcaggaatgcttcggtggacttccccaacaagcgacaccggcagcccgaaagggatgtgtttgtggacaaccttccctgctcatgggaaacagaaccgctaaaagtgtcaccgcggaaagcgaagcgaaagagttctcttcttgccatccagatgtaagtgtcatgttgttgaatacggtaaagttcttggcaactttttaaagcaagaaatatgtagcacaccagcaaaattccgcgtgtcgccaatcgcccacaccgtccttcttcgttctttctgtgcatttctctagtgatttagaccaaccaaaaagtgcagcgattcgttttttgcttgtttccttctgggtgagacatggactgagtttcgatattctctgggtcgcgtctgtcggcccttcgttgttttttcacaaacgagggaacacgtgtcagtagtagggaaaaaaacttctactcaggaaaaagtcgcggccgaggagaaaaggcgacctttgatcgaggaaagtgacagtaa

SEQ ID NO: 2517 - DNA, 1727 bp, Toxoplasma gondii
ctctcgtaccatgttgttgctcttcgcggctcatctctgcggctcagcgtcgcctttccctcgacccgctgctgcctctctgaggctccaagagagaggcgagaaggagaggccgaacgagagagacagagaggagaaccgaaggccccgaggaagacgcagaagggcggaggcagcgaagagagagacacagcgggaagacgatgttctggcgggaggaacgcgagtccaaaagacagagacagggatcagagagcgagagagaagatggggagatttgctggtaaagagaacggcagacggcgggaaggacgaaaagggaagcgaaggacagacgacccaccgagtgtggaaagacacaagctcggttcctggcgccgataggcaaccctgagaaggctatcgagagatctgggagcttgcgtagagaaaagtcaaagcaagcacaggaggagaaggtatatgccaccagacaaaccgtcttactttaggaggagctagagaacacgggacgaaggacgaagcagaaagtaagcttttacactgtctccgtcattcacgggagaggcgccaggaatgaaaaagaggacacgaagtgtgagatgcaggaaatcgtaagaggcaaccagcgctgtgctagcgccctgaattccctgtatctgcgttcgcgtctcacctttgtcctcttcgtgagaggagagcatcggaacggagtaagcctaccacagacactggcgccacggtgtgccgagtgcagagcaaacgaataaaaggttgacgaagtcgattttgagaggcagaagatgtcatgttcgtagttcgggtggcgggtattaacgcgctgtcccttgtgacaaatgaaaaaattcaacggtcaggacagcggcatgcgaggcacgcgttgacagaggcgcacactcactgggatttgaatactggaacaaaggcaagtggagaagaggaaatatctcttaaatgcatttttgcgtctattgtcaagcgatgtaccctccttcccacctaagctggtagcaccagaagcgcagcgctgcgtgctgcttctgagtggccaatccgtaggcgacgagtcaaagaaagaatgaggaagaacagagcctctagtggagatgtccgcaggggagaagaaggaagcgatgaaagcttgtcctggagaaaagttggcgtccgcaagtgttcgcttttcctgagaagcatgccgaccggcacactgtcgcgcatgtaataccgctgcaagtcacacgcatgcatcctgttttcaggcggctagctcctgcagcgcaaactcggagactgcgcctcgctctcctacaaaaatgactctgtttgatttcgggatatcggaggaatcgaatgtagcggaacgatacctagatgtacgtacacctcgtcctacatgtgtctgtggttgagcaacgagccgcattgccgtctgtcccctatgtcagattttcttttgattactttttgtgccgagtcggacagctttgtttgcctatcgaagctgtctgccttcgcaatctcgaggtctctcgacaaagggcagaacgatgtctagccagtgcggttgttttagggggatatgaacttgagggcgggggcaggagcagttgtttgatagagaagattgctgcggcgacgtgatgtgtctgatacgcaagaaatgcctggcatggtctcagtgtctgtttgcagttctcggaattcga

SEQ ID NO: 2518 - DNA, 2402 bp, Toxoplasma gondii
agcaaaccgagaccctctaggacctcagatattgcgtgtgactcccgactactttctctgtctctcgcaagaggacacgaggagaaacgaattccgtcagtttcttcggaaaaaagcttagactcgctcgagaaacgccacctgtttgtgtgagaatgtgctgtgcaggcgtggagatacactttttgtatttcttttatgtaaaaagcgagtgtcttcttggtgtctcaccagcgaaggaacgcgaaacagtttacaaggcccagtgtctctcttcatgtctacagctgtaaatgcaactaataacccgtacgtacatttctaggtaaactcggagagacagggaaagacatcggcgatgtgtgattttcccgtcttcactgtaggcatagagagagacatggagaagacgagattccattctcgccgcaaatgccgtcttctccccacagagagaaggaagaaaacacaacagcgtggaaacctgggactctttttgtgtcacgaggtgtcaatacaccgtatgtctctgtacctaagaactggaagacacgtttacggcgcccccgttctgatgcaaagcaaatgcgagtgtgaactcgcggctcctggaccaccgctagcctatgaggcagtgtcagaaggaagtggagaaacccgtgaaaagccaaagacggtacttctgtcattgcagagaacgcgagtcgtctccacagaggtgctaaaactcgacgagcaaactgttacagcttggcacttttaacgcggcgtcagcgccacccccccccccccgcgcccggagggcaaatattctgaatgtacggaagtagtttcatgtgggtccagccacaccgaaacagtttatccgaaaccttataactagataaatacgtatatatgcacattgaggtaagtgacgagaaacaaggtacttgacacgcggcatcaggtccgtaaccgacagaaacaccacgacttgtccgtgttgaacttaatgtgaacgaactaaacacagggttgaaccccagcgcggactcctgaagaatgatgcgatgtgtgcaccttgaaagagcatgcactcgttctgtgtgaggcgtttcctgtgcattatgtatacaaatacactgtatctttacacgccatatacagtatgtaaatacagtctacgtccacactgggcagcggtctgctttttgggagaactcgtcgcgtttcctgcgttggaacggaaatcccttcggtcagagtcactttcgggcggatgttctgtccaagcggcgacacaaacagaagaaacatttccttcttgtcatttcgcagcggctgtacttgaagcagtagaaaaaccacgtgctttgtcggtgacccagggcaagaaaaggcgcaacgcgcatgcacacgcgcgattgtcggagtgacccgtccaggctggaacgggtgcaattctggctagtgcgtctttccctcgacttcttgctcctttttagttcgagttcgtcagagactttgctgtttctcggacttgtcaagtgctgctttctctgtcccggacaccggcgtcggctcgcgagtgcctgccgacgcagtgcgttacgtcccggctcgccgtcagctcgggagacacggatcgttgacagacgaggctctgcagagacttttcgacgtgaagcagagcaggtgtgtggcgtttctccaagaaacacgggaaactttgcgttatttcgtctttccgcccgatccgaaccctcgaagcgcctcgcgctggccatgtgtcacgagctgtatgtacacacgagacaccgacggctcagatgcgggctggtcccgggcgccgcgaattcgcgaattcttgtactttctttccaacaaaagcgatgtgaacttgatgcgttaggatatcgaacatcgactcttttccctgtcgcagctttgagggtcgcggttgtgtggctggggaaacgccggcgccttctgtttagaagagactgcccaggtgatgattcctcccgcgcgaccccgtcgggaccttcgtcgatgcctagagggaaacctgcggcgctcggagccgccttgacaggtcggaaacccgtgaaaatcccaggagttccctctcgcgtcttttctccgtggatgaaattgcacttccatcgctgctataagcgcgccgtccccgccagtcgccttcgtccaggcacgcctcttccctctcggcgtcattcctcccgctgctccctcacctgagcaatccgcgccccgcaaacaagggacagaggattctcttcctcaagaaagcggtgctcggagagcctctgaccgagtccatcggactgcaggtgcttcagtgtattcaagttctcagtttgcccagttcttcgcgagaactgcttgcagctccacatcta

SEQ ID NO: 2519 - DNA, 2316 bp, Toxoplasma gondii
gattctggaggaattgctggcctcgaatgtcgtctcggctgtagagtcacacgcgataggctcgagccctagagagacgccgaagaagtaaatgggttcatgaaatgttttttctccggttttctcattgtctgtttccggtcgaacaacgtgttcgctcctcgtgggttccagaacgaatctttaggtagcagatttcttttttctcttctcggtcccgtctccgatttgaggggcgtctgcgtactttgtttatttgggttgttcgcgtttcgaggcgcctctctgagtttcagggatctgtttcttgtgtctctgccgtttacaaacgaaaccagaacacgactcatgcgtgactcacctctatccgtcaggaggcgctacgggctccgcagctcgagagaaaggtaacttgtcattgtcacttctaaaaacaagattgggcctctttctcgcgcttatccacactcaaaaatggtctcatttctttggtcttgtcacccgtgtacactagtataaaatatatatactgctgagaatgtggtcaaagacatatttgtggtcatcactcggtttaagggaaagaaccaggtgcttccgcctcacctgcgcaggtatccgtggatagaaatgcatccccatgtgatctttttgttctttagtgccacttagaactctttcaagcaatgtttaggtgatggagccctgttttccgacgggttccacatcggtcgtttaccaggcgtaatctattgatcactgttaccactcgtatcagcagcgaaagagaacgagtactcagatgctagggtgatcggcaccgctgtactgggagatgtccagcggcactactaagaacgaatgccgctacctttgagcaaacggcgttattctcgcgctgtcatgctgggtcaaatctgttttagatttttagggtaagaacgcagtagagtgtgtacgtgggggatcgcgagagtggagaatcacagaacggtgcctctgttacaaaatgaaagaaggtcccacgctgcttctgaactgtcatatttaattccctactttaacggtggtttgggacctagctgcagctcgattttctaactgtctgctgtttcattcgtttcctcatgagtgtcccttgtgcccgatcgtttttttcggatgagcaaaagaaaactagcaagacacgtagcatacttaacatggagcatcgcccgttgccctgcagtggcagtcctctgactacctcccgcccctgccccacagccctccctcttctgcgaaagattggcaaaaccttagacacttatactaataggatctgcacacaaaaatctagtggcaagaggcttgtggcacaaataaattgaggtgcaaagtgttataaaccctttatccagattgccgtcgtctgttctacttcgggagcgtcctcctgaggaaacgcaaaccaaaggacacaaagaagccgaaggttgtagacactggaaaatagtgtgaagagaaagtgagaattatcattcggctgtctccacagatgtccaaaatgtcgattcccgaacttttctctgctcttacccgctcctccaccggtgtactacaccctcccccccctccaccaccgaccctgctatcaccctttttccggtgcttcctttctctcgccttttcttttgctcggagacgcgtttgagaaaaacaagggacaaccttttcttcagcgtagcctctttttcgtcgctagcccaaacgctccacgttttgttgcgtggtatctctgtttttctcctcactccaggtgtaatgccatcgcacacatttttctgggctccacaggcaccgttccggtgtctcctttgccacaaatttttcgcgcggagtttttctctgtattcgctccactttctcggctaccctcggttgtgtctcttttctcctgtagctgtcacggcaggttgcccgaggacgatatccgtcccaattcagaaactttcaccgtagaaaatcgaggtcacatcccctgacctcacactgcgtgtgctgtagctcgcttcccgttgtttctctccgtttcttgtcgttcctgtcgcttgtcacccgtcagttttcttgtccacttgcctgtcaatcgctctttcgcatttctctcctacactgggacgcttttttaaaccctatttcccttgcgcccgtgttcaacccacccagtccacaagcgcctctccccgacttcttcgtctcgccctcgacagaaacgacatctctttcacctgcaaagagtacggaacgttttctcaccccctctggcctttccca

SEQ ID NO: 2520 - DNA, 4984 bp, Toxoplasma gondii
gggcgctctttgcattcaccttcttctttcgcgagagttcgaggaagagtgccttcagaagcagcgagagaagagacagacgcacgcgaaggagagagacaccacgaggactgcaggagaggagccagtcggacgaagggaggaagccgagagggcggagaagagggcagagaggccgtcgccgtaagactggaaggaggaacgtgaagaaggacagagatgggtggaaggcgcttctttgctggagctcgttcatgcggagaaggatctatgaatcgaggaagcagagaggaagagaggccgcttccagcaaagcaacaggtaccatcccggtacccatttccatccgagatgctatgtgaacaagcatgcggtcgtcgacacgaacataagccgctgttagaaaacgaagaaggagaaggaagagaaggaggagaaggaggagaaggagaagaaaacgaagaaggagaaggaagagcagagataaagcaagggatgtgtgaggagacagaagagaggagttgccgatgaagaagacgggtggtttgagctgtgcgggcgaacggaaggcgaagaagagaagagagctgtgaggacgccgagcgagggagagtagagctgacagaaaaagaatggagatcaggaggagaagggtcttgtgaggaggtggaagaagaaaagagaggcaggttcaacctcgcgccatgtacaggacaccgagagaagacacaaacaaagagaaaaaagaggaagcaggaagcagacgagaggggagagtgaaacacccccattggtcttagcgtcgatgggtttgctcaggcgtcgaacgcacgcagatcgaagcctgagaaaaaagaaggcccttcaagaaatacggatcgatgcagcaacgagaaaagaaactcgaaacatggcgagataaaagaaaaaggacatacactgcctcggtatctaacgtagccttgacgaacatccgtacacaaggggtacgcatacattcatactggttgtcgccttctaactctctccggcgaggtgtatacttgacagccaacaacgatcgactaactgtacaggcatcattcacttcggtagttctttcctcgagtgtctccagtctgccagtctgcacgggatacacacatttcggggatcctgcaggtcgaacccccagaaacagttgaggagaggagcggagacggcgcgggagagaagatttatcgattcttggtctctctgggttcctgtcgctctcttcaagaggagctgagaaacccacaagaagtaaattccagttcatactcggacgacggagctcattcgtctcgcgggcgtctgtcgagagctgttcagggcaccggggccattgctgcggggggttctgtgtttgcgtcctttgttcgcctccacggaagccaggaaattttttgtatttgaagccaacaaagcatcccggttgcgacaaataaataaggaaagagaagagcggataaaaacgcgagaaaagtgacagaaccccgacactgcgccctcctgtggcgcgcgtctccttgtctcgatgtgcacgcgatgtcttcagccccgagagacgcggccgcagcggccgatatggcaagcaaccggggaaaattagagactgaaccatcaggggaaatgcgaggtttaaattcgcttcacctgactctaaaagctctgcaaaggagtggagcgtgtgtttctttgctccaaattcgtcttcttcgaggcaagcgcgggcacgagaaacgaggcttcagttacggggcgttgtcattctgggggaggtggaacgccagttcccagagctcttccatcgccacttgtgtttgaggtcgagtccacttgctaaacaggtcccagaccaacgcaaatccgatccgtgcattccgaacaggctgatactgagaaggagcctgcgaacgtgaacgatactttcatggcttgtacacaagtggcggatgttcaaatatacgtttgattccactatacttgcagtagctttcttcctcgtcttctgcgtggaaaagagcactctccgtttactcatctcacaaagacccaaaggactctctgcctgtggttaggggcatgtgttccttcaacaagacccatacggcaagttatcatgcttgcagtgtcaatctgacaacagcagaagcgagactctctgcagctcgcacactctgccgttttcgtctcacagacaaagcaacgagataacaaagattccaagtatttgaaagactccgtgggtcatatggaaatcgagggcaaagggacgcaagcatcgtgactacgaactggcgtatggacggccttagagagttgccgcatctgtttccggaaagtgaggaagccggagttgagtgctgtgcgtcagattcccgacggcatcggcaacgaatgcttttcatttttcacgactgatctttcgcacagcactctcaagggcgtgctgaaaagctgcgaattaagcgggaagcaagtacgatttccatgggttctcggagctgagcgtcgggaggcaaacggtccattttgagacaagggaactggaacggtggattcccgtgtcacgtgtagagtctgtcgagtactggctgaccttaacagtcgccggcgaacacgcgaaaaaaggaccttgctctgatgatctatttgcactgaggcaataccttgcctgttcaaagaggaatggattttgcacttatttgagtgctgtgcttgtcgtgagactcgagaaaaacgcgggactctgaggctcctgttgatggcctcgaaagtggaggggtgacggtaggatcacaggaagaatcgtcaaaagatattcccacagcagggcgactctgcataggagcgcccgaacgctttccggtcttgttcgacttccgtcgtcacattcagtgtcatttgtgtcagcaactacgaccaccaccggctaggagtattgaaaaacgcgtctacctcgccgctctctttgacgggtcttttttgcctgagtgtctcgtgcaggccatcggcataaggtaggattcccgatttcctccgggtactttggtctcataccagcggtagaagttaggttctgtagcacatcactgaatctcaaccactagatgcaggtacacataagtggacattgttcagcatgtttaatcgaggaggtggcgtctagaagacacaacgaaggttcagcttagagcctcacaaatatgcataatttaaagtggcacggtacgtacgttgtgaagttaaggcgttacatctttcggagaggtttccaagcgttacttcgaagcttagactgacgcgaatgctccggcggacacatcgtttgtcttttcacttaacttcttcgacaaagggctttggtgcctcgtctgtggttcgtcgttcgtgtcagggagccgagagacagtttgttccctctctaccatataaattcgtgtgaatatatacaccagaactacagtgtgttactcacttgttcctgaacaggattcagctagtaacggtaggtcatcatcagaaatgacacgtgagctggggtaggatcgtctggacgcagtttgttccctatttgccatgtcacgtgtttctacagcaaacctacagtgttcaggctgacgaattcagggtccaaaactacatagcactcaacagcgactccgtcttccagcttccaaataaactttatatgaaaatgagcgcatgtaaagtcgtcgtgaaaaagccatgaaacacggatagcgagacaccgttgacgagcacgagaatcggtcactcgtccgacacctccagattccgtgaatttctgtggcaaagctcgtttctagaagttagactcggaaaaaccccctgttctgcaaaaaggcgacacccgcgaaaacacgtcacatgttggatatgcctgtcccgtcgaaccccctttcgcaggcttgtgcgaggggaagctgagagtgtcgcgtagtgttgaagtcgacgaaaagtgggagcaacaccctcctcgttcgaccttcagtcgcacccgttacattagcaattatccttattatacggtcctcagaaaaacgcagcgttctctgtcttggcgtgacagcccctcgtgtgcggaggcaaggggtacccatgacccgggaggcgtgtctccgcgatgtagctttttctcgggtgcgtcgagtgtttgcccttcgcagagtgacaaaagctcccttaccccaaaggacttctccatgccagcttctggagaaggaacgaaactgggagaaggacggcaagatcctagccaaggaccttttcgggatctgagccgaaaggttgagagacagccgcatgcgtgccgcacccccacttcctcaaactcgaccctttttcggacgcgtccgaccggcctatccgtgcgccgaccccgggaaaacgcgcctttctggtatataccgaaacaccgtcctttgagtccttcagtggaatttctcaggtgtgtgcattcttgagaacccagggatccactcggggagcttgggggacacgacacccgccaagaaaggcggtttcttctggtgtcgacgcgagtcgtcagcgcggttcgtggtgccctcctctcgagaacccttgcagaaaagtgtacgaaggctcgaagttttggagatcgatgtgttgcctctctgtcgcctctcgcctggaccgtgtcggtttcgagtttgctggccccgcgtgcagttctagcggagatgcgagggttttttctgttgtctgagctctctgcatttgagcatgaggagtccgaagctgcggcatgagcagttgctattgcatttgggtttgcggaatgatgctcagcccagcctgtgacgagcctggctcttctcgtgtccatccggccgagtcgtgtggtttctccgtgtacagtctgccgacttgcttccggtgaaccgtggagctcaggcacgtggaagagctgtttcca

SEQ ID NO: 2521 - DNA, 2312 bp, Toxoplasma gondii
gagagcagcgaatatgccgaagaagcaagcgaagcagacggagaaggcgacagagagactcgcgcggtagaaccgagagaggaggagagagggcggcggagacgagaagagatgacagaggcgtgtgttgccagagtcgcagagagcgaagcccgcgtagagcagcagcgcgcgtgaaaggaaggctgtcggagtcctctgagaagcagagctgagctacaagcggaagaagacgcttgaagcgacgcaggaggctcaaacagcttcgtcaaatgtggaggaaccggcagtggggcagtctttgtgcagaggagctcctcgcccgaacttccaccgcgtcggcctgggcctcggataccgaaagcaagccatcgaggtgtgccagagacagaagacgcgagaagacgggagtgaaggagagtgccagacatgtggcgagcggatgttaccctggggcccagtggctctgctggcgcgtgtttggggtgttggaggcctctggaaaaagaagaaaaagacgagccagaaagacagactctgcttctgtgaagagagcagcagggaagcgcggtttttttcgcggcgagtcgtagaggaagaaggaaaaggcgggcggagcgaagacgactagggaaggcggaaaaacgaggaaccggacgacggccacaaaacacatgggagttgccggagtcgacgccccgcaaagggcgctcagcaatcgcaggtgccacggttgccatgatagttcgagaagtttggaaacggtggaagagcgacggaacgcggcagccagttcgcgcaggcccgactgcgtcagcacagcaaagtctcgggtgagttccgcgaccgtgcggtcggaaattggaagggaacacgccaacgagggaagcagccgcccggcagacccgcaggagacaacgaggcacagtcgaaactcagcaggagacccaacaatccattcagaagagccagaactgcagaaatggacgtgcaagcgaatcgcgtgtcggtcgtccaaaccgccgggcgtgtatgtacacccgaccaggtcagcgctcgatgtcagcaaagacaaatggcttcggcattttctagactcggtgtgccacagaacgcagcgaagtttacgggagagaaggagaagcgagaaagaagaggccgaaggaagggacgggagcagaggacgggggttgtcggaagggtcggcgaggaaaaggaaacactgtgtgtccctgcagagcctatgccgagcgaatccgttcgacagacagctgcatcgtgtaccgtcagggaaagagtttctctctgctttgtcgttggtcgcgcgaggaaaaactagtgcagttgtcagcggaaagaaaagagttttaccttcttctcgtggactcgtacccggctcacgcgtgcatgcatgctcatgttggatatggagaccaccttcgatgcttctgttcctccggagctgccgacgaacaatttcctcagactcttctctcttccgtcgttctttcgcctcagtcctcgtagaacgacagcgacacaaagtgcatgggctgcagaaaactgtgtctctcccgttttcccgtgtgcctctgtgtggctctgtcgacagtcaacaacgaagactttctctgcaagcgtcgctttccattaccttgtatcgacaggcctttatttagggcatgtgaatgagctacgcccttagttttttcaagcgaggctgtctctcccgatctgtttcccttctccctccggcttctcttgcacttgtgcggatgtccccgttaacgtttctagatctctctggtctccgacttttcgtgtctcaacagttcgtgtaaactcttcctttccgtcacaagctcgctttcgttcacgagttacgagtctctcgactggtctgagtctctgcctccccccctgtatgaggtttctttcccctgtggcttcgggcctcctttcgagcaccattctcctttcgttcttctgtcgcgcgcagtctctcttcttcctttcgtccatctgtctccgaggcttttcttgtgcacactgcaaaaattccctctcttctccttctgcgcgcgtttttctcgtctcctcgcctctttctcgccatcaagtgaatgctagcgtgcttcgtgaaagtccgagcactctcttctccttccgctgtgtttcctcgctgctgtgcctctcctcctctcctcttccttctccacaacagtctctttctttcctttctctcggaagagctttcttcgctcttccgcattcgccgggcgaaacgccgctgtaggcacgaacacgagcga

SEQ ID NO: 2522 - DNA, 1651 bp, Toxoplasma gondii
acggaacacgtctatccaatgacatcggatggactgacctggagaagaagctccaagtcctcaggggtggttcggttttcgaggcgaaacgcgcgaatgatctttttgactgaacataacagtccgtgcaggaagggcagtacgagaacgcacaaatgagcgtgaaagttccaacgctaagagacaagtgctcctgcgaatcattgctgcgaatcaacgaccgtgaagaggcggagaaagagttaacagcatgcgtaccttccgtgcaaggggtgatctctgaggggacgtggagcacccggagaagctcagactgtctctgcgtgatcgacaagagtcctgaaacaggtggctgcgtgtcgagaatgagcgagttcaaggcgcaccagtacctgccaggaaaagtgatggagggaggaagaaaacgtgggtgagccgcgaggagccaggattggacccgacacggcagtcgcaggctgaagacagaatcctgtgccgtgaggacgtcttcaaagatgagccttcggtccttaccatattggctcgaggtggaaattgctttccttgcaaagagcctccagctctttgtagagcggattgtttgggtccgcccgcactgaatgtagcgggggctctctcaggagtgtttctccggcttgactgttaccggtcgcgtacagaacccgtcctttgaactcgtgaatctcgcatctaagaactccattgtgattttccttggcgtagttgttgataaggtcgacggttgaagctgactccatcctaactgtgagacattagacgctctaaggcgaaaaaaattgcacgcgcagacgagtccgaaaagaagtatgcagctttctgacactgaatacacagaggcagcaaacggtacgatttgctgttgaaaggtctctactcaaatcgaaacacagttaaagaccgctagcgctttatcgtagtgtgtacaccttgattagtccgttgtgccgcaaacgaaaggaacgctagcacactcgagaaggtgcctgagctgtacgtgatcagcagatgtttccagtgacggacaaacgacatcctgatcatggcactaatgtggtaggggccttgcagtcctagaaatagcgaatgaactgaagcaggcactccttttcttgagcgagtacttctttctatcaaggatagctgcgcaagtgcatgcgatgcagtcactcagcgcaccgctgacatgcaaccgactgggactacacgtgagacagcgtatttcctctcccaagatggcgttccccagaggacaacttgtttgtattctgcgcaccatactgattggatttaataagtttttgtgtagcagctttgagatcatctgcagaatttatgggagggactgcaactacatgcgttgacatgtcaactggaggcgcatcggcgatgcccaagtcctgaccttcagttcgtaggtcgaggactggattgcacgaggcgtatcttccgattcatggtttccttttccagcctatatacttgacgggtgcgacaaaagctgaaggatttgagcgtaggatgcggtttagtttccttttgtggtatgcgcacactctgcatggtgtaatgcggagctgaccaccggcgtcttccgtgactgacctacaga

SEQ ID NO: 2523 - DNA, 2110 bp, Toxoplasma gondii
cgtacacctcttctacgctgaagaagaggctaacgcgcggaaagtcgggggtttcccagtggaacgcgcgacacagctccaggtgaaacagtgtgcttcctcaccgatttgcgaagcaatcgacgacttcccaactccacccttccccgagagaaccatgaccttcctcttgacgtttctcaaccgatccgcaacttcgttcgctgccgacttctgcgcaactgccgcctccgcggccgcgccgccggcacacaacgagcgattcggacagcctgcacatgcgtcagacttcccagcgtctgcactggaaactcctgggcagtcttctctctcagcagccgccgcatcaaattcagaagcagaagaagcagaaggaggagacgaaggagacgcagggggaggaggaggagaagaagaggcagaaggaggagaaggagagggagaagaaggagagcaagaaggagaaggagaggaacaggaaggagagagtaggtttgttagcgatcggataagagcagtttggaagggacaggagcgacctcgtttgaagtggaggtaggcgagagtgcccagagttgccgctgtgcctagaactgcccctgaggctgcacccaggaggaaaacgtttcttttagaaagtgcgaaagggtccattttctgggatacgaagtggcgaaataaaaggaagaccgagtaataaagaaggagacgattcgtcttcaaacgggaaacggagaccgagatcgaagtctctcccccgaaaagaggagaaaagagagagaaaaaaatcactcactcacgctgtgcggaagacattccgaggtgtacatacacctggaactgtaggaggttcttcgaacagaggttgcagaatgaaggactcaggaccctggagatggaaagaaagtttgttctccacggatttctcaggtcgaggaaaacgcaaacaggacttcttttcgatcgacacctgtcggagtcggtgtctgtacagccgatgttgtctcccaggagggatttgcagtctttctgttcccactgcaccgagtttagagcccagagacgttgcgtatttgaagaagtcggcgcgccagtcctcccgtctggcagaacgagagctgtccagtctcttctggagcgtcaaaaaagaaaaggtcctttcctcgagagaaatgtgacaacaccgaggaagctctcagaaagggagagaaggtgatggagagaaacggaagacaaaagaagggaggggaagaaaaaagcgagaaggtccagggcagaaagaaaatatcttttgatgccgagagtcgctggaacaactgcgtcgccgactctactagaggcgtcaaccgcgggagaagtatccgaagaaaactggaagaaaaaaaagagtttttccctctggatttgaacgagaaggcgtcgattccgcttccgagtggctttcattcttccaggaaaagccgtctttctgagttttttactggcatcgtgggcatgcagccgaaagcgagcctgctcgtcttgcgcagagacacacaagcgcgctgagagttgcgcaaaaacgcgtgtgtcttcgcttctttctcttcgctctctgttcgtccacttcggcgtgagtacgttcaggcggaagagagatttttctctaacaatcaagttcccgacccgcctgttcgagacgcagcaccaagagcgtctacagccgtttttttcgtgagcctctggtgtgtaaaacttgcggacttctttcgtccgccagctctcgccagcttcttgtgtgtcggcggttcaagtcactgatttcttctccttttctttggagcgtcctcgcgtctcctgtgtccactgcagcttccccttagttcgtgaatctcctccgtacagaagccgcagtcgccggctgtcggtgaggtcgcgtcgggtgtcgagaagtctttccccgctgcctctctgcgccgtcgtccgcagttctccgtctcactcctgcctcctgcgctgcgaggaagccaactggcaaggcacttcgtctctgcaccaagagagtgcctccccgcctccagagtcttgctcccgcttgctgtcgagaacgcgcgcgtccgctcgtctaaaa

SEQ ID NO: 2524 - DNA, 3018 bp, Toxoplasma gondii
atgaccgtttcagcaatgaaaacggtaacagcgcttccatacatacaaaatgtgttgtgtatacgaatgcacctgaaaatacgtatcaagtcgcactgttgcgtttccgacaggacataggaaagggatcgactcctcagcgcacggacgaagagataactggcgacatgttgccaccatcatccccaaaggtggtttttcaagactcgcacaccctgagctgttcgtgtgggagtgtagatgcaaacttatggaatcaatgtagcgtcacagaacccgatggttgacgggaagatactcggaagctgtacctgcaaagaaaactcattgtaggttccttctcctcgtttcaatcctccttcccccgtttcgttcttcttctccctctgctggaacaagacgcaggcctcggccatagcgtcgtatgccgctccctcattccatgagtcaaacagcgaagaagctgaaggggtcgaggccggtgtctcccgatatgaataacagctttcgtccagagccatggggctaccacaagagcactaagagtctgaagaagcataaaagggcaagccagcaacgacgccagcaagcagacgtagagtggaggccgacagtgaacaatccagggaaaaaaacgaggcaagccgaagccaagacaggcacaaccacttcggttgcgcgaattgatggagaggcgcggcagtcgagcggcaaaaaacggagacagaaggacaggaggcaaacgcgaatgggactgaaaaagtgaaactaggggccccggccctcagcgcaggaatttaccttcacagggccgtttcctcattgcagctcgggttcgcggttctcgctgtttcccctctcgaaattgttgcagaaaacaagagcgattaaccgttcctttcacccattttcactctgagacaatcccttgggttcgctatatttcctccttgtcttttactcgctccaattcccacatatctgggtgggcgccgaagcgcttcggagttgttgccgtggccgtggtcgcctctcacgtcttctggccccttcggaggttgacacagtggcgcttgcataaaagtagccttaaacggccatcatctaagggagacaaatatacagaatggacgcgcctctgggcggcacgtctccttctgtatttctgcatgcggaatgctcgagaaatcagcagacgctcaaccttgcgactctctgcacaccattgtgtgtggtaacttgcgaggaaccagcacgtttctacagcccgcttcgaccttgtcgacgtgtatctcctctctgttctcttcatcgcgagaattcttaagtttctctcgtattatttgctggagaggatctctgtacacttacgacatcatgccgagtcgggcctctgcgcgcagcgtccccagcaagtgacgcgagctcctttcacgagccggatgttcattgtatttcgccgcctcgcaaacgcatcgtgcccagaaggcataagtcaccaaggccaagcattcttttttacgaaaggaaactcttgtggcaactggactctgctgaacaccctcggtgccacttgcaagtgctgagcgaggaagaacaactccatgggcgttgctgtcgagcgagacctgcgtcaacgcacaacgcaagttgagaccggttctgggtcctctttatgcaacaagatcgctcattgtgataatgtctggatgacagtgacagaactcagctgtaaaggcaagtgtttcctttgcggaggagagtgtctttagttgccggcattcctgtctaaaaagccgccgtaacgtggctctgcgttcggcgggaaggggcagcagcgcgttgctgcacgggaactgaacaagtgaggtcgggcaggcgtttgggcggccataccagcagcgcgtaagaagtgccatatttttatctgtaggaatgaggctctttctggattgcctttatttgtcgtgtgcatcttcatttgcgtagggaactccttacagttgaaaacgtctgacggtgcagaagaacaggaagtcatagctgtaattcaaagctgtgtgctccgctccatattctgcgcttttagctagaaaatacaccgtgatattggagcgaatatctcaaaccctggagtagaaagatgtacaagggacacggcacaagagaaagagatagctttgccaggaaataccccgccaaagtgccgtctataatgtgtctcgatgtttcaggagtcgtccgagggtggcagctcggaaaggcgcacactcactttttgctggctgtatgcgtacctgcagccgttccgttttgcatattctcatagtcaacgaatcatcctctgtgcacaccagcaaaagtgagctttctcattgtcgccgtctgcctgttttggaaacgagcgcgtttctccccttgtgttactgtggaggaggaaggcccgtgttcgtatctcgtcgtgcttgctagtcagcacccttcgctctgcgcaaagcgagacagttggcctccaacggcagacagacaacagatggcaagacagcctttacagcaattctgcaatttgcgttcactctttcaccaaaaatccttctgccactcttcccactagtgaacggcgttctcgattctgccggcgcgtgtgccctccctctcttttgagcatttgcacgcaacgagtgaaaatagatgtggagggcgaaaccgtctgccccagttcagacagtaaggcaattctttgcaccagcaaatattcttgttcgttcgctccgtcatcttccgttcactttcttttgtcgtctgtgtctcattaggaggagtgtgtgtttccgcagttacccctcatttcgttgttggcggctcttgcgcgcactccccgacctgccgaccttcctctctactatcgttcggtctgcctcccaggcaaatcttacattctttcaggtgaaacctttccctccgttttcctctcctactccctcttcttcgcctccctctccaacgaaccgtgcaaca

SEQ ID NO: 2525 - DNA, 4470 bp, Toxoplasma gondii
cgtttaaagaggcgaggcaacgcagaacgcgcgctacggtgtctagacaccggagatgcagactcggggcttccgtacaacgttccagcgcctccgacgccccgagaggttcgcgggaccacgcagttccacttgctgctagctcgacgagaagaagaagtgaggaaaaaccgatctggtctgcagtcggagctgcaaggtcttgaactgagcgacggaagccgccttgggtcgaaaggcacttcgtcgctgaggttcggagacgagaagactcggcgaggaagcgagggagcgaggggggatggaggacccgggagcgaagtccgagtgtaggcggaaagccgagcagcgcctagcctctcactcccccgcgcgtcctcccatctcttcgactgaaaccggctcgggcgtctgcctggtgaagaaacaagtgaagagaaggtggaaacaggtatgcgcgtctcttctggaggatctgagttgagtcttttcgccgctccccggaaatccgcgccggcaaaagagtgcctgttctctctcccatccttctgcggggtgtctctcgcagaagtcgacgggtgcggctgtctccacctggccgcttcttgactggcgagaactcgacggctctgaaaggggaacgagtcgaaggcagacatcaaaaaggtcttgcacgcagagcctgacgggtggccggatccgttcttgaggccgcaagggggtaaggactgaacggccaatggcgcgtttctccaccactgtgtctccagtgaagaagctgcgagtgtctgtggagaggcatgttgctgcggtgtcagcggggatgcggggtagcacagggaatgtaagtgccattttctttgcgggtaaaggacgaaggccgaagagtctatcggcgagcctcggctcttgcagggcacagaggcacccaggctggttcgcggccgcagatgcgatggaactccgacggtaaatctcccgtttcttcgaacgagactggcacaaagggtaagcgaaggtagcgccaggcaacggaggtcctcgggagaacctgcctcggtcggccgccttttgaaaacaacgcccgggaacggcagagaagaattgacacggcgaagactgttgaaggtagtctccggcgaggagaccggagtgccgtgtaagagagggaagggaggcggtttgcctggagaggacaaagccagcgaggcgcgaaagtggaaacccacaccgagaaagaagagaccgaggctccggtggagtgacagcctgtatctacaagacatagaccgacgcagtccgttcggaggtgaagcgtttgacgaaaagaagaggaagtctgaagaagtcatgagatggaagagacaaaagacgagggcctgtggcaggacaaggagacaggagacacctgccagtggggctggcgatggcggcaaccgggctgtggcgccccccgaaaaaacgggggggaaagtctcccgtttctgtgacattatagtctcttgccgactcggcctccctctggaaagttctgagctcgtgcgacggttctgacaagcagctttccccaggcagacgtcgattgctggcgacgctcgagaacgaagacacgcgcagggcccgcgaacatgtcgggactgggttggctgtctgcgcgtgcatgcagaagctttggactgaaaaaaaatctaactatccgcgacagaagaaagctgaacgtggcgcttcaaaggcattttcttcgttccacaacaaatccttatttggaccttcatgcatgtaccacgcagtgacaggatacttccatgcaggatcagatccgccgtctggcgggacagtcacttttttgtgtcaggaggaggttcggcaagttgtgtcagtgacatgttttggcggagaagaggcaagaatcctcgataaatggctgtttagcaaaccgagaagctccagcagtccctctttcaactcgacgtagatctgtaggcggcttctgtcgttgccgcacccaacaagggagggtattgaccggagtggtagtccgcaggaatcgactctggaatgccatgataatccgcccaagatgcgacgcatcaagtatcgattcctcgaatcttaacttgaccgtgtccatagcttttttagaagtctgcaggattccatatccttctggagaagctcgatgagttgggatgggaaaagtgaaccttgacaggggtgcagaggccagaaaaaggtctcatatgtgatgagatggtcctcagtgacgcatacagtcaactaccaagacacagaaacagtgtatccgtgtggcgacgtcatgcgaggagctcagaacgatgccagacttcttggacgaaaccccaatggtacgcagcaataggatacttcttgaagtagggtccctggcttatgagaagaagacctctttgtatcgatggtcgccttaccggtattgtcaaggttgcagaatcaaatcagagctgatcaggccaccgaacgcctgctgatccacaggtccatgtgcgtctgcgacgttagtgtccgaacgctcttcgttgccgaggaaacactcggcgtctgttgcattcctggaatgctgacctcccaaagaagaccgcgagccacccgcgcaactagcaggaaagacaaaaccgtcgcagatatgtaaaagcctactgccggagtcgaaccgacgaccttccgcttactaggcggatgctctaccaactaagctaagcaggcgttcagatgccttgtgagactctgtctcttgcgaggctccaccaatgaacgtaaacacccgattcacaaacttgcaggcacgtttaattcaatcagttttagttgctgtttcgccccttcgaatagcgtggcaccgtctttgggtttacaacttactgcgaatgtgagacaggcaccttcgccgcggacgtgtgctcccgcaagttatgaggtacaataaatgcagaagacattaacacctgtacggggagatggggagtgaggctgaaagcattcttttctttgcgcagcactgaacagcagacgtcatcagccgcggcgatctggataaatgtttacctctacactgagcgggcctataagactcccactaatctcgctagtttcttttgtcgtcgagcagctttcccgtcctgtactgcaccgagaagaaggaaatacagcgaatcatctcaaaccagtaccagcggaaaagcagtacatcttaaaataaagcctactgccggagtcgaaccgacgaccttccgcttactaggcggatgctctaccaactaagctaagcaggcgtgatagcagttcgtatatgagccgacataagcggatagcctccattgccacgaaaaaacattctcagggtttagaggctcccctttccagagtgacttgaaaacgtttcgtgtaccaagttattaattcgagtttttccgcctgagccgcaacagcgaaggatagaggatgctcctttgcatgcaacccgtatctacccgatgaaagttgggtctaggtcaccatggacggctcgagcacagatagcagtgcgaatgatgtacaagtgtgtgtttctatcctaatccattctggcagtggtcaatgatatgtcgctttttccgtcgtcgaggcagatacctcctttatctcctttccctggtctgcgccttttaactgcccgtaacggcgtgtcgagctcacgcaaaagatcgggggacaatgcgagtatctactcgcgggattggttcacttggtacacaacctattcgctgacaagctcgtgagtcccaggaagacgtgacagacgtcgacatccactttctgtgtattctagaaccgcgcatgcgtgtctggtgaccacttgtgtctcgtcattgtacgttttcggagcctccaccccgccgttttttttcttttcaatggtcaacagacacacctgtcttcccatttatgttggggagcgcttcaaagtctatcttcgtcgagactccagtgtgtcggctttcgagtttgggggtcctcgcgtacggcgagttcaccgtgtacaagctgacacgcattttcgtccccgtaacacggttgacggttccgttttccttgtcatgacgccggcgatgcatgcgccttgaagggagagtcggtgtctcatccctttccgtgtggtaagacatctccagttccaggtcgtggaagactccggagtcgtgagccaaacgccaatcgccgccggtggcaagggcatttcttccgtaagcgtccaggaataagtccaccgcgtgcatcttctgtcagctcatcttcgatccttcgtacggttcgcactgccattgctacttgcggttcactaggaaggagagaaaggcgtgaaagcacgacgtctcgctggtgggaaggacgcgagttatcgcgcaaaaacaaccacggttccttgtctctttcgaccagaaaagatacccgaga

SEQ ID NO: 2526 - DNA, 3071 bp, Toxoplasma gondii
atgccactgtcagaccatgccagaggtcgacccgcggtgtttccagcttcccctgatggcgacaagaggccagatacttaacgaagcatccgatgcaaaagatcacacggaagaaaagatgtccccagctccatggtggccgggcgggagactaaaaaacagtgcattgctcaccttgcaaggaatcatcctcgtccctattcacgacttctttgcaaccaatagctgagcacacgtcgcctctgctcttgtatcctaggcgcggagcgtcaggatcgagtggcgcacgcccgccctttctttcgtgagatgcctgcagcgattctgcttccttcgcctgtctttcactgtgtgctcgttttggtggaggcggactctctatcacagaagacgacccgtcctcttcctttcggtcccgacgtctgctttttttccccttcccggtttggctccgagcagaaccggcgctcgcattcgacgagaccgtcattgactcttcatcctccgactcttcctccgttcggtccttctccgacttccccccacgtccacctcttttcgaaacgcctgttgactcctcgacgggcggctctaccttcgccgagccttcttctttccaactctggctcccgtgaacactgcccccctccgcttcatcagcggctgcagcgcttcctccttcatcaggctcatttggcgcctcgcttctttccgcgatgccgctctccgcttcactattcctggtgtgttcttcctctgctactccggatccctcaccttgttcttcatcgaaggcgtctgaagatgacgaattcgcagttgaaacacttttcttcgaggatccctgtctcccggcagatatctgggaccccttgtcagataccttcttctgcgagctgcttgctccctttcgagcgaaagcttcctcctcctcctcttcctgtgattcactttgactgccctgctgactcccctcttcctgtgactgagactcttcactggcattcgcgagttcgctgtctgcgccttcgtctttttccttcgcacgcttcttgcttttcgactggcgacctttcccaagttcgacgaaactcaactggccttgagagtcgaggtcgcttggcaaacctcctttagaaccgccaggaacgcgaaaggatagttgcctactacttccagcagacagcgtcaccgggtgacccagctgcagagacacagcttctgaaagcaaacagaagaggaaggaactcgccaggcccagcggtatactcgccattggaacttgaatgatgaggttgaagaacgactgagatgtcagtcattggacccgcccgcgtgatccaagatgccactacgcctacagcggtacttcagctagaacggtgactggcaccggacagacaaactgggaacttgagtcccagggtgtgccttcgagtacaggaaacggttgtgtaaagtcaaaacgatattacctttcaaagtgcagaagcacgaaactcgaagagagcagccagcttcgttgccacggttcactgccaaattgtacgatcagtcagatcaccaaagcagggctgggccggaaggtcactcgctgactcgcagccgaaaactggacagtccttgtgccgaaaattccacaacttaagatacgactcccacaagagaaacaaaaacacattggcgcaccactggacacaaaactaggtcggggacctcgattcagggagatgatggtattcaacaccgaactctgttgcggtcccgcctagcgcgtagcgagtcttcaagacacgcacggttccaggcgacacgaacaggaggaaaatcaagattctggctccggtatatcccaacctttccgttgcaaacacagaagtactttgaaaatcgtcagtcgtggagttcaatgaggaaacaagtgcgagttttccggtttttccccttcccgattctccaccgtggcacgaccgacccggcgtcagcgccaaacagctccaagggggctctctgcatggcgacctaacggggaggatccagaccccagaatgttttccagtttccaacacaactaaatgcaactgagtgtgacaattaaatacattcgatgcatcgcgtaagtggaattttatgttccctcattttctctgcttttccctaacttgccgcgctcgccggaactcggcacgcgttttgaggatgtgcagagttgatgtggcgcgtactcacaaaaatatatcagttctcttgtcctgttgaagatcttttttctgtcactgaaggtcagacatgatatatcttcttggtgatcgctgattatcgtctctccagcgtcacttccgtctcgtaaaggcacacctgtctcgaccggactccagttgaggaagatcccttgaagggtcttcggaggttcctcttgtctgcttcagggttccaacatttattttgcttcgcgctgcttatctcccagatttttgtttttcctgttaacaattgcctgaaataagcttgtctcgtacccaccaggaagcacctggaacgactgaataacttgcgaaactgttgtttcttccaggatcggccagagtcgttggcggggcggccgcgctggcgtcaaaaatcacttgaagtaacaccccccttcttctcctctaatacttcgctgttcatatctccagctccctttatacccgattgttgctcagattcggccacaactgagtttcgtttgaatttgcgcgtcgcaggaagcatttcctctctaggctttcgctagaagtcgctgccggactcagccccttgaaacccgactgtttcaagcacaaggacgacacagagtgacctgtcagagctgaaaaaaagttcgattactccttaggcacgtgcacattcaagctccctcttaagcaacagcatcttggagacttcccactatcgcacgacttttcccgccgtatcgctttttgttctgcgctctgactttcgccttcttctcggatgtcttccaacaagttattggcagacgaaggtaacggccttcttctgcatccccttcagcagtctgtcttcta

SEQ ID NO: 2527 - DNA, 2023 bp, Toxoplasma gondii
tattcgttacatgaaggatatgctgatgttaaacgaagcaacgaaccgccacatcaaactacaggttgctggtttggacggagtcgaaaaggaggggcacgctttcgctgttgccttggatccttccacagcggagattgccaggatttcaatgacccggaaacatatattggagggcgtgagggcaggcttcgctcgtttgtacgacgtgattgtccccgacccacagaagaggggccgcggatacgaggaagcattaaaggtaaggaaattttggaatcccacttttgtaatgtatgttggtggacgtaggttcgggtaattcgtcgaagcactatctgttaccgacccggctttgcttctaacgaaaacgtactactgttggcgcttctgtggctgcttcgacctatgtggtacaggtgtttcctacgaatctaccgggcgtaaccgaggctttcacttcatctacttcgtctgtctcttcatttcccttggtgccaccactgttcgacgattcatcggaggtcacaacagatccaaaagagctcgaggactatgttatccgagcggcagccagagagcgggagagacggaatcttctcgcaaatgatgcgaactcctaagcgtgcccattttcatgcaataactaagagggcgagtgtgggagaggggcccgaaaattgcactgctcgcccagagtgactgtctatgcatgtatttgcgtactgtaatatacaaattgtgcgaagttgaatatatgcatgtatatgcgtacatctacgtctccgtataaatgtttcatgatccgatcgtggaactcatttcccatccattttgcaggagggcgagtagtggatcctagaaagcttcacaaataacatactcctacaaatgagtgatccaatctagtgtgggtatagcgcatcgactactgcaggcactagggcacaccccttcaccgacgactagcagcggtgacatacaaagaattgcgaagtgacacaagtcgattcagcagagaagcgacggtgtcagagcatcttaccactaaggtcacaaatcctatttgtagggacgtcagacctcgaagaagtgtgaggcatcactaagagcccggccaaattctgatatctgccagtgttgtacagagagccaataatcaaacgtggttcgtagccccaaaattttttctgaccgcctgagacgttataccattagagagcagctggaaatgcttgtgttacatgcgagaagcagtgcgcatgtcaatttttgtgcatagtgctgtcgccaagacagacgtaatttgcctacgctggaggcgcaggactctttaatccgcactttagcgacgggccaccctgatttccaccgttctcatgaaaactgcaccttcactgaaggtttgcgctgaaagtgtcatccagaatgacaggttgacccttaagggacataatgcataaacgcacaccatgagtgcatcgcgactgctttcaatcaatgcattcgctcagtctaatgtttatccatgaaggggacgtacaatgtgacgattttgtctgcccacaggagaaaatcgctggcgtgactcatgacaacatggaagccagcttcacattgcaaaacgtgcctttctggcgcaaaaaaggggtgcaagcggtccccgagttccgcagtagtatacgatccaactgtgggaaactaaccgcaatacgtagtaatccagcattcacatccgacacagcatgagcaggccgtgcgcatcccgttcacagcccaaagagcatcttttggtccaaggttgggaggcgattcgacgctgccgcgcgtagagagatgctgcgttttccgggcacttacagacaagacgagcgtctatggatgcgaatgttaccgccaatttgtaactctactgacgagtctgtcgattttcgtcttgtcgagagaaggggcgttgcttttccgttgtaaccgccgactttcttttttccgaagaagacagttgtaaaggcagacccaaaaa

SEQ ID NO: 2528 - DNA, 1574 bp, Toxoplasma gondii
agtaatccactacgtggaaccgtgcctgggagagaagtcaataaccaccaggatggctgtacagctgaatctaatgagcaggagtagtggagaatgtcatccaactgacttggatcgtgtgattttgctcacacaccctcatcctcactgtgtctatcctaagggcacatgggcattcgaactgattctgaaactcgaagcaatcaaaccagagtggttaggattatgagatcactttgttacatctggagcggcgttcgtggccgtggggatgttccaaattctaaggactaatcgcttatcatggaaacgcgccaagactaactctagggcactgtcgtgccgtgaggctgtcaccgggctgccttcaagtacgcgttcataatcatgacacaacagtgtggtgttagcaaacggatgcgtcatgataagtttaatggtatgttgtgctggttactcactttcctctacacagcaggcgccggcgctcagaggtaatagatacgtacgtgcataggaatcatgtggatcgtttatctattgctggaaaccgacaagttggttgcttatcggtgaaacgccgtgaatactatacaatcatgacgaggcaccacacacggggaggtgcaacatcgaagttgaaaatgaggccaatggagcaaacaggagacacacccagaatcatgacgtcgctgtttaaaagtgcggagggtctgtgggcgatgaaaactgtttttcgtagtttccttgatgtttcgtaccaaatttgacaggcagcctggagaccagaatccatagaaatagccacggtgtgcaaatgtcaatttctgccctgtacagagatccctgtgtcggggaatcttacggccgttgagaagcacggcctgagagtttgcacgtgattggggatctttttgaagtttgaatgggcatcgtatggcttaaagtttagacatgtaaccactagtcatctgaccggggaacagatttggaatactggtgccttgttcagaataaagattttgatttcaatgtaagtcgctgttatttcaaaaagtggagtccaactatttcgctaaaattcgttggccgccgacgaaagagcttttcagtgtcgttaaggatgtggcagcagattcccgccatattttcaacatgtgcctgtgccattgcaattacagattcttcgcccttgcctcagccgccaagcttcaacgatgaaatccagtaacaagacagttctttaactgacggtaatcaggggacaaagtgttcgctttttggttcatctttgaccgggtaaaattgttctgaatatcatacgagcttctccagccagagagacatgtgcgcttgcggggtgcgccccaccaaagttgcctgctacccggcttcgctccttccccatttatacaaagtacgtgtgggcgccgtcttctctacacgtgacagttgtagttcctttgcgtcgaaaaacgtcctggagaattgatatacatggtggccatgaatccgatgatatacacttttctgcagaactgcctagccgcgctaagtcatccgttccacagaaa

SEQ ID NO: 2529 - DNA, 1363 bp, Toxoplasma gondii
gagacagacaagtgtgcttgcagagatgcagacacagggaagaaggcagccagcaccgggtaagcaattcttcacaggtcacgagtgttcatgtttcactttgtgctgcggacaggtaaatcttgtctctcctcatggcaaggggcttgtcccccttttgtctcaactagcgcgcactgaacacccacgggaataccaggtgagggtacagtgcgcctccggaagaagccacaaagtttgaggcagaaaatgtggaaacgaatagtagtcgaaagagatgaagaaggcaaatgggtgttaccctttaacaaagaagcaaggaacatacgatggagaaaaggttttggaaaaacggctccgaattgccagacagcgcaaaaccgttttcactttagcattgaaactcgtgtctagtgaaagcaagcgtcgcgttcgacgaacgacgaaagggaagactcgacaaggataataaaagagactgcgcccagaaacccagggcaaaacaacgtgcagggttttttcaagaagcagcaggacaaagaaaggagtcgagagaaggcagaaaagaactgttgacggtttccggaatcctagggaaagcaacgggacggagaaagcggaacgaaagggaaacccgacatgacaagcggacgacaaaagacggacactgtcgacaagcgaaagaaaagggtgccgctgatcaaaaaggaaattcgaggcacggacgagaagacatcagccgtcgatgctcaaggaaaaggaaacgacacacgcagagacggccaaaaacacagagttcagccagaaaagtcaggcgtgacagaccgcagagaaaaggaaaactaggaggcgaaagcaacgacaaagtaccgcgttgttccttgccagaatcaaaggaagaccggacgccgtgggagcgccaagaagaagcggactctgtccatgaccaagccgaaaggcgacaacacttggggacaaagaaacggagaacacgaccgagtaactttggcggacaaattaggaggacacacgcgactgaggacattataaaaagctggaaatagtactcgcgtgggtcggtcgcacaaaataaacgttaacgcatgccacaaacactacccaccccttgccgtgtcacgccagcctcttttttgctcgacgcccgctcccctttgttccacacaatttgttatctcattgctccatataccttttcttttttccacttgttcgactgacagccatgggatctctaccctactctgggagtatgagttgcacgcgttcgcctctttgcgtcttggaggttccagctgccgaccgctgagggcggcacaatctaccgcgtcgacaacagcgcaga

SEQ ID NO: 2530 - DNA, 3842 bp, Toxoplasma gondii
gtcttcaagaaaagacgctggacgggaggaagaggcagcactatgtcgcttggagagagcattccctcggggcttctgcggggtgcgcagggacagggcgaggagaatgagagactgcagagactcaatgggggggaacttgagcagacgacggagacacgacgtctcgtcgctggccaagagattctctcgaacaaacatgagcatggcaagagcaaagaaatccgttagcgggagacgtgaagaagcagcagctcccagtttctcagggacatacgaagggctggaggacgacccttggccgagcggcgaagtgccgcaggcggccgacaagcgactgctgctcatgagatctgtgccttgtgtgagagaaacgccagagcaactgggagagggagcagaaaggacagcagttgaggaaggagtggaattcaaggaagacttcgagttcgaagaggacggagcaattccgttgcggaggtaggcatccgcaaagatcgcatcccagatgaagatcgtgtcttgaacgtggaactctcgactgaagaggagtcggagccagcgcagaaggaagagctgcggctggacgtccatctcgacgaggtgatcgtagagcgcggtgtcgctcttccgcagaagcgaatggaagatgtgactgcatctccacaaaacggcggactgttgcgtctgcggggccgaagaggctacccccacaagccctcctagagcctcccccggtcctttgcccagaatgtttaccataggagatgcaacaggtttcggcggagtcgggggagggatataggcggcgcgcatgaggaaatcgttcatgagggcgttgaagagagagaaggcgtcggcttcgatgtctgtgggctccgcggaaagcaggacacgaacgtgtgtcgccacattttccgagagggtgtccgcagaaaaaacaggcacttgttctctgacgcaaatgagaaacaagatcgcaaggagctcattcattccctgcttgtacgacacatccggattctgccggctccaggtgaagaggatgcgctggagagccttccgtgtagcgtctcgacagaacagtgcacgatctgcaaaggtgcgttcgacgtctttccagatttcctccatcaagctgtcgttctgctgcttctgactccacggattgtccgctgtcgccgcgagagggtggaacttctgcggatccagcgcagtgagcctcttggtgctcagcttttgttcctctcgcaactggaaatactttttcctgttcacttcgacctgggcagcccactccgatgcctcctccccttccaagaggccgaggtatcgctgccagacgatgcggcgaagaagcggggaggacggcaccgggaactcctcggcgcagacgcccgaagcaggcggcgcctcatccaagcggcctgtcgcaagcactcttctcgcttgctcggcaaggggcgaggatatgtgggagtcaaacaaccgggaaatatccgagaccgtgagcggcggcagcccgtcgtcgtcgtcgagaaaggcgccatctacagaacacgaccccaatccgctctgtgcactcgccccaccttcggaaaaaattgacggagatgacatggcgagaaaaacggagggaaaatacgacggatggaggtgctcgaaaccgaaaccctcgaaagagccgaggaaggaactgcgcaaatccaccgggtttcggatcacctagcccctagccctgtcttccttggggtgtacctacagaagcagatcctaagtcctgctctcgagagcgagtagacgggagcctgtgaaattacgctatccctctgttaatgttttgaggaatgaactctgcttctctccgatccagtttcgtgtctacgctcgagcctggtttcagagagaagacggcattgacagggcgaagctatctcagaaaagtgtgtgagaagagagtctttttggtgcagtagacggaggagaaacgacgcaacaacgggaggaaacaatcaccaaatttgccgccggaaggaatcgacacatgcggtcgcacgaggaaacgttcgcagcgacagcaaaacagttcctcagtcaagtgccacaaggccggctcccttcacacaaagtccacgacttcgcgacagttttgcgccggtaaaaccaacctcggcctcacgacgatgtgcgacttccgcatgacctgacatgtatatttcgaacaacaacggatgcggaattttcggcgttctgctagctcctcgtcctgggcaggttcttcgtccgctgtaggttcggtaaccaacagagaggcccttccacagacttaaaaaaccggataaaacatgaaaaagccacagttgtagctgtgcataagaccggatagagaggaaggacaaacgttaccgtttaacaagcggacaagccagttacatctgcaggggtgccttggggcagaaacaccacagaggaggcgtcaaggggggcgctgcttccttgctgcacactgcactgggagttcgtttctcttccactattgaacatacttcccagcataccattttcatatatcgttttatcttaggagaatgctactgaaaacacagaatgtttctttccagctatggctcgtctttctccgtgcctagacacatgcctatacccgaaacatcgagggctctacggtgcagggaattcacggcttattttcgaggcttggtgggaggccgccagtctccgaacacttcatgtctgctttttctgttaatgtcccagattccaggacattctttccatctgtccacaatcaaaattgcctcgttttcgctgagcgactcgcaggggtagagaccgtgtcctatttcacagtaaaccgaagcgagacagctcaagggaagtgtagctgccagtttgtttagtacgtgtaaagatacggtaagagtgatgcagcagatagtggatagggagttagtgccaaagatccctttctaggcgatactgggctctggaaccacaaaccaggaaatctgttgcggtgctcgtcccctgtaccccgtccgagcctggctgaaccaaagagcgacacctcggaattcgaagcacccgctagagaggaaaacgcagttatacatattagcggacttttccgctttgtttcgcccgccacatcgcgctcgtatttctctcgtttcggtcactgatatacaggggatccgttttgttgatggctggcaccacgggtagcccgggtgtagaaaaaaaagtaaatagaaccatagccagtaattgtatgaactgcataggaaatcgccacctcagcagaagtcttctcccaaagcacaaggctgtttcgcgcgacagcagtttgagattggacccagaactgtgctctgcggttgatggcgtgtgatgcaaacgaacgcacggcgttttttcaccacagcgggaaattcctgtactgccaaccgtgtcagaaacaggtcgtctctaatgtctcttagataaaactggatagcaatcacggaggaattcatacgacgctgtgcatcagtgcagtgattttcatgtcccactaactgagtggtttgtactgacttcgaggggaaagacagcgttgcttgtccaacctcacaacatatatagcactactgccggaaaaactggatcgggcatccgaaggtaggagatgccatatcggttcgaaccgtcttcccacaggtaccaatgtatcaaaggaacatcccacgattcccggtgtccattccgttaattttatgtccagcgcatctcctcagaaaggcgtcctagaagagtaacccccggatataacgccatgacacccg

SEQ ID NO: 2531 - DNA, 5022 bp, Toxoplasma gondii
aggctggaaggtccagtgctactcgaaatttgtatagagggtagacagaagaggtgcgcaaaaaattgcgcgcatggttgtcaagcggaatcttagctggctttggaatacagattcaatacactgtagacagggtcgagaatgtgtcagcaaccaaaataggtccgaagcgaatggaaaatgatgacggctattgcgtgtacgaagccatcaccaaagggagttgtgcgcacatatgttaggtaattcacaccaccgctgttttgctatgctcgttccaaaaaccgcagtgagtgaggagagtactcctgtcagtgtccgtctcagcgcccgaggattcacagtaatgattaatgctactcacctccttggcgccaggtacctcctgaggcacaaagatattgtcctacgagacgggagtgggttcaaacctgtaactagacataggaaaggaggccgctcacttcagccgctgtcatctcctgtcttccccatattgcaaacgcatatcgtctgatgtagagtcattttacctcaggggacaggcttgtcatggagctgagaactccctcgtacgacgcgccaagctcatccggaaacaagtctaaatggaagcgtggttgagaaaatgctatagctgctcgtctgtcctcttaccgtcatcctcgtcatcgtcatcgggctggacctcgagagtcttggagccaagtgtgtgttaggcaccactatcatcatcgtgaagcagagcccaccaaaccagggagggtttgtcttgaaaattggctagcctcactgcctagtccagaggaaaactgtcctggttcgtttattataactccacgccgttgactcgagtgacgtcgtacctaagtgtttcttaccacttttcgtcttcacactgttcacctcaacagctacctctaatccagctgtcagtgcgacaatcaaaaacagtgtccttctgctgaccttcattgtagattcgctcactcaactgaacacggctgcgttggagaagtacgatgcttcctattatgcagcatcgtggaaacattgaggcgtgcgatggtggccggacagtgtacgtacacaaggaggcaaacaacgcggcctttcagctgacagtgctcacttctaaatgaactgaaaactgttgttggcgcttcctgtgttgataaccgtggcgccaagatgagacctttagtgcttgctgcctgtgtggcggcagttgtcatagcgttcactcaatcagttcaatgtctcagccacgtgcccaagtgggttcatgatatgcgggtacagcgtgtcgcagaactcaaagaacagatcgcgaaggcgtccgaagtaagtgtgggctgacgtgtcctttttcaacggacaaagcaacgacgatccagagctctgccagtagttttgctggagttgattctaacgacattgcccgcctagccgaagaacttgcgtgccttcaatcagaggaggacaggtagaagcgtttttaaatgtgcgctatatgattcacgctaagtggtaccaataggctgcaagatgacaagcgatcagttgctctttttgccactatcgtcatggtagtcctattcttgctgttcttcctcacaacggtggtgagttattcctaccgatgaaagtgcatttccgatcgccttatgtccttcatcagcacatggatgaagcaatcaaagacgccaggtaaaagcctacctcaaacctagtcaccagcggcaccattccaccgtatcatgcagcatttttcaaagcgggcgggcagatctacttcatcttcgcctctgaaactccagcccatgctcggcaacagagagaactattcgaaggctgcagactgcagtacttgagtggttctagtcttgacgttgcatccctatatgtgcatcgactgggtattcaagtgttggatccggaagcagcttggtaagcaaacctcagattccgattagcgatgcacctaccgctggacaatgccctaaaaacatcaatgctcgagcctgacacggaacagtaacgtagaggctatccgttgctgagttatgtgtatggattctgctgcggcgaacatgagcagaattcgaaacccacaagcggaattcagcagatattctgaatgccaactttctattcgcacccgtatttctggtacaattattgtcgctccacaatgtggcatagttatggaatgtgcagcgtttacaaagaaacacacgttttggttcctctagaattttcctttgcgcgggtatttgttagttgcctggcaccacagcgactttgtccggtgccacgatgtccctcaatgccttcacacacaagcaacagagacctgcgtcaggcttaacgatagttgctgttaggagcctcaacctttatgacgaagtacagaagccgtgattcagtccctggcataattcgccgcgagcaggtacctcacgataaatgtgcagagatacgctgctgtaccggtttgaattgctgcatgcaatcccacagccatccagaagcaacagagtcagacatgtttgcttttatagctttgcccctcaactgaggaacgacagtccagcttcgttgggttgtggctcgtcaccctggagaatcttctgacggtgacatcgagccccggtgccaggaaagtaattctctgatgtcttccaatcactaggtcgccaggttgcacccgttatcctttccagagctgttctgtatatcgacccagtggtctctgggtgtgctgcgttgatgatcagcgacatgtacctgccataatggatgatgccagtccttcatccgctactagccatggaaatcgtggcttgaagacattaattcgggacgccgaagcgaaagagagcccgtttactaggaccgtctacgctttgaagctcgagtcatctggttgttctcggggggcgggccagccccaagaaaatgcttcaccgcagaacgccacagtgcaaggaatatcttcaccacagcgattggtggcctcacagaaaccgtctgcaggcgacgagagacagaagactttccgatgtcggtctgcactgagggatctgcgagatttctgcaggagaaaaaagcatagagccgaaggcaaggcaaggaaggaaagcgggtaccagttatattctttggtagagcaacaaataaatcctccagttgcaggatcgtctcacggccactactgcgtccatggtggaaacggacagacaggtgactgctccagagagatggacaatgattcgaacataaggcgtgcagctgcggtattactgctaccgctacatcacaccacttcttcccttagccgactcggctccgtcacattcgaccaacgcgcggcatcggcttctactccgagttcgccacctgaacatccatttccgtgtcttcagccgtgccgctctacatcgctatcaaaagatgttggcgtccgccaacggtgcaaggacgcagccacgaaagcaatacctagtcatgtcaccaattctgaagcaatttttcaggtgtgcgaggagttgaggctgctacgaaaggagatccagcagcatcagcggcaaagccaaccacccagtgtggcaatcggcacacctctcacttcgagttgttgcccaatgccacagcctgactgtgggcatgcgtcattttctgacggcactgcaacagtcgatccatttgccaaagaacaggttcagtccacgttcgcgtctcagaggcaaaaccactgtgcctctgcttctccagggcctgatgtgcagtcttaccaatccatgggtaactgcgtgaatgctccgcatacacattcttttgctggtgggccggtggggtgccctgccactgttacagtgagtgtgcccgaaactcagcagccagtgaacacgcagaaatcccgcgaagagattagtcaggcatcgtcaccgcaggaggaaaccaattctaagagcccccgcttgttacccaaacgtcagcaaacgcccgcgtcttctctacccttgaggagcagatctagatctgagaccgcagactcattggtggcagaccgctctttcccagtcccgaataattcatgccataatgagttatcgtccgggtcccggtcaccttgttgcgttcttcgtcggacaaaggagagcagttcgcctgggaacgcagcagcgaagcagggggtcaagaaagcaatccctgacaaagctgtcgtcgttgaatcaagatcatgcaggcaaatttccgagctacagcaccagcctcaatttgcctatcgaaacagtgaaccacataactccccacctccgtgtgcaagcgcgttcgagtgggggtcctgctcatggcgggcagtctcacggccctccagtgaagcgtcttcgaatgcactttacagtggatctttatcaactgactctaaaaatttcgaagactttaagccactggaagtagtccagcggagcgcagtagagaaaattaccaacatcgaatgttgtgcagcacagtgtctaccgaccgaaaatcggcttcttgcaagcatgaaacaggaactcccagaatcaccgtccgcggtggccagagcacgagggatacacggaaccgagcgcactagtccacgccacagcacttgtaatcctggtattttgtcttccgccgagaccacgctaggaatgacagcaatgcgagacctggtttccgtacaagggatgcaaaggcaggagcccagccacgtcagatgcttagtaacagggcctggtggcaacagtgagagggcagactctccgcaatgcagactggtagaagacacctgtcccgtatgttcaattatggtgtctatcggcgaagtgtctttgtcggagtgctgctactgcggaaggattgcaaaaccttcaggcaatcttcgacctgccgagagtcgggtacagaagtctcttaatgcagttggcgaaattaattctctgaaaatagctggtggtaaggcgatctcgagtcaggtgaaggcagaga

SEQ ID NO: 2532 - DNA, 4076 bp, Toxoplasma gondii
gtgtactgaacggcttctttgcgcgtttcatcgctgctcgacttctctcttttttctggattcgcgccccgaggacgcgcagcctctccatcgcctgcctctcgtcttctcttgggcggcgcgcaaggccaccgcgatttcgtctgtgtcgagtctcccgactgcttgccgccgccaaacgacgatgtatggcgcagcgcggctgcccttgtccgggcgcgcactgccgatctgatgagtccgacgcggagaaagatcgaattggaagcgcgatgcacaagacgaacaccgaacgccgatctcgctgtagaggtcagcgaaaacgcagacattttgagagcggggagtttccctggattcgacgcagaagcgcgacacacggaacagagctgcccgtcagaggaaagctcgccgattcctgagagcgcgagtcctcagcacatcagctggcggtgcagaggttgaatgcgttcccggccgcaggggggtccgaaaatgtgaccgagagatccctcgcgttttaggactgtgcccagagtcagttggacgaatcgtttcgttcggcagttcgagaacagtgtagaagaaagagagctctttctctgccgctttagcttgctacgttgtccccgcttctccgcgtcgtgtcgactcttgtcagccgctgccgggaagtagccgtggaggcaccgcggtgaattcttgtgtccggcaggggagctctgcagaggtgctcgttcattcgggctccgcgctcgtcgaagcatcttctttgtaaagaaagcggcgcgagtttgttgcttgttgactgccgtcgaaagacatccgttctctcgtcgctgcaattccgttgttcaccggcatacaaggtggacaggaggaaaggttttctccgtagtaaatggcgtgtgttcggtgatctggcgcgccagaagccggggactgtggcagatcgcggaaaaaaagacacccgactgtcctgtaggaaggggcttgcatcttactgtttgtgcctcctgcgcagaacactagaagctggtgggaaaaacggctttgtcgggtgtgaaaaaagccacgagttggaacgtctggggtatgcggccgaagtgttgagagagtgtgtgtgtggagtgtattggagaaggagagaaacctgttccccaaacgctttcaacatccatttggaaagcgcgtcgctgtgttaaggtgccgcttcagtgtctgtgtcaaacacacgtctcactttggaagcacgccgttctcccggctctggcgactccctagaaacttaccgttcggttttcgggcatttcttcgaaacgcgagtttacccgcaacatatgtcgggctcagaggccaagatgctaatcaggcagaggaaacgcggcttctgcccgcaaaccgagctgcttttcggcacgtatttccgttgttgagcacacacatggtcgccggcgggacacctagggtctcttcccagttctcacatgaggaagtcgtctcaccataactccaacgatcacgatgaaggcttcacagtgcctatcacgatgtgcagcttctaaatgtttaatcgtaccgcttcaccccgaacaggtggacgctcacaagccctgaaggaagcttacaggatcaatttcgactacggaagctgtctgtccgttagtaaagcatagagatcaagtaccattatggaaatggtctgtcggttagtaagtcattcggatcaatttcggttatggacttgattgtccgtcactgagagcacagaaccggatggtgcacaattttgactagttgctgtctgcaacggcctaagcttctctgagttttctcattttggcattcgtcttgggtcctgtagacaatcacttaatttgttccgccgccaattcgccattagcagccgtgttttcacgctgcgccatctccacggcgtccactccggagaacttcgatcccgagaggaaagctccgagaaacaagtagccaaccgactgcgctataggcccgtcacgccgctgtgaaattgacggcggccacgaaattacactgaaatacagttttcgcaattgctcttactagccctttgtagtttttttcaacgcgccgtaatccaagggaaccgcaagttgtggaggtcacttgcaggatccggctgcccttgctattcaggttgggaaacgctagattgtcacctgcggcggttcgcgcgtggccgcgcttaagagcggggttttctcttcatttctgcttgggaatgcctgctttctgtctgcctgtgtctgcttttctactgggtcatcgctggcgaatcgtttcgcaggtgttttccggcgatccgcccccaaccacgggactaggaaaaggtagcacacagcaccgcaggccgcgtagatccttcccgtgcatggcacctgttgctgcaccccttcagtcgtttggtatgtatgaagagagccaagaaagagaacatgagagcggattccccctgtggtttttcgagagacgtttgttccttctcgctttctaccccgcgttccttcacgtgctgtctcagttcagggacccaattgcacaatgcgctgtctgcgaaaagcttacgagcggggccgctgtccggggccgcgcgcagtatttctgcttggccgaaccgcctgagaatggcacagtccgtgtttctacctcggcgttagctgtttctctgttggttctttgagtccaccgtcaagcgcgttagataaagtgtcggcggagaaaggtctgtgcccgcgacaatgttcggtgttcttatcttcacaatcggttctttccgcagtttctgcagtacgcagaatcgaggtttctacgcgaccttgcatggtcgatagagacaccgcccaggcagcgaactaaccggcgccaaggcttttgcggccgtgaattttctttgctcaggcgtttcccctgcgaccctctacacgaaggaatttctttcgctatgtgcccctggtgacagccgaagtcgcgtaactcggagttttgttgcttgccagagtcgccgagtccgctctgtgcgtgtagtgtgagcattgcgactgttcggcgcggcgcaagagtccgttacgccgcctgctcctcttcttttcttttcagattcggacggcctcaacacggatcgtgcgctttctttctcaaatcccgcctttctgccaggtcccttctgttcaggacctcccgtccccccggtctgtgccccgctgaacgcctgggccgcttcgctcgtcacaggattgggcatgtgctgcaggggcgctcgacgcacattcagtcgactttctgtgcgtacacattgcattgtgtcggtcctctttccgtctgcagggcgaactttccgtccgccttcgaaatctggggccgcgacgccttttcgagcgaccttcgtttcccgcgatagccgcctcgccagcagccccaactctgcgggtgatgtgcccttccagctgggtcacgtctgcgcgcggcctgcatgcggccttcacaaacactcaagcggcggcgtccgagtcatttttttgaggatttctgcgcagcccgagtgacttcggtctctgaaacacacggcagtaggtgagcttctcccgcgcccccgacagtttgccgtgtctttccttttcgcccggacctcgtcgggttccaggtcgaccttgcgcaggcggcgggaacacgcgctcacgcgggtgctctcgacgacgactgaaaaaggcggcaaaccacctgcccacaacgaaattcagataaaactgcgcgtcaggaaccgatgtgtggcggcctttattggcggtgacggaggcgagtgcgggcagtgggactgccggggccactcgagtcgcgtaaagtgacccgccgagcagccttggcggaagacagtcgtcacggaggaaaatctgcaactttgtgggaggccaacgatctggttcgagtgtggagttctcacaactgtttctggcgcaaatcgcggagcggcgcagaggcacaagtagctgaaccgtcgcgcaagtcgcggaccggcttcccccaacgacgaccaagagaaa

SEQ ID NO: 2533 - DNA, 4052 bp, Toxoplasma gondii
gctccaacacagtccgagcggcaggtgcaccaaggtggaaaaccacgaggtgcaggcaccagtcgcgcgctgcaaatgcgggcagccctgtttgacgacgacagcgaggacgaagacgacagacttcctccgtggccacactcagctcagcagtcacattccatttcttctccttcgccttctcgggcgtccgtcttccgtcgcgacagcccctcgctcccgaaggcgacgggagccgctggcgaggcaggcgcctcgaagagctcggtggagagagcgacgagggtgtcagcaggcaacaaagtgtggactgaagaagaatacgaccaattcgttgtgaggaggtttgagacataccaaggcggccggcccagtcgagcccggggcgtcgactcacgtcttgcgtcggtgactcggctccaccaaaaggcggcagaaatgaggaccaagatgctcatgaataatctcggcgcaaacgacgacttctttgacgaagatctcaaagtttagaccagagatgcgagacacacaaatagtgggacgaacgaaatcggtgtttctcaaggaggggcaaccatacggagaatgaagcagcggcgaagcatcgttgtcgtatccgttttccttggaactcttttactccatgctgctcttgtccttcgcacacttgcacaccgatattgtctccgttgtgtgcctttgtcgcatctgtttcattgttttcgcactcgcttcgtcatatggaattacgattcgtgtgtcttctcttccgtttgccccggtgctggagcaaccagaacgtagtaacagacgtgcgtctcagaactttgcatttcccctgtgggttcctagcgttttttcctccagtgcttctacttgaccttgccactcctgtgtggtgtcaggtggctttttttctgtgttggcatttactcctagtgcctgtgtcagtcgtttgtattttcgttgcctttgctctcctgcgtgcctatgccgctttctttctgtggagtgattaaaggctgtttcatcctgcctgcttcttttagcgttctccagtgatacgcacagaagcaaaagccggaggcgggaacgtggtcacccatgattcatgccgtacaccaccgttgtgatgaataagtctccggttgttgtgtgctcagtatctccaaatactagtgtaagatgtggcattcaagagctttcagaaccggtacaaactgcggatacacgctctgtaacatctatgatagtcgcagctcttctattcctcccggtatctatcttcgaattcggttgagaatgagtgaaccatggattctgactgccgctttcgaccattgctaccgaattgcggggtcgtccgtttctgaatttttttcatgcacttaatataccactgacatggtgggaaaaagttcatcgtgggcacttctaccaaggacagattgtttctcgggcgtgaactgcgctgaaacgattcgctttactatcaaacacaaaacggactccggtcctgaaccccgtgttgcacctcgagattgggctgcttcctcgtgcaggatttccgtatttggttcacacacagtgacacggcaattataaggcatgaaccgtggcctgaatcatgttgacatattgtggcatttcaacaggtttcatgaagtccgtttcgtagccgtcgaaccatggacgaccgtcacaggtcaggcatcgcggtcttaaacattggatctttactttccatttgcacgattttggcgcgtgtgtgaagcggctacttctctttccgcgcactcacggatgttgtgaacgcaaaacctgtgtgttttacttgtttctctccgtcaacagaaatgtgccattctctgtcgtcacttccacggatcagcagcagcctcatcataaagaaacagatgttgctgccagttgaggctgcagctaggctcccttttccaaattgtatcgtgcttgggaattttccgtttcgagaggaaatctgggacacgtatagagaaagattttcttgcatttgcaggatcgcagacgagtaaggtacaaagctgactctacgttaaccccgaacctcgcctgacccctgcgaatataccgtgcacaaaatcatccgattagcttgtttcgctccctccccggcctggatccaaacattactccgctagagagaaactggtctacccttggttttcgtgtctcgacctccgtgccacaaaaatgggacaagcctgtcgttcacacggtatgttttttcttcgcgttgcaacctctcgatagcctttcatcagccttgaacggtcgacgttttgtcttttttctgcatatttctccacggaaaagccttgtctgtctgctaggtttttgggtgtctcgctgacttgccaacccccgatatgcttgagtttgtgcctacgtgctgcgtgtgcctgtcgtggtggctactgggtttgctcattagcaactttctttcgctgtgaggtactagctgcttaaggcaatgaacgcaaaatcaccagaaccacacctaacagacctgttttatacttcttaattcctttcaagctgatgtaaatgcaatggtggaggcaaggaagcgacggtcgacacacagtacatctagcccgcatacgggcggaaggtcaccaagaatcgagtctgtccgggagcggatttggccctgtgaaaggagcggattatttatgcaaccttgtcgatcgcgcgcagctccacatgttccttacgttgtccgtccttttcttccgttttctttgtttcctccacctcgtcccttctcccatgtctcgcctgccccctctgcgccctcggtcgctgccaggttgctgcgtgccgggtccctcgcccccccagcgttgcccaggggcattgaacagcatctgagttcccagcttgcctccgcgcacctgattgccattttgaaagaggtgtgggttaaaataggatgcaccgagaaattctcgactataggcgagaactctgaatgtggaaaggtgcacgacgtaggtaaaggtctgtgtgtgtatgtgtgtgctggggcgacatgtgtttgcttttctcggtttgttttgtcttcttcgcgtgtgtgtgtgtaagcaaaaagtcagccggaacggaaacgggaccacctcgtgttgcgacgaagtttttttatgatctgttcaatgctgtagacgccatttgaggcacgattgcagtgcccccatctcccgtgctcaatgccagtcccaagtgactcggtttcacgcctgggacaaatggggagctttttgtaaaaaggtatgcctcccctctcgctcttgtcagtttcgttttctcttcgttttcctacactcagtatttgtacatcgacttcaggctgcgagcgacatatcacatgtgttggtcctgtgtggtgttgcccacttgagtagggtcaccctgtcgcaggcgacggtcgccgccctttgtgtggtttttcgccttcagttgcctcggtgctatcttttgtagctcgtgtttcaccttaagcgggtgctctttgcaaaacccgatcccgagcttttgccgggtgttcgttacggtgcttgcctgtttgtgacctgcctcgtcagcgcggtgtgtgtgcagcacctctgtgtggactgtatcatcttttgagcactctgtgtgacttccctatttgacactgcatttcttttttgaataaggacgcaacaggaagaagacacgaagaacgagtcagagaatgtcacttgttatctctcggactccctccaaaaagcatttttccgtcatcgtcaaacacggtcgtcatctcgcttgactacctggagatgacgtagatcggccctatgcgccgccagccgtaggttgactcgcctgtgtcgattttttccgacttcttcgtagcgacagctcctctggctttttgatgttccgcgcagaatcgcctattctcccttttgttcctgttttcctcagggccgcggcgcgcgcctcacccgtagcttgcaagagggggaaacagcaataagcccgga

SEQ ID NO: 2534 - DNA, 1832 bp, Toxoplasma gondii
atcggcatcgtactgcagagtttctcatggtacagcaacttgtctttcgctcagtgacccactgttgtaaccctgtggctcagctggtagggataagtgggagtttgcattaaaagagaatgcctgccgccgcacttgcgcagcgtctggacgggggggcgtatctctactttttccgcgtgtgtcgtgagcccacagtaagctgatccagccagcagcggttggcccacacttcttttgtgtacacatcattcaattatttctttgggaaacggtgtcacgaccgcgtatgtgcatctgtccttgcttacagtataggcccagtagatgtgtaaccggggggcggcacaggagcggctcagtttaaaaaagtgaagttttgcttgtgctggcactgagatatgttgcaattgctactcgaaaacggatttctgttatgctgctaggttcgacgcagaaatccagtgaacacgcttattcaatgaatgcggcaactgtggaatgggcttaaagccgtaccagtgcagcgtacggagggatgttcagtagtgaccacgaggatttaaattgtcaattccgttgggctgtatgcgaaaaaggttatgcagtgcaccatgaatgtgttgaagtgcgcacatgaactcattgcactccaacgatatgtgcatttggtgggctgaatatcaatccagatgttccacgcgctgtttcagtggtcaaacagctacgttcgcaagtttgctaatgaaaaagaaaacgtagtggtagggtaagtggactatcgtcaattggtcacgtgtcgatatgtgtgttgctggagtgatcgtgatgggctgctgtaggcgtatggcactatcctgaagtaaatttgactgccagtgttttgggctgctggaaagactttacatggtacagaagcaaccagaacacgattttgacaagccatattggcaagcgattcccacgccttcaggtagtagtgaatacaacacgaccactctccataggtatacccctacagtacgatatgtcagtcagtgagcctgtgcatttggaggtgagttagtacaagggatttttggccctccaatgcccagggcaagtctgagaatcaaaatctagtgatttgcctttgattctcgtttcgtcgttctagcttgcctggaaaagtacattttaatagcggtcagaaggcagcaggggtgggtcattacgcccagtgaggtttatcgcggtcatgaaagaagcatacggtcaatccttaaacaaaaagtaaccggccgctctgtaatggagcaaaatagcgtgaaacgtcctctccctggtagactaaggttggcgagctataatcgtaactacatagctcatgagttgaacaacaagggtacagcaccagactgcagactaagatgtgaaatttaacgaatgatcgagcactattgttgcagaagtcgttcacgggggtgcttctatcttctttgagtactgacagtcacaacgagtgagactgagaaggtggagggcgcagcatgcaaggtggtggtcgaatcgttgcaaatggagaacgcgtcccgcaagcaccaaagtgtgagtgctgcgcggcaaaccgtttcgcagaaaaattgcactatagatatcaccgacgaatatgtagaagaaccactgactctcataataccgaaacatccagagcactactaagacaaacgccatggtaacaagtgctgcactaggagctggagcgtcagcgttagtagcgtgactggtctcagtttctgcattttagaacgtaacacgggccgatacggagcacttgtagcactatacgaaca

SEQ ID NO: 2535 - DNA, 3002 bp, Toxoplasma gondii
aaataccgcccagaatatagccgccgtcggccggactagaacacctagcgccgccaacagcaacgcccacatcaagtacactttcgaagtgaagcctttcgcagtgttcgagctcccatcggaactacagtcgtttttttccgtaggtcgccccgtgtcgagcaaagtcaccttcgaacggacgcgatttctcaatgcgtaaggggatccgtgaagttcaaaggaacccgcttcgtcgggtgtcagatcgagggaacacgtcggcgtccctgatgcgcgattgtgcactctggaagacacttgaccaaagaaaacgaggctccacacattcaaagcagcctcgatacaactcgagtatgtgcgcggcagacagaagaactggaaccagctgaagacgcaacagagaaggacgtagaaggacagaaaacttggttcggtcacagttgtgcctcggacggtcccccgctttggaaggctcccttggagagggtaccagacttgggcaagttggaatgtgccgtagtcagtgaagccagcgataatgctctgcatcacacgcggagcgagggcgatgacagaggggctgtcgaggctgaaacgaccgagcagccagtacagacccgcaaaaagagcagggtgaatgacacttcgcagcgcgatgcaaggctcccattcccatgtaaggaacccgtagccaaagacaaggtggtgggcgacctcgctggactgccagtgttcgtccgggttgaacgacgagtttaaaaccagcccgttgacgatccggaacgcaatcagccccgcaaggatccacctgacctggagtgtcgcgagcggcttcttgagagcgctcaagtggtgcaggcgactgtgcgaatctcccctgtttcgcgaccgctcacgggcgagttccccttccactgacaccattttcctggcgactgcttgacactcacaagtcagatgcaagctagctgctccgtgccgacagcatcaagacacgtttctaaggattccccttcagatcaatgcacactcctcgtgaatgcttaaaaaggcagtttcacaaacggggaccggccactccggcctgtccggcggcaagtgtgtcgagaaaatgtggcaccattcggaaagatcacctgaatttatccgcaggtgaaacagcccggagcacgaaccagtagcatactcttggacaagtaaggatatacggcggcaatgcacaaagacgttcgtcaaaacactcggtacccaaacaccgcaccgtgtacggatatctctccatgcggaggaggcaaaagccggctcaacaacgaacggctggcggccacaaaaaaccacgtcccggtgtcaactgttttggggtaagccggcgagctttttcaatcaacagcggctcataccttaaaaccaaggacgctgccgactgtcgactacagaacagatgtgcaagcgccacacacagtggttttgcattggagaggtcctttggacccgtcaggccctcaccatccgctagagggaaaaaactccaaggaagggtgggaacgaggaagaaaaagtgacaagcaatggaaccgcgatcggaacacggttttggaaatggacaaagcagtcgcgggcgtgtcccggcggtgtacatacagctaacgagaaggcaaggacgccgcgaggacgctgtcgatctcatcatcgaaaagaatcgctccgatggtgactctgtggcacttttttgtggtttcttcaaggacagttttctcgagatggactgtcctgtcattccctgcatgagtcctggggtacgctgtgctgcaacgtgcaacacgctgaaggcgccatcgctcgattgttacgtcgtgtgttctgtctcgaagtgcgactcacccgcctctagtcacagcgtcagctgtcgtcgtgtgccatgctattcttccgatgttccaaggaaaagccgttaacttgcaaaaaagctgatgcgtcctacccgtgcccacctccgggccgtcagctcgaggtgcagcgaatcctcgtttctcattcgcggtcgagtcgtcgaccggtcttcctattgtgtgcgctatcgagagccgtgctgactaggggtggggaaacgggtgcacaaaaaacggttcctgagtgttttgtgtttatgaaaggcagagaaacagctgaaatcgacgtatcgatccaagcgtttagggtgtccgacccgccctgctgaagtggcccacgccctctcgagcattggccgtatattttctttgccactcagtttcccccacaaaccattgccggtgagcaagacttttggctgtcgactccccctcgtttcctcgtttggacggtagagaggctttgcctgtgttttaaaccagaagcaaactccctcaactgcgccgcacttctcccgcagtgtacttgagatcgaggtgtgcttaaagcattcagctgacaatcgttttgtgtcgtgtgcattccgaaaagtgccaacttgctgcagtcgccctgcgctgtggacgaagctgcgtaaagcggggtggccacgctttcttgcacgtaggccagcctctctgtctcacccctcacagcggtcggccgggcatgcaagatctcagcgcgggggtgcaggcacacaggtggagagcgctgtagggaatgtatggggacctggatccaggctagtatacgaggcgggagagcgggtcgaattctcgacctcctacttgttcgcttctgcattcttcgtcccgaggctcgtattatttttcgagggggcactactgcgttttttcgtctccttttctccctcctgttgccgcctcctctctcttctgctttgctgtcaattcgtctgtactctctgtgctgtgctgcgttcgcgcattgtttgcggaacccccgggaagttttcgggtgatgcgacgtctcgttttcgacccggaacggccaatatttctcccttttcgacgtggtttgacggcgaactcagcgagtctctaaca

SEQ ID NO: 2536 - DNA, 1757 bp, Toxoplasma gondii
cccactttatagaccgaacacgaatttgctctggcgattgccgctgagtcgtgtcagaacgttagctgcaataggccagttatttttccgggtttgttctgttctcacatcgctttttgttaaagtgcgcgtttcctctgtttgttgggggccgaaactgatattacatgtctcgtcagatccgactgcggtatgtttcgcgtttcctgttaactaattaaccctttccgcgcgtgagcactcccgttgtaccctgagggatacggagggtgccacggtcgcactggagccaggagcaacaacctgcttgagaaaagaattgactctcaagtcgtctttaaatggtgatagaaagtggtagtcggatagaacttccccaagtctaatgacgtcgccaaacatccatctggcatgtgatgcctctttccgccgatctgcttctggtgcacaagcggaagtatgattttatctagccctccggacgctcgcaccagtgtcacgagtagttattagcaaggtgacgaatcttttgttgttcatgaatcaacgttctcacgggtgtctgtgtcaaggtttcctattcatctcgcgaacggttcagagtccgtttccaactcacccttacattccacatttttcctaaactagcactgctgttgtggcatctctagaaacatcgtactgaggaatcgcgctcatgtttgagtggatatatcgtcctgaagatggacactaggatttaaatggaaataccgtcctgaagaatcgcgcttacagcctgccactcgcacacttgtttgtatggcatctgtctgacgttcctcacgaaattcctcctcgctaaccgtggagacacgaagcagacattggtagcaaaaagtgcttccgttctgttgaatggaacactgacacatgtgtccttgctgaagcattcccttggtcgctagtagcggcacgagatggaagctgtgtctcagctccacagacttgtgtagggacatgtagctgcggacgtcgtactgacccttcctcgagtgtgtaggcccgagcaactgcagtccacgtgtacgccgaaacattcagtccgcaactgtgccggcaagcatatcttacagttccaagttcgggtgaccgtctcctcatgaaggcatcagagcccgtccgccacctagaaagcttcctcactgccgacttttcacagtatctgtgactatacggaaaacgcggacgtggcaccctgaagagtaatgaaaaaccatgccaaagcattcctagacgcatcccaatcggatgtcgatgtctgaattgcatgtgacagaggtgaaaagcacagctgttcttcagaggctcgaagatgtgaatcgaagtcccgttacttgcatgcatcaaaagcgcaacagaatgccagtaagttgccgcgccactttgtgggcgtggcaagcgtcgtcgttgcgtggaacattccgtcgaaaagacgcttgagatctggtacatacgccgctgtaaacgtcctcttccttgtgtgtccgacgacgcacccagacaccacaaaccacttctactgttttcttggccgtgaagagccttcctccacgaacatcgtccagcgatttgctccgtgtacccaccagcgctgtgcacgcgtcattgcgattcaagaaacgaggtatctgcttatcgattctccccagtttcggtttcagaaacaggcttccacttacacacatcttccaactggagtctcgccggcgaaacaa

SEQ ID NO: 2537 - DNA, 1338 bp, Toxoplasma gondii
aatgatgcttgatgttatcacgaatacagttttgtccaagaggttctttccgtcgagacgcaggcgttctcgagttctcgagtggcgcaactgtgctcttcaggcatcataatggggcccgccaacgtgcgagctacacattcagagatatgcaaagccttgcaaataatgtttgtttctctcgtcactatattactcatgcggcagttctctagttggagagacgtttaagatgctagcgactattcaacgtgtgcactgcaaatctgtagaggattcgtcgcagttcgatatacaacagccaaacaagactaccactgccctgctgtttaagaaaagattttcttgaagtctgtcccatattcgtagatggagtgtacgagtaaatgaccactcgaagttgcgctagcaacatatttttctagatcatcgacaaaacgttgcattacgcagccaggtctggaagcgccgtaaaacgtctgcccatccctcgtacaactatttgcgtaaaatgcgcacgtgttaaaaacgtggtccagatgagcgtcattgcctgccgaacgccaaaaagatggctttggggttagaacgtgtaactaaattggatggagatagtccagttttgcgacgccacgtctgggactttcatgactgttccagggccccctgttcattgggagagcgacacgtcacacgaagctaaagcgacctacactcaataacactggtttctgggcaatgtgcatctctgcgtcgccgatggttgattagtcacggataacagtggaaggtcgaaaaacaaggtagtccgcgtgtgctcgtagcagtggctggctgcgtggcatggaggcgcctggctggacggtgactgcaaatcagactgtcagatgaatcggatgttgaacgacgcgctgcacagccaccgggtttttggacttctccgtctcaattctgatgattcccagaggcaaggcctcatttacctcagatcagaagtgttggaagccaaaagacttccactgaggctgccgttcaatcggtgaccattctgtgcctttttctggattcgacccagccacgtcgtccgacgtgtttgacattaaggaatatcatggctttcgttctatgccttgacagtagcgcatgaagtccgcagcaggaatttcaccctgcccccttgaagtgtttgacgggctacccgtgactcgatatccagaaaacttgtttcacagttgcaccaagtgaacagatactgtgacttcattgtttggacaaactcttgcctgacccttatctagctagagggttactgcaggagcgggtgttagcgaaacaaaa

SEQ ID NO: 2538 - DNA, 2459 bp, Toxoplasma gondii
gagaatcaattcacgagatccacatcgacacggatacttcgtgcaatttccggtctttgtggccccttgaagatgagcaagtccagaaaatggattttgcccctccttttttatcaagctcgctaactttcagtttggataacaagtcggctcgctgtcgtaggcagtcaatgttcatacgcgaggggtaagtgtagcaggagagaaataatgcgatccgtcactgtaccacacacgttgaatttcgttcagaggatcacatttaagtgcctgcatatcgatgtaagagatcgtttgtggcccaagcgactgtctctacacggccatctccctgtttcttatcagtaagccaccgttaacacatcctgcatctttcctatggaattcatgtctgcgagtcctccaacccgataaacgaccatggttcattcatgcacagcttggcacagtagacctattcatgatgtttttacagtagagaattcactgcggaaaggatatgtgacacacagaactcattctacactcagaccacgcgtgtgttcgtgtgcatgcgcgccgttgttgtgtagaaccacaggatgcgaaatggaaaaccgtgaagcaagcccgacaggagcaattcaagtagaacccacctcgtgtgtcttgaagaatttcttcttccacttcatcatcttgttcagcggtggagtgggatataagctgtcgaggtacgcttgccatttcgcgctctttgcccagtcgtaagacagaaatgcctcctctgccgggctcagcccggttctagccgaagcttgcgacgacattattgtaaactaacaccgattttaggtgagaatcgtcagcaggccttcggcgttgtctcatgcgttagtaggaacgcctctgataccggatgtgctatggcgcaagccgtgtgcttttttcgtgtgtggcacactttatggcacggcaattgaaaacctctggggcggcaacggacagagcatgcactgttccctcctacgtcgagagaggaacccgcaggcgaccaacgtacaaagacaaagaacgatttccagggactgcgcacactttctgcaaatttaggtaagcggtgctgcaatagggactttcgcgatactagcagctgcatatgactaggccactgagcgtaaaagcacgcgcttgttaatgggagacaacaaaggggatgcgcaacatgtcaaggggccaggaaacaaggaagatgtcggatgcacatgccccctgagaagggaccagcaagaccggcaacaactcaaggatcccctctgttgcctttgcatccaggcgcaggcattcgtcaaaagctgtcttgttcgttctcgaaagaaaggagactgtaaccttcagaaaaccaggggccagcatggtgacatacacgagatcacacttttcccgatgaaacggcagcccagaaacagacgggcttcgcaaaggtgacctcgagtggttgatcgcacgctggcgctgctagcagcgtgtggcgcctgaaccttgcgaaaacgcctcatggggctccgcgacgagcttcgttctgtctgactttgttgactcgtagaatatcctttctttcaaaaaaagataactgtatgttgctatcaagtcaggctcacggggtagacggctataacgcgagatggtgcacaaagagcgtctctgcaagcagccgcaaacacgatgtgtatcacaaccaagacagaggctgcaacaatcgggcagcagtgcttcatttctggatcatattcatctgtaaatatgactttgcgtcaataaccaagccagctggttgtggctgtgcttaaaacaacaacgatagcgtcctcaatgcacacgaatgggcctgtaattgtgaatacaccggagtttgttcctccctgctgaatacgcatctttgcggtaggcgttttacccctctagggtatcattgtaacaaggaagggaaaaccgagacttctgtcctgacaaccctttgtacattcacaaagtccagagtgaaaaagaggtagttcaaggcgtgtactctctagccgtcttccgtggcattttaggaaagagagtcccaccgagccatgcccaatttgctgcggtcacggctacacaattttgtctgcagtttgttgtttgaaagccatggcttatggacctctgaattatcccagtgtctagagcctcgttttggcatcaagcatacgacccagacgtctctgaaacggatatccctttttcgtcagcctcgcctctgggtcataggaaagctgggcgtcggtccttcacaactgctacatctcgaagttgtgttcaagcacccggacagatgcttgcagtctatctaagcattcaagcggcataagaagaaatgcccaggagtatgggttccttttacagaggagactaagcaagactcttaagcaaaatggcctctagcaagtcaa

SEQ ID NO: 2539 - DNA, 2044 bp, Toxoplasma gondii
acagtgattgatcgtgccaaattctgcacatgatcgttatgctggtaggtaaattttccattttgcatgaatgcgatgttgaactcccttgtcggtgtcatggtgagctcgtagcaacgttttgttttagggtctagagtcccgaaacacgaactgcgtaaaacttccatcaggcttcactgacgaatgagcgtaagcaaagatgtagcgttcgtctaacaggaaatgctttttcaggaactggaacgtcccacgtaggaggtttgggtactcaagcaagcccttgcaaacatgatatctactgtaagggcactagaattcaagacgaaacagtggaatgaagcgtctgttacgaacgacaatgcgactgatactctacttcttccccagagaaccggcttgcgatatcatagctcggttctatcgtatcagctctcccctgataaacaacgcgcctctgcactattgaagacgatgcattctgtaagtccaaattatttcttggacttgctccagaatatgcgtatgtggttcagcagtagtgaccctagtttgggtactgcgagatatcctgaagaaatagcgaaaaagagccgtatatatattagagggcataaagcaaatgtaagtgttttgacacttgcacattcgatccatatgcaagacaagggaagcccaatttgtcgagtagagctgcgtatctcctgtcgctctcactagtgtgtgggaggcatacggcaaggaagatgccggtttcagcaagcaacgcttcccccccctgtgaatttcgagcatccgaagatcgggtactggggcaatttaacgttgccgtctgcgtattacgtttgttcgttgatgtgtattctgtacacacttcttgtgtggctcaccgtgctttacactgagtcctctgccagagagccaactgcgacttgtgcgttgaattttaaacctacacttcggaccacgagtgtttctaaatggggttatcatcctcttgaaaaagagaatagaggtggagctcatagactgagttccgctaaaaatcgttttcagatagggagtctgctttccgtagctatgtcgggattgacgtgccgggtgatactgcccgacgtattcatttttttcagtgcgattttttcatgctgccacttctgttctttttgttggacacttcgtggcgaacgtgaaaagaatatccacaatcaactcatttctatcaagctgtattgggagaggctcaagaaaaggactgcagtctataagggtactgcttgccccctccagtttgtagaggcggggctacgggtgaggtatagagtggcgacgaatatacatgggtggtgacccgagggaggacttattctcctttttgtgggctgttggcaacaaaacgaaattcagattgccttcggagttagctgcatgcgcttcactcctgtcgggccccaccgtaaaatctgtcgtggcatcgctttcctgtatcgaagttgatggttgtggtagccccatgctttgaggcctagttcccaacccggatacttgaccatgagcacgggcaatcaaatggcgttctgttttggaaaaaatgttacgcccaaaatgcaagtgggcttcaaaagagtaacactgtctgcgggtagtcagcaagtttgtagtagatacgcttaaggaaagtcctcaactgcgaaagcgcattactgttggaacttactgcgccagggagccgggaaagaggctcgacagtgaattgcgaatgcgggactttgttaggtgtgctgtttgtttgccctaacagcgattcataggttttttggattaaaattggtcctggaatgacgcagtcacacaggtggagaggccgtttgttggtggaaaagacaaactcactcgtagaattactttgaatcaacatccccatcgttttccatatctagacgtgcttgtccagttgcgcagtgtgttcgcgtatcgcaccacgcatccctctgcagacgaaaacgggcgaatgattcggaaaacggcacaagtgtttcaaaca

SEQ ID NO: 2540 - DNA, 4804 bp, Toxoplasma gondii
agacgccggtaggagtcgctgttcgctgtttcctatccaatgactgcagctagctctgtccctctctctctctggaacatggactgctgagattcggcatgcgcttcgacttgccttgagcagtccagtgaggtggcggtgcacggcagtcacagagaacgagttggcgaggtcaatttctcacgcttggtagatacaagtagatacaacaagtgaaagcttgtttagattccctgatcggagtttcagactggattactttcgcgcccacttccgcactctgtaagggggggggtgagctctctaaatatacttttaaaatacgtgcgtccgtattccacctcacggggaattgtcgttttcaacgggatcgtgttcaagaacaggggagacttccctcccgagcctagatcactcgtgtagagggcggtgctcagtgacgtcctccttgtacgctttgcacctgcttgcttcctcgagaacgacggctctcgtatggtacggttgtcggtcccccctcggactgggagaaagcctctcagacaggagcgactgtggcgcacacacatctgtgagtagtgagaggaaatgcgaacccatacagtgcggccctcgttcgtttgctcgaagcatcggagcagtgctgcatcctcgttcctgcgttttctcttgctggtaacacgagtgataacagaactactaccacgcagatgacaggataaaaccgagagctcctgaacgcaaccttaccagctggtcggttccgttccacacagttaggaagtgcaaagaataagggaacaaatgtggtggcacttgcagagagaatgctgatgtgtgtgtcgactgtgcagacaagatcgtcgtcctgagcaacgaagataaacgcggaagtcaggtggtggaggtcgggacgcacgacgaacttatggcaatccccgacggggtgtaccgacacctcgtgaaggttgcagagggagggaagtgaggatggcttgtgttttgcctctcatatgtgctgccgagaactgcacatgttgggaggagtgcagtctgtcggtcgtcctcacgtttgctcgaacacggtagcacgtctcgatgtacgtatcatcatgaaagtcacctatgtgacgaaagttgggtctctgtgggaaaaggtttctccattgttcgtgtgagtgaatgtccatgcaatggtagcctcctgtcagcattcgctttcctctctggatggccgtggcagacctgcgaagtgtgacgggtcactcggggacaatgaactcctgtgactcgagtggggagcggcgttcgctaaaagcggttgcacgctgtggcatcaacggggaaaccaatttcgttccctcgccatccgctgtgagtccccatgttttgtcatgctctcttgtggggacgcaccagctccaccacccgttgttttggaggtgcaggagaggggatacgtttcctcagaaacgatatccacatactgactcacacgagactgtttctcagggattcttcaaagaatttgaatccgaaaattgtgatgcaattgcaccaagacgcagcgacgcacggatcgattacgtcgcgtaaagtgccagacgtagagggcctccaagtgcagcctggccatgacaagacaaaagcgttcttcgcatatcattatatagcgtccatgctcgttaccgcaaactcgaagaggtcctctttcgtagcagtgaataatcaaagcagttgaagcggcatcatgagctgcagcgcgtcgtcgagttcgcatattgtcatttaccacgtagttagcaccttgcaagcacgagttggccgacctgacaacaaataagcgcacacttttggaagatcggtgtgcaacagcatagccgcaaaaaacttatgcatcgacgggcctcgctgcgctctgcatggctttgaaaaaaccacatgttgtttcctgtagtaggcaccggtcgatggcaataagtatggacagttccgtcacttccaatcgctccaatccccttctagaaactaaaatgtcgaggaattcttgcaaatcacaaagcagaagaaactctcagacactaatcagacgtgcgtggcgtcgtaggtagcttcagaagcccgagccaagcagtcgatcccggtcacgcaacgaatgctacctttgttgtctgaagaaacagtaggttttcccatcgtggcgcggttcaatgagcaccgaagaaaacacgctgaagtcgcatcgatagcgcgttcgatcgtcaacgcggcacaggatccttcaccggtgtcgggactgttgtcgcccacatttttcggcttcttccagatgggtgattccatcatcggcgaaccggttgggatacccgctcagtacgatacgtacagacgtgccaatgtgaatggccaatctctagaatgcccccagacaatgccctggtttggactgccctgaatctgaaaaaaagggaacccctgtatcatgtgtgtagccccgtgtcacaccacactcgaagcagcgttcttcagtatttagcggctttggatcctgtcttctgtacaaggtagaaatttgaggtggctcagtgaaatgaactatgcagcgatagatatgtatatggagattacagcgcacttaaacaaaatccccatggcaagagatccactctagtcttccgagaagtgtgccgaactgcagatgacaccccattaatcggcaacgcgaagtgactccgtttgacggaaagtacacgggtgtgatcgcagcaccccgtttgttttcgtctgagtgccagaatccgaagcaacagttaatttgttcgcatgtacagggaatctgtgttactgatcaatccatcacggatgtcacagcagctcggtatcagacatcgcacccgaagcacgggaatgaaagtctcggcttgcggatttgacaagcggtccagcaggtgaacgatcacctgactgacgtgtcagaggtaccccactggaccatccgaagaaatatgagcagtggagtcacactacaccctttcctttcacgtgattttttagcctgactgttgagttttcgagctactggatacgtaaaggctgtccagcgcgtttgaaaatcgtgagactagcgtccttcaacgcagcacaaataaacgttcacagcaagctatccgctcagaatgctatatctgcatgcatatttgactggatggagattatgctatgttcctccgcctgcggaccttcttcgggtatctttcctcaaatcggttcgagctcgtagcaccagtttaggccaaaaactgcacccatccggtgaatatgtttgagggatactaagctctcccgcgtgtccgtcgcataaagcgtcaatcgtcttccgggggccacctgcggatatgtataaggatgcttaaggaaagtacaggaaccatgcagtcccaggagaaggttttcacgctgcatcttcacctggtgcatgaaatatcgctgaggcgcgtaaaaggtatcaccagacgtttgaggtggagatgggacagacgcttgcgtctccggccctccaggttgaatcttcccggcgaaggcgaaaggggagtttctttaaaagccttaagtatgcattatctgacagccagaactgtcgttgttgtaggacgtccagatgcatgacgcttgacgtgagggcgtgttgcatggcccacacagcgttgatgccaacactagcggccgtcggagcactactgtgtgtcactttcgtttctactgactgccacaaggcgcgacgcgacagcggcccgtaagatgagcataaatgcaactgcgtgcgaatctctcatttttaatgtcaacgcttcattatcaagtgaaacgtgaagtgagtgaaccgtcggttcttgagaaaacaggcactcacgttcttcaataacagacggctcgagaatgtggggatggtttaacgacgcaaatggtgtgcccgcatggtggcgggtgggaggaccccacacccgatatgactcaacagaatcgacgcgggaacacgtgaatactcactaatacgttctgttgtcagcctgttttctatccgttgtgaaccattggtccatgtgtagggcgcgtcgctgtgacagcccgcaatcacaaatcaggagggtcttttagacctgttacttattttgaaacagttgatgtcactcatgtgctgctcagtgcggcattcatgtgaagagctggcggtgtggtatcggcaacccgagacagcggcgcccttcgaatcattgtgatgaggagggaccagcatcagttccgcctcacttcccccccccctcttcactttcctgttaatacagatttgtctcaagtaaggacagcgaataatccttgatgcaagttctcgcctgccttgcacatcaggacttctttatgtttccgtggaatacgccgtaagtgtcgggcgaacaaccccctgcgcagaagcctgggtcgaccttcgttgggtaactcaccggcgtcgctgtgcacggatgtgtaggcggaatatcttcgtccaagtgcccaggaagcgccttgcattccagttagaacctgcagcattgcgacatctacctgattttgcggaacgcgtatgtcctcacctcaagccttttctgcttgtgtaggcagtctcaagcacgaaccatagaaaagtaggaaagacttgtacatcccacggagtatcgtaggaggcctggaatccagagcacaggcaatggtactaccatttgacctccgaaacccgatctcgattcttacaaaacttggttttggataa

SEQ ID NO: 2541 - DNA, 4514 bp, Toxoplasma gondii
gaagaagaacttcatgtaaggaattcctaaacggctgtttcagatgcctgccccgtgagaagggactggctctacgtctctcgggtggtcgcatcagttcgctgttaatcggaattcacagtgtcgttgaagtagcgcagtggacgagcagagtctgaaacttcgtgatctgtcagttccgctgttatgctgctccattcttgatttagagttcgacaaaagtcaacactgcagacaaaggacgcgaggggcttcctcctcacccgacatccacgaaagtggactctggaccggccggcagcgtttcgccgcctttctccagtagctcgtctctccccacagcattcgccagaggcagagatgacgaatgcgacggcggagaagagggagactgaggagacaaagaagaaaaaggagaacgattggaggggggaggactgaaagctgcatggttgtcaagctcgtgtggctccgcctgtctcagtctccttttctctgcttcttgcgtcaggcgcgccgcagcagcctcgacgcgccgcagaagttcgccgtctcctacttggccggattccgaggcgaaggagcaagagggcaaagagagagcagagcaaaccgcagagaagccaggggaagcatgcggagaagcaggaaaagaaaagagaggaaacagacgagcagggggctgtcgcggaagccgaggagagacacctgggccaggccatgaacaagcagcagcagaagaagccaaatgggaagaagacgaggaagcgggcaaagcagaggcagataaacgcgaggaagataaacgagaggaagataagcgagaggaagataagcgagagggagggaaggaggaagataaacgagaggacgaggaggggagatgtaagaaggacgctttcgtgtgaggaaggcgagacagaagcggcaaaccgcgagaagaagacagtcggcgacccgccattgcgattcgacgactgagcagacgagcgcgaaagaaagaagaaagtgagggagagaaggtggagcgataggtcgcaagaaatgcaagaaatcaaagtgtggaggagggacagggttgaattgatgacgggagaacttgcgttgaagactttcagcagaaccgtattgaccgacgtgtctctcctctctcggatacagctctgcagcagagatgcttgagttccacgcaagcagttctcttcactgcgtttagctacgcaagggcagataaaaagctttgccgctcctttctctctctgctgcctctcagtccctctctttggcggcaaagaacgagagcgttaaaaccgcgcagccaagaacagaccaacagacacggcagctggacgacgactgcttttcgccgcgaagcgaaaaaggctgctgcatgcagagaggttttctggggcgcctgagggtgtctgtgcactccgcgaggcaggaaggaggcaggccctctccggcctgcatggttgtttctgcttttcaggttttctttgttctctttgcgtagtcgcttttttgctgctgttttggcgtcccctcttggtgcatcggggaatgccacgaaaaatgcccaacaggaacataagtgcggtcaggctgtttagtctagtggtatgattctcgcttagggtgcgagaggtcccgggttcaattcccggaacagcccttttggaaaaattccttcatccttcaacaaagcaatgccttcttctttcttcctcgcgactctcgttccggaacagagagttgcatttccaaattgcgcttcaaccgtcactttcgcatccacggaaaaaggtagaggaagcaggagagagagagagagcaagagagagagccagagagaaagagagagaaagagagagacacagaacaagagagggagagagagagggagagcaagagagagaacagaggcaagagaagaaagagactcgttttttgtcgagatgagatgtgccgaggattccaagtcgttctgttttcaggaaaagggggagacacacatactgttttctttgccggtatgacgcaaatcgaatatatttacgcatcagaaaacctagctctttcccattggcttcctccgagggcggcagagaggccagacgccgcacgaggcgcgttctcgaaacggtttcgtccggtttctgctccccagaaagccagtcgacaaagcggcttctctgacagacagaacaagaacgctcgacctttttttcgtccatgctcaaggcgagagagcgaggcgcttcacctctcaaggttgtctcgacattaacagagagaacaacaaaaagtgaaaacgcctcagcaaagagaacagcgagaaatccttttcttgtggtcggcagaaatgcggcaactcctctttttgtaggcaatgaagcaggcgtttctatgttacttgatagaaaaagcaagagttccaactttgctggatgcagactagcgaccgttcccccgttcttcgcttcttcctctctttgaggaccagaatcagacctgtgtgtgtctaaacagcagagacaactctttccatgagacctctgaattgatgcgtctccttgaacgtcgaagaaagtcgacagcgcttcttttcagacaaagcctttaccggactatgttcatgccccaaagacaccaatcttaacgcctaagagaaacaagttccttgagaatccatagatttggacgggcatattaacggagtcgtagacggaacgcgtagtcatccgtatgcatgctcggagaactgggcttgtatcgaagcgagctttcagagctctgctcatctcacacaccttagggggccagttctgaacctgtgatgattcgtgtcattcacatttctatacacagacatctgcgtataaacgtccttcgatgttgtacctttttctacagatacagagagaatacaagcctatgtctgcgtatttgtgcaaagatacatttcgatagctcggttgttttccgaagggtctggcagcaggacttgacgattcgcgaggattcggcaacaaacggcgtcgagtcgcgtgaactaagcggatttaaaagcggaaaaaatcaaatctttctctcggcaaaaactcggcaccgggagcggtccacttcgtgcgagccgcgcctctgtttctggcgagtgtgcgagagccgcgcgctttttggctgttgcttcctcttctcgacggtgttctctcctcctctttcttcagggcgcagacggggtgtcggaaactgaactggaactcgagcaaggaaatccgagactctttcacggcttctgtcgcctcgtttccgggccttcgatgacgactttcctgcaatgtaggcaggacgccgcgcgcaaaactgcacaccctcgcgttctcattgcggcgccccaagcggccgacgccatgcaaggctagacagctgtcactcgcgtttcgtttctgttgccgggccgcggttttctctcgtggttctccaggtttcaaattcttttctgcggagagatcgagctcctcgagtagcgaacgcgccttcagccgcctccggaacactcgagagttaccgctgacggagagacgggtcaaatgcggagagcgaggcaggcagaaaaagaggaaagctcgctgttcctccgcttgctgcttccttcgtcgtccacgcgttttccactctccgctctcctctctctccgcggagaaaagagcgctgcgccgtcgagctccgagtcccatctagctgctcggcttggcatgcgccctcctccctcgtctcggctctctcttgtcctcttctccctcgcctctctctctcgttttctctctctctctctccgctcgaccaccctgagtgcgtctggcggcggaagcgtcgcgtctcctctctgcttctctctgcctctttctgcgtctctagctctctcgacggctccctcggacacagtcgctctctgtgcttctctccgcttccctctctgcttctccaggcttctctcttgttctctcccgccctctccagttttctcttgttgtccctcactctcgcgagttctcttgtctcctcggtctcctggcctcgctgcctcctgggagcggcccaggagctgcagcgtgaggggggaagcttcgcttcgacgcaggttcgtttctcccttcagacaccatgaagcgggaggagagaggtctctcgtctttcgccgctgagcctctgttctctttgcctgctgctcagccatcgggccttcgcctctgctctgcccgccggcaccatggggtgtctgtacacccgaagacgtagcgcgggcggctgaagcgttgacgccgtgaggcgcgattcgttccttctccagcagattctgaaggtacttgcttgaacgcacactggaaggcgccgtttctgtgtcttcgcgtctctctgtccgtcctctctgtccgtcctgtctgtctctgcctcgcctcgacctggctgatgtccgagcgacgcgcgcacccccaaggagagcgcaagga

SEQ ID NO: 2542 - DNA, 2041 bp, Toxoplasma gondii
tcgatgaagaaaacttgaagagcccgaatcgtcaacagggagtccccaaacgtcagttcggcagagcctttcgtgcagttgcctttccatgaaaaaaataaaacttcgaagcgcgccttccactcacctgtcgcctccgccatgttgacgagacgcctggggcaccactcgctcgaaacgaaggaaaacaagtcccagagacttcctgagggtttctcgcgaaccgaatgtccttccaggacgcggagagaggtttcaagggaagtgtgagagcgaaagactgccgggcaactcacgagcgaccgctctgacgcgaacgcgtggtgtgaaatgcgaaggctcccgagtgtacagacaccccgaagatttgtcggagagcgagcagaaaggcacagcccggcgggaaaggcgaccaccacaaccaagcgaacagaggtgagccagtctgggttccacgtgatgtcaaagccgtggagcacagagggaggaccgctcaacagttgctagacaaagactcggactcgaaagtgaaagaagcggcagttcggacggtcgcagccagtgggggacaggagcgtggggtgggagcaacttgagtctttcgagcgatgatgttttgagtcttggcgacaacagcggtgaagctagccaaacaaattagacgggaaactcgtgaaaaggacgagaaacgtgtgtccagacgcgagccgggagacgccgaaatggatattttgactcagagagaggaaacgaactttctgtggtcgtccagcaaccaaggaagaaatacaagccgtcgcagacgagcgaaacgcagccgctctttgacccgcgagactgcccccgcagcctgagaagccaggacccggcgctcgcggtgtaacgtgagatactcgcgacagctgagtgcgtgttagataaaaaaaccgaggaaatcgaggagagacgcgaatgatgtagaacggaggtccgactgagctggagaagaagggctggagagggcgcggtcagagcggaggcggaagaactcagagagacgcctttttgggtttaggaaacgcccggtttcttgcgtttgaaagagggtctttcacgacggaggctacgcaagatgcagacagttctaccaagcgttttgctgcgcgagaagtgggaaaagaaggaatcgagaggaagtgcggcgtcctcgaccgccttgcaatgcgcgctccagggaagacgtatccacgaccgagcggcaaacaaaaagttgaaactccgctgtcttactttgcgaggcaaagaaatccacaaaagcctttcagcgcgtacgcaagggaagcagcgagacaatccacgcgacccagtgcagtcgacgggggagtttcttcgggacaccggattcgctggaaccagcaacacccgagagagcgcctgacagagaaaagtctgatgtccagaaggaagaggtgtgtgaagtaaaaacagagaaacaaggaaaggaaagtgtgttcacagggcgtggcagcgagaacgcaccgaaaacgacgtgccttctatttgcgcgcgccagcgacaagactgaatccggagctggcctgcagtctttcctcccaacttttgcatggacgcggcgtctatcgttcaaacgacaatgcacgcaaacgatccgaagaacaaacagagaatggtgtcaaagcagacgaaacacacccccgtttcccgccgtaaacacatcctgcgagacgagccgtctttgcgaaaaaagcacgaatgcggctgtgccgcgccttgcaggtctaatgttcgcggcagagtcagaccagttttggtctcagggaacaggggccttcgcctcttaccatgacttacgaatccacgaaaaaacgaaactgtgtcgcgaggaaacatgtcgtgcggtcggacctacttcagagctaaaatttctcatttcttcagggctatcggtgtgacacccaaatgctacgtctggtcattcattcctaacctgcgccacgctctacctaaaaactcaagattcgtgagctccgtgacctcagga

SEQ ID NO: 2543 - DNA, 3788 bp, Toxoplasma gondii
gaacactgggtggatgtttctatgtgtcaaggtcggagttatgttccccagttttctctgactccacttcatccaaaaagtacagatacctgtatttccataaactttactgcgtctacgaaagcgagcatccacacccaagaattgctttgctaagaacgagggttagcattatattgtttatgggagttccagaacgcgaagcgctgtgttgcgttgtctcgatacgacacatgtgtggtgctctctaaatgctatctacaccattggtattcaaaggataacaggaacacagtctccatcctctgatcacatcgtgtagatcgctctgtagtgcaaatacgccagtgataacagacatcgattttctgccggaaggagaggagatccacgtcgtcgcaggcgacagagattgagagcggggacgcgacttctcacacacacacaccgttccatgccacagtcaaattaaacaagagctcttgaaattcggcggtgtgctccataatggagatacacagacattagtgagcagtacgtttcgctgtcgtacaaacgggggtagcgttttttcttgtgtaactcgtatatgacgtgacaatgattttcccattgctttgcctactttgaaaaactcattggacgcagcacccttgctgctgtggtaactttagttttgaccgtccgtgctgaagagcaggtgtacctgtgcgtgcaggttcgcagaaagtgtatctggaaggagcgtcagttcgtgtcgacggaatcgtccgatttgcttcgactccctgctgcttgtttggataaggaggatgtggttcaacgactatctctcctccacagttgagtaaccttgacttctccgtgctggcatcacactcgttttgcgtccttccgagcaaaacggaacatctgcctcatggtcgagggacacttagtttcctttctttagctactcatggctgaccagacttctacggtctataccacggaaacagtgaaacagggaacgataagacaaatgaaaaaagaaccggcgacttgcgagagaaggacgggtggaaagtgggggactgcggtgaggggtagagggagtatgggggcagcgcagcgggagaatcgaagtatcgtggattattcgtatgaaattgatacgtgcatgattgcgcgtgaggggagggtgaagacgtcgtgactgtacagtattcgtgaatgaaaaactttgctgtgtctcgaaaacgcacttgctgttcatattggatccgccattccctccgtaagtccgtttgttaggtgtcaccatcagacgggaagaattctctcatcagcaccagtttccacgaaaactccattaattcttggatacccgtgtcatggcagaactcttgaggggaatgtatgggagacaagtcttcgctgtgtcacgagggaggtgtgtaccgtgcagtagactgtgcaaacaggcgagcctcggtgcagaaatatcaaatggtgcactgcaaagacaacgtatttcctgtcccttcttcacagcggctatccacacacgtgcacacttcgacagagcatggacggaacttaaaactgacgcactcacaccaatctttgaagccggcgttatacacgtacggtttgagctagaacccgcgcacttgcactccgtatgggcctatgctgagcgataatgatacatcaagagagaaacacggaaatgcgatgggaaccacactgcaagtcttgtgcgacgtggcccaccagttccacaaccttgaaccgttgagaatcattcatgaccacgaacacacccctcgattgtgagttaagcggccaagactaccgcccttctttgtattgtgcgagaaggcctatctagagagaagcggcctgtcctacggactgcgttgcaaattcccctttgtgcttcagcttcctgttcactgccgtgctacgtgcagtcttcggtccctttcccttccaagtgaccgcgcccagagttttcgaggatctgaatttctcggtttttgatgaaagccggaagtttctgccccgacttttcatacgaatttgtctcgagcgtaccttcttctctttctctttctctcttctcttcttcctacttttctgattgtgttttttccttcttcctgcagttttctcgtcctcttttccggctcctgtaccaaggctgagtttgatctgacgctgcgttgccgcgtcgacatcttttcttgccgtttttcatctgtaaggttcgtcgctaaacgagcatctgggtccttttttcgtccttcttcgtgtgggggcgttctttcacccatctctcgtgggattctttttctctagcagtcggaaaaccacgtctgcgcgactttgcggctgagcgaccctcctctgtctcctctttcgctttttcttcgtttttctcttttttctaccgtcccctctccctggtggacacccatgctccttgtttcccccatttctttttttccctcccttcctcagtttcgaccttttattctgcacacccgcgccaatgcccctctattgacagataagctgtctggtggagaaacaaacagcaaagctacatgtttcgtcctacacagatttgactcttgggtagcagttgcgtggtgtttggcgtgaccgtctgtgcgtcttccttctttcgcgtgtgccaaatgctgtcccttttttcttcgtccaccaataaattccgctattctcgcagtgagaccgatcctgcagaacatgtatatctgtgatgtgtatgggaatatttcccattcttcatcattttttccgtcttttgttttttccgtccccgatgaatggcgcaagggcgcccctttcccgtgtgcagtctactttcttccttgagcaaaacgaacttccttctgtctgaaaattctaggatcatcttcttcccttcttcaccttttctgcaaacgtgaccggccagcctactctgaaggcatcctgtcctttatttccgcggtagtcctttccattaatccttggagttgaagaaagtggtcgcacaccacgacagaaaacgcagactgaagtgaccctgtttttgtcacttcgagagagccaagtgtcgacagggaagcgaccaaaaaggcttcccttggaacgtctttctcttgtagggcatgacaccccgcgttttccagttttcaaggttcgctcacagaacccgacgcagtcttcctcatttcttctccgtagaccaccttcaaattttaatacctcatttttccctttgtcacccttctggtttgtggcgtttctgtgagcagggagggacactcggcatcaacgcgagagagctttcgtttccacacgctctggcacccttcacgaagtccaacagttgcgtgctgtccgtacggttccttttaaaacaatttcgagaccagtacaggacacagagacggactgtttaggagagagctgagaaccgcgtttcccgttttttcccctcggcagaggaccggaaattccatcttttatcagaacgaagaggcggtgtcgaagtcatggagattgcaggtgcgttcgcaaccggcctcccagctcatttcccgcgagagcatgctggagattttccttgaaggggtgcaattgtaaacagccacgtttttctcccagcagcgcgcatgcaaagacactcttcccggcttcgtcttcaaaaacgttcttgtgtccgcctgcgaagaacaggaaactgggaggcccggggtaggcgtggcccgtggagaattcttggcgggccacaa

SEQ ID NO: 2544 - DNA, 2473 bp, Toxoplasma gondii
ggaacgaacagactggtcaagtcgaagatgaccgttttgtctctgctcaccagcttttaacaagtcctggaaagttttatttgcggcgatttcaacgatcggattgaagggggcacaccgtactctcaggcggtacatagtgggtttctcttcttcctctggcgggggattgtctctgttctgctcctctgtctctctctgtttttcgcattcttgagttcccgtcgcctcttctgcgcgcggcttctctcccgcagactgaactggagaagtgtggggtgtctcgacggctttgtggccgccgcgagtgctctcttcttcgctatcgccttccgccttctgttcctctgtcctgcgcgcttcgctggcgttgcctgtgtcggccttgccgccttcttcatctgcctcgaacgacgcgtcctggggtgtgacgcgagacgcctccccggtacggtcctccattgcgagggtgaagcggagagcgcagaaggcagaagccagctgacgaaggtgagcagggagaagcgtttggagtctcccttcgtgcagaagaaggcaaggcggagaggagacgcgcaggcactgcagtagcacttgagagactgctgaagaggcgaaacaggttgacaacgagagggaggacggccggaagaataattcgaaatggcgagacaagaaggtggtgaatggttctgaagcggagagcaaagaagacggtggaaggagagaaaccgacgtgccaatacagtgcgagagagaggagaccgaaatacagtgcgagagagaggagacgagagagagagaaaaaaaagccgagttttacggggagcgggacatgcgacaaaaagcagcaaagcgtcctcagagaaacgcacaccctttcgttttccggagacagacagaagacgacatgctcttctccgaaaaaacatcgctgtctctcgacttcgagggtctctccggtgtccgctctcccgttccctgatcctttacctcagctggttggcccagtgtgagagacggacaaattgaggaagtccagacacacgccgacatgcggcgaacgctcagacgcgttttgttcaggaaaaacgcgaaaaaggtatggacgcaaaagctgatgctctgcggcttgtctcgtctgcctcgtgtgccgacgcgacactccaactctctctcgaggactctatctagacgacggacgctgtcgcagctggagaagaaggagactcgaccccgacttgttcttccccgtgaaagagcaagttgagagaaagacctcgaactctcgatgacttcacttggcaagagttctcgacttagtcgccactctgtcaaaacgtccactctccagaggactcccagtgtcgcgtcgcccctggcgttcaaacaacgttttcagcagagagagcgtcgttcgcgcgcatgtcgcgacagcctctgccactctgtttttcgtcagcacggcgaagaacgttgaaagcaatcagtgtgttcgctcgtttaactggagagctcgaaaaacatgcgcgtctgggtcccagttcatttgcagaggaagggcaagtgaagatttttcgaaggggagaaacggcgattctgcgggtgttccaagcaacggcgacttggcgggtgcacacaacgaccggcggacggatctcgcccgcgcggcctcctggaaaatctcccccgcaacatgtggcgagaggcagaggcgttggccgtcagacacgcgccggttctcggggaaaagcgaggggaaaaagaaactgactcgaggcaaggcggcgctcgaagaacgagggagctcactcgacgctggtcctggctctgccccccgtgctgagtcattcgcacaggacacacagccgcccggaagctgcgcctccctgctagcgctccagtcgaggtagacgaactcgaacgtatttcgagtttccgagagtcttcccttaccttcggtcacgcgttctgcttcagcgaacctgctgaaagtcaaaatgcgctcttgcctgcaagaactggagaaaactcatgcgattctccccgccgcagccggcagctgggcggcgcaggcacgggatgtttttcgcctgagcctgtgacgcacaccggaacgaaggctgaacttgagtttttcgcaactctgcctcttccacatgactttccacgacccgcatgtctttgccgagttcatgcaattgagttccccgccaagcggacccgccaaaagggaaacgtcaccactgccggtctagctgcgcgttcgcgcggctacctgtcgaggctgtttcctcttgtgtactacaaaaaagcctggcgaacgccggccacgcagagagtgcttttttcaggagccgaacgcgactgaaaaagagtgcttgccaactgccattcgcttttctttctcgccgtctaatctgcgccaaaccgagacgccgccttcctcttgtgcctggacacgcgagcccga

SEQ ID NO: 2545 - DNA, 3908 bp, Toxoplasma gondii
ggatacccgcaattcgaatggcgttttcctctctttcatcgcttttttactatcccgacacacactgggaagaccgctttctttgtctcttgtcaacggggctttcacacgttgaggcactgcaggcggtaggcgtcgaggcgccatgtttcccgcgattccggaaaagatgactgtcgctctgagttaggacaaagatacaaagaatgcgtctacaatcgaacattgtgctcatcccacgactggaatgggtgaggcgacaagatcgcaacacagaaacagcccgggggttgtcgacaacccgaaaaacagggagacacagaagagctctgacgcagtgttttacgatcgctatccgaaaggcatgataagaaacgcagaaaggagggaggcgaagcgcacttggcgaaacactgtggcaacacacgcttactgccagacggacacccggcacgctcgacggacgctcgacagccacactccgcagctgcactggacgaccgatccacgacaaaacagcgatctttctcgcaagcccaaagacacgcaagaggcttcacgcttctgtcctcactccagcaagcaagaaaacgcctactggatggaccccgccgcagatgtagttggagacagccaaggcgttgagtgcccgtaggcgtgtgatacaactgggaaaaaaacagagatcaagttcgacaaggacttcaaaaacgggatagcgctagcgaacgcgtccaatgctacaaatggatcgaaggggagagccgaatgaaatgaagcacggatgcgaccatgtaaaaccgaaccagctacgcttcttcagttagtttgcctcaccgtggcaggtcgagcttcgtgttcgtgtccagttttccacagattcagcgagaaaagcttgaattccttcacacagcgtcgagaaagccgggcagcgggtggtcagaactgtggcaagccgagataaggaagtagatatggacttagaaacagaagcttttcgctcgacagcagcgcgacagcggggtgttgttctcagccgttccaccggttgtcaagccccgacaggagaaaagggaacaaataacaaaaaacgctttcgatatgatgcagagccaataggaccagatttggatcctctgaagctctgcgttgtacgtctgtaccaggcacacacaattagatcacatatactcgacgcagagatcatgttgttgttgcgtgcaggtttcaaggaagcgagagaccttcctctgcagaatcggtccgataacttcaaaaaaacccgtgaacttgaaaagaaaatggtactagggtcgccggcctcggctccctggtacacactgggaaacaaccgagcacgcctgaacaagccagcatgtgaacagccgtccgcttcgatccgcgagtcctttgacacagagaccgaaaacgtacggcatacctgatgggcttatcattccatttcctgcatttgttctccgtctctcgatgtcatccctcatccacgagcaacaccctgcttctttgcacccacagaacggcgttccacttgtctctctgcgcgtagccgaggccctcccaattgcttgttcgacacgcgacaagggggaacagaggtgcgccagcatagagccattttgaggtgctcgtgacttttgcgattcaaggaaaagtcccgagtgtgcttcggtaggaagctctaccccgaaaaacatctagtccgttgaggcttgactgtcgcaagtactatccttacaccaatcggaaacgggggatgttccttgggcgaactgtcttaacgaagagaagctgatcaaatctagaacgttgttcctctttcgatgaggcgcctttccaagtaaaaaccggattgtttcacgtgtaaagtgcccggatggggttttcagtatcaagagagttagctggagaaaacgccatcctcgtcaaaaacagacaaatgaagggtcgacgcctccgccacaatgttccgttgctctcagtgttggaccccttcattgtgtgcaagccacagaaaacaatctacagatactttgagtcacgaacacagaattcagtggtgcacagaagtagacgatcgcggtagtttttaggaaaacgacttccaacctcccaatatagattggtacaaagacgttacgatatcctccgtacaaatccggcatcaagaaggtcggcggcaaacggcgaggaagctgtgccttctgctgcaggcgggtggtcgctgtttcctgcgttctctcgtgaaagcaggaagtcatagaattctgtatttgtatgcgaatcgagtaggctcacaagaaattctcctgttaaaataggtaaagcaaatcctggcgtaagagctgcaaagacataaaccaagtatgtccgctatagtttcgcaccccacgccaagatcccgcacgaacacatgtaccccggccgaaatagcaacagacacccacctcgttagccggctagttggcaagcggtgaatagtgaagtccgtcccttttaccatcgtaagcactccagcgaactggtcctgtttagcggtcacaaagaactcggttgtctgctgcacgcaaaacgtatcgatgtacgacagacgtaaaccaccactgcatggtttgtacctgcgccacccctccgtttcagttgaagatcatttgcgtgcaacttgtaccgtacacgtgagctgggtcgagaacgatggcgaaacatggtgcgaggggaaaccgacttttctgggcttctatccgttctctgcagccaacaatgaagcaactcttaaccttgaaggcaaagtgtgaatcgggatacttgagtcggagagaaatccgacaatgccgctgtcgaagtgtatagagtaaaacatgtgaacagggttgcgctttgacggtccagaggcagaggaatccttgtcgagcaattacggtcatgccttggtgtgcagcagcgataaaaaccttttttctgtatgcgtcctgatcagtatcttaggtatcatgctgttagcactgataaagagcatctttgtgcctatcgcgtaactggagtccttttcagtatccgaggtactacagtgcctctgttaacaagatcccacgtaagatttgagagaagtaaaggtgctcagggtctaacactcggcccgtgtctatccttcaggtgctcctgcttgcttgacagctgcagccattgacagtgtcggtttagtagactcatagaacaagactttcctccgttgcccgcgcgatccagagaatcctaacgcctcatcctttgtgcgttcgtagtccgtcgctacagagggcgtcgagttcgtgacttgtgatcgatcaccatgctcaatgagctcaatgagtgtgtccgggggtgcatgcagtacggacgacactagatgcgctctttgtatcttgacacaagtcatcgtcatcgcccagcggatcaactttctttctcctcattgtgtcgcaggcttcgccttgaaaaaacaacgtcaccggtaactggcgggtctcgcgttcatggcaaaaaaccgagcttttgcccgaacttttcgcctgtacggaagggtcaacagttctctcggcttcagcagtgatgaaaacaaatgctcttcagttcacttcctcgtctttttcgacttgtttcccaacgcacgacgtttccttacaccgtctcggcggactgaggcggatgcccgtttctgcgagagcagcgaacggggtgtatgtacacctgtttgcctcgtttgacttggcctgcgtcgcacaggtgaacgactgaaaatgtgcacgactttttctcatatttcgttcgctgtttggaagcaactaaattgttcaaatttccgcccaggggaaaagcgagtttctttctgcgactttccttcgccctcataa

SEQ ID NO: 2546 - DNA, 1799 bp, Toxoplasma gondii
atggaaataatggaaacgcaggatatggacgtgggtgtgtgctaccgcacaggaaggcacaataacaccgaggatgtctccgcaccggcagggagcctccaaatattgagtggcaaggaacctctgtgaaggcgccgcctccactgaccatgcatgtgccgaatactgacgctgtgctcactgcgtggtatatttagttcgtcggcacttgacacatcatcatggcgaagcatgtttggttcccggtctaattccacctgccgctatgatgcctgtggttccgtagtttaggactgagctgatgccagttctttcggtgaacacgccggaaaagctacagatggctcttgtataaaagtaaccgccccagagtgaaacggaaccataaagcatctgagagtgtcttcagcacttactccacagtcatgcagtttttgtggtgaatgctgatcgtcatactgtcaaactaagagactcccaagaactgaaggatacttatttgagcagctctcatatagtagagagttaagtatggtggactcagtcttgcgctcgagaatgttcgaaagctgcctttagtattttcaactggagtgagcgactcggtggacaaactgttgggggcacctgccgtgtggacgactgcgatccccactgttatttgctataattctgcttgttatagaggaacacatattttgcctgagacaatcaactcagcaaccacgtccgaggtagttcttgactaggggagagaaggaactaatgcgtctccctttccacaggtgaaccactcaaatcgcgcgcaagctccacaaattattcatcgcctgcaatagctttcatgcacttttgtttttcacaaaaatatgcagtccacaacttgacgcttcaaaacaggggttcgtaggcgtcgagtatctgtaggatggcagtattactctgcatcgtggtaccactgtttccgctggtactctgacatctttcgcaaactagctttctacgcataatcacccccacagtgcacatatggcagctgtgatgttcacactattttttctgcctcgacaaggtgtgcgtgtgctgccttcaagtgtgcctgatttcggagaggaccgatgaacgaaattcgttatcgtctgtgtgttctccacctgtcctggtggaacgataattccggaatcgcgaacacccgtgaaccactgtcgttccttcagttgtacgaagtgccatgttgctaaaatggcatcgccgtttgcatgaagcctgcttcctgtttttctgatcagaagattaacaccttaggtgagtgaaaatgacacacaacaagtactcacaagccctccccccaaagtcaacgcacgtcctcacgaacatgagtgattcgagttaatgctgtggccaagcatgcgcgcacgagggcaaacgttacacggtatacacattcgggcactgtggcacccagtactagtggagatgcttcgtgccccgtgtttttgaacgttcaccgccaaaaggtttttgactagcgacgcacaatgagccattgtcaatataatccgggccacgctctcgtgggcaaattcacaaacgaatcaattaagatgtaaaaagttctactgtgcctaaaatgctggagttattttctgaaaatattgtttcgcgtgctgtttcagaggggcggaactaagataatatatatatcgaagcattgtggcgtgaccttcggaagagtcaacgaatctgcaggtaaggtgatttcttgcaattttgccaacttcatttttttcccacaaaga

SEQ ID NO: 2547 - DNA, 2706 bp, Toxoplasma gondii
agagaaaatgcaggaagatctggtccacctcatggagcaaacaattgaccgcatcacaacatctatatgattcttgtctcccagaaacactctacctagagacctcgcgagtgatcgcctctgcacctgtcgggatctcaatctaaatcctcacgtgcctcagtcacaaacgcgcatagggatgtagatatacacgtttctatttccagctgtgtatctgcgcacaacgcatgtgagataaatgcccataactatttatcaacatgaacgcaacgacgcactgctccgtgacgcggaaggtgcaatcgatattgcaatcggcatagggtcatggagttcacccaaacacagtgtcagttgccgttctccaaaaaaagaaattccggtttaccggaattcgcaaacggagcggagacaaacttcgctggaatggttccacgaaaatgccgaagaaatcctggatcagtgtgttatttttgttcgcgggggcccagttgtgtttccactccggaatgtcttctgtgggtgtcttctcgaaaaccggaaccctccagcacgagtgggtgcaatctcgcgtcttttctctgttcgtttcatttgtgtcttgtcaaggatcgtaaaatccatgatttgcttctccctagctacccgacacatggtgttcgacgcggctctttcgaaactaagacgagcgttcgtcttcccaagccccttggtgcaactggccactacggatacagccgcctccgcagacagccatatatttatgcattcgttcattgatttgcgactgtttgtgatcttagtgtaggaaatacgtgggtgccagccggaaaagcaatcgggagaatttctcgactatcagtgcgacacagcactagagaaaacattgaacaggatttgcgaaagtgatacgtgtgtccgccatgaaaggccctcgaggtgcctgccgccacacgaagaaaagcaggtgtctacttccagacctcttaccaagactgtctggaggcagattgccctataaggctaatgcgagagttgtgagagaacatgtcgactcctcgctttccgtcgtcctcacacctaaggaaaaggattcgaataagaagtacgacaacagcaagtgttgcggtgcctcttcttgtcgacatttccttcagaaatgtcttcacaggattcttttcggatggtggttttttccgcagtgtggggctttcgtacgtctgggaatcgtgtggcctctcagatctgacagggggaaggttgccgtggttagtgcgaatgataacagtagtcaaggtattgcgcgagaacaaatccgatgtggaagaatctgagtgccgtaggatactgaaatcccctttcttttgacgaggcatgtgctgacggacctgtcgcacattctctcctctaaagcgtagattctgtacctaactactggaacgggcgctttcagcttgtgacgcccgtcttcgtgatgattcgtttaaagatttcgtcacgtgtactctatgtgttcgagtttcagtctcgcgcgtggtgtaaagatgtgcccggcttcgaatatcctacttccttcgcaaagacctagcttggaaaaaaggactctcagtgaccggttctggacacaggtggttttcaagggcgaaaagcgccgtctctggccgcagctaaaaaagaataatccgcgggagatgcggaaggatagcagaaaatgcagcagtcaatgaagcaccaacggcgaaaagcaggaagaaaggtccgactcaagacgaagaaccggggcgcgttggcgggaggttgcgcgtcgaaacggagaggaaaccccgcgagaaatataccagagaaaacgaaagaaaagaagaactcgttcgaaggaagacgaaaacaattaaaaaccacttctatgcatgtcttcgaacagcctcgatctgcgagcagtttcttcaccctccagcagccaccccccaccgccacactcttctgtctcgtgtgacttgagattttgcgtggaaagattcgagtaacactgcgaaatttggcgttgactggcttccctttttctcccgttcaggcgttccctcctcgtcttttctcttccgtcttcttccggtaaagtccgtcctttcctccgtttcctcctgtcgcaactgcctcagctacagtgtgtgcgggttccggcgctagcacaagcaagagggctgttacgttagcttcaagtggtctcgaggaagagaactcagaagaaacaagacaaacacttcaaggaaaacaaagtggagaaggcaactctgaagctgaaggaggcaggataacgcagcaaaaagctagacgaattcaagggagaaagggagggcggaggcaagcggtgccgagggaaagaacggcgaaaaagagcggtggagaatagttgaacgtggaagaaaacgggcattatctgtcttatcctttgccctctaatgagaatcagtacacatctgccgcggttgttacgtgtaaggcacttccggcctctcccttttctacggctttacctcgggttcctccgtacacgactttgttaccccgttctttgggttctcacttccgttcgtcactcttctgatttttcggcacgacaagctccttacttccttcctctccccctttctttctttaagaaccgggtcgtgttggcttggtgatctagtcgccacttcctcgcca

SEQ ID NO: 2548 - DNA, 3300 bp, Toxoplasma gondii
gatgagtccgaagactgtcgcgccgaggctcttggtaaaccagcctctagcgaagagaaggccgtaatgcgccatcgcggaaggtgataagaaggaaagcctttgttttctcactctgaaaaaacacaacacacacgagtaagggtgagagactcctgggagagcagactttctctggagtccgaaagaaatcgatgaaacgggagaagaattcggcaaacagatggagagaggcaacgtagaactcagaagaagggagggcaagagaacgacgccagatagttttggagagaaaacagcagagaggcgaatgcggaacacggagaagaagagagaaagaagagaaaactaggaaaagagaaaactaggcgagaaaaccgtggtagagagcgacagagtccaacgagaagagggaggaggaagagcgaagaagaacgaagcctgggatgaagaaagaggaagctgatgcagaggcgggagagcgagaggaggaccagtgcaccgaagaaatggaggaagaagagaactttctagcggccgtagacgatgaaaagggggagaaggaagagagaaaagatcgaacagaaacaggccaccgccaccggaaggacctgagggcagactcccgatatatatacgtctgaaccgagtcaagaaagaagaaatgaaggcgaagaaccattgaaaaaaacagcgaaaaaagggacagaaggaagggaggaaacaaaggaaacgagaagagaggaaggagaggtactacacaaagtgctccctggtaagagaagaaaaaaagccaatcgggggagagtccattgaggaagacgaaggagaaaaactggagtttttttcttctctccacgtcgcctctccatcgtttcctttgtgcattcatatcgcgtttctcctgatttctttgcaaagattttcgtccttttccggggaatttatgatgtgcgtcacgacggcctccctcgcagaaacgaggaccctgtcgcgcgatccacacacaacgctgtcgcgaagaagtccacatttgttcgagaacttgtttatcatctgagaagagagacttcttcttttctctgccgacaaaaggttcgcgagaaagcaaagaggacctccaagagtactcacggaaatcctccgaaggcgccagagagccttgtgtctctgttcttgccctgaatgcagcccagcgtcggcgtagttctctggagaagaaaggacaaaaggaaacgaaaactgactgagaaagaccgtcttttcacttccaacattcgcctctcttttctctctgttcgcttctccatctgcccttatatacggcggcgcagcgaccgtctcctcgcctcgccgaggctcttcggctgcgccatttccccgaaaaattcatctgacctcggattatattcggagaacgcagttttttttcgagccaaaaaacagtcgtcaccatgaaacggaaaccgagttagtgtgtcgcctttctgtttccagattgaaggtgcatggagagggaaactgggtgagtcacttcagaggcttctgcatttcgctctagaggccttcgcagacagggagtccccttgtattggtttttttgtgtacgagaatccaggagcagattccgccatgtcgggggtcttcccttccagattcagtcaaaaatagtagacaagaaagatcgctttgtagaggcattttgtgtcttgtccttcgtgtctgtcctgctcaaagtttacgtttgtaaaggagatccgtacgcaagagaaaagagcaaaccacagtgacgcggcgacagtcggagaccccccatcaccccaactgacagaagagacacagaacagcctagaggaacgcgttgcattccgtttgaactttacactgaatgcgttggagtctcaacttgctctggacagtgagaacacagagcgcctctcacgtaacttcgatcctgcaccagaaacggaccttccacgttagccgccgcaaggcctgctgcctctctgaaggaagacttgacctcggtgctgatttaaagcatgaaaaggtcaagaagaaaggaagcagctgtaaagactaaagacaagaaccgaacacgaagagagaggcgaagtcggcaccgaaaaagcatgaaatcgacaggcaggctgacagcggtttttgccgacgccgtttagctttggagaatcgagagctgcggtaaatcgtttgcgcgggtgtggagtgagagtgacgaatctctcttctaaacagggcgttccttcttttttgggcgcctcgcgcgctctgtcgcttcttctgtgtttgatcctcggcgcaggcaaggagaaaagagaaatacgcagacaggggggtcgaggaaagaagcaagagaacgaggatgagaaagagttcgaagagttcgaagagccagcgaagatggtcggcaggcacttgagagacagagaaaccgaaagacgaaaagggaaatcgtggcaaaaaggtgaagaggtttgtggtgagctagaaaacaacaacggaggaagagcgaggaagcaaatacacagaaatgagaaaggcaagagaaaacgctgaataggaaagagtcagagagacggggagagagaaagagaaatggcaagaggtaggaaagagagaggtatatatatatatatatatttctctctctgtgtctctctctctatatatgtaattatgtttgtatatatatatatatgtatgtatgtatgaatgtatgtatgtattgttaggcaaatgtatgtatatatacgtatgtatatatatgcatatgcaggtgagcatggagaaagacacagacagaggaagagatgcatatcggaagagagagagagctattcaaagagagagagagaaacgaagaaagagaggacgagtccttgagaggaagtgcaagagagagaggcgaaggaaaggactcgcaatgcactgccggccactgagtcctcacggacgttgtcctctccttctcgcctcctctgttgtttctggttacggtgtctccacagtgtgaatcaagaaggaattaagaaagcattgcgttctgtggggaaagacacaaaagaaaaagaaactctaagcgcttacatctgggccatgaacgagtgcacacctgagagtctccccaggactagagagagaggccatttttgggcgtttctccggcggagtcgactcggagactccccaaaaaagtaaagaatgttcttttcttcctctctctccattctctgctccgtccggtcctgtttcaccaccctcagtttctctcccccagga

SEQ ID NO: 2549 - DNA, 4246 bp, Toxoplasma gondii
tcttcaggtagataaaccaagcgtgaaggagtgatatccaggtcgactatgctcgtttgactaagcgtgaaactcccccttctcaatgtgcactacaaagtcttgcgtatcagcccttatctgactggcgctgcactcgtccacctgcatgcttccgtgtgcgctgggttccccccttcccctgcagaaagagcaaagacagagaacgagaagacgtgaattccccgtccccctcacacttacttttgtaggctctgtcgcgaattttctgtttcattttatcgaagaacatgggctccttaatgacgacgtagtagtcggggacgagggttttatcgactgctgctgcgaagatttgtttcttgtctttcttctggaggcggttcaaggcgtccgtcagcacctggcccacccggtagggtgtacatacacccgaagcggagtccgactgcgagggctgcagcgcgccgctgtgttgaaggaaagccgccgtcgcggctcgcgtggatcttgtcgcgggtacgttgttttgagctgcagagcgccggctcttcgtcgggagagtcagcgcagaagctgcgttgccagaccccggcggagggcgcttgcgtgatccgagagagacaggagagcacactcccggtctcagtctcaaggtcgagcgatgcccgccggcgcgcagatgacccccagagttcagcggcgctggagacgaaaacgtgtagccggcagtgcttcctggaggcgggaagaggggaatactcgggggcgcgctcatcgtggtgtacatacaccggagaggcgtgccgaaagcagggttcaaggcactgggcgcgaagcgaacgcatgcgtctacaagaagcctgggcgtttcatggcgcggttcggctgcaagtgcgggctgtttgggcgaaaaaggcgaaggcaaagaagaaaacgtcgggacagtcgttcagcgaaaggaaaggggatcagaaagacgctggtctctgtagaaaaccacctctgcatgcgagagccgctctggggtgcccaggcaccgacaacgcattcgccggcttcgtcgagtttccacgagtccctcaactccgcaggaaaacgcatttgcccttgtgtgaggacttgcctccgtggataacgaagcggaacttgcgaaattgacgcagacaacagctgaaatctgcgacgaaggaaagaacgtgaacagactcgaacgcacggcggactccaaacagcctctgcaggggctggagagagaaacgccaacgggctgaagacgaatttcgagaacgcgaggcttcgaaggatgaaaaatcgagacgcaaacgcctcgggagtggagggagaaacgaacaagaaaaggcaggacacaccgcgcaacgttagaactggaaaaagaagcactgagcaagacgtgcatgcaacgacgcgcatgggggtgatcctgctgttctgcgtcggaaacacacatctagatacgatttcctgagtaaaaagtttcgcgatccagatcagatatcgaccggaaaatgcgagatgtccagacacgtaacacagctaaacgttgcggagttctcctctccagttgacttgccaaatgaggtgtttttcgcagcgctgcaggttaaccagtgctttctctacataaacgtgggaagtttccgacgtgagccgtctcgtcaaaaccataccgttgcaatcgatgatcttttcagttcacattggtgcaacgcacttcgaataaacagaaaccccgtagtaccttggatacgctgaatttgaatcccgctgtttcggcgtgaacacaacaaagttctgcatgacttctggcactctagtacctatattgtgctgaacgtgactccaactattacgaggatatgacaacccagtaaaatagtttgcgcatggttctgctagactcaagttctatcaaatgttttctgactttctgtagagctgtaaccggacttcgcgtggatgtcagcaagatctggggttaaaagctgccgaaaacgaaagagcactcttctctacagagttcagctggcatctgcgccgtcgttggcaagcacttccaaaactgccgttcctgctgaaaagaatgtgtcgtgatggtcgacaccaagcaagactgaagaaccactctcgcgaactttccttggcatctgtgcaaatgatcagtccaagggggatcactgactggcgtttcaccgtgagaaacggacgcagtagggaaaacagttttgtggagcctctttgcgacgtttttaaaccaagcggtgcaccagcaaaggcattcatcctcgaatcaaaagcgaacatgtagtaattcgcctctagctcccctgactagtggactggagtacctgcactttttcgtgcgaactcaaaaagcgtttcctagtgtggtgtcgggagacgggcgcaagaaaatcagggacttcgttgccgagcagaaagctgctttccgccctttaacagtacgggaaaaaaggagagctgaagtgctttgatttgagttacgaaaatctgagcgccgaccactacgagaaaatctctgtccacgaaccgactgagtctcgagtgagagctgtgacctctatgtcttcaaaacgcgtaacttagtttgactgaaacgtgtcctagatctccagaaatatcagcagaaaagggttcagggaaacccaaggagttcgtcctgacgacgaacgaaaaaggctcagcgatttgcactgtttttttcgttagagtaactcagtctgttattcaaagtgaaaacagatgcagccttccggcgcagcacactttcgctcgcacaggaaagttatctgcattcgagtcgcctctccctgaactcacatctacacggtagcattccgctggaacgcacacagatccgcgagacaaatactcactcctcaaaaaccctgtcaacaggtgtacgcccgtcaccagtttcttcgaagtagtcacgcttcttctttttctgcttcttcttctccttcttttcttccttgttgtccttctctcctttctgtccgtccttctttttctttcggccaaaaattctcactgcttcagccacctggacagagccgtcctcactggagaagagagagagcgccagaaaactgagaactaacagcactaagcgtccgagtttcattgtgacgaacgtcagtctgggaaatcaaacagtgaagtccgtgtcgacgcgcgtcaaaactggagttatgttgcttttgtctgcaaacttggagcggagagagaggtcacaaccgcattgctcggttctttccacgcagtctagctcaccgaaggggatgatcgacttctcagctcgctgactacgaactgttccgcgcgtttttccgggagaaggccggttgtctccgcaaaaagaaatttcgaggcactaaagacgagaacgaaaaaagacacacacgcgttgctcttccacgcgaggtttacaccagtgaaagccgtcaactctttgcacgacagtgtcttgtcgccgcgaagtggctagaagcaagtttccactatcagataaaatccgagaagaatctgctctacctggggaaaaaagacatcgaggaaacgtggaggaagtagccgttctgtttcagtcgttgaagatttgtagcaaagttattcactcgccttgtcagctctttcgtcttgtaaccgcttgtaccgttgcttcagcgaggctttcaacttcaggcgtgtctgaagatgacgacggaggatgctcgacgcatcttgtctaccgacggtctagcaaaacgcccgggcgacagctagctctggtaaagacccgcgtagggtccggctgatatggggcagtctcgggcggatttattcgagtgcctttcaggcggccgagagcgagacgtgaagacggcaggtaaacagccgcacgtcactcaaaaaaaagaaaaagctggcgctgcgtggggatgccgtttagagtgagcggcccggcaacagagctctgtagacagctgcacagaaagacaggtttcttgcaatctcttttctcccaagccctcccgcgagttttttttcgggaacacatctccgccttgtgcacaccctaaagtgtttttactgctcacgcgaactgcgaaaccctgaacgctctgcgaggcacaggtgtttcagcactcgcggcgaaagaggtccaccgaaaagaggtcacgggacagctccgaacatttggaggaatcaaaaaggacga

SEQ ID NO: 2550 - DNA, 2244 bp, Toxoplasma gondii
tgcatcttgtcgatgtcgatgctcaagccgtcgattttgattccgagcctctcgaaatggtcgcgagcatcctgagaaataaggaggcaaaatgtgtgagaaaaaaggtgcgatcggataaaagaaccatgcgaaacggcgacagtcacgcagagattcgcacctgtctcgcaaacgcgtagtgtttctcttctctcccgaggcagccgtctgcgcatatttgcgtctctcctttcttctctgtgtttctgtccaccctccttccatttcctacctcctgtcaggtttgacacccttctgatctccgttcttctctttctcttcgtccacgtttttgttctttgttgccttcctgtcttcgctgctacaccttcatcccgctgttcacatcatttctctctcaacgtctccggttctcccctttctcatgctcctttcgccatcttcacccttcgtccgttccctccgttctgcgcttccttggattatcttctcttcttcctgtctcccttgctctcccgtcacatgcgctctcccgcgttctccccttccttctcctctgctgccgtctcctctcgagatgacttacgacatatttgttgctgatgttgaggactgccttcgaggggatgcatccgacgttcagacaggttccgccgagagttccgcgtttttcgacgcatgcagttttgaggcccagctgcgccgccttgatggccgccacgtagccgccggggccgccgccgacgacaacaacgtcatacttgcctcctgcactcgcgaaacctctgcgctgcaccgcggaaggcagcagcgagaaagaaaggccttggtttttctgcgacagaagaggcgaacttcccgccggtcgccacgcaaccgccaggttccgaaaaaccgctgccttcatcgtgccgagcagaggacgaacaagtctgagccagccggggaaaccgcgaaggaggcaggtaacagcagaacgtggcggaacgcgtaggggagtcgagatcaggaagtggggactagccaggggtgttggaaaaagggagggggaacttggcggcggagaaagcgcagagtttgcgatgccacgcgaaaggaggcagccaaacacagagtgtcgagagtcgacgagaagagaagccgagagattccgtgacggaagactgacagagggacgcgtttcctggtttttaaatgccgggcaagctgcgccgccgtgactatggaaaagagtagctgaaacctagcgggaaaaaaagagacggggcgccgtacatacacaccttgacagaaaatggtgcctcgctgcctcgagacgccgagcgcgtggcttctcgccgcaaacaaagttccagactttcgcccaaaaagaacgagctcaaacggagtccctcagagacaacgtgcgcggcttcttttcaggcgccgccggcgaagtctggcggcattttctgcaaggggcaggcgggcagagtcttttcacggggaacttggcggctttgcgaaaaacgctgctggaggaaacgctccggaatccgtgcaggagagaaattctcactatggcggacctaggaaagaaaggctggagtcatggttaccgaaaaacgggttctcactggcatcttctctcgaaaagcggcattctggccaaactgacgacgacccacgagaagcggctgtcacacgcgaggggcaacggaaccgcgggagttcaccgtcggcccggaaagtatgtccggccttctggagtgacttcggcatctctcgacagatccgcgtccttcgcggagcgaaacagtgcaattacccgggaaaaccgattcctggaggcagtctgtgagacagacgtttgcaagaagggggttcgccgacatcctcgcccgaactctgggcgttccaccgcgaaagacgcccgtgtaggaaggcgaagaatcctattagccagaagagacagcctgggaaaaaccctgggttcttcctctcggaatgcatctacaagtgttgaactgacggagtcaacggtccacatttggcggccacgcgcacttgcggcgtctcccgggtgtatgtactgctcagacctgcgcgcctccggtgcttgcgttgggcagctgcgaacggagaggcgcgaaatcgcctttgtctgactttcgacccggctttttctcttcgccttcgttcgctttcccgccttttctgccttcccccccccatttaccttctggaaccttcggggcgcca

SEQ ID NO: 2551 - DNA, 1505 bp, Toxoplasma gondii
tgctcagttgactgaggcctgtgcgtggaaaagtgatgacgttcatgttccatgtgaaaaaaacgcagaggcttcggatttccgttgttgacagacgctttcttcttgcatctgagtgtcacgaccaagcacgagacttcgaacggctttccctggatcgagggaaacgactggcactcgcttttggttcacgcgacgcttcaactgagatcctcgccacatcgaaagtctccactctcctctgtatttagctgagaaccggcacagcgtcaggcgagagacccgccatgggagtgtgccgcctgctcggcggtagtcgcgtgagaaatggggcatccggcaacgcgactcaaaacaaggctagaaggcatctgtaatcgcggtgtctacatctgctcgaaacattcatatgtgcgtgggaaacgttgccgtgttcctccagttgcagaggcacgggacttttgtcaggagtgcccttttttggcgtttgagaactgcagcagaatagatcaatgacaggtctgcatttttgcacagtctagagaacttcagggttaaccgtacccgcttccatcagtcccccccctttcctccccctccccccaccccccccaacgctcagagcatatatgaaccagacatacacacggttcatgacgcaagaaccgctttctaatttgcttgacctgaggatccaacctggtcctaactgacttagaaaatagtaaagggttgaactgtgtgcctcctcttcgtgtttaatagccgcctgccatcaacacagggcaccaacgcgctctccttgttacactgcagtagtcacaatctgctgttccagctattcagaactgtgcacaacgattaacgacagaatgttttaccaagacggaaaccagattaccgtgattttcattgttactttaatacatggcgttcaattggttctattatcaccttaactatgttcctctaacacaacagaacacggtgcgacgttaaacttgctccgaaccctctccgtcgtttatgaagatgtggatcgcagtggaggcatagccacgacagaaagtcttcttgagatctcgcgtgtgtgtgtctcgcacgccacccgtcaaggcgtcgactgtcagtgaacgaatgagcaaatagacctggctagtgaagaggaattgggtgtgaccactcaaaccgttttctgctcatcgatcgaacgggttaatcgcgtccgcaatggccgtactgagacaaatttaaaatcatccgtgaagttcacctggagttagcacagaatccttggctctctgcaacgtaaacacgagcttgcatgcgcggacacttcggactcttgtttacgcgtgcaactgttctgcggcgtaagttgccggtttctgacgacgatcaactggcgtatgcttgaaactggatatgtgggttctctttccccagagtggctcggccgtctcctttcggactctcgaatggatcccttctagctgagatcaaca

SEQ ID NO: 2552 - DNA, 1845 bp, Toxoplasma gondii
cccgctcgattatgacttacttatacaagtaactacctacagatatgcatgtacacatatatgcatatatatatatatatatatatatgtatatatatatatatatggtcatgcatatttgcaaagacagaaagaagaggtcgatctacacagacagagacaaaagacagcacaaataagaagagatcaatagatgcgtacatgcggatacgcgaatacctgagaatgtacacatagacacatggatatgcatatgaatgtgagtatacgtgtgtagcgatatttaaagttgtgtgtagatggatttacggaggtacagctagagacttcgatctgtgcgtccatgcctagagatgttgttccgtttttgagtggaaatttgacggcgtgcctctacacacacacacatatatgcatgcgtttctgggagtcgagctgtctccacgcttttgcgtgtttcttccagtttctctccatcaacattctgaagaagaaaccgtttgtgtacggcatgcttcgaagtaatctcagcaacggcagcctggagacgcgccccctcccgcgaccgcccgcttgaggtgtatgtacacctgggggtttgtccgtgtgtgtttcttttgtttttccccttctttgctgaatgcaagagcgacaaccttgcacactttggtctttctacggagggcgtttgatttccagatttcgaagtgcatcctttcctcggtcttcgaccgcacggcaaagagaggtggaaagaggcattttgtttctttagagaaggctttttcgtttccctccttcctcgctgcctccgtccttttttcgacatcttccagagaaagtcgcgcatgcgcgtgctctcatcacgcggtgccagtgcgcgtggtacccatctagaagtcggcgagttgtcttgggcgttgtcactttccgagctcgtttttcttttctttcttcttttcctcctttcttctggccgttgccgctggcttctccaatttttcctgcttcactgcctgcaagtttcaccttgctgataccccggcgcatccctccctcctccagcgccggctgcttgtgtctccaccaaccgtggcaaagcagggcgtttcttgacagatccccgagagagatcgaggcaaacgagaaagaaaatcgcgagaacagaagaagaggaaaggagaggaggagtgaagaaagaaaaggacaaacgaggcaggaaggggagagaaggagagaaagacccttcgcgacgcggagtctgtcgaggtccagtgagtcttcgacgcggcgacttcactgcatcgcttcttgttgaaaaatgttgaagaaagatcagaaagtgtgaattaaaaatgcttttaaaaagacacacacgtgggcgtttctctggccgagctggaaagtggagaaagagttaggcgtccatctcttcatctctgtcgagacatccgagacagtcccgctctgttcgctttgtcagcggctgcaagaaacgatcttttttcggaaaaatcgcctcttcttggaggacatctccacgttttttctcctttcctttcggagcctgccaacgatatcttccatctccttccttctctttgtctcctctttgtctcccttcgctattcgtataggaagaaacccggttcctcccttttttggtgtcaagagtcgtttcggagttaggcaagatacctttctccagcactgcgactgctccggcagcgaacaatgctcatcaggctcaggttccgaggaatatacgtttctctgccttcttttttcgccttctcggagtcgctgtgtgaaggaaagtttcgcgtctcttcgcccaggccacca

SEQ ID NO: 2553 - DNA, 4813 bp, Toxoplasma gondii
atacaaaagagaatgcctcgcggcaagcagagacaagacaagtggcacgtcaggctgacgagcagaaagcagcaggaaatactgacagacatttcgaagacgagggggacacggcaaactctacttgtaataaaaagtgtaggaaggagaactcacagcgtgaggggtccttttcgaaaggcaatgcagcaaagtcggaggccgataatgctatgtcaaagacaaaagcgaaaggaggtaccagactgtcaaatcaaacgttaatcagttcgttttttcgaaagaaacactgagtgtgtaactcctctagtgcgttttttggaagattcggtatgtggattgatgggcagtggctgggcgggcattcagaaactgagtaccgagcaactgtggcaggatggcatagggaatcttactcggtgcttcgtgtttgccgagacctgtgaaaagttgatgctcctgttatggcgtacacatgatcagaaccttgcacctttgctttggtgcttgctcgcgtgttcggtaggaacaccacgtgtgtaagccgtggacttgttcttgtatcatgagaattgtgttgaaaaaggttttgatatacgatgatggactatagggggaacggcgtggagcgccggcgcgcgacgagtgttttcagatataacctaatgtaaaagggttcattttctgttggaggtctcctcgtgcgtaggagaccgatggacgaagttttgacgccgagtgtgttactgcgcttgtttggcgcgcgctgcatggaatgcagttctgctcacgctttttctgcatggaatgctgccgcgttgcaaatttgaaactactcgaacgatgggaggaactgcgttctcatctgcacaccccatctagtacgaaaagaacggttacaatcgtaacttgttacatactgaatttgttgcggaaagcccgaaacatgaaatgaattgcggtcggtccacatacgactgccacggtgcgatggaccggttctagaaacggcagggttcgttctatcaagacacaggaaaccgtcaccagtcatccgtagcagcgcgacacagtggttggttggagacgtttgtgatattgggactgtgttacaatgtgagaaaaccaaaaagaaaaacaatgatgatgtgtaacgatgatgcctctattgtcagccaccgtgaagattgaaaaaagcagactgccaccagccgagtacggtagactacagaattgctgtgatcgcatcgacataaaaaactcgcgtatacgtagatgaaagaaacctgtgatttgttgaagacatgcggctcttctccttgcgcccacctcaagatacttcatcgaagtgatacggacggttgccgagtttcctgccacggctcgtaccacaaaagaaacagattaataatgccatcctagagattttgaactcgctgtcctcttgcactgctatggctaaacctgtgccgtgctctggcctccgcttcagtttgtgtttgccacgtattccagtgtcatggagtagaacatggcattcgtttgagttacttcggacagagccgaacaaccgtctcctcatgcgccccccaaaaactcgagatgaaacgcttggttctggtgcgctctgttgaagaaggtgctggaggccacccaattaccaccatcaatagcgaaagcttccgtcagaacatcgaacgcttcatctgcttctcgggaggcgacgtagccaccaccacggtcacaattgttcaaggggttagtcgttatcattcgtccgttcgtccgtggttgctagaagatgtgtcgcctcactgaccgacggtctccgaagccgccgcagggcgagttctggctgcacccgaatcgcggaacaacagcctgcatctctgtacccgtgtgacgcgggcgcctctaggttgaacccagcattggttcggcgaagcgactgtaaggaacaaggctggcagtcagggaaagggtgtcttgcgctgaatgctggatcttcggaacacgatgtgctgaacaatcgtgaagttctcgcactgcttggctctcttgttccctgtcactaccgtttctgttgttgttgttcctgaagacgtttcgccttctccctcttgcgcttgtcttccggactttcttcgtccgcaccaagaaacggtgtgtcctcaggcatatgtccagcatatgcttctttctccatgcgcacgagcttctgttgaagacgttggagtttctttttgtaacggcgtcgttgcaactgggtgaggccgacaccgattgcgcctgcaagactactagcgatgaggcccatgttattccgcttgtgcactttacggtcctctcgctcgagaaattcgccctttttgtttgccatccaatacactagcatacctgcggatgccaacgccatgctgacaatggacgcagccccagcaaagctttttttcttctgcagattcttgaacttctgtaagtctttgataactgcaggacaacgtcgcatccgatcaagcacattccacatttgacaataggtaaaagagcacgaacagtctgtgacatcgggcggtttttcggcttctttgcctcgaacacgtggcggacgacttgtaatttgcagccctgggtggccagatcgtcctttatacctactcttgggcagttgaagcatcaacagagaaagcgaagaggcagcaacacctactttacaaagaaactccacagcggcattcccattgtcaagcgagtactggaacacttacatgcgggcgattcttctgggtccaagtcatcatcttccgattggtactgttgcagaagtttttttctctctctgtcagctgcacacacaccagacccgcgcatatccaatttcacatcgaaggctctaagacacaatttttagcaagcggcttcttggcgtccgacctccgtgctactaaacgtgtccacagcagaagcgtgctcgaacatttgaatgtttctaccgcagacgcaatcacccagttgctttcaccagctggacacaggaccaccactgttactggctccagagttcaggcaaggataaaggtcactaggatgctaaattccagcacctttcacctgtcttacgcagtccagtgtggtggtggtgcagagacccaagagaactgggctgtctgtatcccgtatgtggaaccgcatttgcgcctacgtttcgttcaccacgaagaaacgacctcccgtgcctcccgtactttgcccccaaagtactctccgttcgatccctacctttcatcttgcggtattcgcggttctccgaaagaagctcgttcatcgtctcgagaagctttgtctgctgctctttgcgcatcttgcttcttgtagttttctgtgcattttcttctccatcctttgcgtcgtcattgtcggccgttgtttccactgattgctgattctttttcgtatttgctgcctctctccggtccttaataacagaggggccgttatcagtcaagtcgagttcttcactgcctcctgcgccttgctctgtagcgacatgcgctccggaagaaggaggtcgcgcagctgccacactaagaaacaagattccgagagcaacaaggattgcagctctacggagtaccgcacaccgcacccgatacagtgcccagatgttgggttttgagccgttcggggcctccatggcggcaagggctgaaccggaaaatgaggatgtatagaggtagtggcgatgatggagtcctgtccagctgtgtggagatcatattccgcagttgggtgtgcactgattcttaaaaactagaggcagacatgcaggcgggcgcgagtggagccacagttttcttttgcccgaaatatcgaggcgtccctgcccgccggaagtgctagctctcatgcacaagaccttgactccaaactgttatttgtccaagatccaccactccaacccaatacggacaacatgttatcagtctcccgactgcgaattaaccatgacagtgaatttgtccctgccctccaatttgccagatcaccacactaataacctctccgctgaatgcggcaccggcagctactcaacggtctcgactcttgggcctcatctgagcagcagctttcagaagcgggctggcatccgggaatgcccctcgacaattcatccctcccgaataaatacagaataccttcagaaaaaagccattctgcgccatcgcaccactgttgattggaacttcgtattccaggtactccaagacccccaacgagttctcggtcaaaacacgtggctcgaacccggtgtactcttgacatcgcctcctttaaggcgctcgtggcgaaccaccaccgcacgacgattggtgcctgaaagggtaccgccggacataaattaaatcgagcccaatcaacccggcttataataggagaaacccgaggcagcagcggttctgcaagagaccgacattgccactaagcgcgatggcgtccccagatgcgcgttctcggaaggagttgcgagggcgtggacactagttcttatcgtcgctcctgccatcgccacagtggtggaggattattattcggcaaacttgttgtcacacttgcccacttcctcagtctggaaccttttggttcgcacgagagtccgtaccgtcgtttcgctgccttcccactcttgagttggttgtttcacgcgtttctgccgcgtgataggtgtcgactaaagcggtgtggggttcgtcatatctttcccccgctcggacctacgcaatattttgacagtcacccattcatagacgaagaa

SEQ ID NO: 2554 - DNA, 4376 bp, Toxoplasma gondii
gaaacggaagtgaagatcaaggcggtcgtccgtaacgtccttagtactgcgatggaatgcagaagacgcaacatgtctgtgttacttccgtttatcaccgcgaggagaaactgcaaacttttggagaaacgtgttgtgttccgtcggcaaccttgcctctatcatttcaacgagctgtgtcactgaattataaaactgatgggtctacatacttgtgtcagtgtaagcagggttcgtctaaaaccaggatgtaacaaagaacgctcgagtggcaagtataaacctctcgcaggagtttgctcatagagccgactgtatttattcggatgtggcagcgtacattgccaaaatgaacgaaggttcaacaaacgttcagatgtgaaaaatctacattggccggtgtgaacggcattgcacggtaaaagacgaattcagccacttcagctatagatggtcaagtgacgcagttcacgctgtacttcgcagcaccgtgaggacgttttgagacaacccacgtgtaccttgaaaaaaggcgtcaatatgcgagtcagaggttcccagacattgagagtttctgttctgatgccgtagatcgagccaattttcttcagacaggtcgcctttcaggattcttgagagaacgagacgttagcggaggtcacattatgtactgcgtgactttcgcattgctcctagagtcttcgaagcattgtgcatcgcctgaggtagtgaaaaaaagaggttcccacaacaccttgcacacgcgtgacgatcagggagctgatgccgcatggcgaagagagtcaaggatggcttggtgcagtcgctcaagattagcaggaatttcgatcaactcgggtcgctctaaaagaccgggaaactcaatattggtgaggtttccgaaggcgctgctgccgtccaatttaggcagctccagagtcggtaagctggggagtgccggagcatcgctgagctttgaaagttgtggtaggtcgccgaagcttggtattgtcggtaacccgctgattattggaagttgaggcaggccactcagacctgggactgggggtagctccccgagggacggcaatggtgggaattcgcccagacttggtagtgatggtaactcgccgagtcttggtagttgtggcaactcgccgaggcgcgggagttgtgggaaaccgcccaatcctggtagtggtgggagttcaccgaatcctggaagtcctggaagttcaccgagtcccggtagtggggcgaagtcacccagacctggtagaggtgggatgtcacccagacctggtagaggtgggatgtcacccagacctggtagaggtgggatgtcacccagacctggtagcggtgggatgtcacccagtccagggatccggggaagttctccaaggcgcggcagctgaggtaagtcaccgatgttcggaaggccagtgaagttaaaacctgccagctggctggggattcccggagttggagggaatatggttggcggaggaagggacggcggcagtcctatatttccaacaggaagtgggaaaagaggaaaggggatcggtagtggctgggggaccacgactggaaaatctggggcagaaggaggtcctatcggcagagggaataggataggcggcaaaacagggaggccggggggagattgtgccggggtatcacccgcaggttccggcagcgtggtaagaagagccggaattccgggcagtcttgtcaggtctggtatcatcgacgaatgcggcagtcctggcgatgcagctggctctggtgccgcgactgcctttggcacgtcagaaacgccatctggatcgcgagcgtgagcgttctgtggcgctgcaggcgcctcggttggtgtgtccagttcagttttcaacggcaaaaattgggcccctataaataatcagaattaataactgttgttgtttgatacctagtgacgggcttacttgcagagacgaccgctccaagcagagtgaaggaaactatgaccctcattggaaatgtgtctaaatcagaaaactgaaggaaagtgtcggcagaaaggcgccttaattcaaggtacctggagtttgtgtaactgcagtgccgtcacgatcgtgctgaacacgaacgtttgcctttggtttgtatgtacacccggagttgatccagacactcagatatccgcgaagggatgttatgtacaccacgtttcggcaaccgtgtcagaaaaacgtgtcacgggcaagaagatcctgcaggaaaatgaacatgtaattgaatctcaccgtgtttgcgtcattaaatggtatatcctcgctaatggcgccaacagatttgcgtcagcatcagaatcagaaacatccaggaaaaagcagaagtgaacgcatgctgagaaaatccgcttggcctggacacttttttcacttgtactgttgtcattaaccaagaatatgcattgcatatttggctcagcaaattacacccatgttgctagttggtttttattgagtcgtgtgcttacggatgcgtccggttctgccacgcaacgatgtgtcgtcgggaactctcctagcctgcaggtagacagtttcctactccatttcattctcagaaaggccagcaaagtggaatccatgcatgcaatggcaaacgcgtcttgctgtcctgtcaaggacatacggctataatgtgccttcatgtgactcaatgacctttcgttcgtctcaaaaaaaatctttactcccccacgcaaaaaaagcattgttcaagacagaagctcgtcacataatgtgagagcttggtctttattgaggctcgttgttggcagaacgaggtggaaggttcagtgatacatatctgaagtatattggctcgatgtccgacgccgccctccgttgcgtatgcaaacgtgggcagtacgtgtgtggctatcgacgttggcggagtggaatagcacaccgcaagcattcgctctctctgcgttcatgaactccttctgcgcatgtaatgggtatagcaatctgtttcagtgaagcgatatcgatgctacaactgtctgagacagggattgagtcgtccttgagcggcggtgcagctccgcaggaaatacagaagatgaaagggacggcggacgcggaagaagttacaatctaccgcagaaatggtagatgagctactagttaagatatgtcttggtttgaccgaaaagaaaactactaaacagagcttctgtggggggagcaaaactggcctatttcatagggtgcgtggctggaggcccctaccacagtcactgtttagcacacctttcacgctctctgtaaagctgctggattctttctgacaagctttacctgtgctgtagtaattggagggctgcccatttctggtcagaaggatattacgcaaggtggcacaaaaaagctcactgacggcgagcggtgctacccgcctcaaacgaatctcagcagctaggacactgcaaaattgacagcaaaacgggcgcatgcagaattcagcagtctctcttacgatgacgcatttttgtgtctaagattcatttgaacgctttcggtcattgacaactgctaagacagctacctggttcaaaaaacactcgttaagttgagcaatctccatcttgtgcgagttttgagagagcatgcggagcccgtcaagtcttggttttacatgacaaggcgggcggttagcgattgtttgtgttaacgttccgtctcgaatggaaatttgccgccagaaaagaaggcttgcctacaaattgtttggcaagagtttacatgttgaaagtcaccatcctctggaaaaaactgtgaactgacatttgaagaggcgctcgcgcccgccgttacacaggcacgacagaacgcgctcctgaggaggcacggcgaggttcgcagaaagaaacgccttcttaaggccgaagcaacgagagtcttcatcggcacactaaatacagctgtttttcatatcttgtgtgcgtgcttgtctgaaggatgcagcgaagtaggttgataaatttggggccttgcctcccaacgacatcgcggcgctacctccctccataaccgagcatcgcgggtagccgagtggcatgcgatgtgtgcacttgtgtctcgtccttcgcatgtgacttccctcaccgtttttccatgcgcactgcttttacacgggcctgaaggagaatctgcctcgacgagggagaagcttgcgcacacttcccggtgacggtactcttcgtaaagaaaaaaccgatgaaacgctgtgactagcttccagcgcaaatactgctgggggatcacatctttcactccatctccaaagagttatttgggccgaagctcatgagctca

SEQ ID NO: 2555 - DNA, 2278 bp, Toxoplasma gondii
taaactttccatatttctcgcactctggtgtgttgtcctgtgcatgcatcggttgcccgtgaatttgagggttcaggcctttctacgtccttgatccgtgagcacgctgagcagacagcgaatgcagtcgtttatctgacagggatcttacgaaaagcgcaaggctagtgaggtgaatcggcgatctttgccggagcaccgaggcactgaaccctacaaggagcgaccacagcctctgtgaagaaagctggcactggaaacgcaaagatcaccgcaatgctgtatgcgaaggctctgcggaatcccccgagcgtcaaaagggaagtatagcgtctcgtttccttctgggtggtactttacgtcgtccaaaatatctttcaaatcctacgggaacacacaggcctgcagaacgcactggcgttccttcttcgaatcgcagtctccttctcgcgtgctgtggctcgggagccactaccattcgctcctttatgtgtcagtttccactttagtcccttccgcaaaaaagcaactgtctctgctctccggatctgacgaaacacattctacgcttctttcgcgccgcgtcggtctgtccaggagcgcggggatgcatctcgcaaagactgaggagctctggaagtaacctgttaaacattcatctagtcgagttgacgtccgcagtgctacacaagagaagatttttcagatcctcgtttcaaaaaatggccactggtttcctctcacaccgccaagaaatccccctagacgagtccccccccccttacattcatgtatgcatatatacacacatgtacatatacaatcatatatatatatatatatgtaactatacatggaaacaggaccttcgttttcactgctttcaacgtggatgtacacttcagctgtggagaagcgagcgtgccttgacgagaatgaggccgttttttcaaggctccgtcttgtcgttagactaaatccttgatgcagggccgcccatttttcagagatgtggaggtcgagaggagtctgcagacttgcgtcatgacacacacaaatgtttatagttcttattgactgtttgcctgcatccgagcatatctagaaaatcatacagttgctcgaatcgctgtttgcatgtctatctttgcgtgcatgtgaaatactgcgcgagagctgaacttctgcacatgagtgaaacaccaaaagatcgacgaacatcgcttgcagaagtttatgcatgttttgcgtcgacttcaatgtctaattttcgatagatttattttcacttttgaatatcactgacttgtcaatctgtgctgtgctgcctctgtggggtgttctgggccgcgggtgatttgtgcatgcgcgtttcttttttcagagactcgaggccagaagagacatgcaaacttgtcgcaaaagaaccttctctcccatcgactttcgacttgatcttttctcagcgtaaccaaccggaagaaaagaaggagagcgctcgagttttgcaactcagaggccaatgcgcgagtctgttgttttcgaggagactgacggcctcggctctcgttttctaagggaaagaggaactcgtcctgtctctcttttcttccgtgctgcctttctctcaggaaccagcgcggtcgtcggtttctgctctcctttagagaaaaacaggttctttgtcttttcgtagagtctccgctgtcgctgcccagcacccgtgtctcgcgtttcacagttccttcccaaagacgaacctaagtttccttcttcagtctcgctgcatgcgtcttcggagtgctcaacttctcttcgatgcttccaaacagggcaggtttttttcgcttccttacacgcaggtcgtccccgcccgcaaggccgaccttgttggctagtggggagcctgaatcttcagatgttgcaaaaaatggaagaactccctcttacgtctggtagcgaaattggattgccgttttttttcggaaagcatgaacgaggctgaagcacgggcgacgtttcttctgctttttggggtgcttttttacgcggactagactcgcccctttccaggcttttaacagcggtcaccgctggaaagggagacacttggttttctgtcgcaaagaattctttttctcgctcactcgaacggcatctcactctttctcactcttcgcttcgcctgaagactgccggcctttctctttcttcttcctcttcttccccccttccgtttttctcccttctcctcgcttctgttgcctctcctttgcaa

SEQ ID NO: 2556 - DNA, 1861 bp, Toxoplasma gondii
tgtctgggcagtgaagaggcggttgcgagagcagagttctttcggcctctctgtcgcggcgacggcggtcgcggcttgcttccctcatcccggagagcagagacggaagagacaggcgagagcgatgagggcgaacggcgatttgcggggagagaggaagcttctttgctttcggccttcgctcgtcgctgtgtctctcggccgccagaagagccagaggcagatccttgtgggggcgctgccagtgcggcagaagcaaaggagacagaggcagagggaggagagcggagagacgaagtccgaacagaaagagaagggcatgaaggagaagaagaccgaggatacgcggaggaagaagcaaaggacgaaggagacggagaataagacgtacaagcagcagaagaagacggagaagcagcaggagggtaaaagcaaggagagagagaggaagagtacgcgctcggcgcgcaaggcggataagaagcagacgaataaagagaagaggaagaaggattcgagaagatagggtggggaggaacagtgtttggctgcattgcggaggaaagaagaagtgaatataaaggacgtggagaggagaagagtggagactttcgccgaagacgcgatgtgaggcgagagagaaagaaacacaaaagttctgaaagcgagaacggacgacggtattaggcggagaccacaggcgaagatcgaccggaattcaagaggacggaaagaaacagacgacatacaaggagacagagagaagagtgaaggcgagaggaagtgtaagagagatggagaggctagagagaagaacaaattagatgagtaggctggtaaggaggcagaggatcacatctaaagaaaagagaaaggagacgaacatgaaggcgacggatgaaaaagcgtcctgcctgtcgcctctcgcctgtcgcctcttgctttctttctgcatgttctcgattcgcttgagggagtgtcaagacagtgccagtttcccggaaaaaaaagaaaacgaaacgtttttccacttgcgccaagattcagctggccggcggcgcatgcgcgagaagggaaaaggcggcccccagcttgctctggcagtgtctcgacaagggaacctgtcaccgtcggcgaagcagcaacgaccgaggaggatgtgtagaatttcctttttctttcttgaaacaagacaagccgcgctgcgtctgtctctcgcggagaaggcgtcctctcgctgagactcgcggcgagtttcaggcaggaagtcgacatacatgtctcagcagaccttgaggagcattctcgtgagtattatatacacgcgttaaattcagcttgctcggattttcaagagctgcaagccaacgcatgcaaattcttttttcttccagcagtgtgctgttgattcttgtcagtccacgtcggctgcactctgggcagaaactgtgaagggcgaagaccggaaacgcaggacagctccccttcttgtcgcagctctcggtcacctgggcgaacgcgcagaatgtcctccccagaaaacggaggttaggaaagcctctgaagaaactgctttgcttcctttccaagggacgtccttaacggtttcttcccttcgcagagtctgtgcaggacgaggccttttctctctgtttgtgagttccgtcttggtctcagctccgcagctcctttgtcttggaggcgctctctctcgtttcgtctctctcgcgtcttcactctaaaactttgtctttacgtaagattttaaaacgactttctttcgtaatacttaatagtgaaaagacttctattacagatgctaaagtcttagtcgtttgctctcttctttggcgaaagaaaa

SEQ ID NO: 2557 - DNA, 2065 bp, Toxoplasma gondii
gagcagacagatgtggacatacaggtccggacaaagagtcgcagacaggcaacgccacctgaaaacacacagtgaagactgaaaacacgtgttggtttgggtggggaactcggaagccgctggacagagtccctgtcgtcggacattcaccaagaagtatcacaggcgagaggggggcctcgcgggggacggggagtccatcaggcgaagcccagcagatgggagagaggcgcgtgggtagatatccctgccgtacgaaccgtctgatgagcacagaaaaagtgaggcaacacctgtacagccttttgcgcgggatagtttccagcgggaaaacgtactctcttagggagaagctgatcgtggtcgaccatcaagcgatctcgaacagcggcgatgacatagtctgaaacagaaggatggaggttgagcgacgcctcgacgccgagaaaagaaaagggccaggacagggcagaccgtgcggtcggggaactcgcagaaattttggggtcgcgagaaacataaacaatggacaacgaaggcgtagagaataccgaggcgcaaagaggggaccgaaaagcaacatagagtgaagacagagattggaaaaggagcgcgagggcagtcaagccggaaagcagactgcggcgtcgcggccgccgcatgcagacggtggtggcaggcggaggaaccccttccggggaagaaccacatggaaaactccccatggttccggaaatctcttgaaaaagacgcgacagacggacaggcaaacacacgaacagacttaacggaccccgcctccgtttcgtccgtcctttctgcctgccatgcagctgcttgggctgcgcgtacccgggagcgcttccgtgttttctcccgaattctgcgagacagactgggaaaaaagttccgggaggtggcaacagtggaaaagaatcaatcgaaagagagaaaaacgacagaaagttcggcgccgctgccacagtgtggtgaccacgtcacagacccgcacagcgagccggcaaccagaatctgaaacagctacgtatcccaattgcctaccccgataacttcaaggtataaaagtgagaaaatcaccgattcatgtggatctcgcattttaggatgcttcagagttctccaccatcgggaaaaccaacaggaggatgctcacggaacctgtcttttgacggcgggctccgcgcggcttcaagggagacttgtcaactggaagcagatgcatatctcgaccttttttttaaacgctccgagtctcgaagaagggtgcagagaaacaggtgaccgatgtcgtatctttctcatctgcgaccacgctgggtgcccaagcgcatgcgccgacggcacggcaaacgaaacggtgaaaacccacccgtgcttcagctgcttttgctcacaactttgcctgagaaggtgaagcaaaaatggaaggcaagacagtgacaggcgaaagtctccacagagcgtcgctatcggcggtaatgttcaactccgagactgatacggagctgcctgtcagagggctgcatgcacacggaaggatgaggtcatgtcaagcacaactgcaacgtggatttctcggatgcagccgaaacgctaacttctttcgataaacactgtctcgctgaaggttactctttgccgttttaagaaacaggagttcctattcgagcaggagcgtctctccagcactgtcgtcttctatatgatcagttcgggagtcttagtccacttcatacaggaggaaaacatctccgcgccgatacttttcacttccatgatgcagggaagattaaacagacagacgccgctttctctttctgcgaacaggattccggtgttcttgcgacatagtccaccggcgaataggcggagaactgagggtctaatcgaacagagtttagcagcagagctgtaaaagcggctgaggtacactatcgacttgccgcattcttggacgaaaacacatcgaccttaggaggtacagggaagcactgtccgcagggtcaaaatatagctcggcagggcaatgcctgagagtcgatat

SEQ ID NO: 2558 - DNA, 1890 bp, Toxoplasma gondii
acgaagaacgcgaggcaattgtacagaaaaacgaaggaggcgaagaacgaggggaaatgagtgaaagcagagaagggagacccgcgtcaagaaagacaagatgcgattggcacaagcgaggggacaggaactcgcaacgcaagagagaagagcgacgaacgttaggaagcattcacaagaaagatataacggagagagacatgactaaagagacgagagaagagacaggcacccccagagaaaaggggagcaatcggagagtgtatgttttctttctcttccccttgcctttcaaccagtgcctttcgagacacccttcccccgctgtcattccagcaggtagcgcctgctttctctcttttctcttttgtctctttctctcttttctctcgccgcgtcaaggctactcgacatccggggcgtccaacatccattcgcactctgctggagcagcagacctgcgacgattctttgaagacgaggcctccgaattcgagtggagcgcggctctgcaccagacaagacgagcgcgtagtctgtgcggtaaggagacagcgagccagagaaaagaaagagagcagagagaggcacagagagaggcagaggaagaatcacgagaggctgggagagggagaacagtcgaaatgagagatgaagaggaagagaagaacgcggtcacgaaaaagagaacaataaaaatacaaacgcgaaagagaaacgatatacacacgagaggcgaacgaaaaaaaacgaattgtgagcacctaagggaggaaccgtggggtgcgtcgtctctcctgtgttggcagaaaacgaggtttattccgaggagagagagagaggcaagaagaggcttaaagcgcgtaaattagaagaaaccttggcgcaaaggctggcaaagggcaagtctcgtcgctagttaagcgccgccaagccgagattgcatgcccaggacaggagcgtcagctcgtcgtgagaagatttttccagaggagataaaacagaagaaccctcgaaaaacgcaggtgaagcgaatttggaaaagacagggaaagatccactaacctatgaaaaactccgacgcgacagcgagtctttctttgcatgcgctctttttgctggaggagaacgacgccggacgcatgcacggggctttcacagcgaaggaaaaggaagaaacttcggcgccgtgttttcacttcctttctcttcttctgtaaaacttttccggtccttcttcttgtcctttttcttcctcaagctgtgaagaaggtggcggccttgaaagcccccccctcgtttcgtcgctgctagggaggaagcattccgacgagattcctttgtattcgctggttctctctgtccatcgttttttttcggtttgtgtttcctctgttctctttttctctcttttctttttcctttctccctcgcgaaggttgcgcgttcagtgtccgtctccgcggccattcgttgtctctctcgccggatcgacactcgcacgcggggcctgtctctcggggctggggacctgcccgtcagctttctcccccttcgtcgcgtcgcttcttcttttcttttttctcgatcggtccatctcttttcgactgctcagtccgcgcgtcaggaaaattcgtcgctcgcccgcttcttccaccccagcagctctcaggcacacaacttcgcagagccttcctcgtcgcctcgggcctctccagcttctccggggacgcgaagcgaacctcctcgtagaggaagcgaagagggcaagcagcactgagagagggcaaagggaacgaggaggaagagcaaggacagcgaagacgaaaagaagagcgcgagtgggctccggccgttaaaaaaaagtcttctctctgtatctgtgcacca

SEQ ID NO: 2559 - DNA, 2252 bp, Toxoplasma gondii
tctttctcctcgctcgaggtaggcgcagatgtgcttgtcgaagaggaaggggcagtttgcggccgttcggtcaccacgtacacctcttcgccgcccttctctcgacggctcgggttcgcatgttcgactctgcgggtatccaccctctctgacccccacggcagaagcacatcagcagcctccagtggagcttttccggagacagcggccgcctgccagtacggagaatgaaacagtgggttgtctgcgtctccctctccatcgtctgagcgggaatcgaccgccctttccccgcttcctcccttcgcagaaccgcggaaaggattggcctgcgccacagatacctgcgctcctcttgcatgtcctggtccggcgtcgcctgcatgtttgcgtctgtgctctcgctccgtcccttcgtttcgtgtctctgtcaataaagcgcctgtctccaggccgtggccaaacaggctgtttgtagcgggtgttgcagtggcggcgagtgcatgaggctccggagaggggcgccccgaagagccccctgtgagggtcactcgctcgttacctaagaacgagggcaagaccccgagacggaagaaaggggaagaaagagagacaacgaaaaacagagtgaacaaaacagacggcgcagaacgcagaggactgcgcaagtaacgcgctgccctacgcagagccccacaagagagctgcggcgccttacgggaaagcggttcgctttcgatgccgcagggaggagcggaaagaaagcacgagaaagcaaaagacggagaaggtaaagaagctgtactggaaagggcaacaccagccgagttcctagcatatggacggacaggggaatctactttccctagaaaggattgtcctgtgcaggacctatgaaatttcgcggatgggaaactgctgagacaaagacacttcctgggtctttgcctctgacgtcggcccctcatcacgctcaacttatgacgctactttgcgagaaatgcaacgcgagaaactggtgaggttgccagaaagtgtgtttgtatcgtgggtgatcaggaaaaccgtggggataccggccccttaactgtgcaaaggtgtcattcacaagaaccttgtaacaatcttgtaaaaaagggaaaccgttgagtttctcaagaggaaaaaacgctgcgtttcgtccgcgcgcgaacgatatgccctgaactgcgttgcattggggaacggggcccgacagacggcgcgaaatactttcggctccgagtctcaaaccatattgtagggaccaccaggaaaatgtcaagcaggggccaacattgccactacctagcgacgaacacacgatagcggagagtcacgctcaacggaggcagatttactgcgatgtccccctcgctcttgctgaatgaactgttgctcggtccacaagaaaattggcagctttacaaaatcgtcttaagcacacatgagaacaatcaatcgaatataagaataatctgccctcgggccttgtaccagcagtgcgtaaaatacagctgttccgtgtcgagtcatgcgacgttgcgctgtgaacccccttccccctccccccccctgagtttccctcgcgcaccgtttcccgaaagagagactgtcgaaccctcatctgctcatgctcaccttctaatctccatgttacttggcggctagtctatccttcatctcctccaatatctgcctcctcgttcgaggcgctctcaaggatagtagtcagtggaacgagctcaagtgaaattgcagcattgaaatgtgaatgcagcaaccagcgagagtagacactggatttgacgaatggaaacctgaggaacagccgagcgcagctgttgggcagagaggaattctggagacatcaggagcgtttctgtgttcctgagtctttatgacggatttagttgttttgcttcgctcccctgtccagcgcacggacttacctggtacctggagtgtacgcagacaaactaatgctttgctaacatgtggtacgtaagctgcgctaactcgcgtcagccgcgaggccacatagtgcagtctaccgtggcgggcttttgttttgggtctccggaagaacctaagggatttcctcatttttgatccacatggtaaagagttcagcagagcaacgctaggtaggaccgggaaggaaaacatcgactgaaataccagttacatcaaggattcttcgtacgttttgtgcctctgagcatcacagatta

SEQ ID NO: 2560 - DNA, 1944 bp, Toxoplasma gondii
ttctcacaaacgataccggccttgtttgtctcgccgttcgagatggtcaaagcatcggatcgtcacgaggtcgagagaagcgatatcaactacgtggacccattcacagtgtgtctactggcggggaacaacatcagctcgcataaagggtcaacgagagctctcgccggtgtccattccagatattggccaattgaagcttgcccgtgacgtgataccgtgacatgcaaggaccgctatcatattgttgtcgagatgtttgtgtgcctcgtttcaatctgtggacaggaatcaggtatcttgtgctccttgagctgctattccagtgtgagacgtgtcaaactgccgtttcagtcgcacagcaaaagggaaccagtcgtcaggcatgacagattaaccccagcgctcgtgtatatttggctggcgtccgttcggtgttagcattatcctgtcccagagattcgctgaacggctcccgtgcgtgccgaatgtcccaaaggcttcatcgagtggcgttcacaacagtcgtttccaaacggcggctagaatggaaactcgaaccgtttcatattggacttaatcgtttattgagagactgccagttgtacgtgttctttgcgcaggcatttgcctctactgccgctccattcactgtccataaacgaaaacgctagacatacctgcacgaaaaccaagctacttgcggagaaccggcagtggtgatctcgcttaaagaggagcattcctgtacgcagactctgcagtatggttagtctaggcaggtaacggtttttacaggccaagtatggtcatgggcacctgttaattacgatcgcccctgccagtgtacagccacggaagactaatttcgagtagatgctactgcacatcgcatcactgatcagaaagcatcagcaatttgctttcgataccagactacctggtaccagtatgctctgtgcaattcgcgatccagtaatgtatgactcaaatacaacagaaagatactataggtatctaatatgactcgaagtatgttatagtctttttggtgataacacagttccttgggtattcagtctagtactctgcctttggtcattaaaaccaaccaggaggtcttcgccccaaaacacgagagtgtagtgcagaatgtttaaagtcgcttagcgacagcgtcaggattgaaacagtaagctcatcagatagaggtctgccaccgaacattatatcattcaggagagacatcctcttgtcgcgtttgagttcctctgaatagtaatcaacagtggcaagccgttcaatgtgagcttgtagaattcacctgcaacctacagggggcgacgaactcattcgcctcatgcgcatctccaccgcgctctgttgtagccaattcccgtaaggcatcttgaccaagagtctgtccgtgaatgggtggcgtacgagcggaagtctccacgtgccggtttctctataccactgcctacatcgaaccatcatcgagcgttgtctattcagaagcattagtgtgttttcgcgtgaagatgcagtttcattctgtacatgggagtgtggctcctgtctacagggaggtacggatctcgtgtgcctctacgaggtcatctacccttggttatctttctcatccgcaaaagaatgcctcgtttttctgtcccgaaagacagaacctgtcacatatgccctggagacgcagatttctctctgtgtgctactccaactggaaatagtatcgcggacgcgcattgaaccccttacgaattctcgtccgccgaagcccagcgttttggtatcgtgcttcttcatcaaaatcgaagtcctcccttcattgcaacgaagatgtctgtatggcatcatgttaaaactctgacggacagtcctttcctccagtgagaccctcaggcatccttcttcctacgaggaaaa

SEQ ID NO: 2561 - DNA, 1468 bp, Toxoplasma gondii
gaaacgccacacggcaccttcctcagtcttctgaaagcttcccaaaggcctgttgcgttatcagcgtttttcaagcctacctgtcgttcacgatgaatattgctatagctaactgaaacagcctcagacgcgtcgtggaaactgctcgcaaagtgggtcatctttcacactcctccgtaaatttatatatacagttatatatatgtatatatatacatgtatatgtacatagcaagcatgcacacattttagttttcagtaagtttgccgttcacatctttttcttcgaacgccagcggaaactgcttggggatccttgcgtagttcgctgcgggaagatttggggttggctgtgggtctgcacttggcgggttctgcggcagttgcggtcacttttttgtcttcgtgaacgagtatgtgagatggctctgtaaactcgactttttccatgggtttccgtggaagtgatgtgaggcaaactttggcgcttaaaatgcatggccgtgtaaaattgctcgagtatggatgacgggctcatgttgtttgtgcagcggccgtctaaactgtctttacattggtaaaagaaaggatccataaagatcaagaggggaacgtgaatagatcaaagagacagatagaaaaaagccgtaggcgttagcgattgcattcatgggtgaaaataactcggtgtagacatacgagactgtggaattgtagaccagcggatattcagccacacagtgacaaatagattactacatatggccgtacaccggcatactcacagacaactgagattatctggaagagagatcgtaaatggtttacgaagttgggtgcagcaacaagcacagataatgcacgcaccctgcctgtaaaatctcgtgacactacgcggcctcatgtatcgccactggtttctaccgtaaacccacaggtttgtctgaaaagatgaacgggtaaagcacctggaagcttctcggctccctggacgttcatggtttgtgtggagtttggaatgacaaactgtaaccgttttggcggcttcattgtgcggacactgagtacggacacagatgcaatctgccggtcgcactgtgaagggaccacggaacgaaagagaaagttctccatgaactctgattccatagttctggcaaggaccatctctgaatgtatcttggcaacctcaagaaagcggatgccgcccatattcatacaatttggaactacgtggagctaagtctgtgaccatactgtgttttcgatagacgcgacgccccatacacacaatttcccccctgtaatgtcgtagcgcttgcagttgaatcgttcatgaaagcctggatctccgcctttccgtaaatttgttcctcatctggaagaaattcgagatgaagtcaacaaagcatcgacaggatctcagcgcggccgcctggtctgcacatcttcccatagcgctcttgca

SEQ ID NO: 2562 - DNA, 2211 bp, Toxoplasma gondii
ctttgcagctcctccgaagcggctcgaccagatactcagtgatttcctccaggcgaatgcagcccattgtcctcacagccagtgctctgcattccacgcacagagtcaaagggaagcggacgtatcgagcgagatgcaagcatccgatttggtgggtgacagaggcgacatacacgcacgcacgcacacagccagcaaaggacgaaaggcttggcagcgaaaaagacaaaaaacaagaacgcttcacgggcaagtgcagttggagtgacggagccactcagaccaaaaattcagcgtccaacggtcctgtccctgtctgtctgtgtgctcacagtgccatgcgtttcgacccaattcaaaaagcagcgcctgcaaagtagtgtactctgaacgctgcgatggaggaacaggatagcgttttagcgttccgtcgagaactcgcactccaagagtagaaagaaggccgtacctgatgagtggattggggtccagggagtctttgcgaaaggtattgatggcaagaatggcgagctccggctgtgccttcgcgtagttgatcacgtacagatacacgagcttcttcagctccatgttggtggtttgcatgcagttgacaacgtctggaaaaagcgaagagacatctttgccgacggtcatggcagcaatcaccttttttaccgcttccttcttcttttccttgttcgacgagtgcagctcctccttcaactcgtgcagttcgccgcgcttcgccggctgaaagtagttgccgtcggtcattctgccgggcgaggagggcaaggacggccgtgcgatggtttttcggcggagtctgccggggtccccaggttcgaggggcctgcgcagaaaacgcgacggaatggttcacacacacagcttccagctgcgaaagtcgcaagcgagtttccgacaaaaggtcgcgagtggggagtacaagcctcagacagacggaaaaacaaccgtttcgccactgtccccagacgtggatcgtgaaggttttgccgacaagcgcagaccgcgaaacgcccgacgtcgctccgtcacggagtcttgcggtgtgcagccagccgtccagaaaggtagatgggcgccgggacttgcgcggagtcttgcagagtccgcagtcgcttggctttttcaagaaaactcgccggcagaagcctccacaagaagagaccgcggcgggtgagacaagcgaggacagtccgctgggccggcgagagttttgcgacctgagaccttgtgtacttcgaggcgtggagctgcgaaacgcagttctggtaagccacggtcctgggaaaaaccaaagtgaagacagcgccgatcttggaatgtttccaagaccgctgcatgcactcaggacgaagcagctgcgccagcgagaggaaacatgtccgagcaagctctgaaactgcgctgcgccgctcgcgcgcaggttgcaccggcaaagccgacgatgccaagcgattgtatccggcgcctcgaatggaaaattctccccttttgcggtaaaaccgtgacacacacctgcctttttcctcaagtacacatacgcgccccttcgcaaagtcctctagctgttctgcagacctctcaaatctcctctggcagcgacggcgttcggataaaccgcctattatatccatcgcaggcagcggatcggtttttgccggcgagtttttttaggtttttaagtcgcttccccccgtctgtccagttgcctcttggaaatctttttcgcctttgagtcgtttgtctggaagcggtcttcttacactccgtcctcaccactatcggtttcgcgttttctgaggcggaatcgacgaggtcacccgtcgtctcgcagaggttcttcccgtctcgccagtttgagggttggcaattcctgccagctcgtgacgcagagtttggcaagaaaaccttccgcaccgttcgtcctttgctgcttcgacgctccgtctggtttagtcaccgctccctttgacggtcgctgcgccaccactcgcttcgcgggtctcttggttttttccgtcggattttgccgcccctgacgcaaattcctgcattcttggacagactgtcctctcgcctcagttcaccgagagctgccggttctctgggaagccgaaaagaggcttctgacaagtttgactagcctccgctttgccccggtgtcctctcacggtggcaaga

SEQ ID NO: 2563 - DNA, 1695 bp, Toxoplasma gondii
ctcgagtctttgttgactctcgggaaaatgcattttgtcggcttaagaaccacggggactttgccccatatcgcgtgtgtagtttcgtccatgttggttgtttttcggtgctggacaaaagaaagaggcccttgtctattctatgctgttcactcgcccttcacctcgcatttcgcctggagaatcaccgttcactttctcaccaaatgcaggatgctcgcagcaaatcagcgtgtccaaacggcagcgacgcggtagcatacgtagacactcatcgtgtctgcaagagatcagtgatttacggattgcttctctaggaatgcaccgctcttgcggtggggcacccggccttgaaaccacagaagttgaaatgtgcatgcagaaagaatgaaggaaatgtattcgcatatacgtatatgcgcgtacttccattcggctatatgtcagcgtatacacagtttcgtgcagacgaatcacagaacgatttggaaaacaaaagcattccttgggtttgcgttgtcaaatgaggagagtgtgccgattgtcgcttcgcaatgtactcgccgatgccgtctcgtatctgactgtgttgcgggaccgctgccgcagatcctctcgtcacgctgcctactttacacagttaaggcaaaactgcaaaaactgatagttcatctggaacaaacaatcaggagaattcgtatagaggcacaggaaagaatgtacaagtatatgtgtgatgtgcaacgcctttggccgcagccgctgatgtgcgtatgttacgactagataagttcatggacatcggaacagacacatttgcatgtgtacaccttaacgcagatggcaacacatcaactgaaggattcgttgtgcgaaaccataacggtataatatacatgtgcaggtgaagagaaaggtattcagtggtgtgcgctgctctgggatgctgcggaagatgcaaattaccgatggtcccactcattggcttttccctcttcttgttctttcttctactgtcttttgtgcggccgagtaaactgttgctgcctcaggaggaactgggaaaatacgcctcttacggtgttgcgtttgctgctacgtacagtgcattcagtaaataaaatatgggcttcaaccagagaggttttgcgtgacttccgaagctacaaaaagccgatgaaattcgatcctccagatccttgtttctgagtctcatatgaggtcgcggttcgttttggattcggagcaacgcgcgcgaagacagatttgtcccttagtcgaattctgatgtttcccattcgcccccagaaaggagagaacggagaggcggcagccaattgtttagtcgccattgttttgattttttcgtttagaaacggctcttttttgactcacagggaacagtaccctgtgttgttaatcctctaggggagaagtttacttcagtcgcacaaatcacatcgtctgttacatcataccgggcagcaacttgaacagttctgtgactgttcaacacagattcgctttttttgacccttggttgactcatgttcttcgataaaatgaaactcttgcgttgaaacgctagtgtattctccgggggagtgcccaattataactcctttgtttttgctgcaatcagaacgtgtgtgtttctgacctttgttctctgtccttactgtagagtggagaaaa

SEQ ID NO: 2564 - DNA, 4389 bp, Toxoplasma gondii
tggaaataaacttgcgcgccttgcagcacttcttcagacgcttgtggccgcgaacaaagctcaccgagccggtgtgggcgtctcgatttcgtcgctgtatttccaaaatatcaccgctgattctcctgagaagactgccattgaaggccacctacagataccggaatgacacataacacccgaaaaaggggctcctttcagacaggtaagtctcatgtttctcatatttggttctgtccgcacttcagcgtctgctgcctgaccactttagaattcatctcgtgggagaatgtcgttcttgttcatttaactgaacgtcccttaccgttagtgagacgccaagtggatagcccaaggtgagcccaagcagcaccgcccccactgcaggcattgctgtgcctgagacacgcaaatacacatggtgtcaaggaaaagcgtacgccaaaggaacaccaccgagatgggataatgctaccggagctgtaagcggcctgtttgcaaactgaggctacaccaaaacaagtgtcaatcttcgttccacgtgttcaagacaatgtgttccacttcgtaccccggcgtttcagcgctctatacacgcccgcgcccgtcgccgccgcagtgaagaggccagtccatctgccttgcgctgcaacgcgagagatagcatggcgatcctctggggggagcatttgaataatttcctgcggcgacatatcctccattctcctgggtggccgcagtgcaacccctggatccacggttgcagtgccaaaggaacctgcgacgcctgctgttgcgctgttgtcggaacttggcagagaccggttcgcggccgaatgatcagtcgcgccgcttcccatgtcaatgttttccctcccgaccgatgccatcacgccgaaaagaaggcagaagagcagctgctcgagttccgaaaacaatcagtgcccgggatgtgtttggagacgaattcgtcgaagcaggcagcgcatgaggctctgaatttccccgttgaagagttgcaaagcttcgtcctcgaatgccgacaaaaaactcagcttcaaagacggaccaagtgctttaccctcggcacagcggaccaaaaagtgaggaaaataatccgtcggtgtccagggacacgaatcaacacacgttgcggcatgccaaaagaactaaactgaggagtcgataggggttaccctgtgcagtcggtaggttgcaaatgtgaaggagaattccctccgtctcagagatggtggaggctgcttccctctggaagatcttcacatcaatgtgaggtaccgacccccgtgtgctccaacaaacgagctggctgcaagaacgacctgactgcccaaacagacggtgacatacgatctgggaacataagtaatagaaacgtttgagaagatgcagacggctggtatgcaacacctttattgccggccttcattcaatttacaaaattcacaattcgtagttggttggatttcgtttcagcgtatctctgtcgtgacccgccgcgaagaaaaggcagctttgcatgcgttgcagcagctagactcgagtagccacgaaggcatcccaaaagttaacgaatcagctagagaaagggctgaggcaaacctgagcgtgccgtagcgaaatgcagtgaaaacgggggcaggaagacaagcatattggagtgtttttgtgtgtttggggattcttcgagcatgttttcgtgcatgcgttctcccgcctcgcgatcactgttcatacgcgggtgcttttaatacctagttccacacggacagttcgtatcggaaagtgtgcagatgtggtgatagtgatgagcctgtcttgtttttgttttcgctgctttcagacaattctaaagcgtgctacaactgcctgcgtccctcccctcattatgttaacaggccgctgacgaggcacatcacgttcggctctaaacccgtcgtactgatcaaaccatgttgggcaactgaatggtttcctaacgtattgacgatgtagatccgttccgagaaaagcagtttcagtcacgtatagttgaggtcagggcaaacacactgtatgggcaagccgacatgcgttctatagagggtaagatctgaagataaggatcgagatggaccgaaagttccgatcacatatgttcacttaagtcggggcatgatacttaaagatgagtcccacagctgacagcaccggcagagagaagaagagcaaagcttgatggccggtgtccttgtagtttgacattgaaaggaggatcactgggagctcaaaggcgcgtggtttgcatactgcctttgcacgaaggttctgattgcgaaacaagaactcggagttctatctttgacactctcctgacaagcaaatcaaaggaacgccgtttcctgatgtagaagcagtgtggctgacataccatcgctatgtacgccgctcaagcctggttctgtgtagcagcgtaagccttttgaaaaggctgacacgacatgtggggaacgtgcagaatggggtgggggtcgtcggagagctacgtaagacagcaagcgcaacaaataggtttttcctgttatctatcacaaatttatcccaaagcaccgcggcctctcctcttcgtttactcatttgcgtttaccagtgtgtgacttcggaccgtaatcagaggaaggcttctacgtagttatgcgcaccctttttgcacgtacgcgagagacttgtcttcgaaatcaacttttcttcttccttaaattcgatcgtatgttacactttgtacgcttgaatctcttcttgagcgcacctggagcgaccaaaagacgctggcacttgcttcactacgaccgtctgcgtcaaccactaggagggacgcctggcatttcgtggatccggacagcgtcatgctaacgagtggcgcctcagaatgctggcacaaatagaaggaaattcgagaaatgaatacgtttaccttttctgtggcgtcttttgtttcagcattttgaagggttgctcgcgattgaagatggcactactattcgcccaccttatcacggaagaatatttcactgtgctttatctttgagtccagtggatctcgaaaaaggaagcacaaaaagtattattagaaatgcaattacggtcctgttcccgtccactgcattgttattctgtcgttcgcatcgttgtccacgttgccttagcctctagcaactcatttactgctggcgaggacacagtcggtgttgtatcacgctctgtcgactgtcgaatacgtccaacatactgaatcttttactaatagcagaggcgaaaggactgtgtagtgactcttatgagcttcccgtaattcggtagcgccttacgttccgcgtttaatgccagaacccttcagctgagaaacaacactagggagagaggctcgaagctctcctcgaagatgtgacgttggagcgctgtccggctcacgtattcgacgcttttgcgacacatttaagaccccggagtggctacgtgctcttgtcctttcttgctcgtcttcttcacacaccggtgtcagctccatcccaagctgtgcagcctgcaggtggagaggagatgccatgtatcggttacaggtgtcaggattcaaatagttgaggggattccttctccactcctgtggcagtgagctttcgtcttcttaatttccggtagcggttcgtgtagaagttaaaccgccgccgaggatgacagttcctggggtcttctcgcgcatgcacgcgtcgctcgatgcacagacactcaatcgattttgtttggttcttgtcctagatcgcgtgaacccgtggataaccacaagaacggcaaatttgtgtttcccgttctcgaaaacccatacacaacgaaatgcatgccggagacagctaggcaacaaaactgacttggaaaacctgtgctgggaagctgtcttctttctttcccctgcgcatccatgaccgactagcacttggcgctgccaagcgcgacatttccaggcaagaaagcaggtccatcgttagaagctggttcaagaaaaaagaatcggacatagttttcgcatgtatcgatctggttttcaacggctttcgcaaaacgcctgttgtacccgctctgccacccgtgtgtctttcaacctgggaccgcctagtcgccgtttcccgttttgtttgattcagcagtgccattccctgcctttcgcatgggatatcgcaagctgtccatcctgggctgttgcgttttcccatggaacgaaccagaaacgcacttccctttcccttcttctttgtcggaaggaacgatttttgtcttctttctagcggttcaaaggccgacgctgctgctacgcgctgcacagcgggaacacga

SEQ ID NO: 2565 - DNA, 1931 bp, Toxoplasma gondii
tgtatcggtcactgtccttggttcttctgctgtggcatgagcatcctcgccggcataacccaatttatccaccagatctgaatcctctgttcgaccgttcttcagcagcttaacgactgcgaaggcgagggggcagtctaggttctggagaggattgcaacgatgctttctgccgagacacaaaacaagctggcagcgtttcttgcatacgcatgtgtgcgaatcctgaggcgtgattccagttgcctcctccggaacgttagtttgattggagaagaacgaaagaggtgagggagcctccattcttggttcagaaaaaagcgggaaaagcggagacggaaatgtcgcgccgcgcacgtctagccatggcgccataccttcccgatggccttcaattcctccgcaaggcggggaattctggcacccgaccgccgccactgcagacacactggtcttggagaggtttatggaagcacggcttccgtctgtcatacgattcgcttgctgaagatggtgctacagcctgccgcttccttgtccggttctgtgcagggtttgtgttcacttatactcgcaagcgcttctctgttcttctgtgagttctcggcagagtgcacagacccaaggaactagcactggtattaccggcagcggagcaaacctattggggttcctcatccggcgttttcatttgtgttgccacatgcgctgcccgattcgctggtcgtcctcttggggtctccgggcttctcgctagcttcccattgtcgacgctggcgtatgctttccccagtaaaaagaatttcgaagttctggtcgaaccaggttgacgattcttcgagtatttctggtttctcttttggggtgtgaaggcacggcgaaggggtctgctctctgaaagcatgtcgtcaggagagaaccacaagaaaagtgtgacggacgttgatcaagaactgcttcgctcccaatagtcgagtaggtatgtttgaagggaaaaatcactgcggacggccggttcctgatgctcactttatttttcgcaggtccgcttgctacacgcgagatgtgcaaccctaggcaaagaaagcaggttttgtctcacgggtcacctccatgaagaagcggaactttgaaagcacacagagaaatcagaaaacaccttacgatctcttaagcaagacaccacaagacaagctgagaacgatgtcccggcttccttgttaagactgaaattcacaccaaaaatttggaaaccagtacaacttttcgacgtcggccctccagtacactttgctagcttgcagtttcacgggctctgtaacatatcctgaatatattcgcaacgacgcggattcctattagtccgccaaaatacgtggcgaggccctacaatgaacagagacaaaatggtcatgattttcgtggtcaccagatgagcggcacacgttttccaaatggggctcgtggcacagccatgattcaggaaggaagtccatgctcgggatgagttagggttcgttctctctgcctttgcaacttccaagatcgcgtgatagtttgataatgagggagcaactagaaaacattttcgaagttagtagcccttgagactcgtgtctgtcaacatttcccagacacctgcctcggactacaagtgaagagcgcagtcgcacagcggtgtagcctgcggtgacgtggacgagttcgcttgtcaaaagataagcagcccctgaaaaagtcagctcagcttcttctgaagcgtcgtggcagtgccttacacgaggaatgtttgagagcccagcatagggatgtacgtacaccacacagtaggcaccttcgaactggaaacccagcccggctgaggtagcttttgtatatttggctcgcccgcagggcctacgtttctgtggagccgccccgtgacgcaacca

SEQ ID NO: 2566 - DNA, 4422 bp, Toxoplasma gondii
ggctctcgctcgtcggtcttctattgcgggaggtggcactagcacacactgtgcgcccttcttcgatgtagagatgacgcatgaattcccctgatgtgtccacagccatgaattcattcatccgctgatcgccagacggtggagtgaatcctgggaccgtcgctgtgtatttcggctttttggcaactgaaggaccctgaaagcaacatgtggtagtcgtagaccaacatagagatgatcgtttttactcgctgactgtatgcttgctacacgaacaatttcctcatggattaccgcccggtaggtgaacaagtatttaaaatgcgaaaggaagctaatgttgtacgcatagagtgtcgcacactgtcattcactgccgatgtagtttgtatcttctggtgcttacttctcccactccctatagcccagggtaaacacaaatgaagtttgagttgcacataagcgcagtgaagcaaagctcgagcgagtacacaagaaaaacatgttctgcctcgcttgagttttctgcgatacgtggcacggtcaatatcagttcagactgtaatttggagacgcggatgttacgcgtaacagcaaatgtgagcgaacacggcagcctgagaaacctgagcgcgtcgaagagctacaatccgcgttttactcaccatccctgttgcctttgaagacacaacagacagacaaaagaagcacagcagcgtttcacccgagaatcaaaactctagaaaaccttgatacaccgggctatttcaggatctgcagatgctgcgcttcagcatctgtctagttgtacgcgagtctaacaatgcggaatccatcagagcctcagagggttgcgcagacagcgtgacgcctagctacagcagcttcaaacgaaccaaggtacatgaccactatgtcgccggctcatacgccacttccccaccatccctaaaccttactctcttaaacaagagagagacaacgtgttggggcacattttttttatctctcataaaccataagtaggagggcttgacacgacgagatgactgtacgatgaacgaaaccgtggctttttcaaatgatcaaatacttatccgtaaccgtgaatcttactttgactttcccctgtaaagtaacaaaacgtaacacagacaaccaggcatatctgcccttgagacggaaaaaacgccttgcacgagcttgaaaacaggtaattccacccaatcttgctaacatggaaaaatgcaaccgatggttcgctttgactagaaccttaccagcaatgtcttggcgtccgcatggagcactgcgaagagcggaaggcatgccagcgccaacactcttaacgaagccatggctgcggtagctttggcacaagtgtatgcagttacttgttcaatgacaggcagagatttatttgggtttgcacaacaaaagtgacactcgcacgaaaacatgcaacaaatgcagcataataaaaaatgatctggtcctgtagattgcttccatacaggctcaatctctcacgcgatgtggctagctaaagcgtttcacacacagccaaccgggaacaactttatgtctccactgtgcgctggtgctgctgactggtctagagtgttgcaagtcgttcggaacccttttgtcattttcaatgacaagaaaaacacaaaagcacttccgcctagtcggccgcatactacaatctgctccgcttgccgtgatggtaaccacgaagtaacctgagcgggaggggacaccgagcgaaagcctattctagtcgtcacctataggcgatcgttaaagagacgcggacattgatgggcgcgtatgtttcaactgcagtctagagaaacagtgatcaaatcacgttgaaaaccaatatgggtgactcgttgggaaccaaagtggtatggccgcaaactgacaatatgcatgcagaagcgttctttcttgtcgtcatccatatctcgtcgcgacatgagcaagacaactggaagtctccagttctcatgaggcgaggcaccagtcaaccaatacaagctaataccgagcctagacactcctggtgctgttatcgttggaaatgcacttgtactttgaaatgtcacaacatcggtaactcaaatttcacaatcacacttttgtcgacgttcagaatgtcttgtgttgcaacactccattctcacttgggtctttttcgtgtgtcctgcgaaacgcctttgtaagctcgacagaggaatcaattccagtggtgaaactcatcttacacctcagttcgtcatctcagccctgcggtcagcctggcaagggaaactcgtaacaacttcgagatagatgcttcccccacatcggagacagcagtggcttcatccacatctcgatacctacggctcgatcaagtacccttttgaaggtctgggttaccgactgccgtcatccactgaaccacaagattaaaacgtggcattttttctagacgactaaataaggctacagcgacgttcgtgtggtagtgataaacgaatgagtgccttcgacgagggtgtgtgcttttatgaaggtacattcacgactcaaggtgtcccggttagtgtggcacattttgaaaactgcgcagtgtgaatgatcactcactattgagagcgatgaaccgttctgccgtgactgtaaagactgctgctgacattctggggcccgcattttgaagccataatgacaccatgaaagcaggactagcagtccagcagaactgcacgaggcaagtttgacaagtgtgcttggcgtttccgtgtgactgcttgggtgcatcccggaattccgggaaatgttgtgtggtactgccattcatcgttgacgtattgctacctgggacgccaagcgtgccatacctgcgcacacaccgacatccttggtgacaaaacgacacggcctttgcggagtctacttggcagtccagacggaacatacaggatgagaagctgacatgcagggagcaattgacagaaccgtgaactgagtgcttctggagtgttgccctgagggtgggcacacgagtcgcgaattctctcgaacgtctgtcagaaaagtgtgctctgttgaacagacgggcttccgcttgtttcgtctggtcgactttagagtcgcaagcagagtgccccgttgttgctctagcttttcgctcctcggcacctcgccgcgattcaaattgcaagtgtccctccgcatacacgcgcctgcataatcctcctcgtcttgcacagctactgtgaccatgactacccctgcaaagggaaggccttcccgacatcacgcgttggagcgactcaatataacgaagaaaactatgtggaggcggtgcgcacacttctgattgatttatcagtgtcttgcgatacatttctctgtgaagagactggtgtctttttgtcccatgccagggcacgccgaactcgcagcttgagacggacagtgaatacagcgcaaccaccagtaaccgtgcacggaagcgtacaggaataggcgacggcaaccgcgcgaaaagcatctgctcgctctggctggcaaactcccctgtgaaaagacaagcacagcgagatgttcgaagtaacttgcgggcctgcagcactttcggcagcgagcggtactcaacacgctctagctgtggcaaaaaaatgtggaattgcgttgagttgcaaaggcgtccaatgcagaatgtgatgctcacgaaatgtcgttacttgcgttttttgtttctgtaacttcttccaaagaagcacagagcgtaaaaaatcaaccctgtcttggaaccccacttgccgcgacaacgtggtgatgggcgttcatgactctcaccgcgcaagccatgccgctcgctggccgctcgctggccgcgcgcgtgtcctgcaaagaatttcacgttcttgatttttctcgctttcctagtgttcattcttcgttcggcgaagtaaatttcgtcagaaaacgaaaagaacctctgtatacttcgcaagcggcgctgtcgcttctgtttctctggcacttttcaaacttttgcgcagtcttcgtgcccaaccttttacccgttttcaacgtgggctctccatcaggacatcgccccttctcgcaactttctcagtccgtttgggcatatccggacttctcaatctcttttcatccaggaccagtgttttacttattttggctcatatcggctattgccgagatctgtttttcatttgggactcagcaagtctccccggtgtctcagccgcgctacacctggttgaccggggtagctaaagccacaacgggacagaagaagcgaagacaacctcaaacattcagtatctcgctcgtccatgaggtggtcacttcttttctgagttgccttttgtcttggccttccaacgtcccaaa

SEQ ID NO: 2567 - DNA, 2717 bp, Toxoplasma gondii
ttttggtaggatgtaccagccacaaagtgcagtctttggtagtagtttacactatagattcagccaaaacgtggtttttttgtgtgacccccatagcaccgagcgcgagaagactcgcgtgatgccacatcgacgttttctgcaaggctagacagaaggaaattcttgtccgagatgtctctatcgataacaagggctctgccgtttcatctgctgtggttccacatttctctcgcgtcagattgatatgtgtacctcgaacgacctttggcatatagctacgcatttgtatatgtaccgatgcccatatatctgtatatatacactgtacgcagacagatatatattcattcatgccgcactatcggttcagctgaatcgaaaagacacgtccccagaaaaagctgtaccttgacctggtggcttcgacacagccaggtgagggcgcctacagcagtgtggatcaaacgcagcacagcagaaaagagtctgggaactcacggaagcgccccagggacacggaaaggcagcaacgcagcgaaggaacccggtcaactcgtgaggggagtgaagacatcgaaacgcagaaatgcgacagcggcgacgctgaccgcttggacgtatatgtgtgtagttggactctgttgcgaccgagactggcacgaacacgccagttcgttatttccagggaaatgtggtcgaatcaggaacgcagggcgatggtctgaaaagatgcgcggggaaatctgctggaaacaggatcgggtggtgaccgtcacacataggaatcaacgaactgacgtgttgctgccagtttcgttcggaaccgagtccaacaacacacacatacatccgagcgaatctacagcggcacccacggaagaccacacaggtgaggagccgagcagtggcagaggcgttgtggaagagcaagtgcaaaagagcatggtagtgaagtggaagacgcatgcgaatctgtggggtcatccagaaggatgctcgtcagcgtgctggagagtgtcttgtcccttgtgtaaccgttttgttctgctggcgatagcgctctcttttcgcaattgtcaaatctacaccgccgcgaacgtcttttctgggcgtcctctcttcaatgttcgtcccgctgtgactttctcagacgcagtctccgcacagccaccgaaagagaggcgaaagatactgcgaaagcggcgattctctgccgtttgcgggacatcaagcagggggatttgtcggaagattgcaactcccaataaagcaatcgccattgccgtatggatatcgacagcggtagcagcccttggtattggcagcatggtttggggatcaactcagccccgaatactccgaaggacactggataattctctttcgccagtagctagctggtgcgttgagctgtgcacaggagctgtcgcctgtgcataggcgcgattttctcctctcaatcgacggtgtgagatggcgctcctcgctcgcctttatggtgcacgtcggacgagtacgttgaaaaagcaactttgcacgtgaagcctattcaaaatgcggtgttaaagcccacgttttctcgtcatttccgcaaaattttaacgcgtgaaacaggctgttccgcctacctccacctcaccctccgcctctagacggtcaaaggcagcacagtcagtgctcgctctgctgaaatattttttgccaattcctcatttgcccgtctccctattccgtgcagactgtggtttccgcctcttccccaacacttgctcgaaaaggcggaaaggcaaacgccggtcactcgcggaggcttttttgtggcgtttgcgtgcagcgtgccacacacaatcgacgcgggcgagggtatctgcgatgactgtgcgccttgtgggccaaaacacatggccaggggttcctcgaagcgacaagcataacggattatttttcccctcactacattttggaaacacttattgcaaaaaatatttccaaattctcgtcaattttgcctgtgctgtcttctttgcgtgccgagagtggccgtcccgaccccgggctaccctggacgccacaggacagcggcagttgccttgaccagcgaccgctggaatacccacaggacactggggatataaatttgagtgcttttcaccgctatttttgatgcgttgtaccgattttctcccttgtcttcgcgtctggtcgacccgtcctcggacgtaagcttgccgtcttccctccattcggctgggtgcgttcccgtgccgacgttttctcctgttcctggctgacttccaaaagcggcactttttctgtcatcttggtttttttcccgttgacacgaaatttggaaactcctctccccgctttctacccactcattcagtccagacttctctcgcccccagcacgggtagcgcaatatcccttattttgtaaaaaaacgcagggcggttcggacctacgagcaactgcccggatttcgcaggccttgactcattttggttcgttgcgcatcacacgcttgatccggaaaacgtagacctgagagaaataaagactttcaagatataaactctagtagtccacctcgtattatagacttccagaagaagcaccttgggggcagcttacccgagtgctgaaaaacaggaggcagacgctctctggctgcctacgcgtttcttccgtttttctcgagctgtcggacggga

SEQ ID NO: 2568 - DNA, 3744 bp, Toxoplasma gondii
atccttttctcagggctgtggagaggaaacaagctgagagaacttggggacgcgccgcatcgcatatgagcctcagtcgggtcagtgttccggcgttccgttgaaactataaaatcgacggaaatgcttggcaacgactgcgcatctgccggaaggaacattgtgcgagagagtctatggagaaaacgcagaacaccaaagaccggtaattcctagcaacgctacccttaaacctccaatttcttcgtcctgcgagagtcgccctgttggcccggtcacaaaatctctgtctgacacccagatcgaaggaagtttttagagacatcaccagacgcaagtccacaggaaggtgaaggaaagttgtacttctttttatccagggggaccgtaactcaaccacccgttacaatgcgtaaagaaaaactgcagtttagcggagcacctggacgtctatctgcattgtaaaggaattaccttgcatgtctttggagcctgctgacaatacagctcagccttcagatctcccaaattcgtcttgattgtgaccgacatgacgctcggtggagagagtgcgtatgagttttttcagcggagaaatcgagtcctcactgtctccagccgataccgaagagaggaaacgaggagaaaaaaggcgaacgcagagagttgatgtctgaggaaccaggtagccagccgcgtactacgcaagcatctacattggtgtaccggtgagagggaacgaggtgacctgcaaatgacgtaataaggaagaaagctcgaggctgttcgtcgaggacgaagggaattggtaccacaggtagctgagaatgacaaagcgcttcgttggcatacgcgtttctctctgtttaaaatgtcgagtaaaagcacgccgaaacgggctaagagatgctgaacggaggcaatgcagggaattgacatgcgatacgaagaaacaagtgggagagagaaaagtgccggagaaaaggaatggacagttctgacgaaaaggctattcaggaacagaagcaaagagtcactttacagagaaactgtagatttccctgggccgcaaatgttggtcaaatttggacaaccctttgccgacgagggagaaatggggcaaccaaaaaagtggaacagggtttgtaacacaaactaacgagaaaaagacaatggctgccgcgttctccaaacaaagcccggaaaagcaacataaatgtgaggcgcaggagtcgattgtttctcaatagggaaaagagtgcatgcactgggattctccctgttcaaacaaaagccggcatgcgggttcttcgcactgtctttgaagtccttggcttaacgtcaaccattttttcgtttcttttcgcgctcagtctgacaaatccgaaataaatactcgcgaaattcaatctttccttgttgcgcaggacctaggaacccgggtccgttttgtagactctgaagctcctgctttgcctgctgcatatcgatgatcaagacatttaaaaacggaaccgtgttcgagggatggatgacaactttcctgggaagacgtaccatgtattttcaggtacgatgcactttgttttctgttgttgcaaggggtgtcgggacgtcatcttgcttctctgtcgtccggtcatggaaggccgttcttcgtctgaaatggtgacatgaagtaactcgaggcttctgccctatatatagcgattggcatgaatattaaggcggatgcgttagagatccgacagtaaagaccagcaactaaacacccttctcgcagtgtggaaaccgtagcctgaatccgacagttggaaagcctcacagttatgaaacgaactgcatcctctcccaaacgtacaaccgcgctcgtgcagttccagtgaagctctattgactttcttggttcttgtggctgtatgggatcttctgcaggagacagaaacggcctctcgtctcagcgcccagtcgaccatctgtacagcccttatgctagcatttatttaagtgtacacgaaataccgctacgattgtatgggtagaataacgcactcaaaacattcacttttgctctgtgttctcttctgccatttgctttccaatgcggcttgtgaccgtacagttttgccgaaaactacgttctgctatttgccaatcaccacatcaagtgaagatgctcaagaactctgttcaatctaactttctcgcacaagtgcgtagagacacagtcttcataagaacagaaactgtgctgtactttgaacacagccttgaatataacgatgtagtataccgccggacgtttctgcacctcgtcttggcggtcgggcgcctccattcggtaacaagcgcagatttagcctgtctttgcagagaaaacacacgtctttatttagaacaaaattcggaagatgagcaacggagtgggtgacgagctgtcatcttcataagagacaatgaggtgtttgccggtgtttttgcgggccttggaaacaagccacaagaatacatgcttacatcaggaaataatacgaagctgggacggcgtttgcattctcgaggcagaagacgaagtggagaatcgtaaaggtttcttttctggtacaaaaatacccttgtttactacattgccccaaggtagttgtcctgataatattctgcagtcgcagtaagcaggactctgaaggtggcatcaccgcagagaacaacaatacctgtctcgaatccccctgacaccataattgtatcttaccgacacagaaacagttttgcgatggactgtataccatttgtgaagctgtctgtaatagctacgaacatccgtctcctgcgccaactagagtgtggcttatcacatgatccagtgtctttttttttcagggacggcggatgaacagaagcacgctgtcccggtcgccgcacaacctccccagacgttaagtcgaataaatggttctgtgtctgagagctgtggagttgtcgagtccttcagggccgagtgtgtccgctgatagtgtcggcccagatcctctggtaacgatttcatgccacacacaaacaccaacttcgtcggcaacagtctcgaacctatggcgttcagcaaaacaaatgcattcgccatcaataaaaatgacgaccatgtcagaacagacgatgtgggcataattgtctgagcgtaggcaagctgcctgggcaatgcatgaggtgaccaggcatttgtgaagtgaggatgccttctcgacaaaccgactgcgagagggaaaaatttcggtcggcctagcaaaatgacgtagccaaaagcatctgtaatttcgttcggagtatcacttagatctaatgcacacccctcggtgagcgctgtcgtccatgttcagtcgtttcactttaaaggaaagtccgcaacatttcctagacaagggtggtcaccgttcagatcacaatgcggttttggtcatgccagtgacagatggtgtggaggttccggtagaaaagttgataagctccggtcaacggtcaaggaagaggcacatctgagtttttggccggactgtctcgtggctgtttctgtctccaaagtcccagactatggctgaagcgttgaaaaccgtggagctgggcgttttggtataccgtatgtcattttttgttcaccgcttcgaacatcgaaaacagttgcatcaccagttccttcgaacgccagataaaccattcgacactagctggcagcaaaatctgcggtaaaaa

SEQ ID NO: 2569 - DNA, 3616 bp, Toxoplasma gondii
gaacgtgaggaaatatctgccgacctgttcagattcacaaatgtcagtgcatctggtcttgtatgtttatggaaaggtgctcgttgtatttgctcaaaacgttgccggttttaaagcgcctctcagggcagggctttccttgtcagtgcaatacttttatggcttcataggcctgccacgttgccatttgtttcggttttcctgttctgttccagtaagcaggcatgaaggccgcagtgcgtgcatcattacatacacgcccgacacgcatctccggaaaagccagcttccaccctcgaggaagcggcaacgtgggcgtactgaaaatgaaactgtcacagacacaaacaaagaggcttactgcacacttggacacgcaacagtggagaaaaacggcgtagaaaacaccgtaaaagatgccgttgtgactgaatgcaccttaaatacgtctgatcaggagtggcaggaggcttctgcgtccactatagttactcccagtgccggttcgaactcagacgcgaaatgggtcacaaatggctgtgaggcgaattttggtgctgacgcgtgtgatttggacagaaataccagcaaacttggaagagctgtagaagaagcatttgtaacctgcatgggtagtcgtcttgcgaattcgcatgaggctgtgaacgatgattgcgattcgaacgcggccggatggcacaaatgcaatatgcctaaagttgtcgctgcatgtgtcgacggtactggaccgcgaatgcccctgatgcacgcaactatgagagcgataggctgtgtgggagagaagctccggcgcattttcgcagaacccgacagagactctgctagagaaagagaactcgaagcaacaaaccaaccggaaaacggttcaggggtaacggggaacgcatcagatctcgaagacgtgagcgaagggaattactactgtcaggggtgcgtggtgtactgctctcatgagccctgcgttttgtgtgccatggcactcattcactcccggatcaaattgctattttttgttcatgacaacaatgttcatggggggatcacccgggggcgcctgcatctggatcgcaggctcaaccacggctaccgggttctctgtttgaggacgaataagggagctaccagcgaccagaaaggcaaatgaagtctttcttatttaattccatctagaacttgaattcgtacgtccacccacgagaaatcaacttgcaaaaattcgagagcatccttgagagggatcgtcacacttacaacgcctgatggctgcatcgcctcgttcaagtcggcttgtctagttcgagaaagggcacaggggatcagattcggcgacttttcaactcacgcttaagggttattgcgtcataaacctagatctgaaacaaacaggccagcctgtgtgcagccacaaagaaagcaacgtctgcctgagcagttctgtctgccactgaaaaagcagatgttgcgcctcctttcagtcactttgagaaggcaatgcttcttagccttgttctagcgtgttgttcgcgtctgtccttcattgaaagttgcaagagcacacttgtagcaaagggcagtgtcttcggacggtggcgtccgcacagccaactggtagcatgtttctttctgatgtataatttcctttttggtatcggttaaagggacatcgacgagagacttcagagccaacgaagtttctcactttccgtttcgatcgtcaaagacgtctatcaaagttgtcggcacgagaggaacactccatcttcacatttgaataaggcggcaggttctggggagaaactcgctgtttcggaacctccttcactgctaaactgcattacttatattatttgttacttaccggattcaggttcaggctttcttctggtaccgtgacaatggtgatctttacgttgtactcgaccctctactccaaaaacagaaccagatttaatgctcggagagcctccgtttgcattgatttcgcaacagagaatagcatgttccagaacactcatgtgcgaactggtgcacagttaaacgtatgattcgtggtgcagtaatattggccacggaatgcagtgataccacgcacaaggtgaatgtgagaggagtgccgtctccgatgaatcccacaaagtggaaaaactgcttgctggttggaacttcgcacagaaagggacggtggttaaaaagagccaaacggcgaacaggagagcgatcgtcgggtgggagacagagtaggcacaactataaaacttggaggcaggattgatcactgtggatatattaaacattcggggtactaattaaacaaaagatgcttcatttcaagcaaaagacggattatccccctcacaaccctcgtatacatcaatagagttcgtcccctgcttccgtgctgcggaagcaagatacgacaccgcaatttatgtcgaaaaaaggctacagcttatatacccgtccccacatgatccacatctaactgtcgatcgtacagtgcaaaaaatttttgcagcgcagatttgtgccgagatgaaataccctgaatcacagggcatcgagtctgcgttagtccgactctgcacacggtttctccataacttttttaaacagcgttgtgtctagatattagttgtaagcccttaacgtcgtcatagactttcgtgttatcttcatcaagtgttgcttcaagagtcgaactgcactagcagcgttgtctttagctactagttgtaagcccttaacgtcgtcatagactttcgtgttatcttcatcaagtgttgcttcaagattcgaacggtactagcagcgttatcttcagctacctttgtcagctgtgagtgtctacgcaagctgtacctcagtcgcactcgctgccacagttccctggaagaagctcttcgcctcaatgccagcgggaccccgttcatcggtgggaggtgcgatcggctgtaggacacacgccagtagtggcacacaagcaaacaaaagtcttcatgacacgagttcaacgcattctgcaagaggctcaatcctgaagaccacggtttaaaggtgaactccttcggtatggcgttacggccggcacaaaagagcacgacaacgagtagaccccaagtgactgcaacgggtgtacccggaaaacggaaacgattgcggcagagaaacttcacagggctcgaaaagctaaaactcataaatagaaaagacaagtgctataactttggaacaaaattacgtcatctggccgggtcaggaagagaacaaccgacaacaacaccacgagctccgtctaggcacaaggcaagacaaggaccggaggcgagaacccgtccattgtggcgaatgatgccgcgggcgactcagcgccgccgaattcgctagtctcaggtcgagtcgccggggcgtcaggagacaagcaccggcgccccgcgcgccaactgtccgtccttcctggtgagttgacgttttgagccacgctgcagaactctgcactggagtgattgagcgcggcatttatgtcaatctggtttttccacgtgtattccagaagcttgccctgagaaatacagatacactgtcacttttgaatcga

SEQ ID NO: 2570 - DNA, 2374 bp, Toxoplasma gondii
gctgtctttagttaagcgcttggacaccatgtagtcacagatggagggaagacgccacacgagcgctgccgaagcagtcttctaaccgtggcaggacagacgacctcgtggcgtatgacagcgaggacacagacgccgtgtgacactgcaacttctctcaatatccacgttttcagaaacagaacgtgaaaagagacactgatcatgctaggaggggtccccgagcgacaggtagctctttctggagcctccggaaaggcatatgtatctatgtgcctgtgtagaacttccaagacaggtcactcgcttgggcaatcacttgcggagctgaagcatgatttgcgactctgaaacgcctccgcgctgagatgccagctccactggcatcggacagaataaagacaaagaaaatgttcaaatttggagcaactgtcgccgaaagggatgcaggcggccagctctcgtcgtctgcggggcaaaagctaggcagacttctgtctctcaagatttggtacatttcgatcccgcggaaatgagggtctttcgtgtggttcgtccagaagagtacagttttgattatttgcactatgtggggtaaatgttgcctccgggaacttctggcttctgagaaacacgtagcggcaagaggtgtgatctttcttttacagcaacccggtcctgaagttgatccacgctccctttcttgtacaagagtgctcgtacgcagcgattgcttatccgattgcagtcgcttctgttgcaggcagttgcctctttttgtctacatgggtaggaaatatgttttgaactgcagatggatcggcgattttcaacagctgagtcattgtctattgacacagtgaggccagtaactacctgcaaaacataccaaacaacgtaacacaggcatggaccctccatctccacaaaaaaacaaaagggtttgacggattttcaaccggccgatgtgggtgacgatgatttcgaagatatgttcttctctggcgttccggatgtagtgcctaaaggtctcgacgttacagacacgcacggcgccatacacagacattcacttccatttatactctcatacacataggtatcgttgtgtctggattttctgatgtttttctacgaaccctgcatgactgggatatttaggtcgagaggcacgagtcgttttgctgtccgcttcgtcgtgtaaagtcaccccatcttgtcgcccagacaacgggtattccacgaacccaccctaagttgtttcttatggattttatcaagcatggaaacaaaatcacggtccaagtaaagtttcttggatcttgatgtttgctcacgcgtccctcagttcattacttcaacgaatcagcgacccgttgcaacaggcgctagctgtcgtcttgctgccgacatctgcaataaagcatgccgacttcctgccatctttctttgcgattcaagcaactctttcagtggatttgatcgattttatatccagtttgaggctttctctttagtgaaaagtcctttaagctagaaacggcctgttccgttgtgtcttcgacgatcatagttttcggatattctgcgacagccgtttctcgcagcagtcagagcaatagctcgcttgctgtttctggacgatcaacaagaatgcaacgctgcccgtcacgcaggttgaggagcatcgaccagtttacattgaaaatcggtagtttttcctgtccgtgtctgtcctcccggcactgttcattcgtgcgagtagaaagtacaactactggctgaatcgccgttattgcagaagtgccttctctgtctttttacgagcgacccttgagtggcgcgatgagtgatactcgttctcagtcatggcgctgggtcacgctttcacttgcagacggctcttaagagagacgcaacattgaactgggacgtgtcttgttttcctttcctatatactcgaggattttctgctagaaagcagcaagagaaccccgcttgtctgatatgaacgacgctaagactggtagtgtgagccgcgcagcaggtgccaccggacctgccctgccccacctcgcggttccggtgacttctatcagtcgctggaacaagtgtttcgatcaaagcacaaacttcatggatcaaatctgaagatacagttgtagtcgaatctcgtctgtttcgcgttcacagacgcggcgcctcgcgtgaggcgtgtctcagctcgaccagcgccgcacgtcccctattggctcttcgaggcagcatcgtcatcatacagacggtagctcaaaaggcaacactttggtggcgtctctgcacggggtttcgctcgcagaaaaggactgcaatcgctagttctacctcagtaaaa

SEQ ID NO: 2571 - DNA, 2753 bp, Toxoplasma gondii
ctgtggcacacgattttcgttggaaactctgccgccgattggaaaggctcgttccagtgcatgacgaggggagttcacgcttgcacaggaaaggaaaagctattcgtcctcggagaaagatcggcgagcgaaagcgatgcagacctgaatgcaactgagcttgtcgaaatagaaattcctttctcctaggagctgccgaacgtcgaggaggaaagctttgtgtctcgcgagtctgcacaaagaggcgaagatgacagaaaaggagaaaaggagaaggaagaacacagggacagcagtcgtttcctgttcgattgagcagtggcttcatttttgcgcgtcgcgttccatccttggttttctttgcgattttcgtttttgtcttgtttcttgcttgtacatctctttttctcttctcgcctttcctttgtctactcttttttccggtctcgcgtccttcttctcccggttcctcttcctgcctttacttgtcgcgctttcttcctcccgttcttctttgctcccgtgtcaccttcggtctgcgcttatctgctctcttcgcgttttttgctgcctctccttcctctcgcctctcgcgtttccttctttcttccctcacctttgacgaatgcgttctctcagttcgccgacgaccttgtcctcgcactctgccgagtagggtcgcctgttcgccaccgtcctctcgccttgttccgtgagttcttccgccctcagtggctccacagttccaggactttcttcgtcagaaggaaggcactgttctgtcccttccctcagggccttgcagacctcttccttcattttcttttcgctctcgcagctgctgtgcacaagcggtgaaagtcgaaggaagaccagccgacgggatgaagagcgaagaaagaaggaagacaaagagcagagaaactccaacttccgggacgcgtcgaacttcgcctacttgtcggcgaagcggtacgagcgaatgtggtgacttccctcctaggaggcgagcagaagcaagagccagcttgcggagacagcaactaaaaaagggtgaccatcaatcttgaataagagtcgtgtgccgcaaagcggtgcgtggagagttccgtctctctctctcttcgctcgtgcagctaactgcactcgaacatgactcatgggagtggtgtgttctctttaaactcgagagaagaatggcgaaacgcctgagaaccgctttcgcggaagagtgaaggcccctcttccttgcgattcactgcttttcagcggaaaacttgaaactgaacaccccttgaaaaggatctcctccactgcgaggcagctggacagacggagggtcactcttcctcgctcggccacgcgtttttgatcttcaccgtgcggtccgcagcgactcggcctttgatgcaaaaaacgtagaagaaaaacgatgtgtctctcgctcgcctttcgagacgaaagttcgcggaagagaagagcaagaagtccctgtttcgccgtaaaaaaacgcgctttccgggatccaattcgctgccacaggggcactagataggatttggccgacttctccgccggcttggcgctatggcagcaacgggacagttgtcccagaggagacagctgaaattttcttttatcttcgcagtgtgtttcgagttcgctgagagttttccctcccttttcgctgcgttgtgtgctgcgacgacgagagaaacgcgagtttctcccctgaacggaagcctgtgcctcttcggtcggccaccgtcgtcagcggaggagtgcaaggatttgcggcagttttccagcaagtgaagaagcggagctgaagacggttcaccacccgttttttgcgagtcttcgcacgggtcgtgagaaggggaggctctctctctctctgcgcaggctcttgagcaattcgggtctatcacctgcgccctttcccggtcgttcttttgcccggtgtttcttggccatttctgcttcgtttccgttcttttttccgcgaaagaaagacggaactccgctctgagacacgcaaacaacctggcgacaggggattgcctcggtgtttcgtcagaaagtccttctcttacgccacatggtcccctggaaccgacgggacggtctcctctgccgcacaacttgcgtttttcaagcagagaagagcgaaaaagtcgggcgttcgcgatttgcatgcgggacttatctgggggttttcgccacatgttcgcattttctctgcacttttcgaccggtctcgcgcgctccaggccccgccaatgagttcgacaaaggactgaaatgctggcgcgaggcttccgagacgcgtggtgttggatttcagactcctttgatgttggggaaacgctttaaaaagcctttcttcctcgtggagcgaggtgtctcctgcctgctcggggccgagagtccgctggtcggtgtccgtgtctctctttttctcggcattctgcctcccttacatccgtcagaggcgctcacaggctgaagcactcttccttgtccaccagcctcctggttcttcctatccctcttctgtcgcctgcggttttcctttcgtctgccccattctaccagagacgcatccttttcaagtagactccggcgaagagcctgcgtggaatcgctccgcagtccgagttcgaagcacgggggtctctcttttggcctcgtttcgtctctttttccccttgtctgtctcgatcttctctgagagagactcgacctcaaaa

SEQ ID NO: 2572 - DNA, 666 bp, Toxoplasma gondii
gttttgtagagtggcggtaggttcacagaagggaacggaaccgaggaccgacgcaacgaaaaaaaaactggcacagttcgcgtttttatccatccagtaggccatcatcgcgaagtgtatactctcccaagacacggagtggagctccatctggcgggaaaaaggaattaagaaacaaaaaagatgcaagcgtagcgttcagacacactatgagttctttgagaggagacatgttgcaactgaaggagaggccgcgcgctcgaatcgaaaggcggcgctgcgagtttaagaaaatggaggtagcagcgcgcatcgcagttgtgcccgaggaaactgggggcaaagaagaagacgccagtgtggagtcggtgagaaagctgacgcagaaaacagggacagagggaggaacagaaaaaagaaagaatcgaggaacctactttggagaagccagtcgccgacagcgacggctgaggcggttccgtcaccgtcggttgcgagggggacgaaggtcgtcattttttcagaatttgcacggcagagaggttttcggggaaagggtgaggagagaacggaataggtgaaaggcagacaggagggagagcggcgaagaggcaaaggaggaaatcgccgcgggtgctcgaagtatctttcaaggaacggggagta

SEQ ID NO: 2573 - DNA, 3120 bp, Toxoplasma gondii
ggggaaaagaaggtgtttaccacattatccgaagagcggtccgaggagaaaaggaacagcgccctcatcgtctgacgtagagtttgggctgtgtgtaatggcgactgtgttcaatcagaaaagttgacgcagagggcttactatgagaggtggagcgacgcagcgagccatagttttgtatcgttggatgctttgtgcatagttgtatttttatgtatccgtaaacctgctcatctgtgagtgtaccaatgaaacacaagcgttcctcttctaggctttagggagatatgaatgtgatgttcgactgtgtctcgtcatgtcttacgctatcgatatacagtggcagcactatctgggactcttgggttgcggtgctctcgttgaggtgctatccgttttctgtcaagatacgtctggacttcagttggcagtcaagcgggtcgccgctgagtgttttgtttttacgaggtgatgtgacctctattggcgctgcttcttgatgttctatgtgtgccatttatccggatattcactcccacagtcgctgtcacagttgccagaagccagccaaggactggcggagtatcgcacacattttgccaccggctacatgtattttggggaagttgtgtacgtaccggctccgttgtgtttcgtagtacaaacagcgcacaactccccagcgtgctgccggggacatcaaggtccgcaactcatttcaagagctttttttctaggagacacagaatctacggaccacgggaacgatgtaggtggaagaggtagcgcgtgtggcttattcttcacgtatctaggttgacgtcttcgaacagttgaggaagagaagtacagtgcgtgcaggcaatacaactctcttcctagagcacactttcttttttttcagcttttgcagagtcgctagacactagagccggcgttaagcaccagcatgcttaggtggacatgttgcttctgtcacactttccttccagtttttccgcaaccgcatctagtggtacaggcaattctggaagcataagttttcactgctttgtctcgatactgatgccgtttttcggacaggcagggcttatacgggatgtgcggcccgtccctcgctacgccgctcggctactgtctcggtgccggtgcagagacagcgaagacatgtatcacagaaattagaagactgaagccaggaatacctgagttttgcgaatgcagtgtggccgctcacacttttccagctaacacagttcgaccgcgatgctgatcatttcaagtgcatcacggtgctgaaacaattgaggtttcgacgaccttacttgtccggtcccgttcccggcccctgtctcctgcacagcagttacacttctttcacatttcaggcgttcacgaagagttcctgagagcacttatggggaggcccgtctggatcgctgtgtgccaccagtgaaaagtcttttttttgcctcatttccgtacaatgagactgttcagctccagtctactgaggcagctgtctctcctttaggttctcgccttgatttgctgaaagttgacaaccctcagcacaggagaagaagctgcgttccgggttcctggaaaagtaccggcgttgtaatagtcttttcctctgtaggtacgattgttttgattgcaactgcgcgagcggccgtggttggagactctacaagcgttacaaggtgtgccatgtgtcgacttttcgcccttaattttccgttcccagctgcggcacaccagggaaaaagaaagggtgtcgaccttcgcggtttctgcgtttttgaattctgaaagccgaaaacctgaaggccttctggttcgccaacgtaatcatgggtatttaagagcaggcatggacggagttcgcctctctcttagtgctgtcttcagcttgctagagcgctcatgtcctgggaacgacgccggtacggtctcttcagcaggtgaccataaacgagaactgcggaacacatggaggatatccacaaggcagtaccatgtccagtagctgttttgcttggtgtcttctcatcctgtggtctttctaaagcaatcatacaaaagcctccttccttagagaggacgaccgctttgagccgaagccgacgagaggatccaagtgaacaaatgtgaagttcgcccgtccctcggtgttcggttttgcctgtcgtgatattttcattttcagcaatctttggagattttctcctccacattcttgacaggtgcagctttccttcaagtgtgcggagacgctctggaacagacctgtatccgcgtctccgcctactgtcgttgccgctctcgtttttttttctcatcatcgcagcttatctctaagccgttttcgataacacgtaaactcccgaagtggatcgaattcaaatagtaactctgatgcacaagcgacgaactattcaaaagcacaggccatgtcgccggcgggaatctcccagctctgcctgcatttcaggggataagttgttgaatcagctgtcgggtaatccaagcgttcggttgctttgttttctacaatatataccatctgcgctctgataaaacagtagaatttggatccggcaacaaagacctcggactgtcagttaaggaaattcacgaccgtaggtgttgcgtctgtctttgttctgtgcaggcaggcgtctctctgcattgcctgaaaagtcttagtcgcctgcgaagagactcattttcagctacatgtctgtcacccctaactggattcatctttttctaaccggctaggctgttgtagcatgcaacagttcaaatcccattttgctgctacttgcggggaggcactgtgctcgcctctctcaggcatgtgaggtaaatgaacgacctgagaagatcggaaaacgagttttcctgcaacattttccgctcgccgctttatttgcaacctcctaccacgcccctccccttttgccgaagattacgaacctctttctcttgacttcctgcttacctgtgtcgtcaagcccgttatccccacgggaggttaccctcagcagaagcggcacgccgccctctcgtttcggctctcgcccctgttcctctgccacgtttcctccaaca

SEQ ID NO: 2574 - DNA, 2897 bp, Toxoplasma gondii
accttgaagatcagctgccttaggtcctgcaagtcctgtctctgctgctgctgtcgctgtctccgcgcctgccgcgccgcgggggtagtcgctggaagcgaccgcgcacgcgccggcgttgggtaatggggccggagaaggcccgtgagctcgtcccttgcgttgtggggacgaggctcccgtctcccatcgacgagagcctcggagccctcaagacgatccagaacctgtcgcagttgctcgacgaccccgagaatatccgccgaggccgcgatgcctgtagaaggctcctcgaggcccgcacgcctcctcacaggctgctgctgaagaagcacttgttgcagatactgctgaggccttccggaagcggtgctggcgactcgatgagatctctccgcttggacacggcgcgcgcgttgcaggagaaaagcgttcacggtctctgcgtgcggctcctctcgctcagacgccggagagtctggggcccgacccgacggatggaacgaggccgcttcatctctcgaaagaggcgtggggggcgcagaagtcgagcacttgaaggcgagcgaagagctcacggaaggcggatggcagccatttgaggtttcttcatcttctgaggaagagaaggacggttgacgctgaaagaactgctgttccacctgtggtcgaagtcgacgaggaggtggaagaaggcgagacgcaggaaggtacataactccgtcagagctcctaaggaagggagcagagtgagacgagtcgtatccttcttgaggacctggaagacgcgaactggtaatcatgcgattgacggaaagtggcagaaaccaggggaggacagagagaggagctgtgttcctcttcgtcgctggagaggcgccagcttcggtcgaagcggattcacacactccctcgagactaacgccacacaaagccatgtcgctctctttcgcttcaacggaaggactcgcctcccggtcagactccccatctgtgcaaccttctctgtgtgaggtcgcctccggcacagcatcgcccctcacgccatccatttctgaatgcgtaaaaaagaagcaaatttcttctgaatttctatcgataggagagagggtcattaaaggggagtgctcggtcggttccgcctagaaccacgaccctgacgagagaatgccctgcgcaggcaggacaacgacagagcgcggccaaaggcaccagaggcaggaactgacgagcaaaaggattaagtgatgttgttaagttagattccagtcatctacaaacaccggaagctaatgcaacaaattatttggttgcggcagaactgcagcgaagagtccttcgacacaagaagccaccacgctgtgctgggcagcactgggattaaaaataattgagttcaggtgctccatgaattcccagccagttttgtcacacaaattcgttaagaagcttccacatgagttcgcctcgttacgggtgtgttctaagaaagcacaccgcctcctccccgaaaactggaggaagtctgaaaaacgcaaatccttttggtcctgtttaggcggcctgctcaagtctcgaggcacagccacttaaacgggcgacaaaagacttaccaaccgaggaaaaggcgagactcgcgcatagagagggaactatatgctacccttcaaggagacatggagcagactgcttacgtaagcggtctaagcggagacagacagcctgcagttccagctaaaaaatcagctaccaaaaacggtgatggagccacgaagaacgcaaaggcttataatcgtcttcatagctttgctgcagtacttctatggccacgagttgggtatctcgtgtgtttcgagcaaaaaagaaaatccacagagaaaattattgcctgtgcagtgacaaggaagatggtcgagtgaacagttcgcgagaggttagtcccttccgggagttccaacaacgcgtgggaaaatacggtggtccggcgtccccaacgtagaaaaaaacggcagctctcatccggaaaaagagtcacttacgatgtagaagacgaaaaacctggagggcgaccggaccaagaaacagtgcaaaagtggcgctcgagcgtcgccaacagaattcagtgcgcgttgtatgctacagcaccaaaaatcctcttctctgcactagttctggataacatcgacgacgtatagttgcagtatgtcagtaagatgagacatcaccactgctggagactgatgatttttgcgtcacaagaagcaacatctcgcgagaaaagcccacgccatttcgcatgccactgccgcaaagcgggcatgtacagatcgggacgacgcgtaagtgggactgccgcgtgtgctcggcggccagtttaagcccacattcagaactctgcacgaaattgggcggcgagcatcaggtgccacccggtgaatagagacacgtattcttcttttgtctcatccctcgctggaaactcgtttactaacagcgaacgaaaactggaacggtgcctcctgtcccgcagttgtgctcatgggttacggggttcttccggtacgggagcgcttccatttaaccggtgaccccacgagtggcgcggggggttcaggcacgtccacaagcccgtaagaaccacgttgaccctttgaaatcaagagtgcccgtattccagttgatatcaactagcacaactgaagcgtcagcagcacttttttttgacttgtcgggtggacatacacccggcacagccatgatgtggaactcgttacttctgtttgcctcgaccgtttacatcggtagagcgttttgacggtggtaggtttacatactaattggctgaagcgtggctctagtactgagtgtctttaagattctgtacgtatcggaaaaga

SEQ ID NO: 2575 - DNA, 2661 bp, Toxoplasma gondii
gttgcgttccactgagcgagctgctgggttgtagcttcctcggttacctccacaacgcagtcgacatgcttcaagtttttttcgatcgccacggtggcgcggttcatgtgcgcaggaaaccaggtgatcgatctgtcgagattgaagtgggcgcgcggcgagaagtctggaaagagaagggaggactcggcaagcttcccgggtgtacgtccacctgagcggagagcctccgcggtcccctccgttcccccgccgaaggactccagctcgcgaggaccgaagccgccatcgatgtctcctggaccaggctgccatggactcagagaccgagaaccccacaaaggagaagaagaagaaggagaagaagaagaaggagaagaaggagaaggagaagaagaaggagaggaaggaggaagagtctcgtttaggaggggaccggtgggtcttcgccagaggccgacccggttacgcgacgccatggagcgcgggagagaagggagaagagcaggaacgcagaaggagatctggaaggcgtctcaagccgcagaagcgagaggccgcgcggcgaacggagtcggccatgcacttgcactgtttttgccttccgtatctctgagtttcgcggggcttcacatcgcggcaaagagaaggcggggaaaaaagacgagagaagaagagaagaaaagatggcgaaggacgacgacgcagtggagttcttgctgtggagacagggccaggagaagacgccgaggcagctctcgactcgagctcggcgacagagtggtgctggccttggacgcgaagttggaatgaggggattctgtctccagggcaggaaccagcgagagcggttttgacgcaggaggagggagactcgcggcgagacggcagggaggagggcggcccccctcccccacagaagaagaagagatccaggtgaaaaacggagcgaaatggactcggagagaggcgactttcccgcggtcgggaagaacatgcagcctggagagcacaaagaagggaggaaaaaaatcgaacgtccggccggcggccgacgccgaacaaggagaccgcgcggagagagcttggtgtggttttgtgttttagggaagcaaaaaggcgagtgcagaaaaccttgataaaaactgtcctgccgaaacggccttctttcacctgttcgctggaggcgtcttcgaaactgaaggggagagaagagcctcgccgctgcgtcgaggagactccgtggcgccctttttgtctggaggaagaagagaggaaaaagcagcggtcgtcgtcgattcgaagaacctcttcactgtggcttgttgccttgagtctcagagatcgccgaagaaggttcgctttctctgtccttgaggaaggaaacgcggagaagagaaacaaacgaaactcgaaaacagcccccggttgtcgaaaaagcggacgctctcaagcactcgcgactaagcgcgctcgatcacaactcagaggcctcgctctcgctctctctcttcgcctcgcctctctcccctcggctagtcccgacgctttcgacaatttccgagccttcttgcggggatcttttttctcgcacagcgacgcgtcggcttctccgtctcttcaacaatttgactcctcgcgaaaaacgagaatgacgagaaagactgtagcgcagagctccgagcttcacctcaggcgtccctactcctcaaagtcaaagacaagaagacacccgcagggtgcagcgcggctggtgtttcgcgtccatttcttgaggagtacttccccccagtttttccctgatgaaaaaggacagcgttgcttttttcacctgcgactctcctttaaacgaaagcctctttgacctgtcgagcttcccgcggcaacgccggactcgagcggcggcggaggtcgcggcgccctcgaggcttctctcgtttttctgagtttttcgcgctggatcgacttgcaggaaacggttccattcttccgcgctcttgtgagcagtcaaggcctccttcttcgccgacggagaacggaggcgcgggtcttggctaccgtcctcctatctaaatcgtccgagatcggctgtgtctcccttgtcttcagttgccactcggcttctgcttttccttgggcctccctcgccggagagacgtccagctctctccctgaccacgcgcaggcaaaggcggtagtgttcatttctggagatgcgtcggatttgtgggcggttttcttcttctctgtctctgcgctacacgctgcttttgcgatgaggcgcgagagaactctcttccctaggtgttcgcttcttggggttagcgcgagaaaagagaaaagagaaggagagcctccaccggcttcaaggagaacgaggtgagggagagaaagagagagaacgaagagtcgaatctccacgacctcctctcccagctgctgctccttctgctcctgtcctttcttctccttgtcgtctgcttcctcgactctcgttcctgtttccgttgcgcgtcggtttttttgtctttcctcagtcatcgtcgttgttcggcgccctccccgtgtatccaccagtcgtcccccagttcctcgctcgcctccttccctctgcttcctctccgcgttgtcttgctctctccttcctccgtttccttccaa

SEQ ID NO: 2576 - DNA, 2466 bp, Toxoplasma gondii
gctggtggccacctgaactgtttcgaccgcatccagcttgtctctcgtccttgtgagaaaggcgccgttgccccgtctcgttttttctgttcttccccttatgcgtctccttttctcgtgtcgtttctgctccctctagggcgggcgcttgctcgaacggatgaagaactgatggagcatttcaacatcagcatgaacaaggacgaactcatcaaccagttgaatgcagtaagtgacgaggacacggtggaggctgcgatggactttcatctgttccttattaccctgtgtttgggttcgcggccgtccacgcgcgtccgcaaagtcgttcgtcatcctgtgttttgccgtttctctttgttttttgaagtcgtcgttagttgtcttcccgtacacgctctcccgttgttcgttccgcgtgcttgccctcacggccgcgcgtcgatcgccaacctgcgttcgtgctcaggcccggcgaaccgaggagtacaccaagctggcactcgaaggcgtcgcgaagctcctgcaccagctgcagaagggatctggagtggatttccttactcgtctcgactctcccatggagaggcgcgcgagtgcatgccgaaacaaaaagcattcctcgagcggagaagatgcaagagaaggactagaggaaaacagggaaggaacgggaagcgctgctggaagggggcacacccccagtggccgcgtcggtcaacctgcaggaagttccggtcggcttccgtcaccgttgaatggggcttgaaactgtgtggcttgtgctggcccacttcgccagagcactgggaagaacagcgaagaaacatttgttacaaaaaaaagtgtacagagttttgaaggcttcagtatggaagggttccagccagcgaccgccggagtccatgcgcgcgatacatgccgtggcttcggcgctagtgtcggcgatagcccgcagaagggacaactgttctgcgcggcacctagcaggaataagtttccgttttgaatgccaaccagagagtattctttgcgagtcagacactgtagaggagaccaaaaggtcgtgtggcctcgcaagtaacagcgagagagacacagcacgtgcagaaaatttcagaaaaggccaggcacgacttgatccgaaaaaggagacatccgtggggttccgcacagtgtattttccgagcttctccaaggccatgcagcgataaatgaacaattttgacccccacataccgaaagaaagtacgcaaacaccagacacagatgtaaccacttagctggcatcggtcggtggaaatgcctcagcctcgaaaaaccggttcgcccactatccgtcttcggtttgttgtttacgggagctgacccacaaacaacgtctaactcgtacaaaatagaccgggcatgtggcgaatacctggggaaacggcggttgcctgccagcgggtcgaagacagagagatagtttaaggaaagcatgcatttgaccgtgaaactcaaaaaagcgtggtgccggctgaagctcgaagagttccccaaagcagctctgctcgtatgggttcagtggggtgtctgttttccccgtgggtctggcggggagtgcgcctgtcggaggtagacttcccggtggattactggaagtaaatatgccgtgctcacaaattgacacgacccgcgacgaagcctgtgggcccccgaggaaacttgacgtagcatctgtcgcgtttcacagcttaccttcagcgtgttcacgtacgccgcctacaacagtactctcttacgaggctggcattagggagctatatggctgcgagcaatcggtaatcacacaagccagcggccgtctcagatggctcaaaagcacactggtgctcgtcggctacatctatgactttcgtggttgttccctgcttccagtatatcgtattattgagtgcatgcttgcagtgaaagcctcctcgatgttccaggtcagcagcagccctgttgtggcgggtaagagacggggcaccatataagacagcagtaaacgtcacgtctctttttcagaaaaatttacatgcagcgtgacctttctcagaaggaggataattgctattgtgcttcgtttccgacggaatttgctatggaggagacttacactttctcgccaggcgtctctaaacaagtggcgagtgctctgtcaccgtctcacggtttgtgttagtgacgctcattggactgggtcactgggcccgacaaaagcagtcccagcgttacttgtacacaaacaaaacggtcactgtatccatcaaagaccgtacaggcgagagttgcgtgctcgtcagttcttgtggcgatcaggtagatgacgtctggggaatgtgcacgaccgtgctgttcacccatggtgtttctgaggcatgcgtgatttcttgaggcacggggagctatgttataacccacgctgtgcgtaaaaaaaga

SEQ ID NO: 2577 - DNA, 3007 bp, Toxoplasma gondii
atgttcaggcggcactccagtggctagattgccctcgtgttaaacgccgtggaacgcttcttaggtttgtatgtgcatttgctgtgcacactgcgtaactgcacgtcgagtgtagaaattgagaagacgcagtactcgtttctttcttgaagcttcacgtggtgtggcgtgacagtccgttgcacacggtcccggcgtagctcatgtgttaaggtcgcgggtcagtagtggagtcgctgtgctgtgctccagagcagcagagacgaagagactgcagagaggacgtcctttcggaatcctgctctctctgccgtcttctctgggagttcttggctgtctgtgctcgtggtcaccgtatatcgagttcccgggaaaggttttttccgagagcaggcagtcagcaaggtgcggtttttccgccggtgggagaacttcaatggataactgccaagcgtcggtcggagaagaagttcatactcgtgcgtcttttccttagtgctttctatttttctcggattgaacccgatagtccatttgtctcccggcgtgcaacgtcatttctttccttgcttcctgctgtagcggcagacatcccgggcaatggcagtgccaggcgaaatgcaaaccagcgaaaggtgctcgtgtagtacgtcacactggaacggaacaaatctgcgggtcaacactacacggttcgtccctggcagtaattgtggacagagtctaaatcagcgacctggcatttaggtggctcctgcccgatacagcgaaaaggtgtgagcgtaccaaaactgtaaaagaaaccagtagaattgtgagaacaggtctccttcgcaaaaaaggtgcaaaacgagtagggccttgttcacaaaaatgtcgactgccattctcaactactactgtggaataagtcccacttaggagactggggtgttgatttgccttaggacaccttacctgtgaactaggttgggtgccgtggcggtcgccgtgtatgaactaactatggcacttcccctccggctcatgagctttgttgccaaccaacagcagaccagtgtatgaacgccagctgcctgttccccttccatccagagagctgcagtgtctgggaaagtttgtttaaaacagagaaaggaaatcgtgcgcagacgccaggtttccccagagggatagagatactcgaaaaataactagtgtttctggttgcgagtgtgcggtcttcctcctcgacgctgctgcgaagaaaaatctgttttttatgttcgcagaacagtgtgaggatcagcgacactctcctcagatatccctgctatcccccaaatctgaaaatatttcagatgtgggacgggaaagtgcaaggacatacatgtttcccgtgttgcattcctgtcggctatccggcagcaatacgggtaaggggcagtacaacagcggaagcttctccaatcacgtaccagtgaactcttcggttgtctgcgcagtttgtgccatgaaagtgcgttcattactgtctcctcacaataaaaggaaagctagaattgttagggcattcggggaaagcatggcatcgggaggaatcgtgcaaccctggggttggcacgaaaacaagctatgcaaacccgtcttgtacaacagggcggtccaccgccagtttaaccctgctgctgtttcactaagatggtgaacgaacttgcatgtagccgcaagctcggttgaccctcatggtaggtcagggatcttggtcgcagccaggtgtaactgaggggtgatcccggccttaaatggttggccgaagcgacatcacggtcgcgcaaacgataccaggttaccgattggtacagcatggttcgttgatgtgtacatcgttctaccgtccgatcggaaagtcattctgcagagtagtatgtcatcgacttctagaccagacaggtctctgacggctccagttcgccccctactcctgatgggcaatcgaagagaggtcaatgtcaacttcacttaaggcgctcgtcatacctataagcacagtctgctctggagactcacgtttcgtatttaaaatgaagtagttgactgcacaataacgttagcagtttcgattgtcattgacacgtgttcgctctgcccttctaggtttgacgtcaccaacggcatcgtacgtttcatccaccacacgcagcgaccttttgcgctcgagtagcatggtgcaagaacacgtgtctccgcaacggtttctatcgcaagaactgccgatccagtcacaggtgcaaccgttccttgatataattgccggtggcgtctctttgcccgggtagcgtctccttctcggtgatcgtcctcggtggtccattgttgaagccacggatacgacgtgttgcggtattcacttggcaaacacgttgtcgtcggtgaatggcgacagtctacactaaacaccgcagcttggtaacaatactaagaacgaatgttctgcggctgaaagtataacaggagcacgcaggtgacgcaataaaactgggtccgttgtccctccctgctggcgtctccggtgattttgtacccgggattcactcaattggccaatggtagagatttcgttgcgtgttcggcctgcctcagtttttgtgtttcttccggtacactttaccccgatcttgtgtgatacggcattgaaatcaaagctgacagactggatgccagatctgggcggtgagaacctgaaccggaatagtcagtcaagaaatacgaggtgctaaaagcgtgtcgcccgcagagaatggttttttgttcgtggcgaaaggcgtggtgctcagatgaggactattgattttctgttctttcgaagtgggaatggtcagaatcaaactgtcgtgtcaagtatactgcaaggattcaagagcatttgtgtgaccaataggatctcatcggaagcagttgaaaccggcgacacccgtgaccgcattcgcccgatcgagcacgctgaacaagtctgtcatcggcacga

SEQ ID NO: 2578 - DNA, 1848 bp, Toxoplasma gondii
atttcgttattgtcggcgcatctttggcaagcgacataacaaacctcgaagcgttattgtcggcgtttcggtgctactttcggattctgtgtttaagcactttcccttcacagatttatgtgtcgccatggggtatctgtggttgcagagatccagctttggggatttatcggggcacaggaatgcagagagattcaaatgccagctgtgtggttaaagccgtcggcgcagattttgatgcacatttacctgtcgttacacggtgacgtttgcaactatgagtggaggtatcttcttttgcctatcgagctttgtagttttgttaggcgcatatctgatgtatagctgcaactgagaggtgaactccgggggcgcggcatcagtttgttcgtgctgtcctccttttttttcgtaacttcaatcccctttgttaagcattccgcctcctgcgtctcgaggggttcgttgccagtcttccggcttctcgtttcctttggcattgttccagcactatcgccgattctactcagaaggcagttcgccacggaaatccggatagaatatctaacaatgtacccagaaaaacgcatgcattcaaactcggataagcaaccctgcttcgacatgcacacgtatacccatatatatatatatatatatatatattgtactcctttctttctgttcactgtttaagtggcctgctgtcaacaaatcgaattcttatctgaggccctgtgtagcatctgcggcatacgcgcatgtctgtctagccgattactaacactgccaaaagcctctccaaacgagtccagctactcaggaaagaagccttactcttggcattaagacaaacaccgctggcacatgtttgtagacagagacacagaggatcgattcttaaaggataaaagaactctgacgagaaagcgcacccgaccgtgaatggcctgtcatgacctcatggaacgtgtaagctgctttcctggttccttaactgcaaacaaaacgcatatatatatcgtgaatgacaattctgaaatacatttacacgctggaggattctgatgaaagaatcctacggtaacaccgacaatgaaggttcgaggtttgctacgttccgtgcaactgttaacgacacggtagagacgaaattccctatctacttttctgtgtcgaatggagccctgcgaaaattgcagaaatctgaagtttccggaatgaaaacctctcgacagacagggctcgatggaatcaagtgctaatttttggaaatgcgtgctttttgtggaaggcctcttcggtgtctccaactcaatgtcaataccggccgcaggaacccggtttcaggcacatgagacaaagagaactcttttttgattttgagtacacgaaacattggcccatcacgagtttctcagtcccttttctccggtaaaaaacggaggaagaagtcattctccgacactgatgccgcgcacaggcgtcaaactgcactgacacaccgtttctagccccactgtcggtagaatagagaaacacacacggacatacttcttctcttctattcctccctcttccgcaaaaggttttctctttacgagttttagaaaacccccgctttgttctttcgtccagctcttcgaacggctctgttttgaactttcgctgggaatagatgcggtggactttcgcaaagacaggagacacgccacgccccttttggaacgaaggcgcgtctcgagcttgagaacatgcgaggaaaaacttggaaatatcaacaatcgagggttgactgtcgagcatctgttcgttccacgtccaatcgccggtcacgtgaaacctaaa

SEQ ID NO: 2579 - DNA, 1766 bp, Toxoplasma gondii
acaggcgagaaagcctcttaggccgcaacctcagaggcagagagaaaggagagagagagcaggaacagggcggagaggaaggacgcgacgggaggagagaagcctgagagagagaaccggcaaggacgggaggagagcgaggaaacggagaagaagcctgaggaggggaggaaaaaaaagggggagatacactcccggcagtgtttgcggctgacgtcagaaagaagacagaaagcgattgtggcaaggaaacggagagcaacgcgtgagaccgcggaagagcagaaggcgggcaaccaaaaggtctgcggatttgcgccgagtgaacgggatgaagaggaggaagaaacgcgtttggggagcgcgcagacgagatagagaagacagaacgtcgtcggcagctttcggagaagtccggacagaagaagagagcagcagaggaagggggactgaagagcagcaagagacaaggacaaaggcgaagaaggcagacgagagcaggacgaagagacagtcgagcctgcatctccgatttctgcagaaggcagaggctccccgagagattcaggcgttctgttcgactggggagaaacgcgaaagcactgactcaacgagaaacgcttctgcgtcctcattgtgaagactgactggaggacgagagaaaacctctccttctcggaacgcgagcgtctcgacctccagcctccggagaaggccgaacgcgctgaggtgtacagacacccggggcagtgggaagactcgaaaagcagacgaaaacacactcgagagaagtgaggcaagagggtatacagggagctgcaagcaagaaagcagaagacaggaagaaagaagacaaagagagaaagcaaagaaagcaaacagacaaagaaagaaaccaacgaagaaagcaaacaaacaaagaaagaaaaaaaagacgcctttctcgtgcatgagagagaggcacactgtgtatataacgtcggctgcgttgctgagagacagacgagacagctgtttcaggactcccgctcccgagagctcgtcgcatgcatcgagatattctggaggaacgcacagaaacaggagtgaattcacccttgtttctctcagcatcttttgactcaattgagatccgcttcacaaagaaagtacacagaaaaggagaaactccgcagcttgttcctttgatccgcaaagaagagcgaagcagccccgttctctctctgcatgcattgcgcgaaaaaaatcggaagcgctctcaaagtcttgaaacttcgccatccgatcgtgactgttttctcgttcttcttatttttcgtcttccgtgaccggtgtctcctctcatcggatccccttcttccaggcgtcgatttcttttccagcgtctgccgctgcatctgcgttgagtcgctgacattttcgagcgcagagactcacacgtccttcttcgtgtgtttccccgttttcgttttattccactatttttccttcgttgcctggcgcgcaaacttctcatccttccccccgcccccctctgcggctggcaaagcgaaaacggggaaactgttctcggggatcctcttgactcttctctctcctcgcccacaattttctccgcgctctttcacttcctctcttgggtgctcgtcctcttccctcgttcctctagcagttcggtccttctctcttcttctcttcttcgctgtgctctcttctcgcctcttcacttgcgcctctgtcgccgtctgcgtcttgttctctcacca

SEQ ID NO: 2580 - DNA, 3180 bp, Toxoplasma gondii
actcactcgactctacgcgcgtatacagccgtgcatgtgcgtctgtgtctcccgtgccgatctttacactgttgtgtccagtgtgtgagctacgtcgagtaataaaagtagaggtagccgtgcatgcaaataaactccgatttcttgtcggcggtggcgctgcctagtctgcgtcggagtgtatgtttttttagatggctgtcggtcacattcaagccgatttggttagagaaacagactttggaaaggccttgcacagccggagcgtgcatgcacagaactgcgatacggcctcttgccgctgctccattttcggcggtgcttcataccgctcgtatgcggtcccagttgccggagtttttcctttcagacaaaccagcagaaacaggactatccagtaggccttaccgttcttaaagttttgagggaagtaactcacgcggttgcttgtgccccgattctttcgcgcactcctcaactttgcctttagtagaagcgatgccttggcaggtagacgtcggtccacatagaaatactttttctcgaagtcactgggccattcatctcctccagaagccccttccgatcgcggagttacggcgtgctgttgagtttcgcataggcatcttcgggagagaccggggaacgtttttaataacccctcacgggggggacgcagaagccaaggatataaagagaacccaagagttttgcacgtgctctggtcagaacagtctgaaattcaaaacgtggcagactgttttttaatgccctgacacatcccctcgtatgtgggtcccccgagggggcggcggctcttcaatccttttacaatcttgctgcccattgaaaagcaccgtttagtcgactgccttcttgcgtctcttcggacagcttggcgtgcatccaggtctcacagaaacaagcatttcgacttcacgactaggtcgagtgcgggttgtccgcggtagttccaggattgcattcgtctggtacgaacgcgcatttctttctccaccgcaactagcacgctgaaacgccatgcacgagtttgttctcgtattgctattggaggccaccagactctcaaaagtctggacaactcttttttcgtctctgttggagctgtgggtggcagagagaagcgcgcaattcttgggatcgcgcgctcatggttctggctgtggggtctgaactagcgtttccttgacaggctggaggcgcagagacaccaacagactaaagcaaccgaactcctttcaacatcagtgacaatatcgaatcagacacactgccctgtgaaaaagtacgagttgccgccgactccggctcgcgttccacgacggccgcatctgtgagtgttcattgccaagtggctcggtcaagtctgtgggttcgcgagattcgacactattagctgtctcaagcatccagttgcgttttgtgtccatcagtcccgattaacttgactgttcttcgtagctggagtcagagccaggatactaggcactctggtcggtctgtttagtctgtttatccggtttgcgcggtgcagttctggatcgcggatcctacgtacaggggggcagaatctacttataatgatacacttctgcacaaggtttggttgtgccgcgcgcttttcgcgtgacaagtgatcccattttctctgtttgcatttcagaagcagagtgaaaccgtgttgaaagaccggcgatcccgacttgacggctggcagtcgctgcgttagacgagtaagccgcctgtttgcggcttgtgaactccacgaagtggagtctgcgactttagccgtgaggaacatttcttcgcagaccgccaagcctgtcagcaaacacgcgagaaagtcgcttctttgagtaagcggccagacgcagctagccagaactgagttgtgaatgctcgagctcaggtgtccaccacctgccccaaagggtcagccgcaccggtatgtccattcttttcggtttttttgtgtcgaagaagcgcgttctagacggtgggtgacgaggcaggtgtcattggattcgtgtggttcgaccacaaagtgatattcttttctggaaggacgctgttgaagattcgcgttggttggcgcggaaacagcgcgaacgacccgctctgtcccacgaacatcgggaagcaacgtcttgcctcgcgcgttactcgtgtctctggaggagcagcgagagcgcggaacgacgaggaaacgcggcacgtgtagagaaaggagaatttgtccgttctttaaccagacagtttcgaatcttggcaaaaaccgaactggcgccaacccccgggaacttccgaaaccatgtcttgcaacgcgtgtctctctggtaacaccggggagggtcacgggagagcgttgggggtcgctttttttcgcacagcgtgtcgaaagtgtttgtcaaaaaaaacgcaaagctcgggcgtcttattccgagacgggaggtcttcccccgctcctcgtttccgcaggaatgttgggctctccacggaaccaagaagaattggacgctgtccgtttcctccctgcttcaagccccgtcgcctgttcgtcgctttggtccttttgtgcggtaaatgtgtgtgagtcgcactttgaccttgttctgtctcttcgttcgcctttcttgctcccccatctgcattctgagaaagacagagaccctggagagcgtcgctgccgagacggcggggcgcgaagcactgtacaatcggctttcgtcaaggccatcctttcctcgccgttcctttattttgttttcctgctccctttcgctctttccgtgtcacacactcttccgttgcccctgtcctcctcttgcgcctttccgggtctctcatgtcctcgcgtctgcttccctttgcttcttttttcaaggtctcgactgtctccgtatgtcttccgagttttttttcgtttcgcactccgttcgcgtctccctttgttggagagacgaaagcagtcgcctctgcagcgcatgcaggtgccacaaagaatgactccaagtgtatggacccctcgcggtctccttggcttccgctcttcccccgctgagagggacgagcacagagacagaacacacagaacgaaaacgagagattgacatcagggctgtagagcacagaagaaagaagaaacgcaggacgagaaga

SEQ ID NO: 2581 - DNA, 4342 bp, Toxoplasma gondii
atgtgcattgaacgctctcgaactgttaacgtcgctaggtactgtagagacgttaagcaacgtgagcgataaaaccagcgtcgttaaggcaatcggcgtagtgtgtccagcggaattcgatctgcatatcggcagagtaagggggctgcgaggccactctgacgatcaacttcttacgcatgacctggtgatgcgtcaccatcagaaaacccatttattgtcgaaggtcaaagatatgtgctggactaactccccgaaggtggagggcctacatatctggttacactgtgtgatatcgagcgttatgccctacgtaacctaaaacgattccccgtgcttcggtaacgcaaaggacttcaaaacgtagaagctggttgaggggccaagaaaacaaggcaggaagcttgtctttctaaagaagtgtgtagagagcgtctgggttgtttcgttgtcttttggtgagatgtgacaaaacaacggacgcgcaaatgaagttgaaacaccctaccgcaggatgacacgagaaatcatctgagtctaccacccaactcgaggtgccaaacatattgtgttcgaacttttttcgggcacccgaagctctgtcggttgcatacactgaagctgtcactcatgtggcgtcggaacctcaacttgccaacacttgagtgcactgtcgaggagcggaacagcgcaagccaggcgccgcagaacagaactattatgtgcccatccagccggtgtgcgctcgtcttgaatcttgatcctcgtgtctgccagcagcaaaatatacatgctgcggcatttgcagcacagcactcacggaaagacgcatagtacgtagacgagactctcgcatcatgtgcctgattcgccgatatggccattgccaccggtcaatacattggatcaaaagcatcatgtaccacgggcgggtcaccgccgtttctgcttttcgagttgcacaggaaagccaacagatgtacgacccaaggattcaaccgaacgtcgaaaaattcacggtcgttgagggtcggagttgcgcaatacaagcaggaggtctctttcggtttctcatatgctcgtttttggcttgctgaaccgcgtccccaggtaacgccatctggccacacatctcatgcagcatctggtcccgatgccctagggtcactacatgtgcgagagcaaaggcccttgaccatctcaaacgggaactcgatcggtttccctgtcgtaagtttcgccgcaaaaagtgtctgcgccccgcggtcaattctgaggctaccgcctgatctgccgctataaattagggtgatagcgcgctccaaattcacccgtttcgctcgtgcgtgtgccaccaccgggcaccacgcatgagagaagtcctggtaaattgcacacttcggctgcagacatcttgcagacgtgtaacgacaaggcgccatggggattggacgtctgtcttatcatcgattcgtatgaacgctgtttcacttgggagcgaaatgctgttgtctccccagatgtcttcaattccatggaagtacgtacgtgtgagtgtgtgtctacgtgcctctggtttgtttcgcaggcgtgcacgtcggatccatggcaacggtgtttcgcagcgttagttccgccttggtcacgatgttcttctcttttgagttagcctacgcgtcagaaatctctctgtgtacactttcggggcaaaccggatggagcgaacgttcgggtgaccaccgaggtcgagtatgtacaaaagcacttcgcttccaacaagcacagattgtgccgcatacgagcccctccgtccggacgactccctcctgacgaagcttcgggaggcgaccgcctggagtggcctgatggattacctggtaggcaccccctccagtgtcactgtgcctcgccagattacggtgtaactttctttggaatccagcgtctacctgcttgttaccttcaaagcgccaaacagtgaagtgccttcagacggcgtttcctgcaatgagcaccattgtctcagcgctaaacagtgcggagtgagagcaagtacgtgtatctaagtgatgattggcacaacactgtaggagatttcgatccataacagacagcactgcatgaacgttgcgtgtagcggtgaggatcctgccttagcgggggctgtacagaatctaagttcctgcagagggtacagaaactagtgcaactgataacctctgcacgttatgaagactcccgcgcgtgcggaagtttacaggagtatcagcgttgacaaactattgcttcctttttcgcatctgggaccaacacatgcggatgtgctttaattcttagtgcactgaagaaggacccccttttcagaggatacccactctgtctgacgccgtttcttcgaacccgtcccgtttcttggctactgtattgagcaagcgtccgcttgctgacatctctgcagccactccatctgaagctgagctggttttacgcggtgtgttccagggcatcagcatatcagttgagggccggcgaacggccttcttccgtgctccatcgagctctgttatcgtccttcagcccgtcggaaagcatggggcgcctgtggtcctcaacgccccttgacattctgtgtatcccaagagtgttgctgcagccaaactactaatacgttccctagggagtgaaactgaggttgcgtgctgctgaccacacgatggaaggatcatcctagcatctaaccagtagtttcctctctctgttaatacgaggaatgccagtaatccaaataacacgcccagaacatgaccgatgtggaccaacctcgatgtcgtatgatattgaaatcaacacttttagctgtcacacatggaagcgaagccggaagtgaaactgctagaagtgtggagtgccataaaggaagccaccagtgttgcctcgtccgctcgtctatcccaaaactgcgctaaggagggacatgcttcggattcacctagactgacccccgcacccgtcagacggcttctgcctcccatcacgcaggaactctttcatcgctgtggttctgcgttgtggtggactagcagctgcattttacgagagtattttcaagtctaaagtctctcgcggtctcacccgagcgcccagatgaaagctcactgcagtctttgtctttcagacttaaggccgtagacagcctcgtacctcctccgtgtctttgccacggcattcttcgcaaaacgagttctccacagtgaacgtcaagggggcacacagcgagaggcacaggctctccgtttttcctgagcctgaaacggtcactgtggcgcattcagaggcacactcacacgcgcgcggcctgacacttaggcggttcaactttgcggttgtgacgcgtttcaaccgacacagaatcgccgcgttttctggctccgagacgcgcaaaagcaaccaaaattccaaacatatttccgcggcggccatgacaagagagtaagcaccagaggaggtgtaattttcgacgagcaaaccacgttgttgactatctgctggcacatcgcctttcgagagagctgcgtgcgtcctaccgcctactaccgttttacgcgcctcccgcttggatgaattttgctgtgcctggaacgcttcgccacttccacaaccgcgaatctaaacacaccggggacgcgtgtctcttcttctgtcttagtcactgcctgcttttctcgaatgacaacgcggcgcggccgctgctgtgagcatgcatctcgtgcacatcccgtcctcatcacgggtgcaccgaaggaactggccgtcctcttgagtttctttggaaaactcgtagtatgctccgtcatttgggctccgttccgttcttttctcgctaccgtcctcagagagtcaatttttacggcgagtgtgtgctgctcaaaaaccaggttccaggttccactgaggacttgacaacttaacgtgcggcggcttcgattcctggaaatcgttcaacgaatttctccttcttagtctcgatctgcagccttgcaaaggtccactgtctctcttgggttcctgcgaggctgctggcgtttcttcgctgcactcttggcgaaataaattgtccaattccgcgctgctgtgcgtaggtaaccccgcagacagcaaccttcgcctgcggcgggagcgcagtggaaaaggactcgcagatgagtttgctcctcgccgtgaaggctttcttcgtgtgaggcccaaaaccaccaggctctccagagtgtatttcccgctggacgcacatgccttaacgaaggaatgcaaaactaacaagacctaatctccacattgacgacga

SEQ ID NO: 2582 - DNA, 2127 bp, Toxoplasma gondii
ctctgcgagagggtcgaagttcagtctctcttctggaagagagaacgcgcgaagaagcgacggaagctcaccaacgctgaggcttgcagacgagagagtggagagtctctccggcacgcaggctgaggctttgcgggagacactcgcagccttcgtctgatcgggtgtgaaggcaaaagaggaggagactggacttcctgttgcaccttcttgcttctgttcccttcgcgcggatccaggagatccaagagaaaacgcggaaagagctcgcgcaacaaacgacgaggcgcgcgagggtgcaggagcagaggtgactctcctcattctgtcaacgaaggaagagcgagagagggcgccgaggccttcttccccgggcatcggagctcccgcagcgctgtcgtccatcttgagaaggtgagaaaaccttcagaacgtcgggtggtacttggatccggaaacgtgtctgtggagtgtcagaagatttttgaggggaccttcttggaggcttgcccgttctgtgactcgggagtctttcgtcgccttccgctttcgacggcaagcagcttttcggcgtctagacagcaaaaggtggacacaaacggagagtactgaagcgtggaaagaaagagttccctggagagcaggtcggaaacgaacacagtcacggcaaaaaacgggaggaagggggacgagcacacgtggaggaggcagacagacgaccagcgacaggggcgctgagagcctccgagggaaactgcgtggcaaactgcagaaaaatgctgatcttgtgtttccttgcttctctcctttctttctgccgggcaggagcaaggaaagaggaaactctgccttttgaaaaaacgacgctcttctctcgagtatactctctatcccttttcccggagggaacgaggttttcgctagcttctgcacgagttctcagaattcaagcgtttcatgcaggcaaagacgctgcactttttctttgtgagaaatatgctgaagtgatttttgaaaatccaagcactcgccagaaacttttgctttcagatccaccacgcgacgacttagcgctcgcgggacggcttgggctctcgttcgatcacagccacttctttgctcaaaagaaggagcgaaaacgctgtggttaaatatcaacaaggattgacagaacgcctgccattacagcgtcttctacctgcaactatcaatatgtaaatgtacgtatggccagacacatctccgttgagatgcaaaattcagaacggctgagcgtcgaaggcgtcaagcgcgacacgaaatctgacatttgtcttcttcaccagttgaattttaaactctcagtcgcgttgaaatcgttcgccgagtcgcttttcgtggttctcctcagtgcaaaagggagcatggacctccaggaagttatcgctcgacttggctgtcgccgctgtgccgccggcagaagacatactttacacgacgctggacatcaaagctcacgggtactgacacagcagctcgcaaatgcatctttgactgaatcgacgcaaagtcatataggcagcctgcaacaatcaaatagacatttcttcggccgcgactcgccacttgggaggaaacgacgaacgtgtcaaatgaggcaagccccaggagcaaagattgggcctttatgaaaagccacttcctcctcggatgtggacgtctctgcagaccatgaagaaacttagtgcagagactggatattcggtgagttgttgggtcggggcgctttctttggagaatctgtcgttttctgcgaagatcgaccgcaaacgctggcaaacgcgcgagcaccgtcacttccccgctctcgctgcccagcgctgtctcgaaactccttcgatcttcgctcttgatgagctgagcgtcgcagaccgtgacgtaccctgcaagacggaggccctgctttccgggtgctgttcttttgacggcttctgccttctcctgacagtactggaacggacatcctctaaggaatctgtttcggagaaaatgttaatcgcaagactcgctgcgccacggccgcaaattgccgtgtcgaaacccacgtgtcttgcagctatgccaattcgtgccacccggtggaccaca

SEQ ID NO: 2583 - DNA, 1165 bp, Toxoplasma gondii
ccaggtgtacgcacacacggagaggactcacagttggaagtttcccccaccttctccaaaatagcttgtccccaaaacgcctccttttttggtaaacgaaaccgtgcgccggcgctacgggcagcctcgtacgcttgagaaaacaggaaaaatgcgttgaaactcacagtccaaaggccgcctagtgttttcttccatggctgttaagctcctcttgtttgtaccggtcaagggcggtggcgccacaccgtgttccgcagccgcagtgacaccatttgaccctgaagaagaatgcggggagatagagaagacgggagaacgagaagggccagggacagctggaaaacaatccaccgagggctgaggcagttcactgacagacaccacttcagtggagagcttggcggcgggcggagccccgacaaaagtcgagtctgtcgtctccttgacttctaccatgaccgcggtatctgtcatccacgtgagaaagaaagtttctctcttgcacccgagaggaccgatctcggtcgctttccctcactccacagggacacggagattcgacggagccgaggatatgccgacgtctcagtcacgcttgaaggcagagacggaagtgactagcgtccgaggagacggaattccaaagaaagcaaagccttcaacgcggcaggaatctctctgggaagattcgatgcagaaggggaaagaatggcaagaaaaacgggatcagacaccatgtgcttcatcggcaactcctgcttcctgacgcccaagggggacctccggcagttcgggcgcccgacatatctacggctgacgaaaaatgtatcgaaactctggtacaaccacgacttatttggggaaacgtccagcctgtcgttggatcccacaaagtcgacagcgtgggggattccttggaaacgttcgtcggtaccatccagcggacacaccaatgtgccctgccagtggtctacagctttcctatttagcttggtcaaactccgacagaattcaacagtggtgtctgtccatccgaagtttttaatgtactcttcgttgccgagattcaagacgtcaggtccaatgcaacgataacaggcggatgccagtttgccacagaaaagcctctcgccgccgaacagtagagaaatatttaagcaaa

SEQ ID NO: 2584 - DNA, 1418 bp, Toxoplasma gondii
ggtcacaagcgttccgtttagtgtgagaacgcgcccgcactctctgccagcgccacatcaaaaacgtgctagagtcgccaactcaaattctttctctgcttaacaaacccagctcgtggaggaagtcgatttgccacagacataaacggtgtcgtgaacgggggcgaccacggaaatccgctacgccttgtgatttcacatacgccgacaggtgagacgagactggagatatcagggaatatttatcaaatgtgcctgttttttgtgacgctcagacgaaaaagaaaaacgacgcagtctcgccccgtaatggacctgttggttttttatccttgtccgcgttggctgcgaggtcggcaacgtagttaggaagcacgtgcacgccaaactacgtgcaaactgtaaacagttcgatttgctgttcagtgggcgaaatctgtttgcatctaagcttctgccatgggatctccatctttcttggttcaagaacgactgaatgccctggattcagtccaatgtggcaagaacagctgaccgttactccacatttgaaacaatgtctttcaggggagaagagaaaaagagaagcgcctccccagcattatgcagaggcatgactattcatagttgaccggaaccactgctgcactctagagtccctaatatgggtcacagacgcgttctgtcaccgagttgcgtctgcaaagtatcacggcggaatgcgagagctttgcaccaagcgagcagcctcgaagggaaccaaccgcttctcccagtctgaggttggccagtcgagattgagttcgcgaacttggctgaggcagttgacctcgatgtgcgagaaaggcattgtcctcattgcagagatgagaccaggacaaatcacggtccaggatgacgcggcttgacgtgtctctctattcgagagtgtttttttctcattctttgaagtaagttgatcatttgaaggaggaacttgatgtctgtattgcatgcaaaaagctgcatgcatgtgtaagcaaagcggcagctgtcgcttgcagaggcggattgaatcctcggtcaaacagaaaaaaccttaagatggttcattcctttagtgctgccaccggcgtgtttgtctctgcatcttgacccgcagtgtagcttgcttctagggcgtcctttcggccatacaccaacgtgtagacccccttcagacgccaaccgactggaaaagaggcttctctgtcgcgtttagcggtcagcgctgctgaagaaacagcagctgaaaccggcgtcccattccgcagttcgttttttctttttttcgcgacgaactttggctccctttcccttgtcgaaggagtcagatctgcgagtgtctgccataggatttccggctctgtaaagtggccagctcgctcctttttcggcta

SEQ ID NO: 2585 - DNA, 1981 bp, Toxoplasma gondii
ttgcttcgcaggcgacagtgttcgaaggaggtcctgagacaagcctgccagcgaggtcagggaagccttgcgtctcgtggggatgctgggcgcagctgcgcagaggcagactcgcagggggaagaagtcgacagcgcccgatgcagcgagaccccgtcgccaccaccagaggggaaaataccgatgaccgaaacgcatgaacggaagacgacgaagagggagatgaggagaaggaagcagaagaaaaagaaggtgggtgtgcgcctgtcagtttgactgggtggagctctggatcctgagacctctgtgggtccgagcagaaagaaagagtgacgtcgggcgtttgaagaagaggcagttgttctcgctcttgctggtccttctctcgatgtgcaaggcggcaaccttcactgtgtgctctcctctcctccgcttcctcttctccaatctccagcgcgaatcctgctaagacagtccattcgccagtcgctgcgtccggcttccctcgtctcggaacagcgctggcaaagacgctgaagagacactctgcgaccctgtccccgagagaccgagaggcggcgcttgcctcaggagacagcgacggagagtctgaggaagcagacatcgcgcaggaagggatgggcaagacggcaaagagagagcggcgatcgaggaagggagcgaagaaccaggcagagaatgaaggaggcgagacgcagcctggagaagacgcgagagaacgaaagagaagaagatagagaattggagcgggggggaagagaagaagacagatagtttcgacgccaccgagcagaggtgcaacagagggggagagagacaacagaggaagaggcagagatgggagatcggaagcaaaagttgagcatccaaacattgaaacaatgaagggagaaaaaaacaacatccgttgtcacttgccgctctccaaggcttcggggtgtctatccttgtggtcgacgttcgcccgatgctgtctttttgtgagagctgtctcctcacgttgggacatagacgagaaatcaacatccatttctactctcctggagtctttgtcgagtgtttcgttgcaggatctgtttttgctcaacatgcaaagttcaaggatcttcaagactgaaaaatcagattattttcaacgttgaagtccttcgtcccgcaccgaagcggcttcgctgtggtgtctccttcgcaagacactccaggcagcttctgtagaagcgacgtctcggaccgcattccctccataatacctgcggcaactccgccacaagaaattcgttttttcgtgcgaagaaactggaaatccttgcggtcccgccttggctccaagtcggaaaagaacgcgagaaggaattcgccgcttttgcctcaacgcaactctcaacgaaaagtcgagaccactctggcgttctcggtgtctctcgtcgcaaatcgtgccagctctgagttcggaagtatcgcgtgtctttcgcagttccttgttcgtgtgcagggctgaggggtggattgccaaagcagatcacgttcagttccttttcttctggatctgcagtgtttttctctgcagtcccaaagtgacccgagcccagctttcacagcgtctgccaatctggatgctgagtttcgcctctctcgctgggtgtgatggtctgtgtcctctgccgcttttcctcacccatctggaagacaagcggcacggttctatttttcccttcggtgtggacgcgccagacccgaggaagcggcgacatctgccgctttttcccctcggggtcgctgggctgggggcttcgtaactgcttgttctgtgcgagcgaaaaggcggacagatcccgttcatgaactgtgacactccagacgcgcgagggaggaaactcggagcatttcctccacaagaagagtccgtctggggccgacttgggttgtggacacggcgcaggaccttggcggcaaagcacca

SEQ ID NO: 2586 - DNA, 1402 bp, Toxoplasma gondii
acagagaactaggacctgtaacggagatggaaggtagacgaaagcgaggcatcttttgtgtcttccagttagcgaggaagaacgtagaaaacactcggtctcagagagggtcgtagcccacagagcggcattgttgtcccttgcctctcttcctccttttactgtccttctcctccctccgatccttttctctctctcctgaaccctcgcgagcttcgttgccgaagaagaaacacctgacaactcggtgcgagtaacttggcagaacagagccacggggagttatgggtgacactctctcccctcatacagaggctgaaacaatagtactgattttcataatagaggcgccatactcaagtaaaacgtgaaaagcgtggacgcacgtgtcgacaccagaacgcagatacacttgaggccgccagaagtggacagaccaagcacaaaaggccgcgctgacctaacggcaccgatggactacagtttatcaacagataacagattcgtaaaggcatgtcgagacacacaacactgacgtctcgacacacgacagctgattaatgtgaccgtttctgtccaagcaccggcccgtatgcatgtgcatgcgtatttacatccacacctacatgcatatgggtaagtgtatctctctgtacaccggtacacaggtatatgtagacagatgtattcgtctacaggtctagatacgtacttgcagccgaaaacgatgcatcgctcaggaatctttcatttcctgttagcccaaagtcaccgaaaacaacgacagtgtgtccgagtaccgacgacggcagttcttatcccgcgcttcgtttgtcagtgtctggtgtttttttcggcacacaggggattccatagaagtgctcgagagctcgattggcacgttatcacggaaatccgcacacaacaagacaacaagccgttttccttcccctttctggcactggttcctcttttcttggcattcgctggctctgcggcacccgttttttcgcaggtaagcatgcggtgtgtcgctctcggcacgaagccgactataagccgaatcgacggggcgcagcggccgcttggagggagttgggcgagggaggcgaacaatgagcgaaaaatgggctgcgagtgtgacttttctcccgcgtttgggcagtgcgtgttgcggcctggaggaggtttctcgcaagtttatcacgccccgtgtttgtggggtctgcgctctgcgcgagatcggggaatttcgctgcatgtcgtcgcggttctcttccagcgcaagtccctcactctatcttgtgtgtttttcaaacaaggcgcgtggaaagagggcctttctcccttctccttccaccctcgtcaacatcttcgagcaaacaaactgcctccgttacaa

SEQ ID NO: 2587 - DNA, 2685 bp, Toxoplasma gondii
acatacatacgctatccaacgcaaaactcaacaccgacccaattccacccatgctctaatccttacagcacgaattactctaaagctccaccactctccttttacatctacggaaccgcgggagtgtgtacatagttgccgttgctgacagctagtctcttgcatcagcgctacatggctgctcctccttttcgtcgcatgagatgcaatggctcgaagaggcaactaccggacaaaatgtagcaccctgttgccattcagcgtttgaaacgatgagacatggtgatgagattatggcaaaccgcacttactttcatgtcgtgagaacgcaagtgtgtccttagagactctatcaacgctgccgaccgacacatcggtatcagcttccggcacaacaacccgaatttcgccaggagctctcgctccggccgctttccaagaatccgctgctgcctcttccggcgtgctgaaactctgcatcctgatgacggcttcaatctgagaactaggaattgcgagaccttggctgttttgtgcaaccacccggccgacacccattagcgacccgtctaacaatccagaaataacagctaataccacaggcaggcacaccatacagccgcctccaacgagccctctcctatggctgaccaacatcgccgaccggtccgtaagacgggaaccagatgtgtgtgcaacgcgaggatccatggtccggagagcagaacgagaggaaattaccaaacaggtgaactgtgaagggtgaatagtccagtcttcactgagtcaggcttcctttgtctttgaaaatcaaaggggaaaagcggtggctcccaaaaatattattgaaaaagggcacaacgtggaacagaagacccctgtttggcgacacgccttccgacggacccacaggaactgttcagaagtaggaaacactcggtcacgtggtgggagattgaaatcctacaaaggggaccaccttcaattacaaaatgtcttagtttgtctctaggaacagctatgaagtgacgatgtggtgacgaacgagttaatgaagaatgaaaaaatgaggccaaacactggtgtggcacaccagacggagcgtttgttgtcggttcctgactacgcattcgcagcggggaggaatgtatttgacatccatgaacaagcatatcataacaactctacgaaaaagtgcagttgagaaccgagtcacagaacctgttttaaggagtgcacaaacaatcacaaggaaagcctcgaccgcaattaccgcgctcaccaagtcactgcagcaaatgctgatttttggataaacagtatgatctattgtcaacgagtttccggcgccccatcactttaaaacacagggctctaagagagagggcaacaatacggatgtagttactttctggtttctggtgtgcttacaaataaactgcaaggatcagggctaattcacaccacaccatcgcaatgcgacgctccccatccccctgtcgtaacaccacgagagcttctatactcccaacagaaacagcaacacagggtgaaaatcatcaaacttgctcgtgtttacgtgattagcaggaaatcacgctgtgcctcagcaattctctattgctacctagcaagcacctcgggatggggcagagtggaacagccaccggctagcccgtcccttgctctccctaggcaggtaccaagccacgaaggagcagcgtggcgagcagcgcatacaagggttccttatcaggtacacacgaaaaatacagagctatcgggctgccgaagcacaaaaatgcaaggaaatggagccagccttgctgcgtgtggagacacacatttgggatggaagcattcgtaatggtgggcacttcaactggatcccttacacgcttctgaaagtacacctattttagggttgcatctggtactatgggcggggaggtgggggggggggggtcacgagcagacgaaaggacccgtccatggcggggagaagctgtagtagagagaagctgaatccctccaagtagagtatccgcgcttgtgttttcatattcgccacgaatttttcagcttcctttcccctctcaaaataaaacaagaagtacagggtccctaatggggtctcttcatatatttataccactgttttgtgcagcaaccgacacacccgtatcgactagttggggagtagctgcgtcatgaatgaatgacctgtggcgagagcgcgattttgcgccgtcacaggctgcgggtcgtcagctaccaggtcaactgtttccgccctcgaggtgctcgtcggtttctctttatccgctctttctcctgcttcgctcgtccccttctcatttacggaaatggctgccgtatctttctcgcgagatcatggaaaaagccgaagtcgccacgcggtgcaactggctgcagaaggcaggtccctcttcagttcaagatagcgtcgttgttcgattttccgattcgtctttgtacctgcatttgaccactggacatgcacgcttgctgcattttcttgtttcatcattctgatctgataactggtatatcaacccgtatctcggtctctcggccgatgttagtcgtgcggttcagttgtggcgcgtcacgcttttgactcagtacaagagctaaaccccagactgcgaacttttctcgaga

SEQ ID NO: 2588 - DNA, 1388 bp, Toxoplasma gondii
ggttagcagtgagggcgtgtcctccatcatgcatttttcctgttttaccacgaacgcagggtccagccaccgtcctggacgcttagtgtgcttgtcatttgtcaccaagtcatcacttcgatacagagcactatttcgtggcaagtcaccttggagagatcagtagtttgcggagtagtcgacaaaataatagtaatcccctcaggcacgacagtgaagcaagtagccccagcctcctaggaaactgagacaaccgtccctgactctaaattgctcagcaaaagtggaaatggactatcacaagaagctagcaatcagtagtcttctctgcaccaaagacctgctggtttgaggacacaataaagccgatggcgagcagccttagaccggtaatgccctcccctcactgacagcgaatatccgagttaggcgagttgttaccctgggtctctgcaacgtagccgcgtgagtccgcgtatgctcaaaaaataccgtgtatgttgttccttgtctgtaaggaggtaagttccattgaagaaagagcgctacatataacacgttcacttctggtaccacataacgcttccgaggaaggcagcttggtccgatgctaccgttctttcagatctatatgggacgaatcaaaatggaatatctcattctttgcgaagaaagccatcggagacgcagcgcgatcaacaccagacttgaggggtagctctagattcggattagtgtggcaaatgagtatgaccgtcttcgttttgttagtacgcgctccttgttctgtctggcagcttaccgtatgcatgtgaacgttgctttcagcagaaattgaaattccctagttcacatggggtcctatatttgacacagtgagctagcccatttttactcaagttctttatgaagatgcaagatgcagagagaccgcgacctatgtaccatcgtctccattggccagctgcatgcatccatcctccacgtgtgccttgaacgcgattttgatagcctcctcttgtgggtcagccgtcatcggtatcagtctattggtcatgatgtagtattttgctcattgttgaactgtctctattcattgttattgttcgacttgtgcctaactgacaagggaaggaagctctattggctcgtgtcttcccccggctgcatgcgatgtgcagatcatgggttggccaaacccccgagcacggcagtgtagcagcgtttcctctttgttgagaccgaatgtcaccacttcctttgacgtttttgagcggatgttttattcttgcatacattaccccttatttcgtcatgcgatggggtttcactggaaataagcgacggaaacacgctcccagcaggcttgagacgagatgcaaccgcca

SEQ ID NO: 2589 - DNA, 2055 bp, Toxoplasma gondii
tcactccagcgccgtcaacgagcacgcgggtctggttgatgatgtccacgacgaagcacagctgcaagacacacgcaggggggcccacagaaaaacatgtttcgaccttgaagaaagaaacgcggccgtcacagaacaaacgggaacatcaacagaagtagcaatgcttgtgcgagaaaccttcacggttccagatgcaggcaaatgaaacccagttcaccttccgaggtagggcgggcaacacgcaaaaagttttcgccgcgaaccgtctgtacagcttctcgaataccagagcggccattcgttacgccgggacatggaaattgaaatgcacaaggtggaaacgaaaacaacatgcgtcgtctccctgtgagtatcgccattcgaagtgcgtttcgtcaacatcctccacaaaaggcacagtcagtagctcagggcgccctcaggacggcccgtagacgagcaggaaagagaaagatattaggaaatcatttaaaagatgtaagatatccccggaaaaagaagtcgtacaggcaggtaaaaagtgaacggcagtgaagtttactactcccagattcctcttccttattcgtttgccgtcgtgggaggcccgccgcacgaagccttcctgagtcgcagacaactacccctctcgggacgaatgccgccgagtacggcatcgtctgtgatgaggatcacagaatcctctgtagatttgcgtgtgacatcccgatgcgacttgttttcttttaagaatctatagcatgcaacctgtcggcaacgggaggccacacgggcccccacactcagtcttgcgggcagagaaagatccgcaaaacgtgttctcgcgcagatgcctttcatcatgagaaaccgtaaacgaaaacggtacaagggatgcaacaaaacgttgtcgacacccacggtgcctcgagatttcttcgtgaaaaattccccaagtggacggaagctgcgtaggaacccacctttcctgcgtcggggccatactgaacgacgcaaagccttccaggctggtagtagcgagtaaaaagccccatctttgtcgcgcggaaggaaaaaagaaccgcagagggacaacaccaacaaaaaaatcagaattccttaaaaaggatgaccgatgtcccccaaatggtcctacggcccagagagacggcgcgcggcctttctacgaattttttccgcgcaaaagcgatgctcaccgagaaaaaaacgcatgcactcgctccagtgatgccgccagggcggtcactggcgcactccacgcaaccgtgcccctctctgcccggactgaaaattacaagaattcggcttatattcggggaagcacccagtcaactgcacttcagggtgctccgggcatgcagctcagccagtttgaggctggcacggtcgcggtcttgcctcaggcggcgagaggagacacgagttgagtcgcgacctggggtagcggccgagatagattctgcatccgttgcactccgtggtctttcggtgtcttgttacttccccgtctgagctgcaaagatctgcgctggcgacccggcagaattttcgctgctggtgcggtgcgcgggactcacagactctccaaaagcggctggtgactctcggcggttggaggctctcccggctgggtgtgcagatcagacgagctcgacgtcttgcgaggacacgagcgcgcagtcatttgaaaggcgaaggctagctcggtggaaacgagctctctccaatgagagatttctcttttccggctggacggttgtgtaagaccgcggccgcactcgccatgctcgccgatagccacgactttcgggcatgctcgacgagctatcgtgtcttcgaagttctggagtggctacagagacctccacttttctgaacgttcgaaaccgcaatctgaaagcgtctgcagttctttaaaagtccttgaagaccggccttgtttgtcgtaagatcgcggcaccccgtccagcagagacggaaccttccaagttgatgcttctgtccataagggtttgaaacctgtttccgaga

SEQ ID NO: 2590 - DNA, 3923 bp, Toxoplasma gondii
ttttacagttccgggaagtccgcacgaccttggatgttgtgttctgccctctctccgcaagccaaagttcaacagcagaaaacacatggaacacacgttgggtgtctcggctgtttcgcccaggaaacgcttgtccattctcggttctgcgacctcgggcaacgcaaccatcgtcagtccgggggaagacactttgcctgcgtcgacatctttagatcccgtcaaccccagtacgacgcgctcaaacaaacgactgcggaagtttgagtcacgctcctcaatccgcgttcgtaacgaatccgagacgacagtgaaagaagagcgcgggagccctctcgctgttcatgtgggtccaaatagggagggttcgtcgaggagctcagtacacaccgaaaaagaagtccagatgcgttttctgcccgtttgtgtgttcaccggggcggacttgtgtctgcccgagacttctcttctgcacgcccgcccgcggcccttacaggctccagaatgctttggtcgagggggatgccctcgtacacgtttcccttggtgttctccttgccgacgtagtagtacttgaattccgggacttcttccatgactttctccatgtcttccttgacgaacgggacgcgccggtactcaggcgccggacccgccttcggctgcagcgccgcgccgctcagaaaccgcttctctgtgcgctggaacgccggcgtccatacacccgaggcaggtgtcgatacacccgaagcggacgctgcggcgagcgcggcaggacgcagacacctgcgtcgaaggcaggtcgaaacgcctggtgcgtttctgcggaaaagaatcgaggcgttcatgttgacgaggaggcagccacgcgggaaagtggcaagtgcggcgttgtcaaggaaggaagcgcggaaaggaaggctgcgttccgtcaggggagggacgggaacgcggaagtcgaaagcagcgccgtaggcgagagcgtgctagaacgaagtgcgcgactgctcccggtagaaaagtgtaggcgggagaaagcggggaggagaggctgagaagggaggaagaggtccgatgcacaaggaaaacgtcgcggaacgaggaacgcctccgtctagaggacgcgcatcccaggagagtacgttccagagccgaagcgtggagctgtgtcctaggtgtgccgcagcgacagaaagaagtgacttccaagagagcggaaaagttgccaggcactccagttctcggtcttcctcgcaaaagtaccacacgcgtgctgctgcagcaacccaggaaaagcctttgggcgccgccccctgagaaaaggacttgccaccgcttttttgcccgtcaatgcatgcgcgcttaccctgagacgcctgagccccgcaacgcgcaggacgagctgaagagaaagggcctcctctccgtggcaggacaattttcacaaagaaaggagttcgcgattcactggaatgtggacggaggtggtttgcttggtagaatgctgacgttcacaaagcgaagaagtgccccgctataaaccacctcagcactacgggagtgggagtgtgataccactgttctcctctgcctgaagttctgaactttcggctttgtagacaatagatctgggagacgagcccgcgatacaccgcttaccttctacaccattcgtagcttggattttctaaggagcgaaatccgaaggaaatggggaaaacaagacctctgggaggtagacgattggcgtcctcaaacactcgagtccgtcagtaaaacgcccttgcacgaaaggcaaatgtgctccatttcgattctgaacgtgggataagtcgaggagaatgcttggttttctccattcaatggaggcagagattctttacccgtacagcgaactctggtgctgtgcagttacggaccgaatggggagtggagtttacctgctggaaactctgagagaatgctcttggtgtttgtcttgcagattgctctcgttattatgatggaacagtgctctccccattctggtagtaaagtgctctcgttattctgatcctaaaatgacctcgctattcttgtggtgagagtctttcgccactctgattgtaaatcatggggaacttcaacaggcgacaaatctacgcgttgtatgtgtcgtagggacctcatcgtgttctcacacgatacgaaacttttttaaccgagaaggtaatgcagttcaaggcccctgtagctctacccagaatgctgaagtttatcggaaaaaacaacatatgaccgcaggtagaaacagaatgctgcactgtctgtggtcacacatgcctcgtctgtaaacgagagacttgcgtaacatggcattcacattcgtttcgtagattgtcaaagcggtacgagtctcgcaggagaaagggtgtgagaaaccacacagctttgtctcttcacgcttgctctaattctttggtgaagcagtcgagttctcaaaagcagtctaccgcggcagatcactgggtccacaaggtaaattcgtgtttcagggctgctcgcgtcgcagttcattcgaatgtcacttttaccgtgacagtgtagcagcccttgtccgtcctcgatgttgcattggtgttttccgtagatatatgagaatttgaggttgctacccaacagagatcgttgctttctgcctctagcggcatttccgtttgtgtacctgtagatgtctacatatggatgctgcttcggtgaaaaaaagtccaaacagctggtgactggagaaaatagaaagcgtctctgccgcggacagcaacaagtatcacaaagacaaggacgctttccctacctgtcagctgtcaacaacaacttcagaaggcacaacagcgttgactacagacacgaaagagcagctgagacggcaaatctcaaggattagcacagacggtttcgctgcgaccaagcacatccaaaaatccagtgccaatacgcgttctcttttctgaagattccattccactccaacgtgcctccgccaccgcgccaaatcgtagaagcagttctcctaacagcagcagtctgctgagcgcaccaagccatattctttcggacacaagttgaattccatttgtctctaacgagatctctgtctaaggaagaaccttgacctttaacagttcgtctcggaacttgcagcagaattgccgactcgcaagaatcgacgcccatttccctgtttctcgtcgagtgtaaagtttaaacttagtgcaagttaatcttctgttgtatgttggtatgacggttagaaaacattcatcgatattgatatttgtatttcattgacacgttgaggacacacataccaacaaaccagcaatatattgtgtcacctgcaggctccttaaaaaagcgaggagctccattgcgcctttctcagcgtctaaacctgattctagcctccttgagtgctctagggagacatgactgtctttcgtcagtcactgtcatttatcgctaattcgtgctttcccgaagtgaaggcacggagtggtcctacggacggaaaaaaaattgtcagtcctactatagtctccacatcatggagttgaagaaaacagtcaacaaagaagggtttgcgtgaaggtgattcacttcgtcagacctccgtgtaatctatgcggaccccgtcgttatcgtctcgaggtttaccaacgatatagcggactgggcatgcacttcacgaagtctacgtccaagttcacagccctcgagacaggtgactcaagatgtacaagactacaggagatggagggctttttcataaccaagacctcgacaagcggtcagctttccgtaaagagcctttcgatagtctgtttcactggggaaaaaaagcagggtggggatggagggcaatttgacagttgcctttctctcaa

SEQ ID NO: 2591 - DNA, 2100 bp, Toxoplasma gondii
gtcgtctttggtttgtcgcacctccagcacctgaaaacatgcatcgatgggcaccttatgcctaacctgcgacgactacgacgggaatctgtgtcaagcaaataagcgaacgtatacccgtgtaacgcggatatctgtgtatggctgtaacagttacagctggccggttgggcttcccaagctcctgcgtttctgaaactccagtaaacgtcatcacagtagtcacaatacgccactcggcgttcgacaacagtgaaccacgatgtggcgctgtaaaccacgtgaaaacacacatagatacgcattgctacattaatacttgtgagggtgcaaattccagaggactacggggaaaatcccgcgaggtgcatctaacactttcacggtgtttttaactagagcggcgtgggaattcgtcatttcctgttagctctattccaactagaaaaggcaatccttcaacaaccaccgttccagttaatgaccgtagacggccgaaacctgactgcgctcacgaactactcgcacattccctttctgcgaaaatcacgttaggtgggcaacagctaaattcgtaacggtacgaggtaagaaccacaaacgtttctctctccccaacaagatttcagagaagctggaaatatctgtgagttgctaaatcggataaacagggagcgggcggattctcacatgtagtactgcgtctggttgtactttttgcagctgcagtcttttgcgtcgaattccacatccagatcctttctcgggcacggatcgaacttctttagctgcttcacgaccttgttgcgttctcttgatgtggtcgcggagttgagaagatcaattagatcgcactttttggcgccgcagtacttgaccatcgttgcgaagttggaggaagttcgacgatctactatcgcgcggctttctcagaaacagcggccggtccacaagagaggggaacggaatgcttcagaagcgacgctgccgagtgaagcgtgtataagcggtaaacacagctgaaagaaaactggtcgacagcacagcaaactggactcgtttcgccgacagggcgactccacccagtgctcagtaattcgtcgactatacacgcgagaaactgaaccagggaagtaaatctgaatgtggacttcttgcctgcaaatagttgctctgtctgtcacagggccagggctgagcgtggagttcgagtatcagacggaaaacggaagaagacggagacagaatacggcgaagccaacttctcgagtaggccaccgacagttgctgacgcggagcacacacttcccaaacttgtctagcgtcaaacagtctcttcagcacgggacccggaaaacctctttcgatcgcttctttgtgcagatgaatttctgctggaatacgccgctgccagcgtttcccgccaaagtactctttcgctgctaccgacaggccgtgatatccgctgcaactttacgcacatcgtaggaggtctcctttcgtgtcaagcgtcaaccgtcgtcgatacggtgcatgttgctcgacacggagtgcgcaacggttgagtgagccgttggctgatgggcgcgggagcgaaacccgtgcagtcatcgtcgggagatgtaggaaacatcttgagtgtttgaggctaagtggagaccttggcgacagctcgagatgaaaagacctgcaattcgagaaagctctgaatagcctccagtgcctctagcttgctcactagggggtttccttgtgtatgtagcaagcggaccggatgctgcctaaaacgacttgaatgtgtggtcagaacgaccacgtctcctgaaacgttgctgttgattacgataggcgtcaacacgacactgccgagtacgggaggtccttctgtgaagaactcctggtgccgatcgagtcgcgtgccattccataccaatttctccttgtagtctgcgattccaaatgccttcggaatcaaacatatatcattcttttccgacggaactgtctgctttccttcttcagcgaatgctgtgctccttagtcacaaatttaaagtgaactaaaccgggcactggacgtctgtgacatgagctaacgcca

SEQ ID NO: 2592 - DNA, 1688 bp, Toxoplasma gondii
ttttgcttcgagaactcaaaacgttcagatatcgcaggtgtattggtgttttgtcagagtccttctgtctcggtaaagtgtacgcgaaaccccggcggttcacagactacctgcttccgtttgttttccttgtggaattgcaagagtttggagcagaaagacacgcaccaatggacgccaaaacctgcagcacgttctcatggatttggtgccagcattccgtttgttgcatgattgtcaggacgtgtttcttgattgtacaggagtggatcagtctactccaccgctagaagcactcaccgcatcgatcgaagtcagtgtttcctctggagtcacacggggacatagaaggacatttttgtgtgagacgtctttcttcacactctctgtaaacaacgcgacaactgggcttctctgtaagccaagtcgttctgaagagaactgcaggaagcaggacggctctctggacagcccgctgaccgtttgaagtgccagttgccctctgtgttttctgtcgctgagtgcaacagtttccgggcatatccaaagatacacacaaagatgccgcgataggaaaagcagccctctctagtgaattcattagaaaactagtactaccgtacgagctgtaaaaatgaacaacattctgtgtaatctttaggtcaaaggaatgacggataatgcagcgagtctgacagctgtgtagagattcacaggattctcaaccgacgcttcttagggagagaatccacaacattcttttcggctgtcccctgtgagcagccttcagagttgatcgaagctcgtgtctgtttcctatggtttttcacaggcgcagcgtctctctttttcgtgtgcatctcattcttaaaccgtgttgcattggctttttcgtctgtgtctaacactcggaaagacatcaagttctttgcgttcaggccgtccctttcgactcggtgttaggaatggagaaaaaggtagtttacattcacctaggagtccccatgcacagtgcgtgagtacggactctagcgtcagttgttgtgtgtttggtattgcgagtctggagactcatcctgtgttcttatcactgggagaccagttccctgcaacctaagcgtgtacttgccacagcaaggaaggtcacaaagaccgagaaagccctttatgcactgtgtttttgcagagacttgtttccactgtcgctgaaaagggagagtatgcaaaatagaactactgcgcttatcggagggagcgaaaccgcgaaattccactttacaacgtgaaagcaaggagagtcgagtttcgcgatctgcttcgcgctgcatgccccttgaagtgccgagattcgcgatttggtgagacgcagccctcccttctgtctctgcgcaaagcgggccaggaatcaagcgtagactagcgtgagggtggagactctgaactggtaacgagggacagggtgcacacaaaccgcacacgcgtggtggccgtcctgtgcttgtcaaaaagcgacgaccgacgaggcggagacaacctcggcgtttgttttttagttattttttcggtccttctatgccaccttgggggactgaatcgtgtgaaccccgggcgcaccccacggtgtagcaaaaggcgcatttctccttcccacgtctccggctaaaagtttctctcgtgcgaacacacca

SEQ ID NO: 2593 - DNA, 4399 bp, Toxoplasma gondii
caagcaagcgctgagggacgccaaactccttgtccacgaagccttcggcttctgccgtagttggcacgtgaacggcgacctgctgggttttccatttgctcgcgactgtgtccggcatctgctggtgcacgcgaacaaactgtcacagcaacggctgtccgcagtcctggattttttgagtcaggcgttggcattgtttgactgcaattttttatttgccgttttgttttttttcaagtcccaactcgaacttccgaaagagtccgggtgaaaccccaacacctgctggttgattgccgctgctgcaaagaaaaacagaaacaaacgtgtgccatcatcgactgtgtgatggtgcgcatcaacagatacacgctttcctggattcttcgctctgtacgcctacgtaagagtgatcttctggatgaaaaacacttattgagacgtgggattactctaaggcataggcactgtttggatacatctacgtagcatggttcgcctagagacaagcacattcagaaacattacggaacacactgggtactgaagatgaccacggcgggtgaaagagccagtgcagttctttcttaggaggtacgaattgaactttttcttgaatttgcttcactgcagtcgactaagctctgaaaaaatctgcttcagacttgagtacacatttcgcacacgtcgccacccaggaggctttctgcctcctcgcgagtcccggcttttattttggttccggttctaccccgtgcattcctcgagatccactccaaagttgatcaccaaggcaagtgtggtgacgttttgttgcgggtaacaagccagaagccgttgacgctgggaagagagcttccccaccccattctcaggtgacggggaagaccacgccgctccgtcgagtcgtttaactcttctgatacgccctttctgttttgtgttcaggagttgtttcagtttcactctctgttgtaaagttttgttccttggtgtgcacgctctgtgtcggtcctcatcaggaaatctaacggactccttcccctcggaaccagtctccttttcgtggcgctcgtctaacttcgttgcttatcagcgaccagagtcctcacaaagttgaactttcagggatgcctcgcgaatcactgttttccacgtacacgggaattcgccattgataattctctgagcaatcaatatgcaatcgtccacgatgcatttaactctaacgcaggctcggtctaacaccccgttagtccatcataccacccgggatttctcgttaattacctccacatcatggtaagggcgagaaagaacgtgtgcttccacagggatcttgcctattcagcatgacgacagtacccagtaacatggtcctgagaacgccgtcccatctggtgagatcaactccccagctgacccgactgccgcgtctcgacggacgtttttattagttctgtgaacggcaactggaattccaacgagcgtgcagcagcgaagtgagtagacgagtaagttccgaccccaacaaaggtgtaacgagttgaacgctgtcgtcgaaaactcgtctccggggcggtgctttcttgcgactctgtccgtgtgaccgacagttttgctccgactcataagtatagggaaggcggatgcgaggaactacctagctgttccagaaaaagaagccacaccgcggtatgaaacttgtccacgacaagtcagagaaaatgcaacaactcctgcgtattcaacttcgtgtggcgcctctgttttccagattcctgaatacggactgcaacgcgaactcttccaagggcaccctgcgcttgtttgagcttcgccttttagtcaccgggctttatcctccccggcttctctggcaaattcgaaggcctcgaaactcctttcccccctttttctttctcgaatgcagcggctcaacctgcttccatttcaccatccgcgtgcttccatgctgcttcagttcttgttttttccccacccttgccttggaagaggctctgcgatcgccgggcactctccaggcggcgcgagagggtatgcaggaaaccctgctttaagggaaggacacctgatctggcagagcactcttcgctgtttgaaacgcagcggggcgaccgccttcgcttcggagcagcgataccaagcgacgaaccacgttccagaagggtcgggactctcgtcgtggggaaaatcgcctctgaggcaggactgatttcccgcttttctggcgaggatggactcccgacgactctcgcgttgcacgcctggtctctaccgagtattccagcgaggagtaatcgaccacggtctaccactaccgagttttttgtcgctgagatatataaaaatgggcagatggaagcagccgttccgtaccagcctttccatgaagagtgtacggtttcttttcgctcttttggaggacacgcgccgaaacatgcctcgccgaaaggcaacatcgaggggcccacggcgacgttgcaacgaggcagtcgagataagaaaaacgcgaggagaagctgagcgggtccaccgtctcggccgagacggattcttttttctgaagaactcaactcgcctgtttaaactggcagaccgaggaaactgctttcttcaacagaggcagggagacagaacagaacgctgccgacctcccagaacgagcgcggccaagactgagaacgatacgcgacctgcgccctgaacgtctcggagttgccacctcgtctgttctccctgcttcgtttctatgcgattcccttaaccagtgaaacacagctcaacaggagaagggcccccattgtcgattcacgttcacatttctctgcatcggcatccgtacctctctatttgctctctctatatatttgcattttctgttgtgcttcttccccagtgccgcaggctgctattcttacagaactctgcagagttcgccttcgcttcctgacgaaaaaggggcaacccttgcgttgaaagccgccgttggggcgtgatgggttccagacccgcgggcgtcgcgcctcgcgtcgtggcgacgggcatctctccagagggacgctcgcatacttctcattcctcccgtccccgttctcagacctttgtgtccgccactgcttcctctttcctttcttcttcaccttctcagtctccaccctctccctcgtttctctgctctccgcgggcaggttcctgctgtctcgttgcctcgttcggcctgcgtctgcgccgtctagacgcatcgttttcgcttcgatctctcccgggctgcttgattctcgcggcttttctgcttcctctctgcatgacaagcacttgccgctccgctgcactcgacatcaattccagtgtcgagaccgcgacagctaccgaccttcaacggacagcaaccgcagacgacttcgaaccccggagacagttccagagattcaagctcagtcagaattcgacgttgtccgaacaaagagacttcccggaaagccgcagaagaacctcgcgttcccggcccatccacgtcgcctctgctgtcgcttctctcgccttcagcaaaggaaacaaatcaaaagttttgctcagagaaaacaccggcgaagtccttcttgaagaaacacgcgatggaactatcgcctgtacagacggcaagacgggccgtgaagaaaatctcgcgaagggcggcgggacacaccacacatcggagatcatgggggaatgttgagtctgtagatgtgtttagaaggactcaaactgcgacaggagaaattccctacacaaaggatctccagagaagtctcgagtgtattcgagagctcatctatgaaaaaacaacctgaaggcgacgcgtgtacaaataggatcttcgctttggtggaactggttctacgtgggggaaacgctttccaaaattcggtaggaagtgaaaacgttacgcttcttccgtgtctccaagtctctccttgtgtgccttttcctcgctttgtatcctgcttgcgctttttctccttctccctttccgtcgttctcttcctctctcgctctccttctctgtgtgtctcatctctttactcaattgcgtctttctccttccgagtcggccccctcgtcttcgtctggagtctctttctcttccggatcccaacgctcttttgtgtggagaccaccacgcgccacccgcatgtagtgcaaatggagccccgcggtgtgtggcgcgcgtttgaaggaaccgacgcatgtgcgcttcttccgctgagtactcttctctgcggctcgcgcttcgccaggacgttgctgctgtcgtgacggttgtcttcggaagtcgagttctcgtctctctgcatgcactcaggtccgacgtacgcgcgaggcgctgtgtcgagca

SEQ ID NO: 2594 - DNA, 2221 bp, Toxoplasma gondii
taaaagagctcgccgacggcgaagaagccgagcatttattttcaggaaaaaaagaggaaaacgtgaggacgtttttcgcggagataaaattcaagagaagaaactggggagcgtcacatagaccactgcagcagaggaacacgaaaaagcaaagacacggggagcatggaaatttctctcgttttctgaactctcatcttgcgctcttgtccattcgtctcttctttctctctctctcgctccacccgcttctttgttagttctatcctcgaaacaatcgacaccgtatttttgcgcgttgcctaccacggagctcgtctctcacatatcaggacattctccctcttcctcatcaactccccgcctctaccctcttccttccggcctcgtttgcctgcttcgcctcttctcttttttctctcctgtctcctcttctgttgcttctctcctgtctcctctccccgtttcctggtcagttgagaactacgtcgacgctcggcctcacagccgacgtggagcctttctcgagctttctgtcggctgcccgaagttgttcagtctgcgcgcgtcgcctgcgtctctcctcgcgtcggagcttcgtcttcgtctttcctccgcggtctcgcctgcagaccatggagtccggagcagagacaccgggaggcagagagacgggcgacaccgacgccgagacaggacaggggggatcggcgacgggagagagcgggatggagacaacagaaagtggaagagaggacggggagagaggaaggggagacagagaggcagagagagagggaaagagataggaagagagcgacgacaatgaggcaggccgaaagtcaaagggtgatccggagggggaaggtttcgatctgagaggaaggagagaggaagaagaagacggcgactcttcacccaataggagagaatggggaaggagagcctggaaactcatgttctccagagagacagaggcagtgcctcctcggtggagcgctgctgccgaaaggagagaagagggggaagagaaagaagaggaagtttcagaagaggacgagaagtaggaagacgaacgtgagagagaccaccgcgggcgcggagaggcagcagaacaggcaaaagagaagcaggtagaaggattagcagagacaacggggggacgcgagaaaacagcggagacacagagagagcggtagccacgagaagagaaaaagccgagaggcgagaaagaagtcgacgaggaaatgagagagtggtgggagaaagcgcgactctttaagcgcgttgttgtcgccatgttcgatgctgacagagaaagacgagaaaaaccgacaggaaatgcagaggcaagaaagaaaaatggtggcggaaagcctcccgacggaacacggctctgaaaggagaatggagtagacagttggaaacgaaaagcggccggagaatttttcgacgctggcagtgcaaagaaagagaaggaaacgcagccgagaagaggaagcgtcggctgcagacgacggaaaaggaaacgaggaagagattaacaaagacgagaaagtcgagtctgtaagagctccaaagaaaacctggaaaactaggagaggaaagaggcaacaagccaagaaaaggcatgcgttgggaaaagaccggaaggcgaagcagacagctgagaagtcgaacagccgcggctgcgcgagacgtgagaaaagccgagacgagaggaagaggactcgaggtgtacgtatacgtatccccgagtatgagaacttgcgaacgagatggagagaaaatccttcatcgctggagaaacgagctttctctacgcgacagggaggatctctggtcgagagaaagaaaagacaaggccaggacaggctgagccggcatgaaaaataacagaccccccgccgtctcctgttccttgtcttccttttctgtcctctctacactcccttcttcttttcccgctacactatatgtttctcctttctacagaaaaactttcttttcaattcaaagtcgcctggacattcgcagtgcgactcggtgttctctcttgcagagagagacgcccatgcccgcttgagtttcttcctcgtcggcctgtctctctcttggccagatgccatcccggctctgcctctctgaattgcctgagggtctcttccgctgtctgcgccctgtgatgcttgttctaaccgcgggagatctttcctgaaaa

SEQ ID NO: 2595 - DNA, 3787 bp, Toxoplasma gondii
atagaaggaatttcggtagttaaagacataacacagatatttcggcatatacatgtgcttctagattcgcgagaagcgacagataggtcaatagcgaggaagatatatacatatgtatatatatatatatatatgtgtgtcgatatatgtgtgaaaatgcgcagatgcatctgcgctcctgtgaatgtttgcgggtgttgagggctgaaggtatccaccttaaaccagaagcgttttctctctgagaatcccaaggggggtaggggaaaaactggaataaaatcggttctgagaagggcgtttatcctgcctttgtccggtttctcgccattccagcaattcctaacatcttattttcggagagccacagtttgtctcgaaaacacaaaagtttctctctgaagttgctctccagcgacccagatcagttgttcccctgcatagtctgcttctcgcgttccgaacgaaagcagccaagctcagaaaatcgattttctcttcttagttcgtagacgctcgccacttaccgattcactatatatatatatatatatgtctgcggatatgtttttcagtcgaacatcataaaaacatatttcgacctgtcgacctcactcccattctgcgtaagtgaattcgtgtttcgacgatactatctacggaaacgttcctcattctacctcgctgtagaaaagttctcctacttgcagatctgtctctctatttctgtatatgcgtatctcatattatatatatatatatatatgcgtctatttccctttcgttacgcgagcaggagagcgagaggtctggggaaagcggcgttgtgagagcgagatcctaggtgtgctgtgttccctgttgggtcttgaggtgtgcctgttttcctagacgccggacttcatcccaccactgtttttttcttcgtcttgtctgaacgctgcactttccaaacgccgtctttgtctggcgcgaaccgcgcgtgggccttccccgcctgtgtttctcgcttttgtgcgcgagtctgccctgtgctcttccggcattcctggaagccaatccccgcgagaaatagcctgtcccttgcttcccttcgtttgttccggcgcatgtcgcgcattgacagagaatcgtcctccgaaaggcatctccaaaacaggatcaaaagttgcgtgggcatttcgctacggccccgcagtcgagcgaggaaatcctcctgccggcgcgactgttcttgcagaatcttccatctcagtcgataatttaacgacacattcacttctttttggaatcgaggctttttcttcgtgacgcaggagtgcgagtgagcgcgggtcgcggaagcaaaatccgtcagatcggcctccctcccgttctctgcacttttcggctgctagacacgcacagattcgcagcgtcgacccgaagcgcatgcgcactctcagttccggtttttcttctcatccgccgacgcaagaaagacctcatttgacagatccacacacagacgcacatgctggagaagaaacggtgcggcttcccgcgactgtgcaggctttgctgcattcttacatgtggtgttaaagggggtcgacttcgacaggaactcttgtctgaactctgccctgcgaacatcgagaaccgccgaagggcaacagaaagcagcgagaaaacgcagaggataacacactcacttacccgcttgactttcaagtcccagctcggaaacgtcgagaaagagacaggagaaggaaaggaactgagaggcgaaaagtgcaaagaaggaagcagtcacatttgaagaggaagaaaattcgaaaaacaaggatcgagatcaaccgcaagaagctgtccgaaagtcactcggcacaaaacgtaagttcactgctattcacagagaaaagaggaaaaagaagcaaagatcctcgatgcttcccggtagactgaagcgagttccgagctcgcgttttcccttctctttcgagtggaaggaaaattgctttccgtgagactcactggagaccgctttggaacaacgcacttggcagcaccctggttctgagcagagagatacctttttctcgtgttcagagaaaacgcgagatctcttgtgttttgcccggatgtctctgtgctctctcgaggtttcctagactttttgccatgagcttagtttttcagtggagatcaacttcctctctttgctggcttctctccttctgcctcttggaagagaagaaacttgagcgtttacgcctttggaaaaacatcgtgctggcgatcacctgctcgagaagtactggagtctcgctcttcgttcttctacctttctttggatcagatattctggtcgaggactgcctcttcagagacacactcgcgaaacgttctctctctgcttcctcctctcttttgttcctctcttcctattttgcctttctcgattctgacatgccccttctcgaagcgacatccggtgtctccttctctctgagcgtgtctcccttctttgtgtgtgtctcttcggcgccagctccctggatttccgttccctttcttcttctttctcctttcagagaggtacacaggagtcctacctttccaggctcctcgggatgtctggctctggctgtgtctcctttcgtctttttgcgcggcttttgagtcatttcttgatctttcccgctcttcactttgtcgtcttcgttgccgctctgctcctttttttctctttccacttgcgcgcaactcttctccggcgagagaacaaccgtctttttcctgcttttccgcgtcctctctagtctctgagagacagacgccttctcctcggcctgcttgtgcctcgcctttcttctcgtctcttacctttgctcttcgcgaaagtacaaccgatggaggtttccaggtgcagaacagacaagacaagacacagcctctttctcctcatctttctcctcatctttctcctcagcacactctaaatctctacctcatatatcatctacatttgcccacgtgtgaacaattatttacgctttctaacgtatcaaaggctttagatatatatatatatatatatatgcagatctatgtgtatttggaactcgagatggatacgttgtatgttatctaggagatgagaatatcacagttattgtgttttattcagaactcttccgttgtgccgatgacagggaaaacgcggttgctgcaactggcgatcttcgttttgtgatctgtcacggttcgtagcgctgtcgctgtctctctgtctctcgctcgtctctgtctggctctctgttttcgaccgttgcttcttcccggaaattctgtgctctccttgcctctaaacaaacgcggacaaggctctcttgcttgccacagtgtttccgcctgcgcttgcctctgcgaagttcacagcaaccaggacttgcttcttctccagctgcctctctttttctgcttccacttgtctctcttcttcctcttcgaactgtggttttttcctccgtcttcaaatcccactgattggcgttccctcgagaacaaggcgattgtgccggcgctattttacagcatttgttgtgttttttttcaccttcattttctgtcggtccggggccgtatcacggcgtatccacactgctttgtccagacgtcgttcgaatcccctctgaggtttctgtctctcttttcgtctcgcttcttttttcgattcttttctccctttctccctcccggttttcttttccccggtcttctctcctgtttcctctcctcaaaa

SEQ ID NO: 2596 - DNA, 2235 bp, Toxoplasma gondii
ttcgggcgctttgtgcgcatcatttccatccatcgacgatgcttttcttgccagtctttcagagaaaaggtctgcgttgaatcacgttcaacgggcgtaagaagccatcgggcgtcatccattgctgaatcgatgccgtgagcaatctgggtgtacatcgtctgcggagtcagacccttgattgtcatggtgtcgtttttgtaccatacattatattcgggcatgagtgggttttgttgatgcatccggaagcccatcaagccccctagtgggtgggatgaatcgcgggtagatccaaagcagcgcgcaattcgtgtcataattccctctgtgtgtttgccttttcccttacgcatctcctcgggagtgatttccttcagcgtaagcagaggggacagcagcacaagtccagcaatcgggattgggcgtgcctgcactgtgatgtgctccactggaacctccttctttcccttgcccctgtgaagacagtactgagggtccgtggcgtattgcatacccggaacctcgcgtcccgcctcagaactctgcgaagtccctgttgttgtagactgctccgaagcacccactgcatcggcaggcttcgccggaggaacatggggcttccccagcttcccttggcgggcaagcatctcaacagcacgcgcagcaatcgtcgcccccagaccctgtcccatgatgaaaatgggcagagttgaattgcggcaaacttcttcgaggagccagcaagcatcctcagcgaattcatcaaaactagacggcaattcatagttcttcccttcgacgaccttcgagagcccgtggccctggagatcaatcgcgtgcacgtccaggcccgcgtcattgaatttttgcacccacgagtcctcatagtgtgacgccttacgcaagcgcatgaactcctttttctctacttccgtggcttccgtatcttcttccatctgctggcgctcttcgatagagagcggcggcaagtgcttgagccactcaaacatagtatgtgtgccctggtcatgaagaagaacaactgcaccgcgggcagggcccgtggtagtggtccatgtgtatcgcataataggttgatctctcacattgtggaaaatagcaactttcgggtagcgcaactcgatgtagtctattgagaagggcggcaaccgggggtgtggccattcctcgagcttagtctcagagccacaaatgaccgacgagcaaacagctgtgtccgtctccgcgggtgaccgcggtgacaccggggtaacatcacgcggaggagccatcctgcattaaatgagaatcccggtggggaaaacgacgatcccgtccactcgcgtgctacttgttcgtccggctcaccacgccaccaactgcccgtcaacacgcaactacgtactaccgcacgagaaaccaagaagcgcagaattgggcgttcagtgacaacagaaagcgcacatcattcaatcacacctcacgctgttgaggccgctggcagcacttctcgcggattcagcaacagtgcgcaccgtcaagctcctcagatttaggtccagtcgggcagagctacaaacgtaaaaacgcggcttgctcgacggatgcgagtgtgtcgtctgaaacatcggcggatggaaaaaagcgctctgtgcggtgaagcctaattccacatcaagattcggaaatgcagctcgacagctgagaggtgatttactcactgctcccgttgcatcgcgattgtcgagcgactcaggtggcggaaactcccgtgcgcaatcgaagcttgcggagtggaagctgtcatgtaagtgcgctgcgtcagcgaattccggagcagggctgtgcgctaatggcatggggctaactgtggcggaataacgagcaaggacgagcatcatcgaaatcttgagagacggaactgaagctatccgttgtaatctcgcccgccatccgttcttttgctgaataaataggtcactagtctgagcatcgaccacggcgcatccgctcaatagcaaggtcacatttctgctcctgcgatgtccactccgaactcatgtgcaagtaattacaggtacaccttgtactctatcggtgtgccgtaaagatgaattctctttcaacgctagcttcccagagacacctacaggcgtaatgaaaaagtcacttcttgccttctgactcgtaagtaggcgctgtgtgcgtggaccgacgtgtcactagacaaga

SEQ ID NO: 2597 - DNA, 1744 bp, Toxoplasma gondii
gattcctgatgtgttggtagtgacacgtcgactgatactggtggatcgtcggcgaaacttacgtccatctcctgttctggagacttcaccttataaggcgctggggcagccacctcggcctcctgctgcccagtcatggctgcctcttgctcctgatcgtttggctactttacctaaatcctcgggatcccgcgtgtctaaactcaccataacttgtgtcatagcgttttccacgtctggggagagaatcgcatcggaatctgctggagatatactgaactacacaaaaacataccggccacggacgagggcttaacaaccataacggggattggtcctgaaagaaggtacgtcattgtgtgggttgccaggagaggaaaagcaggcaatccttcataccagcaacagcctgctcctctgccgcacctgaaagaagccgtttgtacaaatccgacggcaatctgctctgttgtgttgaaaggacctacgttcggctgcctcggaaactgaaggagagaagagatgtgactgtctgtaacgaaactacggttacgcgcaaacggttatcttacaagctgcatcggctccagctcccccggggtggggatagttaatttccagacgcaggccgcctatcccgcctgaacgcaaattgcatgagcaatccccttctactctcttaaacctctttccagttaactcaccaatttgaagctgttgtctccccgtacgtagttcccttaacataccagcaacctctttctcgagagcagcgacggcctgctgctggtcacctatctgttgcttgagctggtgaatcacatggttgggttgctgggtctcagtggcagagactgtcagtccggccaccaaaggtacgatggcgaagagacccgcagcacatgttgacttcattttcactaaatataaggaagctaacctccaccagcaatgagggaaacaagacaccttttacgccaaaaacaaatagtattcgcaaaagctatcaacactagacgaaattgctgcacaagtgatcgggtgtacagacactggtacgcttcatcgggacctttgacctcctgtctatgttcagatttactcactgtcaccgttaactaacgtgcaatacaaaattttttcagggacgtttgccggcggcccattcacttttctaacagatcattcttctggttgcccttgcgtgtcgccgaagatgaggcaatagatacgtcgccagtcattgtgttctggtgttttaggaatgtgtccgaaggctctcgtaaaactagcgtaccgcacgatcgccgggttctgtcgtctgcagacggactatcacttccgctgaaacggtacggtttaccgctcctcctgaccatccttatccacgccacacgaagcattattctggtgaaagaagtagttgatgcctgatagtttgcttgattatactctttcacgatgaactagcccgacaaaagagcacacgacatgccagcgcatgcaactagcatgcattcacccacctggggcttctagctctcgccattcttagggacggtatttcgttactatcgctttcaaagacttctttgcctggctcagagcgactatttgtcacgtttttgatcgcaccaattgttgaataccttccatacggacgctatcttgcggtcacaatgacctattgcatccagtggtgaccatgaacatcttacagtcctccctcgggccacgttttcaa

SEQ ID NO: 2598 - DNA, 2438 bp, Toxoplasma gondii
tctaaaatctcttcctccttgatgatcggcgcagggtcgtagaatttcgactctctgagtctgtcgagacgcttcacccatcggctgtcgtagccccgcctggaggcaaacgctgcgggccgggcgcggccgaggtcgacgaggttttggctgaatgcgccagagccgagagcggtgtagctcgcggggagcaacgctgaaactccccgccgcgacgagaacctcgacgtcgacagaaagcgtgcagatgccttagacgcccctgcgcgagaggagacgggcaccagcccgtgggcgacaagggctgaggttggcggaacagacgagccagcagaagaaccgggtctccggagaggtccagcaagcaggaaaccggaaagtttaagcgacggagaagaggcaggagagggccgggaatgatgcctccacgctggggagcagggtggttgtgcgtcctggctccggccaagagtctctggaagaactggggaccgtgtctggcggcttctttctggactccgcgaggcgtcagaaggagacgaagccgcatgatcttcgcctgatcgttgcccactccctgtcctggcgaagaccgtgtcgctgagagagagaacgggcgcactcaccaatcttgtgtccctccggatagctcgtggtttcggggctcccacgcccgaaaatcttccaaaaaaggagctgcacgcgctcattgtgtcctctggcccatctgaagctgtggagtcagacgtactagcggagattgccggggggcccgccacttctgtggagaaaacgagggaaaaaaggaagtttgtgagtctttcaactggagctgacaaagggcgggcggggcaacaagaggttgccggcaggccggcacggagggaggaaaacgcaatttccagacggcgttcacaagagtcacacagagtcctccaccaagtgctgctctcgagtacagggcttcttggatttccgtgggtgtacgatgaagacacccggatcggacggccctatgaagctccactctgtttctcaaggcaagaagtaatgcgagaggtgtgacgaaagaaagagggattcacgcgatccacaggaaacgtcgactggatggaagctccagactgtgtgtccttgcctcctcctcctcagtgccggatgtcgcctgtggagaaaaatgaaactttgaacaagcacagcgaggtcgctgtcggcgatcggcgagtccgctgaaacctttggcctccggcaatcggtcaagcaggtcgagacgcgtgagcggaaaaatcgttgcatgtgctttcgcacaagaacagagcgccaggacgaggcgaaattttcttggcggccgtcacgaagaaaactcctcttcacaacagcgaatcgggccccgaaaccaagagggatcgactccgtaaaaatagcgtaaatgtgtcgcggaaagaatctgaagagcctcttcacaaagtgaggaaaagtgagttgcgtcacttgacacagccagtgccgcagacacgaaacccaccggccacgtgtgtacatacactcgatgaaatgaggctctccttggacaggaaagcaactcttcccgtgaaaagacgactctgccgacggaaaagtaaggcaacggagtcagtgagcgcagggcgtcacaaccagccttcgtaaaactctcctcatcggggtgggggccgcagatgatccagagagaccaaacgaactgaacaactccagtttcacccgcagaaaggcgcgtgaatttcttttcaccgttcgcggaggccgtaccgacaagtgaaagggggcgtttcttctttgcggctgccgcggatcgtagtgaagcggcgaagagaaactgcatgcgttttgccgtgaataggcgcatgtgtgcgtcaatcgacggccgcgtctgcagttttccgagacaccggtatcatgatatgccgtggattttcttccaagccgcaccaaagatcagattcaaggcccgcgtccactccaatctagaacagaacttcatcctcaaagattttcgtgaattccgaccaggattcttgtcatcggcgcgcgggtacatcgggcgcagacacatgtgcgtgcggccgatgaggcatgctgctttgcggagttacaaaaaagccgcccgtttcgtgggaaaggccacttcccctgtcaatctcagcccctttcttctgttttcaatgaaatctggagttcctcgacgctgcgcgtgcgcttgcgtccatcccactgctttgcttctcagtcacctctccaaaagtagctgggaacgctgcgagtctgttacaccagccacttgcacgctcggtgacccttggatgtcaacgtagtgcttgccatacacagagaacatcgttcgcaggctttctttcccgctatccagacttcttcggcagaaaatccggctgcgatcaaga

SEQ ID NO: 2599 - DNA, 1960 bp, Toxoplasma gondii
aagtaccgcaatgccaccaatactattcttgtttaagttgacgggcatagctttttttggcggacttgattcagcctcgcatatcgtcggtagtctggtgtgaaggactcgagagaccgccttgtatttttgtcgtgtcttcacccgattaattgaactcgactctccaagctgaagtgtctccgcatgttttaacgtgacgagactcaaagcattcagccaccgaagacagtgtcctgtttttcgtaaagttgtagacaacacgaccgactagactcttcagagatgttctaccactgagacgtttgaactcacatctattataaaaaccttttaccagacgaactagaatttccagctagtttttttcatcttcgacagaactcatcgtgttgacagacacagcaacaggaaatatatgtccacagaattggaaaccacaaagcttttcgttaaagtaagcacagccgaaagcagatttttctaggttgcgtaccggaagacgggctgcgggactgataagagcgtcttcgatgcttcaccattccaaatatgtttgtgtctgttccgagtttttcatccagtcgatcgggtaattggttctcacaagacacgtaccgataaccgccaactgcttgtcacaaaaagctgttgaagaagttttgtgcttcccccacttacaccaaattacctagacagagagtgccgtcctggagaagggaatacacttggggtattgccaatccaacaaagggacggcggagaaagaagcgtaaaatgactgtatttttgtggatctcctccctggatagtcgcttcaagctcacttccgcgggagcgggggtccccttgagcttcacgggtccgtgctgactagcggaaagaagaagcgaacgagctgataattccgacacaccttaccttctcatacgcctgcatgccacagcgaatgtcgagaaaacgaatgtggtagaactgcgatatcagaaaaactccccccgatacagagccggaacgcggagcagcttagcaggcgacgacgcggccagcgagacaaatttggtcggcactggcgaaaaatgtgaaagccgccatgtctgaaaggcgcaacagttcacttgaaccctttccaggacttaactcttttttttgctgtctagaacgtatccaagacgctgaagtaaatccgtacaatccagacgtctgcttgctgtgcatgcgctgaatttttgaagatgcaacagagaggcagctgtttctgcagcgtcgcgcgcggtctctttttgtgcgtgggcgtctgtcttagaacgacacgcccaaaaagggttcttcacgtctcttcttttccagaattcctctttcttttgaccgtactcttttccgtggctgtccgcattcgaggagacatttgaacgcggctccctccgttctaggctcggttctcccctcgagccgggcgggcgcgccctctcgctttctccagccgcgaactcgtgatttcaattccatcttcgtccgcgtccgccattcttgtcctttcgcgtcgcgttgtttctcatttccctccacacttgccgagaagctggtatttctcagaccttttctctgcgtctgtctgcttgcaagacgcctacctgaagtcccccggagggtgtgcccgtcctcacttcgaggcttatacagaaaagcacgttacgctttcagccaccccagtttccaaatcgtgaaaaacacccgggctcgtccaggctaggatgtgagctgtggacgccccgtgacgcttgtgatttctttcatgtgacgacagcggcagaccgggagagtcgtccagcgcagaaccgcgacctctccagtttgtatctgatacttttaaagaaatttcgcgaaagaggtgcctttgtgccgagccgggcatgctcttctcactttctgggatgtgtatctcccacaggtaggacga

SEQ ID NO: 2600 - DNA, 4706 bp, Toxoplasma gondii
gacagaggtgaagtctcaagagacgaaaaagaaagcagaccttgcagactgctttcggaagataaaaatgaaatgcaagagtgtcgccgatccggttagagaaccccttgtgcgagttcgatcacatggcttctcgcactctgtgactgtcctcacgatgaaaagaaacgcactcgactgcactgtcttatttttcacttcccccttcagaatctcccccccagtcttcttctttatgtcctttggagccatttcgacttcggctcttccgcctctctgtgctggtggttcgtggcgttcgccgggcatccccgagcctcaaagccaacaagaagtttctccagcgcagtatgcgactcgcctgcagctcttgctgaaactgcggtggactccacagcttccgccgaaacccaggcagcagcccacacgcggccctcagacacggtatctcggcaaaacgcctttgaaaaaaagttttcccgctcactgtgtgaagatcgtgagtccctcgatgaggccgacgtgactgcgtttctcctctgcgggacgcgatgcaggaaagtagaagacgattttcgcttcctgagctcgttcttcggcgcccagttcctcctcttcttcgctttcgtgtcgggcttcaacttctccctgtgcaaatgaaaactcgtcgtcggagtcctcgtcctcgccgccgtcttcttccgtgtgtctgcgagaaacgctctgggagctcgggggtgtcgctctgcagcctggtgcaggagcggcctttcgcggaggctccagcgtcggactgaagagaaaaatcgcctctactccgctgtgaggaacggggggagaactgcactctttccttgcctggagcgagccggagagagtggaggacaggctcaacaaatccgcagcggagctcgagctgagaggcggcggcgccgacttcgcgccctcagccgcagccgcggaagaacgcgagagcgcagccctagccttcacattcgagagtgcagaaaacatcttgccctgagtgatgaagaggcgaaagaaaactgtttagcgcccaggttctttacaggactcgtgtccttccaaatggacagctaaagactggtacaaagcaggtaataaaaggggtggatttccatatcccaaggtcctgcagttgctgcacatcgaccgttttcaagacgtggagatagaagaagtcacgggagaacgcagggctgggcttcctgcgaactgcgacttggtgacaacaggcaggggtcgacggaagcggggtgaggacggaagcaccggaagtgaaaaagctagacaaccggcgaatgagacgaagaggggagagcatgcatgttgcacctgaacaaccggcagaaaagctcgcgattcacgacatcacgtgcggccggcttcacataggagaggacggtccggcaaccggagggcgcggaagcccacgggaatggacgacgttcgcgtttgtgtgtgcgtgtgtgtgcagaagatgatcacgaaaccgggttcgctttggttatttggccatctgaatcgcctcgagtcttttctatcaaaaatgactgcttttttagaggaaagaaacatccagttcccaagttctcctggtggctactccgtcagcgtcgcggtgtgctgcttcggcagaagcccagcgatggtgtagaaacaacagagaagggaggaaacgcgctgaacagagccgatcctcgtcgtgcgagaagcactaagaaaaaagggaaaagaagagtagttctagagcgaacgtccccgactttcgcagtttcagatatgaaaaacgccgagttcctccctggtcgaccaagccgcgtccgcacatgcgaaagatgcagagggccagcatgaatacgcaggctctcccagggaacgtgtagcgtgcttagggacagcgagagcagcctcagactcccagtttatcaaaagacagagcgaaaaacaaagggcaatttcggatttctcactttcccggggaagcaaccaagcccggtcacccttcggagacctaccccggcgctcgcgcatgcgatcccaattgttaccgtctctgtagttctgaaaagctcgtttttgcggcacaagagacaagctagccaagtttcgaggcagcagaacagtgtgaaatgaaggactacaggaaatgccaaaggataaagtcggacaagctggagtcccagcgatccgcaagtgtcgcggtgcctggtttgtcgtagaagtctcgtgttcgaagtggacttaagacagagtcaggagcagcactgtagatttctgaattgatggatcgtgccgacaagatgctacatggtcttcctctgcgtctacttaaaaggacgcagcttgtaggcaaccaagtaaccggagaaccacgaactcgactcattccagaatcccaatgtactacccaagtttttttcgagagtctcaccgtttaaggtatgctgttggacaaaaaagcgcttctacacacagcctgcttttgatggcctcgcagaggatgaaatatgtcgtcagagactgcattgccacacattctacagatgaaacgttggaaaagcagaatcaaccaacagaacaggataaagacgcaaatatagtcttgaagagagtcctcgtcctggaaaagctagacagcttcagattgtctacttagctttctgtacccccagcaaaactgaacactactggtcagttgaacagtgagtgccgaagcctatgcttgtcagaatgtttcttgctaccaaaaaatggcactttgaaggaggtcctggtgaaaaacattcagtgtatggacagcgttggcgtcacacagtcagaacccctgattcaacagatacgtacagcggcatgtcttctttaagccccatgcaagggaaaacagatatgccctctccaggtcaaagcagtgatgtttggtgcgcacgactctcgcatccgcttctttaaagaacccaacacagcttttttgagatggaccgcgaggcagcaggcaaagtgccccgcctaccatgactacagataacatgcgtattagaaatgcaaaacatgctcccataagatgcttccagttccctacggtagatattttgcagagaattactgagtcgtttatctgctgaagcatgctttttgctttccggaatagcgtgattgctgacgaactccctcaggcagaaactgtccttcgcgagctgcataaccaaaggaaaaatactgcaaaaagatcttgggaaagaatccccgtagtccaactgctctcaaaacgcgttttcgttggtgaggtgtttgcatcaaaccgcacggtagttcgaccgtcgcttcacatcatgcatagggcagggctagttttgtgtgttttttcggggtaagaaattgaacatttcaaccagttttgacacagtaaggatgtgtcgccgtggccgcttcgcttgtctgtagcaacaaacaactgtgtccacgaacagtagaggcggccggtcgcctctcctctgttaacgcgcaccaggtttgaaaccgagaaaaagagagaataagggtgttgagttcgagcgtgtaaagacgacgttaggtgactttggcgcgatatcttggcctccactctgcatttgcatccaagctattcgatcttccaaacgcttgtattcctcattttgtcaggaacgtgtgactgacgggtaaaactgtttctttggcctacggaactagaaccgatcttcccacggatcggcaaacgctggacaggaaagaattctttttttggtcggcacgcggcggtgaggcctcgtccgcaattttggagtagataccaagacagcagatttattctacggtcgaaggacttcgaaggaaatcacttcatgagagtgagtgcaccaggtgtcggttaagaacagtcaatgcgtgacacgcaagtgaccccagtgtctcgggcgctctcgcaaccgttgcagaaaggttcttttttccctcacttgttgcggtcttttcacccgtattcttccgcgagtttttgcagggcgcttttttacacaggcatgcatcagattttgttcgaagcagacttacgggctttttccgtgtcggcgaaaaacgcgggagcgttccctgacatccgcccgtctccgtccaccagggagctggagacatgggcgctggttgtgccgagcaactgattcggggttttgggcaaaaagagcagcgagctccaagcattttacctttttttgtttctatctgtgcagcacttctcgactgtcctgtactttttgtccaaatgtgtctttggtacaactgttttcgttcaggacgccactgactcctacgccctctcccgacctcgtgagtcagtagcccttcagtgcggcgcgtagtgctcttttgtccttcagacgcctgctatcttcagcaactatggcggcagttcactgcctgtgaccatgccagtcggagagtcggtttccctctagactttgcttgatttttggctgcactggcttctctcctgagaaaaccggcggactttttcctcatttgagactcgtgtcgcgtccaggaacgttcgttccagggccaaaactggaggtgcgcaagttagcagactcacggacactctcgggcatacatccgtttttgccccgggaccggcacagccatttttccccaaaaatcagttgaagcca

SEQ ID NO: 2601 - DNA, 3489 bp, Toxoplasma gondii
gggaacgatgggttggtgaaggaaagacgaggcagagacaagcgttctctgtgtggacggacgcagttgagaaggcagtccagttaggaaaaacaggaggaaaaatagagcgagcgaacgcggggcagcggcagacagcgtggaagttgacagactgcgaccacgatcgaaaccgcgaaagcgatacaggacctgcggtttcgctggacgaaacacagacgctgttgtcgcaccagataccttgccgtctgccaaaaagcaaagaaacgcactccacgtcaaatgcttgtgcaccagagcaaggaccgacggaaaggtctggacgagtcgtgtaggcaacgagtcgctgcccaccgatgtgtgcggtgacaaggcacgcaaactggtggtcgagggccttgttggatcgacgctgtttcgtcgcgcacgagatgtgacagcagacaagcgtggtgtaccgagtttcagcggagccgcgcacgccggagatacggacgactgacggaggggaccacggaaagggttttgccgtgtggctgagaaggaacgtgtgaggctatttcccagggcagcagaaccactgcaccacgaaccgggaacaggtgacaggctggaacctcgcgacttcgttgttgaaccttcactgcggcactgctggactggatctagagttggctggagggtgtccgcttctgtcctcctggaaggaaagcccgaaatcttagccgcacacagccagaagggcaagggcggtgagaaagacaaaactggtgcagaataggcggcacaggaaaaagacgagtcgctcttcgtaccatggccagctttttccggcgacgtccggcacccagcgggcttatcttctgaagagttgactgaaggggttgggagagaacacttttttgaaaggataaagttgtcacattccaccgtggctattggcgacggactgtgccgtgcgaccgcgaacagattccagagaggtggagcgtatgagtgcctcagagttaggaactggtgacctgacgcccagtgatgttcccgtctctcgctgcagtgctggtcttcctcacccgaaaccgctaaagaaatacgtgtgtcagcacaaggatcaaatgccgaagtttcccatcgctcacaggccgacaaaataaaatgatttacttccatctcgggtgtgcgaaagtggacccgtgagaaaaccggccggggtttccaacgggtgaacggaaaagaagcaccctcgctaggtggcgtgagctccgcgttcttctagtgtgcgagggtcgttccgttttccgaagctcgacccccgcgatgggacggcggtgccaggatctggttttgtagagactttagggaaacgaatggacggcgggaccacagacgaatgaatttttaaaaagcctattagttttgtatctatgttccacgggatctaatgagcaagaactgtgtcaaccgtggtggtccgagagacgctggactgacgagtcgcgaacgagggagggaagatgcacccgaccagggaacgccggtacgtgaagatggagagattccttcctatataaatgatacgttttcgaaggaacgcgagatgatgaaatgaccgcatttcgactccaccgtaggcggcgagggactcatcacgcgcacgaacaaaggcaggcggtatagagaccaccccgtcgcgctgaagatgcggcgggtcgtgcaggttttggacgtctccggggacgggtgctgcgggagaaatgatgcgtctaccgcgtcctgaacacatgaacgggacatggaacacggagaaatcaaccctacaaaatccgatacggagagctacgaatgcagaaacgcggtggttcttcagaattgctctctgtcagaaaaggatttgtgcgaccgcgcctctccccggccacgtgtcgtggcccgtgaagaatgaaacgccaagagagaaggactcctcggaaggtaccgaagcaggaagaagatgtcaaattttcaagcagtgaactggatatccatgtagcactggcgatagtcatgacccgtctgtctcctccggttgctccatcggcaaatgctgtctcgtccctggcgcgcgcgtcgccggatgtgttgatgctcacctcggttcctccccccctggccgtccagagagaacgcgagccggaagacagcggtacgttgcctgctgcggcccataatctgtgatgctcagaggcacaaaacgtacgaagaatccttgatgtaactggtatttcagtcgatgttttccttcccggtcctacctagcgttgctctgctgaactctttaccatgtggatcaaaaatgaggaaatcccttaggttcttccggagacccaaaacaaaagcccgccacggtagactgcactatgtggcctcgcggctgacgcgagttagcgcagcttacgtaccacatgttagcaaagcattagtttgtctgcgtacactccaggtaccaggtaagtccgtgcgctggacaggggagcgaagcaaaacaactaaatccgtcataaagactcaggaacacagaaacgctcctgatgtctccagaattcctctctgcccaacagctgcgctcggctgttcctcaggtttccattcgtcaaatccagtgtctactctcgctggttgctgcattcacatttcaatgctgcaatttcacttgagctcgttccactgactactatccttgagagcgcctcgaacgaggaggcagatattggaggagatgaaggatagactagccgccaagtaacatggagattagaaggtgagcatgagcagatgagggttcgacagtctctctttcgggaaacggtgcgcgagggaaactcagggggggggagggggaagggggttcacagcgcaacgtcgcatgactcgacacggaacagctgtattttacgcactgctggtacaaggcccgagggcagattattcttatattcgattgattgttctcatgtgtgcttaagacgattttgtaaagctgccaattttcttgtggaccgagcaacagttcattcagcaagagcgagggggacatcgcagtaaatctgcctccgttgagcgtgactctccgctatcgtgtgttcgtcgctaggtagtggcaatgttggcccctgcttgacattttcctggtggtccctacaatatggtttgagactcggagccgaaagtatttcgcgccgtctgtcgggccccgttccccaatgcaacgcagttcagggcatatcgttcgcgcgcggacgaaacgcagcgttttttcctcttgagaaactcaacggtttcccttttttacaagattgttacaaggttcttgtgaatgacacctttgcacagttaaggggccggtatccccacggttttcctgatcacccacgatacaaacacactttctggcaacctcaccagtttctcgcgttgcatttctcgcaaagtagcgtcataagttgagcgtga

SEQ ID NO: 2602 - DNA, 2219 bp, Toxoplasma gondii
cgtacacacgccgtccaggcgtttccgttctccgaaaatctcccttttttcgcgaaaaaaaacaatcgtaatcgcgagccacactcgaactgcgacgactttcaaaaaagttcaagtctgtgcgtcactctccgcgccgctgggagttcggcgtccttcctccttcttctgtccaaagagaagtcatttctccctgcgcggcgttctcacgggtcccctctaaatgtgacagagctcatgagacagtgaatctctctgtaaatacaaaaaaaaatagttacaactatagatatcagtggatctacaactatatagatcgatctctacatatatatatatatatatatcagtatatctataaatacatatataaacggtgtgggactgctgcgtttcttctgtccggcaaagacttctgtagacgcggcactcttgtccagcgtttccacgcggaaagcgcatgaagggcgtggaatgtgcgatgcttcgaacttcctttcctcgaagactcccctttcaacagacggaaaggtgcatgctctgagactggtgttttttgccttcttttccacactcccgcgtcgatctaatcacaacagctgttcctccagaaaaagagtctcctcggtaagcacgccagtgtaaaccgaggagacaaaagcttggccttggcagccactacatttctactggttcgttgttcagcgtcattcgccagttccgcgaaacgccgattcgttctcttgccaagtcagatgggtacctgactccgtggatatgtgcaccagcaccaccaacaacataagcctttctgactttcgttctgcgaactctcgctgcttctcccttttctccccacacaccgtcaaccacaaaaactgcgcggaaacgaaaggcgagaaatgctctcgcctcgcgctgaagaagtgactctccccgaactcctgccggccgacgacctcccgcgcgtcttagcaagcacgggagtttcacactctatggcccccccagagtccgcgcttcagtctctgcctctccacgcccttctcctctcgacaggaaagccacaggcacacaaacgcacgcccacaaacttgccttttcaactgctctgcttttcgcgtttgtgacacccgcaggcgcaagtggacgtccactccgaggactgcctgggaacgagcctcgctgccgcgaatctgagcaagcctgtttcgtctctgtttacggatgcatgtgagaggaaatccctccagacggcgcgaggaatgtccttcctctttcaggtacttgctgtcaccccctgcggcctcgcctcgcctgcaagttcggtgaactgacgaaccgtgtgtctcaacacaaggaagccgggaagaaaggtgaggagcgcgccaccgcctccaagaaggaagtgaaaaatgggcatttcagacgcccgcgtccacttcctttcaggagagagatgactggaaggacgagagtgaaggaatccgtggaaaacaagcaggacgagcaggctggggtgttgcatgtgcagagagtgagcagcgcagccgtgtctctcgcggcactccgactataaggatttcctctccttttgtgtttcgaaaaaaacgccaaacaaagtctggcgaccaggagcaacgtgcatgttttcttttccgaggaaaacccaagaaaaagcttctgtccgtccggccaaagtcggcgtcactcctccgtgcatctgctcgacgcggcacaactcgtttttacacacacacatacatgtatagatcggatttcgctcgcgaaaacaacgacgagcacctcaatttttgttcttgcctttctcgaacgtgtttttctttcacgaccttttcttgcaacgtccgagaaactcttccttcgttctcgcagccccgtctgcttcctccacatcatccggaacaaggtcggatcggcggcgattcggggatttccggccgctcttttctctttcttctttttcgaagttcctttctctgcctcgtcctctgtgtctcggctgcgctctcctctctcgccgtctttcttgtcctctgtcttgctcctgttctccctcctcagacgttccagcctgtgtcttcttcgcgttctctcttcagctgccagcttctctccccttctttcctctcctcttttctttctttcgattctttctctcgcgagtcgagcggctttctcttcccaagcctccagaa

SEQ ID NO: 2603 - DNA, 4955 bp, Toxoplasma gondii
ctctgcgacgttcttcagctcggcattgaggtaaacagacagactctggagcgcttcgcggagattccctagcgcggggaggaggagagcgagagagggacatgtggcattgacctcagcgacactctttcggctgctcgcaggcagcttgctgtcgtgcaggaggttgccgatgttcgtcgcggacttctcgattcccttaatgggaggcaggcgacgctgctggtggctgaagaagtctgtgggaaccaacagcgcctccgtcagaagagctgcattgcagtcttgcagtgtcacgagcaccgaaagcagacgcgaggcgacaaagaggcggcctgccacctcgctacacccgccgcaaaaggctgctgcttcgtctatagaaatcgcttgcggagcagaagggtcggccttcgccaagtgctctacggcaccgttcaacatatactgaagagcgctcggatacgttgagaagggggcgagaggaactgaagaagcgagggggagagggtggcggggaagcttggtcaccggaggagaggcctcgttgagaagagaacagagcgaggtgagaatccccgtgcgcacaccccccgcattattcagtaaagacacgattcgcaggactgccgtggcccgtaccgcagtagaatgaaggacaggcgctccttccggcagcgctggaagattgagagacgagaaacactcagtgtttcccccttggggaaaacggcgtccgaactcacgcgagagcttcggaaccacagctgggtcgacgacacaggcaaagtttccgaaagtgtatgcggacagctcgtcaagagttaggggacgcgaccccaggggtggtggaggcacgcttgacgccattttccctgtggagagcccgccagctgcaaacgtcttggtactcggaagcgtgcacacaccacgcacgaacggttgacagagcaaaagccacaacgaatttgggtaacctgggaagcaacggcgccggctctcgcgcgggcacggcggaaacgttcgtccgtggagtgacgcggacgatgcagtcggcgactgccaccagtccagataccgggcagagcaaaaccgaatccccgcggaacgcggcacaaagctgccaaaaacactggctccaagaccttggccacttcgtctcgcgggagaaatacaagggaaccaaagaatacctttctgcgagacgggatgcacgtgatgtggggaatagagacaacggctcaggccgcgagacgagcggattttcgacggaagcatgcgaagtgccagaaaaaggaaattgccacaacttgaatcttaccggtttgaagtggccatctttttgtggacatgcgagaaaaaagtgccgctcctgtagccttcaaaatccatcgtaaaacgcaggtggtaactattgctggcctatcaaaacgatggacagcggagagcgaacagacacacgtgttgctgactgctgttgcaagccgggttgggcgcacatccaagatcgagcactggagccatcgaagtgatcgatattgttctcatagctgaaagtaccaaagagctagtcatcaatcgagtttctcacggtgtcaagagattcttgagaaaagagggacagccaacagtggcaccggtcatctccggggctgtcaatcgccaagtgactagcagtcgttcgctgcgcctttgcacagggtgttcgcgaggaagatgctattaaaggaagatgcgcgactcttgtttctttgttcaacgaagacgttacaccaattcaggcagggcgaccaggagagaaaggcgcctcgagacttgggaatttgagcgatagccagtaagaagaacctgcacagtttctgaagagtgaccaggtgacgccgtgaacgaccaagaatgatcaatctggtgtccgtacacctgagggagaattgctgaacatgaaccgacaacgaaatactctggctttcgtgacttcttaggatggttggcgtcctcgtaaatagagatcttctcagtcggcaataacagagctgttgggcacggacgccattcatcgccagtatattgaacagagaggagtaaaccccaaagccaagatagagctcagagttttgcagttcgacggcgtatgccttcagaatcgtaggcggagcgcatcggtacgagccttccccctgtccagttccaaaaaacatgccacagtacaaaaaggctagcgacattggagaggtacattgtcgtttttgtaaagagctttttcctaacttttaggtccgcagccggtgcctagacacatttgccctgacgtctttctgctgaagaaaaagactctaccaagtttcattctgaggcaccggcggcggcctctacaagtcattgccaaccggttgtaaaacaaagccgtttctcgaccggggcacaagcgaagagaggcttcctttttgcagtatgggggtggagcctttacgagtattctgctctactaatgctctacttcttgtagagacgttcgtcaagaagcccaaggctcctgcaggacacaacctggcacttcactggggccggttcctcgaaagttacgtatgtggcatgaatgtgagcagcgtcttcatttaaccgctactgctgggactgtagagaatctacttccggtaggacagtcgagttcgttcttccaaatagatagacgatcaaatctcaaaggagtaacgaccgtgcgctctttgccaccctgactgtcactacgctcgctactaaattctgtgtcgagtatatatcgaaacagaagcctgacgccttacatgatacatggttgctaatatcgctgtctccgttacttggtcgtgataagttacattctgagtcgatggaggttgccgcagcatgttccgctgtctcaaagctgcagcaacccagtgaatgaaagttgccacggatcagttgtcatgcatctgaactgcgactgtcccttgcatccttggagaagaataaagtttactgccctccatgtttgtttgctctggagcaacacgaaagaaaaacagcgaagcctaggagcgagttgcctcgtttcctttgaagggaaatgctacccaacactctgatatttaccaggaagcaaaggttgagcgtgataggactgcctcaaaagtctgacaagaggtgaatatctctcgtgtgacagttgaggagtcgtcctctgccattcggcgattgtgcttatcacgaggaacggtaacataatgccaagttaattgcctggaggtttgttacgatacgtacagtgttcgataaactgtatgtttgagaggtagaatagcgagtcgctgctagtttcccggtggcgcaccataagggtgtagctgagccgctgtggaaaaaacaaggtgcaccagaagaaaaccgttctgtatgtatctgatacgttggaagagtcaaagcactgacgaaactccgcgggaacttccaagaggaacaaaggcgagtggagtagtatctcacactttttgtgatcacttctgaaaaacaagaggcacggacatgcatgccttagcatcttcgccttccccaaagtcaagaacgactctctccccccggtgaaacacagcaagattaaacgcagagtcagtcagtagttcgtaggcaccagagaaccctccgcaggtaagcttcaggggaggtgactctgcggagactagaagcgcccagtgatttgacacgctgttttttgtactttgagcatgcacgcatgaaccctcgtcttttctaccgccgatctagccaagagcaccgtgaaatgctgcgtgactgattggggaaaaatactaagagaaacacggtaagagtgaccggaatcgatgttcgccgatgaggattttgctcgtcttttccatgctggcttcgaatccggcgcattgcggtgacctgtctttgtgtgctgtcccattctagaagccggaggaaagccccaaacaaagaaaggcggttgccgttgaaaatcgcatctttgcacgacagatccatggattattattgtcaagaagcggatactttgtttgggccgaatgcaattgtgttagtatgcgctcctcgtttacgggcgccagatctcctctcactaccccccctctcttttccctggccgccgctcttcgctgtctccaactctgtttgttttccccctttccttcttgtcttcgtatccgtcgaactcgtctccaggacttgcctctaattgtgctggacgctccacggcccctgatgtgactccgtcttttggatgtaagacgctgattcctgtgtcggacacaagacggctcctgtgcatatggtcggctttttcgtgcatgccccttgttctggaggagctgacaaatctcctgtgaacaaattgccacctgaaattcgtgtcctgcccgcgcgcgatcgtcttttgtttttctacgtcacctgactctctccaaagaaacggggtaccactctacgcagcgttcacaacgccgtctgctgtgggtcgtcgcacgaagattcagtgtccaggcactgccaccattctcacgctattctgaaggaatttttccagttcccatttgcccgaggggcttctgcaagcttgtaatttttggcgtaccctgcccataactccgtctgagagccgccctgcacaatctttcgcagaaccccccggttccccgagagctgcggcgcaggcctcagcgcctttcatgcacggagtagaaaattgggaattttgccttctggtggagagggagaaaagccgggatgaatcagccgccgtcaaggagggtgaggcgcctccaagttttcggtttacgggtttaacaagaaaagacagaaggactatcgagaaacaactagcttgtctcccgagtcttcctctcagtctccggcgtccgcctgatctgacgcacttcacagtgcctcgcttggca

SEQ ID NO: 2604 - DNA, 1185 bp, Toxoplasma gondii
gttgcagatgtggacgaggcaacaaagaaggaagttcgtgatattctcgttgcgtacgacagatccctgatcgtcgccgatccgcggcgctgcgagccgaagaagtttggcggtcctggtgccagagcacgctaccagaaatcttatcgatgagtgttttggagggttcctgtctcccctgttcggttttctgaaggggaggaagggaggtcttcttgtgtgctcgttgactcttttcacttcacccttgtggatcctctttcttctttggcgcgcagcccatggctaaagctggtacggaagactggaagtgtgagtattctaaactgtgcttcgaaaacatgcagccttctgggcattgtcggctagtgtgtagcctgaactgtgttgacagcgcctgaaaagtttcgagtaatcataaagaagtcgcctgtatttgttccctcgtctggaaagacacattcacccaggtccagtggtcgcgcggctaacagtcacaaacggacggaggcaccttttgtcgacatccatattcgcaaactccccgctcagaagcgcaccactccactacataatggttgtacgaagatactagagtccatagttggttgtcagcagatcaatttgttccgtgcgtcttcgcgcacggaaaaatcccagtttttagtgcgtgactgttggattcagtcagaaccaacatctggcctggatttgcaaacaagacgttttgtctacgtatggagtcgaacaaaagctgttttgtagaagaaaggttctcatcaaacacatttaacccagttcagctgtccaactgattctctcctagaggacgtagaccacgtgcgaaaagttgacaaagagttgtcccacaagcaacgtcgtgcgccactggatgcgattgtctacattcattggagctttctttgaacactctcattcgacaagcacttccactagcagcaatgtcaattatggaacatcaagcgaatgctgcggccactacatccaagacctgcacctggttccttgcgtagcgcttcttagcaattgtctatagacaccggagaactactgggtatgtcaagtttctattagctgtactgggtgaatgttttactcacaattcatagttggtacgatttttaaacgtctcttagaactgccctggtgtatgtgttgacaaga

SEQ ID NO: 2605 - DNA, 1779 bp, Toxoplasma gondii
ggatgcctttaggagcgaaagaaatctctgcgccggcaagtaccctgaacctcgtgcgtccttctgcgagagccggagcgaagagaagcggcgaggagaagacagagaggaagaggcgacatgcagacagggatcagagcagagagcagagggaggagcgcgctgggcaggcgacgaaagcgagggccgcgtgagagaggaaacgaagtgacacaggcaagagaaagagttgagagacggagagcgacaaacagagagaggacgcgtctgcagagctcggcgagagccgagagaagagaggaaagaagaggagagatgtgaggagagatgtgaggagagaggggacgatgaacgagaggcagaagggggagaagagacttcttggcgtgtggggctgggagaagagcagaaagagagagaggaggaagaaagcgagaagagacgtcggtggacacagaaggaaggcagagaagaagaaaagcgagagaagcgcgtgaggggggggaaaggaatggagaccgcagatgcgagaggagagagacgtccacgcgaagcagcagagacgcgaccgcgacagcggcgagagactgggagagacagacggaggccgcgcggccgcgcgaggctgtcttcggctgggagccgcattgcggagcactgaagacagagacgaagaagttgacaaagagtgcgaaaaaaagggaaacagggtgaaggaaaggagacgaagaagaagaaagagaaagagaaagagacagcgaagagggagaatcaggcgagggagagaggtccgtgtgaaaaggcagtgaggagaagagctaaggtcggagcttgaacagaacgcgaccttccccaagtcgtcggagtgcaagaggacaagaggacaagaggatgaacagagaaggaggaaagagagaaagaagaaattggatgagaggcatgcgtccgcggaagagcgactgccaagagaggaacgcgagagtcgcgaggacgaaggagcgacgaaaaggataaaaagaagcagaggcagaacttcaacgtccgtagaaatcatccaggaacatgagcagcgagcgtcgttcctccccgggagaagcccggtgtacgtacacctcaaccgttgtctctcccacaacagagagggtccgaggaatgtcgttgaaatgtccagacgaccccaccagcaagaccagcgcggcgaagaagcgacatggaaaccgttttctttttttcactcgtcgagagttgagcgaccggacatgcaatgtcgaacaccgatcgcgcatgcatgcatcttctccttgcgctttctcggcatcttgttcattcactcgacgcgtccgccagtgcgtctgtgttttctgcagccatttgattccttctctctagagaaaggcttgaagcgccgccttcctcctggggaggcgtctcctacttccccagaacctggaacaatggaggaggactaagctgttccaccttttctttcttcctctccgtccatcccttttctctcctttctgtctctcctccctttcctggcttctcttgtcttctctccttctcctctcttttctcgtcttcctcttctcgttctcaggcctcttctcctctgcttcttccttgcctgcccccggtctgcccgctcgtcttccacatcgttccacgtcaaaaccaattcctccgcgctccttcttctcccgctccttctcccgcgtagtctccctgttctcttttctcttcttctttcttccctcgggcagcttccgttctgcacca

SEQ ID NO: 2606 - DNA, 2697 bp, Toxoplasma gondii
agaatgccaccaaaacattctctgtcagaggtggtgattcccagtgctcggtggtcctgattactttagcatctgagcagtcgtttttgctcgcgggtgccacaagggataacagaagtccactcattccggctcgaacgtacacgatgtgaagcaacgttagtcgcacacgattttgaagtccagcacttgcagctgcgtagtctgctttgtgcagttaactccttttattcgagacctgaaggttctttgcatttctgttgtctgttctcaagcagggctcgatatctgagcgtcaaaccctggccacccgagcgactattcgtcggcacctcgtccccactcggcaatgatgcactgtcacagaccttgtgtctcttggaggtgccgagaagcttgtttcccgaaggaaacatgttccagagactcagaacaaacgagaaccttcaatgccaggagagacttggcaggggcctcctggcagcacccaagtcccgtcgctctttcgctttccctttcgctgtttctcgaagtcgctgccgtgattcgaggataagcacagagggagagaggaagatcgagcaacaagtgcaggacagaaggatgccaacgggagacagagaggaagacaggggagtatacgaggaagcagaaagccagatacagacaaagaggggaaacggaaagaaggacgcaaaagacaaagaggcactggcctccctcaggtgtctagggaaagaagagctcccgagtttcttggttttctgagaaggcaccccactcaaaaaggctcttctctccaccgccatgctctgctttgttccagagaacagagagaagtggtagtccacaaaaagaaggaaaaggatctagtttctcgggaggagactcgtaactccacgtacagccgcctcctgtcagttctccagtcctttagtgatgctaaactccgatttctgcggttggcgacacgagacgcaaagaggcagtatgcagttcgtagatcatcaagtagaacgatacaccaaatagaacggtatgcgtggagtgaaagagcataagatgtcagcaagaagctaggctgcctgagtactccagtaaacagaaacgaagttccgtcgatatccaccctagtgctttccgttcgactgtgaggtggacagtgaggacgttcgcagtattgaactccagaattaccaagccacaccgatacacctctcgtctctattcactgcgaagttctttcgagcgtcaatatttcgctctctgcgaacttgagagcaaagcagagagtctcccgagaaaacctttcccctttctctcgacttccgcttccagaaaagggagccgttgagaccctctttcctctcgtattaaaaaaaagagggagggggagatttcctgttcgcaacaaactggtcgctctcgtccggagttctcgatttggtgtatgtacacgtcgtgtatagcgcgacacggagaagcctctccagtcgttttttgcgaactgaagctcggaacgacgcccccgcgttccaccttttgcagctgcgcagaacgaaggaaaagcttttgaccgggaaacggcggaatggagacgcggacgcttctgtttcgaaatgatcacaaaaactgagaaacgcaacgtggttgtcgaaactgcatgcttcacgctggggacccagcggcgagaaacatcctcggtttcgccacttttttcttttcacttcccattttcgtttctttcacttctggttcgtctcttttccgctgcttccctggccgacacaggcaggcgcgcttttttcgccttctgtctcggtgttccgcggcctctctctcggtcggggatgcgtgctcgcgccggtttttgtctgacttcccgtgaaaaagcaccctgcttctttgtctttctactcttttccaattgtctgtttcttgttgaggggtgttccccgtctcggaagccggctcgcctatctggacgagaaaaaagttcctccagacggtcgttgtcaccgctctttctttctctcgcctccccgagtttctcgagttcgcgatgatcaaaccagcttttcgtgaagaaatctgatttctctgggctcttcttctccctcgttgcgtgtccatatctgtgcctggcaagtacgttgcgtgacgctttttttgcgctgcatgcttcaaacaacttcaccatcttctcttcttgtctccgttgtttcctctgtgtctctgtcgttctctgaagcctcttcgtcgtgttttcacggattttccgtcttctttctcagcttttttaccctccctttctttgctttcgtctcgcgctttctctcgtcgctcggtcccctccctgctctttgttccgtgttcacctccccgtcgttttttcgaaatctgctttttcgcgctcttctcagcttcttttcaactctcttcagtctggcttcattgtctgcctcttaacctcgaaagactcttccttatactttttatttcgccactttttctcgtcttcctcctcactctgcctctcctctctcctgaggatctgtgcagtcctgcgctctcggcacctgcggagctccctccacgaggatctgtgtccgccgccaccctgccgttgcttctcgtcttctccggcctgcctggcttttttgtttcttcttcgcgaagcccccgccctctccaaga

SEQ ID NO: 2607 - DNA, 3785 bp, Toxoplasma gondii
ggatccacgctgcagcttccctaaagaagttgacccagaaaaatttcacttgacacatgcaagctttcaacgcaaacacgtgaatatgcatctgtgttcaggaccttgtatttatataaaaacatatgtctgtatactttggaaaagttgttgatgttggtagaggtggtcaagcttcgggcgccggatgtggttggagaacaggccatcccgtagacggctcacaaattttatagctctctatagaggaaattgaagctctgtttgaaagaccagacacttgcttttcgcagatggtaaactcgttcagcaggatgcgactcagaggagacgatgacggcagtcacaggatgcaggggactcatttactcggcagtgaagaaaaatacaaattcctgctgcacttcgctcaccaacacatcaactgtggtttgacaccgaaacttcttttctgcttaagtggtcggtcttctctgtagaccaccggtgaacactggaccctctgaagacgcgtacacaagcaagcgtatacactttggctgttgccaccactgagttacaggaggcagcgcgacccactttgtcggcagcgcgagctgaatgccacatatcgtgatggaaattgcctcccttttgagatgacatcgtttttactgtggctgtaggtgaaagcgaactccagagtttatctcctctgagacagtggataacgtgtacatgcttgttccgtcattcgttgactatgtttccctttgcggggagagcacagagcctccatccctacatggagcgttgctgatcgaaaagctgtattcgtattcaaatttagtgaagctggcactttcacaactgcttacggatgtggctagaagcgaagtagcctgtggctgctagctggttctaggcatccacactgcaatcgtggcgtaacggttctgaccaagtcaaacctgtctgtttcaagctcctcgcagacggtgtgcactcccactgcatgaagtcgatccggcgcagatgcccacttgcttttgttcacttactagcgaatggaatttaatgtcgcgaggctcatgcacagcgctgttgaacctgacgttacactttctgcgcagtctggaaggcgaccagacacacgtccggcatagagatcgtagctctaccttgtagtgtaattatcacagtgtaaatagcttttgtcgctgtgcaactgatccggggttcagaactggacaactatgatcgaatacacagagggttctataacaatccatccagattacgaagttccgtcaaatcgcactagccagcggtcgccaatacacgttccaggggacgccgcgtttattcatcgattaaaactttcggaaaatgctcaactggtgtgttctgtcagaagcaaagatattaaggcttctatgacggtaagaccacgcaagcatttgcctcaggccggcgatgcatgtgcacgctttggtcgaggatcgtgggagtttgtggtcgatgtcagttgctcggaagaaccatttaatttcggcaaaggaccactttgcggagagagcagttgcaatctttgttgctctttcgaatttttccgatcttctgctatttctcgcggcacatccgaacccccgttgctctctcgggaacggtgaactgccgttcgtattaggaaaggcattccatttccctagtccaaagaatcgagacgatattggcattttctctacctcaacttggcggcacccacgcagaagattgtagtcagcatcgctgttcataaacttagaccactctgcgtatccttactgactggctacgtaagaacttctgagtgcgtggttcccatggctacatacacacgtggatatatggccatttctgttaatttatacatatctggtgtcaaatacgaggttcaacggcgacaacgcggactttagatgatggttcgagttctacgattgggcttgcttgctaaatgtacgcgtctttgttgtttcaaatgctgtgccatagactgattgtgcctcggttcgtcgcaagcatggcgccaccgacctgtgaatgctaggctttcgacttttttcagacgttgtctggcgacaaggccctttcgtttcagattgtacttctcatcgacgcggcgcagttttctgtagcttttccatccttcaggacgcggtggggactcctatctcttccctccttctgttctacagcaggagctgcctcttcccctgatccggacataaagattcactgcctctgttatttcttatcatgggcttccgcaacgcgagttttgttgctgggtacacttttcgaccctgcggcatgtgcaaatcagcttccaacatatttctatgactccaagttctcaaacacaactccttgttttttatgacgatggcaactttcatgaacacatacctcgataacctggtacattagcgaaaagcgtacacggatctgcctctatatttccaaacacctccactctcctctcggacgggccggcacacgcgggacaacaactactcaaagacatcgcgttctacgaatttcaagatctcttgtctgcctcatgtttgctaccggagcgtttcggtccttcagcctcaagcgccctgcccggcgcctctctcgtggcatattttcgagaaagccttctgtttcaccagaaggggcagagcctctgcacgaaagcaaaggttctccttctgccgcaagaagagagaaaggcagacaaagcagatcgcagtcagcagacgcgcggcactctcgctacgagaggtggtggactttcctctcgaagaaaagctccgcaagcttcccggaacaacatgaagggacgttcactgagatccacaatcttgaccaccaacgatatggaagcccgagagacgcaaacggcagaggtacaaggaacgcagatgcacaggtgccaagcatggtgcaagcgaagaaagacacggagaaagccggagaagtaactggtcaagcagaagtgagtaacaggggggactgagtgtggctttttgaaacatccttgaattgcggacaggcggtgtgtctgcatcgtagaaacactcggatcagctcttcccttcgtgctacaccgtgttgaatagaaaggcgcaaagagacaggcgaccatgtacaagtaaggtttcgtcttctccgtatctcctggaaaagcgaacattcattacatgccaatcgtctgccttctcttttcgttaccacagtctcgactttgacaccgtacagtgcctcaaccacgcggcagaaaccacaccgtttctaccatgagacacaggttttgtgttccggcgtcgagcattattgatgttgcctatcaggtccaagtgtgttgtttcctcggtctgttcctgttgtgatactctaatccttcgaagttctcagtgccgcaggggcgttcccaggtactgcggggaaaaccatgaccacgctgaacagaatcgctgtagaaagccattcggcaccgacgtgagcgtgttgaaatagaaagtcggcactcgcgttgaatcaggagaggggaagttgaccgtgttgtagggcgttttttcgtgctgctctgcaggtcgacgctagagggagtccggagtttctcacttctgcagtggagaacgcacgtacctattttcttggtgcgggcaacccgtggcccgcgcccggacttggtcgctgcagttcacttcactctttgggctctctttcgtcctccgcgcagggcagtcattccacacactctcggaactcaa

SEQ ID NO: 2608 - DNA, 1413 bp, Toxoplasma gondii
cgctcgatgtttctttagaagacacatagaggcgtagagagacagccagagagctatttggagttccatgaaggctcagagctgaagttgctacagaaaacgagatggaggaaaacgcgccttccacgaaagacgcatttctcacctgtgcagaattgcctgaagttttctgcactcttgggcgcgaggtttttgaagagctcgatttttattctgcctgcttcgtggctgccgatggagatgtcgaagaagacgacaggattgtcaggatggagcagcggccgagagcctccctccatcgcctctgcgtaggaaatccctgccggcaattcgctctctgaaagcagcgaagactccccagagtttgcgggaggcgcgggcgccatggtcgcaaaagagagaagaaaacggagaacaagaagccgaggaaaactgagaatgcggagaagccgaagaaaactgagaaggcggagaagcagaagaagcgggagaaggaggaaacgcagaagaagcgggagaaggaggagaagcaaaaggagaaggcagagaagaagagggagacgacgaaaggagacaataaagagacaagggagcagaaagaagagagtgaaatgggcagggattgtgacttcggagaggagagaggacaatcggagagaagaatcgcagagaagacgttggaaggtcaaggcggcagagaagggcaaacatttaagatgagaaggaaccagagaggagaaggaagagatttcgtttgccgtggaagagaaggagagagaaagaagagttttttttctagggtaaagaaaggacagaatacgcgaccagaagaagcgttaaggcatgtttaaggagagatcgtgggcgcgcgtttcggagacggaaaattctccttttgcctgcgagaagaatttttttttgtgtgaaggaaacgccctgtaggtctcttggattttacctcgccttttctgcctcgctctccttgtcgccatgcatttttgacgagttgcatgcagacgggagggtcagcgattttcgccgcgttttcgttcaaatcgtcgaaggaaagacggggagtcaacttgcacgacggctctccgtttttgacaggcgatacgcgtgaaaaaggcgacacacaccgactcaaaaaatccgttttttctgcaaaaagaacttgcggtttcaactcacacaactgcgtgggtgcgtccccagcgggcctccgagctgtctccttagttgtcgccttaattcgctgcacttcctctgcttcttcgttttttctgaagattcgcgttttcggtctactcagcggccttcacgtgagtctcgagcggctttttggcggtgtgtgaagacctgaaaggagacctcggcgccccagacgctctccttcgcaaggtaaggcgttca

SEQ ID NO: 2609 - DNA, 2080 bp, Toxoplasma gondii
tgccagtgaatcgattgcgattcgacttgctcttgagttggatactccggccggccaatttcgaacattgtcattatccagtccattgctaggtagagtgtggagaagagagagaaaaccgcaatgcaaatcggaacccaaaaggctgcctgtctacttcctggcacggccatgatttccggaggaactgaggacgatctcctttttgccgtagataactttgccctgcgtcgtctcctctttgttccttctggccaccttgacctctcttcttgctttaaattgaatctcgttcccgcacgtttctcctgtttcccttctttgcgttctcccgtcactttgctgccgtctctcttttcggggtctttctccgtcgtaaacgggtccttgtttcatcagccgcgacagttctgccttcgtcgtgttttccccctctgttcttgtgtttcgtgttgtctcactcgtcgtgtgtcactcctccctccgtcccgttcctgtttcctactaggttcccttccctctggctcatccaaaaaagggatctaaatgacagcgaacatcccgacaactttttctcagctaaaatcacgaactatgcccaacacacaaggcgcgtaccataattcccgtataggttccctcctacacggcaacacttaaacaggcgcgtttctaaactattacgaagtcgaggcgagaaccccacaacttcctatccagtccacaagaaccgaatgacaacgcattacttttacacaagtgctcagttgaacacactagatacacaaatttttgttgctgcatgttgagtccaccagtgacaccacatcgaaggcgttgcgctacttttgacctcgttgagtgccctcgcggaaaaccagcggatcttctgaacacgtcttctgcgaagaagaagcgtaagctaccacttttcagtgacgcttattgaaagaacaaatgaaggtgacagaatcaaaaggaaacacaggaccgcaaagccaacactcttccacattttcagcggaatttactcacgtaccatcgcctgactgaggccgtaggctgcaaccccccctccaccgctcccgtcgtttctcagcctgacggcactcagacggcgagtttcgggaagcagcctgccttttcaaacatatatcaatctactgcgttcccgttattattggcgcagaacgcgcaaaaagaagtcttcacatctacatccccgccacggctgtcgcttggaaaactgctctaaatgccaatgatggccattagtgcacacatgaaagccgatgttttctaagcgaataataccaaggggaactccgggttgtctttggaagacgaaaaatccaatgcatgacttcgatgtaagtaaaagtgagctgaattgaaagcgagggaaagagacgcgaattctggcttgcttgacttcccccccctccggccccccgcctccagcgaagcgaatgtgtcgcaggtgaccgtggaagccccattcgccaaccagcagcgtttcggagagtgaaatcttgattctcacaggagctagaattctgaagcttactcacagtgttgtagggacgcgtgtgaagtgtcaggcattatttcactggtgggacgtggcggtgtttaataattcgttccggcatgtgtgtgtctcaaatccccttttcttcgccggcacttcgaggcggaacgggaggggggcacacgtttgctttgctgccaaagcagccgatttcgcgccccctcaacggctcaaaggcacttcaactgcacatgcatgcacagttcccgattcgtctgccggatcatgtgtgtgcatgtttgtatgttgtgggcatcattcacgttttccgtgtttatactggttcaagagcgtacattcaggaagttgcactaaatggaaaattggcttcctgtgtggacacaggacacgggggttctctttgtctcccttcgctgtgacgcgttttgttgtgatcaagggcgctgtttaagcgtgatgcattaagcggcacttcagtctgaatcaatcgctcaacgcgtcatttcctttccttttttgctaaggaga

SEQ ID NO: 2610 - DNA, 2299 bp, Toxoplasma gondii
ccctaactgacgaaggcaccaattctacactggagcctccgtcttccgcctcttcctcgtcagctgcaaaagaaatttctcaggagcaaacagagaagtctctagacgacggcctgagcattgaccacctgatggcacagatgaaacgtctgcaaagttaactggttttgtggaaatttaactttctttcggggaaaggagtgtttcgaaaccatactaacgcaacagaacttggatacggtaacagagatttgagaaagaaaactactcatcaagtgctgaggtttgttcatctgtatcaacgatagtggatgtggtaggttatttcacaacggttatgctctacgctttttttcgaatcgaatagctttttcgtttcgcacgctctcgtcttgcagataggtgcaaaaagcgttctcagtggaggaaaaccaccgtattcctgttgtgtcgtcgaacgcacacaacacctgccctcctgcagtctcgtggattaaaattcacaaaagtacgagaggtgggcgtagcatgcaacatgtaaatgcgtaacacctcaaaggcctgaagcacaaaccgttttagagtgcgggtcgctttttttgccgtcgcaagtacactgagttggcaactgtagcaatgatgtgtcggatatccaacctctctgcagtcccagcgagagcgcacttaaactatacaagggtcgagtattcttcttaaggagcaggtgtaaaaagcgttcgtcgtgttattaaacaggttccaggccaccagtgtacatcactagatgctgcgagtagcagagtagggtacgggctacacaatccctggccagtgcagcaacacttagtcggcggctggatttctcgacgatccaaagggaggacgattcgtggtaggaaattatcgtcatgcgtgcaagttggtacgcaaacagcaaaatggaacggaggcggcgcgcgaaaattaactttttgagcgctgctttcttttttctgcacgtctggtttaccgttttttgcttttgaagcgtacaggaagttatctttttccagtttcttgtcgatcgtcactctagccgaagcaaacggaaacgttgtgttttcttaggagcgtgttttctccgataaaacggattcaaacactcgtaggtcggagttgcttagtaccaagaagcatcacatattaccctggctgttgtaatcatacgtagtgttcacttggttccacttcactaatttttccacctcaactatgatttgcttacacaggataacttggatcaggcaaacacagacgttcaagatccaaaccaacgggccaactcgggggtctgttacgtcagaagaaacggtgagcgttttgtcagcacgagctttgttcctctcgaacagatcccagtaaatttttgacttcagagaaatcgattgctatcagcagcaatatctgttgaaaataacggcatcaccttagtcagtgttcgttcaggaggagaaaactgggtatacaaccaccttattctgtccccctccacaatctgacgacgaaaggaaaagcctgtcttctgtcgaagaccgtctgtatcggaactcttcgctgattgatataagcctaaaatctacccagacaagtaccctctgatgaggcaaaaaaatgcgttgctgtacctcatttcgatgcgctcaacgtgcactcaggaccggctgattgcagccggatggcgtctccccggctaagacacgaacagtcacttaaaaacatgcgtagagaacccagaacgaaattaccagttactgtttcgggatcgaggagaaaatgtaggccctcaactttctttggtgtttacttccctcgcggaattggcctgcgcccaccccgccagggaacgtcgtgtgctcccgtggcgtccctgaggagtgatagaattttaattttcggtttacccggttttctttcgaggaaactgttcggtctgtctggtccctggtttagttccacctttttttctgttttgcctgtagatgcttgcttgttgaagcaaaagatctccaacagtcctggtgtcttgcccggtgaccccgtagggttgtctaaaacgtggagcgtttcctaaaacaaaaaacactttgccaatcattcttctgttggatttgttttacctgggagtgccgtgtgtcactccgttgtgtgtcggtgggtttctatgccgtagcgtctcaaggtacctcaccgccagctacactgctccaaaaagtctgaagtcagttaactcatcgcatttgaaagagaaaagaagcaacga

SEQ ID NO: 2611 - DNA, 2032 bp, Toxoplasma gondii
acctgtctcgtctgtcgtcactcatggtatacggtcaatcaccaaaaaacgggtagttcctgatgctgagcgttttaccctttcttggtcgaatcctgtccttcacttctgttacaagcgcatgtcgacgcgcttgttctatctctctgtttcactgagactgtaactcagaagcaagaggcaacgaccaccgtatgcgtcaaatgccttttccacttaagaactttttcccatgcatcatatctcgactatgtcaacagtgctgtcgctcattctcgttcctccgggccgaaaaggctctttgcagcttcgtcctttttgtgagcacgaagggggcagtaaaaccaggcaatgcgaatcacaagctccgctgtagcaaaaaacatttcggaaacttttctgccgtgtagcgatggaattcgaatgatttactcaagaaacacctgtcctcgctttgttttcattttcggatgttcgattggtctgcccatctccttttgcaatgtcagagaagaacactacggcttaatgcggtcgccgacacaccggtgcaacgagcatttatttcgtacacgacaagttgttcggaaaagcattattctcatattttattgcaacacggcgaagcatctacctgcagtcacgattacaatattacatcctgttgtactgatccgctaccgaaaaaaattctttagggacagcaaaaagaggctttgtcaccgggtggttctattaagtcacatgaaccacgttaacgcgaacaagctgggatgttatggagtttcaccatgcgtcttttgctcctagtggacacttagaagtttttttcggtacagaatatacgccttaggttgcaagcatcccgtggctattctcttctttgctaaaaaattggtcaccgagtcaccattctcagctggtgtcaccggcgacgaggcgccgcaccgcgttcctcgttcgccgtcacagccgccgaacgatgcagcggtagtctcacatagatgccacaactatcgtctcaatgcagtaaaaaatacgattgtgttgtgtatacagatcgaggctcggtgtcggtgttctgggcttgattccgtaggactgaaaaccacgaggggaacaaccatactcgatgttcgttgtgtgcaaccgaataaaggtctgcttcatgcagtatcggggttcgcaaaagtacgcatatagagtggcaatacacctagcagggaacagtgggaaacccgaggtttcaattgtgatcgaatttggcgtagctatgaaggcatctgatgaagacaccagtgggtgagtttaccccatgaaagagcgtacctacggtcgcatgtggtccgtctgtatgttattagcctctgtattaggaagtaactgaatcgttaattcaggagtgtgtttcgcttgatttcgcatcccgggatgcgtcgttctcttgaagcgacccaatgtcacgcgtgtgccgtatacaaagagggcggcgggacgcgcatgcgggccctgtcggatatttgacgagtttggtcagcggtttaggtcagcgagccctcttctcttctgtcgctttaacttggttctccttctcgcccagcatacctccgtgtgaaactttctgttttctaaaccgcaaaacttcatgttcgccgcctctatgtcacctggcttcaatctggcccgccatccggtaaaacgtcaacgcatgtctgcatgtgctccgcagagcaacttcagggcgaatccctggggcacggcacgtcaagaagtccttctgttaggctttatgatcttatgattttttcgtagttgcccctacatggtcaatccgtcagtgtcattatagctggtccctcagttgttgcgcagctggtccccggtcacgcgcagcttccgtccctgcacgcttcgcatcaccagcaggaagactgtgcagccgtgttcctttctgagacgtatttcggcccttggatcatctggaggatgctgcattcgtttttttactgtgggttgtaaccagggaagaaaa

SEQ ID NO: 2612 - DNA, 1363 bp, Toxoplasma gondii
cattcctccttgcaaatgcatgtttaattcttcagaggcaaagaagacacgcaattggcttctcggtctcatctgtacgggtggctcttcgcgctatggtgagtccgctaaggaccacaacagctgcactcttatagtagtacttcagtagccgttgattcctagtattttgaacacctcccctggaaatacaacttgctccccagtgtccgacattgaaggcgaccgtgcgaaaaaaaaagaccaccaccgtcctggatcctgttgtcgccccacatgcatcttttcccaacaaacacgaaatgtaatcgcagactcctccacgggcactacgcatattacgaaaggagtagtcttttttatttttcccgtgctgcgagccccacttactttcttccttctgttcttcaactccttgtatgcgcgccggcccttggttggcttcgcctcgacgtagcccagacggacaaggcggaatcggttttcgaacttctttgccgcgttggggttgtcatagatcatcgcaaagccagacgatctgccgccaccgaaggcagttttcagaccaaaaacgacgatgctctgggagtcggaaacgcggaattgtttggcgatcttttccaccaactccttcttcgacacagagccacggctcgggtggaggatgtccacaccgaactgcttcctctgcagaagagggtttgtcttcagtttccggaaacgaagagagaaggcgcccgaatccgccatgttgctttcggtgacggaaaagaggggagaccggggagagaggaggccgggacgaggcagtaggtgacgcgagagaaagccagaatgagcttccgttccccactctgtgcacccgtctgtggttctcttgctaggacggaaaaaccgagacggaaaagtttcagggtcctttacttccgcagagggtgcgctttgcaatcggattcgaagtctctcctcttgccaagcggggaagtacagcgtcgaacctaggcgagaggggcggataaacagtctagcatgcatgcggttatttgctgcgtaaactgggaagtccccacggggtgtgtgggcgctgtgtggaggcggccgctgcatgcagagaaaaaatcgcgagctttgcttcgacctttccatgtggggcttgcgtggtcaggaggacgcgaaaggcagcatgttagggggggagactgcgggcgcttttacgggaagacctcctcgcgtttacacagtgttttgttgtctgtttatcggggcgggtagactcctgtttgctctctctgttgaacatttgagagttttgcgaatcgcccttttcccggtttcccgcccctttctcttcttcctttcaaaa

SEQ ID NO: 2613 - DNA, 3553 bp, Toxoplasma gondii
ggtcaacttcaatcttttccgtcacatcgcctggagcgacattacctttttgtgggtttaggtggtcattcttccatgaattaactgttgtataaggtccacgactagtatccttaggtactgggctgtattgcgttttttcgccgaagacgacgcagtccttgaaaggaagtcgtagacctagaattgttttcagcagttttgcgtgtttccgctgaaggaaagtacgcgctttgtcggcattgaggcggaagaactctgattttagccacgagttttgcaacgcagaaggcgactctcccttccttgtgtcatggtctccaatggttgaatcgccagcactacggatgtccgcaatcagggagattcgcttcgtcacttctggtacggatgccagccacgtaaggtttctgcgaacctcctgagaatagtcggactgggaaatcagctgagagaaaggaacaaaaaactcggtggcgtggcgataaagaagagcaaggaaaataaatagagggtcaaaaggtgtcgctgcaagaagcgccccgttccccagcacgaactcaggtgatctaaggagaaccgatgtcagtcccacgtcacgagtaaactgattcagttcatacaatgtggagtttgaccataaaaaggctacaactacgctcggttgggacggatgagggagcaaaatctcaagcagctggtgattagctggcttccactgcggggaggacagattcccagagctgcctggagcatctccttgaacgagttgtggttctgtttccttcgttccctcgtctggttgggcacctctttgccatgatgatatcagaagaattctcgggatcagagtccgaggacccagtcctccgctttctattgccatagttacggaaccgccaccaatgacggcatacagtagacacacagttcccggggtcagttcgtacacagtgcgactcagaaaaggtaacaggcaacgctacctagtggcattagtctgatgaagtgtggtgacgggcatatgcaactgcagggcaatcaccggctgcaaacggctttaccaccgcaccccgaaaagcaccaacacgtcaaatttgtcggacaagtctctcagcattcacgtaacactccgctagacgtcgacatttgtgaaactgttctggtcaacacgagttcagaaagtgcgtgtgcaatatcactgtggtgacgcaagaaaaagaaactgtggaaaaacctggggtttgtcttgcggtcctccagtgaggagtgtgcatgcaccggttcgctgccccctcgctacgactttccccgtgacggacaatcggtatctacaagtgtgaatatttgcaaagcaaatttgtttcgcacgtgatgggttggtggagatacgtcctctcatctcaatgcgtgcgcgctacaattgccgtaattactctatgtggtagacagcggtgctaaatgcgagacggcggaagcgtcaatggtagttcacagtgtcgtggcgaaatcggccgaggttgcgccgtatcattcttgaaaacactaagctttgatcagcagtggtttcagagaagagtcaggagaagagttgctcacgcttatcgccgtcaacattcagcagcgattcgctgacagtggccgcacttacgcatccccacgataaaacaaatcgaggccgttcaaaaagccgcgacaagcgccttggcccgagagacggaggccggtgataaaaaaagtatatcgaagccgtgtatagcttctggctgcgccatttaatgtcaaggaacacgtgagaatctcttggaattgtgatcacaacctccgtgaagtaaaggcacttgaccatttcaatttagagcgcaatagttgtagatgatcgtgttgttgtgaccagcgtttatcgattgtcagaaggcctacgataagcgttaaggcagattctgcttgcttagggagcttaatattcgtcgaaacgatctgaatttatagatgtcgtgaactcatttaggataagcgcgcacagatagtgagcatttctgttctcggaacttcgcctcggtcttcttggcaaaaaaggtgtcccctctcaaaatgtactgtgtgcctgtggtggtgtttctgtcctggcgtcgttgtttttgaagtgagacatcaaatttcaccgcctttgattacggcagaacagtcagatggtcacagatgcgacagggagtcagtgataccggtttctgataatatttccgatggtttttcgcatgtgtactgctggcgcgtactgaaccacctccacacctgcactatgtggacgttgtgcaggctcactcgctagaacgcgtaacgatgaaagcagactcctaatgaaaagtttcaggtcatttcactgaagaacacgcgatttctagtaagcagccagcgtcacatattagcgtgtcaaccaccggagtacagactgatcgttcagtggaagacggggattactaaacgaaagcaatacagagcaggagataaaagacagtcaattttgccacgccgtctcattcacccctttgtatcggaatgtagtggtgctcaccagctgtaccttcagtcactttttctctgatacatggtgactaaaaaaggaggccgtgtcggtgctgctcagtaattgtccgcccttgaacggtgggtcgaaaaatccccgaaaccgtattcacagaaagaaaaaggggtaccttcgttcaaagtgttttccggtggtgcagcttcgggttttttgagaaaacgaagacaattaatttgaatccgagtaaaggtcacagcttaaaagagagaaggtgcacggtttgcggcgacctgtgatactgtttaccgggagtgtccccatctagtgtcggaactgctctacctcacgtcatccgtggaaatgacgttttcttccgtcactgcacatctttacggctaccaaaacaccgtttactaatgcgcgctataaagaatcggagtctggtagacgactgcgtgcagtagtatctgaaaaatcactgttctaagtactgtaggatttgacaatcgagacggtcccgttccacctcacctgatctcgaaacttacttacagtgcactacagtgagtgaaccaaccaagtggaggagccaccggaagtcggcgaaaataacctagtacacatgcgttttcaacatttttcagagccttctacacgtcaacctgaaagcgggtgccgcgtcgctaccgtttcctgtggcgtctctagtgcgacatccgaagtaacagtaacgtccggcatggaacgccgacgcgggtgttccagtcgcctggctccttctactcgcacttcgatgttacgttccttattggtgcgacgcggttctcgtgttgctagacgtcgcaccggctgaaagctgtagaaaatttagttattttcctgtcagctagcttgcaggagtgcgtttttgtgtgttggtttcgtctcacatggctgctgatctgttgatgcagctgtgtacacgtgcctcgattctgtagttgacctagaacggatttgcaaaga

SEQ ID NO: 2614 - DNA, 3607 bp, Toxoplasma gondii
tctgcgtaagcaggtgatgtgcgtacgccaagtcgaggaaacagagcgagagacaggacctggaggtgaccagctgaagaaagacgacgcgtcaccggcggaggccggacagctgcggggacgagaagagggagagggcgacgctgcggctggcgagacgcaggcagagacagacggcggagcgtaaataaggaagggggaactgggcgttgtcatttgaaggagagactgcacgcggtcaagttcgcaggagaaagcagacgaacggagtccccaccagtggacggagagaaacgactcgcgcgtctttgttgtgggtcgagtcaaggcaccgagtcggcagtctgactcttttgcgagaagaaaccgacgcatgagctgcaatgcgaacatgagagagcaggcgcagtcaaggaaacagcgacgttggagtacgaaagcggaggtttccggcccgcagcggtgaggaagaacaggatagtggagtccgtgaggcggcactgtgtctgagagaaaaatctggttcacagacgagacagtgctaccccgcacatgtgcagactcgcggctgtatacgttcgcgtctttgccgttttttctccggaggcgaaacccagcggctttgaacggccacaggcagtggttgtgtcgtcgatttgtgagaggtcctgttctttcctcgaactttttcacacagatctccccgtcgtccccgcttctgagtgcatgcgacgcgattctttcctctcgatcttttcaggggaagaacagagtgtggagagatccacggcgtgccatcgttcacggtctcgcgtagccgctctgctccagtgaaaaaaaatgtccactggatgaagaacggcagtgaaggactccgatctgattttttaaaacgcagtccgagtccgcagcgacagaacatgtcttgtgaggacaataggagtccgcctgattcaccggaaaaccactccgctcccgggcatacgttcgcgcgtcgccagtcctcgcagttcagatgtggactcgagatcttccctttctgtgtctctatgtcttagaaaggcttcagacgacactccgcgggaagcggaaacgcctttcaagcaccgttcaccctcacagaaaagcacaccagggacgctagcttcccggcgattcagtcctttctttggggaaacacacttcagttctcgacgcccatgttctcttaaagaacgaggtgccatgcgacctaaccagtaactgaaagcggtctctcacagaacctgcagtgtccgtcgcttgccactccagagccgcttgcagacagcgacgtgtgggggattcgactttctgagaactgacgcgacatccgacttcttgtactttcagagaattctctcagtccagccttcgtcgcagttttcttcgagaaacagggaacttgaggaactaaacaaacgctttttcgagttctcagtggacacggaagtctctttcccttccacgtgcttgccatgtgtggcggcgtcttatcttaggggaagaaaacgaggttctacagctacagggtacactgtcacacattcagtgtttgagtctgcatgtcgcttaagaacgacctcgtctttgaggtgcgaaataagcgacggatactaaatgggcacctgtgaagaactcgtcttcagcacaacggttgacgcgcagcgtacggaaaccacggtattccgctgggacctgtctaactagttgttggccgctggcaaaaacgcctcctccactcgtggttcgtgtgaaacgcgttggctgttgcacagcaccttgtgcgatctgttgaactctacgcgaaaaagcgaaatcgcagtcggcctgcgacgccgacacctggaataccggcaagtcctttcaaccgtttacaaggaaagagaccgacacaggcgtgtgtccacgtttctgaaactctgtcgcgggtgtggcggctcctgcagataaaggaagcaagtaaggtttgtcggtgaagcaatcggatgtggttttcagagttgtctgctgactccccttccacacacctggaaaagatgtatttaagtgtgaggaggagagatacacagagcgatatcaacgccacagaaggcaagacacaatgcagtacagagcagcaaggagctgaaatacgcgcgggaaccgacactggtggctgttctcctgggctgacgacgagccgtgaagtcaggacagactccgaccgacggggctgatcgtgggtgcctctgaccagttgtgttctcttgtaaatacgagtggagacaggagtccagagagtatgcagtgaaaacataggcgatgtgggaaaccatcactgacgaaagtcagcagagtcgacgcagacagaaagaaggcgacggacctgattggccacaaccacccgtctcggacctgcccagctgtacgcattgatgcaagatgaatccgcatgtcagtcgggtaccacgaactgcctctcaatcagatcaactgctgtgtatcgagacgcgtattttttaggaacctgccttgtcctgtgaacagagagtctcgagagtgccccggtgcgctgctccctagtccaggctctctgcttcccggtggtcggaacattctacgaactgtttgcaggcacagcgaaagctcagcggcattccatggacagaaaggaacattactcgtgggaaagcgaaaaaagcgaaatcgagaacacttgtttctgtcagtgcccgcgagcccctgatcctcgagggtttagtgcacttaacatcgcagttctgcctgaagatttcccgcactgcagagaggggattttaaaagagaagctggcagcgaagggctggcaaagtctgtagaagcagaaacgtctctgtttttgccagaccaattccgaaagatccagttcttgaatgcttttccgctatcggcaagtgcctctctctcggctcttggttctatggtgtagcggttagcactgcggactctgaatccgcctacctgggttcaaatcccagtaggacctctagctgttgagactttttcctttttgacggagagcttttccacgagagaggggaaaatactgttcagttacattttcttactcgagttttggagaaaacttcccagcaaagaaaggaagccgacggaaagcctctctgcggatggtaaacaccacagacgggaacacggcgagacaacgcggctggcctttttcggcgcttgcatgcagcgcaagtttcgggactttcctgtcaagttcatctcgacaaagacaagcgtgcatgcatatacgaagatgtcgacgaaatcaattagggtatgaagttcgtgtttttgacagaatagacgtttcgaatgtggacgtcgagccgctgttctcacgttgcgaaagccttttcgctcgcctgctgtgcatgacacctctgccctcccttgcgtcctcgtcgtcgaagtgcaggacttcgtttcggccgccttccactttcaaggaagacgaatgaaaactcattttatgaaactggagtggcgctgctctttctgtgcgcagctttgtctctgcaagtgaggtttcccgccctcgtcggataagatattcactgaa

SEQ ID NO: 2615 - DNA, 3646 bp, Toxoplasma gondii
cgagcataccgccactcaaaaacagccacttgtacttctccgtgaagtggtccttctgaccgacagtccagcagtccggcagggtgccgtcatcgcgcgtctcgagatcgagtttctgctcgtctccctcgctttccaggtcctcagaacgcatcgagtacgccacttgcgcaagcgcccttctgtgaaactccccttcgtcgccttcggtgtcgtgattcgttgagctgcccgacgaccggcctgacttagacacgaagaacccagtgtccgaggcgcctaggtccgctcttcgtgtctgctcactggtctccttcagcttgcccaacggccccggtctgtcacgcaggtcttggcgatcgcgggaagtcaagaataaggaactggagacgctttctccgaggggactgcgttgtcgcaggccgtcgtcgaggcaccggccgcgtggacaaggaaccaagctcgggtcggcgcgcccagcgaaagacagagatggcaggccgttgcccaaactcgagttcctccgacacggagacagtcgatctgcagagagacccggccgcagggattgctccaggcacagcctgtcgaatgcgcgcgcatgcattcgacagccgagacgtaagtcgccgtccccgtcgggttcgccaacgcacccgcatgccgcgaggcccgagtcttcttctcgtcggcgctttccctctactctgccggcgacttcactcagcagcgcccggacgcgtctctcttctgcgtccaaataagcctttcgccgctcggaagtcaggcccctggaagcttgccagtcttgttctcccaaggccgcttcacccatggaactgcgcatcgtcgctggaagctccacgcgtggtcgcttctccaccactgccgcatcgtctcttcctcggcgttcttcgtcgctgtcgaggtgttctgccggactgcgactgttcgtcgcacgcaacggactccgagacagcatcagggcgagactgaggcgcgcagccttctccgaatctcgctctcttagtcgctcgagacactcagctgcctcgcgagtcgcagcgcactccgcaggcccgtctcgcggacggcatgggtggcagagacttgcatccacatcctcgaacggagacaccgccgcgcatgcacgcccctcgcgagttgatccccctgccgctcgctcgaggcgtccgcgttccgggccggtctccggtctctggtccagcacgagcttcccagtcgcggtctgcgagaaggccctcaggggcaggagctcgttctcatccgcaagcggtgcaggcgaaacccgcggctgaccgcggcctagcggcaccgtgcctcgggtgtctctaccctccacggagtagcggcgcaatgccgaggccgcctcgccaagaatgcgctgtacagaccgttcccaagcgtcttccgcgagctcgtctgaggcgccggggcgagctagatcgtcggagccgtgagaccctagggcctcctcggtctccgcgcggcgctggccgccggagacaaactctgagcggcgggtgcttcgcgctctgtcgcggcgcggggggcaggaagaagaagcgtacactgcctgtcggtccgaagaccacgccgcctcccaggggctgtccgagtcgtcggcagaccccctggagactgtcgagagagcgcagttgcaagcgtcgcttgcacagcggccggtgtctaacggagttccggacgcacgctgggtgtcgcaggatcgatgctccaagaagcggttgcggggcggggagaggcaccttttgggcaggtggaaaaagtcgctcgctgtcgtgagcaggcgctcgagaacgcggctgtcggtcgaagatcgtagcgaagagaagtcgggcaaccccgccagatcgcactttccgaggcgcgggtcgaacgctgaggagccttcagccggcgacatggagtccggagagacgccgagcaggcgggaggaacccgcgtacgtaggcaccgtgtcttgctcctccctctgtggactcgggccaagcgattccgctggaactgcactcgacaggcggtgcccactcgctttgggcgagaagcaaaatggatcggcgcctcggtcacttggcactcgagcgggtttgctcggcgttccccactgaggcaagaccgcctcgaaagtcggcagcatgtctttccaagtgctcggaggggcaggcgcagcagagcttttctccaccttgtcttcggggggtttcccgaaggctgtatcggggacgggtcctctcgagacgggagcgaagggcgccgacctgaacatcttgcgtgctcgacaggtccctgggtttcacaggaggcggcggcgcagagaagaagctccttgcgcgtgtggaaggttcgtccacgatctgaggggggaattcagctccgtctgcggagccagagagacagaggccagcgacggaacaaggccgcggtgctctgctcctgccacgtctggaggaaagccggagagagacgccagcttcgccttctcagccgccattcaccaaaggcttacggcgagtcaggaagagaagacacgcctcaaatccgctttttctgccgcgagaaaagcaacccattgccgggggcggacgccgaccgaaacgcggggagccccggtggctgagacgccaccagccagaaccgggggagcgaggaattgagtcggccgtttcttgagacgaggagaacgccgccggcgaaaatcactggacagaacaccaccagaaaaagagcgaccacgcggagtagacatcaaatccgcagctctcccgctcggaaaccagcaagttgcgctaattcacgcttctgacgcgcggacccgggtgtgcccggaggtggccaaatttgtggagtttcctgacaccgcggaacaatgcggactgtatttgagcccttcctcctcccgaactagatattgaaccaaccgtgaatacaagagggccagaacccagcccggttgctgctttgacgactcgacacagaactggggggaagcgtcaattccgctggggcagggaagcgcgcgtcgaaaagccgcccaacctcctcaagggaacgagatctctgcagactgccggcggagagacatcgctcccagggcctttctacagtctttctccgcacatcctcctggaaagcatccggaaactcccgcgttcgcctcccgaagaaagcaagaccggtacggccgcaggcaaaaggagaaagaatgcgagacgagaagcgagagaccactcttcacaatgcccgccccggacggcgaatggcaggggaaggcgggacgcactcaaagagagaacggaaacacgcgcggcactcttgtagctctgcaatgcccacagaaggcgctattctcgagtttgccaagtaaatattcgaagaatgacaagaagtggtgtgtccgcaaaacgcgctttgggtttgcggggagggggggggagtgctctgcgctccccaacagcgccgtaccctcagtttatagcggccgttcccacgagaccccgcaactcaaacaggagagcgtggcagcgaggagtgaggcgacttcctggtaacagcttttgagaagaatgtagggaaaaggtgggctactgcgaaacagaatttatta

SEQ ID NO: 2616 - DNA, 2453 bp, Toxoplasma gondii
tgtgtttcttcttactttttggctttagggttacacggaaaggttcacgcagagcggcggtccgccggcaggggtgaagacagaaaggaacagggatccaggatacctagtgaagatcacgtgtcgagttgtttgcagtggcttagtgcacgccgccggcttcgatcggtagtcttgccaatggcttccggattcctggaccctagaaacagacctgtagcttctgcgtcgttttctcctttgtacactgcgaaaggtcgcccaccgatttcctcccctcctcaggaacccacgacagattcggggcacataccagagcatttcaagtgcacagatgtctctacattgtcacctagttcgtgtgtagcttcagtagaaaaccaggaagcgcagtcgccatcgaacgatgaaaacgctctgttttcttgtgccgactcgtgctcttttccgtcccggcggcctccatcgggagcggcaccgcaccacgaaggacaggcccgccaggagagacgaggaatctctcaaaaacgtcaagcagcagttccacaggtcgcatccggaaagcaggttgttcgatcagagaagagaccagaggaactgcagcgcgagagaagctttggcttagcagtccatgcagttaggtgcgttggtgggagggacgaagaggtcgcccttgccgtggttttgcgggcgcagatggcggaacgcaaacggcgggaggccgcaaacagagcccagcgcgagcaagcagaagtgcgggggcgtcagatgcgtctacggcagagtctgcgacgcatcgaaagcttgaaaagaacccaagcagacaaagtgaggtccacgcagatacagatcaaccctcagcgcgtggatagagccgcggtagcccgcctgaacgatgccaactttcgcatcccctttcccacaggaggcacatgtccggtgaaacatgtgttacctcttttggaattcgacggcagtcacacccacaacggggactacaagtgccaggaacggaatgcgaagaaatacaactacacggatggtcgatcgctcgtccttgtggctcgcgccatgcccgctcccgcccgaggggttcctgtgaaatcggggaaacagagcttcttctgttagccctacccacaggaggcgctctgtaggccaggattcaaaactgacaatgacctagtgacctgatgcagaaagaggaacccttggagaccgagactgaaaaggaagagctaattttttgctcgttgtcaacatctcgaggcctcaacaccttggggggcgaccacgagtttccactgtaacttcccaaccagcattggtgatggtagactggtgtcttgtcgagttatgacagatagcagatgtcctcattccccttgcatgtgcgtaaactccctgtttgtcggtactgctacacgcccatttatttcatggtaacgccctcaaaatcttgaagtaagaccaacaagacacaatccgaaacaaagcgtgagtcgcacgactaacacactccaactcccgacttctaagaacaggatgtaactcgtgattccaactgggcagccttatacaagaaaatcgggtcaaattgcacgatgacgacagtcaacactatcgctgcacatcttccatagaactcagtatgcgtcagacaaacgtttgttgatacctgcgagccctgaacacctttgtgagatgatcttgctttggtataggatatcattcactctttacagtaatttgagctactgccgcacatagcctttggctggtcccgcaccttgttcggtgagaccgtcgccataactcaagttcgcctttccatttatttccatacacgtggaacgagtaagaaacgtcattcttctgcattagcacttttattgggtttgtcgatgagacaaagtacacgaggttgaacgtagcccacccaacgtgcaagaacggatatatctgcagacccccgttgccgctgccatcgctgcggataccacgtatcccccaactttggattttctcccaacggaacgccagattctggcattttgctcagcacaaatcagtgctgggagtggaagccaggagaccaagaacaagttacgcttgtcaagctctgacaccgaagaacgagtaacgttttgtttccaatacccccggcctttaaggactcttcgcgtttgtgaactttttttcgcctgaaccaacgcttttccggcgtgtgttcgtctgtctaaaccctaattttactggtatttgagacgtatttccgtgttcctgtgtttatttgacgctgtctcgcacagactctcccgttcacgtgtccgtttttaaggcgcccgcctcgtcttacagtcggctgtgggtcgccccagaatgtgtgcaaatttttcgaggtcttgtaattttctccgcgcgtggtgcagatgtgggcttttgcacgtcga

SEQ ID NO: 2617 - DNA, 3867 bp, Toxoplasma gondii
ttcctgagaatcacacttctgaactgctctccacgggtggcccaccccaccagcacatagaccgaatcgtaaactggtatgtcttcaacgcgggcatctggatacttccacactgcagcaaataagactcctacctagtgtatagatttataactagataaaatatgtgtatatatattgatagtagatctttacatgttctgcaagtgctctttcgtgagcggtgtggctggcaagacgatgcagcagtggagactgaggctgcctcagaactctgagaggagaaaacggtgagcggcaacgctgtccatgttctttatttcggacaaatgcaacagacggtagcaatctcaaaattcgagttgcgggcctctctccaaggcgactcagagacttccgggtcataatttgtaatgcacgcgacatatttcggcgcgtcgtctttagagaagagctactgtattagtgttttcgtgaagccttttgtgggctgcttttcttccagttcacactgctgccgctctccatgtcagggagcgagaatagtcctagagtcgcgtcttagaaccagcggcaagtgcgtctgatatatcgtccagaaggagtcagaggctgtcgagcaggggtgttgaaagaacgtaggttggcgtctcaacagcggacagacgagacaaagcgagtttcctacgccgacagaaggcgtggcggcagcactgcacaatgtacgcctacttcaccacccggtggcgacctgacactttcgaatttccccactttctcgaatgcatgcgcctacataggaaccgaaaaacaacacagaagaatgacaccggctgcagcgcgccggtgccgtgtcccctctctccaactcgtgcgcttttaatgcagaaacagaggcattcagagccacgggcgtgtcctacatggctccgtcccgaagaatgattgacgcattgggtctagaataccagcacttgcatatagagaagattcacggatatttgtgcttttagaagaggcgataactgtactgctgcatcgatgataaccgcaggcagattcaggattgaatcatctgctcaagatccacccccggttcgtccatgatgctgcttccagcctctgaggtctgtttgcctcgacagcagcatgcaatcggatcgattggttcacacacacacgcgtcctctttgtttccacacaagcatctgcaaggccagcacaggcaacagaaacacacgccacagaccatccgccccacgcacgtgaacaaaatcagaacgagcaggacgacgccgcagcacaggcccagcaccgagccaatcaagacgccgccgtccaacatgaaggctcacgacgaagggaaatacggttaaaatcttcgaaggggaaagcaggcagtcttacacttgaagagcgtgcgatcgcgtgcacagctttatcaacgtgtgcgtagtgaagagatcgaatcatgctgcgtaacctcttcgctacgctgctgccaatggagccggcacggtttaagggggacttagggggtccagttcctgggagggaacctaagaagcggctaccgcgtctacggaaggtaccaaacgtgtaaattaccccgttctggttgagaactggcaagagaaacgacatcctaaatatttaggcttggagtcgtacgagtgcacacgcatttcaaactagcaattggcagacatggtggatgtcaggcgacggtaattccacctctaaaatcgttttctctgtcgcctaacatgtgaagctctgcaggcaccagtccgaggccttctctagagaatcgcgtctctcgacgcatgcgctgcagtgcctccttgttactccgaaacttgaaccaaagccggaccgaaatcaatcgttcgttacggcgaatatcctgcgcatcgaaggcgactcgaatccattcctaaaacgcgaaagtggcacggctgttcttcgacagtgtgcactgcttgctgggtgcctccgaatgaagactgaaacatgatcacagatgcgtgatccttgctttcgaagcaaaacaaacgggattttttgacaaacactgggcaggtgaaactgcctcctcaaaaggaaaaatcatccacacgtctactgacagcagcgatctggctgcgaccttttattgcgaaaatgcatatagcaacatttatttcgttacagctgtacgtacgtgcacaaatttcaatgtatcttcgtacaagtatatgcaagtgtagggcaagcaagggtgaggacactccttgacccgagagcggtgtgggcgagacaaacatgcgctggcaggaggcacgcgaaaaaggtttcctttgcttttgtgttgcgtggtagttgggctaaggcaagctagggcaaatctcggacgccaaaggacacaagaacgacaaagacagacgggcgaccagcagcggaagacaacaggagcaaagactcgcccgagagcagccgagactcacagcaagcaagggaaaagtcgagggcgcaagtgaccgcctttctccttcactttcggcgtgcctttttaactgaaaatgcggagaagggggcatcgctgttctggtaaaaccgagtcaaaagggttgaagtgtatctgtttctcctcttcagtgtgtgtgaaagccggtgcgcggcaagacagcacagacttttgaggcttcacgaaaagatgcgccgccgatcaaacagcgagaactttaagacctcaagcgcgccttagggcgcgaacagcagagagaaaagctgcgtgctagaggaaacgaaacccagtcaacatttgtaaaaccgccatgttttccggggttatttatttttatacgagaacccgcaggacacagctggagagctgttggggaaaaaagcctttgtgtgtgcgagtgcatgtgcaagggaggtaaactggctccgccgctcccctgcgctggcaatttgccattcttacagctctcgtttccttccccttcctgtcgctatacgcttttcgtttcaggggtgctttgtttctgcgagaccagtgccttgccccttctcgtatgtcaccccgtctgtgttccgggatgctgctgcgtgcaccgagtctggctcgcttcgaggaaaacgaacgagtgtgagtttgactcacttctgctcgaaaagtcaaatgcgtgtttttctccactggtaggacaaatgtacttattttggccatcaacagacgcctgagcccacactgctgcacatccgcccctgttagacaggtcggcattgctttgctcgtgtgtgcgcggcatctgcgtgagacacaactatccagtgtgcacatgcttgttagtaactatgcgaaagagccacaaaatccgctgatcatacatctatgcatgcttgatcatgcgtgattcagtgtcagcaagtgcgagaaactgccggtttgccggcaagagtcgctttttctagctgcatcaccaagagaccaactagaggaagtacatcgtgttcgtcgtcccgacatctccatttcctgtgtgtctgcgtgctttgcttttctctcaaccttccgtttttcgtttctgttcgcgaaatgtcgatcgaacagtgcaattctctgttgtccctcactgcgtttgccaatgccataagacagttacgtcctgtcacacaaatcgccatcattccccctgtctcttccacgtttctgcacaagcacctcacgtggtcggcggtgctcatttgaatccttcgtttctgtgttctccacgttccgtcgcttcccccccttcccgtacaagcactgcttcggttgttttcggcaagttccttcgcgtctggtttcggtactcaaaacgaatcaggagcggctgagaa

SEQ ID NO: 2618 - DNA, 2614 bp, Toxoplasma gondii
cctcagtccctcaggaagttttcgtcctccgctttccttgtggtctctgctgctcaggcctcgagcgcctgggcgtctctctgcgtcgccacccgcgtctgcgagactctcttctcctcgagccggtcgacgcacgcagaaggacgccgtctgaggagcaaacttggggatggaaggggagggcgaaccgagggaacagtgaaatggcgagagagctgaacgagcagagagtccagggaggcgaggagcgaggagaccgaagcagagatagcgaagaaaaggtgaagcaagaggaacgacgagcgagcgaggtccagagagaaggaacatacgaggaagagtatcgggtgcgagagagcgtaggacggcggtcgagggggagagaaaggacggggaagactgagagtgcgaggaaagaaaatgagagaagaagagtgagagaagaggaaataaggagatcaagagggagaatgagagagcgagagctgaggaccctgcagggggtacgtgagcgttaaggaacagggaagctctgattggcaaacgcgaaatggaaaggggagaaagccggaaacagtctgtgtcactttttttctgtggatgtctgtgatttattcagtgcgtatatcccgtgtagtcgtgattatgacttgcattggttgaatgcgccgggaactgtggtgtcgcgcgccggaattcctgactcgcgcctcgaaaacttttaaagagaagaagggagacagattctccggacgtccattctttcgaagaaaaacggatccatggcttcgcatctcgcgacttggtgatgcccggcggccgcctcaagtgtctccggtgcaggttctttcctcccctgtcacagggacgtattcagaggatctgatcccgaacagtctaactcgcagtacagattttcatatcaaggtagcgtctgacactgcgaaaatctcatttggagagtcgcacagggactcgagcttcaggtctcaccgggtcggtcctgccccgccggcaactttttttccgttctactgttgcctcgtagtgcgtcttcgaacgctaatgataaatgcatgaagaagtaaagtgtgcagcgttcccgattctcccgaacagtgcagccactgggtccctggaaggtctttgctagcgtacgatgcagcgttgaaatgaagtccacccgaaaccagtgtttcgctgctgaatctcagtctactgtcacagttatcaaagcaaaaagacgtacgcaatgctacgtacgccgcatgtttgcgagagcgagaagcgttcctcaacacggtgtgaaagcgccgttcaagacaggaaggttgttttctgtgatggtaaagcggcagtcaggtgcaggggctgttcgcgggagctaaaaattgcagttcgtttttgctctgcctccttcacaggtttttgtggactttctgctcatgtttcgaagaatcttggcgagttctgcgcgccagagagagagagacacggacagccgtgcaatcgaagttagaagccgcgtgcgacggtgccttcaacgagttgaacgtcgatttttcttccgcagagaaagcgggagaaagagcatttgaaaggaagcactttcgctttttgggttggttgagaaccttggcgcgttggcctgcaaaaatctctacgaggctctggagtttcgctcgagtcttgtcaaattcacccctcccgaaccttggtagtattccccgggaggtccgcgaccggattctcccgcgtttctcgttgtccgtcgactcacaggtgtgcggagttccattcttttcctctgttttgcagacgtcttgaagaatcccgttaaactcattaactgcacgctgcgacactgtccgtgtgtgtttccgtcgtcgtcgccttgccgttcgcgcggttcgcaaagctcccgcagctcctcggcaggcagcagaacagagaccttttctcccaactctcgaaaaacggtgtcgcttttcagattaacaaaagcaaagccatttttcttgacgcttcgtccactcgacctcggacgcacagagacaaaggtgccgtcttggtggagaaaaacatggaaactgaaggactagccgtatacgcgacgagactctggaatccacgaggcccgaaggcacttcctgcctttgggatatgaagtttaaagcgtcaccggtctccaggagctttccaaaggactgaacggagacaagccaagtttccaagagacaatcaacttgcgcctccaccgagagaggcgccacaagaacgagctcagtctgcgtcggcgacaggtcgtttgtgcagcggcgagtcgagcagacagaaggctctccaagtttctgtgggcatccactccgatgcggcactgcagaggggctctcgaggtccagctctctgttgtttttctcaacagcgacaacttctcctccctttttctcaattgcccctctgcctctcccataaacggaagaaactccaaaatgttccagagagacagacaaagccgtacatgtctctttccgttccctccctgagcgtcagtccgcgacgtttccttcctcccttctctccactcttctccctctccctccccctgccgaga

SEQ ID NO: 2619 - DNA, 1407 bp, Toxoplasma gondii
ctttgtcctgtttgcgctgcttcttttcacggagttgcgcttgtacccacgcttgcacactgcgacgatgcctcccgctctcttcggcgtcccccttgtccttcagatcatcgagaacagttttgaacgtgtagtcgattccaagttcctttaagcgctgttgtttcttaagaccagacacaattttccggttcacctgtcttgcagaagccatctctccttctgctttattgtgcttaccagcggcaataagccgtgaaggagcccttttgaacttcttgtcagcatttgaaaacaccttttcagacagattttgagggggaacaacgtgacagacaagcgttcgcccgaacatcatgtagttgttcattgcctctgcaacaatatctgcgacttcaggtaactcgaactccacgaaagcaaatcctttgctgttgccagttcgtttgcttcgccgtaattccaccctcgtgaccttcccgaactgtgaaaagaactttctcagttgaggctcaaaaaagccctgtggtaagtgtcccaaatatatgacgccgcggtttgaaaccagggattttttgctgcgtgactgctccgagcgggtgcctgtagtcgtccttgaccgggattttcctagatcgtgtgtatgatcggaagtatctggccctcctggtgactgccgtgtcacggatttcctctttgttcgcacatcccctgatggtcgtttcgtcacacctgccgccttttgtttacttgcatctgactcgtcagccttcccctcattgcccgcacgttgcctctctacagcaggtactctaccgcccttattagaagttttgatacttccagaggtcgatgtagccctactcctatagtcccgcggagacatggaggcttttgccgccttccgcgacgatttcgtggaaaccgcgcctgaggacgatgccgcaggcgtcatggtgcaacactgaacaatataaatgggagaaaacgtcgaggactgcagagatatcgcaaattaaaatgtttccgtggataaaaagatgcaagatacagtaatttcggtaatttaagtcaagcgacagccgcttctgtggggctgcaagtcctcaaaacaccaggatgatggaacgcgattgaatggcatgaactgataaagagacgtagcggagatgaaaatgtgaagatgaaacagccacactcggtgtgatagctcttcagtggagtcaagatagtccgtactagcgtcgtgttttgtcggctacgccgcatgctaagtggtcggccgccctgcatgcagactttttcgcgtgaagtcgcagtcaactgcgcaggagactttggtgcaactccttaaaatctccttttttctcctctgacatcaacactgaaacaggcgggaaaggctga

SEQ ID NO: 2620 - DNA, 4728 bp, Toxoplasma gondii
gcattctgaaggccttcggatccggcgcgacgtgaacaagagtctggcccgtctgctacaacgctggacggaagccttggcccccgaaaagcaaggacgcggccttctcccgcaccggcgtcaggtcccccgtggtctgcctgttccctctgccattctgcattctctgtctctcttttctcccggcctccaaatccgtccggggcaaattcgaagtcggaggacgtggtttgatggtccaaggcgggcggcaaaccgcatgcgctggcactctcgccttcttggctcaaaagcactgccgacgcgcagccctctgctcgtccctggtggtctctgccgtttgagaaagcgagagcacgctcttcgtctgcccgctctgacgagagaggctcaccctgttcccggtggaagctgctgtagcgggaggttaccgaagaaggcggctccgactcttccggaatgctttctagaacgtgtgcagagtagcacagtcggccttcttcgtcgacccaggaaggcgggaggtagacgggtgaccgcgtcttctctccgcgcatggtttctcgccgccggcgctaaccgcacactgtgctcgaaaataccattccggggttagtatttccttctccctacgtactcacggcatgcaataccaggggggggcagcaatgaaggcggtctcgttccattttacggagtcgttccatggagtcaaaaagcaaatggagagacagctgatgtgtgcggtgttaaaagcaggtgagacctttccctggctagttacgatacgggagtagttcacgtagccaacacggtccgcgggtcttggtttaaccgaccccagttctactgtgctagcacggtttagagaagaccactttgtttctcgctttaatccctttgtaaacctccgcaacggagacacgccccgcccaacgcatctagacagtgccggcgaagagtcacctctcgcgtacggtcggggcaggtgccggcgggccgccgcctgacagctagagtcattgttttagcaccgacacagattggacgaaacgggaaaagcgcaagcacgcactcaattgagagattgtggagaacgcgggaaggcggaaacgcggcgacagaagggtaagagagtcaccaacaaggaaagacacagaaagacgagagccggcttggaacgaggagtcaccctcaatgagaacgcaaaatgtagctacacgaaagtcatcgaacgacttttcagagggttccttcactcgaggaaacagactaaaagagggtttacactggaaggtagagagaggggaaaaacaagatctctcgagtgttgaggaacggcggcacgcgcgagccagttcactgcacgcgggttccgtaccacgtttcaaagaagaccgtgctgggtagggagtaaatggacgaaggatcgtttcatagtattcatcgacaaaacaaagaagcgggtgagtgaaaaggcagataacgaagaaggacgcatcgataaaaagacagccgcaggagacgagagatgaccacgctggagactcgctagcggatctcgtttctaggcagcggacgcgcgaacggggagcgcatgcggcctctcaaaaaaacagagaacgaaaacgactctaacgcatctcaagatcggaaaaagacgctgcgttctgtgttcaagaggaaaggacgacggactttttgtatgtgtagagggtttcccgttccccgtgtcgctggcatcacacggagcgcgcgagacagctagggtttgtggagtgcgattgcctgggctggcgtttctatcgtttctacgtggcacaaggcattcaaggatcgcgaggctctttgttcataacaagagattaagacggacactggtattttctctccttcatgaagaggaggagggagtttcgtttaaagggtcttactgtccttgtttttcactggcgcaaaacgacagcgagtcccggtcaccagtcatgtgtcggactcgtacgcgtccggagaaaaatgaaggagtctgtgcccacgaaggcattgctacgggaacatgaaaacaggtcccttctcttctagtgaaatgcagtgcttgtatgagcagcttctgctccacaccgtgaagaaactggcgtgtgtctggcattgtgactggagagacgcaaaccgagtctggagccgcagcgatgagactgaagccgagcaggaagggttagttctcgtatatggaagaaaggagtacatgcacactgattcatgtgtagaaatgcaaggtaaggaagaaccccgtccagtctgtcgacgtgagggaagacaggcagaggcaagtgtggagactttgggttgctcttcaccagtcgtgcatgaaagaaataaggatccgccttagtctcaaacctgttcatttaaaagcatatgccgacgaatctaatggcggtgagctcgttcacgattccagaagctggcagggctctgcctcttcatggatccctttgaaaaaagaaaccaagaacagagctttcccttcaaaagaagtcgcacgcctgacttcacacacgtcaaaacatccggagaatacagtcgatccttctcggagagggagggaaaggaagtctcctaccactttgggcaattcgacacttttttagccgaatacgggtagccattccagcaagcggcgcacagacggggacatcgtttcctcatcccgtggcttcctctcctatccccttgtctttccgcttctctgtcaaggctttctttttgttgtatcttctttgtccgcattcattctgttacagagtggtctgagaagagcattttcttcagtggaaatatgttcggatttggagggcgcaagcgataccacctcaggggtagaagacctgggtgaagcaggtttgtgttcaacgttttctgaaaggtgtgtgaaacgaacatgccctggaaacagaattagcaattaatgtctgagagagatatcgaccgactcctctcggtacctgggactcgagtggaaggttcacttgagagatttcgtttttcgatgaaggaaagtctgaaagacacgacttaccattgccaaagatagtgacaacacagggcacgtgaacacaaaactcttgagtttgtcttcatctgtttcttattcatcgcgtttcccgctttcttccggttccccatcttcccaccccagtccggcccttctttgtgttcttgcacaggggagaacgagttagagtgcctgtactgactggatcgacatggcctcctgcaaacggagactcaaagaagtaacccagtgccgcaggtaaccggtagaagagacgaaggacctttccataatagttgggtggccgaggccaccctgaaactgaaagttccgccgaagaaactggtatgggagaaatgtagattcgcagaaactgggacgggagcaagacatggatatgttctccagcgtgtcaatgacaacgaaagaatcatgtaccgtgccgactgatacttgtcaaatacttcctcataaaattcgttggccctgtcgctcctggtgaccgcgcaagtcttatttggtttttcagcgacccctgtcctgcgatttccacaacgctgatgaaagctaaagcgacaaacagagctttgtctctgctctggtgactcggtgacaatgagacacgcctgtccccatcgtgttcggtttgctccttacgtttgccgcttccaacaccaaagcttgaggcagatcttttcgttccgcacactttcagagcagctccctcgctctctggtcttgagagagtttgttgactaaaacgaagatggttttttcttttttctgcaagtaaaagtttgctgcgacaccgtggagcaaatgtgccctggcgcacatggtagcgggtgggggggggtcgtctgcgttggcacctctacgcgagacaggagagaaactgagactagaaaagaagaaaagatcgtccaggtccctcgtccgaggcatgtttccatttttattttgccagttgctccacattggcttcaaggaatgacgagaaccgggtgcagcaaaacgtttgcaggtgactggatagctacgcgccgcttggcactgtgacgacctcaaaagtaccaccagtagtttctcccaggctcttgcttgccatctaccataattagacaagcataggcttgctttcccgcgctttcccaaagcaaaaaggtgcttttcgcagaagaaaaccgtttttctgcacctctttcacgtacccattggcgagatcgccgctacttccgcctgtcctagttgcactcttcctgtctctcttgtctcgtgctcgcacacggaagcaagaacggtcaagagcagatataacagtcttttctgtatcaccctctctacgaggtgactctctgatttacttcttgtcattcaccgttaactaccgagaccgatttgcccggtctgctccaggtcacctccagcggaaagagaaactcatgaagtgttgggtcacctacgctgtcgttctggtcgtcaggacgaaacatgattattccacatgagttatgttccaagcgtaatatatggattactgctatcacttctattaacatcgagagaaaataccactcagacgttagtacgatcagtaccgactttcgggaagtaactaactccggaaatcatttataagcctttatgcgagctttctcgcgagactttgaaga

SEQ ID NO: 2621 - DNA, 2627 bp, Toxoplasma gondii
atttcccaggcatgtaggtacctaaggaatcaagaactcatgtttctcgtaggaccagcaagtataattgtcagagctcagaagtacgcctttgcgtatctccccctcgatcgagaggtatcatctgatatgctcaaatctgcattcatgcgttcagttgcatgtgtccatgcatgcgggacttctgtgttatctcgtctggcgcagccactcagtggtctcaggaggttttcgctttgctctcggtcctcagtttgatctcaaccatatcaaccgtcagcaggtaggcgattatctgcacgcagcgtccatagtttcaatgttcaaattcatatctgcccgttcattcacttggaaagttcctcctccgtctcgtgtcacgacttcagtcgttatggtgtccattcgctctctccatatatgtatctatgtatcgtgtcgttttggtccgtctcgcttttatccgttatctagctgtgttttcttttcttccttcctcgttgtcgttctcgctccttcgtttgctgtcccatcgcatgcactcatattgatggctgcctgcaactctctttgtgcagtacgaggagtacggaacgtcgtttctcgagcgattcagcgtcagaggtcgtctgagatgagtcgcgcggtgcgcccccaacgcagagaattcggaaaccatccgatgttcaaatatgtggaggtggaaatatgaaaacaaacatatgtcgaagtccttgaacgtcagcgcatacctacacaggcaaatatatatatatatatatgcatatatatatatatatatatgagtgtgtggatgtgcatgtctatgtcgggatagatccatgctggtgcgacagcctaaacagacgaaatcattcgatgtgcacacctatgtaggtcatcctgtcaggaaaatatgattcgaagtttgagggaaatgaagcgcctatggcgatgtagcatttttaggcgcatgcgagttttttgtgctacaactggcactgcctgcctcatctcatttgtcgatcactcgggcgaaaccatcgtccggctttcaaaacgctgaaatacaacgcactgatcgaagacccacagtcactacgtgatgtgcccatgcgggggacggagggtagagatacaacacctggctagtattatagatgggccaccaaaaatccctgttttcttcagtcacgaatttaatacagatgcccatgggttcccacggctgagagattgttaaaatggaagacaaacgaatttggctgatgttctctccagacgttgaccctccattgttcgcacccacaccgtgtcgctttcaccgcgtctgtcggagcaactgaaatcccaaacctggagagatgattggtctgaaccagctcggtatctcattttctaaacagcaacaccggatgaaagaagcagcaccaggtcgcccgtgactacccagccacatcgccgtgtatataggcgccgtgtataacgatatctgttttagtacgtgtagggatgtatatctacgcctactcatgcggtgtatatgcactagagcacgaggcgtggttttgccagttctgtactgtcctcgaaccggcttttacccacccgtaacgattaccgggtgtcccacagtcttacatgcatttgacggattcttgcaataagtttttaaaggttcgcgtcgatttcgacagctcgctaccaagaggtccaaggtcaattcgtgctcctctgatagcagtttcatcgaaacgtggaatggcgccacgaatcttccgtgtccaggcatcaatttgcgacggcttcggcgacgctccgctcgcgctgaggtgccaccggtgatagctcagttggtagagcggcagactgtagaagtcgcagaaatctgttggtccctggttcgattccgggtcaccggactcttttcgacgtttgttttccgtagagaagacggctttcctctacgactagacttcgatgcaaatgaaagcagatcaccaacagggttatcatgattcgctgtttctccttttagacctgacacaagtatcctgcgttgcttgtgacagtaagtgaaagaaaatctcccccagcaatcgaaactgacttccaacgttatgacgaaaaacagaaagagtgcgggaaccatcccgcgagggaaaaggctgtaaatttacggtacggtcatctagaagcgcccagcagttcgagttccagcatatgaaggattccgcatgtggtagagagtcggtagacgttaacacggctgtcgaagcacggacgaaaccgtttccttacttcctttcgcgcagaaaccctggatgcctagttagctcgtatttgcgtccagtggtccatgtctctccgtaactgccgaactcgaaacaatcgcccgagtctacatagaggcatgttgtgtgaccttctgaagacagaacacaagcctcaggttgttgggctgcctcagcattcggcattccgctcttatgctgcattccatttctttgtccaaaacgtggagaaactcccgctaagaatatccgaggaattgaaccgtacttgtccatgcttttgcgcagaaagaatgcctcttgtagttactgagacaacgccaaccacttgca

SEQ ID NO: 2622 - DNA, 2181 bp, Toxoplasma gondii
ctcttgaaaacgtcgtttcctgcgtctttgcaggagagtgcaagtgtcatcctttcttccggggttccgtctacagtctcctcgtcttcgtctttggccttctcgtcgtctgtctgtacactcgacagtgagtcgctcatggctgcgtcctccacgcggttctcctcagcattcgcgacgggagattccgacagtttcgagttctctgatgcgtttgcttccatttttgctcgcgctccgctgtctgttgagcttcgttcgaggaacgcccgggaaaatgtctgcaggctcgggcagggaatctgtcggcagctcttagagtttctcccagagagagagaggcgccttcgaggtggaggcctgcaaaaaagttctttcgcaactggaagaagagcgcaggagacagacagaccgagagacagagagagatggggagagccgagttctgtgtagtcgtcttctctgtcacgagtggggcgtcgactcaagtgcggcaagagccacagacaggtcaactgctggccaggaagagcagcgaaggacggcaaaagttctgcgtttgcacaggaagaagcaggcgaccttcagcgattcgggacagaaacggcgtgcactggggcggctctcgttttcctctttttctgcgtcgtttcttcactctttcttcgcgcgcgtttcgagatcgctcaaagagacgggagcgcgcaggggcacagggcgcttccgtctttcgcaggcgagacgattccagacgtgaacgagaaaataaaatcttccaaagtcaagcgacggcaaagcgaggaaaaagcttcctcccctaaaagagctctctcccgaaatgggtgcgcacagtgtcgagagagtggacggcgcggcgcttgtctggatagagaaggagactctttgagtcggaggcagtcgcgttttaaagcttcaagtgttccgcaaaaactgaaatgggagcgagactctcggagtgcgttcgtcggatccggcacacagcacgcaaatttggggtgtttctcccgcggtcgtgtgtgcttttttcgcaggcgggcggcggtgttcgcggagccgtctttctccgaggaaacgtggagattcgtgaaccaatgacgctcaatgctcaccgaggagaagaaaagaaacaaatagctccgaagaacatctgccgagtgtctcgcgttccccagcgccgctctgcagcatacagcctagcatcttcaggtgtacatacaccgcacgcgttcggcgaaaatcgcagccttcagtctggacggttaccgctctgagcggcgaccaggaaagagtcggaagacggggacagcgccagacggcgaacaaggcgcgagtctcccgtggtgaacgaggagaaaaacaaacgatttccgcggtgatagaagaaaacgaaaagactgccgtcgtgtctccaggtcggacctcagcgcgctcgtctccatacagacacaactgccagcagagtcgctcgagagagtcagagttcaggcggcgtcgagccagatacgtaggctgtggcggcgtatcgcaaccaatgtatatagagccgaagaggaggtctccaagccagaaaatgtggctacttgattttcaagtgtgagaagaaatccgagttggaaaacgcgctcagtgggctgtcgcgcattgcagccgcgacctcttcgtttcgcccttccagcctcacgtggtgtatgtacacccgaaaaggcattgcgaaaagacgaaccgtgtccccgtcctccacgtgtgcggtcccggtttcttgtccttttatttgtctttcttcggtccactttctgcgttttgtggcgagccttcttatccactttctcgcagtcgcgtgtgcattttctccgtcgccatttctccccagggtagtcgcttctcgctttcagcctgaccccctatttatgcaatagaggccgccgcattcaacccgaccctcggtgcaagacaacctgggcaggaaacgatcaaaaaggcgtccgagaggaggcgaattcccctcgtctttgctcgtctctcaggcctcttcatctcttcggattcactccaaagcgcctttcttccctcccgtcttcagccgcaccgtccgcctcctttctgcctcctccacttgcccgctctccgccttttgtccttgttcgtctttcacatgcgaaa

SEQ ID NO: 2623 - DNA, 5034 bp, Toxoplasma gondii
ttcgaatgttttccgccgacactgtaaggatctaattttctcacatgaaggaggcgctcgcagcagtgctgcgttcagcgcttctgggcttctggaacgggcccttctgcactgcactcctgtggagttgtgcacaaagtcaaacaccgttctatccacagtagcaatacgaatctttggctctagtactgcgggccccaaggttgggtgagcgggggtgttggctcttcgaagcatctctttgataagagaatataggtgagctactcattactgcaggcgcgtgcaaggctggtcaacccgtggcaaggatttccggaggttttctcgagctcttctgaactattcaaagggttcagtaggctgcgcagactaacacacgcgcttctggagatacacaagcagtatcgcgctctcgtagcatgcactagtgaaaccaccgaatgtacaagctgaccaagcacacgtccggtgactgcggcacacggacgggaaatgagtctgacctgcggacccacacggcccttacctatggaaaaggacagtgtgggggaactgaacaaacacggtttaaccagttttgctgtgaatagtacaataacgtatgcacttccaataccgtgaaaatgactcatactacctgcttctccacgcatagacgtaaataaacccttctttgatgtgtcgctgagtccggccaacgcacgaattgctgtcccacgtataacagtgatcggctgtacgaaatgaatttgatcaagcagtttcctggcagaactctccagcgtgcgccttcaaaggcacgctggcaacggaagagccgaagtagggagctgtatttggttatgagtgctgacggacacggaacctgcagcacacggtgcattgttacctggatgggggagaactgcgaaatggcagaacatcaccgcgaatgcatgtacagaaactggataatttaagaggacaaataggatcttgcctcgttgaaatactcgaacaaacaggagcgaaaaacctcaagtcatcattgtcagttgaaacgtggtgttcgaataactgaggtaggcacggttaagcgataacgtccctgttcaaggttttactgaaagccgttccctggttgccgaaatcgcctacatacacttcgcgaggcttgcgttatgccttgacaaaaatcttcgcgcaagtgatttgtgacaagttgcagtgactcctcaatccgtgtggagaccttgtagcagggaattcctcttcctgtctctctggctttttcgttgcagaagaacaacagcagattagtgcgagaaggctccagaaatccccatcgctccctccacgacactagctctgtcacaaagcaaggcaccgcaatgtgtgccactgcatttcccttgtggtgaaacttcttcatggcaaagcccatggagcccctgggctatattgaaagctcgacagaagcactttcttgcggctgggcctaccgtcggtgacggtgacaaatcgagtgatgagaatgtgaggagcggacatgcctgtagcaagcttctgcttgtcttcggggaacgcctttgctctgcgcataccgtcgctgattgcaagttaattgcggcttgagcctcccttggcacaaccctaaaagcatggctttccccacagaaaagtagattatcagctgacacgtcttctgtgaacgtgtgggagtcctcgctcgcgaagtggtcggtgtcccagccaaatgttgccaaggaaaaactgtcgtccagcaagcagctttcttcgtctgaaacctctatgccagagggagccgagtcgagctttgtgtttgtctccggctgtatattcttgattgtgaccaggtcttcgcagtccacagcacccgcaaatgcttcttgacacggccctagggcgatttgaacacaagcctgtgatgttttacaaccgctctcaaaacctgaggcaccgaagagctttcgttccatttttgctgtcggaccctcatgcattaactccacaccagcaacaatggcatcatggattgtatcgaggaggcagagaggagtatcgacattccgttgtgacgaggaaggagtgccgaaagcctcaaagcatcccaaagcgctgcgttgtgaccttgtcgctggcgatggcaaagcagaaaaattccagatgtagttcatgaagagacttgagcgggagcaaacgaaaggcaaatccgaagcctgacacaaaatactgtgactacatgaagattccttgttacatgccggggtactttctgctgatctgctgcgtcgaaagcggtggtgtgagcggccaagggcaacggccctcacccggacgtttgcggcagaggtgggaatgaacacgtcacatccgtatggcaggttcctcggtaaagaatagtcaacccgaagtcctggagagcattccgggcacacagagtgaatctcgctgccctcatcctctacctcgatgcgacgcacgaaagaaacatcagtgagcgttcgcctagtcccacgttcaagtggatccctgtgtgctttgcgaccccttctggtttccggaaacatcgcgaaattctcaactcaacggacgaacacacttacgaataagcaaatcgcaacggtaaatacactggcatgggactcgaagctctgatcgggtaacacagctgtgcgagcggctcgtgacactagcagaagtcgcgatgagaggatatctacaagaagatcaatacatacgaggagcgatataaacgattgaaacagaaatgaaagaaccatggacagatccaccctctcggtagcaccgccggggcagcgcctgcgagcatcggcgtcgcgttggccgtgaaatggcgccagcctttgttttcaaatgacagattgcgaacgggagagctggtgctgcctgagtcacaatattgatgcttcgttgcagctgcaaccctacgctacagcgtacattgtcgctcactagcggatatgtaaagaggcaattcgaatggtgtagactccagtgtcagccttccgaccgtccaagcgacataccatcaaagtcggagaaaaagtgagatagtgcacggcgtgctctgtcaactgtgtccacgaaagatgacggcaccagctgtccaggtaggtggcaatcagatgcactgctacaacggtgagtcgcccaattaaaaaacagaagcgagatgcagtctcggtgagttttcagggcttccaatgggcacccaactttactttgaaccgaagaagcgctgcgcagaacgggttaccgaaagccgacgaagtcctgtgtatctggttcacatttctcaaacataggatcacgtcgggttcgcttaatggccgcaacagtatcggccggatttgttgctcatgcatcagttgtttgtattgacaaactttgtgcgtcttccgatggggactgatgaagaatcgccaggctgtcagagagctgaacatgataacaacgaagcgctgagggcttcacgccagcgtaagattaaccaatgagtttcatcttagggatgtggttcgtgcccggtctttataaaaaggtattcctcagcaactgtgtcagtggtggccctgatccgtaacgtcagacagtacactcgctccaacaaggtgacagttttactcatggtcttcatttttgacgcaccacacaggtccgtgtttccggaactaatgaatattttttcccttgtctgaaccaggttgatatctcgttcacccaagcgttgcacaacggacagccactcatgtgtgtgcttaagaaggacttcattgccgcatctaggatagcgggctgacacggaaatttgtattgtcccatcttgcattatggcaaagaagtgcctaggttcatatgcagttgaacgggagcgcgcttcatacacctgaggcctctccattttttgcaaaatcagatggatgatcgaagaaaagactctttctcagcgggctgtttgctgcaaggtgttcccgacgtcagtcaaggaaaaccacttcatcagccacaagcacaccactttagtgctttgaagtaaaactgtgtaagaaaacttgttaaatgcagtgttcgccagcgcatgctgtagactctcaaaactggtggtttccgttttcgcgtgtttatttcataatgaattttctggtctcatatgctacgccccaggaaggatgcgtgagtacagtggttgtctatattcacactgtatccttcacgtatgtgacgtagttcagagtccaggtaaaccagttacgatctgccgaccgtcttcctttggaggcgttcgcggaaaaactgcagagaagctccacgaggaagatgagacagaggcgggcatcttgcgcaactcgccaagagaaacgaatgcacgagacagaagtgagacacgagagagagagagcggcagcctatggtttgttcggtgaaattgtctttgtcggatatgacatgccccgcttgtggactgtggactccactgaaacttgcggacactgacatcggactaacaaagggtcgtatgaccattgcgacttttgagccaactgtaaaacgagaaaatcaactcttggatgattactcattgtgcccttataaactcctgatcgcctcactttctatatttgcttcgtcacttcgtaagagttcttcatcttacacgtccccttcttatttccacgacaactgggcgttagcaattccaaatccatacagctgatcgggtccccagaataattgttccaactctcttgactaagctatgtacgtgcatctgctcacgcgtttcagccttaacgcctttagaagtgaaaggaagtttccatttacctctgaactggtgtgactgtgaagagcggaggcactatattgatcaagtgattatgcctcacggcgaatactgcattttccctgacaaagtttcacctgtggcaccactcccactagctgtcgaagcagacgtcttttaaggaagtgcatttgaactctgtcattggccgtatttgaccacca

SEQ ID NO: 2624 - DNA, 2310 bp, Toxoplasma gondii
ggaaaggtaggccgcgaggagagcggaatctgagaagaacgagagggcccctcgcgagtcaacgacggagaccggttccgagaaaaacgctctccccttcgctcctcgctgcgctgcagagatcgctgccgcgaagcgacagtggggttcagatacgaaggcgtcccgcttcttcggcgggagggcgaggagacacttgcccgccgcgtggggccctgcgtgtggggcggcggaggcggggcctcccgcgcagacactctgaacgtttcggagcgaacagagctccttcgacaggcactcatgtcctgcgcatacgcgtcgcctccagagaccgagacagagagagaggcggccggcgagacctgtccgagagaagacgagagccgcgtggaggcctggcgaggcgacggcgcacggagctgggaggcaaacgctgcatgcaccggatgagagaagacagcggcagccacgaggagcgaaggagaggaagaagaggcgagagaagaggaagacggagacggggagacatctcgtccctttttgtcctcgctcggcaggagcggtcgagcctcgcgcgcgagagcagactggacgggaggcgttggaggcctgttggctttcgcgctgcgacggatcggagcttccccgccactgtgagacaaggagagagagaaatgctcccggcttccaactcttctgcctgctggaggtaagtcggcgagagaggcggcctgaggcctgctgaaacttgtccgcgtgtctgccgaagcatgccctttcttctccgcaggctgagaccccaaggacccagactctgtggcaagcgcccccaggtggggtccgttacgctgaggcaggagaggcatcgcgaaacagagagacagaaaggccagttgaagccagcggaaaggagggtgagaatggcaacagagaaaagggaaggaaggagggaaggagagacagagaggagagacagaaaggatgaccgttagatgagaataggggctgcaaagagctgagagacaggctgtcgaaggagggctgtccagaggagagagaagtcgacagcgatgaagaggcggaatcgatcgacgcgtggacgggggcggtcaggctcctacacactcggaagtaggagagtacgcgggtggcgacgagaaaaagcagagagatggaggatacacggaatgttgaagagaagagggcgctgcgtgagacggacggggagcagaatgaggagcagcttcgtggcgcaccgaaccaggccgttatggagaagaagggaactgcgtccagattcctgctgaggcggaggcgtggagggaaaagaacttgtttctcttctgaggaagaaatcctcttattttcgagactttcttttctctaggagacccgtctttataagaggatttcgagaagacacgacgcacacactgctgcgtcgccagagagctggcaggtagagagaagccggagaaagcgagagcgtcgccgccccttccttctgataggcaccgagctatgcaagttggcagctgcgtgcagagcaggttcattttaacgcttgaaatatactttttctctcctcgcaagtggtcacatcgtccggcagagagggcacctggagggcccgcgaaaaacttggttctcccctttgcagaagaccagaagagagacgatgcgtcgaggcgcaaggccgtccctgaggtgtctgaacactcagacgaggaccctcaggagctggctggcagaaaaggagagaaaaatacaccggagaaagaaagttcgaggcacccgagcgccctgggcccccggcgaaactgccgaaaaacctgcttggggtcggtggcggtgtcttgaattcttttcgcatgccacgtgaggtgtacatacaccgcgcagcccggagcgaccacccccccaaggcgcgttgtgtaggtacaccccgtttttcgcttgttggcgtcgaactcggtttttccgtatttcttcgcgcgactctgtcagcttgctcttttttcggcgcgatctcccgaacgactccacgtttctcgccgcgacaacagcctctgatttcatcacctttcctcgccgcgcgctccgcccactcaagcgccgtcgtcctttctccccggttttgcgctcgccacttttcgcacggggctcgaggtccttgccctccgcgtccgcagcccgtcactttttctctgtcttctctttctcttcaggcgacaactcgggagatttaacgctgtgaatccgctgttcccgcgctgtccatcgcttctctgctgcggggcctgcgctgca

SEQ ID NO: 2625 - DNA, 4593 bp, Toxoplasma gondii
gaagcagaagagagaaccagaagagagaggaggacacgatggagagagcgaagaggaagcgagaaaagaagagagcgcgaagaggaagcgagaaaagaagagagcgcgaagaggaagcgagaaaagaagagagagagaagaggaagcgagaaaagaagagagagagaagaggaagcgagaaaagaagacagagagagaagagaaagcagaacagaaaaacgacaggaaccgttgatcagctcacttctttttgaatgcgtccacgagcatccacaccatataggggatgttttctcgctcgttgtatgccggcaagatcacggaatagcgcgtcatcgtgagggacattgaacatggaagaagctgtcgagagaaattgaacgaaactcaagaaaacggagaaagtcgagctttcgccttcacgcaaaagggaagtggacagaagtctgctctcaaattcagtcaagtttggaaaaaaagaaactggaggaacagagacaagcgtggaatccgtgggcgctgaagaagctcttcggcgaagcaacgaggaacacaggcgcgcgagcagagaaagagagagaacagtaaaacgaacgagcaaggagagaaagcagcaggaactctggaagaccgccgaaaagagagcgtttgcctcagaacgcgatctcgctcgggtgtgtgtcgaacactcggccttgaagaggaacgcagctgcatgcagagtttcagaaaaaggggaaaactcgaaagccgacgaaaagaaagagagagatgcgaagaaaaagacgctgcaggacgagttggaagaggtagaaacagagggccagcgtgtggcgagcagttccgcagcttctgcggtgcctccgccctgggaaaagcagaaccggaggaactcgagagacaaagaaagaaaggctcacgagaagaaacgcgacaagacagcatgtatctgtgtggagtgtgtacggagaatctgtcgcgcagagtgggggaaagcaggagccgcgaaggacggttcttgagaaacgttttggcagtcctcacggcaagcagagcgcatgcagaagcgaccggaaagaagttggccaggcgacacacactagcgaagatcaaagcaggacgctgagctcgacacagagagggaaggcgaaaagaaaagagatttactgcgaggactttttcccgaaaaaacgcatgcgtcaaccgggagtcgaacccgggtcacctgcttggaaggcaggtatcctaaccgttggactattgacgcctcgagcaggaaagttggcgcgctttggccgagacgaagctcccttcccttcttacaggacctggatcgcctccagtccagtaagaagaagaaaagagtgcaggagaggagaaagcagactgtgaagtcgacgagaaactatgaaggcagcagggagaaacctgcagagttcagttgtggtttcggagtcttcaccaacgaggcgcgcaggcgcgggaagcagccttctctggggtcgttgggtcttttccgccttcgtgttcaggaaacagtgcttctcacgaggaaagaatcccagttgctgacagctggaaagtgtgtagaatacgagtgtcggctgtggcttctccagtggccgtagcgcgctagaaagaagcgaacttctgcgttcaccgtcgcattaacgcagctgtttcgagggacaccgccgatgagacgactcacgcgtccgatcgttaaacgagacagactctgaaagggccagatagagagacgcctgtcgtccgcgaagacagcgaaggcgaaggactctcaaggtagaaaaggtcggagaggagatggcaggaaagaatctgtagaaagagagaaagtcagggaacaactcgaatgcaaggtcgcgcttccatcgggtcggatgcagcagagaaaaagattcggaaaaggaaacggttcttcaaaaccgagaacaagcctctctggagaaacatctgggcctgcctgtacaagaaaagacagtctatggaactccgaaatcccgtggatgaggtgtaccaggatcagcttgagtcgtcggcatctgaagaaacggtggttgaccgaaccacaggaacctgatttcatgtatcagggagtctagcatcagcagttgttgcttgtctttgaacttcatgcgacgaatgcgtcaggaacggacacagtgaaccgcgaaacaacacacagcagtttttgtcacggtccatgtatgtccgaagtctgttgcctccagcttggtacctcgtcgctgcctctgggggttcttggagtctgtcaattcacagttctccattcgtccctggttgaaggaagcgagcgagaaagacttccagcgagttgagtatttcctgttttcatcgagagtgaaccgacggaagaagccgagcagcaagaggcctcttctttttggagagaagcaccgtgttgaacgtgaaggactgggtcgcgctttccttcagctcgtcagtgcatctcgccgcaggtaaatgaacggctttaaaagtgtctctggagacctttgaagacagaacaagacgcatacgcggttccccggatctgagaagtcaagttttcttttggacagcgatgaaaaaacgagagcattctaaggactcagcgagggggcacaagatgtctcgtcgcagcagtggctacgtgttgaagtgaaatggagggatattgacaaagttcatctttctcagaggcttcatgtttaggcttgcttgaaatccaggacttggtatcttctctttcaacaggcaaagactttgtttcttgtttccttcaactgctgtcaaacagaacgcgcgttttttgtgagcagccagacacgtgaccgagctcgagtatggaacttttttcaagggagggaacattttgatgcaggattccgttggactttctctcgtgtcttcgttccggggaaagagaacctctgtgtcgccgcagacaaacgcagcttgaaaagagtgtcattcttgagtgcgcgttggtcggcactcgcgagaagaagtcatgaattgtttttgataaattcgtttactgtgttgctccagtgcactgaaaaccaagggaaggccacaggggtgacttccagactttggaaagctgcttctcaggcacaacaggggattcgctctctgcctcaggtgaaaacagcgtctcgcacaaaactctacacgagagacaactggagaagaaagttaaccataggcgggtggcacctcgagataagcagacaaacacatgaaggcgaaccgggggaaacgcgtctcaacaggatgcgtctgtagttttggatccacagactgaaaatgcactttttcttctgtacgagaaggacggacgatcacatctcgacatgagtggcggattcgacagatcgagcgacagtcatgagcgtcctctgttagtgtgaagagtctgatgaagaaaactcgctgtcgattgccgaacctttacccactttgtcaacctgacaaaagggcgaacggaaagtgtgtttagagaaggggatggtttaatggttaggttttcttcttttctcagtttccccttccccctcatctcgtgaattcgcactcagactccagccggacttggtggcgtcgtccacctttttctggaaaaccgagtccaacaaggagagggaatctttttcgaagtggaatcgaagcacatgcgacggcgatgagcctgtggactgttcgcatctgaaagaatccgatgtttcgccgaatctccacagcaggagactgttctacgaggtctgaaaacacggctggcccccaagttgagatggtgtgtgtgcggcacctgaaaaggccgttggtctcttgagcaaaggacagtggcaacgaacgagcaaatgccaaggagaaaacgaaggaaaaacgcatttcttcattagaaagaacggtcgaccttctgtgggggaagaacggccgacacgacggacttctgaagtgagataggtcgtctgtttttgaatgctgctgccgagtctgtcagcgcttgtttctttctgcactttcgcctttgccgttttctcaaagaagaccgggggttttctcctctttcgttcctcccatgttccgtcttgacactcgcgagagacatccggaacatcggctctatttttttcaatttcctcgaggttcacgggaagtgctttctagatcactgttctctttgcggcgccttcgtggtatttggcttctccgactcttcacatttttttatcgaataccaagtaggtcacggcgtaacttccactcaaatcttctttcatttcctgtctttaaagtctgtatcggcctccgttaacctcgctcggatgtgtggcaccgactctctgtctcgcgatcgggacctcgagtttttctcaatggatgcagcagccttcgagtctctcggtctcatccctgcctcttccccattggaaatgaaccttccctcagtctcgcattttctctctacctcgctctgccttccactctaggaactccgagagtctgtcttcgtcgaaggacgagacagaggagcacctgtgttctgtcgaaaaaaacgaaaaa

SEQ ID NO: 2626 - DNA, 1875 bp, Toxoplasma gondii
caggcagcgaccttcgagaaaagccattcatacgaaattctagcttcccgatctttcaatagcgcatggtcacaccgggatgagagagcaggatgtccacaccggctgacaacggaagaaataagctcatcgaacaaggccgctgagagaggtgccgttctttcatttttgttctgtacaaggagaatgaggtattcttccatgcgtggtctgtattggcaatactccatccgttaattgtttaaccgctatagccggggctgagttcttaaggcagtgctatcaagcgatgccgacagcttctagacaaacgtggataccaacagggtattgaaaaccaccggttttagctgtcttcgtaggccagggacgtggcagtgtagagccatcgacagagccttggttgtcaacatctcagaaatgcagccgtactttcatcattcaatgtaccatgtctctgtaaattcgcgtcgatgccaaggtgaacacgcgcctttcagattctaaacagatatgatctttgtagaaggataccgctatccatcactgtggcactcaatgtggacagaggcactcggtgattctgagtttgagtccaattgtaagccacagacaaccacgtccgtcggctacgcttagtctatggagattgtgaaattaccgcaaagccgtatgatgttgaaatttaacatttccagttgctctccagcagaagcatattaatagtcgcaaaagcatattaataatcctgagagattgtcactctcagtacgatggcacggtcacaatctgagtatcgattcccctcgctgtcctgtgagaagtggactccaggtctctcctaccgtgaagctaactgaaagtttctacgcgacagtgaagaccgcggaaatcgcatttcagaaaaagcgaaaatccctcgaccatgcgcttctttcagcccctcggattccgcaaaggaagctgcctgccttgacaattcaaccctcatcttgcgtcagcaggggcatttgctaacagcgatgatggtaaaagcagaacagaaaggaactgcataagaggagcctggttcatgcccgcctcatcagattacgtgcaaggggattagtgctcgcgtgctgtgatcatgattcactggcagcttgtgaagccgaccgggccggtcaccgccacggcggcgacagggaaacaagccaaaagcagtcaactataaggcatctgacagctgttccgatcactggtgcaggaacaagtttccctccctataactgcaacattgacgagagactaatcaggaacatgggatgaccgccgacacggatcaactgacttgcggtggctcgtgttctgcgggtctcgttgctacaccaaaaaagaaagacgactattaggatcttgtttaggcatcctgcagtattccgagtcgtgcgccaaatcgttttctgttcgagaaagcgttccgcagatctcaagcgaacagcgacgcgtttcggtacatgcaactgcgctagcacttcaataccagcggcgaaccaggctgcccgtttctcccgcgtctggccattggttcggtgtgtcctgaactcgctggctgctttggttaggctaacggatttgcgcgtctatattcttcacgttcgggcagcgaaccaattttctgcccgatcgaatgcttaagaaaacttgagtccgcggctggaaagtggtactgtgtagaaagccacaggactggttgtgtagcttggtgtcttcagttgggagagggcggtcccgcaagctgttcgagtcctcgagcggcttgcctactagaaaatacacggacgcattttgacagaagcagtgattccacagaagcacggcgttcgatcgagagta

SEQ ID NO: 2627 - DNA, 2114 bp, Toxoplasma gondii
aaaaaggcctcagcagatagctccagaaggcacgcgagagtggctgtaggtgagagcggccattcgatgaccgaggctgacggtgtggatggcttctggggcacatacacggaaaagatgactctgcgagacgcccggagctttcgcggcctcatggagatggtgaaagttgcgaacgagactgcggaattggcattttgacgtttccggtcctcggccatctcgtgcagctgactgggggagcggtgcatgcgctgcggcaacattcttttgttgacagctgaaaagagtgaaatgcagtactgtcgtccctttgatgatacgaggttaacttgcaccagtgcggattttatttaaaaagtgcctcatactctgctcctgttgtcagtgcttgctgtggttgcaaattcttgtagcaaaagtaaccttctcagcgtggctctatacgatggaatggaaccggtgaatgcgaacagatcgagacgccttttacttctttcctttccaaatgtggtcggaagaaggcaccgagatagctttacgcaaggtggtagctgctacgacgcatctggtgtggctgcgcttgtgtgaggcaccttttctgggtctctacctcatcacctataagagataagcagcttctacagtgcacatcactgactgtcggtagcgaggcgagtcacgatcatgcgccacagtcggccctaaagctatgctgtattcgcattaaaaatatcccgatccgttttcgacgctggctccgcgtggagtgtcccccaaaaccatgttacggttaatagtcagtgccagccacagttcccttagaacatggacacggagagacgtgtctgtttgcttcaaaggtttacaggcactgaaaggtttcatgtcagtcgagcagagagccttgtgttgcagtgcatgttagcggttgtaggcttcacgaggaacgtgtttgtgcccccgtaagttcagcacctctgcgtgaagaaacgaagattcgttggtgtcaattttgccttgtgggttgatgaagccgtatgggaagagttactcatgatgcagaaataaccaggaggttgcatcgaaactcccggttctcgatgaagttggaaaacagcgcacgcagtgattattgtttgagattcaaactttggacagacgaattgtcatgcgtcaacaattcacgactcgaaatgtagtaagcactctttacgccgaaactcttcttaatgagcctgtaagcaaactctgtgctgctgtcgagcgcgcagtaccaaacttcgttgcatgcattaaccgatcgcaagcattcgggtggtttttccgacttgctacgtcggacgacggaaactttcattctcgagcgacaaattaattttgaattgcttaacagaaacttgctgaacaaaatccagtgctgcatacaatggatgcttctcgcgcgaagtgtgcagttggatgtgcgttggattttttttttgcataggcgactgtatcacctagaaaagttggcctcatttgccagctgttgaagcggtgtgaaatgttatttgtgcagtggcatcgtccctaagggatcgcaaagcgatttgttcttttttgtgtaggtgggagtccgtgtctgcgcttcccttcctgacggtatctcttttcttggcctacagcacggcagtaacacagtttgcttacctacctacaacttttgcatgctctaatttttgcagtcgagttcttaaacttcatgctgtgtacacgagaaaaccgcgggcttgcgcgtggatttcctctcagggcgcttcgctcgtaccacttgaaggaagggtgccctcgtgtgcccggactcaattttttttcgtggcgctcgccccctcatcatcctctccgtcccatgaacggcagaccttttgttttctatccttcgctgttgatttcctgtttactctgcttgtgcgccacgagtcattcagctggtactgtcctgttcgcaattgaaccatcgttaccgattggaaagaatccatccgcgactctgcttccgcgaacaagcacgcttgtccaattgtcttgaaaactccttgtcgtgcaatcaccttctgacgggtaaggcacaa

SEQ ID NO: 2628 - DNA, 3001 bp, Toxoplasma gondii
cttcttgcaagaagcgggagacggtagcagcaaacatgtttcttacgaggagaagcggtattgttaccaacactcattgtaggttcttccatctcgtcttcctacacagcaactctcgaggtttggtgacctgagcattatggcaaccggcgcgagtcgatattggagttacagtggattggctccattgcgcgattcgtcatacgtatgctctgtggacgtatcgtcatgccccaacaacgtttcccgtgcattttggtttatagtgatcaccctcatcgtttcactggcggcggcgtttacctacgcaacaggccaaaatgcaggtatgctgtggtaaatgctgtcacctcgaggtaaagatggctggtctcaggatggcagctgaaatacctatttagttcctcgacaccctgtggtgggcgttctctctatgataatgtaagcacctttgtgaatcatgtttgtcgtggagtgcatacgggttccgagaatgtattccagcagaacattcaagacggcggaaaaaccacggagtttgacctattgtagtcgttgaggggcgcgcgaactgcgttttgcccctacatttaatgtgctttggctttaagttttccgtttgccttgtcgcttcacagccacacaactgttcttctcgcgtaatgcacgagccgttgctatgcttctgcacccgctcctcgtttcatgacgggctcgaaaactgcatcccacgggattgactctgaaaaaaacttcttcggcaactaaactcttctctgtacaccagcgagacgcttgttgatttcaattgtccccaccattttctgttgtcgcctcatcgtttaggaaactgtggaggaaaagcggggtgactctgcgcggacatatctgccattgtgcttcagtcagtttccgttgagctacatacggcgtcacgtgggcgggagtcccttctaaaatttcccgtgcccaagctagcgcatttgcttagaataattcaaacttcactaatggtcctgcgggctaacaccggcgttcgtttcccatgcattatgattcgcggcgtatactttgcaggagcatttcttcactagttcgatgtgtgggagtccaccacagatgatatatgcctttagaatacggatatgacggttcgtcaaggatctgagcgcaaaacttgtacagacaaccagcgctcacgaaccggcataacgacaatcgcgtgacggccgacaaaaaccacatcatgctgaacccaaattgatttgttcttcagcggaacgatgcggagtacgaaatgtggaccaaacgacatcaacaacccccgcgtgcgtgaagagaaagaacacttgagcaccctcagaggaaaaccaagtctcatagcttcgttcccggcagagtcgcgtttgttgcactctattgaaacacaccatggcggacacgcatgcgacaacgaaacctcaccgctgaccagcgggggacagcgctataacccgcaaaaaaagtttcttactccggtgtcctggagaaaattaccatcgaaatggcgatgttcacggagattgagaggattgcctggaatgctggtccagtggtactcttttcctctgaagccgcttctgtagcgaccgttaggtctctgcagggtcacttctgttcccgaggggggtgttggcatggcgccagttgcgcagaaggagagcgtgtaacggaacgaccggtgagcgtaacgtctcgctgtcacctgagtgggggtcgtccgttggtggcaggagaatcgcgcttccctgcctggcaccgggtacaagtgacaatctgccccttgcaaggccgcagtctccggtgggatggggacggaggtccccatctctcgggtgatgatgagacgcgcaacgcctcaggctggaaacagagcagggaaaagtgtccgctgtggcgcagagcagggatcacagagtgtcaccccggctgaacagggcaggtggaggagctcctcacaccgcgtttttttttattacaaattatgttatgtatatacaaccgacaaccccttatgtctcctggtgacggtttcctgcatctcatgtgctagagggggatacaaatttcccggtatgaagtcagagtgtcgcttgcagcgcacaaaccccgcttttgcccacatgcatggacttgtgacgccttctcggggtattagatgttgttcttttgtgcatttactgttttagtaagcctgttgagaatgaattctgcggaccacatacctgcaattgacatttctctgagttagggtagctggtgttgccggctgccgtcgactgtgtcacagcgcgctaaatactccgccgagtagccgccagccaggaattttaggctgggcgcataaccacaagcattcgccacactacgtttcgatgagcgggggctgtatgccgcagggaacttgtgagaacagaaaacgcaattacgctacagtggatggtcgtcaacggagtgctccgtcccatccaagtggaaggtttacctgcggcagtttgcacacctcgtgattttgaagcctacccaaccacggatgtttccccaagtccagctggatgctatcgtgatcattgtaacttgtcgcaagggatctgaaatgagcagcgagtgatcctgctgctcattatcactttcaaaagcaccaggttgcgtcacacagcgactgccagtgttgacaacgattttgtggcaatctgcggctccggcgacagtttgaagactctgtctgtaagatggagttccattccgaagaaagtgtgtgatctgaatgtgagtgggggacaactgttctcgatgcagtgtacggggactgagctctgtttgagcgaccctcccttggctcggctttgaatgtctgacccgcttgtggacgacttgcgaggtttgagcccctgctactcggtggagtgaaaccgccagcacagtccaggagcaatcttgtggctttccttgccagtcgaaa

SEQ ID NO: 2629 - DNA, 2400 bp, Toxoplasma gondii
agacgggcatccatggccttcagtgcgcgtgtcagctgaagtaagtcatcaatctcctccaactttttctgtatctttatcttctgaagcgccgccctgagtcgtcgctggttatctttgatcaggtcaaccagccttcgtcgaggtgaaacagcaggtcccctttctgactcaagctcgtctgcttctagcttcccggtggcttctctgtatgctttcttgatggcttccaactgcttcacagctcggccaacttcgaaactgatgtcgaagtccccagatccctgaacccttagaatatacacaacctgatccgggtggatgtctggcaaactgaaaaatggaacaggcaccgacggccctggtactgcaataaaacgcggatggactaccggtgcaggtggcagaacaggggggggcatcccttcagtcccgtactgttcttctgtctcatgctgatgcgccacctctgtttccggcaaaccctcctgttcagttccacctgaatggaaatcgtgatcggataacgtcgtgtcaccctgttcctgttgttcttcacagtccggcaccacctctcccacagcgccagtcgcggcttccacactagcacttggagattccacatgaaagtatgacggggtcgatgctgaatcactcggaacggcaacgtcctctgagttctcatataaaacagcgtcttgtggaagaagggtcgcaatggacccggaccgtcgagctcccgtgcctacttcatcaaaggactccacttctggtagctctggcaccctgcacgccagttgtgccaacacaacgccttgcaaaacacttaccaacaagaagggtgactgcaacttcccgtgcctacacgtagcaaaactctacgacgcttgactcacctttggctcaatcctacggttgctgtggcaagggtgacaaacaagcctagaacacctgctgcgtgcagttgccttctgcactgtccgcaatccatgttgctgtgcacagtaacgcaaacaaaatagcgatcacttcagtgaatacgagtgccacacgcactacggtagtgtaacactgcgccgccttcgctgtgatagccgtcacccaccaagtagcgctgctgtgcctttctgttgcctcccctgttaccgccacccccgacgctcttcctaccaggtgctttccctggtcgcactagtcgacctccttccccgcagttcactctatcgtctctcagtgaccgagtgccatcatcttcgggtaagatgcttaccctccccccctcctccgcaaatcagcatgcctctaaaccccatggatggtcagtggcgtccgactgcattaatacgtctttagtcccgaccactacaggtcctccaacgacgagctgttaaccgcgctcgtttcccttcctcaaaccgctcggaatttgggtgatccaatcgtgcgtcacccccccattaagatatacacagtgccagtcggaagctcgtgaccttacccggtgtgatagcgcgacgggagatattgccgtctctctcgttcgtgtgttcctcgactggtttgcgttagagtacgtctagcacacagaacaaccaacggcgagtgaccaaactaaagctcaactcttgagaagaaaaattttgtcttccaaccagtgtcttgcaggctctctgtaagcgtacgcgcacacatcggcacgcttcagacacagcagtagcttgccagatgtgtctacctgccagtagttcagcgctgtgacgcactggcatacgcaactgcaactccaccgaaaacctcgaggctgctagtactggtgatcgtatgcgacacgcggattcacggcgtatgcgacaagcgggattgctgatgagcgtcgttccccactgaagcgcgcggagtcgtgggcgaccaccggtcacctggcgtctcagctgcgcgaggcacccctctcatagcgtggtactcgtcacgaataccaatcgctggggtcgcggcgggaggaatatgctgtttgttgaccatacgatcacgctgaacgaaaacatggtttgagacgccgtaagcgggcacaggttgtttgccctcgtctcattgcggaccaattcccggtccaccgctgcgtctcgactcgacggttgtgaccaccccacttcgcattgggcaatcggtaaagccataacattactttgcaattttatcggttgaaactgccgagcgagcttgcgtttttgggtgctgtcttctcccaccttttatcagttaagttgtacagtgagtgtcagcttgtttcgacacgtctgtatagacgcaactcggtttgcttgtgttgtttggtggctggccaaatcaaaggctattcatttttcacttgctgttgttctttgaagaaatcaagcaaga

SEQ ID NO: 2630 - DNA, 1456 bp, Toxoplasma gondii
gatgccaatgcgctaacaactgaagcaatactccgtcacttcacattgttgaacatgccgagatacagagcctgagactgagaaataaaccgcacagggcgggaatggtcgattggctagagggtaaattgcttttccgccctcataaggacgtcggaaatgcggcacggttgtgcagaacgtcaagacttctcttttagacagtgttctaataatataaagtcaatgtgacaagttcaagaatcagacgctttcagctttcgttcgaagtccacagtcgggtgagctcggggaaactcggtaccggcctgtgagttgttttgccgggaacgcaggctgagagtgaaaagcggtcgcggtctcgtgtttttttccacctcctccgttcaacacggaaaggaggcactttggttgaccggttgacttcctcatttctcttgcccttgaaacgcggtctttcgtttcttgctgcgatgagcggacacagcggtttggacggagtcgcatgcacggctcttgaaagaactccacttttctcgccgtgctcttcgagaaaatgcagtacttcaacgctttaatacgagcgaagaagtctcgcggagagagaagaaccgagagagaagagagaaggttgtgtcgctctttcgaagacacccagaaggtcagctgagaagcactcccctccaagagtcaccaccggcgtccacgtgaacgaggagtccggagtgaagaaaccttcgatcattgagtcggcgacagaagcctcaaaacttcgaaccgaaggaaactaaactttctaagcggaacataatttcaagtcctctgtgccaaccagctttcactcactgtatgatgcaactttgtatcgaccgcaatcggacgcagcttttcgaagcgagagcacaagaacatgcagttctcccttgcacttgattaagaacgacatcacttatcatttggtcaaggaaaaatcaaaaattgccggggaaagaaagaaaccttctaaaactgcggtcgcttgcgacgcgccagaccctgtgccgcttttgtgtcgtcgacatcatctgcatgcgctagctaggtcatcttaccattgcatctgttttctccatcttttctctcactttgtgcgtcgtttcctccaatcctacgcctttccctctctctcttctcctcctctaccttctccctctttccttttctcaacgcttgaggacgctctgactctccaactctcatttctctcctttcttcccccacaacaaaagagacgctgacgctccggtgtctcgcttcttcttcctcctctccttctgttctcttcttctctctctccttcgtcgtctccctctgcgtcttcgctctctcctttccgttctctcttttctctccttggtttccctcagtcttcgctctctcctgcgtcgctcggtttcgaccgggatctgctaaaaaa

SEQ ID NO: 2631 - DNA, 1927 bp, Toxoplasma gondii
caccactggcggaaggaaaacagaatttcctcctctctggacgccacgacttccgccgtcccctctcgacagccagacgagggagaggaaggcaaatggcagggagacagcaggggaggcgacgcggcagccaggcggccgtcctgcccctctgcggagacgcctggccggggagagagagagcgaggagccctgtctctgtctcttcttctgccttcctccatttcctgttgagcgagaggagaaaggacctatccgccgagcaccgggggcctgtctaaaggtgtgtacggagatttgcttgcttcctgcgcgaggcaagaagcggaggctctcccggcactccactcaagaagcgacagcgagacggatacgactgcgtttccttgctcctgtgactccatggacggttactgaacagggagggggactgaggagaaggtgaaagggcaacgagcgcaggcaggcaccccgtgcgtcaggttggctgtgttctgcataacaagtcgcgacgacggggaaggaggaggaggatgagagcctggcatgacctcacagtgggtcctggagccgcagatctgaggcgccgacgaaacgaagagaaggggagaagaaagaagcgccgacttgccgcctggtgctctctggagagtcgagaagggatacggaacacagccgagaagacaaggccgggaaagagcgtcgaagaaacatgctggcaggcctccagacatatctgaaggcgacgcaacagagagaatggaagaaatgtcgtccttctctccttttgcctcgaagaaacagaagaaacagccgccgctattcccctggattcctgcagaaaaaattctctgctgtctcgacaccccgtggagggcgagaagaccatgggtcgtggcgacctatacaccggggaataggcgcgttttggcaccggttcgcggctacgaaaaataactcgagtttggaaacgagttttctcgtctccatgtctcgcagggcattccagtttcaccgtgaagctccaggtgcgtcaaggcggttcagcagccagcgtgtgcatgcagtttgtgagaggcaagaagcagcgacccgcagaggacgcaacagaagcaagaaaaatcgaccgcgggtgtgtatcgctttccggcagtggaatgcgtttttcctctctgaacagtcccagtttgtctccctctcccttccctcttctggagtcttcaagcattttctcgcgagctcggttccgtctttttgcagacctcgcaggtccccggccactgcgcgctcgagagacgagaaaacgaggactggtttcgcccgttcatctggcttttttctcgttctctctctacgacctctctgcctctgttgagtctccaggcgcgtttccgactcatcgttcagcatagttgtcctcgctcttggactgctgtttcctctctctctccctcagtcgccgggtgcgtagttgaaatccctttgtgcaagtcgagctctgcgagttggatggatgtatctctcggtctccatctctctatttttgcgtcggtctttgtctctctctatccgttgatctctgcacttgccgcagttagagagagttttgttgtggtgaatgacatcctgcctgacgtttttactgtagggacaccgcctcacgcgctgcctgtcgctccgtcgctttcctgcccctctgcgcctcttccatacgctcctctctgtgggagagaggccgaatggatgggtcgccacgaagggtaacgaaacctcttttgctatagaccttttccctgctctccgtctcgccataaaactggaactcgcgtttcttctcgctaagcctacgattctcgccacctgaaaacgaagaaaaagtcaccgctgacactgcgccaggtcaatatctctgttctttcagacgcca

SEQ ID NO: 2632 - DNA, 1610 bp, Toxoplasma gondii
gaagagaaaagcgaggaagaagccgagatactggaaaagagggagacgggcgggaagcagagagcaaccagagcggaaacgcatgagggcgcgcagacctcagtcgaccggggaaagacgagctctcgctttcgcgagaggggagaggtcggctcctggaaacgaagaaacgtcgcgggtgcgacggagacgacaagaaaacaacagtgccaaggagatccgaagcggagagggttgagagagagaaaaggtcgagagagaaaggacgaaaccttccacagggtagaggcaccgagagaagaaagcacgggagaacgagagagccccgtagagattcacagagaagcgacagggcgtctgtcccacagaaactcgccgaaacagctctcgggtctgttcgctctggtgtacgccctgcaagtcacttttctccccggacggcggacgcggggaaggcggccgctgtagagagacagaaagacgaagcgtgtgttccctaatgagccagatgcgtcctgggcgaggcgtctgggtgtttcgaggctttcgttttctaacgagcgacgaggaagtgaagattccggggcctccgatgtgagaaacgctcgtcagaaagtccggcttgtacgcaagacgtggacgagggaggcgcaaacaaaggctcccgtgacgcggcaccttgaaaggtccttctgcccaggtgcatgcagagctgcgtggtcagccgaagaggtctgcagacgaagaaggctgttcgcagcctcaactcagcagtctcgagcgcagctgggcggccagagagctcgcgaaaacgcgggggcgcgcggcgcgttcagaacggacggaaaaagcaggggaatgcacgcctggacgacgaactgcaagagtccgggcatgcgggacgatggcttgcctcctctctcttttctcttgggtgagaagcgcgcgaggctttttttcgcgcggcagggcgaaaaaagccgagaaaaccgcggccaaggatccgaggacggacgcagtgtcttcacaggggggacttgcttcacgggagatggacatgcactgaaaaaagctacgcgaagaagtctctctgtggcgccaaagttcaggagagcgttcaagcagaactcccgcgggtgtgcgcttcccggcctctggaaatcccggggaattgctgggtgtacatacacctcagccgccagccggacacgaggtgacagttccggagcgcgttgcgcaagatgtttcctgtccgtcgcgcgccggggaagaccgcgccttttttcgacggcaaatccgaagcgtcgccagttctgccgaggaggtgcagcttcggtctctcgcgcgaaggaaaaccgaggcacaaaacgcggcagccgctgctccgcaaggtcgatgttcgggtctcgcgcaaacttctgggtgcgagctagttgcgcgaagtaggctcaccgcattccaaatccctctttttcttctttctcgcctcgatttccgctcgatcgcgccctcgtctgcacacaagcggtctgaacctcccctactctcccctccaccctccttcttttcagcgctcccgcaaaaaaagcggccgaatgggtcggcttata

SEQ ID NO: 2633 - DNA, 2308 bp, Toxoplasma gondii
tcctgttcaatggtgacgtcgccgcgtttttcctccttccgttcttccccgagtgaaccactatgtccgtttaattccgtgtgcgacggaagatcacaatcgtcttctttcctgcatccggtgcactctgtctcagcgttaccctcctgcttttgcacggaaccaacctggacacctttcgacactgtcaaggggtaaccaatatgtttcttattcgacaatgccgaatccgtagagaaataatcacaagcttgaacggaatgcgtggtcatacgtgatcccaccatgggaggcaccatggacgaactcatctgcacgggagagaagaacggggatgaggtagggtgattccccaggtcttgttgcctgacagtgtatggcatgggttgcacttggctgcgaacattcggagctccgggaacacactgaacgggcgacggaacgtaggtttgtacgggagttccaagacagctcattgtcttcacacttacacgatgatgggaggaacccaacgacggcgcgtaagtctgggcatacacctgttccctcggaacgtgaatgatctcccgaggtaatgcgtcctgttgcaaaggcatatttgtgaaacacgctttgttcggccaggcccgtacaccttggtgctggggaggagagctccttaggcgaatactcagttcattgctctcacttgtgactgacctcggacaagagaggcaatcgatcagagccccggcggctgcagtgcacaaaggtcagcatacaacagacccacgggagtcaacaacacgataaagcttgccttggacagttcttgctggtacgggcatttgtcacaggccaagtctcctaaaacaataaacaaacacccctgatcttcattgtagccgtgtgggggccacgaaaaatcacttactcgcaaacggcacttgccataaggggatgtgatccgatatttgtctttgcagggccgatgaaggttcttcgacgtacgccattgtagaccctctaaaacgaaactcctcaggaaaaacagattgggccgtacaggaggacgaagtttaccagtattatctgcgtgctcggcgagttcaggttggcaagtcaaatcactcaagatccgaaatagtgtacacgcaggtgaagcaacttggcgcccctcgtcgatgatctcgtttccacgaataacatggaattgtgtaagtctgacatgaagctgcaaaaaatgacgagtttgttacattcgcatgcccatcgacaggctgggagtccgcgtggcccggtacgggaactgcgtttgagtcgttgctttccccggctgaacaaaaatttcaccgtctcgacagccttactccagacacgattgacgcgcgtgatgtatggaagttcaactctgacttcgcttgattttcctataaagaccagtcgtcgtattgatgtgtacctgtcgcggcgggaggtgagccgttgcaagcccacacaactgttcctcacgagcacagagaactcagggctgccaaagcctcactctcgcttgacttgcgagggggaaagtggactgaaggtacacataggtgtgaaaacattgcgtgaaaaggtgcttagaatcagaagcctactgcttcagcttggcacgcgcatgtttccaattggtctctacttccgattctgcgaatgcagcaggcaaacccctcgatgcgagttgccttggcgacggggcacgcctcgccgtaccctcctgcctccggcatcgcacgattcatcgacgccgtctctacaggaaatgcggaaagcgatcagagcgatgtggccgaagatatggcatttttggtgtgtatatgtgaaactaaagggtgaaataggacattttgtgtgcagctatgtagcaagaaatcattaaggaacgggacgcttctctccctccctggcaatcagggcagctagcagaacgacagaatcatggacacgacccacgctgcgatactgtgcttgtcgagacctaacgaggtctcgcaaatttgccgtgtgcgtttgtgccacgactggtgaacgccggccgtaaaaacgccaattctttgcagaaatgtgtggagcggaaggttgacgtcaaatcactctggaaccgtctgtcttccgcggagaagaaaatgactcgcctggaaaactccctccacagcatcaacatgcacggggatgtcccgcgctggcgcctgacgtgaactagttctgagacggtgttttgcttcgtgccaactatataccactactcgttgtcttccatccttcttcgacagtcaaattctgcaaaaca

SEQ ID NO: 2634 - DNA, 1895 bp, Toxoplasma gondii
aactcgagtttctccatcgtttcaaagacgtccttgatgcggctctgcaggacctctgcggcctctcggcgcagctggagaagccggaccgcacgtgagttgtctccgggtgagtctccaggaccgtggacctcgccggcctgtctctgcggctccaaatccgccgcaggccgcgcctgggtcgattgcccgcctgcagtcgcggccttctgcatgaggagcaggtcttcttcgcgctcctcgacttggtcgtcctgaatgacgtcgtcctcttcgcctcgctctcgggagaagctggcctcctcgctgaagtctggaagcgccgcagccgcgaaaagcaaagcggcagaggacgcagactccgaccccagggaacggggacctgcggagcagcgcgcatgtgaaggagacggcgcgcgagagaaggcagagcgaggaaggtcgggaagcagagtgtgcagagcgacgaaggtcagaagagcgaggatggagaaggagaggcgagaggagacagaagtcgaggagaggccgggcactgccgacatgcagggcgttctgttcgcggacattgcggagacagagaggacgaggcagacagagaggacgaggcagacagagtgaacgaagcgctttcctctacgaaggctgcggaggtagggtgacagatctcccccgagaactccttacacgcacatagacgcaggaaatgacaggaaaagaagagagagagaggggaaggaagaagaagagagaacgagacgcaaagagaaagaggagaggtgagaaggaacgcgagagagaagaagagaatggaacagcgacagaaggagaccgagaaagagaaagacaatgagagcgaggagagaaggaatgcgaggaagacggactagagagaaagagacgcccgaggtaaatggtggatagagaacgcggcctcaggagagagggagaggagacgattcagacaccgagaggaacgcgtgagaaacttgtctcctgtcgagaccctcgtgtacatttgaccagtttccgagagccgagagagaaaagctttgccgacgagaagactgcactctggcactgggcgccagcgacttgctctgtagagaaaagacgcgtctctccagttactctctggaactcagtacagctgcatggaagctgttcacaaggagacgagaggaagagacgaacagatgaaggagagaaggaaaacggtcaagcgcagtgcagaaaatcacaagaacggaagacagttacacaaaacatgcgcatgcacgggtcttcttttctcggagacagcagccccgggacacagaactcgagggcgcatgcactgtggcgcggtttgtgtctcgtctccccgcaaaacagccccccagaatcttttttctctccgtattttccgtcttttttctgttccacctgccttcctcttcaagttgccggcagactccccagtagggacggttccagttcccgcagcttcctttcgcatgcacgcgttggcttcgcgcccccccgcggcctacgaaggcgagacaccgtccgttttctctcctctgcatccccgctcgaggaaaggctggagaagctcagagagaagagacggagaggctgtcgctgccggaacgcgaaggagggtgacgcgcgacagcgcctcgagagagaagagcacctcggtcttccagaaagacgggagactcgaaaaggcgagagacgaagaggagacaaacgacgaaacaacagagggcgacgctcctgtgtctgacgcgttcaagcgagtgtatctttgtgctcgctttccttctgccttccaaggtcgcggtctccccgctctctccactcccggacgtctgcactcgcttcagcgctctcacctcttagcaaaacga

SEQ ID NO: 2635 - DNA, 1745 bp, Toxoplasma gondii
tgtgttcagtatgcagacgatattatttcagtacaagatgaacgcgagatcttgagggaacatcgcttaccttctgggagtgccgtgtacctatgtcggactggttgatcagagctgagagagcaaaggttgccacagacgccacagacaaacactcaaaattgattcagtgcctgcggagttttctccctttacagttcagccacgagcagcctcagaatgatgttgcaatacatgtactttagtctccgcagaaagcaaataatttcgcacggtgccactgtgcgctgccagacatgatcctgagatcagtgtgaccacatgtccaggcattcttacttgtggatgacgctggtggtccgccggcgttgcgagcgggattccacctgaaaacgacaacgaaagggcatgaccgcgttcacctgagtgcttgctaagagttagtttgttaacaaatagtctatcccacgaaaacgccatataatggtaggctaaccatcagtgaagttatcaaattcagttccggtttagagcaagaaacgtactctggcagagagaggtgatgggtttgccagtcgagacttgataccttccttccatgcctgcaacacagcggaggcaggacaacatcggctctcaatgcgtttagccacatgcacgcggtcacaatcgagcgacggggtaccgacaacttcgaccgtcccaatcacgggcccgtcaagaatagtaacatccccgacactgtaactctgatgaaacaagagccaaacaactgctggatcaatcgtggtgagtttccatggcatcatattcatttaaaggccctctttgctcaccgcgacaaaagccgcagccgtctcctcgtcaatggtggagaagtttcctgcctccaagtctctgtgcagacctacaggcaagcaacatccaggaagaaaaggttcttcaccgaaagggcacatcagacacgagcacgattttggaggggaagccacttacagtccacaatgctgaaataaaccgcctcaactggagaggcaggaattgttcgagataggctcatgctgcgagtgattggcctgtcctttcctggaatttacatcgtcgaaggatggcatcaccaagatgttccgaaaaaattaatcacgttgtgctattgtggacatcttttctgccactacgttatcacgtgaggtcgcggttgcatgcacgcatgcttgtgacattaaccggcgctggcgtttcaaatcttcatgaaacagtcgtctgtactacagagggtgatgaaatgccccacaagcagattagaccacaaacgatcggatgttattatcggaaccaaaaacactcacggccaccgaaatgcacgtggaaaaagtgaccagatatatcctatcggacacccatgaagtccacagcttgcttgcttgctcctggtactgcggcctttaaagaagggttttggagtaacttcaactctagcagacaaggcccctttgaagagaaatagtatgtaagaaacactttcagatacatataactttagccaacagtttccgcgcaatccacgcgttcgcagacgccggcaactcgggcaacaggtgtatttacaccttaatttctaatagccgcagctcatcatcagttttgcggcagagtgagcagctggcttcaatttgttggcaatgattgcaagcgtcgtccaagaacaagctttccagtctaaaagctggagcgattttgtaaca

SEQ ID NO: 2636 - DNA, 3165 bp, Toxoplasma gondii
ttgaaaagaccatacagcagcgacacagtggttcaagagtctgtgctaggggaggcttgcaggttcctttcgccacttctgtaaaactcgggaagcagaacgggggaagaagacagtgacatctcctttattttctgccactgttactttcctttctgagaaacacagttcaaaggctgcgttgaagcacggtgcaatcaagcatcgttggtatgcttttcttgatgcgcaacatgtcaggcgtattccactattcttgttgcacacggaacacagaggctgcgcatatttcggcaagacgacagtctctatagttcccgatgtatgactcgaatgagaacaaccagtagctttctcccctcccacaaaattcctcgatgtacaggagagctggaaggtgaggacacttgtttgcgaggcaagatccggttcgctctgttccctatttttcttggttcgtttgcgctaagatgaataccatggctttgggggcagttattcaaacggaaccactcttatcctgaaacactcgcatgccgccactgtacatgcgggggcagggttcacaggaaaggggtttccctcacatttcctgcttcatacaaagtctacagcgtcggcggcaagcaggctagcagtttaaaatgctaacaaaagaagtatggatgcacaaagcaatattcttcagaagtctgcgggatgtcctccgaaaggcacaaacaatatctggtgcgtgcccctgcgggtgctacaagcagaaaggccgtgtagccacggatttcatggaaggcactttgcggaaataaaatgataaatcggtaatcagtaacgaactgggtttcacaatgtggtgtttgtgttcgtacactgatttcctaggaacacggaccgccaacagttctatttttgtttttttctggcaagtgataggctgcatagtatggagtgtggtctcgatgtgatgaagatgatggaacgtcgcatgagcgccagatatgtcgacgaacctcagtcatttgtgacttctgcgggatgctttgtggtacagataaagcctgcaaccgcagaatcgccaccacgtgacgttaccttgtgaaagtcaattacagatgcactgttcaacacaatttgacgcttcagcaaatcacgaaggatgcgtagcaacgactgttttgcctaccatgggacatccgtcgtttttctacagttccacaccgccccctctgaagtgccaccgtggagtgttgctcgcttaagcgtgtcagttgtaggcgggaggttgtgttagttttctcatggggaaaccgcatttctgcccaccttaaacagtttctcaaacatatcacaacgcgccggagggcggactggcacagcagcaccacattctacgtttactatgcctctccgcattatcacaggtaccctgttcttgtctgattgttgtggaagcgaactgtgccggactgttctcgacgcagcccttgctccttggcacacaagtcctagagatcattcttccacaacaacttcgttggtgtttttgtccagtttacctttcaagtctgtttttcaagcttcactttccttcacaatgtccgaagcgccctcaatgggaaggccaggccactgagctagactgactcgccagcagtctagccgttcctgtattcaaggaccgccgagcagggctgttgttcgtgcaacagatgaatgcccgtctgaaacgattgtgaacatggtgaggcgtttgactgaatcttgtgacaaatcctccagttcagtgcttaaatattctgccacactccgtggttctgcttccaactacaaaccaaaacggcaggtgttacgctgttgtactgttcttcattgtcgatctgtactatgtcgtcctgtaccagtttatgactttcgcagcgtcaatcgggacagcgtcatcctttccgtgctactgggatatctatagcttatgcagtcaaggtttgctagcgcccctgttcttacacgcttatactgatgagcgctcgctttaccacgtctgtataaaatagtcgcgtttttgatcaacacattgaatacgcttccatgcaatcacgtttaaaacagtttacgcctgtggaatcacaagatacgcttttcaattatccctgcttctgtacaccatggcgatgataagtggtgccgcggacgcccaagaggggcacttggatccatcaacagccaatgcattatgttccagtgaagagtaagcggtattcagaaaaaaaggaagtcagtggagacgattggtgaacagcgagggaacaagcgaaggaaaacaatactctaacgcactgggaactgataggtggccaaagaaatcgcacgagcaaggtaatcagggttcgcatagagaattcaactccaaaacaatgaaagagagccaaatgtcgcgagaggctgcagataaaaactgccgaggcagggaccgccacaagctgaggaataaacggtgcggagacaaataaagaggcaatgaatagatagacgttggtgaattattcttacgtgtgaaacagcggcgtcatcttttgggaaatcgacttctgatattgtttccacgcgcgatgccaattttagaactaatgagcggttactaattcgaggacttacggaaaactgttctatgctgcacatgctgtccgttgctgtcatacgtctgcagcggttatgaccatggggatctgccatctgtatcgaccaacccttctgaaggaaaacgatggcgtaaaccggtcagagctaccaggagcctcgtgggtgggatggttcgatttctttttcgtgatcctattgcgtacatccagaaaaccaaacgtgactttggaggcggttttatgctcatgctagcgtcaaactacctcctagttaaagggatggcatataacctcacacttagcgcctccgctccaatatttcgagaaatgctgcatttggcggccgagaagcacaatgttgcgtcggccatatatatgatcccttggtgtttgaaggggttcctggggacactgagcgatgtatttgctccgtctggctaccacaagcgccctttcatgatcgcatcttcactgctcggtgtaaccggagcgatacttatatacgcttctgcgggagacattgtcttttata

SEQ ID NO: 2637 - DNA, 2131 bp, Toxoplasma gondii
agtccgcactgcgtcgaaaaagaacgtcaatttctgcacagcgttgcggcttctgtaaccttcgcatgctctcaagctgtttgcgccccgcttcttcttcacacgcccgactccacagttttgactcactcatgtcctcgctcggcgctcgtttgagaaattgtagatctgtatctctccgaaattatctcgatttacataggctcatatttatgcttctacatccatacataaatatatgtatctgtatattcgtatattcttgtgcatatacgcacacttatacatattcctatacaatcgattggatctgtacacaaatatgcatatttgtatgagtttttatatgcattctatacatgcacatatatatatatatatatgcgtaaatatacacatgtatatatatatatatatatatggagaatactgctgacagaccgttgtgttgggtggtgtctgttttttttgtgtcttctcacgttttgtcgctgtgtcctcttttctgtgtgcattttccttgatggtgtggcctccactttttcttgcgtacgatgagtttcgtgcgtcgaccggaagtcgaccgcccgagagatttctcctcagacaagcatcgcaggagtttctgcggtagcatctgtgttggcgtggttgttcagagttccttcgttccgcgagaagcgaggaaataaaatacacgaggaaaggacgtgtcgatgaggcgcagagaacaccagagccggggcaagcaagtcttccgtttcgtttctgtcttcagacattccacttgactctgcggagtcttccaagttctcttgcgtggcgacgagtttcgcggaggcagcctctatatgggaggccgaagctccagcgacgccctcgaaagatttccgggtcgtcttcttttctctgaagatctcgactttcgccttcagacttctcactgcggtgtcgctcgcactgtgtggcaggaagagcgttggtggagcatggcgcgccagtgcttcctccgcgtcgttctctcggcattccgccggctctgcccgtccagcgacgcgagccatatgccgtctctctgcgcggctcgtcgttttttttcagggattccagcaagaaaggacgataaagacatgcgctcgaggatccggcgctctgcgcagcgtcaatcgccgcgccgttctcgggggctcgctcgcagctggccactcccctccgtcttcgcgtttttggcagaggcggcgcgcgcctgcgaggcctcgcatttctcgcttcgcggcagttgtttctccttcgacaaacgcacactcttttctctcagttgcgtcttggctccgaattttttcttgccaagcaccccggtttctctccatctccctcctcaccttcttcgcttttctctcgcacgccgggtccgcccccgttcccccaaggccgcttcggcgaggccatctcacctctccctctgctcaggcgtttctctgcgcgaaagagcgcgctcttcttcaaatccttgacttctcctcgtctcctctcctcggcttctgtgtcgcgccccgctgcccttgcccgacagcgccccccttcacgcgcgagcgtgtcttgtgcagcgaacttgtgttcggcagcggggcgccgagaggaaacgccgaaaggagaagagactcgccattctccacactccacgggcatttgggcaacttcacttcaggtttttcgtcgcgttcgccactggccaagccgcgaccgcgcactgcggctgctttggaagactccccggtggttctctgcgctctcctctgccttgttgaaaaagccgcaccttgacgcgaggtgtacatacacccgagaagtttctcgccacccttttttctcccgcttcgctttgccgcagcgcgctgacgactctcgtgtcttccttctctctcgcggacaccctggcgcgcctttccaaccacctttctccttcctctcttctcccttctcgacgaagactccgacctccgctcgagctttcctgcctctgccgccgctcgagactgccgagccgcgcgacgtacgcagaccgtcggagggctcgtgctggcgtctcgcgcgagtttcgctcttccgctgcttcagaagaaacgaaaaa

SEQ ID NO: 2638 - DNA, 2433 bp, Toxoplasma gondii
attgtgttaacagagccaccgatcttctctcgctgccgatacggtaggcccaggaactgcgtcaagtgacttttcttgcatttgaaagtgtgtttgcctcttggaacgatacacacttccctttcttctgtaggctgtgtagcgcagattctaacgattgctgtcagggtcacgatgtatgcactgtcatctggttgctgttcgtctcctggggcgcttttgaatttcttgcaagaaacgagaatctcctgggaaggacgactttcgcttgcgttgacgaaagtacagaatcggctttagctggaatcccttcgttactcgtgtgtttcttcggagtgagtgaaaccccatgtttttctagcgaagatccgtactcaagtgccaagcgcgtctacatggctgtttgattggtgttgtcggagacgggcatccgggaaaacaaagcattcagctaggactgacaagtttcaccgttgggtgtagtcgttgtgcgaagtgaactctgcgccttcgcacagacgcatgtctcatgcacgttcctctgcatctaccctaattgttggacactcggccagcataatcctggctcaaacgacaacacaaatgtcagcttctgctttcttggagctttgcgtgcttttcgttcccttgtcttggaactcaagcctgatgcagaggggcatgcgtcccggggcgccgaaacgggcaagatgacgacgttgtggaatccaaatcgcagctagactcgagtgttgttccatcagatgactttatagtcgagtggaggcttctatggatttcaaacagaaaatgtaattacagaaattccagcttcaggttcgcgaccgcgtctgcgctcgacggtcccgagcgatgctccagggtcgagtattgctgtttttggtctaagaaacatttgtgtccccataacagcatgaaagccttgacagtctaagaaaggcggcaacacgagtttttctttctctgctagccgaattcttctgctcgattcaatcgcttgcacattcgcgcgatatgcacgccgccgcggtcgccatgccgttttcgggtactcctccacgccggtttcccctttcgcttttgaaattgcgtctcgaggttttatcctgatgagtcttcccgtttcgcgccaaaagactaaatgcgtggcttcgtccagatatacaacccctggaaacatcgaattcaaatgccgaggggcgggatcgtgagctgaacatcccaagtttcgatcacggattcgcgaggtgttttcggggatgtcatgtacgttttcacaaggacgtttcttgcgacttcccttcaactcaattgtgacaatgcgaccactttgatgtaccgtactctttggtacggcactctttaccccatggcactgcctagctcgttgaccacagaaactccccgttttgtactttccttttaccaagctaaaccagtacgtttcgggggacgaatagacgcatccaccatgggaaatcaattgcttcatagctgctgcctcagaaattggaatcgaccgggcggttcggcggcgtaggagtcactcgtgcaaagcacggattccctcttggcgctaatggctcgggtgtctgtatacaacgaaaggtccagatcccggcctcccgcgcggcgagattcctcaacagtttctggtggtgaccttgtctcagatctggtctggattgagaactaacatttccttgaggccagtcaatttcaagaaaacgccaagtgtcgatttctgagtgcgattgtgagcgcagtgaccctgaagagaacctgctcctcgcatgcacggtggacaaagagggcacatgcagaaaaccgattcaagggagtggtaagccaacgaagaacagtttcagtctgctgttacctggcaaacgttgcttcttcttcactgaggtttcacccacattctcggcggatacaaatgctttgcttccgaagttcttttccactctgttccgtatgactctgcaagatgcaagaaacaaggattcacggcggttcttctaagccttcgagctgatgagttgcctatctcacacccggtaagagcatcgattcttctccctgggatttgtcgctgtccctccctttatgagccgattgacgtttgagtcgtgactgtgtcgcagcggaaaccgcttggtctccaacgaaaggattctctctcgttacgtctcgaccgtactgaaagtggaactgcaagtttgaatcgcgtccaccctctcggtgaagagacactctttgcacctgtcccaaatggacgcccaagaggtctctgtgcctcatctcccgcagcgttttcatgtccttctgtcgcagtctgagaacctcagcagcaacgaagtcgcacagcttcgctcgacttggaaactcaactggagggacgcgacatacaga

SEQ ID NO: 2639 - DNA, 3677 bp, Toxoplasma gondii
cgtcctcgtttccagactcaccagtgaccgccagaggcgtcattccaggagtcagctgactcgtcatcggcgtgctgccgtccttcccgggggtcatgccggcgccacccgtcatgggcgtcgatgctccaggggtcagccccgcagcagcggccgccgccatgtctgcgtccgagccgccgagaaccggcgtcgcgtcccagcgacttcgcttccgacccatgctgggcgtctgagaccctggagcgatcatcggggtcacgttgccagaaccagcgccaggcgccatgggcgtgacgctgcccgcgccagcaagaatcggagtccctgcttggtcgaccgcgggggtcgctccccactgcccaggagtgggagtttcctgcgcgaggtcgcggacaaaacacagcccctttcagaaaacagtgacggatattcccgagagactctgccacggaaaacgccatgaagcagaacgctgcgcacaagcgaatatttaaaagcggcggactggcgggccgcctgtccgtgaaaacgcttgcgacagttgtacacagatgcagtatagagacgcagtgacactgtccagattagagatcgggtttggccctcccattgagcgaaagcgcccccgggaagatacccgtgtagaacctgccagtgaggaaactaaaacgcaacaaatggttctcgcgccacatcggggaccgagaacaggacgcaaaaagaggcgggtgtctggcactttttcaagatctctcactcgaaggtgtgtaccccgccttcattcggtatatgccacacccagtcccaagcgtagtgactccctgctcacctgtccagtgcctccgatcgtgggcgttgcatcccatctgcttttctttttgccgggcgccgcacctaggcctgttctggcgcccgcaccttctcggctgtcgctgcctgcgacgagcggcgtttctccccacgcgccgggggtctgtccaccggcatggagcggcgtatcccagcggctgacgagggccgccgccgcagccgcggctccttcttcgctcttgccgccgccctgcgccttggcacgagcgagttcttggcgctcagcctctgtgaggccttcgtcctccgcgccggcggtgccccagtcccaccttctgcgcttcttttcggagccgtcccctccgccgagctgcttctgcatctgaagctgcctctggagctccgcgtcctcttgcagtttgcggatttgtcgcacagctgcttgcttctcgcggtccaagtgctgctcgagcatcacgtcggcgtaggtacgcgcgctctcgccgcgggacgccgcgcccaggtcgccgtcggagaagggatccgcacgctcgggggagagcgctcgctggaagcgctgccggcggtaaaagtcttcgcgggcggcgatcgacttgtctaccccagtcgcctccacgccgtcgccctgctgagccatcagcatgcgctcgcgctccgcgatccgcgccccatcttccgtcgagcgttggccgctgcggctcgcgcgagacaccgccgaacccgagccgccatcttgtgccaccaaaggcgtctctgcgtcgatttctgtcacgtaatgcgccgccggcgtctcgccgtaaatatgcgagtcaaaggcgacgcctgcactgtccgtcgccgccgccgttgacgacggctggttcttcccactgcttccgttgttctccattttgcgattgaacacaatgacaagaccccgaagacgctgcagaaggatggaagaaacacgcgcttcgtggcagaaggaaaggtgagaggagccaccacaacgaaaagaaccggctgtgacaccgacgggggttagacaacaaacagacgagagaaaaacgcttccctggattcagcgcacaggtgtttcgactgcagtccgaaaaaagtgtgatggagaattccctagagacacgtacgacgcatgcaagcaactgctttcacgcgtcgtgaggaaaacgaactgcgaagcccttcacctcgcgctgtgtgaaaaaggacgctcaattgcatcaaaacaatctaggagatgtcctctgaacagatccttcgtcgtgaagcgcgtcccgcaactcgtggcaaaacgctagcatccgatccgccttaaatgggcaggcagcactccagaggtattcacatccacggcggaggagaggcttttccctacaaaagagagaacttgacggcagacagagacatcagcaggagttacggccatcgtaatgcgaacatattcaaagaaaattagagaacaaataaagtgaaggaggtgtccgagaagttatgcctgactccaggaacctggtgactacgtgaagccaacgcgcggtgaagacgggcacgatatcgagacggggagccacagtgaaaccgacacttgggaaaaacaatgaagatacacataaagattcacttccaaagcacgatatacgaggatgagatagggagacaaataagagacattaaagtagcagcaggccggtgtcgaaagaggacagcggggcggtggaacgcgagaaacactgcacactcgtagagactgcttgaccgacagttggaaagattattcgaaaaatgcgatggtacgaaatccctggggaagcatcagctcttgtggcaacagaattttttccagaggcagtgaatgtttctgtggagggatgggccaaaagcatctagaacggggatagacgcttccctagaggaaccggataaacagaaatccatgacagtaacgaacagtccacttttgccggccaatagagatttccaccgctggataattgtttccttcttggttcgtgcgaaaaaaagaacaggatacgaggaggtaaggagaggaactgagcgagacggtattttgtaggccactcagacacaaacaagatgacgctttctgctcctgtccatgccttaacgaggatgaaacaacgaaaggagaaaagcgctttaatttcagcagatagcgccagctttcaaagcgcggaaaaaggcaactcccacacacctatggcaaagagaggaacttcgaacaacgctgaccatgccccagggacgatccctttcgtacgatgtgcatgcaccagcctgctcgtggttggggacgcagaaacatcagcgcactcacaagtggagaaaaaaaccttcgggggcagcggtggatctccggacaaacctcccaaaaaagtacaagagcatatgccagaggtttgagagagggtattcgcggaaactgatcgcaactgtccggtgcatcttacaggtactgttgtatacatggttcgaagccggagggttccattggctcttccagactctttgcgcagcgtcccaatagaaaggtggctcacatcctgttgttgggcccgtcgaaggaaagagaatgcgtacattgtttcaggtctttgtttcgagtttccgtctgaggtatgtcgctccataagtagaacattcacgctgcaagcccacggtccctgtccattccctatgaacagatgttgtgcgttgggtctggtagtctcggagaaaaactggttccctgctcggcgagccaaagcaggcactgtctatacacccgacgacactcgaaagcgtgcaatcgcgctaatccttgttcctctcatttcaaagcacta

SEQ ID NO: 2640 - DNA, 3155 bp, Toxoplasma gondii
ggcaagctgtcctgatcttgcgaatgcattgaaatgaacggtggtctggcggggggagaacgcggagagtcggactcacgctcaggtgaaaggagtgaagggaacggttgtgggaagcttgtgggacgaggagggagtggttctgggctggcagcaccttccgttgggctagcatacggtggcggaggatctttaggcgcgtcttgcacaaggccggaggggccgaaatcgcggggattgccatcccgattttcttcctcaaagggctcatcctccctcgacattgtgattaccgtacagaagatgaatgcgtaaacggtggcgaaaatgacagcaatcgcgtggttggcaatctgccgcttccacactggaatataagcgaaactttgctcgccctcgctgtcgggggtcaaagccgcttgaccatcaacgacttgaacgggccctgaatccacttttggcgctccctttgccgccacctctgttgaggtccgtcccagaaacagttcattccatctgtggcttgcacgacgcgagtttatcaccgcaataaccactgccatagctatcactgccgtcgcagccgccaccagcttggcagcaggcgccttggcaaccagttttttagccttttctcccctcggagacgaggctgcaaaagctgcgacccgatttgttggcggatgtgtagacatttcactcagtgtcgcgcgtccctcgcgtttgtcttccgccgtctttcctctacggaacgccgtggcagcaatcgccggtagcagcaagcacactgataacgcaagagcgaggtgaattattgagcgttgactcaggtatcgtcttctgaatggggttcgccctgcagagcgagactggctcctggcagagtgcgaacaacccgattttgaacattctagtgacgaacatcgatctccgggacagtctgaagttctaccttctgtttgtgaaaaagagttttccccgtcagttttcgtctctgcagacggtgttctgaagctccgtgacctgtcatggagcgcacccctgccgggctgatacctgctggcggcagcctcgtgaatgctgagctcaccacatgtcagaacagaaagaagtagacctaaaagaaaaacaaaacgagtggatgcaatgcgggatgaaacctccattcttacccactctggaggactgtgagaagtggaaggcgacactgcagagtcgtctacaagactatagacccatgcctaggctttcaagcgcgtaaaacacagtcaccgccaagcatttgagtatcctcctccctgcgtcaaaccttgagctccgtggcaagccttttcgaagaacatgatcacaggactcctatcccaattacggtccagtgccaaccgttttcccaaatatgcatcaaccccacaaaaatggtacaacgtgaggcgcactgttggtggtttccgagcgacatttttgaacaaagacggaagcctaccaggaaggcaaaagagtttcagcactccatctcatttacaacgtcaactgtttaccacgggtgttcccgcagttgagcaccaccgtttaaggagttgactttcccggaggggctctccagaaaactcagcactcatcaactcgagacatcgaataaactccgaacacttttattgcaagttgtcgaacgtttcgaccgaagcacgtgagttaagttttaacgcctcgacaaaacaaacgactggagacgaaagaacaccagaagcaaccgaatgccccacgagtggaaaattctgttccgcttcaacgagaggcatccgaagcattttgaacatgggaccaacgggcactgtagaagggacaaaacatgtcaaaaatgtcagtcttaacgaaggacatatgcatcgcatgtctctgcgtaaagacagtactgtatccatgaaagcccccgccaccggccaaccgtggggcgctgttgccccacttttccctgttcatggaacagggccacaggtcagcatggcgcttcgtgaatcttctttgaaggtacttgttcataatcggaaaggcgaactagcagtgacccccaagaaagtacaagttcagttcctgcggaaggcaactacaaaaaatgtaccgacagactccgcctgtagccggccgcccggcactccacgattgtgcctgctgctcgccagagtcgtgccccgacgtggcccaatcaacagggaaatcgaaactacatcttagatcccactgagttcacctttgtgactgtcttccccctctgacgtagagccaagcgccgagggatcgtcgtaatcgagggtctctgtgtgccggcactgagtttatcagcctgcttacctaatgaaccctgtgaaatctgcagatgtgccgagacgctttgtacaccagggaacctgaaattgaaaagagtcggtcggaaaagacgccgtgtttccagtagtagccaaccattcacgggacatgtataaccgaaactctcctcgtctctcttctacatgaagggcaccacaaatgcccaaatgagaaatccggccacacgcgcacgaagacacggctaaacttcactttccaatgtattatctttaactggaagatgccatgcggtccaggtgctttggaacgactcccagtggttgtggacttctttattgagtgcggtgtgacgaacactaccagctcgaaagatgctgactacaaatcgctgtttaaaaaaacagggttgaccggtgttgacccgcagtaacgagtttggtcgtatcctggatgcatgtgatctgtcgtcaccagacaccgcacgcagtacaaccgccaagagtgccaggaacgatctgcccatgttgttcacaacacctccgtaggcgaagaattcacatttcagcaacgtatcaataactctcgaatacagattttcctgggtcaggcagttttgaacgtccgttttgatcgagcgtttctgagggttcgcccgtgtggggtaggcgtttggctagctctaactcctctccgtgacgtcgtagtcaaaacacataaaataaggttctagcgcagtggagagtctaatgcaagttcaaatctttctacgctctgttcgcttttatgaacaacaaccaaacaatttcataaaaacacaaatgccaccaaaa

SEQ ID NO: 2641 - DNA, 2703 bp, Toxoplasma gondii
ttgttcgacttcgctggaacggcagattccaagctaggcgtgtctcttccaccgttccgtacagtgcgtctagagaacgtcttgtgagagaacggtggtatgaaacagagcggtttcaccacaggtgaagacgcatctcagctcgaaggaggcacttttgttggaataaaccggtacgcggtttctgccaacacagtgctatacgcgaaagccaaggaaagctatttctgacagggggttcacagcgacacccgagcgtgaagctcccagaaaatactgcaggttcaggagcacgctgagcagctgtcaaggcaggctgtgtgtggtgagacgctggacacacagagctctaaaatcaagtctgtatccaccatccgcacctgtctccgaagataaaccgaactccgaagtccgcccgctcctgctcaaatcctgcagaaccttgaatctgcgagcaagcatgcgtggcagacaacacacagactgctgcacatgcgccagtaaagttttagacacccatgcatacgcataggaatgcataccgcaaggcagctgctccaatccgcacttagtctagacgccagaccatccgtttgtatcgcggcttcggtcctgcgagcaaggaagaagattctgctgggggtttcgtctggcgttccgtcaacgacgaccacacccggggcaatatcccgactcgcgcggtgcctgattccctgcagttctccgggaggcgccagacttcctgtaccggagaccgaaccaacatttcgctttttcaccaccgaaagtttatccttcctccttctcgtagagcttttttttcttttttgtggacttaccatagcggccattttcccgttgtcagaaatcgtgacaaagattttgtcagaaaacgtgacgcataacacggcgacttctttcccctcgaccaccagcagtttctcctggactgcaggagtattgatgccttccttcctcatctgctgagcaagaacttcgtcctcctcctcggtggaatgtgcatggtctacttgcctcccatccctggcacctgctcttgtgcgttgttcctgcgcacactgtcctgcagcaattgccgccgctgctgccgtcgggacttcggggagtgcagctgcagcttcggcgattacagcgtccatggtgggctcgggaagaaagagtaagtgatgttctctcggtcaggacgatggccaatccctcccagtggacccgcagtcgccgcggacgtctggacggtgcaacggcagaggagggcgcccggagcaatgacggtttggtggagaaaatttagaaatcagggaaagcggatggaaatgtgccaggtacgagggaaggaaatgccttgtcgcggcctggtcaagaccgaacccgtgggatctcatacacccccacccagcaaagagtattcgaaatctcttgaagatacagaacagacacagagaaagtgatgttggttttacatcatgaaagcggcagtgtgtctggtagtgtacagcaagctattcggttgctggattgagtgatacggaagtgtcgagtaagcttggtagagacgttttaaactgcgtgttgacggccgagaagtctcaggcagcggtatgtttgctgttgtggcgaaagaagagcgaaacgcggtatttccctacagatatggatcgcgttcaggatttcgcgacacactctctcggcgccgctgcagcgtacgagcagcccaagtcgctgcgaacgcggaagactctacccgcaaatttgccgagtccgttttttccgttttgtgtacagctcttctttctcacttccgcttcaccctgtgcaaaagccattctaggagaggtattgggatcctttcttgtctcttcgtctcggcgaagaagccccttctttccacgccatgcagagaaagccgctcaaacgccgcccagtttccggtttggacggcgtatcggctgtttcgggggggctacggtaacacgaggtagaaggtcgcgcgcgatgccctgcaaggactggctggcgaaatgctgcacgttgctggggtttccctcacaaggggggcacacggtcttttcgcatgcatgcactcagtgctcaattcaggggagtggaaagcacgagcgaatgaaggttgtgtcgtgtgcgcgagagttctgaggggaaagcgctgcagggttttttggcgtgtttgctggctggaaatcgcgcgcgacgggaccgaggactttcgaggtcttttctttttctcaatctggcatcgccagaaggtgtcagtcttgcggcggaaattttcaccggggcagccccgactttcccgcctcgccactgagagatttatggtactttgaatcgtttttcagcccccacgacgcgttgccgttctccgcctgtctctcttatccgtcaccggttccatttcgtccttcgtttccgtagcccactcccggtttttccctctgtctctcgaagcctctgtctggtccccagtcgcaaagcttgtggggggtcactttttcttcacatttttctcccttacgcagtcacggagttcccctaaccggctcctcagtccttctcgtcgttttctcttccccggccttttcccctttaaccagggtgtctatcgcggcttttcggcgcccgtcacgtcccccctgatctccgcttctgctcgcgcctaccgcaaga

SEQ ID NO: 2642 - DNA, 1810 bp, Toxoplasma gondii
ccagattggtctagtgttagagttcaaatgtttcaagctatgtgcctcgtctttatggactgagaagatactgatgtgctgcacacgtgcggatgcttcgtttacaagatgtgtagtccacagcgaacgcatgcggtttcctcagcattttcttgtgggtcgtctctgcggcccaggtctctacaggaaatggtttttttattgacgatgcatgtcaccacgtttccatcaaaaacgggaaactgatcatctttcgaaaaggcttgatgcaccgcaagcctctctgcggtgatccttgcagacgcttggcgaaaccgttgctgttgaagtaagagtgaagtgtgtccgatgtctagtttcttgtctgaaaaactgtatgcggccctccctttctcaacggatatgggagttcctgagtaatcatgcaaaaaacgaactcaagtgtgctgaccttcttcagctaaacgtgttggcggtgtccccatggtcgaggccatggtcacagatgttgtttcgcagcaacacgtgaaaaaggaaggctcttgtcctcgtaacttctagtagaggaaaaacgaacttccggtgtgtggctttcttgctaccttgttgcactgaaaacaaaatatgttcttcgtttcaaaaaaacaccagccagtggaaaagcttggaaagaatcaaacgtgaagcccccatagtcctttctcgtctttcgcattcttactccgcgtcgtgttattgtgcccctgcttgctcttgttcttactggtagtctaggataagagttccaaacctgtgccgcagcacaccctcagaacgccatgtttagctcttacgttgtctggagtcaagccacgaattcttctgcgcttgtaggtgcgctgccctgcaatcgatgcacccaaattaccaccgcacaaaagactacatgcacgaagcactagcacagataccgatgaacccacaaactgaaatccgagacggcagtacaccaaagcagctaaaacgtgctgcttttcctggtttgttaactccaaaaggatcgttgtaattcctcgacaacaggttagaatggtgttgcgttgctgcgcgcttaaatggcatggggtggtttctgtgtcaagtctgtgtactcatcaatcgcacttgcgatccacgtcaggtatatttttgtcgttacccaatgcgcttaccgcatctcagcatactacaacctggctgcatagattctgcaatgcccaaaagaaagtgtcaacatgctgacggcgaccgcggcgcatatgtcgtgcgtgtctactttttccgtatgctaggagtccacatagggacgcacatgacctcggccaatctacttatccacgggtgtgtacgtacatgtcttccgctttccacgtcgaattcatcttgtttctgattaatgttttcggtgtttatcggatgggggccttcgcacggttgcaggcgtttcaattgaggacgcgttacgtttccccgtgtgctggggtgaccgtcgaagggagagctgcaggtgcccccggcaggtggcacgtgctcgacgcggtgcggaaagaggcacgggaaggtaccgttgcgctccagattagaggagcggcggcaaagggaccttgactaatgatgcttttccggaccttgtctttgtgcgtgaactgagtgcggagctagtaacccgtctcagcggtgatgggaacaaggtttgtcacggcagcatacttgtttttcggcaagatacacggacagctttgccgcatgactaacgttctttacgtagaaggagcgtaataaatttgcaaga

SEQ ID NO: 2643 - DNA, 2126 bp, Toxoplasma gondii
gttaaagccattaaaacacactttccagacgaaacggtgttgctcaccaagctcggagatttttcatggtagctgggcgactaaaataatttgtgtttttccgaacctggaccgcgtttacgaacagatgagtgcgcctcggccgccgggagctcgaaaaccgtaaagatggtaccgatgacctctgtgagcgtcaaacttgtgtccgtatgtgactctctacactcgattgcaaaacaaaatgcacggtcgcagctatgtgtcatcccaattggctttcacacagcgtgtacacgcgtactaggtgcagcgcatgcgtaagcgtacacatgtcccccgggggaagttgctgcttttttttaattcgccgagacgctgactcgtagtagcgtttgttaagtccgtgaccgatctgaggaaataccatgcggttgctgccgtgtatcggtggggtttgttattcttcacgaatttcaaggcatcggatgtgaatgcagggtgtggcagcagtttggctgtcctctttttattcgagcgacaccgataacgatagcccgtgcggagagaggtatgttggtgtggcagttgtaagcacgtgtatcgtctcccactgagtaatggtgcaaggaaagaatacgaaccggtgtactttggatgctgcaaaggggacgcggaagtgtctgtttaggctcgccaatcacaagtgttaaacctggatgggggtttcgtgtaaaggcgacttacgagagagccaagcgccgtcaattcagcaaaacaaacgccaaatgaagccagccaccacaacggtggaacttcaaccttgtcgctatcaagtccgaatagtgtgcatggtcgagcaggggtgtatggtatttggcatgggagggaatttcctttcgctatcatttttcagtgcgtgaaaagtgggaagcaccgagaagcacacaatttgcaggggttccacgtagtatacacgtacaatagtacgctcatgtttcgtgttgctgcatttgctcggtatttactgactcgtgcagatacaagtctccggtgattgaatgaggtcaaccgttgagcactgaggaacattgtagttatgaagttagagtagcggattatctgggaaattcattagcaaagtagtcagggaaagagtggagctgcacgaggcgttcggactcacgctttgttgcacccggcgttgatctgcactgccactggcgtgcaagagagtagaagggtcacccacgaactgcgatagtatcgtgcaaggggtttgttgctttttcttagttacgatgagagaatttgagaggcggcaaaaactggaggtggtaaacagtcatgaaacgtgaacgcccaatttgacctcgtcagtgggctgcaaacggcatagctgaaatagtgagacacgaacgttcgagacagccacaatcatccagaccacgtttagtgttacgaccaatgacaccactaataaagtgatattttgtttcgaacgccatagaaggcttgataacggaattgtcatattcgagatgcccttcgctaaagccgacttggcgcggtagctacaataagggctatttgcatgacgcatcttccatgaaagacacacgtactcgtagctggacggcagcgagcatccccaggaaactagtaatcacatcgtgagctgagccttagcgagcgtagcgtctgctcatatatcacagaattttgcctacaattgtggcattgtgctggtgtttcgtgcgtagtgtccctgtgtcattgtaaaattgggcaaaacgaacagagacgcagctcgctgtggctacatggctctctactgcatttcaaagacacaggatccaaagttgcgattgacagaaaatgaaagcatttttcatgtcaggtgtcagacacgcacctctgtgttgtcttcaatcacaaatgtttggccttataaacacaccgcgcgatctagaacgctcgttcgtctctgctgaaggacttctttacgcgccatacaatgcctccgcaaggtcactctgagaaagccgctgaagtttccctgtacaaacggggtttccagcctcgatgaatttgggacgcctcctcttctctctgagaattctcgtcca

SEQ ID NO: 2644 - DNA, 2481 bp, Toxoplasma gondii
cttgacaagctcgcagctgagcgtctcggagaaaagcgaaatagtgcgaacggccaccaaacgaaagcgtcttttcgacggggcgccgagtcagacgaggaaagttcgctttttgcacttttatcagagggattcgtggagtgttgtcaggacggttaaatggtcgacagggtgacagctcgtaaagacctgaaacgcgcgttccgttcgtatatattttcaacacgaggcgatcgaagtgtatatacatgccgcaagggtgaaacgtctaggtgtttctggatttctgtcgaacggccactcctgtccgtgtcaacctctcgcttggtagatgcgtagaggactgaaaagtaggcggcgcctgtggtcgtggccctggtgtaaggcagaagctgtcaaggttacctatgtgtcagccgagtcatttcagggggaacaaacgcgctagaatcacggtgatctgccagagccaaaaggcagacgacactcaacgtgcagctacgatctaacggaagacggtggtggtacgtacataccgggtcccagcagtccgtaacgctgcaggtaacaattggggaagtactgaggatgttcaccattttctgcggacgaacacgccacacttcttttgggtagaatcatgggcaaagcacagacgaagagaaagggccacaacgtttttgaggaacgacggcaaagaaaaaaacaacggtagtgtccattgttagaacgcgacacggaaccgtcgaaacgaacagcgcatgcactcgtgcagcagcagcgatctctctgctacagccgtgccttatctgccttcgaaacccagatgaggggacggttgcaaaaacagcttcagcgacttcgacaagacgttcatgtggcgtctgtgacagaagtgcgtgtcttatctctcgttggcgcatttctaataaagactgcacgtgtcacgcaaacgaatttagacgataaaataataccggactatgcatgcatatacctacgtcgccacgtgcaagacgcttctcgacaccagttgattagttcctgttttccgggctggctttatatccatcacaatggtgcatcgctctatcataaactagagcggtacctacataaacgaggtgtggctctaacgcagccgtagcgccactgcgtcactcagaaaggcgtatagttgagatttcgtccccgttctggggcctcgacagcgacgctgctgacaaacacggaacgctttgaccgacgggaaaatccaaaaagacgacactggagggatgagctctgagagcgtgacttatgcagcgcgcttcattgaagggttcaagggaaagtacagggtgcgcgaaggcacacggaaaggacaaccgtcaccagttggacccatacgaagcgatcttttttcggaacaaaacttcgcccaaattgttattttcagcacagcacgcaaggatcacacgttgaattaggtcggacgacatatttcaccataaatgcttgtttcgctaacatgcagacggttgcctcgggaaccgcgtggctgtcggttagagtcaaacgtttcgctgtcgtcagcatccggacttgttttgcttcgcttttgcacatccttgggttttcgtatacttttctgtctgagtccgaagttgggggaaatggtgaggcttcaaactagcaaaggcgacgattggtgtggccgccgaacgaggacaccggatgtgtaaagagtgtccaccatgggcagttgtgtaaagagtcgatgatcttggataaaaaaaacagtgtgctaccaaaggcgtcaatgccgcaactgcgaaggattttctttttgtctgaatgacggttggtttattaaatgctatgacgctcagcacgcctccgattggcacttacaccgtacaatagcagtgctttctgcaggtgcttggttcagtgttttcttctgagacataattatgtgtaagaaacacatgcaaaggattgaatgagtgtgttttcaactctgacaattgtgtgtcatactagaaaactctacgaatgacgtgatgaaaccggtctcatcaataatcgaagctcaaaatcttgtatccatctcgatgtgtatctctctccgtttgtgaatatacagatgcatgcgtacatgaacatacgtatatgctcaggcagataaaatacgaaacttgcatgccaacgaggggtcccactacagagattttccgtctgagaatatcgaagcccccagttctggttgaagaacacacgatcagcgtccaccagggagccgtagaaataaggacagcaagcgcagtcgtgttgtccattttcttgttggggtgcagaaaatcgcgtattcgcaggagcttggctcttcctgtttttctgttctcttcctgttccccacctccctcctcagcactatcctatttacccgtgactgctttctttcgcaggtacacgcagctttcgcgcacgctggtcata

SEQ ID NO: 2645 - DNA, 4689 bp, Toxoplasma gondii
gccgacttccaggaaaaccatgaagagcttctggtcctctcgggcgcctgcttctgcgccacagcgtcggcggaggttccgccgttttcctgggcaactgaggaggaggctgagacgcttgtctcagcctcgatcgcgaggtcgtcgatccgacgtctcagctcctccaccttcgctttctgttcaggagagaaaagcgaagaaggcaagtcggagaggcgtggagccggcttggcgagtaggggaggcggacctcctctcggattcgcggctctcgactgcgactgctcggtcgcgtctccttgttctgcgtccgctgccttgtctttctcctcgtgagaaggaggaactccaccagtccctcccgacgccggaggcgcggccgatactgacgccgcgcctgacttctcggcagagaatcccccagagctccctcgagagacgtcgccggccgggcaaggctctctctcgtgcggcgcagccatcgcagacacaaaagaggaagaatccaaggggagaaagccgcagaaaaagaagaaacaaactcaagaggcggcggaaggaagaggagaagctgagggcagaagaaggtgagaaaagaacaacgagagagaaagagaaggagaaggtgagagaaggagaagcaaggaaaaatgaggagagagagaatttgaaagagaaggacacgggagcgataaagcagcccaagccttcgtttgagaaatgcacaaaacccagagaaaagagcagagagacggaaaaacgcggatgttatgaaaagtacagcggcggagagaagagaattggctgagttctcttttttcgaaaaaaccgcggaaggcccgctgaaggctgcacgggagaagcgaacgccgagaaggctcgaaacaactggaagtaagcagggacaaaggggagcgagaaatcgccttcagtccggggacaaaaagaagtcgatttgaagttttttaaagccgagaaaagccggaaaaccgcaaagaagagccgcagctagttgcctggagcccggagtgcgaagagattcctttcgcttgaagctcgagagagaggcgctcttgagtcctaaatctttgcgcagaaagcaggaaaacgaaagaactgaatgtcatttctctcagggtctcgtacggaagaacgcgtttctgtcatctttctcttttttctcaaacgccgaacgttaaaatcagacccgacagcgttgccctgctgctgcctgctggctaagcagcgtcccgattgttcctcgaacggtccgcgtttccttacttctttccagcggaaaagttgagagcagtgaaaaactctctttcggagttccggcctctttcgctgtggctcttcacgggaccgacaagcctgaaggttttcaccggaaccgagttaaaactcgtcgtttctcacgcatggggaagagcctccgcgccggggaacctttttttcgttgggaggagcgcacaacgacggggaagtcaggaaggaaagccggagtcttgcaggagaaaggcagctacgcgttgaaaagaaaagctgctaaacgcctcgagagtcaaagtcggccgtgcaacaagccaagcaaggaaggagcgttccggtccgcccgagccgtcgggtgacccccgcgattttcgcaggggcatgaggaagcggcgcagaccgacaacgagcgcggaggaggcaggaaacgaaaaggggaccgggggacagagcggggaaagttcgagaaaaagaaaaagaaccgccacacagcttttcgcaactcaaccatgaacgtaaaacgcgccgaaaacgacagagaaaacagtcctacgcaggtcgtacctaaacggagaacgtggagacgcgaactacaccctgcggagattttttcaggatgttcaatctcccagagtctctctttcagtcgaatcaaaaagagtcatcgactacaggagtcctcctctgtaccctagatcttctgtatattgcgtaggtttcttcgattccccttccaccactgcaagacagaggagatctctctgcagtcactgtgtatggaaagaaccgtggaaactgctgtgtttttctcgcgtttatccttggtaaagaatctgacgaggctccgacagcaacacggcttagaaagacagcagtctggaggaacatgcgtcgtttccgacacagttttcggcgatgtacacacaccaggcttaactccttcgaaggtgaataggagggtacttggacaacttgagcatttaaagaaatggtggctttccgaatgcagtgctctgggaacagtctcctgaacgacgttagagagtcacgaagaggacatgaccgaagtcgcatccagtaaacgaagcgtttcaacgtctttacaaactccacagagaagactgtaaatagtcttgtctcaggtactaccacatcccgttagacattgttttgcttcgtttcttcggctttcttttcgttcgaaatcccccctcccccccagagacagacgcgttccccaaggggcgtgaggaaggaacgcaccgtcgtctgtcactttctcgctctctgtttcttctccccgagattggtgcaaaggctggaaaacgagacacgagcgagatgcccgagtgccttgagcggcggcgaaactcgaggcgtccaagtgaatctggaaaaagtagactgagaaagaggaaccgtttacgtgtgttttcatttcccaacaggttctcggctgctcaaacgcgcttgccaggcttctcaccatcgttctcctggctttcatgtttgcgtgagctgtttcgcgccagcaagctacgacctccggtcactttctcttctgtgcagtgaacagacaggtagcaggaagcttctagcaattttttcggtgaggtcagtagagctctctgcctctgtttcgcatgaacctgcacacacctatcttcctcactggatgttcctctgggtcccctttcccgaagcaggtagcatcgtttcttcaactctgcatgtgacatttccttttcccggtcttcgtgctcctagatcgaggcctcgacgcccatcctggagttcccctccgttcagcgaaaaacgtggagctgctcagctctgaagagatggagaaaaaccgggaaaagccttctttttccggttcatgcagactcgctgacaagcgtgcattcactctgcttgtgccccctttgagaacaacgtgactttcctcaactcgaacggaaccaacaaaggcactggggctttcgggagatgtgagaactgaacttttcagcctcgtgcgtcttctcgttatgctttgtcgagagtggagacacgcgtcgcaggcaagtggactgtgtagggggcgttgaaagtttttcgtcttcctttttcggttctaactgcatgcgtttcggactttgcagagcgcagtgggaaaactgtcctgtggcatatgcagagttcactccactcctcgcctttctcgacatcgaggcgagagaaacctcaggcgttttgctgcttctgtaaaagtaaaggccgaggagaaagcggtggggggtttgtggctgacatctaaacagcgacgttcgcggatctcgttcaagcgaagctggtgcctttcctttttctggaaacgtttcctcggttcctccctcgctctctctctgtcctcttaacctccctttgtggagatgagactgagatctcatgctgcctgaagcgctccggcggtcgttcttccttcttcaaagggcaacgccgttctttacttcgcctggggcaccgtgaggggagaggtcgaggcagcgaagaacagcgagggggcgaagcgacggagcaggaaacaaggcaagaccctccgcggggaagaaaggaaaaaatggaagaggcggcgtcgaaaacgactggaacgagagatcggcagccgcctcggggagacacacacacacccaggcaaagtagaaagggagacacagacactctctgggcctttttcgcgtgggctgctgaaaaatgctgtgcatgcgcatgccgacctgaaggagggaggtgaattcttggagtcgaaagtccttttcctggaagaaagtcgaccagtcgcgccttcttccctccatccgagagtacgaagactccgaacgacgacctccgtagctcttcgccgttcggttctctctcccaggctccgtccgcggccaggctctcactccgtgacagcctctcgtgagggagaaaggagaaagagagaaaggaaaaataagataaaaggggaaaggggggagaagaaggaaaggaaaagggacgaaaggcagaaagaggctctgttgcatagcacactcggtataaatatcggagagtctcaggcttgtttcttgctttcttcgctgcaaccatttctcttgtcgactccggcgtcctgcgtctccctgtctcctggtgcgtcgtcccttctccacggacgcatcgagagaacgaacctttttcttagtcgactgtccctcagtgctttcttttcctcgcaaaaatccgctcgctcctcgtcgttcgctcgtccttggtcttctttcttcaccttctcccttccctgtgccggccttcttcctctccttcctctctccgtctcgccttcgtctccttcctcttctggcttctcccttcgcgctttttctgggtccttcctgtcttccgaga

SEQ ID NO: 2646 - DNA, 1168 bp, Toxoplasma gondii
gaaaggaagcatcgcatctgtcacacgaggatcttgaacggtcgtcgcctggttgtccaagtaaacgggtcgcgatcccaccactgcttccccgccgctctcaaaggctccagatcccgaagaaggagaagaagaagaagaaggaggagaaggagaagaaggagaaggagaagaaggagaagaagaggatgacacggaagagaagggagcagctgcagacgcgaggaaaggggagaagaggtgcaagtcagaagcctgtgggtgttgccgtgaggcagagggcaggagcgcgggtgaagtagcgttccaggacctgcagaagggggagttttcttcggtgttgaacgtcgcgagcgtcgctgttcgacgttccctgtctgcgaggtcaggccgggacctcaaaggacctcggtgaagattaagaaagctccttgacgacgcgcgcaccgctgtcgtctggagagggacacaggacgcagtcgagaagagagacgagagaggagagaacgaagagcgagacgaaagagaagaagagcgcgaagagaacacagtgagaggcggaacggtggaaagagcatagcagcgacctctgcagggcggtgcggccgcgcaggcgactttcgcgagtcgactcatcttgcacgagagatccgcgggagctggaaaaatccaagaactcgggggaaaacggagaagttccgggaagtgagagggagggtgtgaacacacaaaaggcgcgaaggagtgacaaaaaaaagaaatgcagcgccaaaggagacacacgtctctgccttgttccgtcacttgtaggacaagaaagctactgaggtctctatagacacccgaagctgcgagcttctgctctctgcacaaaacaaacgaatccgtcgggaacgaagcgtcaaaggcgcgagaaaacgcgtttttcgtttctccggcaaaaaaacggggaaaagcggcgaatcgcagtaaagtcgacactgcgaaaaagtctgctggggtaaaacgagaagaccgtctgcgcgcgaggaagaggaaactttttgggtgcgagaaccgcgtcgcgatgcatgcaaaaacgtccacgagcggtgaaccccaagccgagaaggaaaacgatgttcgcagggtggagaagcgagcgcaaaattgcctttcttcagcgaca

SEQ ID NO: 2647 - DNA, 3847 bp, Toxoplasma gondii
ttgtgtcctatgtctccggctacttgctgctgaagtcgcatcaaggtacgcgcattcgccaaattgatcttcaacagttcgttgtgcaagcatatcaggtcgggcagcatcgcggagaaatcggttgctccaatttgataagcctgctcaacagggattccgtctgcgagcatctcccagtcccatgcaacgtagacatctgtgacgcacgagtaacagcggaggtcaggactcatgagcggcgtagtatccctacttctgcttcccatattttcacacgtattaatgtcagactacgatcgggctagtgcagttaccaacaaaagggtttggcctgtggtcgagaatgacgtggactgtgcagcagcagcataagcgaaagatcttgctcacagggggttgacatcgcttcgtaccggtggcagaaaattgatatgttataagtatctatctctcgcttcgcgtgaatgctcttgcgacaggtgggccatcttactgctacacagtaccgaaagatcaatatgtgagtcgtaagtatcggacccaataaagcactgttactaccagaaaaaaaaccagaaaactgacctgcgtatttttgaaaatagtccaggaggcgcagcacgctactgactgggcgcctgatacgggtgtatttgccgagggggtcctcaagagcaggttgattcatcggatcaagagcgtcaattcgctgctccaacggcgaagtgctcgccgatgtggccttgctcgtcgcagctctcttcgtctcatcctgagactcttgttcaagagagtccggtaacggcggcttggttaaaaattgtgttcggatctgccccgatgtacgcgtcaatgtacgttctaggcctttaaccgcaccctggaccgataaaatatttggtaatgtctcgatgtagtcgttgaccagaagtggaagcaacgtaaccggtggcgggggcagccgtcctcctccccgaagtgactccatctttactaaggcagaaaacagcaattgtcgttatgcatcgtatctcgcattgcatcttgttgacacgacacacttgaaccgtaggtgttacgacacaatcctgaagcggttgcgttgtgttgaactgcacaatgcagcggagaagatgaccctgtcgggaggcgggaaaaagaggaaatggataactgtaacagcatttctgggtgaaatggttgcgaccagaagatacatggcgtgcacacacagggaacgttctgtcaagctttattaatcctcccaacttcctatattctgtgtccctcaactcattctaaacgggggtcatggtatcaatggcgagagctggaaggacaattcttctgtctgaatacgccatttgtacagcatactaacagacgtacaatgacgaattgcagaggtttcggatgtgtacaacactggagcaaacgcggtatcctaatccttgggagaaccggacatgcgcgcccgctggaatgagacgccaacccatcgagttattggatataaaaatttgcatgtgcataatgatatggtttggcgagcttttgtacgaaacaaaaacagtttgttctctgcctgaaacaaatcaaacgactgaagtctgcccatttgcagttctcatcgaccgagggactagctagccgccatacgacaaggcaagagcggaaaaaatgtggtggcaacccatattaaagttcgaacttagagctcttcacttaatgctccctccccaaatgttgttttccaaaggaatatgcggctcttgtggactgctgaagtgtgctcggtagcggtctgacagggtgacgcaaggttggcggtcaccgggggtggagactcacagcgctcacggcaatcaccgatgttccttggcatgacatgacagcattctagaggtggtgttgctagtactagaagagatcttgctgcgcaggtctgcttcctgcaccagaatgggctggatctaacaagccacacagaacttccgacgtctggcatacctcaaaacgccgttagtgatattctttacttgatcaatgaaacatctcgacgtctggagcgatcatagcatttgagacaatactttttcggttttcaggaagtattccgagtcagtcgcgttttttacacaacgaagtctattgactgagcagtgcgtcgtgttcccagcatccgacaccacacggatgtaggcttggtggtttctgaagcgagcctaccactagaagcgttcgatagaaagtatgctgtcagagaagtttccgttgctcatcgaagatgcccgtgctatttacgggcgtgagtgtaagcattcttccctcgggtcagtgcgcttgtaaacgtattcactaccaagatgctgattacagaacggccaattccagactggcggaatccaacaggcactaaaacgggttgtttctttttgcgaggaggtaatttacagtgatttagctgcgtgagatgttccccgaggcaaacactggacctcccttttgcagcagaactgaaggcgaacggactatctgatgactttccgcttcggtcagtactgcagttcctcgatgcgtgaatgactgacagtggtaaacgttttgtgtgctatcgtttacggtcgcctaatggaacaaatgctctctaactcctccgagcatgcattctttccacctgtaggaggttagttatttttgctttcaacttcagctgagaccgaagataagaaacggttttgagggtcgttccctctgcaaggatatagctaaacagaaacgtttgctggtttttgttcactatgcttcgttcttgtcggtgtggtcaatactttttttttctcctccatagaaatgaacagcgtgtgtggcctctgagtgacatgtggatgcatttaaaaacgtttgtggtttttgctagaacgtaaggacaacaacgaagcacgctagtgctgccgaacgtactttgcggggacccacatccggcagcgtgttcggcttggaaacagctgttagagcgttagcaagaaggtttcacgcagggaacgaacgaagaaaagctctgctgcgttgactcagcgtctttgacttgagtcgttccagtgcttcgcttttgatttcttctttgattctagcccttcacgtttttcttcaacagcgtccacctcactgtagcggaccgttgacagacgctgtggtcggagaatgagacaaattttgctggtttggcgcgttcggctaccacgacagattcacgcttgaaccgtctggttccctctctccttcttgactgcatcgactgcctatagttatttctgtaacggcggtgcttggatgatgatatgctcgggacattcaactgtccaaactcggccaggcacaaagcggtttctgttcgtccatggtgaaatcacgaagaagacatcgatgctttgccaccagcaacaggaatgtgccgtttttcctttcactataatttcccatagttcttcgtgtatgtgctcgctggaattcctgcgccatagcgactgctttaaagtgttccatggtgtactacaccctctacccgctgccgtatcacaacgacacgtgcggcatttgcgaatgtttttgacagcatgccatataacacgtcgctgatctcgaggaattggtttctacgatctttccgctcttcttaccgggttcgtcgactttgggtatctttgccatactgaagctccgtccttgtctacgcttccgtagaactgttcctttgggtcgcgaaaacgtgtgaaaagcgacccatccgttttatgtagtgctctgacgaaatctgagacccgaaacctaaatgtaggcagca

SEQ ID NO: 2648 - DNA, 1979 bp, Toxoplasma gondii
aaaaataaaccagatggtgtggagtttctctctcagtttcctcaccaagcatttggctttcgtcctgtgacgagagggtggaggggctgctgcatcactcgctcgaggagcgtccccgggagaactggaaagtcaccgacgcagagtgagctgtcttcctcgtcctccttctcctcgttttctgtaatgctttgatgcgttgcaggagtggatgcgcggtctccctctctctgcgcgcgcgattcgatgcctcgaagccgcaagtctctcagctggtgcccgcagttgcactcgctggactggtcgcgctcgcagaactgtcggagcgcacagtctggcgatcgacatgccagggagacgctcttctcgcgatgggcatgaaagcaattttcctcgctctgttctctcttctcccctcctcgtgtaccttcagcgctctcctgagttacactcaacacatttccatcctcgacaccgtctcgagactctccagaagaagagaaggccgaggatgaagaaggccggaaggagaacttttggaccagttgagagaagtgagtcggtttgcgtctgaggtttgccgcgcaggtgtcttgctcgaggaggcggtacgccctggcggtgagttcgaagcggtagagaacttcgaccaagtccgcgtcgttctgaatcaaatgcggaggatagcgatccaacagacaagctacgagatggtacgcgtcgacatggcgttcgaggaacatctgctcttgaacgacgcgcttgtcatgcaaatacaaggaaaaacatgcacaggtttgagtcgaggaagctccaaaagccgacgaagagaaggaagaagagggtggaggtgaagaagcggaggaagcagaaggttgaggaggagaaaaagaccgcggaggaggacgctccgcctttggctcggcaggagcgaagatggagaggaaacgcatgaggagagaaggatggagaacgcgggagaggagagaggagggatgaaggtgacggagggagaacgcgggaggcagaagacggcggacgaaggagggtgaagcaatcgagaccgaaggagacgacaaatgcggacgagagtgagacgaagaaagaccagttgacttccgtggaagactcaagcgaacgcagcagacagagagcacccgagccagtcgccgtcgctgtatgtcccgcttcacctcggtcctttctggagtggagaagaacctgtttggctgaaagaaaagaagactttccggagacttttcaaacacaagaagttcctccatcgaggctcagctgctgctggggtgaccttgtgcgtcgtcgtcgcttgctgccttgcatgcacagtctttgccgactcgtcgcatgctcgcagcgatggaagcgagactgaacttacagtcaagttctttggccgatttttaaaagcctgacaggcaagtcggtttctctggctccctcggtcctccaccttctgcagctctgtctttttttgttcatgcgcagcaaagccgcaacagaaggccgcgaaaaagaaaatacgcgcctctctcccttttgtctcctcagtgggtgtttcatcctcgtccttcctccttgcaagtgccgtcgccttctgtttctttttcgtaattcctcttccgttttttctatgttttctcttcttcgctttcttctctcgcagctcgctcctccctttttccagttttctttcgccgctctcatcacctcgaggctttgtccggtgtccgcccctcatcttcgtatttcgtccttttcctgcttcgcttcggttctctttttttctttgcttcttttcttcttccctccgcagagactcttttcttcttctcgaactcaggcactttgcatgtttcacgcaggcgctcgaccccgcttttgcttttcaagagaatccgtctgatttcttgacgttttttttagttcttccaacttccctcgacttcccgtttcaacca

SEQ ID NO: 2649 - DNA, 2654 bp, Toxoplasma gondii
gttggcgtcaagcccgagagaagatgtatgtcggtggagaagagaggaagaaagaggagacgcaaaggcgggagacgagaaaacatcgacagcggtgagtttgaccgctgcaacgaagcaaaagagagcacccgcaaggtggaacaggagacaccatgtgaagaagcgctgaaacgagtgaacctcgcacgaactccccagctgagtgtggctgacgagagcgatgaagccgaaggcaatgccaagagccgttaccatgaactgcacgacagatgaccagaacaaatgctctttccagagattgtgggacaaatccaggctcccgtcgcggtgcagaaagcggaaggaaccgaaaaatccgacgagaagaagactcgtcgacgccagcaaaagaagcccccagagagcaaggatgcgccgaaccgccggcttgtacgcctggtcgaggatgtctacacagcacacagagtcaaaagcctctgttccaaaaaggtccgggccttcgtagacgtgatcttcattgctacacacagcagaacggttccgttcgtcagactcgccgcccgcgtccgcgacgctcctcgccttctcagacgcgagtggaagagcagccgaaagcgattcgcctgtctcgtctccttcgcctctatcctctgcactcggatcgcccgccaagacaccgccctccatcgtggaaacgagggacacacagctatgggcggtcagaaaagacaatagacacgcgaagaacgcagagaagcaatgaagggagagacaggcgaggaagggaaaccagcaaggaaagggacaaactgaaagagggggagacaccagaaacaagacagggagggaaggggaaaaactggagagggtaagaaagaattcgcgtggctcctccctctgagaaagcaaagtaactgcatggactggctcagaagatcaaatcgagttttgaacgagggaaccttccctctaaaaatctcacattccatgcatcgcaaccactcgcttcacgtaccaactgaaaaatatgtgctgaagaagacagtccaatttagtcatagttatatatatatatatatatatatattgcagtactgtcactgcaagtttacgaagcaagagagacaatactggtaggtgtggatttttcgctctctctctccgttgtagagtgacagatttggatagggtgttctctcaccggggagaagctcagggagaacggaacttctccgagtcctgcgagattccccaggggatcaccgcaagcgggcctttttctcagtggcatgaagaggaattcttcgtcattcggcaagggggaaaacacgtaagaaagagggcgacagtggagaggccggcatccttcgcgactcaaacatggaagctgcatcattctgtgttaaaaaacctttcgggcgcaagcaagacacgaccaccctctcccgacataaggcgccggaaggcggttgcaagccacggttaatacctttcattcctcttcttgggagtaaacacgaaaaagaactttgcaagaaagaagaaaggcatctccccacatggctaatcctacgggctccagactaaaagtggacatgcgcgttttttgcttcaccgctagctccctcattgccgctctggtagcgggcttcgagtgacaagtcaaatgaggcggcctccggtcgcctctgcgatttctagccaaggagtccctcaaaaggtagtcccgctgtgttttcccgctaatttgtgcatgttttgtgtcgcataaaacatgcgaattccagtcttgcggaaaagacctatcggcctaccgacgctgtaatcctgcgcgaacaccttcgccgttccgtggcgcgcatttgagtgagacacgtaacgctgaagacacctgtcacaattgaacgggttcctcctgggacttttcgcagttttgcgtgcgcgttgtacaaaagtgctttcctctcgatctctgcgaacgtttcaacgctacgcgccttatgtcgaaaaaccttccgacggagagtgtcttgcgacacgaaatgcaagaaggacagcctgcgagctactgtgcgttaactcaaacccgaaaggaaaattcatccatagaacgggcccgtaccttgcgccagactatgcgcaggcaggaacgtaaattgtttggttattttcccgcatcttcctcgtgcaacggcctcgcccgcaatatcccggcttccagaagtcaacacatttataaaagtgaccgtgctttcagagtcgcttgatgcagattcagctgtacgaaccccccaagtgacaggcagtgctgtgttttctttatctttcgcggcctcaaagctggctggctggacggctatctagtgagtttcctgcgaaacacgggacagaagagcctggcgaaagaacgtttctttcgttcttcgcactcaaagttactgaggaataagagtacagcagtcctcataggagtctgggttcgcctgtgtcatccacattttcgtgccgagtgtcttctttgcattgatttcgcggtggtccgacatttctgccttttccttcaccgcaagccggtctgctacctgtcttttgtttcgtcgtatcggttctgcatttcctcatctccgcatctacagttcgacaattcacca

SEQ ID NO: 2650 - DNA, 3370 bp, Toxoplasma gondii
tgagtgcatgatgacaggcctcttgccagctggagaggaggagagacaggtcagagacacgaggcgagaggagagagcaggcgactacaaactcgaaaaagagcgcgtgcgtgttcgtcgaacgacggtggcgacgggtgcgactgaagacgggagagcagcaaacctaggggttgtttttgggtccagttttccgttaagtgtggctttgtttgttgctggcgaggagatgacagtaaaggcgacaaacgctcgcagaggagagagacacataggacgatacgcaggagaagtggggtttcttaacaccaggagcagagagcaatgtgacggttgtaataaagacggcaaacgaggagcggaaagacgggatttgcttttgacgagctgaagacaagggatcgcatgactcaggtgctcctgggaagagaggcagaaagaagtggagagcgagggaagatagaaataccgtcgaaagagaagagagaaacagtgttctcgatgcatgaggtgccggggggaagcgctatctgctgcggagagagaaactctcctgcaaaagcacggatgagaacctgggtaaaatagctaacacgaggcgggcaggaagattcagaccgtcagaaactgcagacctcggccgacaggaagtttcgcctttatagaaaacgaaagcgtgatggttttctggacggacgacatggaaacagaaggggcttggatgtttctgtgccgttgaacacggccacgaagagcaaaaacagtttttcccatgtacgggaggtctacaaggacgcgtatgcctcaaatcttgcgttccggatgggtagtcgagaagagattcgaaactcgaagcatgcaaaggcctgggacgaaatgtaacccatgtagattcaccgtgaggaaaccccttgaccgggtgacgtcttcgacaagcaagacaggaagcatctttgtcgctcgaagacgcttgggaaatgtgactgagacgagaaaacagagcacctcttcatggtatgaaagaacatattacagaagcgactttcactccagcgaaacgcacttacgagatcgagactctggagattgagagcgactgttcgatcgattcagcgctcgcggcggcctttgggggccgcgaccttctcctagacgcgagactcggcaggcaaaaaatggaggaagatcagtaaagagcgtgaagaacagagaagatcgtttgctttttagcgagaagaaattgacgcggctgctgcacactccagggttcaagctcagcgttggcatttctggggaaagagcatgcacagcacgcagattgagttctttgcacacggctgtacttgcaccggcgcgcagccatggcgaaagcgcggaaggaaacgtaccggaccgaacaagcttctctaagaatgcgatcaaaattgaatggtagaacaagcggtcgccatcgcagctgtctttgctctggagctctggtgtcatccacttggacgaagttatgcaccgagacagacgcgtagcagccaatcatgacgccctgctatagcaggtgacagcggtagtcaaacacaggaacaagaagtcagtgagagtaactccttcatgacggagccggtggacggtacggatatgcgtgagattaatgacacagaaacgaagggccggttgcaaacggaaaggtgcctcgtgcttggagcagaacagtacaaaggtttcaagccgatcgggtttgtgtcctagacagggaacagtgactaacacaaacggcaggttcggggactgtaaccgaggggaattccttgaactcaagcagcgcgagttcctctatggctgcagcagctgatgaggccgacccatcagtgtggcgttattcacgtgacacagcggcagacgtggcagggcatcgcagtgtgacacatcgcagtgtaacagtacggaaagtaggttgtacaaatacaactatgcccacaatttttatgaggaaaagggagccgcaaagttctcgtttagcgtgaatctagctagcagagcccacgtgacccggaacgctgtccggtgacaagcacaggagggctttcggaggcagaggggcggattcatccttcagattggcaagacagctgaaactgttagtttggttcagcgttacagattgtggttagtatggggactcagtggtggtgcgcacctgtagcgggattcagacacccggtgacacctgccgtgagattccgctattttagtggtaaacttccagttgacaggaaccgcggcgcgatgctttcaacattcaacctccttgattctaaaaacaagtagaccacgggtgtacagtaactcacatgtctaccgtcagtttaaaagaatctggaggcgaccccgtcccttccgatgcggcggaccctaataggttcgtcccgcttctcgagttgattccgtgtaccgttggcccgaacactcatccctgcggattctcaaatgttattttgaaacgccaatttattcccttgactgtttcgaaacagtagcgtcgcgcctgatgcctcgcgccatgttaacaatgtggaaaggctcaccctaatcgacatcggtggtgtggttccctcaccgcagtccggtcctcgattcccctcagtcgtttgtgccgtctcgtgggctgcgtggtgaagtaagagatacacaaagtggaaatcggacacgtagaccttgggtactgtggggttctctttgcaaattccatgtcaattttggcttgtgcgacagtgcccaagaagtgtgctcttcccgtagtggtatctagtggagcagtccatagttagtcaacgcaagactcacgtggctcgagcgggcgtggggggcgatgcatgcccgctgaagagctgttcaatgccgatacgatggctgttgaggggctgagcgggagtcagaatcgagtgcttggcgccggtcagcggaggccgctgtttcattggcgggtgtgtctcaactgttcctaccggacgggagttggtggaccgtaccttgaatgcgggtcgcgtcgtgtggggacacaacgacgaggctgcccaattctctggtgagacaagagcgactcgtgaccttgtctcgcctcgggaatccatcagctgggctgaagcaaacagtccaaagcggtggcgaaaacaagatacgaggactgacgggcttcgtcccggaaagcgtgcacgtgcggatacgcgactactctctgtgtaactcgcgacaagattttctttatgtgcgtttgaggggggctggaaccattcgagcgagcatttggctgacggtgggcgccagaaacgagccggtcagggacggtttccttgacttgacgtaaattgggctacaa

SEQ ID NO: 2651 - DNA, 4598 bp, Toxoplasma gondii
gttaactctaccgctgcaggctctggactttctccgccctctctctgccctgtcccctcttcaagacagaagcatgaaaaggcactgcaatgcttctcactggtcgccagactgagcaaagggaggtcacgtggtattgagccaccgacagacgaagaggatactgaggcagaagggaagatgcgcggggcttcgagagacagaagcatcattctaggaagcgcgcggatgaggaagggctcacgaactgccggcgggaggcgcttgaagagggcctctactttgctgtaaaactgcggcttgaagaacggcaaagacggtggtggacgcgctgtctcttcgccctggcacttttcttcgtgttggcatccactgtttgttactccaccattcgaagcactgccgttcggtgccatcgtctgccctagacgcatttccacctggagatcgacaagaagctgagttaggtcgcgcggacttaagccccggtctctctttccagaagtcgggagcctctcgcctgcacccggcaactgcgcttccgtcacctccctctctttctgtttgtcgttcacttccctctcatctcgcctacggtcggtcctgcgactggcttcgaatgcgcttggatagtacgccgccagataccgccgaagcaccgccgaggcggcttgccagtacccgcaagggggcggcagctggtgaaacagaagaaactgctttttcatcctgcctgccgggaggtaagcggcgagatagacgccaaatcgcctgttctgcgaacagaaaggtgcgcgtgaaggctcacttccaacgggctgcgaagggcctgcgcacacatcgaccgcggtctgccgatggctatttgttgtgcgagtaaaaacaaaggacgcacttcgtgttaggcgtgtatcaatacatacggaaatggaccagaccaggtggtgcagtcccgcgataagtacgcgggaatgacggctcctcacatgagacacagttcaaggcaaccccgaagtacgacagaggccggtgtcaatacacgtgagaagcgcgtgtggcgaacgcgtggcggccaaagattgcagcagcaagcaagacagcgtccagccgggagacacgagttacaccttgtccagcaggcgtctggcttctcttttgtccaaggagtcgcagtgacagttgagttgggaaggaaggaacgaattagcggacgttgcgtcgtagtcgggaccgcaatcgactcttccacgccaccgaaacctcatgcaaggtcgccgcgacaacacgcccagctcagaagaattgttttcttccgtccaacggcgttttctatgaaggtagacaaacacgaatcttcatggacccttcacgtgtgcttctttttcccgcgtcaatagctgttccggactcagctgaatatttctgttctagcgcatgcaccacgttggaagggccggcaaggtggatggctggttcgcggccgagtttcccggaaaaagacgtccattctatgcatcaaagaagtgtggatccaatgccgtcgattgtctgcagcactcggttttccacacgagggagaatgaaggttttttctgactgatccgcaccgtaaatccggaacctcgacacagtgtgcagggcgtgtgcgtgtgcgcgtgagcggcaagcggctcgcctggcgcgtgcctgggtttgaacacaagctttgatagaaacgacctctgcggtgaagtcccaaaaccagaagaaagatggaaggaacgtttgttactgttaagcaatgctacctgaatgaaggagtctccaggaaacgctgagctggtgacaaagtcacgagaaatcgttcgagtatggggaaagtcttacagaggagactgaggtcccgtttgaacggtcccgcctccaaagcgacctgccgtgaaggcggtaggacacacagacgcagatacgagccgcaaatgcaagacacaagatctgatggctaccgccagtccacacacctgacgatgtaaagagacggaatggaagtttgacaccgcaacgtattggccttctctatttcatagacaattacaaaggatttcctctcctactggagtgtcacccttccgtcacagcctgcgttttctggtggctaagcacgtacgtgttgcgtaacaggtggctgcgaccacgtttctaacggacgcagtgtcatgtaatgcaccgacgcatttccccggaactgtctgctcccacaagacacgtggaaagtggtacattggaccaacggcacatgcaaacgcgtccaggttcctcgataaaattttggtgttagttgctgcctcagtgacacagcggatgccgcgccacctgagctgtttcatcctgtttttacgtgtttcgtatgtaggtttctgttccggttactcacaagacaagtcgaacaacagggtgtttcaatgggagcatgtggctaccatcatgaagctaggctgtgccttgtggtgcctcaaggtcctctgccaagcgtgggtgtcttgtgcatagttccaagcacatcaggcatgtcaagaatctgttctacagactggcgtgccgtcggcgtagagccgactcgtagaacaaggtgtaggtccattcgtgcagacacgagggactgtccacttcgatgtatcaagcacttcttaggcaatagaggtggtggaacattattagtcgaagcgtggaaaatctgaaggtggctgagacactgccagtcaagagctcaagattacctcgccggccgccaggaagggggatcggcggcctgtcggtaagaacgggcggtgcacctcgacctgaatgacgaccacatacaatgacatgctaattctaacaccacgatctgttttgtctatttatacgagatcttggtcttcttttgtaccacaactgctgggtcagcctgacagtaagcatggctgtacttggctatcagggggatgtgcccggcggccaactgtattccacgggctcatcttattattgcttcaagtgcactcgagagaagaacttcatgcgagaatgtaaaccagatagaggcaggaaaacttgttcccctgtgcagcgtgttggtcctgcccctcgtatacacgacccgcttcggcacacccggtcagggtgtctccagaccacaaaggattacagggaaagctatgcacggaagtctctcgcgacaacctatgttttgtaagcaccatttgaagacatcgaaggtgaatgcactcgtctgtgcatgaggcctccacttcggtgtgttgcacatttccgttattatgcatccaagtcttgcgatatgcacaccctccgggaagacataacgtctggcggcggttgtgccgtctagtgcaccgaactagttgctgtcatgactttcaagggtcgaaatggaacgggctaagtaaactttttgcatgggcacaccatagtgctacttatgtggcagcaaccgagttaggcttcagcaacatttgtggcaaccgctgcattgccgagttgctacccccactgttggtggatctttctcggtgcttgttggggaccgttaccgtgccggccgaaattttagtttccctaacggaatctgattttcgacgtgaagaccgaagatcctgtcaaatttgcaaacacaagacaaccgctttctaagggggtgtgttcactgctgtcttaccagcaggaagtgacgggaagaagagctgcgagatgagttttgtggtcaatggaggtgatcggtttgtgtgtccgccaccccttggaaggggggaagaagccacccccttgcttcttgttgcatcagacgcggggcaactacggagcgcgcttttcgcaaatggagggaggcacatctgccacgaagatagcgacagcatggctgtatgattaccacaagcttgcccggacaatttctgtctcgatggtgcacgactcccgtttcaggcgccgtgattaacaaatacccgccattctgtgcacgttgtcgcggttccaggaaaactcgctgccgggcacggatcgacgcggtgtctgtacaccagcaccggtccacggcttggcactctacctgttgtgagtgtggatagtttctgattgccagctcggaacgtccaactctgaggtcagatttagctcgcattggcacgccttgcagcagtcggcggctttctctggcctcctgcgcaggacccgggttttcgagtgaccgtcgtttctactgggggcttgctgacgggtagacagcgtgcagctgactcagatgccccttgtcaggccatgaacacaacatctggcaggtagtgtttttttgttattcagtacgaaatctccagagactcgattcagtgtcttctctgcggacttgaggcggtcttcgtccgagggtttctcgaccgtcaccaccgacttttttctggtgggtcgctgtgcaagcctgaccgaatcgtctttacctttgtagcagtcaggagtcgtctgccggccactttcggggtgtgcgccgttggcgtcctcctggactcgtcttgtctcgaggcgtgtgttaagcggctgtctcggagcgtgccctcggctgtccatca

SEQ ID NO: 2652 - DNA, 1922 bp, Toxoplasma gondii
tcgcccgagtaacttcctcatgtggtcctcccacatagcctgcagacaacatttcgtttgacacaccaggcacaggccttctgggaaaacagtgttgaatcaatgcggagacacttccccgttaatcaacttcgtgtcgcactcttggcaaatctgcagttcgtgttgcctttgtggcacacacagacttacggcgataacggcttccgccagtgaatcaaggtgggacgcacaggtaccagtcattatgaccatcccttcaccctgaggcgctaggccgtcagaacccctttgggccgtcaattccgccttctcagagcccggtgatgttccatcggcttgactgcccgagttgtcgccaatcgtccttggttcattcgcttcgttcgtagagtcacgaataagttgctgttcacgaccagatggctgtctgtcatctacccaccccatacgctggaccccaggttttttccagagggcaatgatcgactgagccttgtgtttgtctcctgcccgaacagctgtgaataacgggggtaatagaaattgggggatcttctggttcttatctgaactacgggtcaatcctgtcaccaagggaatagcgtagcaacttccgaatccgctcccttcggaccacacgtagcgcctgttttgctgtccaaatggtcgagctgttgaaaaccccctgtttagcgtcttgtaggcagcgaattttctcagttgtctgcagccatcgcgttctaacttcctaatgagatgcgacggaatgaatgagcgggctgccagcctgcagttcgcctgttgcattaacatactgggtgggccttcctgtgcatcccacgacggtctacgccagcacggcctcgtggggttccttatacacctggattggggttgaagagcatgcttgaggcaggctgaatggaccagacttgctagtgatcgcagaacagtggcgtccggcgaatgcgtgcacgcgacgtgtgtgaacccgtccatgtgagacgggatatccctgtgaatggtgatcgcttcagctttgatagaggagagcaacacacggccgaaaatgcacactatgacggaagatactaacaaaaaataagagttctccatcactgctccccgctgcggcggaatccgccacaacacggtaccattgacacactaagcagtatcaagcatgattttaacaaaagccttcgttaatacgagtccctggaatgcttcgcgtttttcaaagattctgtcatgttccacttccgtagccgaacgagcgtcttctgatgcatgcagggaagatggtggaagacaacgcatgcgtgcaatggacagtcccaagaagatatcttttcacttttggaattctcgtactgggcttctctggcaccattcatcttgaagacacacccgttcccatgggaagggcactaaagtttgtcttctatggtgctgcacttcgtcagtcgtgacgaccccgtctgtaggtggtgtgtcgcggtcagtgggctccagcagcttccatgatctacacacttctggatttactttaatttcacgaaatgttcagtcatagacatcgttatcctgttacttatgctggaaccttacaggggttgctggcctgcaagacttttgacagtcctcctccagggaggagtccgattaaagcttgacatgtcacagaccataggcaccaggcattctacttttttgtgcggaaagcgactaccgcgactctgggcttgggcaaggacaagttgataagaagccttcttggcgccctcctgtacgacggggtaggagaggtcagaaacgagtgccgccactcggctattttgttgcagttgtatccagtaagggtgagaacaccaaccgtacgaagaatcaaaccagttcaccgacagggaaaggaaata

SEQ ID NO: 2653 - DNA, 1781 bp, Toxoplasma gondii
gaccttgagaacgaacggcctccagctgagagttgcctctgcttcgcgccttccctccgcttgacttccagcgtcaccttctcccctgccttcgcgggattcgcttttggcttcaccgaccgcgttttcttcgtctgcgcagcggtctctgcctccgccttcgtttcctcttccttttccatctgttgcgtctcgctcctcggccgcgcctgtttctgccttcagctcctcaggtccagcgacgaagtagacgttcgcctctttgccggtgctgattgtgccgcatacagaagtcagcgcgttgcgcttcatgagtttttcgatcagtctgcaggtacggttgtcgaggacgttctccgtagtcgccctcgtgtctcgcgtcaggccttttgcgcggttcgtccggttttcctgaactttctgcagacctttcagaaagtcgttcctcacttggtgaccccacgcatgcggctctgctctccgccgctcccctgaggaacgcaagagtcgccctgcatctcccttctgagtcgcaaacgaagaagaagaggaagaagaagaggaagaagaagaggaagatgaagaagaagatgaagaagaggaagaggaagaagaggaagatgaagaagaggaagaaggacgacccccaggactattcgccatggtaagaagagagaagaaaagggaggagagaagagagaagaaaagagaggagagaagaaccggacgatgaggaagaggagacttttgaggcaagaagaaagatgagcgtggaaagaagggacgacgcctgcaccgtggatggaagagagaagaagtaggactcgaagaaaggagcgaagacgaaagagaaaagctgggcgagacaccagctgcacaaccgagacgcaaagggagaagataagaagcgaaaaaaaagagaaagaaagagaaaagaaggaaagaggacagaaggaaagagaggaagtttgctctctcggagatccgcgccttcaacgactcaacgaggtttactttttttttctcgctttttttctacccttcctacgactataaaccgcgttgcgttccctgacgcttttttaaaacatcgagaaaaggtcgttcgctgcgcgggcgttgctgttcacagtgttcgcctagcgagtagaggcggaatgcgagattgctgaagcaagcagaaaaaggagatgcatgaacaccgaagccttccttgcttcttctcatctcttctgtctcctctgttttgtctcttctgtctccgcggcgccgcagtgtcaccccacggttttttcttgcatgcgcggcggagctgcaagacacacaggtcgagagagaagggcgcttcgcgcctttttcctcaggaacggtttccaaatgcaggaagttcggagtcttccagatccagaaaggccatcgtggactgtcacctcacgggagctgaatttcttttcctgcggtgggaagcgatctgagagatgtttttctctccggacggactgcagaagagcggattttttcgcaagttcagaacgctttcttctctttttctttcccggccttctcttgcgcttctctccgccttcctcgtgggtgctcccagtttcttcgcaacttctttagactttttttctccaaaaacgcgcgctggccctcggcgtccgactttcgagaacacttgaaagggtgcagacgccgcgcgtcgatttttattcttcccccgattttcgtggactctcgaacttttcagaaagcttcttcttctcctctgtccgccacga

SEQ ID NO: 2654 - DNA, 1647 bp, Toxoplasma gondii
acgacccttgttgaagaccgtaattgagctgcgttaacgaaggttcgaaaagcctaaggccgacccgcatgcaagattgctgcattgtgcttcactaattgaagcagctccagcgtcgtttctgaaatgcgttgcgctattggacaataccctgtcgtgaggttttgagtgcagaggtgctacctccgcggagttgagtcttgtgagtgcagagagaaaagatatgtcaaaatcccgtaatgcagcggtccagtagcgcagaaaaaaatcaaaggccctctagatctaaccgagagagttctctggcgaagcaggaggcacgctcgaggtcacgataggaacgcaactaaaacgatcagatcgtaaatttagttcgacactggcctggcaagtgcgctcgcacaggcacaccttctccaccggcgccctcacgaaaacacagggaagaatggcctgcaaaagccacaggacgagagtatgaatcgaggacttctgctgtatccaagaactctcagctgatattcgatactcaggcacatctaggaaagtgccggtatatttgcttttctgatgcacataatatatatatacatctatatagagagggttgccactacgtcagtgcggttgcctgagcttcagagagttcttggcttgcattctgtcatgaaagttcgaaacacccaacggcgtatgtccttacactttcatccttggatgactgtccacctggatgtcatgtaggtgtgattctatgaacaattatacactgaggaacctttgtttcttcgtctagtgatggctcatcgcgcgcacttcgcgtgtttgctggctatagtcgagctttgtcaccgatcacgcgtagtaatcactctctgtcctgctagaaaaagccacaaggtaaccgagtcgatttaggactagccggaaacaagctctggttaattcgggaaagcgttcgatactgttatgtttttgactcttctttccgtggcttgaacgagtttctattacacacgctttgtgtgcatgttggacgaatgcgtatatgcatgtgcggagtctgcgaacggggttgtgtcacccactatagtgcgacacagcaaaggaacttctttgcgtagcagccaagaaatgttcgatgcaatcaacccaatgacccttcgccaaaaaggggaaaataccttgaatcgacaccgacgagttcgacgagggacggaggtcggtcaagtcttttggggcagctgtctctcaactcgagaatgataaacaacgcccggccgtgaggtcgactcgcggtttttgagttccgaaaactgtgacattctgttaatatctcctctttttcttcgagttcttcatcgttgtcgagttttttgtctcctaattcgtaaacctcccaggtggggaaactccgcttgtcgaaactccctgtctatttgtcgtgttagttcctctccgccctccgtcctcgtcccgtttctggtgtctttctgctgcttttcttcttcgtttcctcgcttcttctcttgccttattcgtcaggtgccgttacttcctccttgccctgttctctcctccctccgatccccgtctccgcgtctgctctctgaggcgtcgcacccggtcttctcttcagatctggga

SEQ ID NO: 2655 - DNA, 2454 bp, Toxoplasma gondii
tgcgtctattggtcgaatttacgactacgtggattttgtgcgctggtctcctcctgtatttcaacaaagatccgttcatgagtgctacggacccccccgatatattttcaccgctagtgtttttgttggatacgaacccggaatggcagaggagcagcggagcaagcagcctacttgggcgaggcttgcgatgcttctccttggtggcttcgcgattggtttcttcgtttacgcaattcatgagcactacttcaccagagatgatggcgtgactcgacaggctccgttactctctcgactacgaggaatgaacaccgaatccgtgacaagggcatcggtaaatcgggacagcacaccggcgatttctacagcggacccccagccgccttatgcagtcatccccgcattcacggatgccccctcaaactcaaactcgagcggcactggaagctctgagatgctggggggttcaattatttccggtggggatagcattctcgtggacacgtctgcgcctgcctcccctccccaaggggccgcttccgaagctacttcccaaaacgcttccttgattaatgtgctgcgacccgaagctgctgagaagcaagaagctgacgcttacaggatcgtcgcctttgccgttgacgacagtgaacacgttatcgatgtaacagacgcggagccgaacgctggtgtcctcccttagaacacacaatgaccgtggcttcacgtggcctttataagtgcatatcgacctatgtgtgcttacgggtatcatttcgaggcgtgtgcgccgcagtaatacgcgcagtgattctgtacagctgctgggtctttacacttcacttgtctgctgcgtgctcgatttccgtgacgaaccaagccactgtgctacggaaggcacccacgaacgaaccagttgtagtttggttgctagagggcctgagcttgagcaaatggagacttgcgtgtgtgccgcaaaatatcccttagcaaaaccagcagacagcgacgcgtgaagtttgcttgacccatctccttgccgacattggggacattctgactgtgattggaaaaaatgaccacgagcaatattagacagaacgccacgttagcggatctcaggcggatttggacaagaagctgtttttggtcccgctaggggacaactgcaacaccagcttcacactttgaccgaaaggtaatcctgccatagctgtctgttcgcttaaaacaggtttttagctatttaaacttctgtgtatctgcgtgtatgcgactacgaatgtccgtcgggtagagaacttaaccagccgttattttgctcattatccaagaggaggtcctgtgcttgaaaacaggcaagccatcaaaccgccgagtggaccgccttcgcaacatgcaaaccgtctcgtatggttggtcagaagcctttgttttcgcatccttcctatgatacgctgatttggatttctctagttgttctgcactctagatgcagtcgactgagatagcaccataaacatgcaccactattccgtcgtcctcacttctggtagtcaggtgtgtacactccgaaacgtcctgtttttcacttgagagactcgctgtatcacagacttgtttgaacaaggaaattcctgtagtcgccccgcggcaatgactcgaccgaccataaatcagcggggtgacccatttgtccaggtgactcgtcttgaacacgagagagaaatatgctgacattgtagcgtccgaaacgccccccttccatggctggatacgggactgacgcgaagaagtcaacaatcctgtttttttttctctctcgtaggcactcacccaccaggctaactagccgtttgtctaagcctctcagttagttcgcagtctgaagggcggggacaaagacaatatagatgcaacaacaaccgattcagcaacgctctcagcttttttttatttccgcatggtacttagactcatttatccatgcaaaaaacagctctctagcacagtaaaagcaagacgcacgggtgcaataactaccgtgagctgcctccgggcatctcccgaccgttctcattcaccacaagaggggaaccgtcgagctgactcgctcggtatgaggtcaaagtccgtcgcaagcatttattcaactctgcctgcctttcaatttaaggctcacattttcaaactttcgaagtccctgcttttctgcacattcttcccggcaagacattgtacgccttttttctgtctaaaaatcgcccgccgtccacaacccaacttcagcgttctcgacacgtagcccatggcccccttcctctcatcaagacgaagcctcgttggtttcatgtgaacgagatctcggcaaacatcccttcaccgatcctggctgccaacgacaccttcttcacaaaaatcgagtcaacaaagcagaggaaaccgaaaaaa

SEQ ID NO: 2656 - DNA, 3309 bp, Toxoplasma gondii
aacgagttcgtttacacatccagcggccattatgacacctgatagtgtgttgttccttcccccttttgggtgggatatgcgatgcttctgtctaagtatgtgtgtgttgtcaaggtttggagacaacaaaggatcttggagcactacaagcggttcatctttattgcctctgaacaaaggtgggctgtagaaaagaaagatcgaaaacactgctgtatgtcgcagaaatacgaaatcctcgagtgtatgcctgtgctgcgatcaggaatggcactgcagtacgctgcacatcgttaccttgccagttcccctagtcattgtaaaaaaactacagtactctccccacactgctaatgatatgaggttgacggatgctgttgattgagtgaatggggtatacagcttgcggatgatgtaatgccctcgctcttgaggcctcttcgattgagctcgtgatactctaaaaagagctgtgcctcttggtactggtctgcagcaacccatccccgctatgcctagacgcctgctttctcttacgtgaccgggtggggacgacacagtggggaaggatgcatggaggtgggtgctggtgaccgtgagccgttgctatcgtggtagtttgcaggagcttagtgacaccatttggagaagctgatgccatgcagatcgataccaaggatgggagcccgctgtcacattgcccaccgcatgactttcctctcttggatccagctcaacctaatatagtagaaaggatcttcctcagtagctacactgaggtgggtgttgaaacagtctacagcacggtagacctcgcggaactttttacggcaccgcacgcccctttggagggaagcgccaacttcagaacgatcggaatatcagtgtcactgcaacggcactaaaaacgagcccatctggtggcgccttgcgactcatcgcttcgtcaaaggagagtcctgttgcacccaagcgcatctcagaaagctgtcctcgaatcaagctactgacctttcagaagaaacctagatagttgtggtgttttatcttgtggaaaccaagttgtctctggttcctcctgacataacacagagttaggtttaaccaggccccctacgacggcgagtctcagccgtcgacgagaactgccgctcgatccagtgcaggatttcaaacagacatcgaataggcgaaacgtatcgctttgctttactgtctggatgctgtcgccaactaaacttgaaacacacaactggtattctaccaagcctgacttacgagtgcattggttctggggatgataacactgtcacacctttcccattttttctggagacggccagcgtccaagaacaactcaactcgtcctgaacctgtccattttttctcgtgtgtccgagcaaataacgttgaacctgcctttgacgcgttttcctgtgatcagacgccaaacaacctttacaccgatggggggcgtcattttcactagggcgattatcggcacacgaaagggcaatgccccacttagttgtctcacgaaacgagacatcgactcgtggtcaacaagcaccagttctaacagcgacttgcccatcgagacaaagtcggtaagaccgcttgtctgccacccagatgtcgctttgaggctgtctccataaaagtctgtagaagacttctggaaagtggggacttttagtgttgagagccgacgacgtccggtgccacgaatggcccgcgttcgctgttttttccacttctgctgcacttcggttgaggggccgcacacgccggccacacagtttcaggctgcagctggcagtgaatgtttcttaggagcggaaagcgtttcgagctgttgggagcgcatttggagtctcactcctcacccgaaaagcagtttcgcttttccagagaggatccaagttttgcggagatcatgttgcacagagagtgcgtgcgggcaagccgataccgtgactctgaagattaccagcgccttctgcacttctcgcaaagtcagaaggtagacttccgccgcggtttcctgtctttcccaagtaggcgcttcgtgtttaggaaagaaatgcgctaaagacacgagatggaaaaacgcaaacccgaacgcgcaagaacagcggaacagtgcggacgacttgtcgctagctgcgctgcctcagctgggtcttgcgatcagcgaatctttttttgccacgggctttcctattcaccaatacagacggtttttgctccgagagttgtggtactgcctctgaaaatgacacctagaaaaggggacggaacgcctgagtgattccatcgtcaaagtttccgttcacctgtgaaatgccgtccagcgagtaacttcgaggtaacccaagtttctcttcccagccgttcagaaccatcaacgcgtttttcgcgggaacactcgactcgctcttttccgtcgagaatgctggagggaagaggaagttcccgacgcagtccctttcgttccacacaaagaacggcgtccgtctgtattttttcgagcgctggtaacgagccttctgctttccgtgaattctggcaagcccgtttagccgggcgggcctgtcggccacgctccgcgacccttgactgaaaccctgcccttttaaagtcccatatccagtgtacggcgttgaaactaaccagcctctcttgcacgctttcttgtgtgtcaattttttgccttggagtcgtattctccatatgtgggcgtccaagctgacgcagttgtgcgctcccagattcttttcaaaacatatggtcagaacgctcgttctctgcttctggaaaaagtgaaacttgcagtttgaaggagcagatttagcgctccgtagttcaaccaccttcccgttagaatttttctattggcacttcgaaacccttattttggtgtcaaagggcgtgtctatgcctgtgcgactgaacggactctctcgtcattatacgcaggaaatcggatttgagaaagatgcccgatttctactttcgattttcctcctttttttctgactgtcgtctaaagatcgctctcaactcgccgtccgcagagtaggttttcaattttttcttcactgtcggcgattcttttcgtggtgtttcccagccgttaggttctttttttcagactcgttgactcagaagccccgttcaaaattccacggtcgatccggcccgtagctgtgccttctttccgtgagcccagatcccaaggcctttgcagtttcccaatctgaccctttttcttccagacgtccgtcttcgccctcgctgccgtcaata

SEQ ID NO: 2657 - DNA, 1628 bp, Toxoplasma gondii
tttttgacgggcttgcctgaggaaatacgggtgtgcagggaagcgagagcagaggagttcccagtctcgcaattgggcggtgcttattcacattgaacggacgaagtcgtcgtcatttccgcccaaaacattgcagaatagacgacaccgaccgccttcccagtgcaagtgaatggggtcgagtctggtactcacgactagccagatggaggtacattcgaacacacactggaggcagcgtttttttcgtttcaggcacctcgacacctcgttgatcctttctgctctaatgcatgaagaagggattcacaaagtgcttctcgctttgccacataaatggggtgcggtagcaccggaatgctgctatcttccgcgatgaagtgaagaagctggggctccgccctctctgttacagtgccaataacttatgcgattgctggagtttcttatataacatccacaagcattccagacccggggcgagtcgggctttcatctgatgtgaaagctcacgaagctcgacaaacacattataaaatagggtggcacaggcgacccccgcgagccgcccgcgattgccttaataccgcgattgctcttgaacctgtagccgcccacacaacccccgtgggaatcgcgaggctacagtgactgccgacagattatatgcacgtcacgtgacaacatccttttgagcagtggtcgcgatagcactacgacgagttcctcgaggcgccccgccaagtttgagatatatcttgaaccttgaagtgagacactgcagggattcatggtcagacatttttcctagcggaagcaacaagggattctgaatcttgtcgctccgcctacgcggaagaacggcggacaaaactatcggcgtagattccgacactgtgaacatcaaactgtgcttgccattggcgacctctaactgatattcgttctggtggtgagatggacaaagcgccacggaaatccttctgcacgtgacgtcccctaatcgctgttgatgctcacggagaaaaggctgaggatcaaaggcaaaaacagcagagctagcctgctgtggtctacaatgtcaggtcccgcccagcctcgacgaagattttctctcaatgaaacggagtgagccatctgaagagcctcactgcatttctctgaccgaacgctcgcttgttagcatctcaaagactgttcataaagagtgtgaatctcttatactcgcagagaggaaacgcatccatcctttgtggcttcctgggctgcaaagtgtcgcctcggcgcccagagggcttactactaacaacatgatctcggaattgcactcgggttgagtgagctgcgggcaacgttctgcagaaaaaaaagattcagttcccatccggggttggtgtactttggagttcagcatcgtctctatccattgttcagtactatggctattctcagatcaccacctaggaacgaactgaggataattacaagacagattaaaggcggcattctatcctcgagtgtttttgctctacacgttgaacctcatcgcatctaccacctcagtcttgctgtcgccaatacaaattcgcacgtggtacgcgtggtgcaccgcaatccttccccttgca

SEQ ID NO: 2658 - DNA, 2220 bp, Toxoplasma gondii
gcttctccacttgtaatactcacttcaggccctgcctcgattcaccggacaccgtcgctttctacggtggtgccgtttccttacggggagttgcgcttcgcgggtgtcgaaagatgcaacggccaacagtcaggatcagacgatcaacgcgactcagaaactcatgcgacagggttctcgagctctttgacccatgacttgatgcccctggatcccagcgtgaatcaagacctcccattcacttcaggacatgctgaactcattggattcgctgtgtttacgagagagatagagggattcacaagatgaaatgaggttctgagtttagtgcactccacacaggtgttggcgagaggcgtgaccgagactgtcctggcgctggagcgcttgtcactccgttcttgcacttgagaggctttcggaatgcaaagcagagtgaaggcgcccatcccaccgggcagtgtacaacaggggcattgtggaaacaagggagatggtggtgaaccactggggatgaacgaacctttggaatatgcggtcattcgtcttgagagacgaccgtttccagcgcagtgccagggtgaatcgtcaatcgacagcctgcaagtgtacgcagcgagagaggcgaagcgtcattgatgcaaagcgaagaactgccgctttctgcgtgtcgagaaaatgccgtggttgtgttccgcggcggcctgtggggcagcgttgctgtccggaaactggacagttgcccgtttttgcttttcagaaacgagtttggttagcattcgagttcactaagaaaaccacctcatttgctcgtctgagcttccatggtctctgtaaattacgttcaaaacgtggtgccgggtacacactcacacaaaaacaacgcctgtctgatgatggaaggcacagaggcagaagccgtcaaactccgccaatcgcacgaccacgataatacacttgagcgctctgaagtgagcaccttggatctttagatttccgcagaccttggacctgcaattaaatggctctaggaactctgcaggtagagatgatcccctgcaatcctcatgcgccagtgtcggaggctagctgtccacatagttaatagactcatctccttacgcgtatacttgcattctattctcatgtgctcatgaccgagggcagacgccgcatcccggtacggactagagaaacctgcgagacggttctacactcgaagaaaagctgtggaacaaagaaatcgttggatggttgcgagtcaggttgcaggagcaagcgggaggagcgccatgacactttttaaaactttccgtttgtttgcttctttcttggccgccattgttcgtgtttcagcagcgacttgagtggacagactcccggggcatgaaacaacccgaaacctccttttgtcctgctgaccacgaacttcgtttccaaaatcttgtctgcaagctacacgtaccctaattaaagaaccccgagaaaagacaagagcatacttcgaatcggtaccagtgaagtcgttgccccagtttatatcacgcgacctccaactgcgctgtctgacggcgtggttgcgcacatgctgctcgcgtgacagaagcggccgctgtagagagaagcccagttgtttctggactggcgaaaggaggtttgagtagtaaaaaatcgagcgattcgtgtcaaagactcgtggatgctttttaggtcgagtctggctttcagccaagaaagtttctttgtgcgctgttcaccacactcagctgggcggtgcctcgattcgtgcagacgcgaattctcgctctttctcaggttggttttgcccgcctccttttcaggagaaaattttccgcctttcgttgcagctccgagggacaactcggaaatttcaaacccttcgaatctggaggcttcccaagaacgaaaacgccgccagaccgaccgactcgcggttttctcgaccttgtcttgcggccccggactctagctggcgcatctggtcgttgtttattgtctctggggggtttgtgggggaaagtagcgtctcttgcgtctttctcggccttcctcccggacagaagacggtctctcgccctcgattccgagacaacgccctcctccctccaaacagcgcccaccgccgtcgaggcgcttgtctttttcttttcgtctccttttccccgacacacgcgagaaaaaactcttgtttcaacgcga

SEQ ID NO: 2659 - DNA, 3531 bp, Toxoplasma gondii
cgacatgtaaacgaggcgtggaaagaaggccgcagaaatcgttccgagaggcacgaggcggagaagaccaaggccgcagctgtcctgcagagacgcaaatttctgtggctctgatttttctccagaagaccacaagccaggctatagaagcgctgggacaggaactcagagacccgtgtctgatcttccgctgacgtggtggagagaaaactgtgtttccgtttcgtacagaggagtacaggaagttgccttcgcttgttctgccttgcagtctttttcttgtcctttacaagaactgcgtcaaccattcatccaagagcgcatgccctgcactcgccgtttgctcgcctgcctcgaaaagagggacactgtgcccgctttcgcgactgcgtgcgccggcgacgctctcgcggaactttctactactcccaggacttgcggagtgacagccgacacggaggctctgatgcagttgatcattaggccatgaaatatgagctgccttttgcgaaagagtgcctttctctacacattcgcagcctacgccgttggtacaacctagatttttttgcgtcactgtacgcaggacgatctgcagtttcagataccccccactcccaaacactcgcatcccacgcctcattcgcttcttttcttaaccgcagtcgaacggcgcgcggaagtaaagtaactgcgggcttagtgcgcgacgaactgtatcctcatttgatgaagcaagctggcttaaaaaacagaagtgtactcggaaattaactcctactttaacgcgtgcccgcacttgctagcggtcaatgtagagcaacaacaagataggaattattcaggcttacgcagttctgaattgcagagactttctgcacagggaaattccagttagattgtgagaacacctggtctacctgtaaccggtctgttgttcttgatactcgggcatgcgtcattctgttctcttccttctgtaacggctcacgatcaccagaaaggagacgagtgcgtcatcgtaggtcgcacgacagatcacgcgatttgttttgctgtttgttcgacaacaacgtctcccccacaaggtcaaaaacgaacgacatcctcgagttcgtcagcctcgatttcgccagagtcaacactggccttggagacgctcgcctgaactctataaagcccatggtttagccaagttctttattgcgtgttcctgtctgtctgtttagcgtttctaacgcgaccgtgcagaaagctggcaaagttccggggcctctatgctaacgtgaatagtcctttcccacttctctttgctttgttctttcgtgcactggtgtcgtctcgtcttcaacatgcacttgctggctcgttcggtgcttgtttcgggttcgccctcacgcgtcgtgactttgtatgaggttctggggggcatcacctgcttttctaaccccgatgttgaggtcttgtccagtctcgtgatgttcccgttttggcttgctttccttatcacttcatgtcaccttctcccatgcgggttcaccatcgtgtgctgtctagattttctctgacggtgtgtaaaacaaagctccggagtgccttccatttttagacgcccctggttcccgcaacacgtcgaggaaaggttctcctttttctttcctttgttcttcgatggtgtgtctcactttcgctgcacaggaactgcttgcacttcatgtgtggaagggaattctgtattgtcgtctttagctaccagtttaccccgtatcttcctttcgttttctcgttcgtcctcaaaatcggcggattcgcaccgaactggctcacgtttctttttgcacacccgaaaacctggattccacgtcgcgcgacgtgaacagagagaacaggctacaaatgaaagtagcacggactcctggtggtacatttgttcgagacaagcttgaatgatcgctgactgctgcaactttcgttcagtcggtgggcctccagttttcttcggagctgtcgcaacttcccagtgccagcgtcgatcgtaaatgcgtctcggtgtttctttttcttgcgttatcttcccctctgtgcggccttctgggaaaggagaggcataacacatgtagaccttattggaaaagtacgctccctaacatctgggttctgcactgagacgcggatactcgagacgggcagcatgtgggggagacaaatcgggagacaacagagagacgggagacaccatggagccggacgacggcaggcggggtgaagggccccgtcgtgcttgcatgtcagcacaaccagcagggggtatgtgtggcttgtgtagccatgagtgcttttggctttgcggcaagaaactcggacaaaaaggcgacaaacgccaagccaccatgatccacaaagaaggtggtattttgcttccgcaagccacaaaacacttccgcctgggggtcccagcagagatagggggcacttggcgtctggacgggttgccctttctctagtagtcggcttcaagcgggagcctcgtcagctgcgtagccgcgtttcggcactaagggtgtgctcccctatcagaggacgagccccgccgagtctcccgcttcgtttcgggccacggactttgaaattggaggaaaacagagcgaaaaccgtgtcagttccccggaacacgaatacggacagatcccgtcagccacagatccgctcggctgctgtaccgacagtggagctgccgcagcttgttctggcaacgacgtcttgcccactttttgcgagtggctgcgggtggcaaaggctctccgaggaggctgcagtgaccttgttcttggatcttctcccttctctggttcttccgtcttcacgtgtcgtttttgtgattgagaaggaggacgcggacctcctttgttctcaagaaagcgccaacacgagttggtgtagtccatccatctcctttgagtccacttgtgtaccttttccatcgaccagccggccctagctgtttctccgcttctgcccgacatcacgtgcacccggccacgaacccgtccgcccagtcgttttttcttccttccctatctttcgttgtttctgcttcttcaacaatgccagcagagacgccagggaaagtgtgcgtttcccagtggcgaaaactccgtccgagcgcgcttcgtttcgccctcctctcgagcgtgtggggtttcctaccctaagtcgcgtcaaatccgtttctttgagttcttccgtgcctcgccaagcgcagtcaaccgcaggaatgtggcaaaatgcgtctggatgcggtgtttcgtagctgacggaggccgagctccttcacaaaaccgcattcgacgcggagttcctcgccacgacgccctcggcctcgagtcctgccgccttctcgtgcctcatcatcgtcttcttccacccgcgctccgtccaccacccgcgcctgaccatccagcctcctgcactgtggtcgcttctcggcgtgctttgccggtttgctggctgtcagcccctgcctcgtaacca

SEQ ID NO: 2660 - DNA, 1857 bp, Toxoplasma gondii
gaaaggaagcatcgcatctgtcacacgaggatcttgaacggtcgtcgcctggttgtccaagtaaacgggtcgcgatcccaccactgcttccccgccgctctcaaaggctccagatcccgaagaaggagaagaagaagaagaaggaggagaaggagaagaaggagaaggagaagaaggagaagaagaggatgacacggaagagaagggagcagctgcagacgcgaggaaaggggagaagaggtgcaagtcagaagcctgtgggtgttgccgtgaggcagagggcaggagcgcgggtgaagtagcgttccaggacctgcagaagggggagttttcttcggtgttgaacgtcgcgagcgtcgctgttcgacgttccctgtctgcgaggtcaggccgggacctcaaaggacctcggtgaagattaagaaagctccttgacgacgcgcgcaccgctgtcgtctggagagggacacaggacgcagtcgagaagagagacgagagaggagagaacgaagagcgagacgaaagagaagaagagcgcgaagagaacacagtgagaggcggaacggtggaaagagcatagcagcgacctctgcagggcggtgcggccgcgcaggcgactttcgcgagtcgactcatcttgcacgagagatccgcgggagctggaaaaatccaagaactcgggggaaaacggagaagttccgggaagtgagagggagggtgtgaacacacaaaaggcgcgaaggagtgacaaaaaaaagaaatgcagcgccaaaggagacacacgtctctgccttgttccgtcacttgtaggacaagaaagctactgaggtctctatagacacccgaagctgcgagcttctgctctctgcacaaaacaaacgaatccgtcgggaacgaagcgtcaaaggcgcgagaaaacgcgtttttcgtttctccggcaaaaaaacggggaaaagcggcgaatcgcagtaaagtcgacactgcgaaaaagtctgctggggtaaaacgagaagaccgtctgcgcgcgaggaagaggaaactttttgggtgcgagaaccgcgtcgcgatgcatgcaaaaacgtccacgagcggtgaaccccaagccgagaaggaaaacgatgttcgcagggtggagaagcgagcgcaaaattgcctttcttcagcgacatgcgcgacccgtgtcgcgctctccagacgtcccctccctcagctgcgcggagttccgcgttcgacgcgttttttacctctggactgtgtagaagaacgaaatggagggagacagaggtgaaacagaaaggaaaagaagagaaacgcaaggggatgacaagagaggcgaaggacacccttcaggttccgtcgtcgaatcaggccgaacactggggtacaactgatgcgtcagactcctgcggcttctcttgtgtaagaactggaaatgtcctgtggctcactgagacaccgtggctcgggcagagaccgcgacgacgcaaacttgggaaggtcgcatttctcgaccgcgaaatcctggaaaatatggcaaacagctctgcatgcacgatttacgctcgctgtttctcggacacaccgtctgcaaacaacgctcaaaaacacttgggtaggctgcggtaagttgcaggaaatgcgtttttgaagaagggagaacggcggtgattgaagcgggagaagaagaggtcaacatctgtgtatacgtaagaaagcgcggacagaaggaagctgctcgcggcagccgaaggcagagagaccgagtcgcgcacaccaggtttctgggcgaactcggctttacagacaccgcgccgagttgagaggaagacagaaaaaaaacggagagaacaaaagaga

SEQ ID NO: 2661 - DNA, 2669 bp, Toxoplasma gondii
ttgcaagatcactagcagaaaggaatcgacgcattccctctcccgctccctcaggccaggggcagcaacggcagaggagctttgtctccagtgtaccttggttgatgtcgatcggcattttgtgaatggactccgggtagttgtgggcgatatcctcgatgctggtgcctcctcgagcgctgaagacaaaggtcgggacagtctcaaagtgcacacgagtctctcataccaccgacggatttcgaatccacttcctgcaacgtcaagagcgggtgctcctctccttcgtggattcgcccccctttcttttctgccgaccgctgtgggggaaacaatctcagtctgtggcaacgaacctcagatcccaggagtgtcttctctttacaccagcctctgcttctgtttctccagcctatgaaagcacacggtcatgttcggcagactttttacgggaaggagacaccttgaatcgtcgggaggtgcggtctgcagtgtcaaagtgcagcgctgcgacttcgcacgtcgaccgcctctcgttcgtgtgtcgagttccctccagagtcatcttttcttaagtggttccacactgacagctgtcaacggcgctcgatcacacaccttccaatgaggataggacctccggcgccgcggtccatgaggatggcgacgtatttttctttccggatgaagaatcgctctgtgacgaggactttgttgcacagcttgccttcctttcctgtttgcttggtgacgagcgttttcccgagcattttttccgcaacgatgccgacctcgcggggactctcacagacctggacgccgccctggtacccgttctctctgaagaagccgaggcccctgccgccagccaagacctgcgccttgacgacaaagtccacgggctccccgtcgccgctcggcgactcggacaggaaagtcgcggcttcctgctcggcctccttcgctgttgaagcgacggcgaacttgggcgtggtaatgtggaactccttcatgattctcatgctttggtactcgtgcaggttcaggaaccggcgctgctcgcgctggtgggaaggcgaggtcgcgccggtcgcgcggtgagtggcacacaaaagggagggaagcagagaggaagacgtggcggaagcagctgtgacagaagaaatcgtcgcgcgtagaggggcagaagaagtggaacaagacagacgcgcggcggcagagagaacctgccggccgacgccagcggctgagagcgccattgtgagagggtgcagcgaccgaaaaagacgaaatgggagaagagagacgacggggggaaagtggaggagactcgagaaacgagaacgaaaaaaaacgaccgcgagacacgaaaaaaagtgtcacccaacggcagcaggctctctgagaacagtcgacccctcgagacggacacacaggagcatgtatgttgtatgtgcgtacccgcgtgcggcacgctgagagcgacctgtatgtttgtgcgcgtggtagccgtggaggctacgaacgagcgaaatcggggcttcacagcaacactctcaccagcaaacacttcgttttcgcggctaataggtggaggcatgaaaaagactcactcactcaaagatgcgatgaaagtgcgcgtagaaaaggggccgagacaacagagtccaagcgccggtacaaccagatcagggacacttgggaagtctgtgtgctggctacagagctcttgcttccagacagacctctccacagaatagcgagcgactgagcaaaaatagttttcgcccctttgtctcgttggagaggagagccgcttaccttctgctgaggggggcctcgcgcaatcgagactcaacaggcggttgtggaacaaggtacacgaccacgaggggctgagggctattctcggtctgcggaaacgccgacccgcaggaaaaggacactttttgcttcaacagggccgagatctgaggtagatgcgaaaccaaaatgccaagaaagataggcgtaacttcagaaacacacgcataccggcgtcgtgtttgagagtcgcttggcggccgcgcagcgccgtcggtttttattggggatgaggagcgcatgcagagaaacccctacagacgacacagaacagaagaaacgaacaaggaaaagtggggtggcagcagttcgcgcgattacgcatgaggcaagctcgagaaaacgccgagaaaacgggaaaatcgccgcgtattttttgtcgcttccagttcggagcttttcatttctgcggtgaatgtgcttctgggctttggtcgccgcgcgcgtctgcaccctgtaactggtgtctgttttatccgcctccgactcaaagcgagcgtgtgtccagcgtcaaatcgtaaagtgaaacttagaaaccagtatcgggttcttgcgactctctgcgcctgtgactctgtccccgtttccgccccgtttgtctccgacagcacatcctttgcgtgggtggtgccggtcctctaccgcgcgcgcagaagcgcccagacgcttcttgtgttttgttttcctcgttttccgtttagtctttcagttttttctttgtgcttcgtctcagaacgtcttctcggcttcatcaagtctcatagatttcgcagactgccccattcagtaccccggacctgacaaca

SEQ ID NO: 2662 - DNA, 2343 bp, Toxoplasma gondii
agaggttcatgtgttcagtgtctcgctttctcaccgtgtaggtagccaggacgtcgggtcgatcgacgccgtaggtgattctgcggaatcccgagggttcgttgagagtgacgaaaatatcacccgccttgtagagaccgaagagtgccaggttcgccttggggttgatggacaccagagttctgatgtagaagcgtacttctgcttccctgggcagaaggaatttcgacaccatcaggttaccatcaacaatgcgaaactgaaactggctgtccgtgggcatttgcccgtccagttcggtgaaggtgacacgaccttgaccacgcagagagggtgacgaggtagtcgccaaagagatgctcttcaagatcacactctcatctccatcgaggacaaggttcattggttcggtgccggcgcgacggtaaagagtcaggagagcttcgacctgcggacacgtcgaaagagaaacgcgcagtgcagcgaaagaaagacacgaaaaattggtaacatgcaagcagagtaccggcgccacggaacaaggggtatgatggcagacggcgcaggggcattacggagcacgaaaagaaacaaaagaaaacaccctccagcacaaaagaatgaagagtcaacagaagagaggggacgaattacatgcaacatataaggaatcaaacggttcggtgagagaaatgaaggacccaaaagaggaggcacacagaatggaaagtggagagaggaaaaacagcacccgaaaccacagctacggttttgagtccgtgagctgcgacttgtaggcaagaccccacagaacgacaaagtgcgtgaaactctcggcatgggtacaaagagacacagcccacaaagaaaggtccgatcctagatgcatgacatacagacgatggcacatccgcacggagtggacggaaatcgtagacacactcacagttgtgtcttcgtcgtccaagttgaagtccaaaacgatgtcttcaaggtagaaattcggaggcttgtagtccaatctcacgacggccttgggttcttccttttcctcgcctgctctagaaacctgcaccgtaataacggatgcaagcagaaagctgagaacaccccaaccgcatagtctcgaggaaacacctccggagatccgacatggtgacaccgtcgcattcatggtcgtagccgacagggtcaccataaaataaaacgctttggaacgacaagaataaaatgtgacggggagatcccgcacgctgaggtgacaaagacaagcccgacgacaaatgtggaaatcaaaaaaactcagcggtacactgaatctttttgttacgctaaggcctcgcgacagcgggccgtccacctatagatccagaacggcaaattggcaggtagtcgctgtatgcacttgatacacctgcacacataaaaacaaggaagcgtacagctgagaaagcacgattcgggagcaacggaaagctgcggaatcgtggtaactgctggtacaaccggatcgtgaagccagatgcctacaggtcttagtgacagcacaactggcagactatctccgggcaaaacagcgccaatgatctcgtgtggtgcgtccgccagtcagtttgaagtcgcgggcaacaccttgaacgcgccaaccacgaaaacaagaacaaatcacaaagaatggcctcaggacaggcccttctaattcaatttgctaatacaaacaagtgttcttgtgtccactcctgaaaaacttacaaattcgtgagagttcctaagatccccggagtgcaaagggtgccgcaacacgactacaatggcgacgacctgacggagacgccgtttcagcctgtagtgccgcgatcgagagtgctggtttcggtcgcagtgctacgccccacggcttaagttcctcaaaccgagatctgggatgcttgcaggggtcgtgatgctcgtctcttgtgtcaggcgggaagagacacgcttagggtccgtctcgagtgactctccgtccaaattcgggtattctcgctgagatgagtgcttgtagtgtcgacttgtgttatgcgacgccactagcgcatgtctttgcaatcgcgaagacgctgctcgattggttgatacatcctttcaaaagttgcgatgtgggcacgaaactggaatctagaaacccttgcataaatgggcctagtgtgtagctcgaatggggaaccacgtggcgcccgcgaatgtgactgaggcgcgcgccttgcgagtaccacgcgatctagttttgccacgaaccattccagagatagccgtgcagaagctctgtagctttgctttgcagcgcctgctacgagcgcaaaa

SEQ ID NO: 2663 - DNA, 1680 bp, Toxoplasma gondii
cgttccgttgccctaccttgttgctccgcgacttcggagaaacctcgggccgcgacgtcggagagagttgggcgtcggaaggcgcggctcttgagcaccggtcttcctcaaacgcctcgccgaggacgccctctggcagtagggaggaagcttctgcaatcatctcaattgcagagtgaagccacgaagcgtcgcggaccatcacagtcgaaaacgccagttgatagtgctgcgccgcaagcgcggccgaagcctcctcgatacgacatggcgctgacgaaggagaagaagcagaagaaggagaagacgcagaagaagcggtgtttcccatcgcctcttggaggaggggaagccagccaggaacccagtggagagaggaggcgtcgttttccttggagtctggaatctccttttcgggtgagtgtgcgcctggctctttgtttgtctctttctctgcagagcaggtcgcctgcgtcgcggcggtcgcagcgaggagaggcggcaggggggcttggcttgctccttcgtctggaacggagacagaagacggcggaatttggtgaaggaactggagcagcagatcctgggaatccacgcgtttgcatcttctctgcgtgtcgagacactccttttcgaggctcttccagaagcgcgaaaggtcgtcgaggttcagggaaaccagctcctcgaccgcaggcgagagagcaggagaggcggcggaagacccgccgcggtccgccatgtttctagcagaaaatcgctgacgttggtcgaagcagcaagggaagagagaccggtttagtgtgctgtcaagacacctcaagaaggcgcatgcgccgtcgcatgtgcgtgggaagcggcctgccagtcgagagccaacggcgagaggagcagcagagacgcgagagaggcgaaaaaggaagcgagggaagggagaagaatgcgaagaaagctcagcgacaacgtgagccccgagaaaaactcgcgtctgccgagagaaaccgagggtcgactgctggctgccctggtgtcaaaacgcgtacatgcgcgaaacgtttcgcgggcgatcctcgtcgaatccgcacagccccccatgttcagtccccaggaaacgaacaggactcgaccacttggcagctcgatcctcacggaggcgccagatgcacagagcacggtgtacaccaaaatatgacgcagctgcgattcatccggtcggcttctcccattcttcagcgcctcgcccaagaaaaacaacgcgtccggaagagtgacacagttccttctcgctctcgacagaggggcagactagtccgtttccgggcggtcgagctccagcgctgccgacgacgagacacccgaaagaaaaaagtaacgctgtccacatggccatctgcagagagagatagagagagaggacaacgattgaagtccgagagagacgcttaggcagccacagcgagcggagacggcgcgggcgttggtggtctcggcgcgcgagtctccggcgttgcccggggggtgcctatcaaactggagtttgtatgcgaatcgcaagcaggcctccagcggagaaggctcacactgacaagggaaaaaacagcaaaggagctgtgagctgttgagagaaaatggaaaaatggaaacagggtgtacaggcaacttgtccggtgggcgctgtcg

SEQ ID NO: 2664 - DNA, 2075 bp, Toxoplasma gondii
cagtcgtgtctgctttctgataaaggcacctctaacatgcgctgaaacggcaagtgagtggtatgccgacacaagcatccctgcttttgtagacaaagattataagcgtctctctaagagcgatattcaggtcaatcatccgcgtgtagcagcccgtgctggcgaagaaactggttattgtattcttaacgatttgagtttcctgttactagactgcccgaactttttgagcgcagacccctttgtgtgagaaaaaattgattcataacatttttgtcgcagtgatggaaagagcagcgtacgactaccactgctttctgggctgttgacttttgagtttgagcggttgagcgcgggagggatcaggattgttgcataagctcttgataatccaggcactaccagagcgtccaggtggatggagtttcacacacaactccgggctgaggagaccacctgtcagacttctgagggtgaatgcttttccacgtgtatacactcgagaatgtgatggggtgcggaacaaaatgctcatgttaaagatgtcttctttttcagatttctgcagtcaatgcgtttgatatagagtttactcatgtaaacttgctgatgaagtttcaaccacaacgagctgacacgtttctccgtaggtcacagagccagtgtttatgccatgatgtatacacatgggtttgatgtgggttacggaacacgattcctaggacgcttatctttctgattaaaacacagtcaatctgtttcccatagggcgtgtacaattgaacggaatacacaatagtactccaggaggccttgtgagacgtcgacgcctagtcttctctgtagaatgcgtttaccggagacatcaactctgaacgcaacagttttcggtgagtgctgtggtgcaaaaagcattctacatttgtcactcagtcgttcctttaaaccttgaaatcatcgcccggaccgctacgatgctgtaatttggagtttccggtgaacctctggccacaaggaactggtttattcccacttcactaccattctaagaggatcagttccatctgcgccagaaagcgtccctacaacactgtcctcatcccattttcaaggaatcagaactgtggaaaaaacggacgattcacgatgagtcacggaacagacactctgaccattacagacagacagtcttcggtgtttattcccgcgcgcatgcatcatcgtgcccgagtggaaggtacagggtcaacaagcttcatcagcaactctgctctgcgtttcttgacagcatgcgccgaaatccagaacaatgtcctggaataaaatacaagtggttcgttggtcagccttgaacgccgagccttcctgcgttttttctacccggacgagttccggataccacactgctgtacggcaggactctgtgccaaccgtttcttcaagtcctcttcgcgcacctcatcccattcgcaaactggagtctcgcttctctctgtcttcatttcagacccacctccatcgtgacttgaattcctcccagtccgtttctgccgcctctgcctgtttgtgatgcaagtctacctgtaatcccggtgtgcccgttacgcagacctcacgactgtggtgtacagtttgccgttttgaaggcgtctgcattcgtcacgactcttttccctctctgcagcgcttcactgtgacgtttcctgttcaccttctcacatctaaccgcgcccctccctgtcctgcttcggcaagcctgtctgctttccctctacaggacagccgcgaccgtgcatgcgtagaccctagctgtcatcccgagtctaagaaaacaaccatttgtttgatttcctaaaccttaaaccctgttccaaaggggggagaagaggactggattgtctcctactgccttcttcgtgccgtttcgggagctttatcgttcgtctcaaaaagcacgcccacctgctgtctcggcaaacgtacacgccttacccacaaccgtcttccttttgtcaagtagcccctgcgtcggcttcgtctctgctcagaaacctgcagctttttctcctgtacaa

SEQ ID NO: 2665 - DNA, 2442 bp, Toxoplasma gondii
tagggaatgctgcaccgcttaattggcaatgcattgatataataatcgtacaaacgctcagctagttatttagagacactcacgagacccccccctcccaagaaacagatttgtccccatggtagtgcatctcctaggaatggagcggctatagtaagtagatataaaacttgtcagctataagcttccgtcacctgtgaagaccgtgatggcacgagtgagagacgatatagctttactacgatcttcagctgattcttcgagcttctcgctcttcttagttattctagtttaacgtcacatccccgtatggcgggaggtagacgtccactgccatgcgggtcggtgcgtatctgcgtgtgtcgaattttcagagcagctttgaaaaagaagcggtatgacagacaaatcgtgcttaggtgtcttgtctatgtcagcccccctgggttattccccgttaatgaggaatcaattttgccggatgcatctaccgaagctcgacgacttcagatattttggctgtttacccagctgtcttttagcaatcagcagatacgattcaatgaccttgcacgacagcacacctccgtgctggactacccgagttgcattgatgttggccaccagcttgtttgtgtgaatattttcatcgagcaccgctggtgatagttcttgtgtgtaagcaagatgtaaaaagtgctcgttctctgacttgtgagaagggatgaactcttttgtgaaggggaaccaagaaggcaagcctggcgagaagtgggaacacggcaaatttgtttgtcgtataagggagcaagaaaccgcgttgacaaggcaagacgagaacagctactgatccctcagtgtgatacaagtatctcggaaaaacacgtgtttccaccggcacttcacaatcgactcgtgggcggattccggctggggcgacctgcgagtctacgaattgccggcgcactcttataataactggggcaggagaaatatttcaacatcatactctgcgagatatgatcagccgtcggtcctgggtaggacgattgctctaaactgggctccggctctctatctaccgctgtagtgaaataaatgaaatgcaggagtatgatatacggagctgttgagcagtgctagttgttaaagtgacagacccaatggtcactggagaatcagcagagtggctacagccgttcgtgatatgacggcaggttatcactacgactgcagggaatgcgaaatgtagacaccccaatgcgagaggacagtttcgatcatatgcttaaaattcctgaaacgttctggatccttagtgatgcatgatgcgacgatattcgcttgggatgttttctttatacttagtagagaagccgagcttaacatctgaacctcatccataacagatgttccaatgtgggagtcgcagttaaacgttgaggtcccgatagaatatttctggcttgaaagagcatgctgacagtcaaatgacaacattgtgctggtctcgacgacgtcgttgaggcttgtagagtatcagcactagttgtaggcactaagtgcgaacgactgctcgtccgcgtggaaatgttcgacctgaaggttaaactgcaatatgagagtgctttcttctggccccgtttcttccaagtgttgtgacagagggctatacacagcgcctgcgagtcgacgagctaacggcaagctgagagagcgtctctatcttctgtaccactgtaccaggagtagtctttttgcaacgccatcaccatacgtaactcaatgtttgctcgaactgtcggggctcccccatgcaaatccggtcgtcgcaatagactgctgctccgggctgctccaggacgcgcaagcgcaagggtgttatctgccgtcgtctgcccttaagccataatccagacaaagccgcctaagcaatggggcggctaaagcggacatctcgatcacgtatcggtggggtgattcctggttagctgcttccctgcatttggctaagcaaatctgtacaacaatcatgcgtgtcccaaacgtcgtatacgcagcagtagcctctttggaagatatattttttttctttagacgcattagcaggctaacaagacagatgaaaggcatttttgaatattaacatctttctgtcggtccactgtagctttctttcaagccccccgcccgggcgacaggcctgccatgtttttactttcattgggctgccgatcctggattcggaaatgcatgaatgaggtcattttatgtcacgctagaacaacaattgaaaatagtcttaatgaaatagaaatcccaccgcttgacgtttttttgtggagtgacattgcctctctctatagagacgggtgtttgcttggtccccaacggcaagctctacgccgagcggccgtgagatttaacacttttctgtcgaca

SEQ ID NO: 2666 - DNA, 2352 bp, Toxoplasma gondii
tcgcctctacaggatttcgatcgtggatgcgacagaggcgtctctgttccgcggcttccccgtttcccttttgcccctgccgaccagcgaaagactctgttttagcggaatgttttggacagtgtgcatgagtaaatgcaagacgctgaggtcggcgtctctctgcgcgcgcgtccgctcctctcggcaacagcttctctgctcgctctgcgactgtgttgtgttcagagtttaaagaggcctttgtctgcggcttcctctcacctggtggagcaattgattcaagtcgaagagcaaatggtcggcaagaagaacgtctctcttcttattcacctggctgacagcagacggaaacgcttgccgcagccagttgtgcagcccagggatgcctgcctctgcacacaggcagcgtacgctgtcgggactccagcggaggccgaggcagaagcaaacgaaaagggagaaaaaggagaagaagaaagaaaaggaggactttctgagaggcagccgcgtcgtgggtaaggtgcaagaagaggagtgagcaggtcgcgctgtcgcgcttgtcgagacgcggcggagcagggcaacaacgtacaagacctttcgagtcttcatcctcggaacgcatccctctggaggagttcgagtcgcgagaagcagcagagagcagcgaggcaacgaggaaggaaggaacgaagctggagagaagcaacgggcgtttacgtttcaggttgacaggcagacttttgattgagacacggagaaagaacggaaaagacgaatcccctgccaattctcgagtggggaaagagagacgccccagaacagcaagagggagaagagactgctgcagttgccccgaaggaggagagaagacagcagaaaagcggaaaaagcaggaaagaggagggcggcatcttcgctccgagaagtccagagcttttccgaagctcgtgagacatccgaagagtcgaaagagaagaaaacgacgaggagagaaagaggcgttcaagacatttcttcgtgaggtgagcgaggggtatataggaagtaaaagttcatgcgttcgttctcttctcagcacaagtgcctgacgtccctctctgtcgtgaggaaccatctcctgtctcttttttcttcctcttcgccgagagattctgattctcagagttggtctctgtctctcgtctgtcctccctgttcttctacttgtccttcttctccggtgcgtcttttttctctccttccaccctccctcgccctctggcagtgtacatacgcaccggagccgacgagccgggagaggccgcgaaggtggagacttgagcgagcgcggggaacgaggataaagagaggaaagtggagaaggaatgttatctggtcactctttgctcccgaagaaatggagacagctgtgtctctgagtgtcttgtcggactcgacggtcctctgcgcccaggagactccttcttccgcatctactcccatctcttctgctgcttccttccttctgtctccttttcagtttatgcttcttcaatttatgctcctgccgcttccacaagcaagacggagactgcgcctctgctctcttcctctcggcaaaaggcggccttgcaccgcagactcgacgcacagaagagattcctcgcagactctggcttgtagccttcctttcgcagccccagaggaaacaaagaacctttccatgtgcgctttcccctctttaaacctcagctgggtggccggctttctttcttctcgccaacgagctgagcgagcggagagcgaagagggacggaagctgcgacttttcgcgttcatagaaacgctgaagctcggagagacgcctgtcgcactggagaccgcggccgcatggctgcatgcagagagtcaaagttttctggtttttttaaaaaataaaaaaattactcagagagactcgacagccggactgctgggagtggcgtcctccactgttctctggaaaagtctcgaatgtggaccaagcctgccgagtcgcataaaggagacagaaccgcgagaaaaagcgcgtttttcagaaataagtttcatctttccaagatctctgtctacgtactcttcaaacattttcaaaggtctctcagcttctgttgtttttctcctcgcctttcgagggcggcggagtcccagctgtttgtggggcaagaaagtcgtcggggaaacggcgacttctctgtcggggaattttcttttctggaagaacttttcgcagcttcctgtttcgtctttacttctgggggaagaaaagttgcggctcggtgaactggcgcggaaacacactttttcttcgacagagaactcgcaaaa

SEQ ID NO: 2667 - DNA, 1378 bp, Toxoplasma gondii
tttcaaatccgcttaaacgtgtacagtgtctctcggagaacctggaattccgcatttgtcgtttttccagcagcgccatgacatcgcctttgttgcggcaatagcggcattcaggaccggtgtctacggcattccactccggtgtttgtcctaacacggcagcctggttaggtctgattcgtctcgtcatagatacagtgaattcccggttggttacgagcaacagccttcccacatcggatggcgaacgaaaacgtattaccgaataacgaaagacgatacgcgattcgccttgacgcacatcccgtcgtctgtgtggctccggtgctcttcccgcacacgcagcattctacatagtaagatacacccacctcaaagtctgtgtcgcaataaaccaccggtttgggatggaatttcttttaacactgcataacatgcaagaatattttcaaagccagcagaagtttgcctatacatagatgagaatgcgggaggaaacaagacaatcgtttggtgtatcgcggctggtggtggcatgctttgaatcccgtttgcggggaaaaacaaccgcaagccaggattcttgcccacattttcaagggtcatcgttacaaaagatgccctcaaacgcgacgcagtcaaacgcctatcgtgtttcgcgtcaacagagacaagagacgatttataaccgtcgtgacagaagtacagaaaccccactgcagtgcagcgtgcaatttctacaggatacttccattctctggctttcgttttgtcacgcggaaccggtctacaacagttagctgtcttactcgtcttcagactgtccagctactgacataacgacgtctcttcagaaagggcggaaatcgctgtcgtcttccgaagaggttcaggcatcccagagaaatttcagttcactgccgaaccccagtttcagaccgtgttacacttaatgacgcaaagatgatgaaagctaccattcaagggcgatagaaatagatagctgtgaggatgagcatacgatgcaacacgaagatgattcattgtactacattgtatcttgcctttttagctcctcacaggagaagcaggacgggcttcgagagctcttgtgaacggctacgcactatcgcggtctcctctttccagctttcatgaccgatctgaagtcgtgatgccattttgctggtgtttttgaatctggcaatgcttgtcgagttcctgcgaggagatctctccttgtgcagagaccagtttcgtaccttgcacgagacaacttcgcacgcgcgggtgtgcatgcacacttgcttcgcctcaagcttccggtttcggcacgcccccgcttcacagtctgtatttcccgtcgttttagagtgaa

SEQ ID NO: 2668 - DNA, 1764 bp, Toxoplasma gondii
gtatctggttgaccgagaatacggatctctccgctgcactagaatctctgtcgtggtccattctggtttcgtcgattcggctttggcgcagactttgggggcagaagtgtttcaagactggctgcgtcacgaggctgcccgacagtcaagaaaaatcatgtcttgagtgaatagcagttagaaaatcccttagcaaggttccgcgagcaacgaattgcatctcagatacgcacgaagaaagaaaatgcttcaggtgtcgcctatggtgtgtctcagcttatgatttctccctcgtgatcatgcatatctttcaccaccaagtcctcttcacagttcgataaatctgcttcttcgagcgtatctttgtcagacacgatccttatcattagtacgacctgctcgaatccaccaaagcctaccattctgacttggctgctttacacgtgctcgtgcccttgaacaacgtagggcttcgccgaccagtgaggcggaaagtccccgtggccatctgaaaattcgtcagttgttgagtcggtgacggtgacagaagactggagctctaagcggcgctggtgccggccttcgataaccactttcataaccaacaaaagtgcatttctgatgctgtgagtttgtgcggctgacatctcccccatagtgtttgctatgtcgtccactgatgacagtttcggtttggaacgaggaatgaaatctgatccgcgcttttatcttggcgcagtcgaacatcactcagtgaaacgcgtgcagcagtcagggaatagctagtagactatttctctaaggctgcggtggtgaatatcggtcggcaaggagtcttcttctcgtttcttgcctgctgtaaagccacagttacgaatgaaggtaagcaaaatcgtagggtttagagcctgcgggttgctttccaacacagctcaagggattttctgtcaaacagaaacacggacacagtactacgctgtggttcgcgcgtgctttatcacttcttgttttggaggcgtccacgatctgaggctcaacaacttcccatttctgaacgggaacctgttcctcccgaaggtcgcgaaacgcacaagtctccgtcttaagcccccttgaatgccttgccggtgttgcctgggggctcatctttgcaacaagtctcaaggggggtgcttcgggagcgaattccgtgactagacttgtctctcaaacagaggaaagcaggctttcctccaactctaaaggaatgaaggaaaatttcgctcggttttctcttgctgcggcgcctgtcgttcgcctcgacgggagacgcgcgcatgcgctgagtcgcgtgcatgcaaaaacgcggaaaccccggtcaagctgttaaagagtatcgcgttttccggccgtcaatcggtgcgtcgtccgtcggagatcttttcctgttcacgttgactttgctggtgtgacggaattcagcaaggacctgatcagctcgttccctgcttcgttttctgggcagctgaattgagcgtgcccgtcgccgtgcagtttgtgctgtgtcccacgccaggactcgcccgcattcttcctgccactatcgatccgcgagaaagccttcaaactgccgttcgctttctctgcattccctgtttgagtctgggatccgccgcagcctcttcccgactgaaggcggcgctcccgttccactctgcctgcggtgccgcggatttgttctgaagacaaaaccctcgcgcttccagctgctctcgagagctacaa

SEQ ID NO: 2669 - DNA, 3059 bp, Toxoplasma gondii
ttcctttatttacagttgtgtcttgtttaggttgcctggaacattgccggcctctcgaagggtggggcagcgtcatttgaaacatatttgtacaatgaagcgcgcatgcttcctgtgactatgggcatgcgtctggatcaaggtatattcacgtatttagctgtgccgtgtgtgcatcggatgtgtacgtgcctgacgctctccagtaccacgagtcctcccagcggacccgctgagtttgcagtgttgttgtctaatttgttttcttgtcactgaagtaacttgaaataacccagctaatttgtgctgcttttatgtggccgaacggaactttacataggggtcgcacatcatttcacggtggtcacggcaaattgagtaaaacagccccgtctgattcacgaaataaaccctcaacaagtgccccggccccgaacttaaacgtgacggagtgagcggcgcacacgtgcagtgcggaaaaagtaagataacacagagcaccagagaggaagagcgacagagatgtcaccaattgagcaaggcgggaaactcgtgactctagcggactgtcagaagaacttgctcttcttcagtagcataacggtccaaacgtaccaatctagtaacgcttgttcctcgcatgtctcgagctcactgcgtacttacggtcagaccaaaagcgttcactaatggaactatgaaatcggaggtcgcggtagcaattggaaaaggactggcggacccccaatacgcggtagaacagaagattcttggaaagaaaacagaacgggagcgcacgcatgcgagcccacgtatctctcttcttcggcatagaaacatagtgtttgttgtgccagaggcgttcttacacggggattgaacgagagatagcaacactaagtgcgagagtcgcttgcgagaaacgaaccctacacagacacatcgatcgactgactcgacaccgagctcacagtgagaatgtctgtgatttttggaaggagttctctttcgtttgcgtttttcgtgcacgggtgacaatggtcttcgaatttgtctttctcgtctttgttctggtttgagcaaagcagattgtcaatcaactatgcaggcgtcgcatgtcttagactctgcgctcggctagaattcaagatcgaacatagtccagaggcgtcagtgtcactccatctttcggatggtgttgcttcttgtacaacaatcgtttaaatgtctgtatcccaacctgggcgttcctttccttctgcctgcttgttcctgttgtttacgaacgcactcgtgtgttgattcagtgctgtggaaaatgagatctctcctccccaagaaacctccaggaagagttgacagatgtgtcacatattagtaaggcatgcgtacagccatgtctgtgattccagagaatgcagcatgcacgaacgcctaggcaaggttccgtatttatctctttctcgccgtttgtcatcaagcctcagcctatgcgatgagggatgccggggagaaactgggtgccttggagttgcagcgattggaaaacagcgacggcgcacgtggtctgttttcaggtctacttaatgcgtgacagtggtcctttagcgcacaaagaagaacgatcgatccatgtctgcccttctgaagcgctgtggaaaagggttttcgtatcagatagctatatgcacggctctgaacagtgtaatgtccttgtggcgcattcactatcgtagtgcgtggtaggtgccagaacgggcacacttcgataaacctgtaagattatacgacatagagtctcgtttctttatcacgccgcgatctgcctagcgctgacagcgctgtgacaatgttccatcgccctcagcttttaacgcgttctcagtacaaccaccggattatctttgtcaacacataccttcgtctttttcggctgttgacagccgaggtggtgattatacggtcccacaatgtcatcgcggttggcgcacgagtgggtttcagtttttgacgagacaactttttctggtgcaactctttcaacatacacgaacagtgtttgctttgcggaagcatgcctttttcacatgtgcaaatttgtttttctcaaacgacgcgtgatgctacttgcgctcggtgcatgcagtaacaccggtttttcgcatcagaaataggtaattgtgactcgcttcctgataaatcaacactcgaagataggactcaaagggaaatcaaggcgttcgaggaaactaaaacacccctttccttgattccggttctacaacagtgtactagtcatttccaaaccttcctccaggagaatgatttccaaggaaacgagcaatcctatttgagcacgcaaacttatacatgtatatgcgcgtgcatgtgcgtagagggaaggacttgtacatatacgactgcctgcatttctttagcggtaaccactcggacgcgcgtggcattcttcctggctacagcaaagctttggccggactcccgctcttcactcttttgtctgcttgagtaaaacgacattgcttcgtagacagttgttggactggcacttagtcgcacgttactgtagtgaacaattcacgttcttcgtcgtctccccccgtacacgtatgagagatcaatggaaatgaagagtttgggagaactcagcaaccccagcgtctaatttgggaacaacaaaactacagaaagcagagacagcggaggtcgtagaaaatcgggcaacaataccgggagttgcgatgccttcattggggtacgacattctgaagttgaaggctacaccgtgttcactgtactggtgcagttcctgtaggaaaaacccaccgggtaaagtggctgtataacagtgaagctgcgttgctaaaagaaaggacacttttgtccggctttgttgattcaagcaccagtcttcgtttttttacgtagtttgtaagtgtgaaatgagtgggtatctccggctttggggagcgaggaaatgaacgcctttccttgcgtttgttagcatgacacggcctgccgaccaggtacggaacctctga

SEQ ID NO: 2670 - DNA, 2858 bp, Toxoplasma gondii
aaggcgaagaagtaaggagttttgcctggatgtcaacgacgaatgccgaggccaaatgtggctgaatcagaggctcgaacagcagtgatgagtgcggggcctcgtgtgtcatgcagaggttgccttgaaatggcggggagcgatctcgcagaggagatcaagcagcagatgtcagaaaccagtattctggattgaaacgcacgtcttgttcaacggcaccaggtcgcgtgtggcgtccggtctgctttgaatcaggtacttcttggttctatgggtaggcgggagtcacttgccaggccagcagcaacagctacaacaacttcaggcggcagccttgggagcagatgggccgagccaaatcgaatctactcggagagagtaagtctgagactgttttacagcgttgtcttggaagacaagttgtcacgggttcttcaagaacagatgtgaagaagatcacgttctgaagacaaagacactttcgctgtatccgggcgttccagcctgtcaacagtccttttcaggtaaacactgtgtggaagcgaatccatttcgagctgcgatgacactaaagacatgcaggcgaacatcgtattgcgttggatatttctgggggacgcgagcttggtgcccgcactactgattcttcttcaggtagacaagggtcgtttgacaccgtattcctgtattgttcacggaacgccatctgcctaatcgttttcgtcaacttgcgtttttcccgtgaacaggagacaaaagcaacctcggcgaggaaagagtagcaaagccacagtcagtcgccgtgaatggatcgagaagaagaaggagagacagcgtcttcaggtacgtctgcattggtgtacaggattggccattcccggtttcatctgttggttgtctctgtggttctgagagcctcgacgtttcgtgcctagggcagtaacgaactactcggtttttgcagaggagaaacgggagcgcgtggcgatcctggtgtggaatggcagagtctcccagggagttctttccgcgggttcatgctccgagaaggaacgcagaggtctactgagcatctccatttctttctacttttctactcagggaaagaaggtccgccaccagagcaagtacacaggaaggaagcggaaagacaagttctaaagagcacggatgccgctccgtttggcgcacttttgaaatttacatttgtttttgcttttcctgcaactctcgaatgatcctgtgtcatttatcgacgacgtggcatgagtctctcgagctcggtttcgtcagactgtgtgatgcttcctggtgtgtctgctcctctgctttcaagctgaattactaattcactgcattttcacggtgatgattgtcggctgacagacgtcagagaaacatcctgcaacggaatgttgctaagctcaggtgcacggatatcgtattgagaaaataatgcccacatccccaccggggcagtgaaattgctctgctgtcactgtttgcttccataatctttctccattcttctgccgaacgacggaggactgcagttagtaaatctagagaagtggagccccacccttcccgcggtctgttggaagggattggcagcgtagtgctctttgcaagtgaggaaaaagtggagtgcatgttttagaggaacagctggggaattcttccagcaatctatggatgtcagaaaaacacgctcaacctacaagaaaaatggtattgagccagtagaaaactcttgagtgcttaccgtgactagtgcaacactattggaggtcacagcgcacgccgccgtagtttggtctaaaatttccctccacccttgcacgcaaatacttgcgttggccaccaaaagtttcagcagcgtgtcgacagcttttttagctcgggctcccagcctagtgattttgacttccagtgccatttccaacatatcagcgtcaaggttataggtctctacagaaatcattcgatggataggcctacacttagatgaccggcacaagtgtcagagcagctctgaagacgatcataagcgctctcagtaaggcttgcaattttcgtttaccctggatgtccgagcgacacttgatgcagcccggaaaactgaagacctcaccggcggacgttgagacactcatagtgtagtcggatctgcgatgcgatgaaaactaacaaacggcagccttacattttgccttaaaaacattctgtttatctcttgaggctgcggtaacgaactctacgtgcgacatgtcctcggaagaactcgtaggcacataactagttgttcggagacggccatgggaactccctcatgaggctatgtaccgcgaatcggccaacctggtttttcgtgatcgttttggtgttgaatcgcttaccactgtgatccgtcatcacggggagtcggttttaatgacgtcagaagacagcctttcttacccaagtcgagctgtccgctgttttaggggctgtacagcaggcggttgataccacgttttttctgcggacgacggaagataactaaaggcaacagtggccaaccgggccgcacgctcccgtcaccacgacgtcgctccctctaaatttttgatagaggccaccacccctccggagctctagtctcgtctctttgcagactctgtctgggtttctggggccggacgttgcctgctgacgacgtaaacaatccctccgtccttaggtggaaggaacgtggggagagtgctggcagagcgtgccggcagcggcgctgccaggtgacacttccacgaaatctgtctttgttagcatagtttggaagaatgctgtgggattggtccacgtttctatccacagca

SEQ ID NO: 2671 - DNA, 4159 bp, Toxoplasma gondii
cctcgcgacttccacgtggagagaaaatggcattcacactgtgacactctaaggactcgcgcatcggtggaagaggtcgacagccaatttcctcatcctctcggatctgcgagagacactgtctccgtgtctcgctccaccttacgcgggccgtgccttcgttttttcctctctcaccctctctgggatagcgaaaggaagagcctgtgaagcattccgagcttctctgtgatttctttgacgtctgcatgtggttgaactgacgagactcgagatccaaacacgcagcgcagcttgcgtctggctctgcatctcgacgtcgagatgcaggtggagaggagcgactccatctacactggcggaaagctgtttgagcaggtgagaagcgcagcgagcgcgaggacgaaggaaagtcctgtgtggaaagctggagacgctttggaaggaacatcgttgacaaaagaacagaaattgctgaagaaagcgaaagagaggagtgcggacgcagagaaaaagcaggtgaaacatcgcgcccacggggtccgcgaattccaggaacctgtttaggatccgtcaagacactgcatggtcagtcggaggtttcatgtcccggaatccgaagcgtggaggatgacaatttctttaaaaccaacgtctttcgttgttccgctcaaaggacgaaagcagaaatgcgggcgagcggcaagctccagcacgaactcgacttccacacctgccaagaattctataaacaggagcctcggtgcggtgtatgtacaccgcaagttcatgagtaaaacaggaaccacgggaaaaggaccgctcgatttgtccatctcacctctgctggtcagcgctctaaattcctccgacgcttcttttctgcagaggactcaggaagtgctgtaccgtatttgaaacgagattcgcagcaatcgctctggaaatgcatgcggcggaagaaaccaattcttcgaaaggttctcctttcccttcatattttcggcattttcctgccgccagccgcctaccatggcgtgtctcctcgctggtgtctctccatcgatatcctggctcgaccaaagacgggcagagactgtgcttcatatttcgacgggcatgcaaggcgggagaacaaaacggcacggcaaaaaaacgagaaaacaacggggcttgcgaaggatcggatcgaagagcaaatttctcgacctgcctcgagtcgacagcattacgctgtagttgcatgcaggtgcatgcaagtcggcgcatcggggaaattcactgacttttgctcatgtgtgtcccgtaaaactgaggatttcgctcttctgttcttgaaatgtgttttttaaaaactaaactgaaaacgaagaggcgtcgccccactgctggagtgccttgacgaagttttgcaagggagttcaaaccctacagctttggtgttctgtaggactttgaaagtaccctaaacaacgcggtcgaatctctcctggacttcttctcgtttccagtggatctgctgtcagaacaatggctgcaccgatctactgcgttagatccttctatccaccactcgaaaaacttcatgacaggggtagacttttaagtcgaaccgcatgaggtttttgtatctcctctggtagatgtaataaagagacagaggcttcagtttcacacagcgcaaatacatgcagatgcgcctctttcactcgagccgtcaaaaggcccagatgactggaaaatcggaataacagtggaaacatgaactgtacacgacgaccttgaggaacaggagagaaccactttcacccgggcacagaagcttcccctttgcttgcgcgttctcactggaaatggtcagcgattttcagacagacgtgcatgcaatcggaaacatgttacaccgccgccgacgtgtggaaccatcgggtagtgggagaagatacaactttcggtggctaattatttccagcgactctagcaacgaaaatagtctatcttctgtcgtccatagagaggatataccagttctttcagcaggggggggggggggggaacgaccacgatagccactaggtcgtgaggatgatacgctcagcgcatgcacaactgctgcatttgtgaaaaacagacgaaaggtctagaggatccagagactcgcctgaagggagtacgcattttcctgttgactgcattgctacgcctctcttgtgtgcgcaagcgaggaatcgggacatctgcatgtgcctgagggaaagaatgtagcctcatactggctgagcagtcactgatgagcagtgtcgttcatttcgatgttctcgttctgaagaattggaagcctcgttaacagccgcttcgttcacaagtttattcctggagttcattcgtcggggagcttttccccaagtgaatgtgcggcgtgggtgagattcgtgtatcattcgagttacttacgcagcacgacttctgtatcgatgttgctctttcggttcggcaaggagggcactgtcaaacgtcctctgtgtctgcaaaaggtgaccgcttacaaggttgctcctgccatccattaaaaagggaaaacggtatctttgtgttgaagcagtgcatgcgacaaacaccctatgtccatccctgaatgatgtcagtgtcagcattaatagcagatatacatacacctggcaccaaaatgtatggacctgcaaatcttatgcctcgaatcttaagatcagcagagagagcaactggcggccagtgcttgaagtgcggaggatggacagatctagagcgcggcatactatgactcaagaggatttcagacatgagttaaagacaccgagctctttatgattggggtgcactacaccccaccccccttcccccccaccccactggaccatttgagacagctacgagaaataacggtactccgtggaatacgtaaagaacataacccactgagtttataccgagacttgaacacttttagccgttccaatttctagagtcacccatctactacacctggacgtacccgatgtgcaacaacggtggtatcgtcaaagacgccagttccagaggagcatgtgaatggactaccgcaaagcagtgcacattgtatctcgggaaatcaagccccagtgtatggaaggaaagagctttcgttgagatttgtataaacgccgaaacgaccaagggtacaggtgctcgcttgcatctagcgggtgaacacggagccgaactctttgcggtcttcgatggtcggagaaacgtggagagttccgccatcgagtgtgtagtctcgtttgccggtacgataatgatattgatgcaacactaacggacgtatcacacgtataaccagtgagtggaaattgcaacgcaccctagatttgtgtacgcgaaaaaaaaaggcaccttcacacgcatatttggccagagaggaccacaactgcagccacattcagtatccatcgactttaaattggcaagttgcttaacgtttttgccgtgtcctcaccagaggtttccgtctgtcatccaaaacactccaactcggtacatgcaagctcgtggcgtgcgaatgaatccgggcctagcacaccgtccagatacttccgctgtttggggatttcctcgacagtttcccgtcccaaccacttactgaatgtccctgtaatacctaagcactcatgaaatcccgtaacctgcatgtttggcggttgtttccagcgaacagcggaagtttttgtcgcacgtttgtagcaaagtcaactgcacacttcctgcaaattgctgcccgcttttctcgcagcgtttttttgtggcatgcgccggcgcatggtctggtgtttttgctcgttcagtagccctgccaacaacgaacttcgcttgactttttccagttgtttcaaagggcaccggacttcgcttccttcagcatgctgctgaatgtgtctttgtggctgcgttctgtctcgccccggtccctttctcactagttcttcctgtgtgtttcgtcgtccgtcggatatggaacccgcgacaacagaagaggaatcgaaatctggccagacgcattttctcatcagagcgccgcatttacctggcttcgggcgaaatgtaacctgtgaacgggattgagcgggttgctttgagtgta

SEQ ID NO: 2672 - DNA, 1803 bp, Toxoplasma gondii
ttcatgagtcgctcgagtttcgggtactcgaggaaccgtttgtcttcctcgcagtctcggatgaagttttgcggccgctctcccacgtccacaaagtgctgcgtgtagtcgttcatgagcctcgcgcggccgcgcacaccgatgttggtgcaggttgcgggatcctccggttcgaggaagccctcgtcgctgcgcccgccagcctggactcttcttccgcctgcatgcgcgcccaccagctccgaaaaggcgccctcgaagaaaggaccgccgtcgacggccggcggcggaggcggcggcggcacaacccggctcgctcccaccatgtccccaggtgtatgtgcacccgcggcgccgggtgcgccgcctgcggccgggcggcggagcgccgcaaacgcgttgcctccggacagcccatcctgatctcccacttggcttgccgccgaccccggcgcatgcagaacgacagggccaggaggcggcggcggggggatgaaggcctcgtcggccgtcgctccgcgaactcgctttctccctgtagggtacgcagttccgccttgagtcatctgaaaggaatggtcgacgccgcggccggagaatccgccacggttgcgacacagccgaggtcccagacccggggcctctcctggaaagccgcccgttgcgcgagagctttctggaggagccggcaggctgctctccatcgcaccagcaagctcagtagactccgacacaggaaacgatgtggacctggagatgcacggaaccgaacttcagtggaggtacaaaaggtctccgtctctgccgatacgcaggtcctttggatatattcgagacgagttgaagggaggtacaaaaggtctccgtctctgtcgatactggaggaccgcaggtgccggagataacttcagctggggaatttagacagccaagttctgtacgactgctgcacttcaccacggatgcgaaccagggtagacacacctgctgcaggatcgatgaacagagaaggagcgacgaaacagggagcagggaagagagaaacagacagttggaggcttattcatcgtttctttggggggacgcgcgacgagatggacgaagagtatggtctacgtttgccgagtagaagaaaaccgagggaaggcctcaaccgccacagaaaaaatcaatgcatgttgtctctccaatgtgagttagagaggcatcgggaagtcgagacaagacagaagagtggtctgaagaagagaaacgagagagggaaaagaaggaaaaggaaggacaaaataacaattaaccgaaaccctgacaggttgcagcatgcatttaccacaaaggccacagacgaagctgaacagccaacggtttgactgcttgattccctcgcagagaagacaggcaattccgagtcaacaagcagttaaaggacgcaaaaagtttccccatgttttcgaatgatgttttccctactctacacgaactgcgagggcgcggacactcctaggagaaaacgagtgcgtgttgagctgtccaatgaaaaagcgaggatctgctgtgcatttctgccagagagacgtcttccacaatcgcttgctctccggtcagaagtgcagaatctctctcgcaagtcctctcgtcaggaacctggtgaccggttgggttctcgcgtaaaccagacccagctggaaaaacgcttttgcatgcgctgaggaactcacacgacacaccgtgcggccgacacggaccagcggagaaggttcaaaagaaacggagaaagcgccgcaacgatcccttctaaaaaca

SEQ ID NO: 2673 - DNA, 1276 bp, Toxoplasma gondii
ccccgcaaccacaatagagatctggaaatcgttgttgctctaaggaggaaaaaggagtaggcaagccaagtttgacggcgaataatatcgagcatcaaatgcagcgtgcaccagttctccgcaagtgcagcctcaaacaaggagtcgactctgacagtgccatgcactcgaaagacgggcttagtgttgcgtgctttgcgtgagggcctcgcgactcgattcacttttacacgacattgactgcccaatgtggcgggcaaaccaggcaccctgcgaagtgtcaaatgctacctcagagaggcgtcttggaagcatgatgattgcaggcggtgtcgggttgatctggaacgctattaacaacaaacaagattaactcgttctccattagtagtttcgctgttttggcagagtctattgtaactggctggaggaagctacaacttgggacgggttggtggagacgaagatgagtggcaaatgtgtcatggtgagcgttgacttatcgcgccagtcatgggacgagaacgatagtccaagctacccagtgtgcacgaactcataatatctcgcaccattcgaatagccccttcccctctttgtcgtaacgaagtggcttgtttttctttgttgtcattactgtcactatgctattcccacaggtcaataccaagttttacatatttactaggtcgctcgagcaaacgtttccttttcattgcagttagcaagagtgatcttttgttgacgcctacgtactgtgcgtcttgccattttctctaatcatttttgaatgaatcatcacatgaggcgttgctggagcgttttctcgggccgaccgtgtccgccggacgatccttgtagcaaggtcattgttccagggagggtgagactccatatgtcatgttttgtcgagcgattatggaactgattcagtatccgttgctgtgcgaggaaaggcatactactgttgccgtaacagacaagaggggggaggttataacaaatggtgttattctcagcgtacgaaatgtccgtttgtcgggtttccacagaatgccgaaaatgtccgtgctggcggacctgttgccgtttcaaaattaaacatgcgatcgtgggaggcatcggcaccagtaccgagtacctcagggagtcacgactgttagcgacctgccggggtagtgtaggtacactggatatctggcaggtgggtttttcgtatccgttgaccatctagaatttcatgttgtaatagatgcgttttcggatgttgcgacaa

SEQ ID NO: 2674 - DNA, 1164 bp, Toxoplasma gondii
aagacaaaagacgttcatcctcctcctttcctccgtcaaactttgctgtcgctactggcgctcctctgaaactcacctccgaccgaaatatccccatgatggcaaacagaagacgaccaagaggacggacgagcgaagaggaaaaaaggcaagagaaagatgcggaggaagaggaagaccaaggggggtcaacaacgggagcaggtcggacgacaagagtgcgaggtcgaggtccacatgggagaacagaagacaaaaaaggaaaaggggagttcaacggaaaacggtggaaaaagggtggagacaaacgactgagatgagaggagagagaaagacaaaatcatccacgtgagagggccgaggatgtgagacagagacagactacatgggcggtgtcaaatgcctcccgttatacgtggatcaaacttcacagggacaaggaagaggatgcggcagcatgcagcatcctggaagagaaaaggagagtcctttgtggtgcgagggaagaagacgaacagggaagaagagacatacgcggcgaagaactgaagatggcatccccagacgccatctctctgagaggtacccgcgaccctggggtgtctgtacacctcccagaagagctacatatctaacgtctctcggtttttacactcgcccattcaactgtggagaggaagaagcgaagttctcggcgcggcgtgtcattcacatctcacattcgctgacatagacaccacagagtctccccgagaccagcggaagagacttgcatgcacaaattcacttaaagtccagattgcaaggcctggacgaggctatctcggtcggtgtgtcgacccagcgtcgccgttttttccgactactctgcagacggcaggaccgggagaagcagagagggcgtcctttccaacttgagaaagagtgcaagacctcggctcccgcgccgccagccggcttcgagacttctctctcgttgtttcgaaagaaaaaagggggattccttggagacaaaagataaaagacctcccggcgcgcagctgctgaggtcacaggcctgcgttttttcgagctctggaagcagtgctttctgtcggcctcgtcctcgccccctgtcttttcgatcgacctcgccggttttcggtgtcgacgaagtgcaaaaaa

SEQ ID NO: 2675 - DNA, 4290 bp, Toxoplasma gondii
gcatcggaatctggtttcggtagatcttcagcggcttagcaaatttatagaacatttcttcgtagtcgtcgtacgtgaagtcgcccttgatcagtttgtacatgaacggctgcagcgatggagtgtcatcggcgagcttcttgaggaacgggaagaactggggaggcacatagtagacgtgtttgatgtgctgagagacctccggggggatttgagcaggcacactgtagccaagcgacacagaagagaagaacaattcacgcagatgaaggacgacagacacgaacggcagacaaggctgctacagacagccgcgcacagaaaagacagaggcaacgggtatacgcttacactcctgaaacagaacgaaaggcaccaacgatctgcaacctcgactgttcttctctgcacccgcgtttaacaaagacagtcgccctgagtcgtctacagattcgcgtttcgtcttcttgtcttaaacttgaacctctacgtctaccagtacggaaggtgagcctgtgctcgcactcctggccacactgtctgtcgcccactctgaccttactcgttagaacagtcccctgggttccacacggcttcctttcgcagaccgaacccctaacatcgactggtacagagactttaccgcatggtccgctaaaagcaggcattaagaacacaacggtcacaccgagaccgtcgactgttgtgtcagcaccccattatctaactatggatcttgtctctgtacacgtgtggctcccatagttttggtgaacgcatctcaaacacagcacaagaaacaatatcctcgaaacacgttgaaacccgactctctctttggcgtacccgaagccgtctctcgggataacctggtgttcgtcttcccaaaccggctgccaggtaggtcggtcccactgcataacaaagagcatgggagaaccggcgccacttccacgcgcgtagagtccctctcctccaacggggatgttcaaagtgtctttcgcgccacgagtgagctctgggggatactcatcgtggccgccgctcatgccacgcgtctgctgagaaagggcactgacgcctggacccgcggtgatgcgccgggagtacaaaggagtggagagcggcgccaaaggcgacgaaaaagagaagaaccgacgagaagctgcagtcggcaagccggcgaaagacaacgtagaccggctgaagagaggtgctgtggctgcgccgactggccgcatgccggcgaaaggcaggaacaactgacgggctgtggtcgccattttcaacaacgggtgctcagtccagtatggaagtcgaggaaaaaatgaccatatctgctttcggcgtcctaaccgataataaaggccccggaagaccggatttccacgcgggtaatagggaacgcaggaacacgccgggttgtcggtccggagctgcggcaggcggtaacgcagtgtgtggccccgtccacagaaaagggagaaacgcccacgacaaagaagtaaaaattcgggggtttgcccgacaaatcgcgaaaaagcgagaattccacactcggaacacgggcgaggttgcagaagaaataccctggcgtgtagggcaagcctccttcgctgcctcaccgggaatcgcaaatccccatcaaatgcttgacagagagagtgagtaggcacacttgatcgtacgtgtgcgttttcaacggggagaacacagagggagcaaaaagcaagtccagcccgtgatccggaaggcgcgaaacgcccgggcgagagattgccagacaaagcaggacccaactcttcgaatatacagcgcaccagccaccaggtattcgaatgccccgataactggcgttttctgtgaattcactcgtgtccacgctcccccgtagcttttaatgtacacttctgaccttcttgtgcaaacgtccaacgtggaaacacgatcttagccgaaaagggggaactcaaatgccacgtttaatgcacggaggtcaacactcaagcagcttcttcaacgacactgctgacaatctcctgaatatatcagtgtggtctctaaaatgtaacgatgtactcgggtgttcgcttgtcgacttggatcttccaaacttttggaatcgactttcttgcaagaaacaacctggaccggcgtctgtgccaaatttgtagatatccagggtgagacactccgagttggttgttcacttcatacattcagtatcagctgaccaccccacccgggatgtatccatcttcgtcacagttatgagtttaggttaaccacagtcttgagtatgtatgcaacttctacgacagaaacaccacttggctcccccaaaggttacccagcgccaccaaagcgacctaactcacaaggagaggctcctccggtgtaaggctctctacctgaaacaacagggaccttcagcgtacagatgtcatatatatatatatatatatgtatatggtgtttacatgcaagtacataatagtccactttgacggatcggaaccagatgcacatgaggcagtgtccagattccgcaggcgtcatcaacgccacattgtcggatgaactttgctagctgaaatatcgggactttacgtcgtcccttgcttgccgcggcttgcatgcatcgtggtcctgacctcagcatagaaaaccattttcaaagctgctgccgatatacagtaatctgttatgtgcccgtatgcattgagacagcttttacatttttatcatgccccaccgtgtgcacggtggcaccgagagattacacagaagtgagaagcggcctggcagatttcaaagttcctcaacaaggtctgaaatgtacgtagagatagggacagcgtggcaacaaatggtaactctgcagaggcaatgaccacacttagcctctaacgatatgaggtgcatttctctcttaccacttcaatgacatagtgatccgaatccttctgatgccactcgcctctttctgtggctgagggagcccgggcaagagttctttgcgtcgtttctggtcgtacgtgctgactgaagtgcaaatcttcagtttcagaagggcgaatgtgcagtggcgtaccaccgtttattcctatagcaggataagtgtgcattcgccagaccgcagctaacatggataagcggtcaggtggatggtggtgaacactcagagagatttaagaagaaacaccgggcccacaacttggagagcgttttgatgctctgaatgccacgtattgaagttgcagtacgcagaggcccgcagtggtacgagttcttcagagagtcatcgtgagcgagcaatgatatgtatgagctttttcgtggttgcttagccacaaccctggtggagaatattagtacacagtacttcgagtcgctacgatcctgcagcgttcccccttgtttgtaacaatgagggtaacgctgcgaagctacgagtaactagctgcatgcattgcgagcgagctaaaaatcgacgcaagcgatccctctcaaaacggggtgtgccgcgcgtctcaaccgaagcagggaaacccggtttctctgttgccatttgtttagcgttgttccccgcgtcttagttgtcgactctccaggattgactacttctgaggcaggaagtttacaggcgttctctagtaaatgctacgaattgggcgaggggtgtagatcttgacgcaggtaagcgagtgcggcggtatggaaccggaggaggaaaacagctttcgttattttggcaacatagaactgtgtgttccttgagttctgatgatcggctcatctgcgaggctcctgacattttccgaaagtgaaggtgaatgcgcgctgccgatcctgtccgcgctgacggatggaccggtgtcgcagagaaactagcgaggcgtcattggcggggctcacaggcattttgccgttttgcccaagatgccagcagagtggattttgtagactgtgcagaggagagccaggggtgcgttttattcaaaagacacggaattattgctatagttctaaacatttgctagcagctacgttttctactgagagaagtgtcaggcgtggttgccgacgacgcggggttctggcacgcgcggcatcaatttcgaatggaactaccgttctcgtgagcgtacaccaattttcccgacagcatatcctccacccgaagatgcccagtgcagtctttcggaaaagttaagggaaggtcgggactgtcttcttgccaacgtgctcactaaggtggtacgtttcctgcgcttccctcagacaaaa

SEQ ID NO: 2676 - DNA, 4805 bp, Toxoplasma gondii
agattgggctgttccaagtctcagcttctttctttaccatccgagtcgcgctttcgaaaagtctttctccaagtctcttttccccggatttcccgttttctggacagacttcttctgtccgtttcctccaagacgaaaagagaggagtgatctccctctccgccctgctcgctcttcctttgtggaccaaaagccgcgttcgttcagcgagtgaggctagaggcatgagctgaaaagcgattcgtccggccttctcggctttcgagtgatctctcttccaagttagatcgccagcgaggcaaacgaactcttcctccatgacgttttgtcattcctgccacgagaaaggagagttttcatgtcgtccgggaatcctcgagcatcttcagtagtcttcagtagtcgcttttcttcgttctgaacagagatcaagacttgccttattcctgccctttctttttctttacctcactgaaactcttcattgtttttctgccgcatttcttcttctcccccaaccgcagctggtctgcctgtgcagccctgtctccgttttacgttcggttttcctcctcagtgcctttcttcttctcccttccttctgagacttttcactggagttcttgttctcctcggtgcgctctgggcgagagacaaaagcgaagaacactgttcatctcgaccagtgtccagacggagaaggttgaccaggcaggaaaagcagcaccgttgagaagggcagaaagaggggagagaagaactcggacggtcgactggaggacagagtgaggagaaagaagagaaataaggaagacgcgcagactggcgtaacgcctgcttctgcggtctgcgcctcctcgacttctcagtttaagtttcgcattcttcgctcgcagcttgtggcgtgagaggcaggagagtgtagcgtgatgtttttggtgacatgagacggggagctggagcggatatcgaggaggagaaaggaaagagagaagagaagctgagagtaatccaagaaaggagagaccggacgcgctgagtgaggagcagagacaagcgcgaccgccagggtcaaccggaagagaaggcgacagaacggcgcaagaagagaggggaaggtggaaaggaaatcgtggaagcgagcgaagagaggtacggagttcgagtgtaggaaagctccggaaactcaccggacgccaggaaggcaagagttaatctgtgtggaactcggggcgcggtgacaggatgagataggcgaacggtaaaatttcttttgtcttgttttcagaaacgacacagaatgcgcgagtgctgggagcccacgagggtcgggaacctcgagagttaacggagaatggagacttttcgcgcgttccttgacggagagaatccgcgttttttatggaaaaagaagaggggaaatcgaggcaaaaactgcaggcgtttgagtctctcccgcgccccgtgacgcgcccgacaagcgatccgtgaaaagccgccagataaccgcgccgcgccgcagcgcctgtactacaccttgacaagacaagacgacggctacagctcgaaaagcagttcctcgcagagcagaacggcaggagcagaacggagagaagaagagaagagcgacagagaaaaggaaagagagaagaagaaagcgagaagagagaagaagaaaacgagaagagagaggagggtctccaggtgtctctctgttgcatttgtttcctgaggaaacggcagaatggcattagaggctctctttctctttttgtagatgagaggcattctgctccatcttgcttccttccttgtcacagcaattcgtgaataaacagaagagcaagaagaacaagtcgcatggtgtttctttcggaaaggcttcagagcctggggaactgaagagagaacgagagactccgacgacggagactgttttcttccactttcatcgctgttcacaagaaaaaagcgcttgaaatcgtgcgaattcaagagtaattgggggttcaaagacaaagaggagaccgctcgcggcgtctccctgtttgccagttgtgcctcatctacgccagcctcaaggtttcttcggcaacatccgaaactgctgaatctcaaaattcacttacaacgacgcttctcactcgctctcattgtccgagggaaatctctggatctctttttcatcgcgaggagtagccgtcagagggacaaggacgacgtctacacccatacgatgagcaggagtccgtatgcgcatctacaacggccagaaaaaagtacgacgtctctactctgagtgtcattctcgcgtctccgtcccccattacgtccatccctcactacgttttctggaactcttctcacggaaacgctcgacagttaggaagcgttcgcgaggcgaaaagatctcctcaattacagtaaacgtgtggcttggaaacggagacaccttgcagaattccttcgattggtgagagccaactggatgcatgtacagctgtttgcttgagtacaatgttcacagttgcacttccgaaaaaagagtatattttccacaaaaccagcgagacgccagttttccctcaagccgaacggcaggaaggagtctaccggccagggaatttcggagggaaaaagttaggttgtgtaaaagctgttcgacttgaatcaattaaaccttgtgtggtcatgttagagcgttgctttttcacgaacgttttgactctcggggagtaaagacgagagaagcagcttcatcaagaatatgcaatttgacttgtgtaggaaagggtgttcagcgacttctgcagatccgaaattcggcttctcaaacctaaaggagggaacgtggaactgcagcggagaaacgcacgagcgatgagccaaactaaactggaaatatcaaggaagtaccgaggagaacgaacggaagaacagagaagaggaacgctttccgtgtctttcgtgaaggtgggggaaagcggacaatccagttgattctttccaatctctcccggagtttttatctacagagagttctcgcgcgcgtcgtcgcacccgcgagactccaaagagaggcgctcgactcgacttgcttcctcatgaggcaggccgacctcgatttctgtgttctcgacaaacctgaaccagacctctatacaccgcagaagggaagaagagcatctatccaaagtccccccctcccttccaacaatcccatcccaagcgaaagacatctgtgatctagagaatacacgcgaaaaaagagcccagaccggtttgactcgtctttctgccggtcggcttctgcggtatagatacacacctaagcgagactgggagaaacgcattcaccaaagagagctcagggggcctaccctagctgtcgcatcgcttttttgctacaaggcggctgacctccgtcttcctgcagttttcctgcgtcttctcagagtcctcctttgacctgtgaaagagtctcgtttcgcgcgacctcgatcttccggtgtttctgtccacctgagcatccgcccgcgacaagagtgcacagagctcgctcctctcgaagtcgcgtcctctctctcaccaggtttttctgcattttgagagggtgaatgccctcgcgtggtggacgcctcttctccgacacagtctctctctggtgactttgttgtttcctttcgcaaaaaaggactcgcaactttgccgccgcagcgatgcgtccaagaaaaagcttggcagatgtgcgtcagcggggcctgagtgtgagcacactgaggaggtccgtcccccaagcaggcagcggagtagagagggggatttatctacgaatattctttttagtggactgctacgactgcagatatccacgcggaaacgtcaggaaggccgggatcgttctttccgcgggtctttcgcctggatttttgtctcgagaaacaccgccgcgcggtgccgcagcttttcgcggcagcacacctcaaaacagagagaaaagtgaagagaacgagcgagaacaaagtgaaatgcatccgccctccacgcctctctcggctgaacaattctcacccgcagaaatgtcactttcttaggagaaaggcagaactaccgacgtcgtgcgagattgctccaggtgtcttggctagcacacaggagcaagagacagaaagatcgctctcgcgagcgtccccgggagaggcgcagttctctgtcaacgagttccagttctcccagcgtacctggaagaaagtataaaaaagaaaccggagttcgttcatccttcgtactttctgttgtcaatccaggaacaacggaaaggaacatggcaggacgcgccttcactgtagattgtacacggaaaagcagctgatatagaagagccagggagaaaggatggaagaggagaaaaagaagaactgagaagaagtccgacggagagaatgcgcgaatagacgagaaagataaaaaacgtatcagtggggtccaggaatctctgaggaggtatggatcatctacatgtccttcttcctctagcatgcgtttttgacgatgagaaagtttgcaacaaaagcattccagcactcttcttctttccctgcttcttcttccttctttttctccgtttcttctgctacctcttctccccttcctctgtccactgcatgatctcctttctcttccttcagtctccgtctgccttctcttcttcggctctgcttccatttgtgccttctttgccctgaggacgcggcagtctccacagtctcctgctgcccgtcgcttcgttaaagacagagcgccga

SEQ ID NO: 2677 - DNA, 1749 bp, Toxoplasma gondii
caccgccactcacagtaaatgttcatagacatacagttatctttccctgtggagtctgagcttccgagccccttttttggggagacctcgccgtaattgttttcggtagagtcgcgtttccctgtaggtcttccacgttctcttctccttgtgcatttcgacaaaaggtattttcttcagacgcattaacttcttcttgtactttttcttatggaatttacgcatcttgaaatatcgtcgccggcacgtgctgatactgcggacaaaggcctcagcgacaggctgattcggcagcacggaaaaaacaccagggcaacggctcaagagaacgatgtgcgtcagcgatgggagagtgccttgatcttgcaaatgcaagccccgctcttcgcctttggagcggcagcttgtacaacagcgtgcacgtgacaaatctgctgacgccgctcggcctcggcaccgtacattcacatgacgtagatgtgctaacggaagagttactgccctttcaccagccgacatgggatctgacaggccagcctgtacagagtgctgacgccaaccttgcatcagcctttcagctcctctgatcgcgcaagggccagttccagctgggcgctgtgacagggaagtcacaccaccgctcctaaaactttgtgtggcgtgccaccgcctacacgggagaatacgaaattttgcaaggagcacatcggttctctccagacagctcggaagtggagcattcgcacgtggtgcgatgcctctgggcaacgagcataaggacgccatttctgcccctgcccaggtgggaactttacaaaaaactgccattctagcgacgtcactccggtcggtccctgaactcttccgcgaacttcacctgtttggatgcagctgcatgcgcacaccaggtcagcgccttcttttcagtctgaagctccgaaaaattactcctgcattggcaacgtcatcgatgaaaccttgtcgtgcacatctttgtggagcgttcctggggtgaagacgcgttacggaccggaggctacaccagtaacaactgaagtcgcttcagatcgaagtccacgaaatacacgggagaggtgacggaaggttgccgtcgaagagtttctgtcagaagcggatatcccgcaagacactgtcacgaaaagcgtacgctcgccacgctgaaaaaaaaatgtcgtggcggagacatcaggcagcacgaccggaaaatgatgcacatagatggagtagcacagagcacattgtgaagcaagtatgatgccctgaaaaacgaagtccttttctccattttccactggagggtcgctgcggtgacgtatttctctcttgacccgcatctgcagtggagaaaaatggcttcgttcttactctgcatgccctggctgatgtgtgcctctgggactgcatgcagcaatcaagaccctgaggtaggctcactggctactaggcttatcgtacgacttctgttcttgacgttcttcgaatgcctcacaagacgagccgtacaaaggcattcaaacgcgaataaaaccatgcttgcgcgcacactgctgtgcaaaagtcacctccggcaaaaataaaagactacagaggttcggagcctggtgtacatacagacggagccacagttcttcaagctccttgacacattatgttctgcacgttgtagtggcatcttctttcacctctctcacctagctgttgtttcgctccaagtgtttttctagacaa

SEQ ID NO: 2678 - DNA, 2332 bp, Toxoplasma gondii
gttgcgagacagagcgacacacagaagacgaaaaacagagagaaggacagcgaagcaggaaggaccagagcagaaggcgagcaacgccgcagtaagaaagagagaaaagccaaggtgcaaggaaaagcagaaaaaacgggagaaactcacagcttcaactcgagcggcgcctgcggctgcatagtcttgcttttttgtcggaggggacgaggaagaagaaggccctgcgtcctccgcaggccttgcagaggagccactgcggggcggagcctctgaggcaggtccaggcatcttctgtctgcaaggctttcgaacacagaaaactggaaaaaacgtagaagaaggaggtcgacgagaacagcgagggcgggaggcactttgcctgacagaagaggttgcacggaaaagagatgcagaatcgagaggggcaagagacgaggtagtcgcatctaacagctgctgagtcaacgcgggaggaagtcgcgaaaaagggaggcgagaaaggagactgagaggaaacaactgcacactcgtagagagcctcacatgcttctgactacgcggagttttttctgcagagcaagaggccaagatccacgttgctcgatgttaacgaaccatggcatctactcgtagccgtcactgaagacgcagatgtacctcagtacgtatgtgagtagataggtagttttggatggagctacgatggacagacgcatggagaaggacagacagaggaagccagcgagtctgggaggagaaaaggcgtgagtgggcggtagaggtcggagttcctcagcaaaggccgagtcgcaggcagtttcttcttcaagagcggagcaagaacctcgagttgttctcctcctcgaccagcggcttcggagattccgccgctctctgcttcggcgctgttgaactcagtttgaagaagcgagaaggcgtgatcgaagaagagagcattgttcttattggcaagtctgggcaaagcgtcaagaccgtcgcggtcatacaggcaatgagtacgcgttgtcgctaccccactctcttttgtcgacgagacctcactcagctagttattgagagagacactcacgcgcgctcaaactattggatttcaatatcttaccggtattcatgtttgcttggaagctgtagtcattaacaatgttgttggtgtagtataggcacatgatagacatttagcatctgtcacgaacatatgaggataaaaaaaggcaactttaagcgccccgaaataaatagatcggattcttgttgacctggcacctgtttagtaactggatgaacgctttttacgcctggtatgtagggatactactcggcgagacaccaaaaacatcgtttcgtttctcacgccctccgcgcgcatgcaggagagaaaaagctttcgacgaagaagagcttctcccccacaaggatctccaggggaaaagggagagaagaaaaagctcaagacctcctcaggaaggacgacttcgcgcttttcgtccagaaattgtcgttttcatctccggggaaaaacaagaaacgcgtttccagctgcgaccctcggccacacgccctgcctgacggccgcccctgctttgactgctcgtcgacttgccgtttctcgcgagtgttttctccccggctctctctcgactttttttcgaacgtcttttctgctcgaagaacttccacaaacgagccgccggctgttctcttctccgctgcgtgcgtgggcggtcgaagctgagcaaggcagtcgccagatttcgcgaaggagttcaacgaaaccggggaagaacgagagcgagaggaagaagcaaggcaagcggcaagtgccgggggtgagccgccctcctcttgccacggttctgggagtctgcagagagcgcaggcgtccctactggggaaaaatcggatttcagcgccgcatgtcgaaacaggtatcttttcggtagaactcgcgagggtctgaaaggtgaagaggaatgtttctgacgacctctcctcattgtctcctcccagcgggatcttcttcatcttctcacagagcgtatgtctgccatgccgagacgcttctctccggttcttcaatggccgtgactcgctcgtccttccccgagacatcagccctgccctcaagtctcttcttcttgtcgaaactcgagtttctttctcggaatccggcgtcgagcagacactacgcgcggctcttctctccgcagagctcgctggccctctggagctctcgaccttcttcggggaaatcccggcaccggaccgttctcgaagtcgcctcttcagtctgaaccgaggtctctcagca

SEQ ID NO: 2679 - DNA, 3238 bp, Toxoplasma gondii
gttgcctttttagggcttgactggatcaaagagaagagatgtgtgcctgttgtacctaccgttttttctattcggagagtgccttctacggggcttagcgcgcctgcgttttctctttccgcgacctctgcgcttaacgtttccccggttctgggggcgacggcgacgaccacctacgaaattcaagcagcagtgcggggggtactttgaacaagaaattaatgcagttttccagaccccaagccgaccgcgtggagcaaaacttgggcggggtctcagtcgatggaaagagtttgaatatttggttggaaatgggtttacgttctcgccttgtcatacttggagacttgagcagacaaaccactttgaagacatggtgatacatgaatacagaactaagcaggcttctggttcatataatttcgttattctttgatctgcttctgtgcagtttctggaaggcaggcaagtgtagagtcgcttccaaaatgttgactaccacacgatgttgttggtcgtcaaaatgccacacgataaggaaggatcatgatgtagttgtgatttcatgagagggcgcagcaaacagaaaatcacgattccggatacgcggcagcggacgcttcctcacactacaaagttcattgtcatgttcaagattgatgcttgccgcaagcttttggtggctcccactgacacgacgaacctatctgaaaggagtatggaagttagaaatctcaccaagtgtcgtctggacgaaagagccaggaaatttggcgtccaagagagccaacccactccacgtatgaagcgttgttgactgttgttgtgtcgaaggggcccgtggtctttttgaagcggtctgagcattctcgggagtgaatgcgccgcgtatcccggctagaggttgctggttaatttcggccgactgtggtgcctgcattgcaaccgagatgtgaaggtgcgctttcacgacggcgaggaaaagcaggaaacaagctgtaccggtcagacgaaggtaggcagaccgcccctgtacggaggccgcctgccccggcggcttgttcctcctcattccgcgtgcatgtgtgacaggaaacaaaccccttttgagggaatcctggaagttttggtcatttacatacttcgagccgtggctgcatgcggcgtggcagacacggctgccggcatgtcacaacctgccttgcattcgcttccatgtgccagaaatatggacatagacaaacttcagtacgcatgagtggaatgggatgtcatcagtcaaaactgttaatacgcagtttgcccattttcaaacgggtccgccacccggcgcagatcttggctcgagccagcccgcggatgtcttcggatcccggtggcaagacaaccagtgaagaaacaccaccgaaaatcgagagaacgaaaaacactgctatgtggataaccgaaacgacgagtgcccaccctcatttagtttccaattatcatcataacgtggacttttgagcgcgaggtatcctaccagcggatcacaattgacttggcgcggacgagcgagaagtgcaacgtcccgtgccaatgcacccggccccctcaaaaaggcgcgagcgcgtcgtctccggtacgggccctaaaagtttgccataagagacgctgcaaagaaatacgatctcttgacgaactccccacgtgtccacttcaaattatgattgtaatgtgcttcgttaacgggcagatttcggcactgacagtagtagcatcgatgctggatcttcggtcgaaagtacaccactctttttaccaaaggagttctcgattcctccagtgtagataaaggaaagcgtggcgatgaccacgattgtccggtagcagccaagctggtggcgccctgtgttggttgtttctttggcgtttatgcgtcatttgttttcgcagccagatgattccttccatttcacacagagttagtcttagggcggtcttttccagaggaaggtgcgctccgtcaccgcgttaccgtgtagactgacaagccaacaaaagcaccgtgagcaaatgtgtgagccatctcatccttctgatcaagacacctcttcatgatctttccaagcgtgaggtgatgccccagcaatcagcatcatgagttacctcgcctatgtgccaccaggttcgtgctgccgcctggaaacagcaccagtaattcgatggtgaaggtcgctgctgcagacgtgtttaaacagcgtgaggtgaagctgctgtacactgcagtgaaaatgctccttgaacaacaaaagcgcatgtggaccgaatccaaagtgtgttgtcggcgagctggttcgtccgttacccaacaccagccgcctggcacattttactgtcaaaaaatggcaaacccaggcggcgaagagcttcgtatgacttcacggctgaagagttgttgttctctgctctccttcctcttgccgaagcaacgttatgcacaagcgagctcaacgatatcccgcttattaggaacatttcacaatcaagctagcgtacgaataagccctttttatcagcattgagactgcctgtgcgttgtgcagaggtatccatggtcacgcactttctgcttgattcttcgtggatgcgaaggaacgagaatgcgacgaaagcacgtccgtagaaataactatgttcactggtgactgcgcaacacaaaagcaatctgtagaactgttccatttgtctgttggtcggctggctgctacattggagttcctgtgtcgcttccagaacggcccgtagcctctacatcagccgtgactcccttcctagcggagacgcgggcgttctgggaaacccaaagttcctcgataactgtcgttaccaccatgccgacagcttcgttcacgcatctccgtccaccatgaaatggacgcttctggcgtggggcttgactgcatgcactcatcaaacgttcgggctgcgacgcatctctctgttcgcatgttttgttgtcaccgactcggctgtgatagcttgcccagtcttcgaaatacacacaggcaagccaatggagctcatttcccattgtttgggttgttcgtgaggaaaagacccttgacaccacgacatccacacacgcagtctcacccaaatacctgtcataagctgtgaaagcgagctatgctcagtcgtgtttttcggtaaggctacgacagggtcaaggacaccgctgtcaatgctgtggaacgaa

SEQ ID NO: 2680 - DNA, 3225 bp, Toxoplasma gondii
gtcatgtatgcgtcgcgactcggcaccggagagaagacaaaaaggaggcaaacggcttcacgcgagggtgtcgagcacgaaaatgcacaagagttggggagaacgcgtgacgaggagactgaccgcagttctgtcttcttgctgccaccgccgcagtcgacagacgagcctcttccggtctgggttcaggcgtctcggtacgcagcgtttctgcccatcacaacgagcacaaactttcctcgtttcgaggggacggaatgcagaggaaattcggacagagaggaagcagagagtgtggaaaacagtggagagtacagccagagacgctcgacagttggtggcgctctccatctgtgggtggggggcgctctcgtcaccaagggggatctcagagctcataacggcgtggttcacatgatcgacaagccactgattcctgtgcagctattagcgtccccgagatagaacggttacacacaacgcatcatggtatagccagatgtagtcgagaaagcagggttgaactgtttgagacgtgtctgcgcccaaggcgaacaagagcactggactggatagaacccaggcaactgttagacgtcagtgcgtgtcgtgccagtggcagagaggagacctctaaattctttgctcgcaggagtttcttgaaagttctgcacatttcgcgggagaaaaccacgcgttcgatgcatgcgatcaataatgctgttgcggctttcggtggcaaccggtaaaaggcacacactaagaaacgcaatatagaaggcgttacaaagtcatgtttgcgtcgggatcccctcatccaacgccagacgcggtactgtttctcgcacagttgggagagctccacttttccgcgagtctggtaaaaaggcgcaagactctaaacgcagttgaaaagaaagagagatgtgtaagcggcttttgttcttgggtggaggaaatatgccaagaaaagaaacaactttgtatgctgacgaaacagaaaacgacgtcatcagatcgtacagtctgatcgatatttgcagttttgaaaggcgaagcggtgggagatcccacttactaatcatatgcacgtgcagtgaaggcgccctaattttttatcggtgtgcccgaaacagaaattccttgaattccggttccgtagttgccactcgaacgtttcgacctacttcagaaacgtcttctgcatttgctaggagaccgcgttatttggtcggaaaacgattttggagcgacgcatatagactggtaccgagaaggtaccatatcctccgtaagaagccgtcattaagaacaggaacaccacagttagaccatgtgtggtaattcccacatttcacataggtagtgattctatagaattaatacgtttctcaaatattcgatggataccacaacaatttgcttgctctagacatgatggtcatctgccttgcgatcgttgctgagagctacggcctacccctcacggttttcacgttcagaagaaagcaaaagaagttagcgcaacagtctctttcggcctggttctattttttatgattgcaaggcccccgctaacgtcaaaggcaaaactgccccagtcgaggttcaggtgcggcttaagatgctacagctccaataagctgaaccgaatcgttccaattcactctggggttttgagacagccacgagttcagatcctaccttccgaagaaagcagcgaggtgagctcaacttcacgcaagagtctgaagggaatctgtgttttacatccgcatgtttctttgcattttcaccgtctcgcgtgtcactttcacacttgcgcgtcaaaacgcggtgctagcaacttgccacaccccactgtcagctcggctgttcccaggtgaaactgggcacgtcgcctgccgcgctcgggtgcccgcaactcgtccattcgcgaatgtctcttttctcgagaagaaaatcgggagaaggcaaccagagtctcggagcgctgcatttgaagtgggaaacaacgtggagtgcaatttgtgtctgttcttgctctggagttcagtttaaagtgcctatggctggcagcgccgccgctgcgaaatcctctggcttgtaccggcagatggccggtaacagcctgactttctagggtagaaaataccgaaaatcgcagaatttggaagtgtgacgattctaaagattctcagaagttgttagttcctggcaccgcgcccgagtgctgcacattttactcctcgttggctggcggcctctcctcccatgtaaccgctcgacacctttgtcttcttgtggcgcgtcacgttcctgaacaagacacgcaccaagcaaaagtatcgacaggcatatctatagagtcaggtgggcaaattttccggggaagttctgtcatggtcctgcttcaaaagggagcgcgcgttcttcaacaattcgcacacgccggtctgccgaccgtctgttgaccctggaatgaatctgttgcaagtggtccgtctggcggttggccctgatgcggacgggggtttccacagcaaatgcattacaactgtcgcattttttcaagtcaggaaccctttctggtggggtggtttgcacacgtattttccatgcggcagaaaaagccgtgttgcgcgccgtttgcccaacccgccgtaagaagaaaacggattctcagcacgtcagccctcatacgttggagaacggcaaggtcacaagattaataactttgcagaggttcagctgaggtccagctgagaggaaatgcgtctgtaagggttggcagaggatttgggtcgtctaacaggcggtgaaaatcgattcggagccacgcggtaaaaagagccacgcgtactcttacgacggcaaaaagtatcgaacccgtgatagcggtgcggtggggttcgagagccatgatcttcgcgaatcgtttttgtggcgaaagatgtcgggaaatcctggacgctttgtctcttaccatgaagcagttgcttcagcgcagttacttgtgcaagaataggcagttgccaagctttacctgtcagtagtcgtagaaggaagcgttccggaaggacgttgacgtgaagaaccttttcggcgccctgcacatgtgcagagtcgccgacgcacttctttgaagagagagtgtggcgtgacagggagaatccatcaagccattgctggtacccttctgtgtcgtttctctcgtttgtacaa

SEQ ID NO: 2681 - DNA, 2004 bp, Toxoplasma gondii
acatgcggattagtggaggtacgcatgtgtgttatgtcatgccacatttatgtttgtatgtatgtatctatgtatgtatgtatgtttatgtttgtatgtatgtatctatgtatgtatgtatgttgatgtacgtaggcatgcctgtttgtatgtatgtatgtatgtatgcatgttgatgtacgtaggcatgcctgttcctgtttgtatgtatgtatgtatgcatgcatgttgatgtacgtaggcatgcctgtttgtatgtatgtatgtatgttgatgtacgtaggcatgcctgtttgtatgtatgtatgttgatgtacgtaggcatgcctgtttgtatgtatgcacgtatgtatgtatgtatgcatgcatgttgatgtacgtaggcatgcctgtatgtatgtatgtatgtaagttgaagtacgtaggcatgcctgtttgtatgtatgtatgtaagttgaagtacgtaggcatgcctgtttgtatgtatgtatgtaagttgatgtacgtaggcatgcctgtttgtatgtatgcatgttgatgtacgtaggcatgcctgtttgtatgtatgtatgttgatgtacgtatgcatgcctgtttgtatgtatgtatgttgaagtacgtaggcatgcctgtttgtatgtatgtatgttgatgtacgtaggcatgcctgtttgtatgtatgtatgtatgttgaagtacgcaggcatgcgtgttttgtgtgggaaagaggaaaggtgaagaagcgtagtggacctacactgtaacagtcggaggagcagtaaagcgtgtggcacttcgggcatgtgtacttggaggcggctcggtggcacctgaaaaggcgagactcacaagcaaagaggtccacaaaaaacgcgccaaacgcgagagacctccgcgccgggaaagacaacggagaggtgtctgtggctgatcaacaaatcgccctttgctattgtttccatcgcacagaaagtgcaggcttggccgaacgagtgactctcagccatctctgctaataaggagctacaaaacgaaaccccagcgcctctctctgaaatgtctgaggtagaaaactcgagacaaaagaaaccaggagtttgctcacagggccacaagcgcgacttcacacgagaaacttacacttggcaggtggcaccgctgctccttgcggatgcggctgagatgccgatagaaagttcgtcgtccatggccttttattatccgaaccttagaatccactatttggtctccacggcagaagagaaacacggacggatgctgaagagatccacacgacgcagacgagcgccagtggacaatctttgaggcagacaccgctgagttgctggcgcaattcaagggaaactaacgagaagatggttactgcaaaaaacgcactttttggacaactgctcagaccgcggaaataaaaccttttgccaagaagttttggagcctccaaattttgagaagtatctttggaccagaaccggcaacatgcagtctcaaccaagcacaccaaacatttgttccctccagtcgtctctgggtgacagaactcccgcaagtggtggcaaatgggcagcgccgctgctcaagagaccgctgtctgtaggaaacagacattgttttcgcaactggaatttgttaatggcttgacgcttctctgtgctttgacagcgtgcatgtccagtcggcactggtcgatacacagctggtttctcgaccctgcaattccgagtttcgccgccttcttgacatgctagacacaatgttgatggagaagaaggcgactttttctcgaaacttgagctcgaaggatctccgcaatgttttatcttccatcgctgcactcgctttcaactggactccaccgctgttctccgagtcacacgaaagtccaccttttctcgagttgagccggcttttcgcattccggcagcgctcgtcgatgcagcggcgaaaaagccgttgagagttcgtggttttggtttgaggatgtca

SEQ ID NO: 2682 - DNA, 1888 bp, Toxoplasma gondii
aggatactgacgataagaaatgactacataagagatgcagtgcatgttttgctatgaggcgtcagctggttcgaggttgctggctaacccttcagcggtcgggagcgagacggcttcagtcacaaggggtttctgctgtggactcatagttcagataattacggtggcagttgcatgagttaatcgaaggcaagctggctcggacggcaatgactaacgcatcatgccttctgggtgaggcgaacatctgaaacagtgaccgaacatcacgcaagcaccccccttagtacctggtggtgggaattgcacacaaaataccggcagaatgtgcagcaacaagagcttgtcccggtcctaatgaagtttgcttttgtgtgtgaatgtcagcgtttgttagcatattttccaccaatgggttttgagagcatacgcgccacggaagacgtctatgtgtgagctagtttgcgaacaatagtgttgcaagcctcacaagaacgcattgagcaaccctgccacaaacgaaacgactccgtacgtccttggaggagcgaaaaccacgggatctctgctgaaggttgccgttattgaggtttcaaccccatgtttcctctcaggatggagcatgcagtttgcttatttgaggagccagtgactgataacctgactgaaaccaggcccccgacacttgtcactggagttttcgcgtgttcttccaacaaacgactgcccatattcgcaagtagaggaacaacgttcaggcccacaacgggaagaatttgccacatcccaaacggcacctgtatcgacacgaaacttctcaacgcaggactattcctttgtttccgtttttctggagggcgaagcccgctatgcctgtccttttagaatcttgcacgtaatcccatgttttttgagggaactggttctagatagttcttagcagcagagaattttggtcaccgaagaaacaatttaccatctaagagggtcccgaggctgcatcaacatcgggcttccgtagagaggctggcaacgtgatacaactgttctaaattggttgtctctacagaactataacccgcaatgaaagaaggaataaccactttagtgttttctgtattctcttcaaatctctgttcgtctgatccgacaaccgttggccccgcctctgccttgcgaggggccctcagtgtcctgcatgcaacccgcagcctcaatgctgattggtaatttttgagcgacactcacgcggatcgatgaaatgctgaacatcgatttctcatctctagcattcaacgacgcattcactcaccctgcacgcaatggcatacggccgctgcgccgcataccctgttcaagtatacgcactgttgcttttcgggaaattccgaaagtgggacggcctgggtgtgcaacggcgtaacctaaaagtcgatttttggcagtgaaaggacttaagaatgcattaagtcgcttgcaccaagatgatcatcgccaagctcatatataattctgctagcgcgcaacagacgctagtcctacgtccatcatctcatttcttcttgtgcttagtaaatgctgctgttctcttacacaactgaaacaactgacacacccgcaccgtttcagatgaagtcagcacttccggacgctgtccatagagtaatcaaagagcttgagtgccggcagtcctgatcgtcacgaagaacgttcggttttctgtcagggaccgcatgtataatcttcttcaggtgtgttcttatgcatgcaaccttcccgactgtacattatgcagggtcattctcttgtgatacacaagaaagatcctgaaccacaaattgtacaaagttcttcgttctcgtgatgcactgctcgggggttgggggca

SEQ ID NO: 2683 - DNA, 1991 bp, Toxoplasma gondii
gtgggcacagagttttatttcggattggtacgcgaatcgcagatagtggaccataagcatatgggggaagaaaatcatggagtcaaaatgaatatatcaagggaagtttgccacttgaatggtatgtgatgactctgtcacataaatctggttcataaagacactgctagtttccttgtcaatgcataaggatggcacttcgtaaaatggttcagagactaacgtgaagcttttcatatcaggcaaaaggctttcgtgcagcttggcggaaggtcactcagctatgaatcgtttctaacgcagtaaagaacaaatccccttttgggcgccgattttccatggcgcgctactggccacaaggttgccggctgtgtgtcacatatagactcctgggtagaccacacacgtggcaacatagttgtttgccagatttcagttgcctttcctcttttatggtagtacggagggatgatgccttgctatttgtttccaggggcaggtccgcctcttcaccttgaatcatcgggtgatctatttggggaccctatatgtaaacacgcgtttggactatttcattcttctcggaaaacgccgctggcgccctaaggctgcgccatagaacagagaaggtcactttgaggaactctcgggagctgatgctcccggactgtccactgtacgtagcagcaaagctaccccttcagaggcgcagatggcatgtgtgccaacagcatcttcgatgtcagaacctgcccgaaaatggcatcgaacgtagcactgttgttaggagagctctctcccccagggcacctgcagctagcggcgaacgggcgaaaagactactaagtgacttcctctgcagcgacagctgcaacgaattactgcagtatgcctctctcctaccctttcgaagtaagatgtttgcaatcccatggcaaaaacggtcacttgaggctggatgctatcgtcctggtatcggaacgaaatgtgcattacctcggagggcacggcggtgcttgttggagggactgctgcacctttgatggaatgctccacctgccttgggttcctctgttagctctaatggtaattttctaggcacgactaacaatgaatttgatgaatgcattcattagtcaagcaggaaaatggagggcaagactgaaagcactgaacatctgtcgatcgtgctgccgcaggcgtctgcatgggcttctctggtagagcggaaacaagtggcgtgtacctacctaccgcaggaggaagcttagtgtgccgacgataagtgtgtcaatggatctcttgcacaaaaacgattcgctcatccaacgtggccgcgatgcaagtggctcgaagcgccaaatgaggcacggtgggtcgaggcggacggcatttctggtgcacaccgtcgtcgtacatgcagcgggactctcgtaagggcacgcaactacaggtgcctttaaaaacgtagcatcagcatgagaattatcgccaattataattgtcatcaagtgaagttcctgtttgaacggcttccatctttttaatcatgtttttgaaagaccgtagttccgacaacctttgaggtgtgctgggtcggatcagcacatgcggtctaaccgtgcgaacagtcgtgatgccctttgtagtctcgtcttgttcccctcaccttttctctcgtgttgctggctgtctctgcttgcgcgccccggccacgtgtcaaatgaaacagaaatgtttttcgttgggtgaacgcaaacagttcttctgcattaacagtgcgtagtcgtccgagtgcttcagtggtgtcttttcctgaaaaggtgccgcagtaccgggaccacatgaaactttctacaggcggttcctgcaggagctacgcttcgtactggctttccgtgtcgctggcatcccttcgacagtggtagcggaacttgcaagttacggagtaaatccacaaaggaatcaagttgaatgcgcaggcaagtgaa

SEQ ID NO: 2684 - DNA, 2077 bp, Toxoplasma gondii
gagttcctgtcccaggtgcccgaggcaggaactcgatactctgtgaagaaagagggtggcgaaacttctcgactgcgaaaatctcccgttgtcgaggtggaaagtgaagacggctctgcgcgcaggccgtcgatctgtggagcctttggccatgtgtggtttgactgcgagatggcgaaacgctttctgtgaaagttgagggaagacactcgaaacagtgtggaaactccccgcgttgcctggtgtgggcagctcggttgccaacgcgcgacagcctacctgagctccactctacgaaggcgcctcctgactggacgcacggtaaaacagcgtacctttcgtggctggagttggcgactgaaagaaaccgcaaaacaagagacctgcaacggtctcggaaacaaagctcactttgtaaatctgggaagagacccatcgcgaagagcgacggtgggtctgcgcgatgcaaaacgtgcaaacgcctttagccgtggaaagagtgtggaagagcacttgctttcgtccttcggctagacgagaaaatactcgcagaagaactgtacaaataagatatgctgtctcgacctcctctactcggtcaaagctggtatggaacgcacggcttagcagcgagagaaaaagagtccgcagaggcggggagggcaagcgccgccgtccggagagtcaattctcggagacgcgctcctgttttcttcctgttcgacgctgcggttggcggttgacctcgctcgagagggatgccttccgagttagttggctgcatcgatgaggcgtgcctaggccaccgacgcagaaacgacccagtttaaagggcacaactccgtacagtcgactcaagaaatgtcacgcaacatgctggaaaagcggggacttgttacactgacttcttataaggaattgcctcccagaagcccacactgagattccacagacttcgacctgcgcagtcatcgaacgaggaactcacgtcttttccacggaacaaagactccagcagtcgtctttgtctccctgaccgacaccgccgctctcctctgctttcgcgtccttctacgtcttcgttctctctcacacacacggaggaaaggtcaaaaaaaaaaagtgaaagagagctgacgggcacccttcttcctccgttactcttctctctgttcttccctcacacacatacacacatatatatatatatatatatatatatttgtttcaccagttgagacgtcagctgcttttttaaattggaaaagcctgttgggtggcgagtgtcgcgctcagctaactttttcgcagtgagaagacaacgatcgtcaggaaaacagcatttgcatgcgacgtcggaggaccgttcgcggtgtctctccaccggagaaacgtcgagaaactcaaccgaaattctttccccccactctgcaaaataaagagaaatgtcgatttccttcaattccctttcttctccttctgtctctaaaaaggcgaaaaactcttcctgtaacgagaacaagcactgacgacaccgagcttcttattggtatctcttgggccttgtttctccgctcttcccaagttctcctttgctctaactttttcgtctttctcctttctgcgcgccgcgaatgtcaagtctcaccttcttgctgtctttttctcatccttcttcctctctcttccgtatcctcttctgtcctctgtaacttttttgtgaagtaaacgtcggtgtccttccttctgtgtctttacgcgacgagaagaagagactcctcagcacaggttgacgctcgcctcccctctcttctcccttttcttcgtgagaggagagacatttcttagacttttcttagacatttctgccggtcttttcacactctctctcgaagtctccgcctttctcaaacggcaaagtctcgactggcgggagagaagaacgggggaagagagtcttagggcctccccccgtttcctttctacgagacgaagatatccttttcgtctcattcttgtcttcatcccctcctcttcctcctcttgttctcttctttgtctcttctcctctgcgcca

SEQ ID NO: 2685 - DNA, 1938 bp, Toxoplasma gondii
tatttggtatcttggctacttgcaggatgttatctctcttttgccacactgagacaaatcgttgcattatatatttacttgcctttcagaggttgtattacagttgttttacataccatctacttccatccacacggtgtggattcctgagtccaatgcaacccctcagaccctgccctgtgtcacaaagggcttcagcagcaaaaccttgtacactctgttcagcgtcaccagatcacaccacgcaccggcatggcaattgacaggcaagcaagtgaggttgtagttctttgagatgctcacgacgaaatccgttgactccctcaacacagtttcttcaatcagcacaccgtaaccgccggagacaaacgacggctgtgaccttcattcattcaatgctagaagcagcctgcacgaccacatttactggagcccctctagcgacgaagaatcactgatgcgagctggcacactttcggcccataatggtattttcatctccacggaggacgaaggacggttcgaaaacggagccattctcctggcgtcggataccggtagccactcgttaacagcaataggaataggaggcagaatcacacaaaacggacgtatatctcctgcagtggaactcagccgcgatgcctattcaagtggcttaagccccccggaaagtcgttcattgaaaccgcacttgaaacgatttaagttaggcctcgttactacccctcatgaagagatatatcaaccggatctcggtagaagtcgtaccgaacatccgcgcttacttcagtactagggaaacgtgcttgctgacgcactcccccgttgacctgcccgggtcatccgaacttcacacaatcatgtactgctttaggctaccaggaccggtactgccagactagcgccgaagatagaagtcgcgaaacactgtcagctcgttaacactgccgacctcggccagccggtaaaagtccagacagactttctttcgaatcttgccgtgcgatcagtgattcccatactgtgagtagcttgtaggagcttcggaagcaacaacggttagctcgtgtgcagcggcatcgtgacagtgctaacagatacttgttcgtgatccaagcaagaaatagcgtctgatacacccgctgaagacttgaaggatgacaagcggtcctttcaaacgtgaaacttcccatgtgtgcggttcccaacagccccattccctctgaacttacgaacagtcgaggttctgaccgtccgaaatggaactcatgagcaattcgctgagcagatggttcaccagatcatcttggcaaaagtatagaacccagatgcgactgcatagacatcaaccgactccattattctctcttcacaggtacagagaagccctacgaaacacacacagaatcttggctacggcgcgcacaggcagtatcactcctgcaccctatagagcctccgcggatggcagaatactgtattcagacatgaagtttgacagacaaggacaaaaggggggaactacaaggccgcgaagcgacggacgcaaaattcttgatcgaacctagacggcactttttccttttgggttttagctagctacgccgcctcatcccactgaatgccgccatactgcatgcgcatgccgtggttcgctgccggtatgttgtttgcacaaaataaccagttcccttgctactacttcctcgtaaaatccctgtcttgccacaggatcacgtttttcgcgttaagtgacagcattctgacttctttccggttctttgtggcacgtagcggccgcattcaccgtctggcgggcggtgtttgtcctcggggtcgccctcgagctttcgggttttctttttgcgagagttttcgtggcatgctctttagggcaaaccggcagtcctgaaattctttcgcccaaggcaacaa

SEQ ID NO: 2686 - DNA, 1481 bp, Toxoplasma gondii
ctcccatacatgcaaatcatgcgagcagacttgattatgcagctgtacagccgtcagatgtgactcaaaatgggtggtaaacatctcctctgacaacacccttgtggcgtacgaatcctcataccttcactacctatacttatacacatatatatatagatagatagatatagatagatagatatagatagatagatatagatagatagatatagatacatatatgtacatttatatgtgtatgtatgcatgtatgtacaggcatataggtaactagaactagatgtatatatatatatatgtatatatatatatatatatatatatcatgcgtatcccgtttccgtgctcgtacgtatatctgtttaacgtttacggtgttcctacgggcaacgagaggaagcgtgagtgcggagtctcgagagggtgtatttagagacggaaagcaatgttgacacggaggaaagcagatgaacgtttgtgtgaaagtttccacttcggcaagagcggtgagtttcgaaggcatggacgacgtcgacagtttcttccaattcagcctgtttttgttttcagcgagtctcccctcagcaaacagccgaggcaactgcgcgttccttttagcggcgacacccgagatgcattcttcctttctttgttggagggagactgttccgccatgctgtcggtaacgcgctctgtctccgtcgcaaacataccacccccctgaccaccctggatgcatgcccgattctgtctgggagggtcagatgcacgcgcgtatcttgtcttttctcagaggacctcgtcgctgtcgcgtccgagttttcttttcgtcgacagacacgattcagtctctctgtttcggagtcccggctgtcaagcaggcgctcggcagagtgtgtgtgcaggacagggacgcgaaaaaaaaagacagaagaagggaggagaaacacagaagaaccgcgcagaaccgctcgcgaaaaagcgaaggaaaaagagaagcggtggagaggcggaggagtcttctggctgaggcgcatatgtcttgtcttttatctgattctttaaaacgtctctgtgcaccgacaccggacacagtgcgggtcgccggtggcgaggaacgcccagagacgagcacggtgatactttttgtggctcgacagtccggaaaagagaaaaaatttgccagaagcgaggagactgacagtgtctttcttgctctttctttctgagaagctttttctccgacttcgtcgcgagtatgtcgccgccttcgcagctcgacagctggtccggtctgctgtgaggtctgcgaatccgctgcaagcaggcgtcttctctagccctttccttttcatgaagcaggtggatgtacacagacgctcggtctctctgtcgtcggagtccaaatcgttcaaaatctctcccctgaagtctccgtgcagggcgtctttttcttcgctctctcccagcgtacacca

SEQ ID NO: 2687 - DNA, 5057 bp, Toxoplasma gondii
atgccatcttgcagtatgcctatatgtatatacacacatgtaagtatgtgcgtatgtccacatctatatttttcgtttccgtacggtgagtgaactacacataagtatgcaaaggcatatagcagtaaaaagagagacagcacaacttcacaaaacaggcatcgcaggtgtctccatctcactcttcagaggttaacacattcgcacaggacgtagaagcacgcgtgccgccttcatacacaaacactgaggagatctccggcattccaaactcgctgatttggcagatgtgtgtgcacaccccttgcttacctaatttaccggctctgattttatctatatatctttttgtgtgcgcgcggttgtatcgtttatgtgcgctagagaccaatcgctctcatgagccaaaagaagcatattgataaatatgtacgaacgcgtacgcatgatgcatatgtgcatatctctcaaaggcatgcacctgcctttcttcgtacggtggctgaaaaacgaatccgtacgacgtaacatggccacgcgtccgtaacaacagaacgactcgctggatgtcttctgaagaagtttctcctctagcggaatgtgtgccagtcttccacaacacgtatagcagcgcatttggaaatatatatttggcagttccttacggttgcgacaaggactccaatagcatgcgtttgaaaatacgctgcggctttctgctgacgtttcttgtccgcctgtcccgccattgttccgtcgctcttgagtatctctccacctgaagatgttcctccctttgcgtgaacacagaaataagatccaggtgaaacgggtcttttgaggtaggaagcaacatgcaactgaggtagggacgatggatggtagctctcgaacggaggaaagaggtggacgccggacagtttggacaagtttcggctcttcaaacggaaaagagtcgtcaaaatgcggtccgatctccttctgcttcaagacggaaagaaaatgaatgttccgttggttttgtacaacagaaatggagatgcagcggggggcatgcatgggacagagccaagagcaagacgcgacggaggtagctgtccgaatgttgcactgaaagcagacgtaaacccacctgtcgacttcttcttgcggtaaggaactccaaatccaacacccactttggtggtcgattttgttaaaataaacgaaacagaaagttccagagaaaaccggacgattttacgcgaatgcccaagcgcagcattcgggtgtctacaatcctgggagaagcgttccgacccccagcaaatcgattcttcacatggaaaggattttcagcccgaaccgtggagctggcgttgagacccaagttagaatcaaagggacaacggaaatcagctctcaccacaacggaaaagggaagcaagggtcgctcgacttgatttgattcagaacacgagatacgaatgagaagagagttggatgtcgacatgtcctgtttagcaaggtgtgttaccgttgtgcgtctagctcgcaattcggtatttgtcgcttgtcccaaaaaactgggtcatctgttttttgctctccagaatagccttcatttaggaagggacgtcacataaggccttgcctcttcgcatcccacctgagctctttctgtgccctttggctattagatctcgcactggtttcatgctccagggcgacgcgactccgagttcagggatggtggatctcgttttgctttccgtctgaggcctctcgcggtaaaagattccagaatatctcagtcgaggaacttaagcgacgcaagtaaacgagaaggaaaacaagtgggggatgggcgctgagaccttgtgtacgcttgtttttgctgttcccatactggacgacgaacggtgcagtggagtcaaaacagcgacagagagaatgacacgccgtcggcgttgttgtgggaaaatacagaccgacggtttagtcgagcgctatgtggagcactgctctttctctgctcagcgacttccacttgcacgagatcctcagcacggcttcacttgaccagaagaccctttcctcctgtccactatttcagctgtcgcgtcttagtcattcaagcaacccactttctttcctgtgcaacttgtggaggtacgcataaaccttttttctttcagtcctccttttgctctttgcttgttgaaagtagcagtttcctccttctgtcgttgtgttcggttcacaatccaggaagaccttgatgcacggcaaagtgtcctgtgccagtcaaagttggttgtcaggtttcgtcctcaaagtgtcaggaatatctgctttgctctactgattctcagtggaaacggcggctctctcgtttcagcagaacggtgttgccgactgtttcacctgcggtgatatctaggctggctacacgacaagaatattaaacccaacttcaggtgctggtcttctcttattgtgtgcatgatgcgggatgaggcagaatgcttggcagctgcaacggtgtccacatctgtagatgctcagaagaaaagtccctgagtttagcgatacgagtggaaaattgcttgcatgtgcatgtagtagtatgctgtcaaggcgctctcctgcttgcatttactcggcacatgtggacttggcacactccgtcactgcatgcgtcgttatatatatatatatatatatatatatatacatttatatgtagacgtatgcgtaagctttctttcgtatagtgaaacgtttaaaaaatcttttgtaggtcgtggaagtaattgcacgtgtttttacgtcgacatgaaagtgcacatacattcttatgttaactagagtcaccgtcagtatgccattaaagcgaacagcgtttccgcctacgggtgtctgtttcgcagctttcactggcttccaatcgtgtgcttgttgggtttccgtcagtgctttcgtcattcttacgtagcattctgtatttcttcctgcatttcgcttttctgtcgcgaacaatgtgtatctaaacctgttctgatgtatcgccatcactagaggtctccttcaggtgccacatatagaaaggtatagataacggggggaaaaggcaccaggtaacgtacgacagaaaatgtgggactgttgaagacaagtagttaggcaacaactcaagatacacaacagaagacacagaaaaacgcaagagcaattcccgtgcggatgtcgggaacttggagcgtttgattcgctctaatatagcgaggaattaaatgcaggccctgataacacgtgtcggcactgtttaacggtggggcaaacgcattttgggttgaagtgctcgtcattcgggacttgtatgccttttcaaagactgtctctgtctcttgtggagacatacgatggaactgtctactcttgaagaacagcgactgccgccctctgtcgtgagtggtttcgcagactgggaggaatgaacaaatgcatggcttgcacttattcttccttaactttcttgtagggaagaaagtgtttctctcgccatttccgtcgtcgggagtttacccgaaatgggaaagctttgctcggacggagaggccgtactgtcaaaaagtctgcagctggatatttcttcagcagagctgctattgctgttcacagtataacatacatttgttcttgttgctgagctcttccttgtgcccatcacacctgtaccagaggctgcaaacgatattgacaagccgaaactttgatgcttctcgctgttcctcgagatgctctcagacacggaccggaatgtactatctatgcctgaggattcaatcgagggggccaccgcgcttgcgaacggatctggagaggatgaggctgttgtagacagagaatgtgaggagttcaagattttctcgttaatctttcgtttggtcgaagacatccggcttttgggtggggaagattgcgggtctcccagcgtttctggtgacgtgctgacgaatgttggtgttgcactagctgtgccacagaattcgttgcttcttttttctgataacgttttgctcgcgttcgtgtttcccgccgttgagctgaaaagggatgatttggcagatcctcgcaacgaaacgctcttgagggaatcctcttttccggttgattctgccttgtccatcattctgcacggaggtatttccgagtcatgagcgtcagataaagatgatatacacaaagaatttttcccgaagacaaaactgagtgtgccgctcgaacgctcacggggtatggacccggtcacactccagccaaaatcagacacacttcctggcattttgttggtcagttaaacaagaaatacggttccgtttaaccagcgggaaagtgccacagctggcctcacatcacacattcagcgtgtctgtattctggttctttaacacatgccgcacacgcgagcgtaagactgctgtcatcagctgagaataatacacgtcaaaacaagcgaaactatcaaaaggggactccacctcgtcatatatgatgtcagttgagtcgctgtatcgatgtaacaattaaagcagaaactgtgtcgccggtgacacagtgcctcgtacgtccaagccagccacgaagactcgtcacacagtcttgacggaaagaaactatcgcagaagttactgacaaagaactacgtacgctggtctagcgaagccctaaggcgttttcatacacacacagtagaacctccttctcgttacaatagggtgtacccgaagcgttactgctcgtcccgatggtgtccccgagcactgacaagagtccataccttcgctccgatcgcgttcccctctcaaaagcttgcaacgtggcactgacaagagtcccacatcagccatctattatcaatttcaaaaggctcctacatttggagagaacgtgtgcacgttgatgctgtaacgccccaaacagcaagcgaaacaagtttacagcaccgtcagacaggtacagctaaggggaaaatcagttttgccagccctaggggatgcacgggcatcgccaag

SEQ ID NO: 2688 - DNA, 4285 bp, Toxoplasma gondii
ctcggccgaaaatcattcgcatcatctttccttcgcttgaaaacactgcgaagtgagataccgtgggctctggacagaacgcccgtagcacctagagagaggggcaagtagaaaaggcgaaagggcggtagaactgcccttcgcagggcctcgtaactgtgtgagaggctggcaccccaaaaccccaaatgctcaacctttttactctttactgctactgtgtgatgtgaggttgggcgaagacgctgaaggaaatctgcaaaacactcagccgctcccgcggtcaaatccagagaggaaggacagacggtgactagacagaagcgcgttttcgcggagaccaaagagtcgaaacagtgaaggggaaaaatgcggtaagggaagaagggagacagaagccagacattagaatgactggagtgggcgaaaataccgccacgaacgcgaagagaaaggagcgcgttgggaaaggatgtaggtgcatccggactagtctaagggacagaagggcaacgatttaaatgcgggccgggttggagaaaaaccttccaggaaaacttcttgctcgtctacattttgggccgcagggaagcggcacacaaaacaacaccttctctcgtgtttgttgctcaaaagaacaaaggaagcggaacagatcaccacatacgggaactccagacacttgggtaatttgaattccgcgagccgtttgtgaaagtcaacggaatagaaaaacggagaagcgcggctgaccaaaacttcaagtggagtggtagcggtcgaccagacaagcaaagcgtgttgttctgcttttccgcgtttctggagaaagactcggagagcagcttgacgaataagagagcagcggaccggggacggaataggaacttgaaatcgcacaagagagaagcacggacagcacggatcgtcaaaaacaacaacgctgtggttgacaaagttctcctttttgagggaaaactggcgttctgtgggggtccgtttgaggcaggagaaaaggttctaactttgcacaaaactacgagaaaaagattggagggagcagagctgccagtaatctacggaataaaaaacctccgttggacgcccgccaaaatacacaggcatataaaaacttaagaaatagaggcactctcgcctaacggcttcagacactcagacaaatcgagtgcagaagtacacttctttctccagtctttcaggtagctgactctgtcgtgcaagccctaccctccagggaaattcccctctaacgtctgaagtcaatgtctgcacgtgtctgtcacttatgtgtacgtaaagctacggaaacttgtatccatctctgtagtagaagcagggaagcaggaaatgcatatgtgcgcgtgaaactcatggattttccagttgcgtctatagaatgcatttcgtagagcaaacggccgcgtagaaatgcgttgtgcaacgcgaggaacagtcgcaagtcaggaccaccggggggggggggggggagcaaggaagaaagcgagtccgatcactgactgaacggagctactcttgaatcgtcaagagatgagaatgcagccggccttaccaagccgctttttcattagcctcttctctgacacaccccgatttcgcgttctgtgatgctttcttttggctcatgttttcgaaggcgactaacggaacttactcgcgcgcttgccgatgagcaccccggtccgccggccacgaacattcaaagtacgcttgctttctcgtgattcttgaaaggcttgtctctgtcatttgtttcttctgcgtgccgtattgaagccgtccacttgttcctggaaatgctctgatgacgataactggaaaaactgggctgaagagtgctcttgaaagtgccgtcccgccgacgtatgtgccggcaacacattgaagacacgcgagtgccactgcaacacacttcaactggagcggccgtacggagggacggacattcccaagatggaatgcttgtgccgcagaacagacgctcccgaattaaagcttccgttttatggtccggagccgatacgtggaaagtgaaacgtgcgggtcggtatgcaagggacagcgagaaccccaacagagacgaaatggcgggagcccgtgttaacgccaaagcgcccttcgtcttcttttcgcttcagagtttaacagcttccgaagatttagatatttctgcgacctgggaatccgtaacagatactcgaataccacaaagtagcggaaaaaacaacggatacgctcgtcaatgtaacggtacaagccaaaagcaaaggatatacttcatatcacagaccataagggatggagtttatgagcctaaccggtacagttgtcccatgacgacggcgctttcgaagtcgagagcgtacccgcatgaccgggcagaggcgttcgcctgatggagttgtttagaggtttctacaagacaaacaatggaactcatacattcactggggaaacatcgcgtttcacagaaagcctactgcaccagggacatcctggtaatagcggatggaattagtatcaaagagggaacaccgtaccacattggcgaacagcatggtgacacgataacaaaagaaatgcactgaatgaagtcgctttgaggatatgccaccgttgcacttcgcgtcttgcccctgtgaaagagagtcagcatatgctctggttttttaagcggaagcagtccgtactaccgggcgaacacaaatgagtactccattatttgtctcagagattctccttgctaaggtaatgcatacagattgccttttagtttgatttccctgtaggaacattttggcaatcgagatcagccaggacaagtataaaggtcgacatgctcacagacaccaaataggagacaggaccaccgtccctgtattgagtttgtggaccgctacatattatggcaacgaactagcgacgtcagtgtgaccgatatgtgctctatattcacttatattggacacgatatcaggataagtacgctgacgtcttcatcgtctccagggcttcactgttcacgtggccctcaggcagaaagaggcagatttctgaacccgacacatcaagaggcaaagtattttctctccaagatcagggtcaatctccagaactctatgtacacaaagtagcccatttgtgattgtgggtgccagacgttttacaaaacgaagccgaacgttttgccaaaaacataacccccccttgccgctgttccgttactggccaaggcaactcctcacgctctatcatgtgaatccgggatcaaattggaagcgctggattcttagagcaaaacagggaagtgtatgataagtggatagccgcctctcagccagctctgtagacaatggatggtttcaggaacttgtccctggttcgctgtgaatcgtctcgacaaaaactagaagatggtggagcaacgccgcacacaagtaacgccaagacgcaaggggactatcggactgccgccaaaagttccgcatagcagaaagtccacacagtttctcgtgcaacgcagaaagcctgctgtagacgactctagctgccaggtagcaaacgatttcccagatcgaccagaagtgtgcagggcagatgcagtcgggcgggacttgcatgcgcgcctgctctgccggaatgagactcgagaaaaaaccagccctagcgtaataacgttagcggttgaaaactttagagaaactgaccggtgcaaagagtctaaactgggatgataacgccggtaggcgacgcggcagatttcctctcagtctcgccacgctgacgcaaactttgcccagcagtttttgccggacgtgtgagataggatgatctgttttaaccacaagaaaattgtcccagaattgagtcaaaagagcaactgctccgccttttcttcattgcattttttcctgcatatatctacgcaaaaaactcgtgtacgactcctgcgtattgctgtatccaatgtctcccgcttgcggttttcagaccctgcgtaaagggggaattcttcgtgagaatcccatcctgttatttctttcccactgtaaaccccgaaaccatccgcttttatttcccgttctcgtccatgtcttcgcgtttttcttgcacgtcgacggcgacttgtgaccttgtagttccgtcgttcttcctcttcttcgcgctccgccgctctcgcctccctccatttcatgtctgttctgtcttgtatcactcgccttttctgttacccccagtcggtaca

SEQ ID NO: 2689 - DNA, 2667 bp, Toxoplasma gondii
gcgtttcttcaaaaatgcagacaaaaatgtccatagggactcagcgtaactgagtggcaacacctgtggccaggctcattgggtctccgcactgagggtgaaccgttcacaaatacagttgtggtcacttcttcaacatgtctcgggttgtacagtatacagatatgtactgcgtttgatgtttgaaaccgctgattatgtaggtgtgcagtgtatgtatagctcaacagctagcagcttggccacttcagcttctaatgaataagaatagtaactatgacgccgccgcccccccagtctgccacatccatagcgtaaatctagacgttcgtgtgagtatagcgagtctaaaatccggctcgaaggctgtccccggtgtctctcacaaaccactgatgtattatgtcactgatgtcttcggcacgtgcagaaactgtagtggggaacgttcagcatgagtggctgcagaaagacccacataggaggctgccattccagtgtgtgcgtttcggtgcagataaaccatgcactccctttaatcaaaatagccagccataggttgtgacgagcctgtcccggcgaactggaaacggcgactgttttgcctcgtaagccgaaattatccttgtggttttctcagttactgcggtcgctgcgtcgtgcggatattctgggagccgtgttgtgtgcctcagggttgtcggatttcagaacagacgacgttaagatgcatttcgtttcgttgatgtgtctgtatctaaatggaaaaactgtagggaacgaaacagcgatatgtcgcaaccacaagtcgctgtgttgtgccagttcatttacgtctacaaggcggttcggcgtatatacaggcagtgatgcatttggggtggggggctctttatttcaggtccttcattctaacaagctttgggccaatcaatgtgctcctccctcttgttttccctaaatgccagctggtcgggcttttagcagccattctcctggagagagattccgcgttatctgtagggcgacttgtggttgaacgcctcttgctgcgttatgatttgagaaataaccgtgcacagaggttcaggctccaggagtgctgccgtaaaatgctgccgacaaagtcgccctcgtcaggagtgcactcctggattttctgtgaaagtctgtactcctttctgtttgtggctgcgtgccaccagtgcagtttaccatcatgtctgttaaggtcctctggtaccgggggaaagtggggagcaaaaggggtggagtcgatttatgcgcttcggtggttgtgcgattttttttcagggaaacgaagagaactgcgacaccaatatcagctgatgtgtatggtagcgtaaagaaatacgtgtacagtggtctcgttcacaagcacacaaaaaagtcggcgcggcttggacagagggtggctgtgtggtggcgccatcttttcgtggcgccgacttccgtgacgggtcgtgggcttccagctcgagcgtttggatcctgcaagcttaaatttggagagtggctcggttttggggagcacacgcgcagtcgcgacgttttcgcccgtggcgtggtctgtgcagggacggcgagaggctgcgtcagcatcccgaattttggtcactcggcgggtgacgagtcgcggtctttgccccactctccgcgtttcgtgtgacaaaacagaccgaatttctaacgcagagaacgcctgtgtttttcggcacgcgcgggcggcgttgagaacgagacagagatatatgaagtatatttctggtcttttggtgggggaggaaatgttttgaggcgtctgccgttttctcctccgtcttcggtctgtttcttccgcctccactttctcgctgtgtggcccgccgcctctccggttctgtcccttcgttcgatgttttctcggtcttttccggttttcgtcgagtgttcagccgtttcccacgccggatttccatccactggagaagtccacgcgcccaaaaagttcttcaaaaacgcgggagtgagcgccgcttttgttgccccatcagtggatctcccccccccccctccccgcgccggcttttttggcccagcctatgcgatatttgcatatcgtacgggtatttctgcatttgatcagcggtatacgcgacgttctgcgtctcaacagttcgcgtggtccgattctccacggttcgcattttttctgcatttctgccccgttcccacggcgtcgtacccggtccgtggttcccgcagaaatcacgcacttgtctacgcaggcgcgtccctccgtcctgataaggtgtcactcccgtgtcctgcagatatcctgttcttcgtgacatttcgggaaggaaaaacgcaggggtcgtttcctccaagccgaaatctgtgcactgcgaccgttagctctcgactcgtcttcgcagtggtccacgcgtgcatctacccagccagggagtagaccctctgcacaaagttgtggaatcgacggagaatctgaggtgttcccttttcgcttcgttgtctgttccgttccccacctaacttttttattcgcgtcgcaccgttcaggagcatccaccctcccgtggctggcagcgcatccacaggcacacccttgcccacgaagccgtgttcatttaccatctagaacca

SEQ ID NO: 2690 - DNA, 1587 bp, Toxoplasma gondii
gcatcgttgtcgctcaacggacttccggtgttagtttctgttctggggtaatgtgtgttgtttcaaagtgcgtttctccccagacgttttcgattgtgtcgcgcggctacgaccttgctcgcggcaaaagtcacaaaactacggcctcagtccccgttataagggtggtgtcctccggccctgtgtctacagtgtagactcgtgcgtccggtctacggtttagacgaatatcaggcgtccacgatgagagctgcttcgagctagagaggtcccctctctgacagtgttgtgctgcggaatgctccagcggattctgctcgctcggggacctgtctagcaactgcaaaggcacttctaccgcctggcgtgtttggctagagaactggagttttctagcggttgacggccactgccagagaacgcaggtctctgcaatgaagggagcgaaattggacaaggcgtttaggtcacgagaccctttactttcttttgcttccgttcaaacaggcacctcgcggcagcgcctcttcgaggaactgcagaccacagagaaatgtgtgatcaccgcggagagacagtcccgccgaggcgcctctccttggttcgttttcttctgtgaaagacctttctacgtggttccgtccgtcctgatgcaactctcgccgagcgtctgcgcttcctttacttccgttcttgtttctcgcttctgcccatttctgtttgtgtctttccccccgctctgtctgtgtgacaagcgcgtgcggctctcgaggaggacagaaaacctgtcgagcgccgtcagaaagcaacaagtcgtcgccaggtgcttttggcaacgggcaatccttgtctgcttcttgccatccaagtgcatttccactctaacttctgccggattctttgcggaggacgcgggagcatcttcgcaccactctagtttggaggtggtgctccaaaggaaccgaaaatggcagtcctttcctcgttcctgtatgaggacgatttccacgcgttttctggaaagaggtgctgcgagtggactccaggtttgtcagacgttgaaagtcttcgtcgaccggttccggttctctcgtgcttttcgcggccatcacgaaaagactcgtttgcaccaccttcctccggaagtcgatcacacacagttctcgatttacatagccgaagaacaaacgccctgattttagtggttttactttttctggaactgtcgagcgggaggcctgccgttctggcggttgctgacggccgatactttgcgggacttttttcggcgcatgcaactgcgtgttccttcgctgcgttcccgctttttgccctttctctccgcgcaagttccctcccatcttcttctgtaacccacgggacatttttctcctcgagaggatacctcctttcgcgtccgctgtctcgcgtttcgttttctccacagcgaagcgccgctgtgggtccagctcaggcctttcctctgcccgagtttttgcctccgcttctctcctctgtcgtttcttgcttcgtgccttcttctgctttctttctcctgtttttcgccgtctcgtcttttcttcaaga

SEQ ID NO: 2691 - DNA, 3863 bp, Toxoplasma gondii
ctcctcaaatctcaggtggagacgctgtatcgaatgggagcgaatacagaggcgaagaaacttgcagacctcataaacccggacaagtgaacttcagaaagaattccagtatcaagatttcttgcgagcagaaaaaacaatccttggtagtctcgcacagagtcagccggtggtgcttcaaagccggtcggagatgcgggtgcttgaaacaacgatcacggaaacagatttccacctaggcatttgggtggtgacatcacttcccaaagaaaagagtgtctgagagatcgcgaaactaaagaacttgaaaaacaccactagagcggaaaaacacactaccaccgccacaagaagaaatctcgattttagagcggctgttacagactgtccaacctaccactactaaaccgagttaaatcatacagggtggagctaagtaaatatcaatgcatagataaaaggaaagtgactttgtagttcccttttttcagggttcttgctccgcggagtgcgcgagcagggcagaagaaggaatcgaacggagctgcagagacaaaaaaacaaatgcgtttctgtgtcaaaatctcgacgcccatgtttgtgtggtggcgatgtctcatttctttgtttctttctgatggaagactttttgctttcggtgcagttagtgtgtctgctatgtttggtctaatgcgttgttatcctttgacctcaagcagaattccctataagcaacagagacatccagtgaccgaagatttggtcttgccgcttgcggaagtcagaggttgcctgtgtcttataaatggagtcatattcagtgtccaggtttcatagtgtctctgttcattcgatttgttatacatttctggatgtcgcggggtgagaccggaaagactgagtagagtccgtgaatttacagtcgacttagttttgtcttttccaggtcaggtgtttttgccctctaatcctcagattgtatcagcacgccagtgtcggctgatgattctttcaactgcatcataaactacatatttaagcgggtgccaatagaccagtcttgaacgcacagtagatgttgtgcccagtcgagtgtcacacacggaagttcgcttaatgattctaggtgcagatccagaacgaaagagaagcgtgtaccgtcagaggcaacgcgatgcgagctcagagtgggacgcttgattagtttgtgtgtcaaaactgtgttgccaccacatttgacgatctccaagctctctgcaaaacattggaagacagtctggaagaagcgcgtgttgttcgtcttgtttgcttgtgaaagaactcgaactttcacggagtatatttttggaacgtgataacttcacctagccatcacgatgcggttgttttggaacaactcccttacatgtaggggccgcggaattttctcaacactggaagcgcgctgccaccaccgcagacttagatcacggacacgaaagagggcatcattaccgtgtacttttctgcaggtttttacctgccttttctatcctcatggatacgcgtgcatctgtgtctgtgcgcttttaattcgctaactggcaggcatgcactctttcaccattaagaaaacggtgtctttccgtggctttgaaagggtgtcttccgcagtatctttgtttctgtttccctagagacccatgatgcctgctcgttctttaaaaagcagttgcgtaagcaagaggttgtgttaacattttcctgaggccatcgaagagtggtgcgaatccgtaccatttcaccggagcgccgattctgtttcaggcgtcacccacgttcctctgaagttggacccggtaaacaaagatatttaagatctaaaccggtagtccacctccttaatgcccccaccagaaaaaggtagattacataaaagtaggagtcctattatatactcgtctaatgcagtctgagaaggagaagggaagcgtgccgctgactcagacggttgtttcacatccgaaattctccaggctattttctgtctttctctgaaatggccttacagtacacacgaaatcgtgaccagccagaacgtctggcagtgaccacttgttcctgcgttttccagagaagagagaaaatgcgaactcgggattgtgttccgcgctctaccgtcgtgcctgcctctgccgccacctgtcaaaagcaccatgatgatgacaattaacgttgtgtagggcagcagagtcccggaccacggaagcccccaaagttcgtcttcacacttcgggtgtacatacacgccagcgccagtgcccccacactggttgagccaacacaacactttgccaaagaaaagcttttccctcgtttaccgagaacgttccccgcaaactcggtaccgctcctgtccaagaatcagtagtacggttcgtcgcgcgtttgggttgcgggcaccgtgagtaccgatctttactaggtctccttgtggtggcattcttgcctgtgtcgccttttgacgttcgctggtgtcgcccacgcctcggcttccacgtcgtcgttatttggcgagttttcattcaccatacatggtgaaaatgcacccagacgcctttcgtcttttttctgctcgatccgttccgcttctcttccttgttggactccatttgtgtttttctgtgtgacagtcccgaccagttccgttcggcacacctcattggagcacccgggcaagacctcactcaaagcccgcggttgcgggtgctagcggctaacgacatgcagatgcacgcttgcgtctagggtacgcaaggttcaaggaacgtagagaattccctcatgactattcagcgtagctcgcttttctccaaaaggctttaagcttctccgactttgtctcgttccctgctagcaatgcatggcgccagacgacaagggccctggattgccatggcgtctctcacaactcccgggggagcgcccgagccttgaccacggatctctggttttccagtctcgatgtaacaacgaacctcaaaagacggctcgagaacgaaaccttccagtctttcatcgaaaacaagaatcttcacggcactgacccttccagttggaagagcaggcccgtcctgttttcgcgagaccctgcgcccttcggcgagcttttggctgcagcctgccctcctcgattcgagtggcgccataggcccgtggttttgcctcctgaaaagttgcatttgtgtgtcactctggtctccttcatccatcttgcttcgaacagggggtactacccctgtaactctccgctataagcgcttccttgtctctcgccgttcaacagttgaccggttcgaaaccccatttcacaacgtctcttaatagtagttcaaagaaacatgtgcgatttctctgtccgcctcaccacaagcgctgacagtgtcaggacagtctcaattcgaaatgtcccccttaccccttcctccccactagtgtcgatctaaccacttctgccgggcaatgtccaatcgtgcatgacaataacttcatctgttctacatcctcatgttgttgaagtacatagaggagcaggctcatacgacccacctttcctgcgtgtaaactggtaggtggagttctggtttacatcttgaatggctttaccgggtccaagctccactgcgtccaaactacaactcactcatctatcccttgttggtgctcgagagttggactatcccagacttcgaggtccgagaaagaatccccaagagaacccttccttccctcagatacggaagtcctggaaacatgtgtcgtgaaaacagtgtttgttgcctttccatttgaggcaggacccgaattgaagaacggaaacacga

SEQ ID NO: 2692 - DNA, 2145 bp, Toxoplasma gondii
tgacactggaaagtgttctggacaggagggtacaaataaatgtggaaatctgtggcatgtgtttgctgtttcagcgagatcataccgtcgcgtccttgatgtgcgtgcacccccagtagtcagactcataatgcttttcgtaccaaaggttccccaccgcatgttcagcttggaacctaacgttaaacgtgcaacgtttaattcgatttggtccccctgttattctgcgcgttcactcacttcgatgtaattcgccaaaccagcaaaaggacaaaaacaccaccagagtttattcgtccgagaatgatatcggtggtattacatagaggtgttcacttccggtttcgctgtgtagcgtgcccagtctacgtcattctcctggcggtttgtacaagtttacaggtggtcgttggcttcgttgcgaacttcattcacttctcgcacattgtatgcagccgcagacattttcctgtgtgtctatgagtctctacgggaaagatatcaagattaccagttgcagtcttaacaaattaccgggtgattcgtccggtctaaaggtgactgcatttgctcgaagcagtctcttctcttcgactggtgtgctccaattgcacaagaggcaaacaacaatgtgtgcgcgtatgcacccttttttgcgtgcgttgactaggaggcaaactattgacatcgaaagttcctcgtatgttcagacaagttgatgaatactgtttccttctccagtcgctgacacccaagtcccatcgctgaacccgaagaaatcaaggaaggcgcatctacctgtgtttatggggcggcgggtgcgcgggaggagcacgacacacacgcacggccgtttcaagatgaagaattaccacagtgttgaagatatacagaaagaaaacagagtgatggtatgtaaaacaactgactattgcgaattggtatcgactcacgcgcaggaaaaatgagtgtcgcgttttgcagcagttgttgcaggccttagtctaaagtaagatacataagcgttttcagcaagcaaaagctggagcagaaaatcacgcagagattcctagtgaatgatgaactgattaggtcgctagataagtccgcattctctcgttttccgcgctacgactggtgcgcgcgctgttggtagtttgccttgcactggcgtcttgcagacacaagacttccccattttcacccttgaagttgtttctggcaagctcaccgccattttgctcaagtattttcgttgaggcgtctcgtgcaaggtgaaaacactcaagagttgcacgagttctctgcagtatcaactgcggcctccccactctggcgaactccatcgttgcatgctttcttgctctgcgagtagagggaagctcacgaaaagtctgttccgcctgtgcgtgttgaacgcgttttcggtagctgattttggggttgacacagtttcttcttttgcgttaagtgttccgtttctacgtacaacgggagacgtctttagaggccgaaaggtcggatcctgtccaactgcgccatctgttccaccggtgcactgcagtgtcaacgtccgcggccgttctctttttccacatttccgcgagcaaaaaggtgactggtaaacctgtcaagggtttctcttccgagggtgcttttctctcgctcttcgatccggatcgaaaagtgtgtcagcagtccgtccccgaatgttccgataatcttccttctacacctttcccagtcactgaaaaagttcttctctctcctttccaaatccggtggcagtcgccgcagctaccgccaccacgacaattcgagtccctcaacggcgttcgtagtgcttctcgtgagtgagtgtgtcaccaaacgcatcaatgactttatttttgtccgcatgtgcacggaacggcgcgtacgcatgcgtatcggcgcaagtgtttgctcctctgcgaagaatttcgtcgagagctttccaagaaacctacgcctcacggattctaagttgagtgtgcattcgtagaaggcaaagtgcaccttatttgcgcgccttgttttcggttgcttcggtcgagctggcagtcgatgaaacgcgtcttcgaggcgtgaccttcttcttgttttaccctgtccacagccctgcaa

SEQ ID NO: 2693 - DNA, 2161 bp, Toxoplasma gondii
tgtttgaaatacgtcgtattacgtctcaaccggaagtgaagaaagctttttgcacgtgtgcctttggtgatcgtaaaagtttatcagcgggtgaacatcagcttgatgggtgtatccaggatgatgttggcgagtcgaacgccaagtatccgcggaacacatttgcagtcaggagtgacggctaacgtaccacgagagtgtgtaacagcacaaatgagaggtgtcggggggtccagggtcctccctggttgcacaccagtatttatctcaagtgtacaagacgatgacgattgcctgggagtgtacatatgtaatacgtagccgcgttcctgtgcaccttcgattttgaacgagtttaccagtgttttcactccactagtggggtagagatctgccgaaagaaccttcaagcggtggtttctatgaacttctcgtatgtttcttccgcacacagtggaaacggtcgtgcaatgtgtgtgcggtcgagccgcttaggtggccagtcatacttgcacagaaatacaccatgatccacatgagcagtacatctcagttcccatgagcgagctccttcgtgattgaggtagtatgttaattttgcggcttcacttcggcaacatccgcgagtcgtcaattgcatggaccacaagttgttgttcagagtttcatttgggaacaaagttagggtttgtatacctactccccagaatgcaggaggcctccgaccttcatgactggcgagggcatgcatgttctacaagaagcaaatgaaataatgcaaccccgtggtgacgctcgtaatcctcatctcggggggcacgttctccttgagtcgactgcctcgaactaactactcacgagaattacttacaggcgtaacgcggacaggataccgttttgtcttttcgtaaggatagtaacggttgcccggtagatagcgttaggttcttcagcaatttcgagttgtcgttctcccttctgaaggaacttcgtttttgccgtggcccctttgttcagagctccaaaaacagaaaacagtactctagtgaatacctctagccgtttccaggcacgtatttattatctctcgttagtggtagcgttcagattcccgtatggatgtgtctcttcacatgaaccgctgcacctgctgtagtcgtcgaagaaaaagtttcatcagaagaaaatggtaagggaagcttggcaagggctcaagccctctgcaaaaaatgacggctcttttcgtgacccgtcaagaaaaatggcttgtttatgcggactggcatcgaggctcaacaagtaaaaagcagacggtcttttccgtcttttccgttccgcctctaaggggaactacgttttttttttcaactatggacaatattgataatggatgacggaacaggtctccccatcacagcgtgcagacaccgcaaagatagtagaagtgcggtacacggttcggatgtgtacggccagtcacttttgtttgtacaaccaaacgcatctgtaatcaaaatgttgcttatctttcccatagcaacaatgggtctcctctttggttgctccagctgttgttttcgggatccggtagcgcactcacaacgcagtgaatgttcctttgtaaaaaaaaccactgttccgggaaatagaatcaaaccattttgtggggtggttgcagccacagtcccttcttcacgatacgatgactgccaagcgcctgaggcagccgcctcgccacgtggacgaaaggtcggtttaggtgacttgatctccagtgacagttgtacgtcaaggtcttcgcttccgacctcgtggcatattgcagcgcgcccggccaccaacataatctaatatgaagacaccggcaatctgcacgccgtaccccacacgttaacaatgcgtccgcatcgtgtataagccgcactcaacaacgtacttttccgcaactatggtgggcactagggcgctgtgtttgatcccattgacaactcgcgggccgatcttgccggattcttcaccgaagcgaacaggaaccacccgtcagcttgaaattacaaacggccgtttctctcagtggtgaattacggcgcttttttcttgttcgtagaccggggaacctcgttcggcgaaacgtctggactatcgttttcccgggacacaa

SEQ ID NO: 2694 - DNA, 3039 bp, Toxoplasma gondii
agtcgcctatcattcccttgaatatgtgctttgcgtacctatttgccatcgccggtcaatgatttagctttttatgtacatgcatgcgtggcatgtaaacatcgtcaatagaaatctaaagagcttttgttgactgtatgtgtgagacgtagagatcatacctatgtcgtgcattctaattatcacattaacccgatggcctcgactattacaggtactgcaagcaggcagcttagaccttttgcggtagaatgactgctatttgggatgcaggtaagcaagctcttcatgactgctgtgtattggtactacgaaataggatatcgctatagttcctggtaacatgctgcctgacacgtgtacccctcccgaatcctgccgttgtagtcaatgaccttatgcgccgatatggtgactcttttgtatcagtatatgatggaggttcgggagttggagtgaaaaaagaaatgtgttctttcatcatctttcctcctggtgcgacgggagctacttgaaacatagagtatgcaagggttaggtgaagaaaggcactgtgctagctgattgtgttctctaccgtgggacgacgattacatctgcgcaaacgtctgacactaacggctcccaagtctcaacaagtaagtcgtactgcattgcatcgagaggggtcgatccaaaatgatatcgacgaatgacgaagtggcttcatgcttctcacggaaaggccccgcaatggacagctagaccatccttgaatcggatacgtttgtgtcggctacacttctgaatcgtcaaacacacacaggtcataatgcaccggtactctgctgatgggatagcggtgcagcagcgcatagaagacatacaagtaactgcctgctggagacatcgcagcaattttgagaagatttcgaagtgatgttcttctcggaccttgtcccgctagtggagctgcgattatggacaattccacatatgccaaatcacagaaaagggtcccctgggtccaacgctttcacaccgtataccgctactgttaaactgcggactgcctacgctcccataacctttggaatctcccttactgggtaaacgatgtccggtgccgtttccttggtttttccctccggtgctttgaagaaattgctagtaagaggtttctcgttgacataattgaacctcggcttatttatgcgggtaaaccggcccacgccctcccgaaaataatgcgaccggttttggcagcagaaacgtcaagagagtttctttgcttcaaataagccataaaaaacgaaaatatgtggcaatttcctgtacccagttataccaagctctcaaaaaacatgaacttgtgtctctattttgactctttccgacagtttaggcgttattcgctgtaccttaacttacaccgcatgcaaagttgcaaagtcgtttgtaggtacaacgtgcaccactatctacctggtggatgggatatctgtaacgaccaaatccatactaaataaccaaacagaacgtaaagcaagttaccccaagtgctacgaaaagattgctcgaacaaaaaaaaggtcggtgcacttcgacaagggatcatcgactagaagccgacggagatgagccaagaaaaataacattgttgaggccaccacctgttaccaaaacctcgtttagagaaagtattgaaataactcgccggaaatcgtagcaaggcaaaaggcacctgaagatgcacaatggtatcgctctaggaactgctggatacaggtgtttactatggtgtgactccagcaggtacatttgttacgcccctttcctgtaaacgcgaacatggttttcgccacagcatgccgggaaagtaaataattttggcgcgatgcgaattcaggctactcgattgaaaagatcccccactccaggaatgatttgaagtagtttttggttctggcacgtagtcttgttgtgagcattgctgttccaccatacaaaagtgggaggccaaccgaggtgatggttccacacgagccgggttttctttccattccatccactcttcttaatccgaggtacctccgcggggagccccattccgttggctctgatcttcgactcctagatcgagttcgacgcagagttcacagcgtttcttctcgtcatccttacgggatttagtacacagagtttcagatagctgaatggaaaagagtgaaatgaaagggaatcaaatgaaatgttcgtttcagcataacgcgtcgacgttcttcgatgcgctgctatagatgactcagcagttagacgcgcgggttccaaccgcgtcccttaacgagaaaagtgcgagtaccgttgacttccgcatgacaacatgaacgacaggagataacttggggcagttttcagtcgcttcaaaaggcttcctgccacagaaaggagacgcagtagcgtcaacaaagcagcacgcgaacacgccgcaacacgatggaggaagtgctttttgcatgcagtgcaagacaatactgcggcttgactcagacggacggccggacgcttgcgtcgtcacatagtgacagaattaaatttgacaggttttctgagtttctgagttcttgtaggcagaccgtgtcgtcagccgagtaaatatcgcgattttatttctcaattctcctgatgagtctgcccgtatggaaagagaagaagtattagaaggaccgccgacggggacgtattgactccggttcgaatatcacttgaatgcataaaggctgcttcatacgcctggcagaacggtttggctcccgtgaaaatatcactcagatgcataccggatccttcataggagagattgccagtcatatactcttgtgggacgtattctgtcgtttcataaccgccgaaattcttgaaattcttgggcggcgctgcctatgcccgaccgcaaggtcgtatgcagccgtgtaatcatgttccatttcctcaggtagccttcctttatctcgatgtaccttgattgaactctgtcgctctcctgctcatcagaagaca

SEQ ID NO: 2695 - DNA, 1351 bp, Toxoplasma gondii
gtcttccatcgtctgcggaatgcttcagaatctgcggcagaaatgcgccttggtcgatccaaaggaggatacgggaaaccagtgtttccggtgctcctgagactatcgtcggagacgaattccgcctctgatacacccacgttgtcttcggcttctctagattttcccacctcctgatttttgcttggcgtgcaaccgcgactggagggttgattttggtctgtctgtaggagaggttcgttgggaggatgctggtcgctgaacgatgtgagctctcttgtcgcgtgtccagaagatacctgagtcgtggaggccgccgaagacaaatttgcaactgtgtgtgtagtggcagtcttccagaaggagtatccccttttggatggaaacgaaagagcggcaagcggtcttcctggaagcatccccaccgtccacgtaattcgcgccattgcacgaggcctggtttgttgtgtcgcttgcacctggaaggagatgaaattttggtgtagtctttgcattatataaagaaagagccaccagttcgcatgtactgtgcttccagggaagttttcctcgtccggtaacgcaattgtcccatggtgacttcatcagaagggcgcccagagccgggttgctgtgtttgtggactttcaggtagtgatgccgacagtttagaatgatgcacaaagagagacattaccaaaacgccaagacgtggcaacagtctcgcgagactcgcggacttgcctggcattcagggtcttcgtggccccgggtggatcaacaaaatattcggcagttcgtcggttttgagcgccctcggcctctgttcacgtttgcgaaatacggagtcgcgtgcgagagatctgtttggattcaccatatcgttctgtacgagaaaacgaaactgtattcagctcttggcaaatagctggactctgctgttgctgtgaccacgagcctgctgccgcagggtagcctacagcgtgtccggagctcacctccttggaagcggaaatgcctctgagaataaatgcaacaaaacagagctttcattctttggtttctgtactttcctctccgttgtggacgatgtgccatgctaatcggaagcatgcagtttcgaagatgagagccatcgcgcatgcagggcaaataacatgcacgctgcacacttcactcctgtttgatgctcatcttgactctgatttccctcgtggtgcacatttctgcgaaagtaggccaagagattatttttcacgtatgaaaagtgctgagaaccggtcgtgtgggtcgctctgcggtccatcatggctggtatagctgtgttttacatacagtctttctgtattga

SEQ ID NO: 2696 - DNA, 1641 bp, Toxoplasma gondii
acctttttggagatttcgccaaggtcttcctagtcagtttagtcaatcccgtctctgtcgactcggttcctgcacacaatttcgtgaagacagatctatcagggaagttggtcgaactaaggatcatccaatccacccgtcgggagcttcaggatttagaactgccaggcgagtactgaatggaggattctctctcgatgtctagttacgcgttttcgtccccgtcgtctcaaccgtttgcatcatagcgcctttttccccgctttctgacgctccgttgattcatcccttcttagttgatttaaaagacacgccgcctgcgggtgcccagaagtctgctttttccctgcggggggagaaagcgcaaagaagccatgcggaatgtgtgcatgcacttttacacccaacatctcacgacacgagctgacgagcgtgctctgccgttgagctactagccttttttttatttactagcgcctggctggcttgaatgaactggaggaaacgtcgggagtcagcaaactccagaaaggacatgcaaactagaaccataattgaacgaggcatgcagtcagagagagaaacatgtgtgtacacatactaccctgcccaagttcaatcgattctccgtggcaacaagacaacaagacatttccaacgcctcaactgaaactcgtgagccttctcgtagcattcatacacaccgccgaaagagaaaacgtcagatcaccgctcgacggcgtattgttcgtctccagttagactgcctccgcaccggagtcggactgtagaactcccgtaagactaaaaagatgtaactttcaccagctctcgagtctgcagcgaagctccgctccctcaacgccgtcaggcggcgaaacgggaagagctgcttttcctggagaagagacagaaggaggctgacaaaccgtccgcgccagtcgaatttcttccacttctcgcgaggaagctgttgagtctggctcttctgtgcaaagtcccagggagaagtccaaagtaccaaggcgcatccagcgtggagtttcaaatgggtacgactcaaccttcgacgttggtaggttaatcaaatacgatttccagttatcgttattcgaaaagacgtggagtgaggttcgtagaagacgctgtcagacagtgcccctgcaaaagacaggccttctctcagcgctcgctgtccacgcgttcgacgcaaagtttcgctaggcaggagtctcttttccagaaaacagaaccttcggaaaaagctgctttcctcgcttcagtgtgtgaacgcgtcgatgcagcgaaagagacgcgttttcgaggcggcctttttcgtcctgttttccacgtctcgcctctccgcattttctcttgtccgcgtctcgcgtcgtctaagtgcgcctctctgtctctgtctcttttcgccgactttgttgtcttcggactcgcagactctgtcccctccccaggcctcgctctactttatctccgtttttctgtgcgttttctttcggttccatcgcctctgatcgtgcgtcgtctcgaccgcggaactctgctgctcgctgtcttctggacttctctcccgactcttctccgctcgacctcgtgtctcgcctgcgtacaagtgctcatcaa

SEQ ID NO: 2697 - DNA, 2028 bp, Toxoplasma gondii
atcaacgggctttgccaaacgcttgacctcctccatcatcactttcgcagctctttgaatgccgcgttgcaagggaattggattgtgacctttgttgacgtgatccacaccctgaaagcataccaaccagctcgaccacgatcacaaattcgtgttgacgatcgtagcactgcttccggcttcttccggcccctcctccttcgtggactgtttacccgggagttgacgttgacgccccagacaatcgtcccacgagacggtgctcacctggcgtgctatttcagctgtgagaatagttgtggaggatgtgccgtctcctgcccactcatccgaagtcgatgcaacctcctgcactaactttgcaccggcgttgtgagcgcgactcttcagctcaatatttcttgcgatggtgacaccatcgttgactatcattggcggtccatattctttctccagtaagacgttacgcccccggggtcccaatgtaacctgtgaagtccacacgcgtcctggaacaagagaaaaatcacctagtcttcatgggcatgatgaatacacgtgctgtgcctgtttcacgacagtctccgagccggctgatgctgtgtgctggtcattctgaacaataataacacttatagctctacgcaggaggttcacagtactgcacatctaccattctagtaaccaaggccgttcttgtcccccagaactccgggcttcgcgtgagttgatcatccggagaacagagcatcagccggagttcctccacacatattagtccatcttcggaataatgcttaccctaactgctccagccacagcttcgataccttcaaggagctgatttcggcattcatcggccaaaatgagcctcttcgctttgcgtgcctgctcacacatacaaatttcacacaaccaccaatgcagttgcctcagcatgacgctgaggcagcagttatgcaacagagacaagttgcttcttcgtcacagaaaagaagtcccacagaccaaggaacgtcttgttttctaatttaaagcttgattctttgccactgccgctaaaggacgttagtatttgtgggttgtttgctcaccatcaaggttgacggggaaccttgccgcgtcgaaggggctctatagttgtcattgataactagtggaacatgtttgccgcggacagtggcaggcgagacagagtgggacccttcagaggatggggaacgcaacagggagtggccaagaaaagcatttggggctggaagttgaaaacatgatgcaaaactgctgataccgaatcctacgagaatgagaggatacggcacaaaagatgcaagtgccaccatcatgccaacctctggttctaaaagcatccaatccgttgaaaacagcgtctcgcctatgtcaaatatgcagtgccttcattgctgcggagacaccttttgctttgagtttcttcccacgggcgacgaggagacgtgtctggagacaggacggccgttgtcgcatagcttctgcatgcaaagtcgcgtgcgccagccgaagacctgtaacgacaattcagcgttcaccgtcggttccgcgaacagtcgttgaacgtcgaagggcgaacgccgcaaacttaacgggctcaaatttagtttcttctactggtttttgcggtaatttatcgaagtgccattttgcgtgtcgctttttcggtgcaaactatccaccgtggcgatattgattcctgcgtggcgcgtgggtacaccacagatcgatacccgagtagaacgttcagtcttgctggtcattctaatgaatgccagaatgttttgaattcaacagagttgtcgataccacttctaagaaccaatctgtctggtacggaggagcaactctgccgtgcggaggctgaggattcagtgggcatggtttaacttgtggggaggctggatgatgaggcggtactaacagcagtagggtgtcctgtgacgaacaggaaattggactgacccttcgacacttgactgcctttgagaaagaaga

SEQ ID NO: 2698 - DNA, 2162 bp, Toxoplasma gondii
cattccctccgtggcgtcgcttcctgagagtgtcgctacttgataatccccagagctgtccgaaatctgagagccgcgacaccgtgcaatatctgcccaagggcgacgatggtgtcgctgtgttgaacatatgtccgggtgatcgttcccagagatccactgcgaagaggctattaccacggatttttcactaagaacacatcagaggagcgactccacagtaggactcctctcacagtggcaggtaacttggctgcagtgtacctctgagagactgaaaatgcatacagtttggacctgattcagagatagcgtttacactttaaaatgccttgcatgtcgagatgcattggccacagaacacaggagccagacctctctagccagcgcagctgtctgggtgcgtgggggagatgcacttgtgccatgctagtaccagaccgtcaccgcgtcagactgtcgcctctcctgggcccctagtgtggaaccacttcttttttcagttggtccagtcactgacatcaaacgcaggcatcttcatgaaacacttttgtacgtggaggtggcgatcctttttaccttcaccatgatatgaccttgagctttccactctgagactacgaatggagatattagctagtgagtgtctctatttgagaacgcagtagaatcttcctgacatctaacgatccgtgatgtagtgtgctggcactgggtatagagaatcaacgggagattttagttccatgtattgtcagcgatgcacctatacagaaattcactatcatctccttgatgtagatctgaaatcgcctggcatcggttctgaaacaacaccctgaaactggcatttcccgcgacgcccactgctgtaggtggtgggtgtcgctccgaatcgtgacaccagcccgacgcagctttcagaaccactttcagctgaatcgctgttaccttgtgtgcagctccactctatgtgacgccctacgcattgtccgagtgaaatccgtgggcatccaagagtcttccgcccgcaatattccgtttacagcaactgtatgcgtcgcgctagcacgggtggattgctgtaacctggcgatgcacgcgcttgcgagtactgaaaagaccaccatctgatggaatcctcgatgtccaacgctgcgtcttgaactccggcggcactcccgatgaacgaaaaacctcgcccgcagcgttccggcgtcgagtgcttcctgagctgtcgactggacgatgtgtctagatacaaatagattcgatcattcgggaggggaagcgtgcgaggtgatgcttctctcgattattatactacggttggacaggtgatgggctaactagagaaataaatgctcttgagagttaaacttgtctatcttcctgtccggaaagtatgcgtggccttggaccaactgcatgtgcatgctcacacccatgcccgtgcctaacttaatcgggcaaaaactgcgtctcgttggtgcactgggagtgaactgaccctgtaaaaattaaaaaaaggacaattcagagggtttgaaacttcgctgatgaggcaattcttccatggatacaccgacgacttcctaacatggctgtctgttgctcccgatgcagctggctgttgcaactgcaacagtgctagcgtctgcagaccttcgcacgtctgttatcgccgatttcctctctgtgaattcggctctatcgggattggatctctctgacgcctggaatcgcagtagttacctcctagtgtaggtcttggtctaccttcacccacatttttctgttcttttcctccacttctactccgatgtggctggctggtaaaggcgaagtgggtcgtatccaaactagtttccctcaaaatggggcaatttaccgaggtgaaagctacagatatctactagttgatcggaccagctgtctagcacaggaaatagcgaaagacacgacatgcccgagagagttgtacaccgtctaatcgtcaatcaatgggggcagggtcaagcagcctttctactttgttggaatcgctcaaagtgactgaagaattttcatcggttcactaattttggttcctagatccgaaaccagttgaccgaggagcactctccacacgtggtcgaacggagaagcccacgggaaccaga

SEQ ID NO: 2699 - DNA, 4851 bp, Toxoplasma gondii
ctttcttctgcgctcacctgcccactgtgtagatcgtaaacgcgtccttcgcaaacactcgcagctccagtcgcgcctcctacgcttccgcactttcttcggcgcctgccgcccacgcgagtctccccagccgtctccatcacggccgcggttccgatcgtacacgccatgcgccctgtctcggtgtggatgcggcaggagagcagagtggcgcttcccctggcgaatcgcgaaagctcgtggacaggtggcctggaacacgcgctcaggggtcgcatgcatgcaggggtcgagggcatcgagcagcccctatctcctctgtgtttctggctgccttccgcgtgggcagatctgctcgggaggccaccctggggcaaggaaaactccttccaagtccgttcgcttcccttctcgcggccctggtctccaggcgtgtctccgaagcctccgtcggcggcgaggagtctggccttgcgcctgctctcggatctgtcgcctggaccttcttcgctgtccggcacaggatttagggccggctctagagcgaagggagggggtgagctgcagcttcggggtcgctcccgttcgttcatggcctcaactggagacagcgagggcgactcagggaacccaggacacggtttccggccgctgccactcggcttcttgctccttgtctttccgcgtcgcacgttcgccccttgactccccgcggcacaggcgctgagacctatcgcctggcctgagaaggcttcggaggagctgctcaagccgcgcgcgctgccgaagtccgccgcttctctgcttccgagagaccccgccccagaggtccggttctttacgttgtttggcgcacagcctgtttggttccagaggtagatttcgtacgagtcgaggtcggagatcgttcgttcacgggatttcgaggccggggccaataccggcgtaagcgccggtgagttcagcaacgtggagtggacatccggttgagcgcggggccctagcgacggagacagagcctgagaccgactctgtctttccttcagtctggttggctccttctcctgacgggctgagagcggggcgctgcagctcttggcgtgctcgtagaccgctaccctgtccgccgaggcggtgaagaagcacgaccgttgctcgagaaccgcgtcgagaccttcgtggacagagaagaatcggggctcgaaggtgaagcccacggaagcggggaactcttgctcgtcgttcaggtccattcgtccttctccccaggcttctccaaactcttctttcgcggaaacgccgcgacgcgcgctgccgccagatcgtctgcgggtcgacacgggtgcctcaccgaaactggctctgaaattgtcatctctctgtacctcagcgccgcaaaatccagggccttggctgcgggtccccgacaagtcgcgtgcggagtcttccacgagatcaaaacatggtggcggatggtgccttagagcctcttgagggtccgacagttcgccttgcgtgatggcgaacgggggtaaacgcgaacggcttgtagaacgctcgcgggggacatccgggctgactggaccgacctcaccattgcatggcccacacgcaagttccgagacttccctggctgtcgaccccgctcgcgacgcccggcgctccgaaacaaacgacgagcgccgcgaacgccgccgctgcagttccgcggaaaaaactgactgaaccgcgcggcacgaacagagcggcgactggtaagacggatgcagagccacggaaagcagcgagtggtcgctgcttgggacttggaacctctggcacctcccggttgcccagttgtggagtgtccggacactccagaggaactgcctccgccacaggccgctgtgcggtccgagacccagtatcagcggcggcgtacttggcggccagccttcgatctcgaggtttcccgttatgaatggcgatttcggcgttcgtcccaggaggtgcacaggtaggccattttcaagaaacgaactccgaaagaaatcgccttctgcacgcagctcggcactcgatccaggacagcctgaacctcgtggcggcaccgagtcagcgccagacgcggcgttggacggctttgaatctcgagcagatctcgcagctaaatccgcatctcggcagcgaggagtgactgtctcaccggccgctccactcggtttccgcgaagccccgccgtctggggactcgcagccggcgtcctccactttgaggggttgcgagcaaggcaggacatctggcggcacttgtgtgtgaggccaaaagtggaattgccgatctagccaccaggtgtaccagagcggatcgagagaggcgacagtcatggcgcctctgcatacgggtgagacagcagctagagcagccgcctcgcgcgggccgcaataggccagaacgtaccggagcacatcttcgctgagaagtacatccagcgcagaccagcgaggtctcgccttctccgttttctctttttctcccaaaccgaaccaagcgcagtccggcggatttggtagctgtgcgcgcaccaagtgagagtctccagcgcgacgcaggttccgcgggggagtcgagatcgcccggtgcagggtgctcgaacttcgcgtgcggctcgccaggccgtgtctgcatgcgtcgagttgtgcatctgacaagagggaagtgacacggggagacaccaaggcggcgcggcagagcgttccccctgccgcctcgtcttcactcttcgcccctcgaggcgaaagattttcatcggagacagacgcgggaggcgggcaccggaaagccaatgcatgcagtggagcagacaggaactctctgccgaaacgatctggagactctgacgcagcgaggctggaggaaatgaaacttcgctgccacggcattgggaggcagcgccggtctcagtgaggcggcgacgagggggaaggccagaggcgatgcgacactcaaaaaaaaaacagctgctcctttagctctacagaagcacgcgtggtgaagaaaagacactgagaaaggaagaggagaagctaaccggcatttacacacaagagttggagtagctgtagatgaatggtcggcgacacttgcaggacggggaacaaagggttgcctggctgcgtgggatccagtgagtgactctctggggtctttcccagaaaaccgtgttctacatactcttgctacgtctagcatacagcaaggccgcggaagcattccccgtctcaagaaggaaagactttcgcacactcgggcaaggtggagcgaaactgacgggcgagtggcttcgtttttcaacgaccattattctcggtgtgaacgacggatggtcggtgtgctcgctggtgcagggcatgctggtgacaggatcagcggggttttggacaattcgaggtcgcgcagagaagcgaggagacaaacggtggtgaagatgttgacgagagaaggaacggaagaggaactgacggctagacaaagcgagaatgacggtttgcacgagcactgacgacccggaaagagacggctggggatcgtcagtgcaccgaagacttcggtttcgtcgcaaacgcgaaaactgggaatgtggcgaatgttctaaacgacgctcatttaccagacggaatatactttcacgaaaaacgacctctgttgctggaggcacctaggcgagaaagcgtgaagacaaagcgcggacggcgagagggcgtctgtggcatactttcggtggcgtcggaccagtgaaaagcctacacacgggacttgtgtaaggaaacgggaggtacacacagaaaaggatcgcaagcaagcaactcattgtgcaagaacctttagaacaggctcttctatcctcgtctccctgcccctgtccctccgcttctgagaaaaggtgtcttgcggcggtttctccgtacgacaactgagagctgcctctccacagtcttgtttgggataattcgcccacgatgtgacacatgcaggcgtttggacggttcctgtgcgaaattcaggactcgatctgtcggatgtgctctctcagatgcagcgccgagtcttccgctgacacagacgccacacgcaaaatggcgagacaccggcacccaggctccactcgagtgcttgctgctcatcccgccgtgctcgagaaggcgtcttctctccatgtcgacaacttttgtcggaacatgtatcctctaccatccgttgaatcaaggactgaacgctgtcgtacatctttgtaaatgcgtgttttcgattcgtcacggtcaccccgacttttgtcccgaccaaacccacttgctgcacagttgcacaccgaacagtcggcgccgtttcagtcccagcacttttgttctcgtctccagagacacactggagagaatctactgcatatttcttgtcacgttgcgtgtccgtcgtggcgccatttcttgaaacaggcatcttgaggcaaatctggacttcacgcggatctcagcgatagtgtgcggtgcacgtacggttcctcacaggggtggggattttcgcggccccgtgcacacctttccagcgcactttatcgtcttgatcgtgtaaagatgctttctccactgagcgaagagtaggttgttgagcctctggagctcgattcaggtgcctcgtagaccctctattctctccggttcagaacggctgttcgttttcctctttcgtccctacacgggaggtctttgtgaaaccagtgacacttggcggcgctggactctgaaagacgtcagcctgacgaactcagctgcctggcaactcctctttctccgacactgctgtgtagtgagtcca

SEQ ID NO: 2700 - DNA, 1650 bp, Toxoplasma gondii
gacaccctggttgcagtggacgaggacgtttccactctcgcggattcggacgcgctccatgagctcccagaaacgctcaaagtgccgcgcgaggcgttccgtcccgttgtccaccatgtccaggcggtggtactccagaggcctgaaggcccccggagccacgcagtcccccaggggcgaggcccgcccggggccgcgggccgagagggcctgccgagggtggtggtagttcgggacgccgccgctcgcaacctcaggggtgcagttgatcacgtacgcgatttgccgctgccgcagcagcggcaagttctttgccaagtctttgtccccgacaaaaatccacgagaaggaacggaaatccagaggagggtacagcgaaatgcgcgcacgcggaggcgacactgccatcgcgcccctgcggaaagcggttcggcgggtggggcagaggcaccttcgacaaggtctgaagggggaaggagctgggtcgagtgaacgactgttttgcgacatacaagaggaaagagactgggtggcgaggagagggtgagaaaaggcaggcgtggatggtgtcggaatggattttgggaggtgatagacaaaaaatgcaacggggaacaactgtaagacgggggaaaagggggtttgaaagagacagacggaagagaggggccgaagaaacagaagagacacgcgccagagaagaagggggcgggagacaggagattaaacggttgaactcgacgcgttcaacccagcgcgtctggcataattgaaggcgaacagaaacacctgctgcagactcaatctctgtcgttaagtatgtggcttttccgcgacgacgcggagagcagcgatacggacaaaaaggcctcggcttcctcgcacgatggaaaagaatctggcgaagggaaacgcacgaacggcgcagcgcgacaggtcccagtaagtttgccttttttgaaacgcgacgggcctaagaactccgaagctggccgtgggtaagggacgagactggcaagaaaaaaggtacagacaaggcgaatcggtggatgggtcagaagcaactcgtgaaagagacgtttcgccacgggtcagtccagtctctcaagcaaaaacggggaacgcggaggaaggggcgccgggttcagggagagacacgcgtcaagagaagccgacgcgacagagaggtccgttttccagaaaaagaaaagttaaactggagtaagccgcgtttttgtgcgtcatgtggcaggcgttgactctgtcgtcgacgtccaccagctcacgcatgcactcggttttttcacgaaaagaagtcttgcccctggccaagccttccacgcaggcttcctcgttcggccgcccttaagttcgcctatcctctacgattctttccccggcagattttgcgtttttccactcgtaaaaaccgttcaacaaccctcaacttgtttcccgagaggaccgcaagtcagtcgtgcggtgtctgtacacccgaacatctcctgggcgtatcttgccggagccgactggggcacccccgcggcatcgcacaagtctgagtttgattttccgcgtttttcgtgcctgcgccttcgcgtctcttcgatttcctctttcttgtttttttcccactaatcgccacgacca

SEQ ID NO: 2701 - DNA, 2427 bp, Toxoplasma gondii
atgcatgcagctgtcggttgacaaatgctcaaagactgtaagggaggtcgatgtatacgtgacgaatgggggaggaacggggacggggcaacgcggaggcgagaggaggaagagacaagctggaaggctgaaggggcaatgcaactgctattgaagagccacgaagagccagggactgtacagactgcagcagagcgagaggcaacgagacacgcatgtgcgctgcgccagcggagtgtacgtacacaacgccgcagacaacaaaggggcccaactgtgggagggcgtcagcgctgtcgcgccagtcacaagcatcttcgcctgcgtgctcagaagcgagggagagaacagagagcctagaacgttggctgggaagacgagagttcagtgtccgtttttctgtgtcctaccgtgaggagcaaagaggacattcactcattcaccaaacaggagaacaagcagaaaagccttacttcttccgctccttgttgccgaggagactgagggtccccagtgcagctttctttctgaacatgatgcaagtctaggatgctattctgaagacgacgaagacttccgccagctaactcgcgcagcgtcgagtgtcgccgcagacacagaagcaagttgccgcgaaaggcacagagggagcgacgcctggaagccaacaggggcgtggacagaaaggacgagcccaggacggagaccaatcaaggtcctccgggaaggacaagtggaggcgctcaaagaaaccgaaggacgaggcttcactccgaggcgaggagaaagacacgaggaagctgccagaaaaggaagaggacaaggaggacgaggagggagatgcgcgcgctggtcagggaaaagtcgagagaatgtcgagatgctttccagcgaaggagcgggcggcgcgagcggagacgaaagtgacgcagaactggcagagtgagcaaggggactcacttccttcaactcccccgcttctcgcctgcaaagaaacgaagcctgaggccgctctcagaacgggagctcggcgcaggaccccgacaggagacaagctgaggagacacttgctttctcgagtgacttcgcgtgagagttccttctgcctctctcgtgttgtctcgtaaacgcatcgtcgggaccgacaaacgcgaaaccgccttctcagatggcttctcggcgtttggtcagcagccaacttcgggtgtacatacacccgaggaagctaccctgtcgagctctgcagtgtgcatacaccgccaggcgtcaaggtcagcttcgcggagcaggcggggaaccgcagaagatctgcgcttctggcaacgagaggcagcgagaggcagcgagaggcagcgagaggcgcgttgtctctggaagctcatgaggcggagaggcacgaggcggacgaaatctcagttcagtgtcaagacagcttgttttgcgaatcctgtttccgcggaagcgtcgacgcttccccgcgacctcgaccaggccggcggcccatctgtcgcgaattcgggagagtttcggcgcagtcgcagcacggagacagcttcccttcctgagcgtgaaaagtcggagtttcttggccgccaaatgcacacgcgagcgccgctgcatgcgtttcgggacgaaagcctccccggcggcgaaaggagaaacaggtggggcacgcctcgagagcgacgaggagggccgcagtcttccctcggcaggtctctctctcttcgattttctctttttctcttttttctttgcttcgcatccgtcgacctacgtctctctcccacacgtccggagaacaggcgaaagccgcgcaggcgtctctctcagtccttctgcggtaaaaagcgcaagcggtagtctcacggtgctcgcgtgtctctttcaccagttcacgagatctcttgcacaatttccgagtttccaacgaacaatagaggtttttcgtctctgggtagtctccaagagacgccagactttctctctctccacccgtttccgcggtgcagtctccctgcccctactgcttcgcttggtttgtgccgcttccggaacggacgtgagcactttgcttcctcgctttcgatttttcttcttttgctgctctcgatgttttcgctcaacctctgtctctttcagtggacgcacccttccggttctcggccgcttccgtagatcgtgccctctgcgcttgtccggcgtctgctttggctggcgtttttccctgcgctctctctctttttcgtcgctgtgtggtcgtcccctccagtggtacgctctccccgtctttcaacgcaagtccggcgcaggtgtgtttaccgcgaaattcgctgttttccccaaaccccagccttccgtttcctccgtcagtccgactcctgtttcttctctctcgcctctcttcacttcttcgtttcgacaaca

SEQ ID NO: 2702 - DNA, 3287 bp, Toxoplasma gondii
ggcctcacagacctcctctgcgatagtacagaacgaaagggagcatccgtcgcctcttggctctgaggagtgttactgcgaacttctagggactgtcagtcgcgcagtcgggtcactgccgaagggggcattgctgagtcctggatcctttgatatagtaatatgcttttcagttacgaagtggattcatcttcatcatggagactgtggcattctgctgcttttctcgcggcttcacgctctgttgaagcccgacggaatccttcttctcgagcctcaggactgggcttcgtatcgtcgcgcaagacggctatcttccgacttcaagcagcagctgcaccatattcgtttgcctccgaagacgtttacttccattcttaccgcaaacagtggcagcagaaaatcgcagtgctcgtcttgtgtgatctgtgacgcgtggtccaacgatgccaagacagcggcttcaacggagttgtctgcggtgacagacaagcaatgtgaacaatatgagccgaagtctgagacagcagagaacggttgccagtgtgcctgtcgcatcgtatcttctctgattccaccgtgtgatggatcatcgcaaggtttgtcggctaaaaaacctgtccagccgtttgctctcatgtgttcattaaacccgtggaccaatgacgtccgaatcagcaaacaccagcaaagtggtgcttacggggggacgatgtgggatgagtcgcgagctgccgcggacggaagagcggcgccccgtccccatcagttgtcagtggatgaagtatgcaaacatggtaatgttactgccagaaagagcgacgaggggtatttggatggtgtcttcgatgatgatcaacggtgttcacaggcgcctgctaatcacgttttccagaaaggttcagaggtcgtgaaatctgctgaacccaaaatatcagacgcgaaagctgtacgcgaacccaagggtagactttcagataggcgtatccttgtgttacggaagagcagcagttgtttctccgtgtgctgctgcaccttgaaaatgttgaccagccgtgctgtgggacgttgcggacccaaaccaatcaattcacaaagccaatcttgactgtgccgtcgttcccgaggacgaaaacagtttaagggttatggtaataccggtttggacgcggtgattgtttcttgaaaaatcgtagctatacatttttcaatatgagcgcatcaaagcctgtttgtttcccagcattcgtgataaacgtgagctgatacggaaacagtcctaatgttgccatgtagcgggtcgagtttgcttttcctcgagacgtcgcctctgctcggctgcctgctaacccaatctttgctgctacttcgccctcccagcgaccttgtcaaatctttgcgcgtagttagctcactgagtactgagagaggggcgctacgattggagaacgttcagtgtatatgtgagtctattccgggcgcgcctggtactttatcggtgtgctcacatctagtagtctcataatttttgtatctgtgttgcagaaagcgctggagttcgtgggtgttttttcgtggcttcttctctgcaaacagcaggcaacgcctttgtggcgtttgcctgacaaggcagtcatgagcctacatggctgccgaccaggaagctcgccgcacgcaaggatgcggtgacacggacataggtttcgaccaccacagtttacagcgtgccagcgaacgggttcactaaacaacacttcacttgctggaagctgcggagtcattaggataaagataggctgacgggcccacaagcaggctgcaatacagacaagcctgtggcgcgtctgtctgggaacctcagtcagagccaaacccgagaaaaaaagcgacagcgcagtgccggactctgttcacagagttacactcaatgaatttctgcgaaaacgcgaatgcccaggtggctccactgttgctcagatcaaaggagtccaggaaagacgcaacaaaatcagaagtcgcgctagttcttcatcaaatgaattccgccccccctccctacaaaaactgtactggtacaaataagctaccatatgctccgcgactcactgtcgttaacagtcttaaagccatagccagacagcttactatgccaacatagaacatgtagattttcacgtgaaacgagttcatgacatgggtgtctaaatttaagtctctattttgcgctggcctctcttcctctcgccctaggacaggaggtgttcaggctgttcctctctttttagatcccgcactactaccgtagccccaaaacaaccacgcgcagttccgcgtgactccaggccactgaaactaagatgttcgtcggattacaaggtatagcttcactctcgggggctcacatttcggcaaatgtcacttttctgacctcaggtacccaaccttttatatttctcctcttataatagtagttccggttctctgtttgatgaccagatgcagattggaccatgaaacccacatgatgtatcgagccatgtacatgttcgatgtggtcgcgtgaacagtgcgccctttgaccaggcaccacgtacatttttctcatgaatgacgacagtgtgagggaaataccatgagaagacaggacagcttggggttctagcagacacactgactgataaacgtcgtcacaaaacaatgaggggattcataggggaacacatgaacatacgaaaactgcagaatcttggcacctaactacggtgcagacggagggttgaatgtgaactaggagtcattccttgcagccgtcggcgcccctctcgtgcagatctatttttatatgggctaccattctgtgtgttcgttttcaccgggggtcctagtcaagagacgacaatgcccatgatttcggtgttttttacttaggttgttttgctcaaatgttcgattccatcccaaacacaacaaataatagaagattccagaatcgaacgacggttttattatgttccgtactggcctagaatttgcaagtataccaaatgcaggcggaggtcttggtgctcgttccctacttgcgtgctgccgttcgttgcatgcatgcgtagcccaaccgcgtgcgtcggcacctgaaagacgactgtcagactgcccaacaaaactcccgaaagaccataattccagaggttttaacttttaaggaactgaggctactacgtcagtgtacacgcatctcgtcaatggggattttcatgcgacagcctctgcgcactgactgggatgca

SEQ ID NO: 2703 - DNA, 3697 bp, Toxoplasma gondii
ccaagcatcacgcttactgcgaattcccttcccacttaccctgagacgcgggattccaccgaagggcagcggctggaggttctcccagaattcgtcgctttccacttcgagaagcgccaggtcggcttcgtgagccgtggccacaactctcgccagaaatttcttggcatttcttaagcagcacaaaacacgaaaggtgaactgtttataaatcggtgctgcagcgatgctgtcgcctgtttgccgaaaggtgcccaagacgttctcttttggttgtatgcatctcaaaactaatttttgtgcgagttgaatggatacagccgacacaccagcacgacaaagactccctttagctccagccgacaaatacgaaactgtcgagaaagatctgaacagctaaataattgtggttagacacatacgccgcagaatcacaaagcacacgcagacatgaatacaacgatataccgtcaattagatatacgcacctgcaatatatatatatatatatatacgtagttgtgtgactcggagaatggcaaaacgaaactgatggtttggcgcgtatctttcgttgcttccctatctctcaggaggtcgcaaaatatcagagcgtcctggcggaaagcacttcatgcgacagagtggccatgagaacggcaaggaagggccggtactattttgtttaaagtgcctcgaacttacccatgtttcctaaccagaactcgggttgtttcaccaacgacgtggccattcgtcaagattcgcttgccttcaacgacgaagcctgacctgagaataccggcaagaaaaagagcagatcccttggtttatctctcgtgcctgcagtggtccttctcctgtccaattcgacgatcacgtcaagcaagaagggccatttccagcagtttcttgagtttctgactatgacggtgaacctgaactcaacctgaatgtcaattcgttgacagcttatgactcgaaaggtgttcagtggatgggcgatcatttgggtgtataatatgatcttcttaagtactatcagtggggctattgcacaagcagcatacctcttatacggtagattcgctactctcttacacgttactaccggactggttctatgcatatagtaaacaaacaccgtttgtgactgaagttccgtcacctaactaaaagacatcacaattttagatcggttggtgcagaataacaaacttaacactaattaattgagttaaaatcacttttagatgtcttaagcagtccagtggaatggtggtgtacggtgggaatagagaaattggttgtctgtatgtcctaactggagtcatattcagcaccctacgtatgacaatggcccttcgctccacacagctgaggcagtccgccaacttttacccacgcatacattcgcgtccagtgagctgtttgaaatctctcaaggcagggccgccgcgcggaaatgcttgtgcagcaccaatgtgcaaggacgtcgataaaacgttaggttgtgcaaatctgtctgcggctgctacagctgaaaaatgcatgtctctactttactaacttcacagtgtccttttgcccacactttttcctgagatttcctcccttgtgttccgtcttgcctacccggaggcatctttcggagcctgcatctgccaaggtgaaaagtagtcaggcattgtgatatcgacgaaaattttcacaacgctgctcagggaagaagtcaacagggcatgccggtccttcgcagttgtttgcttctgggaagcggcagcggctgcaagggtctttgcgagggtatttcctccctgcgaattcacaccctctgcagcagccgccgccagttccgttggttggcctgccgcgctgacttggagcagagaagaacctactagcatctccccggtgacttcttctgtaatttctctctcaggtggcaatggctctgcaccatgtgctgatgtagcaacagcggcggggaaagtggatacgaagccatcctcgtgcagcacagtagcatcctcgcgaaggtctcgagaaggttcaggagttaacagagacgaagcctccgcaccatgagcttttagagaaactacgctgtcactggaaatccagctggacacttccaaagccacaaacagtgacagaaggagcaacatcaccccagtccgcgcacgcggccgtcgactccggtggaacgccgccatcgggataggtgacggacgcaacagaagccccaggaacagtgcagatgccgcgcactacagggctttgtgaagctgtgtctcgcagcctccgcaaaatacagaaggaaaatgataatgacactctcccatgggaaactggaggactgcaaagaccaggcagcactattcggctgctgccagtgccgcgaacctaacggggtagaagacactggaagcgaagcagatagtgagacaagaagagaaggctagatgccttgggtgtccctttgcagcgagagcggcaacagactgtggtcacttccacagagaaatagtttctacctgtgatgtagcctcttgtctcaaatggccgcgaaaaagtaacctcgtgttcacccagccagtatagacagtgaatcgctcttaaccggctagccaccctactgatcttcgtttacggtgaacattggcctcttccgcggctaaacttctcggatatcaagtggtagcaatcttctcggtcatgtgggaaggaacgaaaactccagcacatctcagatcctagaaaaaaggggctttctcggtgccatgttgttctataaagcggtgccggaaacgactgccccgcatggcaggctaccaattgagacatctactcacacatgcactttgtctgcttgggtgctggcgaacacaccgccacgctttctagcgtaccgttcccacctcgtttgaaaccttttctcatctactggcgtttcgcgaacattgagcttcgtgtagcatgaagtctttgggaaaatacacggggggatgttaggcatccgcgtcgtcttcacagtcattacccccgccatctttccggcaataacgagggaattgcggtcttccttcttgggaagcaaagtagcgaagtatttaatatagtccttatctacattttttcagaggcctctggggctgtggtcttcgggagtgtcctaccagtcgctggtctctctgccgcttctcgtgggacttctgccgccgaatgcacacagagatccaacggcacttgccgttttttttgttcgaagaattccccattacggagcttgagttttttggagacgcgtcttcgtcatttccgtttaacagaacgcaagaatctcccttacgtatctgtcgcgcatgcaggaaacacaccacggacgactaatcactacccagtgcgtgtgcttcccttcctgtggtgatttttgtctttttccgatgcgttactcgacatattcggtgacactaaaactcctttgttgtatcgcgtgccactgaaggcttttctattgtcaagttgccttttgatcgctcgcaattctcgccgtgtcgtggattgattgcttcgggagagaaacccacaaaaggccaaactcacgagcaaggacagttgacattccgctgtaagagaagcgagaccgctcctctgacttttccatgttgagtggctgttgcgaagacctaggaaa

SEQ ID NO: 2704 - DNA, 2093 bp, Toxoplasma gondii
gtagcaggcgatgttcagcgacggaccgtggagttgcgtgacgaagcgattgcgtcgaacgatccacgcagaagcgggagtcggagcagaggcggaaggcggcgaagaagcgaaggcagacgacgagttcatgcgtctctgttccgcggtcctcaccttgcttagcggcgaccctgacgcgaggagatcagaaaccttcgcgttgtagagacgagagagaaagaagaacgcagctgcgtcgcgagaaatactcggaacgccgtgaagcaacactcggggcggagcgagcgcggggcggtcgcggtcaagtgtacgtacacccgacacagacaccgcctcttccggcgcgggcgcctctcggctgatttcgggagttcttcggtgtctcgttgcaagctgtctcaactggaagcgggagcgtctttggctggggaaggcggaaaggtgaggcgcatgcagacggacagcgaggccggcgaagagcgactttgtctcctctccgtcttccgaagggccagactgagggcaggcttccccctctgcttcttcgtcttcttcctcagctcccccgcgaagaagcaaactctcgccgtcctcgccagaggcgcagcagggagaggaagaagctggcatttccccagcctccagccgcccgcgttcctctgcctctgccgaggacgacgaagaaaaccgcggagccggactggagcagagaggagaaagagaagccgaggaagagcagagagaagtcgaggaagagcagagagaaggcgaagaagaggaaaaggaagatgtcaagggcggagaagatgaagagggagaagctgaggacggaggagaagcgataggaacgggagaagaagatcggccatttctgtagagccgtttgcgtttgcgtggaggagacggcgaggaagaagagggagacacctcgccgggaccgcggcgtctctccgtcattgcggacagctcaacgagtctttcttgccgcgcgcaagacaagaaagacgacgaggaaagagaaggtgaacaaggagaaggcgaacaaggagaaggctggaggactctcagtgcggttctttcaactggattcgcttgagaacctggagttcaacaggcgcgcagagaccgactaggctggcgaggagctcccggcgcgcatcgacggagctctgcgaaacgaggaggtcatgcacaagcggggaacgacgacgcgaggcagtgggcggagagaaagcgaagacagttgcctgcaactagagatcacaagatacgcgcatccatgccaattctctgtaaatcgaagcgggggaacgtatcgccctcctcagggagaagacacgcaaaggggggagggacctctccggacgcaagtgcgagagcagccgcaggagcggaacgaaaaggcgagagactgaggcctccttcagatcgccagaacctccatcacctctccggcaaaggcgcgacagttctcttcattcttatactctctcggcttttcctctttttctggaaaccttcgttcgccgcggcgccttagcagatgcacacccggaaaaagcgaaggcgccgctgtgcgagcaccgcggtccagacctgagaaaagagacttctttttcgcggcgcagctgtacgtacactggaacccccgggcgcaggggggagacgagcggacgcgagaaggcggagtttcgcggctcttcggcgttttctgaaatttcaagagagtcgacaccttgctcaaccttcgatctttgtcgctagaggagtccaactcgagccaggaaatccaggttttctgcttatctctcacccgcgaaaaatcgccgttttgcgctctgtgggatggtgcccagctgggcatgcaaagtcttgaacatgtcgatttgagtctcgacttcccaaagtttttagagaatctttcctcaaagaaaggccaaaaccgacgctctgcaggaaaggcgacttgccgatctctccggccgactgcgagagctgcagggcgctgtctctcgtccttcttctgaatccgtccgccgacgcttctccgcgctctctccggatctctgaaatttacctctttgccagca

SEQ ID NO: 2705 - DNA, 1842 bp, Toxoplasma gondii
ttggcttccctgctgaatcatgaagtctcttctcgcacaaacagtcccgcctttcggctgtttctctccggggaaggacacgaattccaccgttagcctgactatagaaaaggccctttcaagctgtgtacttttccagagcacgagctcctactgctttcgcttagttccacgaaaaaatcagtgatcgtcgaggcaacaaagcttccctttatggacgacggtttccgattgggtccattttgcggacgcttccacagactcaacttactcgcaacacgcgacaaaacacaatcaaagcatgcatgggcagtcccagcggtagcagttaaactatggtagagtcgagtactatgaaagcaggccaggcgaaaaggcgttttcgttcgacgcaaaaatatcgacatctatcggccagtttctgcagatgtctggcacgcgcctttggggctacgtgagcatgtgggtcttccgagaatcacctgcttgccgacggctgcgtctgacgggcgacttctcctccagcctttttgtgttccagcaaaacatccggcgaacacagtgaggtgcttggccactttgaatgggttcgatgtctgcaacattttccgcgttgaagctatgctcatgtcacgaaaaatctcagataattctgattctctctgtctctatcacgcagtcacgtttgctctccgccgctgactccttcagccgatcacatccacacattctcttcctctttcgagggcttagagacgcacatttcttcgtaaacacttctgtttgtgctcttccaaaagaggaaacgcctgtcgtctcatccctgctgcatatgctttcacagctgtccagactgaaagacagaagcgaaactcgaacgtctctccttctcccaccagcgacaacactgccttctctctgctaaaatgccatcaggcagatcgacaaagtgaagaccctacaacctagtcattcatctacatatacatagaaagtttcacaagtccggctatgtatatatgcatatatatatatatatatatatatacttttatatcgctcggtaggtagagatgggaggagagatatcaacactaataagagcagcagaacatctcttctttttttcctcgatgaacatgtacggatttttcctttacctgctaccactttcggttctcggggttacgcgaaagattgtgtccgtagaggcctgtttttcttgcccatcgccagtcaacgaacgctttgtgcatgcacccgttgagttcgcccatgcaagtttgtgaaattgttgcatgcagcgaatcctgttttgagcactcgatgcgagagtggggagttccgctccggttttcttatcactcccgcctaaaaaagttgagaaggagagacaaaaaggcgctcttttggttctcttctcctcccgttttgccgtcctaattccttctcctttttccgtttgcggttcttctttccgtatcgtccagcgcgcgaagccgagtctccgcaagaaaaaggtcgctggcacttctttcttcctctcttgccttgcttctcttccgccttttcgttttctggatatcgaagcatcgtcttttcccctttctttcctccgcgtcttcaccgacagtggccgcatgcaagaaggagaactttgaggtcttttggagcgttgcccgtcactgtgaaacgcgttttttcgctgagcatccagacaagagaatcccccgacgcggcagtgcccagatgacacctctccgccgttctaaacgctctgctttttccccgacgtttcttcctttccttgggccttccaggccgcaacagcggcagagagaa

SEQ ID NO: 2706 - DNA, 3064 bp, Toxoplasma gondii
tctgaagagacgcgtgtagttgaagagcagcgagtgacaaacgagctggacgacgtcgcggacgacagtcggaccgagcgcctcgactgccagatgcgcctcccgcagcgcgtcgcgctgctccgagtccagcaacgcctcgtccgcgtcctcgacgaacggcgagaagctgctctgctctccggcgcaggttgccccagtggcgaagggattcgagctgcgctcaccgcggaagcgggagaacgcgggggcagcggcgtcctcctcaaagactgcttggtagtcctcgatgagttgctgctgaagggagcgacagagcaggtctttctcgcccagcagaaggccgatccgaggcacgcggtctcggtacggctcgaacgcaccctccaagttcttgatcgcgagaagcagctgcgcgcacgcagcgtactgccgcgtcttccccgcaactcgcagtttgcccagagccgaaaccaccatcaccagcttcttcaacgtcgaaatcgaagtcgtcaggttcttcttcgcgagcgcgagacgctgaagctccgcacagatcttccccacctgccggtcgctcgcctccgcgcgccttgccatcgcctcaaaggtcgacatcaacgccttcacactgcctctcaacgcctccagagacaaagaagaggacgaggaggaagacgaggaggaggacgaggaggaggacgagcgccgagcttgctctcgcacggcgatgagaatgtcttggtcgagcgccctgaggtaggactggagcgaagcgattttcgagtccagcgaggagagcgactctagagtcgaaaactcttcattcagctgctgaatgcaagcctccaaaacctcggaagagggcgcagacgccaaagaaggcagagaagaggagagaggaagagaaggagatgatgagagaggaagaggagagccagaggagacaggcggaggaggagaagaggagacaggcggaggaggagaagaagaagagcgaggcgtcggggaagagtcaggctgagcagagagaggagagacagaggaagggggtgccggcgcagccatcgtggaggaccggacagtgaagagagaggagaggaggaaaaaacctgagaacgcgaaaacgcaagaaggaagagggcgctaccaaaaaggagggacttctcgagttctcgcctcttcagcgaagagaagaaaaaagcgatgtggcgggaagagaccgagatccgaattcggaagatgtgcgagaagggagcgaagccgggtggacagacaccggaaggcgcgcggctggctaagaaagccgcgagcgctttcttatccactttcgcgatttctcctggaaaccgtttttgacatctaggagtcacctgggcaaggctctggaagaaaggcctcgccagtcacaacgcgcgccaacgcggacgcctccgacatgactcctagttgtccacgcaggctagattgagcttcttctagcactcgcgtttgcatgcacacaaataataaattgaataatatatagacatatatacatacaatatatatatatatatttataagtatgtatatatatatatatatatatgtgatgatgtgtatataagaatgttgtatccgtatgtccccgcgcccacggaaagcgtctcgaagaatggtggagaaagccgttgagttggagggcagagagcagaagaaaagagaagaggacgaggtgcaggacggtgagaagaagatttaacttggaaagcggaggctggcgactcacccaacgccccgagagagaagaagacaccgagctgggagacgcgcctttgtcgccgtcactcctgttctccagagtccccctctcccccccaagtctcctcacgcattcgagcggtaacgaactggtttaaaacggcgcgaagctacgaagcgaagaattctgcgctcttgtccccgagaaaagccacaaggctcgggtgcatgcagcgaaaaaggactcgtccaaccgtatcgccatcgtcctctctctcccactggcaggttgttgcgcctgagtctctcttctctcgcaagacaccaggcagagtcgccgcgagaacagaagaaaggagggcgacggggcaaagaggaaaggggataaaaaacggagcagcaggcgagaacagagagagaagaaggagaaagctttttggagaatccgtccagaggcttgtcggcgtgtgtgtcctgttgaacttcgattcgagacctatcagtacgcgcgcgttttttactggtccctggagagcttcgctgccgggctccccttcgatggtttcgcagtcgccgctgaagaaaacgaatttgctggaacagcgaaaggaaggaaaggcggtgggagtcaaaaactttcaaaatctccccgccccctttgcatctgaaaagccaaacgctcgccgcagcctgccttcccgccattcaagaccatccggctgctgggccatggtggtggcgcctcggggcaacgaagattgcgtttttgacatatttttcagttgctcaggcatcgacgagtctcctgctgtttgtacaatgttcgcgttctttaaaaacttggggtctttgctcggaaagctcctcagctcccccagaactagctcgcgcaagctctcctgacatcgcagccagctcagagcccagcgggcacccgagccaggcgagaagaatagagtcgccagttccactactcttctcttctttttatgacttggtcccgctgcagtcgagtccctcccgctctgctcggtctccggctgctcttctttttcttctcgcgttcgttccgcgactccgtcccgctctcccctctcggctttctcctcctttctgcttctttcttcttcttccgcttcatttttgcctctctctgcggtccttcttctacactcctgtgttgctttctctttccttctctgccctcctctccacgctccctcttctcgttttcggccttcttcgtctctcgttgcctcgatccggctcttcccctccgccgcctttcctcgtcgcgcggttgccgtctgctttctcgaga

SEQ ID NO: 2707 - DNA, 5023 bp, Toxoplasma gondii
ggttttcttcacacccgttggagtgaatgtgtactcagtgacgtcgtccaacacctgaacagacacgacagcgacacacactctctcgacatcatagccagcacgattgggcggccgttatcaggtttgctgcggccgcagacggcatgctgacaacggcgactgcacttcgattcgcgtaaaggcttctccgatccgaagagcagtgaaaaaagcaactcttcaggcagccggtctaaaaagaaaccgccgcaacagtgacatctgaaatgcggaacagttattgaaaggcgttcgtactccggctgtttctacaccgcggcttcacagaatgggtgtcgagaattgtgccacaagttaggcggtggaaaacaccgcgtgaaagttggaaaagaagcaatacagacgtaccatgttgacgaagtcatcgaaacctcggagggtcccggctaactccttgtcacctttcatgataatccacatccgacttccgatacacttgtccaccagggcgagaggcaagtagctcggacctccgctgacaacgccactcgttgccggggccgacgtcgctttgggggcagctgcgctcatcgtgaaatagatcagttcctcagaaagcgaatggtatggtgtgacgggatggaaagcagatggtggttccaccaaaaagactgtccttcatatgcgctctcgcgttgttttgaagtctggaggccagtttgaaggaacaaaaaatcgacagattccgctcaagactgggcaagttgatagggtccctgtcggttgaaataaaaggcttgccacagtcggagtgacagcttctctctgtcactgcggttttctgcgattcaactggacaggctgcctttcgctttcacggcaggctcaaaagaaagtcgcgacctttcgaatgagttggccaatccgagttcggcgcagaaccgctgaaaacgcgacccctggtggttttttcttcaatgcgttacccgcctcctgccaatcgcatactgcaagaacttccgtcttcctgggtgcttccgcaagcaattccccttcgagattgtgccgaaggcaatgccgtccgagcgatcgttcctggcgcctcacagcaaggacagacaatgcagaggccagagtcgcacgacgcagctgtatgcgaagaaaatattcaggatacggcacgtgaaatcacttcctccttgacagacgcacagagaaacctgaggcaagcgggtcgcacggctgctacaaatgggttttggacaggccacacatgcactgcgattctacagcgcaggacgggagttcctgaagtggtacaaagtcggacgagaagcaacaaacgcaggaactcgagactcgctagaaaaagcaaaagtgccgtaggaactgttgaccgacagctcgtgttgataattcagcgcagagcctccactgaaagtcattttcccgtctgcatgaaaatgaatttgtccgtgcatgcagtggacaggcatctacgaccaccagagggggctgttcctcgatgctcatccattctcttggtgacagaaacacaagaaggaggatgtctcagcttgatttctttccctcatgaatttgagcaacagctgaaacttcagttgctccgctgttcactggttctttcgctggtttgcatccgacagtcgcgagataccgtggagaagtccctgcagtaaacctgagatagccgttattttggttcgaatacgtactgcggcggtgtttttgattacccagtgtaaatgtccttcgatcgcttactgaatgaggtctgttcggtggagcactttgtggctccgggctctgtctgtgctgcaggtggatgtgtggactcaaagagttacggtagccatgaagagttgatcctttccttcaagcttttatggctttcctctgcaagttcgcgccaccggtattgtccccactacatggcagcgataactcgccagtgcacatatagcgcttcccgctgtgtgtaaatgaggggaactctatagcgcagatcgcggtgttccacagcgcgtatcatgcaccgttatgtttgtccctgggcacaaatgcacacgaggaagcttggttggttgtcgatgagatcgatgcagggacgcatcgagtttgttgcttgtcctctcacgtcggaagcgcagcatctccataacgctagtggggaataccggtgtgtcatcccagtgcaccgcccactggtcatatacggagcaacgtcatacgcagatacgctgaaaacctcctcagcctccaccacttgagacacgaaacagatttctggatgtgaaaccgtggttgcttgatttgctcgtgctctatctgtaaacatgggagagatggggctacctggagccggtaaacaaagatgttcaagctataacccagtagtcctcggtttcgtggcggcagcttccgcatcagctcttgccaagggtcggggaaaattcgttagaaagaggaaacacggaatcttgataacggcgctgttgcaaggacacttttcacaccttgaactcgaaccacggttgtaaaggatgcttgaaaaggtaatgtgctcggtccctcacgagaacagcgtcgtgacagtccgacacctgcctattaacgtggcgcagctggtggaagcttcccactgctatgggatgtttctcgcgtttctaactgccaggcatcacgcagtatctatcaaacacaagggatcgtttcaacataccttaaccactaaaggttcttgctcaacaggtccgctccgtcgattctgggtacttctagagaccgtactgtcctaaagcgctattcatttcagcacattggctgtaattctgcaacagcctttggccaaaaggtaaaaggggcttcctcgggcacatttcgttccgtaaacgcaactactatcgattatcaggttggtccgcttcctagaaactacggctagcctcagcatctacacgagaaacaggacgtcgccgcccatcttcaacggcggctgagtttcctctgcgggaacggtgaataaaaaaaagccagataacacttggcaaagatacagtttgcagctttttgtgacaacggtcgcttgaatctctctgtttccgtgtaacgacattccaggactttccgcctttgtcttagctctccgggtcggagctgttttcattatccgtcccgcttgaggtggtcactcgctccgtagctttgaagctgttcatcccgtgcaggctgtagcgataacactggtatctgtaccgcgtagatccacgcagccagccgttctgttacttgtaatgtttctgttcgagtcctcttcgagcccatccctcacgttatcacagggcgacttctctctacacaagcaccgttacaaataacataacgcgcacagcgtgacacaaaagggagtacctctaagtggacagggaaaatgaagagcgatatgtataggtaaaaccacatgaacacgtcaagcgtgccctgcggacccggtggcactcgaaggggcagtccgtggcaaggctccagaacagaaatcgagctttcgctgggggtgatactggtcgcctgatttgcaaaccgcttctgactttgggaaaatgcgtgcgataactgttggtcagccaacttttgcgccagttcgtgtttgagtgtttctgtagaatctggatgaatgtgcagaggctcaaggcagcagggcctcagtttttcactatgccgtgctcccccccataccagtttggcttcaaccgctgatcagtgcaagtttcattgcctggttttaagctgttgctatgaccccaaaacgtcgataaaacgactcctcaagatcaacacatcggctgtgccaagtgtgagcgccagttcctgaaagacaggcactccacgaatatgccggtaccgttcccccgagtttcggcgggtgtatcaacgggtcacctggcggcctgtgacgcgagtggaaaaaacacgccgtatggactttttgtgcagacctaatgggtgccagcaacagcttcgtggttgcatggatgctttgttttaaccagaagatgaactgcgttgtactgtcgctgccttcaactgcatacaaaaaagggtggctgtgtaactacgtccgggacagcgattgctaggggaagtgtcaacagactcatcgggcattctgacagttgagaccaggtaagcgtcgcttctgagaaaaaacgcgactttcgtgccacaaaaaagtcatgcatgcgttccgcaattgagttcttggcatctgaccgccatgctgaatcggcagtgtcgagtgtgcgctttttgtcatgcctgcatgcccggtagttgtagaggtggtcgacggtacgaaagacgattccgtgaaagcatccgaatacagttcccgtgaacagtgttatgaactcctagtgtcactgcgtgttgcccctttctgcagcgttcattgtgagaaccacccagtgttttaaggttgaagaccccggtactctggacttgctagaggggtgtccccgattggaatggaggcgggtgtgattgacgggggcgcgaggtcgctttatcttagcaacaaagcggtgtcgaccatcttatctttctggttcgcgtgtacgattcattcatttctgtattcgtcttcgccagtaagactgcttagagctttgagcaggtttaagcagggaaccatgaagccaggtcgaatcaccgccactgccagggacctgccgtttcctggcccacgcgtttgcgcccgaatccaatcaaatctataatcttcgggcatgtcgaacgacaagcggcttctgcccggcacgcgcagaaacgaaggtgcaggtaacggcggaaggagctgtacacacagccaggctcttcgacgtgctcgctcgctcttttgtagttcggggcgctctggcgattcgccgggaatattcccagcgtttcagagctctcttcgggcggatgcctgtgccttcccctttgtagtttgtcgccaaaa

SEQ ID NO: 2708 - DNA, 1743 bp, Toxoplasma gondii
aaacatatcgctgacgacgttcttttgttaatatcctcattctgcatgcgagtagacacaattttaaaagtggattcatctactatccatctactacccacaactcaccttgttgtagaaaaaaatcttctcggcggcagcattaagttccttgagtcgcgcgacgtaagctccgcggtcgaaaactccagcaaagagatcttctacctcttcgtcacccctcattcttgcggtggccctcttcgtgtcgtcgagtgctggcagatgtgcagacgataaaacaaccgagatagattttgaaagagacgacacggtagacggcttaaaaagccagaagacgtacgcggataaagcaattgtcccgataatgcaactgagaggagagggaggtgtaacggagtgtacagtattgggaaaggaacaaatcaagaatgcagagagcagacgaaagcaaagcacgcggcaggacagtttgaaacccagagagagagatgaaagactggacgaaggcatataagaacgcgaaaacgtagacggactgtaaaggaaaatcttgccttgatctccttggcaaactggggtgacaaacacctttgttttgcaacgtaaacgttgggtatcttgcaaggactatattcagttgctgcgttccgctgcccacacagaagggcgcaaacaaaagtgatgacgccacgagacagaagacggaaagaatggggaaacagagaagagagaaatctgtttggtggaaaacaccgccctggaaagtacgatttttaccgcgctcccgctgcgtttacaacggacgttcgctcttagtagtacccgttcatgcacagtggtatttcgttactccccgttacttctggcaaatgcagctgaggaaaaaaggaactgtccttttggtgttccttgacgctactatagatgttctcacacggacatttaaacgaaacttcattctgattttcagcaagatacgctcccctgttagacgttttcaagattgattcccggtcagactttctccgtgagagcgactcagcgatgcatgcatgcatgcaaaaacgcgcttctccgtagtattgacaagccttcagaagttcccttgttattccgtagaaaaagaccaagtcgtgtcgtttcttgtcaccttctttcagtgaaaccggcgcgtgccgcgcctggatggaatttgtttgtctttctttcaacgcggtgcgtctcacagacggaccgaaaccgccaggaacccaggtttgctgcgtttcttcaccgaaggtgaggcaagctcgtctgaacatctttaaccgcatgtaggattgccggttgtttgcaacttcgccgtcttcccgaccgtacttgcagctcctgagccctggcgctccttacttgtgacctgctgctcaagcgccggtacaaggtttagtgtaaaccgaccgagtttgcgtcgcgagttttccagtttaccaccattgcttccttttccttgtccagtcctgaaatggcaagtgaagagggcagggacacggtgttgccgagccatgctctttctggatgtccgtcgccgcctgacgcactgcctctctcctgcggcacttgcatcgcatgaatccctcgccggtcgagacgtctaacagttttcctctgcagacttggaaacacctaagcatttgcgtagtttttcacagcgccttctgacacattgcgacgttagccctcgacgctacgctttcgccacaa

SEQ ID NO: 2709 - DNA, 1961 bp, Toxoplasma gondii
tcaagtgccgagggtctttaaccaggcatacaaagtggaaacggcgccgtgggctgtagcctgtgtagggccactttaattttggcagttcaacgatttgcaggtgcgtggatttttgaaagcagtggcgtcagcagtatttccttttttccaaaccgttttgagagatcgttaaaagttttcagaccataggaccagcagaacatacgaagacaagtcagctgccagtcatcttgcggatggcaggacagcaattcggtgcactcgtttgagaggcttgcgtttagctaaagtgttggatttcaatatcctacggcattctccttaaaggttcaccgagactgttgcaggaagtcagataaatcgacactgattcatgatagtgccagtaccagccaagccccccaaaacatgtgcccctaaacttcgatctcgccgactcgacgagctgcaagagatcatgaagctatatcgattgccgttgcccagaatcgtttacaaaatagaaacaactcgtggaacaaatgcctcaaccttcttcgtgaagatgttattgattcgagcgtgtatcgggtagctaacagcggaagtccaagtcttgacgtggtcgtgtacgtgacgtacctcttaaggttatgctgtcatgggtcggcagtgatgatgcgctctgttcgggtgttcgtcgccatgtgacggtgcaccacgatttctgtgactgggtaaaagaaactgtaattaactatattaggcctgtcaccgttggtaatttcgaagggctgcagctgcaagatgtgggcacaactatatacagtaacagttccaacagtaaagttacaagtaacagagaaggttcccgggcgttggacgccgatatagccataaagcaatgaattgacagttgcggccaggatgcagtgtgatagtcatatgatgaggtgcgcttgtgctgatgcatttaaatcatagcttctgagtcacatccactagtttggtcatttacctaagagtgtcactccgctggaaaatgttctgtggcgctgcgtgacagggctgtacagcaaacaaagaggtcaaatgtcgagggttacttgttccccatgtgcggctcatttgcattttgtcatgtgtgacacgtatgtggggcactgcaagtgacgtctgatgatcgacactgtgctgagagacgaaaatgccagcgcggtgttacacggtgtggcagttcttccacaggaaaatgatacatttcggtgctgaaagcttgtgcacaatgaggtatcttttatgcagccattcatcatacaactgtctaccgtgaatttttcttgttacgccggtgctgctcctgcagagcagcgggatgttcatctggccagcagtatagggtacatgcttgtcgaaccggtcaagccaatgggtgaagcagccctttcagcaactactcacagaaagatcttccgaatatctgctcgaattttgacaacagtcacgcgcagaggacaaagtggccgcgctatatggcaactctttcgtgactcacggacttcccacctaagcaaaaactcttcacggcaaagaagcggttcaagaaaccgaattttccgaaaggactgaaataccgtacattgcaagttgctataagacgtccctgcaacaggtgtacggtcaaaggaactccctcgccgaaagagctgtgcctatcagtctagggtttaggaatccctccacatatcttcaaaaatgcatccccaattaaccactgccaccgtgattcactaaacgactctaccatcttgctaaccactatcgctcgtgccgtgtcgggggcacgtgtgtctgtgtcgcgtgtcgcgtctcggtcatcttctgccgctgtttatcagcgtcgcactcctctaccactgtagaatgatgtgtttaaattgctagtttaacttagaacattcctagacccacggacaaca

SEQ ID NO: 2710 - DNA, 1653 bp, Toxoplasma gondii
tgctcacacaacggagatcgctcagaaaaagaagactgctcagaaaacggagagcgctcagaaaacggagagcgctcagagaaaggagactgctcagaaaacggagagcgctcagacaacggagactgctcacacaaccgagagcgctctgagaaaggagactgctcagagaaaggaggcagttcagaaaacggagagcgctcagagaaaggagactgttcagaaaacggagagcgctcagacaacggagactgctcacacaacggagagcgctctgagaaaggagactgctcagagaaaggaggcagttcagaaaacgcagctcggtcagggaaaggaggcagtgcagaaattgaagatcgttcagagaaaggagtcaggtcagaaaccggagagcgctcagacaacggagagcgctcagagaaaggagactgctcagaggaaggagtcaggtcagagaaaggaggcagatcagaaaacggagagcgttcagagaaaggaggcagtgcagaaattgaagaccgttcagagaaaggagtcagttcagaaaacggagagcgctcagacaacggagagcgttcagagaaaggagtcagttcacagaaaggagactgcttagaaaatggagatcgttcagagaaaggagtctgttctgaaaacggagagcattcagagaaaagagacagtgcaggcagacttgcagttgcgggaggagaggcgagacgcgcctccgttgaagagacgagttgtccatgcgaaagaagagataaacgcgggagcgactgtgtagaagagaagatagacgacagagaagcagccccggaagaaggcacagaaagcctggagacgaaggtgcaagagagagaaatggcgagaggagaaatgcgagtgtcggccgtggcgaggacacagcacaacctcccttcaggtctttcagagagtggagagacgcgtacagacgaaacgctgacaaaagacaggaaagaggcgagaaatctgtcaggtgactagtccacctagagcgagcgcacgatgccacaaaaccaagcagtgtggggaaagagacaaaaaaaattcctgacttctgacagtctttcattctcaattcaccactagagtcacttgccctgcgatgggggtcttgacgcttgcgagggacccgcatccacacctgcggcatagcgaaacgtgtaaaggcaaaaagccaagaacgtaaggagagaaactgcaggcacagaaagacacagcgcaaacgtatctgaaatacgtttcgagacaaaggcggcaccaaacgagttcgccgtcacagaatgctgcggggcaaagacagccacttgggaagtgaagaagagcaacggggacgattagtcgcgaaacctccgggaggaaagagagaagagtccgcgagactcggaaaccccttcgagaagagagacgctgagataaggaagtaacttgctttcaagaaaggggatgaaagacatttgtttgagcttttctggctctttcctctcgaggtgcactgcaggcgttggacaggctgtggagcacctgtcggtcggactctcaggggtctcccgtcagcctcgctgggaacgtggaaacgaaaaaaaactgtccactctgacgaatcgttggccatcctttcttgca

SEQ ID NO: 2711 - DNA, 3821 bp, Toxoplasma gondii
ggttaaggcatcgtttttcgagatgtgtgcctcagcctccaaccacccagatacgctcactattcgtgtccgcattgtttcacattgtccgtctagctgctagtagatgttctggttttttcttttgtttcacgacactgtgttgcttctcacgaagcgaatggcagctcgagatgtccactactatgaatggggtctggtctatgaatgcaacattatggattaatttatcgttaacaggcaaatacgagatatcgtgtagcaggctttgtgttttgcacttgcgtttcatcaaacgagaagctttgcaaatgtcagcatgtccgcctactgttcggtaaagtgcttcctggtttaatgtcttccgaaggtatttgcttcctttcattcctattctcagcctggtgtccccgcaagaatgttaactgcagtgtttgtctgcttatgatgttgtctcagtatcaacgtgatgcaagtacgctgctttaccgctcaaaatgtgaaacgtggatgcgctcgtgtggtacaaaaaactgcaccgtgtgctggtatgttgaattttgattggaagcttatccactcgacgggtttctaatacattgaagtctacgtcagcactgctctgtctgtttgcgagcgaaaatatgaaaaaacactctgcgaaacaacgcggtagcaaattgcaaagctgtttacctggagtatgccagtttggacgtccaagcaacgcagaaaccgtgatggattgcatctctaacccaaagaagataatagacatggttatgaagttactaatcggaaaagaagcctgtctttaggtgttgtctgattgatatcgagaaatgtgttctgcccagcggtttgccatctgatgggcatcaaaagtgagatgaaggcgcacgtctcagtgacagtcgcagagacaactgctatttcatcaggctgatgacgatatgatgcctacaactggcccaactgtgatcagctgcaggggcgagtaaaaaagtgaaactcatttaaggcccagattagaactataccttgataagggcgggcgttgtaggcaaaccacagggagacgcactggacggtcgggaagaggtgggtgcttcaattgtctcccaatgcgaatgctcgccttgggattagaggtgatcggacgagcctccgtcccttttgtgtgtatcttactactgttattcagcagtacagccacagcggactttggtgggtcctcatgtctttgccacactttgacgaactgacgttccacagcaccgaagatgtccaccgcacggttgacctcctcaccactgacttgtctcatgtcgagtcgcctcactgtcgacttagtgaggcgtacgaatgctgcatagtgaagtaactagcatatgttggacgcatctaaggagtgtcttgtgacagcttacaaccaatgcagaagctggagcacggtaagagatagaaattgaaagagaacctcgtactcaagattcgacgacccttattattattgtgctgccggcgttccacgtagttgtgccccttatttgtagcattgccacaaccgatcggatgtattcgatactcagcctgccattgcaatgccatgaaaaaactgttccttttgagactaccttccgcgctctccgagggaagcacgtggggcatcgcgaatgccccacggtcttactgaattggcatcggctcacctgctgtaaatccgagtagtgtttgaaaaccgatgtgatacgacgtttgccttcactaagaattgcccatctctctcttctatctcactcccgggcgctgtgacgcttcgggttcattttgtctggcacttcccctgtcttgctgcggtaagcagagacgctggatcccacctggagtcaatagaaaatgccatctgtggtagacctgatgaacttatccaatataggctcaggagtacctatggaaaccgtcgacagatttaccttgtggggcgaagcgcaatcttgggcaccgtgttgtacggcggacgaacgcctgtgcgttgctattggttcagccgtacaaaacgaaaatacaagtactgtcgccatgcatgtctcttgcgcagtacgaaaaaagttgcgctaagagcagacaaaccgtattcgacgaggattacagcgtgaaatataattgcattatcgatgtatgcggtactttccaaattctatttcatgtgccgactgaacatactttagagataggtatcgctatgcgaaattcttaaaacggaacccttctatgtctcgctacgtctgaccgcaatgaacgatgggatacgagacctcaagcttgcaagcgttcatacaacgttggacctatgaaggctggcgtcacggccaactgtgcggatgacatcatttccatgaacatgcttcgacttcagagagcttctttctttctatcttggtcagacgttctggacaggactgctcagcagtcagtcactcgcacagtaagccggaagggagttccttttctagtaacggtatcgtcttcgcgcgatggaggcaacgaatccccgaacgttgttaccatcaggagtggaagccgccttgccttccgcggacgaacactaaattatcgtcatccgcacatgctccattagattggcatttcatggcatccaatgtaagtttgtgtgcaagccttcgaacgtggtgcatctcaagtcaaatataatagattatgtgccgccatccacggacccccagcactccgtcacggtagttgtagcacctgtcgaatcgacaaagaagaattgatcctcaatatcactaataggtacaaaggcgcttaaggtcgaacaatggagctatctcaaatatcatatttgatgggtgcagtattactgtactggtttagcgcagtgaagtcctgcttccgcgtttcgcgtagctttctgcattaagcggtaaccacttaaatggatgatcacgtgatatatacacattgcaagagcaaatgtaaggttacggcctgatgtaaaacaccatctgagtatatttgacatcattagcaagacacatgcctacactacttcgtgaaacggagtgactacactggaatgcggtatagacaaacgatctgtctttttttttgatgttgaatcggacactttgcctttgcaccagactccagaccgtttcaggtcgctggcctctttgtccttcagttgttttaatgctggtggagatcaaatttgccttttcttgtcgttggccggcgcacagcatgtgccttctacgcgaacgtgtgagcacgcggacacggggcccatggggtttcggtcacccatcggggtcagcagccattcgacgctgtgtgcggccgcatcaatcgttgctgcttcggggacagcgcaaacttcgcacgcattccgtcgaccgaacggagatgcatgctcactggagggtgctgttcagctgaaattaaacatattcgctcacctcaaaaacaactgcggacttctataagcctagatgagtaggtcaggcgaagtcactcagtttgactcaagccctcgtaggcgccgttgctggcggagaagtgtttcatgaattgaaaatcgctgaacgttttcctggtgagcgagcgtctttcccttgtatctctacggatagttgtgcaatctccccacttcgaaaccgttttcgcaacaaagcaggagcttgtcattgttctcccggtgtcgtgccgttcaggttcaccgcaaacgacgacgcctacacccgatagggtcgtcgcgtctccggaggtgaccagcggtgaaaagacaatagagaaca

SEQ ID NO: 2712 - DNA, 2154 bp, Toxoplasma gondii
ttagtgacgttgcctttctatcctgttatctccgttgtctgtctgtttaatcctacatatatatacatatatgaacatataaaatatacacaatgataagcatgtgcagaccctcctgtatctcttgtatatatgtatccaaacacacacatttataaccatatgctaacttattatatttatgtgtttaccaatatacatcagcctctgtaaatacacatctacatatatacatttattaatacatataaataatgcatatatatatatatatatatatagacacatgattaaggcccatatacatacatatatatgtatgcatgtatatgggccatctgcttgactgtgaatggggtctgtgtgtatcgttggtttttttgtgctattttggaagcaattctacatgcaatgaaagccaacgagaggatggtttattctgttcttctttcgcttcttctttgtcgccgtttccctcgttttcttccatgccgcctgcacggcgcaaagagcctcggtggttctcagcgggcatccaccacaacggcgaaactgcgcggatgttctgatttgttcgaaagacgacgcgttcaggaagatccctccctgtcctgttgtaaagacaattcagagaaaagctgtaaaaacagaaacctctctaggcttcccttggatgatcttgacaaccagcgtgggcccccacgaagattcttcgcagtctctacgtctctacagctacttcacatgcacatagtcgatacgcacatacattcatgtatatagcacttctatgcatatatatatatatatatatatatatatatatatatatttgcgtatctggtttcacttgtaaggcattgaacacctcgttgcgcgtgcaggggagaagcagagcgtctctctttttgcttgttcccgagacaacggagacagcgatcgagtattggaagcttcctggcttcttctctctcggtctcttgtttgctgtttgaccggttaaacaggggggggggacacagggtcgtgaatcgagccacccttccggtctggcgagaagcatgtcagatctcgagtttcagatatctcttctttctgcggtcgctgcatgcggggccgaaaaggctgttccgtctgcgttgttagtcgaagaaaactgtgggggttattacgtcggggctgtaaagtctctgctgtctctgaacttcttttatcgcgggaggttcgagtttttagacagctttctccgtgtgcatcgccttgccgctacttttgactggcggtttctctgcgagctttgtcgagggactcttgtagcgtctctctcttccgttacccgcagaaattctccccggtctcggagcggaactttttctgcctcttcatgcctcgcactttcactgctcgcgcgtgagcgggcagatggggggaagtcctgcaacggaaatccggattcttctcgtttttcccctgccctttcacagggctcgttgtcttctttcgctcctgtctccacttgggagttctttcttctctcctttcctccgtcttgctttcttgtcgcccgagtttgcgaaaaaccgagccgcgccttcctcgctctgcaccgacgtgtgtcgcaggcctcaaacgctctcgactttctcctggctttctgtggccggctttcgtcgccttttttctgctccacaacgcagacgcaaatcaacttttccagcgacgaaggccgtttctgcagggagagcgcataaagcagcaaaagcggactcttcgtgaagtgagcgcatcgtggagagctcgcgggcctcagtgcgcatgcgcgagagaaaaacactcacttccctctggagcttggaaacgcgttcgtcggcttctgctgcgactgctctgcgactccaccgtgtctcttttcgcctatcctgaaaagaaaaacaggaaacctcgggggagacatctcttccggccgttcagctccctcacaaagtgctgaactcgaaagggcacgagagttcatcttctctcacggtgtctctctcgccttctcactccccttcccgttccccgatcgtttcgttccctttctcacttcccctgctttgtttttctcgcgagtcgccgtgcggcctctccgtgtttcctccccattctcaacca

SEQ ID NO: 2713 - DNA, 2824 bp, Toxoplasma gondii
cagactttgcttgcttctagattgtttgtctctcctgtggagttctttctctcttcagaggctcttcgtcgaaagatgacctttcgccggcgttcttctcagcgactatttctcctttctttggaagcgcatcctttcgcagggctcccctctcctctgtccagcagcgcttctttcagcatgcctgtagctccccccccccctaagacgggcatggcctggcgttttgctgtctggcgttttttcggattggtcttccttttctaaagctttagaactcgtttcctacccgaagccttcgtgtcgcactggcctgaagacttcttcgtagtccccttcacacaaatctggttcctcgaagccgaaccacagtctgagatcaagccaggtgcgacatcgctgcgagttgcagagcttttctcgagccttctccgtgagtatttgtcctctttgcgggagagtgaggtcgtcttctccctcccactgctctgcctccttcgcgagcaacgctgcccagagggaaggctcatactcttcttcttcgccgccgcggcgagcgcgcggtcgaaattcacacgaggcgcagtgcggcacctgcgtcgccgaggaagggtggatcgtgagaagtgcgctcgacgccattggaaggaaacggaggaaggagagagcaagacaacgcggagaggaagcagagggaaggaggcgagcgaggaactgggggacgactggtggatacacggggagggcgccgaacaacgacgatgactgaggaaagacaaaaaaaccgacgcgcaacggaaacaggaacgagagtcgaggaagcagacgacaaggagaagaaaggacaggagcagaaggagcagcagctgggagaggaggtcgtggagattcgactcttcgttctctctctttctctccctcacctcgttctccttgaagccggtggaggctctccttctcttttctcttttctcgcgctaaccccaagaagcgaacacctagggaagagagttctctcgcgcctcatcgcaaaagcagcgtgtagcgcagagacagagaagaagaaaaccgcccacaaatccgacgcatctccagaaatgaacactaccgcctttgcctgcgcgtggtcagggagagagctggacgtctctccggcgagggaggcccaaggaaaagcagaagccgagtggcaactgaagacaagggagacacagccgatctcggacgatttagataggaggacggtagccaagacccgcgcctccgttctccgtcggcgaagaaggaggccttgactgctcacaagagcgcggaagaatggaaccgtttcctgcaagtcgatccagcgcgaaaaactcagaaaaacgagagaagcctcgagggcgccgcgacctccgccgccgctcgagtccggcgttgccgcgggaagctcgacaggtcaaagaggctttcgtttaaaggagagtcgcaggtgaaaaaagcaacgctgtcctttttcatcagggaaaaactggggggaagtactcctcaagaaatggacgcgaaacaccagccgcgctgcaccctgcgggtgtcttcttgtctttgactttgaggagtagggacgcctgaggtgaagctcggagctctgcgctacagtctttctcgtcattctcgtttttcgcgaggagtcaaattgttgaagagacggagaagccgacgcgtcgctgtgcgagaaaaaagatccccgcaagaaggctcggaaattgtcgaaagcgtcgggactagccgaggggagagaggcgaggcgaagagagagagcgagagcgaggcctctgagttgtgatcgagcgcgcttagtcgcgagtgcttgagagcgtccgctttttcgacaaccgggggctgttttcgagtttcgtttgtttctcttctccgcgtttccttcctcaaggacagagaaagcgaaccttcttcggcgatctctgagactcaaggcaacaagccacagtgaagaggttcttcgaatcgacgacgaccgctgctttttcctctcttcttcctccagacaaaaagggcgccacggagtctcctcgacgcagcggcgaggctcttctctccccttcagtttcgaagacgcctccagcgaacaggtgaaagaaggccgtttcggcaggacagtttttatcaaggttttctgcactcgcctttttgcttccctaaaacacaaaaccacaccaagctctctccgcgcggtctccttgttcggcgtcggccgccggccggacgttcgatttttttcctcccttctttgtgctctccaggctgcatgttcttcccgaccgcgggaaagtcgcctctctccgagtccatttcgctccgtttttcacctggatctcttcttcttctgtgggggaggggggccgccctcctccctgccgtctcgccgcgagtctccctcctcctgcgtcaaaaccgctctcgctggttcctgccctggagacagaatcccctcattccaacttcgcgtccaaggccagcaccactctgtcgccgagctcgagtcgagagctgcctcggcgtcttctcctggccctgtctccacagcaagaactccactgcgtcgtcgtccttcgccatcttttcttctcttcttctctcgtcttttttccccgccttctctttgccgcgatgtgaagccccgcgaaactcagagatacggaaggcaaaaacagtgcaagtgcatggccgactccgttcgccgcgcggcctctcgcttctgcggcttgagacgccttccagatctccttctgcgttcctgctcttctcccttctctcccgcgctcca

SEQ ID NO: 2714 - DNA, 3458 bp, Toxoplasma gondii
ctttgctgcaaatgatgttgtcgcgtatctcagtagtttccctagaaacgcagatgacttcgctctcccatgattttctcgtacagcgctgcttgcctcgtgtagactctgcgcggtgacctcgaccgctatgcactatcacaaacgtggagttccaaatcttctcctcaaggcccctctggagcatctcccaaccactgatcagtcgttttcccctgatgcatttatcacacagagctcacctttcgcccgagttcgtctgtgctgttcacgggctccacgttcacttcggcaggctcctgacgcctcgatgctgcggccccggatgccgtcttttctctcttggtgggggctgcggccgaaagaactttggcggcactggagacgctcgaagatgtctcagggcgcgagatatccctcaccgcagttctggatcccaacgcacctgcggcaatcgcagcaatcgaggcgtgagcatcttgagctgctgcggcgttgctgaggctgcttcctcccacagggggccgtccctcctttgctctctcgcgctgtgcagctgccgccgccgcaaacacactcgcctgaatctcttcttcttcagcttcttgctgttttgcagcagcaggaggttccggcgcgggagacggaaatacaggaggcgccggggagaagttggagggatgtccaggagaaaagttcgaggtaggcgctgaagagaagttagagagaggtcccgaggaaaagttagacacacgaggcttcgaagaaaagttagatggaggtgccggagagaacttagagtctggaggaggcggcggggaaaagttagaggcgggaggaggtgctggagggaaggcagacgaagaaatcgctgcagagaagttaaacgaagaagctgctggagaaaagttagatgaagaaggagttgcagagcagttcgacctcggagtaggttgagaggttagccctccggcagatcgtgacgcagcggctgttgccaaggcagcttggacagctgcaactgcatgcgcgggcgcgctcttgtctccaggagtgtctccactcgaggacaaagcacctggtggaggattcggagatgaagaaaatgccattgtgtgtttctcgagacaaagcaaacagaaagagacccgtttatacgtcgggtggtggcgcacccgtcctacaactggggactgtaggtcggacaagcagaggccaacggcggagaggcagcaagagaaaaagggatggtgccttcgaataaggaagcaaatgtgaacaaacgttaaagctttacgatggtgcagcgtcgcagagggctggacagccaaaaggtttcgaagacgaacttccccatcaccgcaactcctccctctacacggtcggtcctttcaagttggatgcacagtgaacccacaccttccccaggagagtttgtcggacaaacgctaaattagagggacgaatctgataaagaaggcgggaaacaacgaaaggcaaaacagtaatgcgaggtccacaatccgcgtccgcgtttgagcggggcaacctaccgaagggagagcggacgacgcgaggtatgctctcgcattatttatggtggaagaaaaacttgctatctcaaaaggctttcattggaagaagcaaatgcagtaacgataggagattttcctgttttcttgagaaaatcttcttctccacctccaggaagacggccgggcgctcccctacgggctgcaaccggaaagatgcaggaaaaagaagggaggtaactgcggaagaagaagtggcggaggggcagctttcacggggagcttgctccagtaaaaaatgatttactttctgaaggacattggaattgtatctgatctctatgtctcgaccctgcacagtcgtttgtattcgcttctttgcatgcgctgtctgtctcgaggcgtttcgtagatggcaatgtgctggcgaacgatcctgtaactccaatcgacaatcgttgtctgccttcttcatgtcttgttgcagagaccagtttcatctagtgacacgtcctttccctaccgtgttccctctccgtttatggcaccttttagtctgttcaacaaccattccaatacacggctagagtactacaggtttcacagaaaggcaccagacaaaacctgctcataggctgtcgcacgtactgggacacgcggcgtgagaacaacaacgagggacgggggtcaaggtacgctctcttctccctttccacctggtttttagtggtttctcccacgttcacccccttcaattttgagttctaggccagctgtctgggcactttgtcgacaagatctttccttggcttctggctcattgagcctgagccctggagccatgtctcgccctcgcccccactggcgccctcacaccggaagccacatcggcacggacttttcagcgtcaaaattcgagagcgtgacccgctaacaatgaatggtgctgtctctctgttcgttctcgttggatggaaccgcttgcattcttcttcgattgaccggaagaaccgtttctcgctttccggccggctcgcgctagtctcggtttgagactggttaaggttgtttggtctgtgcgagactggacaagatcttgtgcatacacactgtcggcaggaaccccggtacgggaacgccggaccgcacgcgccctcgtctcatggggtccaggttttttcaaccgttttatcatccgggcattttccacacaccttcctgttgcagcaaagtaggagcctttcatgtcctagccgcttgagaagtctgtctagggctcagttcagtggatctttccacgggtggggcgaaagagcgcgtagcctgggggcagcgaacaggtgagctgcctctttcatctctctaatctctacgggcttgtctgtgtgtttgtgtcttcctgtagatgaacctacgacgggtcgctcgaaagtgtgtggggcttatagaaagaaccgagaggggatgtaggtgaggaaaggcaagacgcggggcggactgttgacgccttcgcgaaaaatgtagcggcgtccagtaacaacacgcaattgtcaattgcggagatattcatgtgctgcctagctggcatgtgtgtccttcgcttcggttggaaggtatcgcagtccggatcgtgcgagtggagaggttaacgagaccccatttttaaacttgaacaagaagtcgatcgcattccttcattcaggacgtttcgcgctttcgctgcccttacccaccaggtgtgtgtgtgtgtgtttatgcgtgtgtgtgtgtgtgttctccacacattctcgaatggcagccgtcttgcaggcagtccgacaacacgactctcgattgacaggagctttccaggaaattcgctcacggtggcagagtgtgccgtttttgctgcttcagcttcagaacctcttagaacctccgtcgcca

SEQ ID NO: 2715 - DNA, 1818 bp, Toxoplasma gondii
gtgtcgccggaagagactgagtgatcactgaagcttaactcacaaaaagaacttcgattcggtagacaaatgacaccttcaagagaagttggaaacaagtcttctgtcctaaagccaatgcagcgtactgagaaacgaacacacatacacctggttccacatataaatacatacatttttatgtatatatatatatatatatatatatatatatgtatttattcatatgtttatatatataatatataattatatatataataataaattatatatatatatatatatatatatatatatatataattatgtatgcatatatccttgtgtgtaattatacatatctatatctatatatatatatatagatagatatagatacatatatatttttttgtatgtttgtagacgacgaccgaggtagacggagaattgcaagggcctgcaggaggagaataggtcgatagacaccaccgaagggtgtggatgtacatcgctccaaacgggatgcatttacaggaaaagactcggaaggggaattgcttgacaaggaagtcaactgccgacagccgtcgaggctttgaaatccaaggtctttcgagcgcctgtctcacgcggtggaaggcccagctaccgtacgggagaaagctcgattccctcctcctttttgtcgcctctccatttccgcttgcacaagagcctcttcggagtgtgtgttttaaaaagagagaagcagaacgacggaaaagaacagcaaagtcccgaggccctctgaaaaaccaagaccagcgcatgcagcgcgaaagggagcgtcggtcctcaggcgctgctgcgcctctgaggcatggctgcttcgtctgcgcgagtcgttgcctgtacttttcttgagtcctcaaacgcagcaagacaagaaaggtttcatggcgtttcttcgcttcttccacgcgcgaaaaaaagaaaaaggacgagaacggacctgtccagctgtcgctcacgcagcagctggccgcccctgcttctctgtgcgttttaacagagcgcctgcgcggaaaaaagtctctctttctgttttttttgtccgcctgtgttgctagaagtttcttcacttgtttttcgaaagaatccttcttcacggttttgcgcatatacaacttctggtccacaaatgaactatcttcgacgcgggtcttaccgtagcctcgcttctccgagtcttgtctgagagaactttgttctctctgaagactgagagaacttggttctctctgaagaatttcttctttgtcccggtcgtgacgctgcacaccgcgttcgctgtcgactcaggtgaccgagacttccagaactcacggcagcgccgttctttccttgaacacggtagcgagtcagaagccagagagaaacgtcgacggacgtctcttctcgtccagctgcgtatgtctctctcgttgtttgtcgctgcatttctactacatgtcttgcgctgtgtgacgttgaactgtcagacctgtcaagcttctctagacatccagatctggatgggttccttcgctccactcttctcttcccccgtctccttcctggtcgtctcttctctgccgacccccgtcctgtcttctctctgttgcttcctctccttccgttgtttattcttttttctcctttttctcgtctgctctgctcctgtctcctccgcttcctctttctccctccccttctcgatcctggcttccctctcttctttcgctgttcctcttctcgctctcccttctcttcctccttctccgcttcctctttctccctttttttcctgaacaa

SEQ ID NO: 2716 - DNA, 3858 bp, Toxoplasma gondii
ctgatacacctgtcacacacacaaagacagctacgactagcacgaatagttcggttcacgccttgctgacagacaaaaaacgtgatatccatcccccattgcgccgctataaataggatctcggtacctttagaaaaacggagaagaagcttcagagaagaccctgaacaacgctccacttttcaagactcagatgacttcatctacgaatctctttccgtacttgcgactggttgggcgaagaagacaatggtgcactcagcatccgcgatgtttgtctacttttgtatgcgacaattaacatcctccgacgatcccaatcgtcagctctccaaagcgtgaagagtaccgccgatatcttcgttcactttacagagaaggtggcgacacacaaacagggaagggagggccacctcttggtcaaaacgtgcttattgggtagatagtgctccgactgtcgactggattatgtcgaagatggagtctcacccagcacctgttgtcagggacattttacaaggcaacctggccacagttgccgtgctttttgcagagaaacatttcatggcgatacttctctttctgttccaaatgaagtgtacggaatgcgtccttatcatcaccaacaaacaccactctgaaaggacaagcgaattgtgctactgtggacacatgcctggacagtatgggtttttaagcggaacgtgtgggactggaaagacagaggtggaagaagcctgtaagctagtgattcaaaagggaagtttaggaaaacaaccggattgaatcacagccaagactgccctgtatgaacctttctaattacactgaagacaggacttaagactgtatctcgcggagtctactaccttttctttaaacacaggggccgagatttgctgccgtgtttctgcagcgagaacacgtgcgacaaacagccgagcaggtaagctacgagaagacgaaaatactgaaaatcattgcgggataaatttagggtaaaaaatgtgcgacacaagtatacggtacaaacggaaaaatatcctcaggttttcgaacgcaacacgggaggaccacctaactctaccatagctttttgggctcctccagtgtggtttttgtttctgaacaaagagaaaaaaaaatctatgacgcacgtgcatagtattgctcgacactggttggagtttcgtcatgtgcaacaagtaaggacgtgtgtttaaagatattgttacggtcttaacagtgagaagagggtgaggagaggttttcccaagttaccggatgttccttccgggaaacatggcgggacaggcgagtaagacaaaaggaacagatttcgagctgaactcttgaacaaacggcacacaacacagacatcgtgaaacaacttttgcgttagaatagggctatttgacgcttctcgcgatggaacatttttgaggactgcagtaacgagccactcacccacaatcctcctttgttcagcagaccggcccaaggaaagaggaaatggaattcaacatcgccatgatgtgaaagggagagttcgaatgcttttcagaatctaacttttgttgacttatttgattcgaaagcgcggtgcctccacgtaatgccccgtaagacggacccacggtgcaagttggagagagaagttatttgggtgaaccgtccgtccctttggcaaggttttgactatcgtacgcagacttctgactggacttcgtatggtgcgtctggaatgttgaactcttggtggtgcagcagcgaggtcttgtatttggcatgtgaaagggacatttgaaagacagattcgaggaaccaagacaagcaagtcgtcacgttctgcagtgccggtagctcacgatagtgaggacaacgagcgggccacagtgttatcctagagtgacaggaagtcagaggaacagattgaagaaaaaacgtcatcttccaagggtgtctctcttgtgcggtcgtgagaccaaaatgggaggcagcatcacaaaactgcgcatggtgcacaaatatcctgtaggttgtttgggtaagatgacctatgcgaactacacagtctctcaccgaatacagcattgagggggaatacgaggcggcggcagtcgtctctgttacctaacggtgacactttcgtcagtccggcatacgaagtgaaactccccaagaaactatcgaacaccttgtagatatccaatatgtcgacctgaggccggcatgcgaagacagggaatgtttaatcacaagttggcgctccagaagggtactaaggcgctcttgcgagcgggccgtatggtggtctgatttgatggagagcagaaacaagttatctataactctatgcggcggcggcgcaaacaatgcagtaaaaaaaaataccgatagaagacccctgtaagcacaaaacattggtgctcatattgacgcagcacggatctgagttccttcttagcgatcggatttgctcacaaccgtagcgtgataaaaaccatcacacccccatacgtcgctctgcggtgagaaaacttatcggtgaaagaggaagcgcctttccacaattgtcgttgtttttctcttcccgctgccgttatcagttgccgtcaaggcaaggaaggagtaagacctcgccgtcccccgcgaggaattcgagagacagcctggcacaagacatcggcgtgggcagggactgacacaccaacggttccaaactttcaccactgaaaccgagttcttcgtttcagacttgttccctccgttgccttggaggtgcctgatttatttcaaccattttctctgttcatcagggagacagtgaaacgattctctcgacttcacttctacccggttcgtctgattaccgcctggcttcagctcgctagtctctgcgtttttgcactgaaaaaaaccgtaccgaattttgtctttcatctgcgtcgtttgttcgcatcttgttcgagttgtatattctttgcgcgggtgggcttccgctttttctgcaaccgcttttatatctcctcttcgcggtgtcgggggggttgcgaagctgtggtgtctccgttccagtcacgtctctatgcatcttgcctcctttccgctttcgttggaatttccggcttttctgttctcccgatttgcgtgtgcgccatttttcgtttttttgcgctttacaactcatctgggactccgggtcttcacgcttgtcaaaaacaaatacatgcgcttttcccccctatactgaggtcagcgatttccatcaccccttctccgtttggatatatttcttaccttactatcgcgtttttcgttggccccatttgctatttttttcatttttgactccgtttacccctctccttacggaacgaggcgcttgtcccacttttctccccgcattggcggcctccgacgcttacttagcttacccgaaggcgaggagacggagggcttgcgtcttttttgcctggcctgtttctcttttgtcaacgtgtctcttgccacttgccgtacattccttcccacgtagtgatagcttcacattcctcggcctcaacaagaacgagatccctcttctctccgtcgggctttgagatttttttgcaggctgtctctctccgcttgttctttccttggtgcctagacaggaggatactcgagacgttgcggaaacacgatggaacacaaagtttcaaagtttcagttttgacgcctacgcgtgaatgaaaggtctcctgttgaaagaggcataacaaatacgccgggcacatagagggatagacacgacaggacaagacgagacagatatccacgcttgtcgaggactccaccaagtcttcatccgaccca

SEQ ID NO: 2717 - DNA, 3936 bp, Toxoplasma gondii
ccgaagacatgtcatttgttgttcccagcgcacaaggcgacgaggaacgagaaagcgaagagagagaagaggacggaccgcatgcaggggagagtgctgaagttgaaggggcgggaagctgcgacggcgaggcttcttgaatgcgaggatgggaactggggtcaccaccagaattccaagagcacatgcacctcggtctggcgcacagaggcgtgaaagctagacagtcaaaagggataagataaggcaatttccagaggcctcgagactcaaacgttcctgcgcggatgttgtcaggatggccatggcttccacttccactctgacaggttttacccccgacctcagcctcggatgcttccccggtgcgcttcccgcgttgggcgcctgacgaggagcttttctgagacctctgccttgtcgacgacttccgcttctccgtcaaaaacaagcactcctcttgctccaagtcgaaggaaatgtagcgcagaggaactgcgtgaagcagcctgcgcatcacagacagacagcggcaggtgccccagggcttccacgcggaagcggcggtgcgctctcggcggttgttcaaagagagtttctgagagcgtcgcgactgtccagaagcacttggaaaggacggagggaatgagtccagcggatcggcgcagacgagcgatccagaggagcagagatgcgagacggtggaacaggaagactgggaaaccaagagattcgggtggaggtcctggtcgcgacaaagcagacaatcggctctctgagatagactctcatcgcaagagctggaaaaagatgtgtacggctcatatgaagagcaggacggagatgcagagttccggggacacggagtcgacatcctggaaactataaggaaacaaaccacttaaaactcgcctggggggctggcttcccagccacacaaagcgagaaagtcgtcgagattaacggcatagagggttaagtggggagagagaggatttcaaagggagagaagggagacttccgtgcaggaccaactaatgaggaaaagaggaaagggtagctccgtcgttttggcaaaagcatctggggccccgcgcgaactccaggaaaacgctctgctgggaggaaaccaaggaaggtgtgcaaggcaaacactccctttaaaggaacccggaaaacgctctgtctcgatcctatcgcctcctatcgattcgagcggatggaggaattccgtgtagaaccgcgcctagaaaattgcaatgccaccatatacaacgccatgacaaagacaccgcgagggttggaggtggggggtgctgctgcagcagctgtcgttggctttgaacatcaaacaaaaactctttgtcaaagaagaaccgcctatcaataaacacgacagaatgtcactgaaacacagaagaagaaaccgagtctgtttcaacaaaaagcgacaaggaaatgggcattcgatcgcaagcgtttgccttgaccggttgagaggcgtggaactcgacaaagtgtgccacacgctgtcgcatgcgcccaaatcgacgcctgtgctgcaatggctgcttcgttcttcgtaatgccttccgtcgagaacaggtatacataatgaaaacgtttcagagttttcttgtccaatctcattcacctcatgcgcgtcacacgggtgtctttttagtggaacgaagaaaagtttggtgtcacaagacgcagaccacagggttgccgttaaatcccgtgttcctcatcctctggcaagaatcatcagcacagaggtgttcggtttcgctgtggcactttttacccttgaatactgaaaagagccttctctctgatctcccagccatgtgcaacagggcagttaatgcttccctgggcctaataaggattcgtcctccagcttacaaataaactccgtactcagatgggcacatgcaaactaatcttaaacacaccgcacacaactgagagtatgagcaaaaacaaagtagtttcctaacgggcaactggaggaacagcgaagcgacaggaaggcgatgtctccggagtctttaaaactagaggtgaaagcggggggaactgtatgtgttaacgcggagagttacctggagaaacgttctcatgtgtgttgagacctttgttttggctctacggcattacatataaacacgcttctctccggctttctgcaagatgcccgtcttctgggggtataacgcctccttttacacttttttctggtgttctctcattagttttgaaccaggggcaaccacttagccgctgtccgtctcggcgacacccgataaacctgttcactcaacttcgcaaggcgttgcttttttaccaagtagtcttagtggacaccagatgtagtcaacgaacgttgggaatgctgaaaaaaggtggaatagtgtttcctagaagctccgtgctgaggtcctgtgcaagcaccgtcataagaaactttaagcttcccgcatagcaaggtgcgggaagagggtgttttgaaggctacgcatatcagctcaaggatagcttcttactcattacaagcaccgttcgatgtgcaaatgagatccgtatcaccaccgtcgcctgaactagcaatgtatttagtgtaggaagaagacgctctgtagccacaaaagcattgtcaagtcgccaccttgttaatgcagactgtttctggtggctttgacttgtgtgtcgctactctcacccgtcaggttcaccgattatttgccttcttcttcagggaagacgcacctccgttcaccagtttgttcgcatctgttcagtttagatgtctcctgcgtctgccgtatctggcggactgtttcctggatctatcgatgtctcttgtgcagtacgctaagtggtgccatttccacacttttttctctgccgacgccggaggcgtgagtgaccctcaaaattcggtccctcacattgcaagagtatcgcaaacagggccgttcagaagagtacagatgaatctctggactatttttgaacgtatagcgacaacaaggcctcgcgtgcatgaacacgatctcgaaggatggggcttcctatccagtaagctaaaacgtacaacatctgttgatccttcaccagtcgacgggcaaaaggtttcgacacacgcgagagcacattagaagaggtcctcacagttttcggcctgttttttcacacctaccggttatatcgtctctctgtgtgtacaagctgaaaactcgatatgcttgcagctaagtgttgaatagaaccatctgaagccaagcttctttccgtttgcagattgtttccaacccagcacagaatctctactgttcactgaagtgtgccttttgcaaaacctaacccatggcatcatctcggccgcttatgagaagtgcaccatctcgcatgccgacagaaaagtttcaacctcttcaaattactccttcagtttcacgtggaacttcggtatggaagcctgccacgcttaaatgtagtcagtgtacgggatttatttaggtgagacacaaaaaaacagccgtcaagatggacggtgcttaaggcggccagctggtcaagcctaaaacccgagtggggggggggacgaattgacacgaaatcgcgggttattttatctttgtgatatcgttttgcgaagtaacgaatcctgcatcaaagagtcacttagtagtcgcacctgtcggcaaaaggttaagatcgggacaacgtgtcagagacaccaggcatcgggactgcgggaaagttgcacgtggcagcggtacgcttgcgggaagtccgttgtgtctcacgctggcgacaagcgatcgaaaacgcatctctgagcctctcccgccgcgcgccgggattcgggaatcgatttcttttccacaaactcgtgttgggattttcctccgcaagaagccagga

SEQ ID NO: 2718 - DNA, 3322 bp, Toxoplasma gondii
atggtgtgcgacgaggaggaccgaggaaacgaaaaagcgagaaaaagagaaaagccggtgggggaagaggcacagagaagacacaaagaaagcaacagagaggcaacaaagaggagacaacggagacgaagcggtcgcgtccgcgtatccgttcgaagtactgaaaaatcgccgctggtctagagaggcgcagcacgatccgaacaaccagtggtcgtttcaacttgtgtactgatatagtctcaaagaaaaatgacgcatgcaccgatacaagcatacatacatacagatacatatatatatatatatatatgcatattatacagaggtggatagatagagttagacagatagagaggaaaagatagttggtgatagatagaaatagatagaaagacagcttgtggcagatcgatagagaaacggatagatagatatgctcgttttcctaacgcttttttgcatgtccactggagcagcctgtcgcaccgtttcttcgagcgtcattatcccattttcctgacaaagacggcgaggtccaaggggagagagtgaggaaaggagttcacgaccggagggaggcagagcaagtgagagttccgccgagatcgcgtttgcctgcaaggaggggtacgctttcattggacgaggaaaggcgagaacagaaggaaacacccgagaagagactgaagtgacgaaagacaacggaagagctgaaagactcttccttcggagagacgaagaacatcaagaaagtcgtttttgcgacacagcagtacctccccccgccctccagcttgggatgcccgagagaggaacccagagaaacagaagaccgcctgctgagaagatcgacggcgcgctttaggattgagttcgctggtgtcaatacttggagctcatcaacaaacgagaaataaaatcccaagaaaatttggtttcgttttttgcgcaaagttgggctagcacttgtatatctacgctgtgtgccgcagacatctacggctgcatgcatatctctctttcgcgtttctcgctgccgcaagaagcaaacaccgacgagaaacgcgccaggatcgacggtttgattatgttttcggcatcgcagagtagatgtttgtcggcgcagggtctgtaggaagttgcagttcaggcctgtccactgtgtaagcgcgcggatatatgcgctggtaagacgaaagacaggcttctgttgcgagggtcgcatgaaagaaacgactgtgcaagtagcatggacacagttcagcctttgtacctgcaggactgcgacatgtacgcgaaaaacaaagcagtcctgatgcgtctctcttttgaaggggactttctgaatatgcgctagacacagacacacacacagacgacgcttgacgctcttgacacggtggttgtgaagagcacagaagatcttgaataaagtgaatcgtcagggaaaggctgaaagcattaactgcacaccaacagctcaagaaaggcgtcgttttcctttttcagagagcgactcgaactgctctttcctccggactttgtcttcgattcagcctcgtagtcgtctgcgtccttcttccgagacttgacctgcgataggaagtcctttctttgctcgccactactccatgcaaaggtgattttatcaagcacggagtattgtcatacgatgtgtgactcaaatgcatgttcttttgacgtgatgcgattgcaatgcaaggtctttttatgcgcctttgtggccattcagtgttgtgttgtccgagtgagaggggaacttctggcgtgtgtcaaactcgagcaaataaatcggcaaattcgctgttttatatcgataatcgagttccaggagggctctcatctcttttagttgtcttcagcgcgccagaggaatggtaaaacggacagcagtcgtcaggaccttgattgcctgtctctcctactggactcatgtacagagtcctacgaatcagacaatcaggaaccagtttcaataaggcacatgagatgttattaaaacaaatataaaagtgtgtcactctctcaagtttccatatcgacctaaaaattccaatactctactcgtgagattcggatagatcccccacaagtttttcgttttctgggactgtgggttcgtatttcttcagcgagtctgaaaagaggccttcctgtgtcgccaattcgcgtcagttgctgggaacatgacttccgaaccggcatttgtgtgaataaaagatacactaactttttcctgttcgaatttaagcttaaaaacagtgcactgataatctcataattgcgcctgtgcattcaagtgactttcagaagacagattggtacagagaagtgataagcatgagcagttgaaaaaacagtctcgaagttcgaaaaaaagcgaaaggtctaatgatggagaataagaacgtttgggagttctaaagcgagataaactatgacgtagacttcgcaaacaagagtctgaaatttcacaggcaagagtgactgtggcaatgcagaaataagagtcgaaatcctcaggtcgtaaaggcgagaagaggcgaaagtgtggaataaaaatacaagagctcgattttcgaaatgggggaatttcttgattcttctccggttgggttgtcaacacaccacccgcgtggtgcccggcgcacacatgcagaaggcgggaggaagcttttcctgtttcacgatttctccgcgggctttcgtcggaaaaactgagataagaatcacaaaaatgcaggaaagaaaaagacgtttttttccttttatatcaagcgaaacgccgtcatcccggccactgtgtttcgccgtcacccgcgagtggatatgtgcatgcagctcgactcttgtcttgaaaaaaaggccgcttttcactcctcacgcgcttctcttcaacttctcttcgtcgccactgggtgtgtttttctgtcttttctagaggtccgcagccgattcgcttctcaccttttgttcctcctgctctgtgtgggcgttttcggtcatccacggtctctcctcggcgtcttcctatcaaaacactggacacagcaggcgtcagaggacctgctctttttttctccagtttcttgtcttctcgctctgcgtttcgtttccaggctcggcagagttgtcaggggagaacggttttttcgcagagaagccgttctctctcccgcttgtccgcttccacatcgcatttgcgcccaccttgcttgtcgaggaaaactgtaaaataggcattcgtgtatcttttttgtccacatctcatgcacaaacggctgtagcgagctgcgca

SEQ ID NO: 2719 - DNA, 3029 bp, Toxoplasma gondii
ccttcatttgtagcatctccagataatgcacctgtcgccacgatgcaggctagctattgttgtgtcgtatcatttccaatatatttgttgaggtgtcttctggggtacagacatgcctgttcagggccaataataacaccgtcgttagagtagccagtccgacccttatcactcagtttgcccgcacactgaagccaaatcaagtcacataaaatactgggaatcgtagtaccaatactctgcgtggggtgttgctcccttggcgttccggcactggcttttgcatgatgttgtgctgcctcgagagcaagcactgctggacgcatattgacccctgagcccgcaatcacaggtccgggtgggaaacactaacacatgtagagcttttacgcgacacagtggtgtgtttatgtcactacttgtggatggccctgctaacagtgtaactgatagtccatcttgtccctgagctctgtcgaagagcgacgaaagcacccgaataaatggcagttcaagagttgttggcggggaggtatccagatcatgtccattttttctatgccctgtctggttccggctgttctaccacaggtactcacgaggagagtagattccgtttaggcatggtgtggagcattgcagactactgtttggttctgtgaaaatatcataaccatcatcattcatataactgagtgaagtaacttcatctgacaccggttcaccttgtcaacgggtaccagtccctggtgttgtcagtggctcagttctctgccagcaacatcgtaattttgaaactgcaaaaatttttgagaagacaatgctgtcaaattgacgattctcctttgagagttccgcaaagaaacggtaacaggacgcggggtgaaggcaacactgctttgccgaagtatacgtgctttgtgtgctaaatggctgtgcatccccaattagaactgtagggtgacgttgagttatactggcagacgggccaaaagtacggatccttcgaagcagttgggctgggatttttgtggcatcttccgttacatggttggtcttctgtcgaatcatctggcactattcgcattacacatgcatgcaacgtcgtcagtagcgaaagccttgccaccgccggcgtggggcccctgaaacggggacaaaacaagaacggcttgccggtttcgccggaatctggggtggtccttcgagagtggactggctctgagcgaaccccgtttgtagaaagggtattaactgtatcacaatacatggctggacgaaaagtgtggcgaacatgaattcagcggttggtgtcccataatctataactttcagtcagttcacaatcagcacttttacaataattctattatgacgttaaactgttcactgttgagaaaaactatgcaacagcgatgaccgcaatattcttcagatgtaatgattgttatggagcgtggatggactaaacagatgcgctgtatgatgtctccgctgtctctgaaagccccagcaattgcgccaccttacgagctgaagtaccctgcttctgtcacttcttacgagaattgcttgcaccgctgccgcaacagcatcatggcatgttcacaatgtaggaaaccactgggggagagtttaacaaataaaccggactcgtccggtggcaataacgattcagagttgcgacggagagagcatctgttcaagcacagaccgtaagtttcacagtctcttaccactttacaataaaatgcacggcatgctacgaagtaaagggcagcgagtgtctgccctggcaatgcaggcattcgttcaaaggtcacaaaacgctcacacaacctgaacatgctagccaattcaagtagaaggaaaactcagggcctcggctccccttgagtcatcatgcatctctactacacagaacccccatactgcaaaagaaccaataagaacacaaagtatttgcgcttccctctgtccacacatgtctgcacacagcagatctggacattgaagtattcctgtcagtccccagctgcatcatttacatcctgaggcgctaggcatgcgagtggtgttcagtcaactttaaaaccatcctcgcctttcgtatgatgactgcttttctggcgacgagatcagggaaggcgtgtctgtcgccaaagttgcaaagcttcagagcgaggtcgaagcggcagaggcgatgctaaggaatttaaagttcaaaacaggctgcctcaacataccatcacatatggaaactgaagtttattttgaaaaccctaaaatgtacgtctcaccctggtaacgtgtgtgactgtacccatctggtacagttgcaatgccgtgacatatttatggtaaaatccctccgaaatggcgggccacattgaagtattgcgtcgtttatcaggcaaccacgatatcaagaaacgttactgcagaggcagaaattaatgatgctttgctgaggtggctcgttcgtcctcttaggagacgctggtggcggatgcgagtgacaaaggttgagaaggacagagtgcctggtcctctcgaatacacaagatggtgatcccaacactgcttaaacagaaggtgtcgtgtatacgtttttaccgacgaatgattttgatttcaccaggattggtacattgcatgatggaggccgcatggttcaaagaagcatctctgtgaaggtgttcaactctgcatcaggctcacaagctcgtacccgcagagcgggtccagatcaagttgctcgtcaagaattagcgacaagacgactcattcagcgtacgaaacccacgagatttcacaatcgacacatctaagaggacacaatcacaaaacttctacctgttcatcgccgaacagcgcttctgcaacctccttcctcaatgcgccggagtctcgagacgcgcaggggcacgtatcctattcacacattgttgtgaagcggaacaagcaagcggatcttcctcaaaataaggcagctgcgccgacggttattaaccaactgacaaaaagca

SEQ ID NO: 2720 - DNA, 2656 bp, Toxoplasma gondii
cagagcgaagacttcttcttccgcgcgatttcgccgagcacttcgtagccgcccagaaccttgggggcgccgaacgccgcgtcgcgctcggcctgcggagcctccgcgagaggcgacgcccgcgcctccgcgactttcccctcctcaataggctccaaagctcgaggcgcgtccgcgagaggcgaggcttgtttttgcgcggcttccctcgcttcgcgtccgcgagacgcctcgtccgcggccgcgaacgccgatggccctcgagaagaagagggagagggaggagacggaggagtgagacaagtgaggggagacggaggagtgaggcaagtgaggggagacgggggagtgagacacgatggaggaggaggaggacagcggtggggagacggcgaagggagaaaaggatctgatggcttctcggagcgcagagactcgcggcagtctgcgcattcgtcggcttgatgtagaccgtcctggagacctgagggaagctcggaagacgcgtcggcaggttcggtgcttcgaccagccgagtcgagacgcgcgggcggactgagaacggggagaaagccagacttatccgaggggccggacgctgagggaggagcgcctgagggaggcgccttctcgggaggcttcggagcgtgatgaggctcgaactctgcagccggcgcctcggccgcctccgtcgacgaactcttcagagaaagagaggggaagcggaaaaacgtcttgcggcgctgcatctggattgcacgcagacgaagaagagaagaaaagaacagaagaagataagaagagaggaagagaagagaaaaagaagagaagaagaagaggagagaagaagagaacgggcggctcgaaggagttcctgggacccgcgcaggctggaagtctctgtacggagagctgagagaagagaaagagaagacagcagacgtgagaaagtgacagcgaaacttggggaagagaattcgagagaggcacagaacggagaaagagaagacagggggatagcaagagagctcggcggcggtcaggagagagaggaacgccggacgaaaacaagcaaagttgacgaagactgtgaacgaagcgcgtcacgagggaatgcggggcggccttccagaaaccgcctttgctccagcctcagaaaagtctctcgccactcagaggagagagaaagacgcgtttccatctacacaaagtcgacgcaaagaacacagcagagaggaaaatttgtgattggcgggcgcagtggagggtgctgtggccgcggagacgagggcgctttttcggagacaggagagagggtgagagttttggaagtgaaaaggccgagaaagaagagaagagaaactgtggttccaaaaaagagaggaaggagaagcgccaactgccgcgcgcgctcttgcatgcaggagagcgcgagagaagtacagtgtctgcgtcctgcgtcgccggaaaggcagagatccacgctgaaaacgggagacgagagagaagaagagcaaaaagaaagaaaagacggaggaaaaaaacgaagagcaaaaggaaagagagagagagaggacaccacgagcggggggaccgtcactctcagggcaacggaaatggacagaccgacgagcacgagaaggacgatacagaagcagaaacagcgcggcgttcttggggtgtgcatccctttttcgacgcatctgtgaaataatagatttctgaaaatcgaaacagaaactctcgaaatacgcgcgagagagcgttgagtgaagaaaggaacaccggagtctgtagacatgcgcctttcctcccgccggcgagcagcggccctggagtcggcgtcttgcgagttcggcaccaggtgaaaacaagcatggagggaaaccggaagaaaaggcaggaagaaaaggcaggaagagaaggcaggaagataggcaaagaagcagagtcgatcgcggtgtctcgacagcagctgaggcgcgaaaactcgacctgggggccgccttcgagtgagcgagagagaaaaagccgagaagcagcgagctcgtcgaggcaagacttgcagctgctcgggtgtctctcgaccccccttcgtcggaaactggagtggacgcgttctcggctctgcacttctgcgagtctgcgactccgttttctccttttccttcctctgttgcgtctttcctttcccctttcgcgactccgccgccacagctccgagcgcgcaggtcgagagaagcgcgcaggcctggaaggaggcgaccgcctggcggttgaggggagttcttctcgagactgcatgcgcggcaagtcgccgatgaacggagagtctaccctgcacaaagggcggagccgcgtttgagtctccgcacagaaaacactctcaaacagagtctccgaaaagacggagaaggcgcgaatctgctcccgcgtctccgcgtcgcctgcgcccgtttttctgcccgagactgacagcgcgcagcgctttgcgcaagtgcgccgtttcgtcggggacgagtcgccagaatctttcacgcttctggggatctgttcgagagcgccaacgaagagattcgacggccgtcggagtgtcttctccgcgacacggctctctgaccgagcattccgcatttcagccaccagaagacaacca

SEQ ID NO: 2721 - DNA, 1369 bp, Toxoplasma gondii
agacaaagaaagattttgttacttttcgaatgagggacggtgaatgcatgagcgagacaagccgagaatgtaacagcgtctttgaaaacgctttgtaaagctccctctacagacacttacctgtcgagtggtcattccatgtggaagggtcggaagagctaccccatctgaacaggccgtcaaagaaaccggcgatgcctccagttgaagaggaggaggaggagcgactgggggcagcagacgaagaatgctttttcttgcgactgtctccactggatcccttcgtcttctttccagaagacgcagccttcgtttcctctccaccgaagacgctccacacgtccaatgtcccgaagaaatcagctgcagaagaagaggaggcagatggagtcgtcggagaggaagcagacgaagcagaagaggcagaggagggagacgggggaacaggagacgaagacatggtggtgtgcggaggagcagagatgggggtaattgaccgtggatgaggaactctcaggagcatgcaggaaaaccgaaaacgcggaggactggggacctgttttaagagagaacgagagaagcaacgacgaagaacgagctatacagaaggatgcgtccacataagaaatttttgcctagcaagcgcctcataccgagatgtggagactttcacaggtgtgcgacgaagagagaattgaacgactggccgtttacggaagcaagagggccgtgacgaaattcttgcgactctgtttttccctcgaaatgtcacaaaacccggaaaaggtacgcagcaaagagggggaccgaatctttaaagcaactttactatcgaagcgcgacgaaaaagagagagcgatggttgagggagcacgcgtaaaaccgacatgagaaggcgacacacttgagggcatctcgcttctggcaggaaaaaccgaagtctggtggagagctgtgtcaaaaacgcaccgagaaaaaggaggggggggaaatgaacttctagagatagcagaataccagcgaactgtggctctgccggggagagaaataacgcgagagaagtgaagcagagaaaagctaaccgggtgcaactgccggcggagagccggagaccgcgacgctttcgattgccacgcagaagcggacgtgggaaacaccgattagagaaatcgattgcaaacggatcccaacgggtgcttgctggcgcgtgtctctttctcgaggtctcatcggctctcgatgagtagcgaacccgatctcagctgctcctctgcacggacagccgcatgcaagttcgcgacccaatcgaacaaggaattcagtcattgcccggacgaaaaactggacgcaggtcttctctttcctaaaa

SEQ ID NO: 2722 - DNA, 4867 bp, Toxoplasma gondii
aacaactgttggctttcgatgtactctatcacaccaacgttactcctcaacggctgcgcctaggcgtactatggacggattactgttatccctcgtgtaacttcattcacggaaacgagaaggtcgtccatgaactgcatttacgaaacgcagctgcttgttgcggcgtaccgcgtctccagcggcaggcaacgcagacgcgcaggaagttgagctgaggaatccggcttggcgtgtaggagatgagagaacgacggcgcgcggcaacgtttctgcagatcccggcgacgtcggacctggaatgtgcttcgactgtgcgctgctcgttttccctgactcggatttctccgatttcccttcgaagggactctgtcgcccagaccccggctggtccagaatctgcagctgagaccattgtcgacgcagattctcatggaaagaccagatggcatctgaaagcgacgagccgtttctagacagagaggcagtcttctcacctcccttcccggaattctgcggaaaagttcctcccatcgtcggagttgcttcgccgtgaaagtcgctcctggtgacccaggcacggacacgcgaggggttttcccgctccggcagcgcaggcgccgtcgaacaaacagccaggggatctgagatcgaagtcaaaggaacattccgcagatacgacgtgatgctgttcagtgtttcttccatggccagcgatgggatccgcgggggaggaaggaagctacagcagagacgccgcgggctctgcgacctgtggaagcaaagttcttggtggaagaggcgaatgaacgaaaccgccgacaaatcccccgcttcttgaggaacctactcgcggtgaaataaacacgagggaaagctgcgaaggacaaggtgaaacgcggcggggtaacgaaactgcgcgctgcacgggaacggatgctcagctgggtcaccgagcgcacagacacacaactcacctatggacctgcgtcgagttgacactcaaggccgatggacggagaaaaaaagaaagagaactgaaaaacgggggcacgccagtctcgattttcgccccgaaagcctcacggaaacgaggcaaagggacccttcagtcgagaatccgctctcatcatgggagcgggcaactgctgccgctcagcagttttgttgaagacggacaaaagcagagaggaaacttcactcccaaaaaaacgataccaggtccacaaaataccaccaaaactccttcaggttcctctttcaacgatgtcaaccgggagaacggcgcgtactcagacgcaaccgccagacagaacatgtacaccaacaccagatgcctagcaaaaaaagaacgcccctttagtaaacctggcgccagcgatcggttggaaaaacagggaaagtggacaatttctcagaggaacaacatcaggaagagacaagccatgagtgtaaaaacaggacgatgaaaaagactgaatttgcgatcttcgcacaggcgtgctgcacggctgcggtcctccatcctgcatgacagccaaggtacggagcggcctactttgtctcatgaaagaacgacagacgggaatactgcgaaaaattcgcagacagacctaaccccaacgaacgaaaggacgtgcgatttccctacaaaaaggccaatttgctcgcagaccccgacagaaagcaaagtcacacgatacccaactcgtcccgcggtgggtggaacgctagatgagaaaagcgtttgctaccagtgatcatcgacaaatcgccagctccatctgtagatggggaaataacccgtaaagaacggcaacaaaacagtgtagcagaaatctcaacctgagagcgattgttggtagatctcaaacggaaatgaaggtagaggttcatgctcgtcactttcgctccgagaaggacccctagtccactgcacaaatcccaagaaacaccgggctagcgctaacaaagcgacatacagcaacaagctggagcgtttctgccggatgcgttccaagtgttgtttcatgcatagctctgtatgcgaatccgtaactacgtggatcagtatgccctttgaacgccctctctcctcacgtactcatgtaggattactcgttactgtctcccttttcgcgtttctttatgcaagtgtctcacgcttatcttatgtgatgaaattaaaccaaagcagtttacaatggtgatactcactttcaacaacacatctgcgccacaaatgcggagtagcttcgagttagtctacatgaggatcgcctccatttctattcgaagactgcgtgaggcatctgtatgttgattccaccattacacgttcacaactctacggccttttgcttagtgccactgtgacacccacgcctttctggcgctgaattctgtcgagacagagtctgttgtgacatactagaggtttaagtcgggcagttctgccccaaatccctaaacaccgtcaaaaaaaagacgaacgagcgtctgcctctctagatgcatgattgaatcggtgcggaagaaatcgcaagcgtagaaagccagatgctgaagatgggtggggtgtttacgtcttcgaaaacggtctcgtgaagctgagcgccgcgaggattgactcttccataaagagtcataacattcgctgccaggcatgcggtaccaatataaaaacaactggagctagcctgcctgatacacgatatgaaaaggaattcctaggtttacatgtccgagtggaatcccgcagcgcatgcattcgcatgttccggtagttgttgccgcctactgcagtgactactgtcggaaacaagtaccacggggactgcagcatcccgtctgttaggaaactcgtcaacgtaaccccagtttcccgattagtgaattgaagatgtgcttgggtgacgcggcacgagagccattcttactgatcgaggcatctgaccacgttttttccaattcgattatactcttccgaagacattggcttcccacagtggcgccgaaagacctgaagccacttttgtcgacaagtaacatcttctgtggaacaagcatccgttctgctggacgtatagctggcgcctatattaaaggactgtgattgcgccatatcgcgaacactcgccagtgccgacattcttcgacaagaaaccgttcggaatgtcttttgagctctgaatcaacatcatttgcttagcagctcaaaagggagtgatagcagactttttctgcctcattgaatgagaggatcaaggctttcagcctcctgaaggtgctggtttgacacaaattacgtagcgtggtctgcggagcagccgtctactgagatccaagaaagctaatggttaacaccgacacgcgcatctaatcagaaatggcagagtgagtttccagacacttccactccaccgcttctctagcacggcagactaggcgcagttaatgggtctcggtaaacgcgtatttccccccagcacatgtttccgcagactcagtcagaaaatttactcgcagaggttttcatttaatccaagaagtgttttgtctcaagaaagaggttgtcccaccgcgtgttcacatggacaactgttacgtagactgatatgtgactacattgacacacaaagagtaggctgcgtgtgtatgtgaaccagcattcactcgctatgttagaaaatgacttcgtcttcttttacctccgatactttgcgttgttatgattgggagagaaaccttttacatgatgccggttacaacaaacacaaacatccgggcaggtgaaagttagtgtgaaccgacatccacgtccaacgaatgaggtcaagataatccggaacacacacatatcctggttggtgtatcctggctgtcggcgacgaggacagatccctgcttgcagagccactgaagacacgaacagcaagcgttttccagcacgacaatcacatgtccgtcatgcggttgtgttctggggggcggttcgactgttcaccgtcacccaatttttggaagaacttgccttccctgctgtgcatctgactgcagccttacacatacaaagccttaactatctggatgttgcaaggtaacacgggacggcgaatgccgtagttcccgaaacaaaggaagacagacgaacttctacagcgtgcattcgtgcgcgccagctactcgagagacggcacttttccccgggtgcgccgtggttccgaagatccaaaacagttaaagtgaccccatgaacgaccattttcggttttcagacttaaacgtgtgctcgagttgtcccagcgcgttcatttttgactgttggttgtatcctttctcgaagaaagtgaaggaagtccgtgtggacgccgagcgcgcatgctcgctgcatgtggccattccatgtgtagacacggaatcttttcgtggtcggcgtccgtggctgaatcgaattcatcattttgagattgttgcacaagcccttctgtttctgcgtctgaatgtctgaacgtgttaccttccgctgagtaccaacgcctcatgctcaggcgaaagctgctgagcttcctttctgtgcatgtgcagcccgagtgtctggctgcgactagcgcatccttgcgcatagaaccgtgaattgtccacatttcttccatccattcctaacacacacggctccggacggagcgagagaagcctctgtttgatcctgaattgagtggtcgagaatgcccccgttttttgacgggcaagccgtctttctggagggaaagatcgtagcgctccgactcagaggagggccggcgagcccgtctttcttccgttccttcgttccagtcctgccccccgtttccaccgattccaagca

SEQ ID NO: 2723 - DNA, 2022 bp, Toxoplasma gondii
agctcaaagcacagcagcatgacgcagcgagagatttcagagagactgaggaggaccgagtaaagcgaagggacagctggagaaaatggaaacatgtacaagaaatgacacaggaccatcgacaaggaatacaaagaaaacatgcaccgtgaatgagagagctcgatcaccctgtttagactgtggaccagactcaaatggtccctaagactacaaggtgaaaggcacaaaaagaagaattcgctgtttctcttgaaacgaggtccaaagagtctctcgaagtttcgcacctgctcctgtgacgaaaaggatcctctcttgttcgtcgcgcttatttggaaacgctgaagttgaggccgaggctgaacagccgaagagaagccgacgcagagcgtccagatttcctgagtttcttgttcgtctttccatctctgtcttctctgatcttcgagagtcaaagacgaagccgaaccttctctctcctcttcttccctcttcttttctttccttttcttttcaccactctcaccttagtgtctcctctccccatcctcgacggagggccatgtctctgcagccgtcttttttttctctctctagtgttttcctctccctcctgtccctcccttgccctactttcttggtccttcttcgttcttgttccttcttctttctcgttctgtctaagtcttcagggcgtcggcagctaggtcttcttctttttctttcagagttggctgaggagaccgtcgctcgcctctctgtgcttcactttccttctcacagacttcgttcttccttcttcgcttcaacgcccctgcttttcagctggagtaggccttttccatccgcttctcttggccttcttcgccgctccatcccgatcttcccctcgcgctggctgtccgggtcttcggtcttccctccttttttttctctgaacttcttctttttccctttaattccttccttctccactgaatttcttctgtgtacgctgagttccctctttgccctcctgaatctcttgtttccccggtgaacttccttttccttcctcttcctctcgcgtccctctctcctctgttgtgtctctgctctgtctccttcaagcttttggaagcatagtgcaggttggccacacacaactccggcgcagacggaggaaaatgtaaaaaggcgaagccggagggaacgggaagactcatgttttttctgggacaaggaactccgaaaaaaacgcgaggagcgcagcggcagatgtgcgcatgtagattcgaggtctctcaataaaaaacggcgaaacgcatgcgccagcggagtgccaagacaccgggagatcatgcctctgtttttgaaacttctgtcggaaaggagagccgacgacccccgaggcgaacagctgtcgctttttctgtttttcatgaagaggctggaggaattaggagaaagagacaaacgacttggggggactgcccgcctgcggaccctacctcgttttcggggacgacagtgaaaagagcttggttcgtctccagaaacgctctctttgaaatttttgtaatttttgtggccttcgctttctccaaatcacctccagtcttgggagcgcgtttcagacgcgccgcctcgcactcaaacggagctgtccggccttttttctgcgcctctgcttcctttcgctgggcttccacagactctcggtctcgttcgcaaaacagggcctcacgctgacctccaagtcttcgttgttcgtcgtctcggtgaccgaattcctcttttagtcgcggtctctgcttttccgcccactggttcctcgttctcttccttcttcttcttttgttctcttcttcttctgttctctctcttcttcttcttctgttctctctcttcttcttctgttctctctcttcttcttctgttctctctcttctctgctccgtctcttctttccttgccccccctaccttcctcccgctttgcttctctctttctctccctttttttccgctgttgccgcga

SEQ ID NO: 2724 - DNA, 3733 bp, Toxoplasma gondii
gccgcacttggatgccaacatggcgcactgggaaatgcagaatgtggggatgttatggaaaaatacacggaaggcgggggtggcaaagacgcgaatagaacgcaacgagatctggtgtcacgcgcaagaaatgtggagtttctagtgcagacacgccgctaggaagactccagggcagacgtccaaagaaccaatgcatgcacactgccgttgagattggaagtttcgctgttcacgcgtccactggccttagagccttggcggatcggcgagctgagaggactgtggtctttgttacggagttttcaaacacagacccaagtcttccggagggaaatagagtgccgccactgtggagtttctgcgctgaatcgagaccggacaggaacgtaaggggaaggaggttgagatcttcgcacgggggaacaccgcgctggactccctcccagatgaggcaccgcagcttctgcagctgcgttcgtccctaggctttcatctggcttcccgtctggcgtgttgtcaaaagataagagcgaagctaaaaagaaaacgagcccgtgaaaactgactcagaggagagtccagaccccatatggaacgatagttgagcaaaacggggaggttttccagttcgctacgaatttccgagaagagtgaacaatgcgccccaactctgaaggaaaagtcaagagagttggcggtatcctaggaaatgccggggaaaagggggagacaaacgggcgaaaagcgagacacggagaaggaacaacggagagacacggcgaggcggagagcaagacagtgagtgacagacaccgccacggacagaaaagcgcaaggacgcggcagaaacgatgggtatggcaagggtagatacacaggcatagagaaggggaaatgggaaagacaaaaggaaaggtccgcctgcgagatgaataactcagaaaagagtgtaccaacgaacgtggacctggaaaaattcacgggaagagagcaactctgtcaggacacactggcggcaccgagcgtttccgacagcggatccgacagcatggacagaaaatccgcggacgagacaagaagtcaagcaattatttcgagactacctcgtttccatttgagaaaaaacgtccaatagacgagggagggcacagcagaagaacgagtcttcgaatccagagaggagctcgagtaggtcgagcgatgcgacctaggtccggaaggaggcggctctttcgggaagtgtgcggaagatagtggctctttcccgtacatcaaaagagagaaaaatcgagaacttgtgattcgattcagtttttcacgatgattctccgatggcagagaagggggaaaggccgggcaacgcgagacctctcttgcagcgctctaccatcgcaaagtcacaactgttgtgacgatctgaacctgatttctcatttgatcgtttggaggtttcggcaattcaagtgcgctgttggtctcagaaacactcccttctgtgcgatgaaggcgaccggtgttccgcattcacttggcgagcatagccgcaccaccaaggtggtcagcggtcccgattagaagggggggttgggggcaaggaactcaaggagggagtgcgggttgggtggcgctttgaagacaagtgatcagaagtcgcaatctgtgcagcgttcacagggatgcatgcacaagcgtgaagcaaagaatggagcacactctcaggtcgcctgaagcttcaaacgaagaagagacgactcacggtgaagcagcaacattattccctttggaggtttttgcaaggacccggaggctcgagagtaggattgcccattcccgaatcttcgctggactcatactcgcgttcagcgtgcttgcttgaccagacccgcccgtagcaactagactgttctagcttctggaggtcgaagcaagtcagaagcaacgggactgcgcgcgttcgacggaggcatgcccagtagcagtttgcacggatgtgctgtacatctagtgtttcgtttaacgacatgaagtcgtagactgtgtgtgtgtgtgtgtgaaactgcgcgctagtgtctgagctccagacgatctctttcgctcactcgtctagcttctctgtcaaggaagggtgtgacccggctactgcgtaaacctatatatgtgttcatggcaaaagatgtatttaggatgtctttccttttgtttcacctttcgtggtgcgattttaacttgccaggcacttttgagagacagtcgaaaatatgtttcccttgccctagctctcgcgtgcgaaccctcatcgtcccggctcttgcaggagcaagacggggctgcggacggcactccccgcacgaggagtcgctagtccggtggagttctcgagtcctttctctgcgtgttcgtggctcaattttcagtggagaaagatgggtatgtgtgtgttgttgaaactaaggcgtacctcgtggaaatatctttttgttttgcttcggtttcgcaaacacaactctggcttttggggcttatcgtcgcaaagtgtcggcggggactcttctctcatgttggcgagcggaactagacaacgagacgagagcagacgagagagctgagcagaaagcggtgaaaacactcctttctgtgtttgcatcgcgattttttgccgcaagacggcaacttgagattcatgaagccgttggttgggagaaatctgctgttttgtagcgagctcttcaccgcgttaatgcggcaatgccgcagtgtctgccagaagcgcgccgtagtcattcattcctccacagtggatagggaggctttgccggtctgaaaacggctaaaaacgccccacagacataacgcgtttgtccttttctcagtagctgtatagtttcctcccagtaaagtggcaaactggagtcttctagggacgtagacgggcgagatgtgagtgcggatacccgcccctcagctattttcgcggactcgaggcaccaggctgtactttcgtctgtgttctcttgcagtttaccgcttccgctgtccttcccgggttcgtctccaaagcgttggctttttaaccatcgaggtgttttaatgttaactcactacagaccatgggagcgaagacaatctattatgtaactccgttcatagaaagcaaaatgctttcacgcttgttgcacgctatcatgtgccgcagcccttggtaacaacgtcttgtttaagacctccctctgttccttcaattgtttgactctatcgtctgcgtttcttttctggataacgcatgtgcaagagattatcgcctttcttcctgcatttgaggtatcaaatcgcctctgtagcggaatcgctctccaaacctaaagtcaagcggtctttcagcgccagcttttcacgtcggcattcaatttttttcccctgttacgtgcagttctagctgtctacatctccgtggcggctcgcacgctgaaagatttcggttccggacgcggcgtgtgcctgccgttccattctgctccagaaatttgcagagaattactgattggagtgtgcacacaagcgagtggacagtcgcctcggtgctgctaagccgttggtttcttttcgctactctgaaacccctttatttctgtgggcctccaagtgctagttgactttttccgtaatgcatgcagtgggaaagtgtcgttgtttttacacactggatggtgcggctttgcgtcctaccacggaa

SEQ ID NO: 2725 - DNA, 4482 bp, Toxoplasma gondii
gtgtcgtgagtgaaggaagataggcggcgatttttccaaagatatgaaattgaaaagcccgattttcgaaagaggcagggcaaacggttctgtccaggtagctgcatgcatcgacccaggaggctcccccttgctacgggaagtgagaacaaggttaaattatggccgtatgtggatctacgttgacacttctcggttagaggagttcaactctgatcgagcttacctccctcaggaagatgccatgcctcagtggaaagaagcgttacgcagaagacgcaaaaaaggacccttgacatcgccaggtaaccaccgaagctcgaattccgaaacagccttccgcccattgctgtcgctttcacccttttgagtggcattcgcagatgcacgtctacttcatcaatgtgtaaaacatctatttacctccgtatacatatgtgcgcatctggagtgagtttcagcgggcgcagacacgaatccacatgcatgcacagggcgtagtcgttcgcggcatcgggggaagaatgcgagtcatgaaatccgtctgccctccatttcacttctccctactttccatatgctcaaaagtgggtaactgacaaacattcgttcacatacgaatagacgtacacatacacacgcataagcatacatgtatacggatgtatacaaatatacctatatatatacattggcaggggagggtcatatgtccacgtgcctgtttgaagcttgtcgagtaaactaagaagagaaaaactggaacaaaagagcgaagtacaccaagcgccgaaacggttacttggcgtggttgagaagtcggcaggtgccgacgcgcaggagttagcttgggcgttccacctacgggacacagattctacttgcgacggggaaaacgcgcagagatttgcgttcgcattttcttttcaagcatcgaggttacacacggttacactttcacaaattttgaaggaaaccacggaaatacccatgataacagtttgcgcgtatcagtggacgccgactgcggaccggcagagacaagcggagacaagcgtctaggttcgtggacgcagtggaggatccgcaggttgtttgaaaacaggggaatttaaccgattttttcgtgtgcaaaggcagtctcttagggcacgctacagaagcgaacgaaagcaaaagcgtggtcgtcgtaccgcgctttagccgctgtgtcacggcggaaatctgacgcatgcagaaacggagacaccacgcaacggagggcggggtagcgaattgagtctctggctcgcaacgaggaagcactgttagtcgtctctagacgagaattatgtaccgacacaacgacacaacgatttcgatttgcattgacatttacacacccagttactggagggtattttgactacagaatgaaacagcgtctgcgcacgacgaaggacagcaaattcgtaggaggggaattgttgattttcagagcgattttaaggcgacaattatgcacaccttgtgaaaagacagtggaaatttctttcaaatccagtaaaagcgtctactaccatcggcacactcactcaagtaggcgttctgttgccagcctgaaaacagggctaaaaaggtatcaagggatcctcttggcgacgttaaaactttcacgcggtgcttcgttctctgtgcggatgtgagtgtctttaatgccttatgatattgaaattaagccttctgagctgttttccgcggttcagtgagcggcggtgtacagcaatcgtcaagaactcggccgtctatgtctcgtaactggagtcacccattctatctccaaggtaggatgctgtctccttttattcgatttgcgttgttcagttctggacagcggacgagagaatttctttgctttccgctgacttctgcgatccgatatgcgcgcaagttaagtcgacagcaccgctctgaccgaaatgtaggaacggctacctagccgtctgatgccggagaaagagatgttttagcgccgcggcaatatatgccgcacgagtaaaaatggaattctgaagttgactcgggttactctgaaactatgtgctcactggtttgggctagaaagccttgaaggggtgtaaacatgtgcagaagggatttcagaggttgctatttttagagccctgtagaagaatgtagttccaaaaaacgatgccgagcgactcttccaatatgacaacacggaaaggtcgacaaagagactcctctctataagtatttgtacgatgggggacttctgaagctgtggtaaaagcctatgtactcggagtgtgcttgcttttctccactcaggaggtcacgcgtgcaaaggcaagttctcccaggcaggtttcggttgccgcctggactacaaactacctaaaaagacaaaggtcccagagagacaggctgtaaaaagtggagcatccttcattggccaagagtatgtgagggagctgcacatgcaaacgcttacacgcacttgtttaagcttcgtgtctgtcgttcacggggtcccgttgtctcagttctgcgagctagctaggcaaggtcgagtctatggtcagggaatgtttcatgatgttggtgtcaaaactcccggattcccaacattatgcggagagttgaaacggcggaaaagaacgctcataggagactgtttcttccgtgatcatcgccggacatgttgcctgatgatttggaatcaaatcatcccatccgggttctcctgccccgcactacccctgctttacccatcctttttcgaaatggcctcaaatcatcatcgtttgcgctagagcaaccgagcacatgggcaacaatttggagtatttcgtctccaataacgaagacggacttaaaccgtaaacttcgttttttgcagagaaggcaagactgacccgcccttcctctacgttggaccccttactagggcgttttagtgtacattcgcctgacacgccgtttgaaatccaaatgaaaaactcaaggcaaagtacggtcgcgatacttccgattcggagggaacgaaaagagcttcactctctcgttaccggttcgtagagaatccgcagggagtttagtgttcacggaagtggcgagtgctgcagaataaaccagttagcgagtgactagactgggaagccgtgagaggcagtctccttttctcgagagcatgtactctgggtgagactagtgatttcgattatgactatctttgtttaccggatccaagttctcgcgctttgtatgctgctgctgttcaataaaaagattaaaagagcgcagttgttccgcgaaatacgtgtcaaaaacgttcacgtaggcatgcacaagttgtctcaaggccagcgtagacaccggttttgtatctcttcaaacaaataccagtcaaacgcacaagagtccggagattcacaaggctctgtggagctataggcgaatcttcgaacgagcggtgttatatcttgcggcactgcgctttcaattcgtccgtcaaaagctgtcagtactgaaactttcatgtctcaaggtctaaactaaaccgttttcttacaaccagtctttgcggatgccttcgaacctgtggcgggaacaccccttctctggtagtaaatgtgcacgccatgagtcgaaaaaaagaactgggtgatttgaatttcatcattggagtcacgttcattgtcctctgtttttttagggtctctgtgtactcgactggagtttcgttcgatctcgagcaacccaaaaacaggatgctgacgctctgctctggaccgggttgacgaggctctacacgccgtccggcagaaccacgaacttgaacgaccttatttcattccagccacgaaattagagcttcccaggttcgccacatccgtgtcagctgtaaatggacgcactcgcagccaacagaatcccgggaaaagagaggaaggtgctcggtgtccatattgcgggccagagagatttgtgcagaagcgttttgttgcggtagcttgcatgcaacagtctggggcgcaataaaggggctgccatcttgacttcgaagtcacttctccgtctcagactgcggagagaccaccatccacagttggcaaacttgtccgttatcgccacgggagctgccagcatgctctatagttttctcggggttcagattcgcggtggtgtgctggacaccggaaatcgtggccactgaaaataccctgcgactcccgtccttttttgtggactcctttttcaacaaactactcaattgtcccatcattgctgtttccctctttctctttaccgacagtggctgctccttcggtcctgtcccgtgtccggctccccctggatgtcgcttttctgcacgcaactcgacggtctcccgaaacgtttttctttttcctgttacaccgctgataacagctctttccccccgttttcccgcgcttccattccgaaaagaacacacga

SEQ ID NO: 2726 - DNA, 932 bp, Toxoplasma gondii
aaccgatcctctgcctgtctcctgttcttcgagaaagaagacacacgcagactacagaagactgtctcctttccttcttcgtctcaccaatatcggggttgtcgtaaggatttcctttcacagcaatgaggaccttgctcttcttcttcttctcctcctcctcctcttcgcctcccgaactcttctcgtctccctcctctcgcttctcgacgtgtacaaagagtgactcgatcgtccaccttcccgtcgctccatcttcttcttctttttcttcttcgtctccttcttcttctccttcgtttccttttccgtcttttttcctcgagctggacgtccctctggaccgtttcacatcttcgtaggcttcccccgaggcaacactcacgagggcgagatgcactgcgcgaatgcggtcgcgcagccagagtttgaggaggaaaggtcgctcgcgcagagcgcgccagtcgagctcatctcctgcaaagagactctgcgaagagagaagcagaacagaactgacgctcgagagtctactcggttgaaactgccggagtcgcgcgagcgaagcggggcgcgttctggactggcaaccacacgcgtcaaaggaaaaaaggaacagatggaaatgagagaaaacgaggcacttgcgtgagaggaagcgagagaacatccacacacaaacacagttcctcgaaagcggcaaacgaggtcgagaggtcgctcgggcatggcggcgagagcgaacccacgggggagaggcgctcgccaagggagaaggaaaggaaagagggaaagacagttgcgagactcgacagttaggaaaatccttctgcggagaagaaccgcgccctccaacagagcacagatggttgggggggacgacggggacatgcgagagagaacaagacaaggaaggcccccgtgtctcccat

SEQ ID NO: 2727 - DNA, 2084 bp, Toxoplasma gondii
gaattccgtgattcaactggcgatgacatcacgctggtgtttacaactgtgcttgccccacatttctctgccatccctgtcgtcacgtgcgacaactgctggtcagggttcttcgagccgggttcgttgcaaatgcccacaaaatctcctgtttgaccactgcaaggccaccccgcgggaggcgtttcccacccagtttcgcttttgactttctcagctggcacgcagagacgggaatcatggttgagcgtgtgactaccgtcccactctgtcgtaccatacttctgagtggatgcgctcgatcgttttgtcaatgaagcaagaacacgagcagcacctgggacataaaacgaccggcggatttgcagatgcggcattgagagcactgcaggatggttttccaaacgacggcacgattttctgccaagcctgagaaacagatgaagagaaggaaagatagtgcaccctccttgttatcacgcactgtgcacaacacgtacgcattgtaccagctgtgtggttaccagcacagctcaatctcacaaaacagatctataccggagacacttgcacaacatccgactccataaacgaccacgcgcgagcatccctatgtgccagttgtaacggagtcgcaggattttgaaacccagaaccgcttgtcagagacagggaaaatgctgtccctaccaccatggtaaccatcaggccagtagcgtgaccagctgcgaacactcaataatgatggtcccgccttgcatgtcacttcaggggggcgccccggacatgaggaataatgaggcttaattagccatatcaatcgaccaaaacttgaacagcccaggaatctgaaatccggcaacgattaccaccggaaatgcctcgtttcagagctgccgtttcgtttgccacgcacatgccaccagtcacatcacacccggtgacgcggaggatgacacgtccaatcggtctcttccggaaaaggaaatccacgcagcatgtcatctgatacctggtgctggatccggcgttattctttatttcccccggagctagttggccaaacacgagatagggtggtagcagttgaactcacagacgccggaccaaaacacatcagggcatccgaaaatccttcagcgacgtaaagcaacaaccaacaaaccctcacacatcgtatatcaaagaaaaacgaaaacgaacatgcggcaggaacatggcggttcacccaattgccactgcgccggaggttccgcatgcatcgcagccagcaaggaccagtggtcccatgctccggtgaagagagaaagccaatggaccggctggtgcgtagagcgcctatatacctcgcctgatgcacacttgttgcaacgggtgattctaccgtggtgctagccacccgttgtggactactgacagtcaaaaggcgcattttcccctagtggaaaagcacacacgtttttctggagagtgccgcacccattctagtgatgctgcttagctgaacggcgatattgtgcaagcagtggtcgaaccaaacccttcgtccaaaggttcgctgaagtgttgatcctgcagtagtgtacgtaccgccgcagcgtttcctagccagtcacagccgcatgcgaaaatgactaggtcggagccttgtggatggcacaatcctagacgtttcggttcaccggcgaactgaacaatcctttcgctgagaatctgcgaacaaacagccctgatggcagtacctacgctaaaaagggttctcccctggggggtgtgctttgccctacttctatacgcagcacttgctgaagcgggttttcagtttcccgacctcaccactcaccccatcaagcaacacgcgattccagtagaagaattctttcctgtcaaccggtaagcgactataagtttgcctttgctacattcattagtacgcctaactcccttcagccccggagagattgaccaaggtgtagcaaagagaagtaaaccgagttctaccagcagagggacaggagatgcagctggccgcgatggtgaagcagcggctccgacacgttcgccattcattcagttgccaacaa

SEQ ID NO: 2728 - DNA, 2020 bp, Toxoplasma gondii
cgcttctgccgatagttccgagtttcagaacaggcagaagagacagaaggaaaagaagaggaagccgagaaggaagacaaagagagaggagaagaggcagacgaagaagaggcggacgacgaagaggcagaagcggaggacgaagaagacggtgaaggagaagagaggcgacaaggaggagttaacgcataggcacctgaagaagtagaggaaggcctgcatttttttcgcagtgttttgtcctcccgctcggtctcgacttcctcgcctcgcgctcgcttctgcctgcgcattccatgcgcaagcttcggactctccaccggagaaggcgaaacctcctcggcctctcgaggcctctctgccgagggagggtcatggttctcatccatagtccgcccatgacaaagagaaggagaaagcgagaaagagagagaggagagcgagaagagagagaagagagagagaaggataggaggaggctggagacgagaacaaagatgaaaccgagaagaaggcagagatggagagtcctttgtccgagcaggtcggagagaagagcggtcgaaaaaagagagacacacacgaagcagcagacagaggagaccgagcgagtttgtcttgaatgcaagagagaagacaggcaggagaccaaggggaagaagaggaaggcgcagcaacaaacaacaaggcggacccaggcatgaccactggagaagaagcatttagagtctttcgtcgcatcaagttccactttcatgtacacacaccgtcgcaagtacatgcgtaagcgcttgtccacatgcgttcaagattgagagttcttgttcgctgaagatccccgttctcgacctcgctctctctcctctgctgttctctcgtgtctcctctctccctccttctctctgtcatttctcgctgtctctgtctatctctctctctctttctctgtgtctctgccgcgcttttctcctcctgctcgtgggcagctgtgcgatgctttccaagaactgtcaaaaggcggaagagagagaaagcagacaggcaggaaagcggatcttggagacgaaaagcaagaagaaaggctttcgaagtgacaagacaagagagggaggttctttcactgcgactttgcgtacgcgggggccgagtcgcgggagagacggatgcatgtgcggcgaggtctctcggatcggagacgggggatgaaactggacgttgaaaaaaaagagaggcagaggcagacgcgtctggcggccagcaacgttcaagccagcaacaggaagaagcgagagcggaggcggcgaagaaaacgcaaagacggccttggtggaagaagaggaggagggcgcctgctcatctccacccaccgttgccgggcgcactgtgaaaagcgaacaagacaggggggaggagggtgccaagttgaggtggagtgagggagacgagagaggagaaaacgcgttttgaggaggattctccagatgaagtgaggaacgcctttcctggcgaaaagactcgacttctggggagaacctcagggaggagaggaccgcaggggtgtgtgcggcgcgagtggtgcgagtctcgagtctgacggcagcgctgaaaaagctctcttttttctctgaaggcgtctcctctgggtcgccgcgctgtctgtgcgtaggcgtctgtgtccacctgcgtcgagtccagaaaaaaacagagaaaaaagactcgccggaagtccactgcctcagcggccttcccccctgcttcgtcttcatctgggccttctccttcaccggaaactttcggggaacctctctctgccggagctgcttgcgtcgatagaaagcagcgacggtggcgcggaacgaagaggagagacgccgacgcgtcggcggcctccgagcaaaaaaacgagcgagaactctcctctccactccgaccgaaggcgatcgctgtcggcccggagaaaaagaaaccggtctccccccggtcctcgttgcaactggtttctccaagatcttctcgcata

SEQ ID NO: 2729 - DNA, 2729 bp, Toxoplasma gondii
attgcgagaaacgtacatggtcaaggagttagcaccgccgccggtcgggtcttcctcactactgggcatgcctctgcctcgtaccatcaccgttgttcaagttcctcttctctctgctagcgagcttttggtggcgccactgccggcgcccgtcgagcgcgggggtggtaagagcacagaaagacaggaaaaagcaaagagtaaagcccgtcaaaagaccgccggctaccctgtgtcctttggaggaaagggggagttcgcggaagggaaaccggggaagaaaaaggagaacgacagcgggagccgcgaaggtgaggacgggcgcggagccgcgggagaaggtgcgttcacgcgggaggttttggagaggactttgcgggactcttgcgaaaaaacaggtttttctgacgttctcgacgtggaaaaggtggtggaagccattcgaaaggaggcagcaaaacgagtgaagcaggacagttcttccgaaacgtattccagctcatcggcatactgcgacccggacgcattcacggaattcgccaccgtgctgtaccccgaggcctgcgcacgagttgagcaaagtctcgcggtggaacagaaaagcggaactgtgaaaattcgcagagcgctgaaaaactctctgcaggcagttggtgaatggtgggctgcaattcgcggacaatggaaatccccctcgctggcgaacccactctggcttggggtggtgggcttgggcgccgcagcggttgttactctgttcgcatccgtggctgtaagaagacgtaggtgaggtgatgagaaagaactagttccgtctgaaatttttggacgagttgtcaaaaaaaatgctgccaatcgtgaaaagatttgctgcagatgcagcgggtgttttggagaacagtggcaggtctcttacgcaggtggagtgcagttcggttctctctagacacattaattgccaccgctatttccacgcacttcctgactgaagtctctgtacaaacatacttagagatattcgtgtagttagatttctttcttcccgcaaaattgcgaattctgcattccagagttgtagagtatctcggttggtgaaatggatgtagtactgttggagtggaacacgcggcagtatataaaagaacatccgaaagcagggctagaaatcgtcggcgaggacttaggactatagtaagctgctcagtcctgtaaaagaaaattaccaaacagcacagaacagtcaccgacggtaaactgcagttgactctcaaggcttttgccagcgacttcttatcgacagacattttttgttattctttcagcacaaaaagtcggcggccggtcacttgctagacaacaaccaaagcacagccagataccgacgctgaagtacctagtcaccgtctacggcttaatggttccgccgcgcagatgatgccgattaaaggatcggatttcctgaacagccatatgtagccctgtcggttcttcatgttggtcttagtggcgtacggtatttctgtcacatgtagatgctaccatcgcgtcagattcggtgctacgaacgtccaagatatcgatacgttcagtacaattatggcgataccactgttgtgttacgaaccggctgcgtggtattacgttagctctctgtgatggtccttcaaaccaaaagccattcttcattatcgatacgttcagtacaattatggcgataccactgttgtgttacgaaccggttgcgtcgtattacgttagctctctgtgatggtgcatcaaaccaaaagccattcttcatttccttaccactggcatgcagtccgcaacagggaggcacaagacaaagctggcatattgtgcccgtgagatactgtaaatgtttaatggacaatcagagttgtgtttcagtccattcgctgcgctggtatttacgacaaattgcatggcgaatgctgcaaaagtgagaaagggtgaaaaagatcaccgcataacaccgcgcgaaagcggcactgccctgtcaatgaaactggcaagagttagcgtacagcgaccacagggcgcaacgcaaattgtcaacggtttgtccctggttctttcgattctctgaacgtgccgcattccacgccgggaccagaaaccttgacataagtgtaattttgactcctgttcacaagttcatgcatttaacattctatttccagagaaacgagcgcggctcaaaaatgttttgtgttggttttcgcggggtctaagtgtatcccatatggtgcgccgataagtcacgggagcgaagaaggtaaagcatgcgcatgcactcttctttttttgtgaagcatgcggttgttacagctgcctctgcaactgtactggtgagaaggcaaaaacaacttttcggtacgggaactttgcatccgacataatcagtcgtgtggatgtgtgaggcgtggatgtctggtgtcgagcagtgctgcgaagacttgcctattttgtcgcacagcgaaagcgtgttatctgtgattttcccaactctcacagttaaacagtaatgatctttttttccatcatcctgtagacaacgtccgaaaaaaacgactaccaatcaattgcaaacaggggatcttcgctctacgccaaaaacgcctccctttctcggttcttcgtcctgcaagtctcttgccggcagctctcagttcaaccgaagaaaagttgccgcccctttctcgagaaaa

SEQ ID NO: 2730 - DNA, 1294 bp, Toxoplasma gondii
tagtcaagctcagatgacgcaatgagacgccactcaaagataactgcgggctccatggaaagacaattctctctgcagacagcgtgaagaacttctcgtgtagcgctaatgccgcaatacacatctatatttctcttttgcagagaaaaaggtagctgaaatacgcgtcacaggatgcatcaattacaccaagaagacacaagacgcgtgtgtgtttcaagagcggcattacttccctgcttcgcatttttccttcgtcgcggaagcggtaaaaaaaaggcggtgcccctaacgagtaactactccagcatattgaatgagtagaacatcggaatggcgcaacaaggcaattcatttttctaaagcggaggccgttctttggaattgaactcacgtagaggacaagcatccagtgtggaagcctatgcttccgaaagaacccaggcttatgcggatttatttcagaataccgtagcagtttcagttaagaggcactgtaatggtggcagatataatttaccactattatgtgctcctggacccaacgacatttctgctgtgccatagctatgcaaccccgaggttgctgcaagagttttcggggatataggacaactttggataccgttgctcccgggtctctgccgtgtagtgaacttcgtgcgctgcactaaacacggcctgaaacacttcgcctgttcacacgccatctttcagacgcgtagccctatcaatggtgggtacgtttcggtcttcgaaacccacacactacacgtttggtcgcctgcaaaagttacactgatgacgtgaatcaaatctgcagtccagttccgagccagtctgattttggtttgttgcatctaggccactccgacgctttgaatctgccacacgaaagcagggacaggagatactcatagacgctgttgctttgctgccgtgggagtccctgtgttcacctcgctggtgacttatagtgtgccctgatgatgcacgtgtcgcgggcatccccatgtaaaggtgactcacccgatctatgggccttttttggctcaagatgatccaggcttgttgtcaccaagagtccatcgtttctgggattgatacagtttttctttactggagcgttgagctcgtttccctgctgacagttgacacgttgccgttttcacaatctgtcattgcgtgctgcattctaatacgacgcacagcagtggaggctcccgcctcacgtttttgtcgccgcgctattgtgtgaaggatcagttgtcttgccaagagcagcgccgcgaaa

SEQ ID NO: 2731 - DNA, 1997 bp, Toxoplasma gondii
cctccgatttcctatagacagtcaaactggtgttggagctcattggttattcgacagtccgcgctcaatatgcggcattccaatgagagagtttgctgcttctgctttttcaagcagcagcctctctgggcacttccccatcttcgtcaccaaagccattcagcttccaaagcataaaaatcgtgacaaattttgactcaagtgcaatttgtgatactgtcactcggtgcgccccactcattcgtcttatgaacagacctctgagtcacgctgacacctgtccgtggtaagccgatctgacacctattctggtgaaggatcaacagagaatggcgtcgaacagaagtagcctttgaccggacagctcgcctctcgagagaggcgcatcatcactccacacgaaatcgagtggcgatacgtttccgtcgcacggtaaaagtgtcgctcggtggacagtcgccgcacaccagtctcgtgttagatttgtttgtgctggagaaccgcctgccggaagaggattttcttatgagcttcaggctgctacgaattctccctggtgttgtttagcgactgtcaccaatgtgtttctgtcctcctgtaccgcgtaaaacggacatttttcatattgaaaccggagcctcaccgactcggcaacatcactccgtaacgacacagtcgcctgagcacaagacagcgaagtccgtgcctacgtattcgactgaatgcaatctggaaaagctctttcgagttccatggacggagatcagacgatcttcgcttgttatttgattcccggggcgtcgccgcatacggaatatatccgctcaaatgcaacaccagctcccggcaagatactttcagacatggcacccgacagaacatgttagaaaacaccttccaggtaccaaacaggtcgctgtgcgactaagcgcccgtgtggtactgtcgcttctgcgagccgacgttagtcggaagaacgcccacaaaatctgcggatacgcatgtatcgcctagagggcatgctttcgtgttcttgtgtattttaattcacacacctcgaagagtacataaccagacttatagttgccgaactcccgcttggatatctggtgtagctttatatcgactgactataaccacttcctccagcgtcgaagctgtgtgtagaatctttgctgcccctagaaaaccacagcgttgacacgtagttgccagctgcttttcaacaagactcaggctagatacaaaaagtcactggttccgatgagtaagaacagggacgcttttttcacacattagcgtgcaagtaaatgggtgttttggggtggtaatttggatgcatgcatgctgtgcctttgcgccgccagaattggttcaaggagacaatcctcgcaggttccactcaggaaactcgcaagcatgtccaccgttttcatcagcagccttgaccgagccgaaatgtgctttagtacgcgtttaacgtggctcgttcagaagtcagtaagagcggacagacttcccggggcgctgcctgccttctgggttctcgtggcgcatgtttgaagttcgattgaaacgcgttctccgcttcagtcgaaatgtgtgttcagaaagagagtattcctgagttgttctccgagaaggggtcagaacagtattgctgtcacgccctgtaaaccgtctgcggcgagtgtgtctgcgttggtgacgcttccatgccgtgtcgcgtttgcaggggggactttcgacttttctgtgtatttatctcgcctgtcaaccgctcgtgcccgttcagtgttgaatgcctgagtggtgtttttccagcgttttgagcgatcttgaattccccttcgaaacaggccgtcactctcctgcgcgtaccccggagtactacatgatgcgcttatctgtccacttctttgcgtagttcgaatcgaataaacaggaacctgttgtctctacgtcccgccgctctgttttccctccagttcagtaca

SEQ ID NO: 2732 - DNA, 2717 bp, Toxoplasma gondii
ttcgactttgttcgttttcatgtcagcgaggttcgcgaggcagatcccccacttgagcgcaggagcccagaagtgaatggtgaaaggccccgcgggatgagctgaaggcaaaaacagaagactctgcacctcggaagacgtaagcaccacttgcctgctgcggaggggttgctgcacttcagcgagaaaaggctgaaaagtgcatgcagtctgcttctggagattcaacgaaagtagacggtcgtgctcgtcgctggacgcatccaacagcctgtagagacagtttcacctatggctgtatgcagaggtatttcaaggaccacacacgcaagcacagatgcggctatcccccacacagtcccttatatccatgtgcacttcggggtgcaagaacgtgacacaggtaggcgtcgatgcctgcatgcaccatagaaactcgacaccgaaaacacacgacaaaagacggcgcgtgtcaactctggtgacaaacggggaagcgaaccgcgaatgaaggggactccaggaaagaaggaagagagggaaacggggaccaagacagtgagagatgaacgcgagaagatgcagaggagaggaacagaaaaactcacaaatgactttcttcacgcggtccgagaggggtagctggagcgccttcgcctggaggtagggagcgaaccccgggaagaagattttgtggaccacagatgccatgctgtcaaactggaaatctccttcgctctcgcctcctctttttctgttgccacccgagatccgcttccctgagtcacccttcttctggtcgacgacccgcgacagacgtgggcgacgcgtgtgctctctgcaggttctctggaggtctcttcaaaatccacaaaaaaaaccgcaacacgcttctgccgcaatgctagccttctcgccgttctcacgccttgtttcccgtgtctcgacactcgctttcgctctgcagaggaaccgatgctacagaccgagcgacgtggaccgccttgtacaccgacacaaaaacatggagccgcaagaaatggccctgcatgcgggcctacctctctctttagagatagtcgcacggtggatagctctggggaaaaacagacagagtacgacgtgtgctggaatagagagccggaggtcgacaagtctcaacgaagaactggggtccaagcagcagagaggtcctcgtgattgtgtctctgaagaggttgccttaatttaccacgaaaaggaagaggggaggaaacagaagaaaagacgaaagttcatagacaacaatgcacgcctggaatccgaaagacacagagctcagagttgccagggatggcactgctcgagaaacctgggagacagatgcagcgaacagacacgggaacaacggactcgacctcgccttctcattcacttacaaactgaaagtcctttcgcctccccagaagaagtgcgcctttctcgccgccggaaaaatccttgacagtgtcagtgtgctttgcatgcaccagccgttgtcggccgcggggcgacaggacgacacacagcgcacgcggaaaaacctggaaggagaggcggcgagactgtttccctgtcacagtctgtgtcgaatatggcctgctcgaaaggaaacagggaacatgagagaaggcagaaacgcgggagattctgaggggcatcagcagcttttttctcggtcaaatagcctagaatagcggctcggcctcacgcagctcgccgcgcctcccgggtgtatatacacccaaagagagagatcgctagtgtgtgtccggggggagggttccgcaagcgcgggagaggaatttgcgaggagaggtcttatcatgcgtttttattgtcttattttcctgggttcggttggggaagatgcttttttccttctcgtagcgattgacaagttttgccaccggatattgtgaattacgtggaccaccagagctcatcgctcgctccttttgccttgccacacatcgccaggtgtatgcacaatacctgtgtgcgcgcaccagtctgctttctcgcgagtttcctctgtgtgccattttcgtgttgcctccctttgtgtttctccggatttctgtgattctctccgtttaagaagagacacactcgaagactccttgccctccgcgcaggagcggcggcccagacggacgcacatacctctcgcggcaacgcgttcttcctctgcatgcgctcgacgcatttgatattgaacagaacgcgactgaatcgtcgcttgcgcgtctcgagtctgcgccttctctcgtccgcactgctggcgcccgctcaagtgtagatacacccttcccttgtctcaccccggtccccagacacccggtgcatcgacggcggccgtgtgccggcagccacagtctcagtctccaccatcacggcttccatatctccccttttcgtcctctactctccgtctgtttggtcttcttgctctccacctccctttctcgtcctgccgaattgctcgtgtgactcctctccttcgcgttctgcgtcggacaaccccgttttcctctccttgcctggagctccctctttttgtctctcttcgtctgctctcgttctccatctcggtgcacctctacccggagggcagcttgggcagcggttgtggtaagggcctccgcgacacaaattcttttccgcggcctttcgtgtttcctgttcaactctcccga

SEQ ID NO: 2733 - DNA, 3350 bp, Toxoplasma gondii
ctttgtctctgttcctgcagaatcacatggaagtttccgtcaccccagacgtcggccgccactgagggcgacgccagccaggcgccgagagagaaaggcgcggagtcgagactccatgccttctggcctgcggacagttgcagctggaagcaagtggcggaggagactgcagacgcaagcgaagacgaagagagcgaagaggaaatcagcgcagctgcagacggcgaagagagacctgtcccggagccgccgcgcgtctggagtccatgctggacaatcacctgcccagctgccgtgacagccgagcgccagagaagctcgccgcctgcagccgagccagaggagacatgggaggagagacgcgcagcagagagccagacagggagacttgagagaagcggagatgagaaggagtcgaagaaaggaaacgacaaaagaaacacagagcaccgagaagcagaaaggaagaaagggggagcaggatcggcgagagggagcgagcagagagaaaaagagaaagagagtgaacacacacgagagagaagaaagagaagagaaccagagacagcgacagaaagacaaaagacgaaaggcacatcgagtgaaggtggcgtcgtcaagttttcatgtctgatctctccgtcggctgtccatccacccccgtccccctccccccccccccccaagtacctgacgcccgtctctccgccttcgcctcgtcgctttcttctctgccgtttgggtcttttcctttcttcgtaccgtgtttgacttgctcgccgagaccagtgacagcgacgctgagagcgcggccgagcttctgtgtgtcgattctgacggttccatcgtcttctgttcgcggcttcccagtgagagacggtgaccgcttgcaccctccagtgtcgcgccagtcctgcaagccagactcgacgccgctgccgagaaatgccgtggtttcgtcggagcctgacgacgcaactcggtccggcgcgactgcggcaccgcccccgcggccgcccgcgtagtctgggtcgtgcttgacgaggaattcatcgagactctcgtcgatgacgttgctgcagccgcggaagagagccatcttggggaaaactcgaggaacgcggcgggagcctcggacgcggcgaagagctggacttcagtatcctgcaccaacgaggttgtttcacatcggtggtgttctgcacgtaagatacgagtgagtatttaaatgcgaacagatggtttgccgttgccgctccttgaacgggggaaaaagagaggagacgcagaagaaagagagcagggaggaggaggcacgagcaacagagttattcagggaggaagcggcggtttcgcgccgacgagaggcgcatggtgcgaggaaggaaaaaacgaaaacggaaaagagacaaccgtgcaattttgctatcttgcggatctccgtgagtgctggcttcgcgtcgaaaccgtcgcagacggggagaggacgggaagaagacttgacagagtcctgcggtgcggaagcagggcgcagattccaggtagaagacaggagaagcggccacaagagaagcgagttttcgggtgtcttcacggcggagtcgaagtcgcggaaacgcgtggtgagaaaagagcggcgtattcgcaaaaagggcggcgaggagcgaaacgcgcgcccgcgagaaacggctgtgacagagcagacaaacttacgaaagcgcagttcgccgcgcagcagcaggaaacagtctttgccgcactctttcgcggagtcggtcgagaagaaaacgcgagagtctcgaagaaaaccggaaaaaatcgctgtgtcttttccactttttcctcgcgaatttgcgcaagccgcacagcagtcgacagccagcctgatatagaaacgaaggttgactctgctctctgatcctctctgatcttctggacagcgaactcgagggacgaacactggcgggtcggacgagaagccgagcaaagcagagcagcgaagaaggtgaggtcagaactgccgcgactatttaggaacgttgccagtttcgcgtttccgccccggcgggacccactccgcgactgcgataacgtggtttttcccctctgcaggaaggcggctttgtcgtagaagatccgcgagtaccagggcgaagtgagaggtgtgtcggcgagctcagagagggggaggggcaggctggcgcagctgcgcagcggcagcggacaagtttctcccagtgcgaccccagaaaaggcaagtgaacagtctagattgtaaagatttaccctgctcctcgaagcgaggccttctcccgggatacgtcggcgcgcccgcgaaaaaacacgctttagagcgtgcagtcgtccaccaggtctgcagctggcacacggtttcgcgttcggagcggcgaggcaagaacagttttgtaggaacggtgaaaaggcagcagaaacgaggaaagctggcgcacctcgaaaaacggcgaaaaagaaagttaggaggacgacgaggagtcgcactgcccctcggacactcacgtggcagagaaaagaaacggttgggcgttgaaagcagccaagttgtcggactggaggatcgcgtttctttaaagccttttgtcttgccggtcgcacgattcgctgcatggaagaaaaataaaagccacgagctgtttgtgagaacggggatctcgctcactgtcgaagacgctggacagttgtcgcgaggacaccgcattcgagttgagagcaagcgaagagctcttgtcgtcgcacttggctaaaacacagtccatctgaaacgactgtgaggcgtttgccagccgtttcgcgccttccctctcgttgctcagaacacaccatcagcggagtttctccgttcgtagaccgacgcctaggtgccggaagaggacgcagtcgcacttgccaaacttcagtcttcttttccttcggtcgcagaggggcttcctcagactgcctgcatctccacgaaactcgtctgtggagattcagtttcagcccggctggttagcctggcggggcagttaaaaaacagttcaaagtacagaacctcgcgcacgcgcccacagcgccgccagtcacagttcgcgttgtccgatggctgggatttagcatctgtaaaagcctctgcgaagtcgctcaagtttcttcttgaccagcggtttgtcccagggagcttttgacgagctgtcgctgcaggtttaagtgcaggaaggcagttcgccgcggtagaaaaggtgtctaaaacccagtccatcgtttcacagcgcggcgggctcgattcgcacatttgtgtgttccggtagctcctcacaggacaaagaaaatca

SEQ ID NO: 2734 - DNA, 2716 bp, Toxoplasma gondii
attcccagaggtcctgtctctccctcaaattggtctcttggcgaccccatggctttctcgctctagcgcgatacgcacacgcagagaggaagaaatcctaataagaacgacaactgaaacaaccctatgcagatatatacgtaaacagagtatgtagtcgctggtgttttgcggtgtcgagcacagagcggcgacgagagaagactagaaagggtggactggggattgtggagtcagacggtacaatggacagtgtctcgattatgacggatgctcacagctccttcacggaagaaaatctgccaagacaatgatgcgtacagtattggacccgaacgtggagacgaggacggcacacaagggcggagggaggggaaaggtggcccagcaaaagagacgaaacgagaggcagcaaggctcacggcgggagtgcgagcgaaagcgcccagctcgagcctcgaaggaaaatgagagaaggcacaggacgcgaaaaaaattttgtggtttgatggaaagacaggagaacgaaaaggaatgcaatcaggggcacaggttctgactctgttggtagttgcatacagccactaccacgatgaaggacggagccttttccgcagaagagaaaaaccagcaagacagggcttctgagtgttttgcagtttggtgaggaagcaccttgcgttgacgagcgcagtggacgccggaagaggtgcatcagggtgaaaagcaaagagacgcaaatcagcgggacaaagatacacacggtaagaaggaatcgggatttgaagagaggcaggctaaatcagaaagaagcacggcgactaccggatagaaaaagagcacaggcaagtctgagggagagacacgcgaaaatatacgaagtatgccagctgcgactttgtcgtcgtctccggtgaaaaagtgtggtcaaaaaccgcactgtcctctctcacagtccctgcgaacctgccctcgaactttcgccacgaaacggaacctctaacgaggaagtcgacttgagaaaaaggctgggaaacggattgcttcgtcgagtagagagggggcaaaaggtcactcagagcgagagaaaccgcatgttcgtggccaagaagtcaaaaccaagaaaatagccaatctgctacgcgctggtaaatcgattcgcttgttcgtttctgccaggttgactccaatcaccgcacagtcgcagcctgcgaccgtccaagaaagtacgaaacgaaacctctccgaagtggagaaacatttagccgtggcactttttttcgtccgagaatagaagtgcggcgattctccaagcagctgaaatttgttttggtctttcatgaaggtgggaacaagtaccaccgacagagttggtgaagatcgtgctggactcagaggctgggcaaaagtgtcgggacctcgacgtttttctgccgagtggattcgggttacaaatgaatcaaagtgaccgcgaactccagcaaagggcatgcgcaaaatgttgtcttggcggaaaacgagacacttaaaaaaactgctgctgtttgtcaatgccctggacggggttatggccttttcgttcgcagagaccccgctgtacgtacacctgggaagaaacgctagcggaatgcgacattcccgatgcttaggctgagagagcgagcgcaagcagcagacttgccgctgccccgtttccacgcggcactaaaataatgcttgcctgttttggccgaggatacattttctgtgctctgggaccctttgctgggcggaaacgctgagtctgaacacgcaatcggctggaccgcctaaacagaccctcaagcatgcacccgatcgccaagatgcgcgcacactttacgtgtggatagtgtgcttgtctgtacgacgcgtggtgccaggctttcgccacgacggtgcgactccgaggcttgctttcactagtttcggccttaacaccataaaaaacatgcatacgtgctgttgtagcaaaagcctttttcttcaagcaaaaatacgttgctgtgatgtttatggcaaaacagtcaacgccgtacaaaaagcacttgactatggcggactgtttcgtgctttgcagcgcccattagagggtccctagatccttccagcatgcagtcgccacgtgcgggttctctcagatgccgatcgacggtatcccgattctcggaggggtcagacccgtggattagatgctgattttggggaccttgtccaacagacggatttgccagaattattgcgccctctttccgaccctcaggtgttttctactttgtttcctccctcaactccctccaccatcacacctgcctcgtgctacccagacccgttcggacaacgtggcgaccgcgtcgtggcgccctgcctctggctattgctgccgcctactttcttcctttgacttcgttgttaagtaatcggcaccacctcattttttgcgtttccagttgacgagtatcaggtggcgtgtgctgagtaacgcagatctctgcatagaagttctgccgctgccaactgcgtctgcttccccagctgaccaaccactcttttttcgccgatacgaggcagtcgcgtagctattctgcccgaccccccgagcgtggccgacgaatcggagtcgttctgtggcggggcgtgttctgcctctcgaatcggttggctcttatcacattccactggctttctctcgtcgaga

SEQ ID NO: 2735 - DNA, 3005 bp, Toxoplasma gondii
tggctggagaatctctttaaccagccgcaaggcaatgtctccaatgctcgcgttgagcggcaaacaagaggtcaccgacgggaaagcgaaccccggagacactggcggcaccggcgcggaggcactgcggcccgcaggcggcgcctcagaagcccaaggcccggaggccgggaggcgcccatccgctccggaagggagcgaaggcccctctgcgggctcggcatgcgaagagcggcgtgagcctcgtcctacgaaagctgagagacgccccgagtcctctcccttcctcgaattcgctacttctttctccttctcaccgtcaggcgagacagccgcgtcggctgcagcctgctgcaactctccgctcgtcgttctgagctgaggagacagagctgtctccaccctcgcactaagacctggcccctccgcaaacgcttgtcgctctcgctccattgcgccctcgccccccagcgggtctgcggaaggatcgccgccggaggcctcggccccgaggagggggacgtgaggagcagagacgtccgaagtcggaggagacgccggattcttcggctgagttgaactgagctgagcacgatgaggagagtgagaagagacagctgaggacggcgtctctgacgaactcggttctgcagaaactcgcgactctccagacccccccggcgcgtcgctgggacactctgaaggcgccatttttgatcgatagtggtcttggagaagagacggagaaagcttctaacagaagaaccctacacacatgactcgacggagtggggtacggcgagatttatacgactagagcctgggagaaagagaagaaaaaatggacaaattcaagaagcaagacgtcgcaatttatttgaagagaaggaattttacttagaaaggaagagacagactgcagaagaatgagggcaggcagaagaagctgtagacgatgtcggcgaggaaggagacagcgttaagggcagggaggggaaaaaacagacgagagagcagtgagcaaagagggaatggaatgcgggagaaaactgtaccgtttgactcgtctgcggacactgcagcaacctgttggatatgacagaaaagagaaaagaaattgaccggctgtcgacaaagagggtctatggtatcatgaatcgacccccgccgtgctcccacgggcaaggcgccaaagagacgggcgtagggaagcgaggagccttgcagaaaatctcccgtgaacccacgaagaaaatgccaagaaaaacaattgctctcgatcttttgcgcctctttccagtgtgtgaggcagagccttcgcgtgaagacagcgacggccccagagcggcaaacactttgaggaaaacgagaaggacgaccgccaccttgatctcgaagaaggatagccgaaaaacgggggaaagaagttgctcccgccgaagtcaatttttccttccactgttttccggtcgaagaaagtaggatgccgcgcctctccctccgccccgcctctgtacaccggagatcttggcgaagagagcagacttccccttcgcgagaaaaaaacagagcgtcaaaaaaggacacagacaagggtgaaaaggcaggagattttcgcagcggaaaaaacaggctgagtcgttcaagaaaagggcagtctgtttgaaaaaccggcgcatgcggacaagcttcagacccgcaatttttcggcgcgggcgagaccctctcaccgacaagaagatcgagttcagagatcgcggcgcgaagagctgctctccagggtagctgtgacaaagcgttctaaagataagccagcaaaaccaggaaggcggcggtctccgcaaaaagcggaatctcgctgctgtcggaggggtagcaagcgacagagaggacagaaaggcaagggcgattgtcgtttcaacggaaaaccacgagaaaagcaagctctggctcgcagccgctgcggcgctgcgccttctggaaagcgggaacctgtgatgtgacgctcaagtgtacatacacagcgtctcgcttttttgcggcgggcgggtaacagatttctctggatgttcgtggcatttcgagacgccgttttctctgtcggaagaagaattgctggctgtctcgggactgcacacttaacagaccaccgcctttgtgtcttgggaacagaggaacgcgccgtttccttcatctaaaaacgagtagtccgttcccctgcttgaactgtgtttaagttttcaggccaaagaaggccgtgacggagactgaagagagagaaacgcgccacggcatcgtcctttttcgccttctcctcgtgatccagcctcatctcttcttttttcggcgcgtcggttcctcgcttgccgtgtgtacttcgcgctcgctcatttctacttccgctgaactctcttcctcttgaatttctcctcctttactcagctgctgttaagcccttccccctcatccgtctgtattcgtcgtcgcatttctttcgtgcttcgtctgattccgggggtgtcttcgtcttccgctgcgcgtatacactcagtgtgagttgccgccttttcccttgaatttgtttttgcctttcctgttcctccgttcgcatcgctctcccggcacccggcctccacactgaacttctcttccttcacagcgtctcctcctcttcctccttctcctctagctgtgttcggccagttctcttctgcgagtcttcacgctacctgtcctcttcgtcgtccacgtcactcgtttcttctgtctctgtgtatgttccccttctgtcgcagcgtcgcgcgaaggcctgcatctttgaatgcaacttgtgcgccgtcttcgccgaaaatgttgctagctattcgtgagtttgtttcggtcgctctacttgcagctgtcgcctctttgtttctcggcttcctggactccaggctccacgggattgacctcgtttttcaagttttcaaagtcgaaattatatgaaacgcgaccagcaagcacca

SEQ ID NO: 2736 - DNA, 2223 bp, Toxoplasma gondii
agggtcgtttaaatctcatggattcgcaggcgtcggaaacaagaatcgtagacgccggcagccggcacagactctgcgtcggtgaaaatgcacagtgcttcaacttacgaagaagggcttggttgacttcctggcgtgtctccggcagctgcagcgcgtcaaatgcctgctttagaataataaagtcccgagtaggagcctctgtcgaactgaaggcgttcccgtccgccaaacagcgtccttttccccctattttctcatttccctgtgatctagacgaatgtactgtctcatcgggtggtacggaaacagtggcaccgtcgggattcctgctctgaagtcccgaacggtccagctgtctatctgggggaagtgatgacttgccatcggaaacggcgtttgtaggatccggtttcaaattatttgtgtcttcgctcaacagcgagcagccgttcaagtcgttcagtctctggagctgctgctgcttatcagggtggcagagacgcgctgcccgaaagaaggcagcgcgtatttctgctctcgaggcattcggagccacgccgagaatttcgtacggggatggctgcgcctttcccatctgctttgtccacgtgttccgtttactttccgaactcaacggatcgggcgcaacaggctgccggccggaaaacacgagcgcagagaggactgaaaaaaagtctggcgcccgatgaacgagaaacaccaactggcaccatgcggcaccggcaacgaagtgggtgtacatacagcagacacttcgtcagaggcgtcgaagcaccgctggaaaagatgggcttcagaacagactcaattgtgcttcagtctttgacatcatagaaacgctgacaggagacataatcgatcgcgtgttggctagtgctggaggggcattttcgcggcgggcggaagtattgtcttgtacctttatctgtttgagcaacccactgccccgttggagacaacttcgttcaacacctttccatcccgagagacccggaatcttcacatcagcgtacaagagagggaacgaggtaagcgaagccggttaacatgctcacgcagacgagcgctggttctccgtacatcgcggaattggatacgctgtcgcaacaagggcggtacagcagacaacgtttgggaagacagatcccgccgtacagcttgtccctgtgcctaagcgaagcaaattcgagtttgcctttctttttagattgaggcgtttgggacgggcctcctgccattgcccctgttggcaatacttgactgtaggatcggtctcgctcaaagctgcatgcatgcaccagcgagaaaaaggaaggcctggaaggtggtcgctggctgactgtggtatcagcatcctagtggcgcctccgccgtggggggatgggggggccaagcgagagaaaaagcacagagaccgctttttcgaaggtcatcttgaacatcaggccgaggtctcgtccggagctgcgcacaaactctggaggacagcggccgacgagctgcatcgttgaagggagcaaaaaatctgtcgtgctgttgtgttacgtttgagaagatgcatgtcagtgaacccccatgttcttttttctcgtttatcgggggtagcggcgtgtgctgtagcgggagctggtttcttcgacgtgcattttgatcggtacagtgtcgcagcgcgaacgggaccgcgtgttttttttttggcgtcaatcgacttccgtctgcttgggagttctccgaccccctccctcgcttcggtagctcctgtcctgttctttcgcttgtctggcaattcatttggaattgctccttctctgtgcttctcagagtcgcgtggaggctgagcgcgacaacgccgagagcatatagtccgaggcttgggcgtgtcacacagttcagtgtttcaaccgagcagctgttcaggacgacgttttgctgctgaatgctgatttggagtgtctttcttcgttgccacttgtcctcgacaaggcttcaacgtgttcgaatcgactgtagtggatcccgacgcccacaggcgccgtcgtcctgcttcgagtcttttttccggggtgtaaacgtctaatatcgctgtgactcactgcggaactttgtcaagttccaatcgtctaccgtctctaggcgcctacttccacctggtagaagaagagtgccctctcctaaatttcttttagttcctcgggaaaa

SEQ ID NO: 2737 - DNA, 4438 bp, Toxoplasma gondii
aagcttgcgaaaatggaggactttaagggaacgcgttcttcagtgagaagacttttggacaaatgtatatcaaaaggggagagaagaggaacacccggtgccgtacgcgttcgggtgtcgtcctgtagatcagtccccggttcgtgggcggtgtatcgactcataggtatactgagtgctggtctcaaactcacgctgacgcggtaagacttggatccggtgagcacaaattttcaagagctaagccagcagtccagctcatagtatactctacgcctctgcaatcccgctctggtttttctgggcttctttcgctcggataaagccgtcgcagtttgcgttcaaaagacccgtgtctcccttttgtcggattccccacaagttcacgatggtgacttccttgctgtattcgtttccgtttcgcctacgtggaacctatttcgttagtctatattttcatcgattgtgcctgtgctcagttgggctgcagcttcggtttttctgggtacggttatttgttgtgttttcctttttcgcttttctgctgggtggtgtaacttcctcgctgctcgtctgccggtcttctccagcttgtgagatgccagacacgtttctgcgaaaaaatcttccagcacgccttttcgcgtccgccgcgctgaaaccgccctcgttgccgaagttagagcgcatggaaacaagaccagctgcggttccactctagtttccagagacacgcagatggacagaaaagtttcgctcggagtgatcgctaaactcacaaaatagagaatctggatatttttatcggggctacgaatagccgcagtgaagcagagagtgtctgtgtacctgacaggtttctgtcactgcgaaaccaccgactcatgcactgtcattttgggggactgtttcccctccagcggaagacagcgagcggcccgagaaaatgggctactagatctcaaaaagagaaaaaaatgtagttttgaagtacagctgagggtcttcttgttccacaacctaaccataatttgctgccctaaaaaacttcagtttcggtattcttttggtggcagtccaccgttaggcacaccatagttcaacaagagtccgacccgtgtagtcgccccatgcgaagttacggagacaacctaatatggtattcgtaaagctttaaaccagtttgaagtcctcaagtatatggtggacacatttataccgagtgcctctatcatgatgtcgctttatcgacagatgatggaaattcaaacacagctctgcgtcacggtttttctccgtgcaacttcagctagccctctgcatctcgacaggcttcagtgtgagaccctgtgataaccccgatggcagtgttgtactatcgttctttcatttctttcccgagacgacctgccgcatctctccgtgtttccgcctagctctctgttcagtgacgaggatcggcgaaatgaagcatttcggcctacacatgtccgttcgcttttgtgtagacagaaaacaccaggaccgtctccaggcgtctcagtagcaggtcgcttatcacttcatagaaagtcacttgccactttgggatggttttctcgccctctgtagtgtcctccggtcttcgcgttcttcctcggtgcctgctgtcgggttttagaaaagttctcttttcagttaccaagtgtgaaagttatgcccgaaacgcaaagtcctgctttgacgggttgtatgtcttcgtaaaaatatactccagcgtgcatcaggcgccctgttcgttcgagagagaactccgcagaccaatcaaaaatcaaggcagaacgagctctcgcttcccagatcccgccggtccgtctgtgggtaactggattgagcgagttcttcttggccttgcaggcaagcgccttcaccctgttcatcaacctcggtgatttgcacctgtatttcgtcaatcaaaagtcgcgatctgccgtccttctgttgccttcgcattgtactgcggagacacactgtccaagggaggttgtcaacgttgtttcagcagcaaaacgtgaaaccggcaatgagaggtcatttgcctctccacccgtatgtctgctgtctacttgagtcccctagctgtggcaaggaggcgactaacgtgtcgaatggatcgtctactactgcgtgcacttttgtgtgtgcgacggtgagtggactggttgagccggttaacgtgctggattttagtgtccttgaacagtgaggatattccacaccggctacgttctaggcgtaatagatgggcaggttgcttgaggaagaaagtggaaatcgcaccagattgctcaggggaaactgcgtcatttgcaggtctcttaccagtggtcggcaagtgtgtataaagtggaccgcaaaccgagttcattctggaaaggaatcgattggctaccaaaagtgggcttctgatgcatgggcatacgcgcgtgtttgccttcacagcttctttggcagaaagacgctgggaaaccacgtgtgaaacggcgagactctcaggggagacacggtataaggctggggaaggcggcctgctcgagacccgtgtataccatcgaggccgcttggggtattcaagagcaagaagggtcacttcagaaaaaaaggcagacagccgagaatcctgcaaaactcgggggctgtggtagcgcgcttcccagaccccctgactccgtggttcttgcctgtgggggttccctctgggtttcgcaacccacgcgggtcaggatacccgtcgtctcctctcggagacaagagaaccagcttcaccacacactgcgaaaagttgcaattcgaaaatcgcgggggcaattggagagtttgggtttttcccgttccgcatgcaggcgaggtagtgggtgccacgggttccgtccacgtccggcggcgccgcgctccccgcttctgtctccgagttttgggtctgcaagattttcctctcagcgttcgttttccttttcttcactcagacggggcgttgttttttgctggtcctcaatcttgaaagtgtaggcttctccatcgtgtccggctgcgtttgccgtcgaccgtcgttttctgcccgtaaccgaagaggggcggtaacagaggctcctctccaggacgtagcggcgccgccctagaaggcctgcttcttgcgaccgcatgcatctggaactttgcaaagacatttcacccgcttttttcttttctttctcgactccagcgtcgcctgtggaggggtgcgaaaaccatgtgctcgaggctttcccaggcttttcctccttcccgaaatagtcttggcacggtcccgtggaaaggcacggaccgcggacgcgggacccagcttgggagggcgaccgcggcgtttccaaattcttttcttccatttgctttgttttttctggagacacgcttgaaaccccgctcgacctccacgcggttccggcgtacgtcctgcgaaacgcagtccacaaatcaaatttggcgcatactcccctcgggttggtgaaagaaccactgagtttaagacgggaatatgattttcgtttctccttgtgcaggtcttgcttcacgtcaacaagactgtcggcagcgcccgggcctccttccttgcaaaatgggtgcgccgacgtcgagcagttgatcgtgtggccgcgaacgtttctcagtcgccgggtcgccgccaaagacttttatcggcaggcgggcaaggcgaatctcgtgcctctgggcgtttgcaagggaaggttcgcacgtctacgagtccgttaggtttcgaaggcaacttcaggctcggctctggggaaaaggtcgcgaaactgttgcggggaagcgcctcgcgcacatggaacgaagcgtcgacccagcagccgccgtcttcttggcatctcgcaggcaaagagtacagtcgagtgcaaacaagcagccggtctcttcgcgggcaaaatatatggcagaggacgttgtctcccgacctgcaccgtcctgtctggaactctcaacagagcgctgaaagttgcgtaagcggatgcatgcaaccagaaaaaacggagagccggcaacggaacgcctctctcgttcgctgaaccgcacaccttcccttcttctcagtttccaagctttctcgcgcttctcaccgtcactgcgtttcggagttccctgaggctagccccgcaacaggggaaacccccagcagcgccatggtcctcacgtagctacacactccgcagaaacaaagcctttctgtgtctgaaccagacgcaaggtctccactgttgtcgagtctgttccgcgagattgtcttgagtgcgtcagccctgctggacggccaggcgagcgcctctcttggcgccagtgcaaagggcactctcaaagcggtgcagcgatatatgaactgcatgcggctatgtgcgcgtaggaa

SEQ ID NO: 2738 - DNA, 1646 bp, Toxoplasma gondii
tggatcttttacgcgctcctcattccctcttgtacctgtgttttctgtattctgggtcaagcgtgtgcacctttcgcctttctctcggcacatttgaacgctctgacgagcttccaaaaatgtagattttctgcctcagtccggcgatgtgtgggaggcggagtgcgcacggcttcagtgtcttctattatatgttctgtgggcgcagacttttgtggtcgaatgtcactacatctctgagagtatcgcttcgttgatggtcggcttctccgtgcattctcagttgacgatcagcaggtgtttcccctgatactgttttaccacatgctctcgtcttggtcgcctgtctcgtgggttcacctgtttgccagcgttcgtctcttcagcgatctcttctctttctcttcttcttgcgcaatcaaaaggcagagaactttccccactttctctcgtccgtgagagacggaacggtccctctcccaaccgttgctcttcccgtggaagagcgaggcggcgagcgcgtttctagaaaatccaatttcacacaaaaagcaatttcgaagcaaacaggccagcgaaaaatgtaacttgctggagtggcgccagatgcaaagaaagagtacactgcaagcagggtccacggtcggtataccgccagagggaaaaaaagaagtaggatgcctggacagaacaccggaattgaacattctctttcgcactcttgtttatttctgtttacatgactcgtagattgtataactggagttatagttttcgtcgaccggggacccgagaaatagtgcagcgaactgaacatcataggacttctgcagtctacatgagatacaccgaagaaacataaagtcacaacttcaccttaagcaatatatatatatatatatgtatatatatatatatatatatatatatatatatattatagactcgagatgaaattcgactgttcagtgcaggtgcacgacaggtcacttcgcttcaagaacaaacgacgcatatcgctgaagaagcctcaaagatcttcacaaaaaggggaaagagggcgcccaaactgcaccaacaacacatgcgacagcccatcttttacaccgcactccgtacctgtctacgaaacctacatacgtttagatagatagatactcttacacggacattggcaagcgcgtgaagtggacatctgctgcccttatcgatgaaatctccagaagacactcgattttttggtgttgttttcggtggatgtgcagcgatatacttgagcatcgcttctgttgcttagttcccgagtcagctcgtgaagtcgaggtgtcagttttctgtcctcgactctccttgtgttgaaagtttgcaacttctttttccgtctttctcgcctctaaagtttcttgttgattgtcaagggttgatgactgcaaatttctgcttttccttgagtgtaattaaaaaaaggccgccgctcttccactgagaaagcttctttctctgcgtgcgctgaccttcgcgggtgtcgcggcacgagttagctctacacttcgacacgcagatcgtcgactgagtagagaagcgggagaaatttctttgttgacacggtgacggcaagcaaaattgatgcgtcgaccatgtgacca

SEQ ID NO: 2739 - DNA, 1592 bp, Toxoplasma gondii
gaccacgctgtgctaaatatgacgaacacgaacgcacataatgcgttaaaccaaaccatcaataatggctttggtgcggctgccactgcagcttaagtttccaacacacgtcgctgacttaacaccttttcctcacgcacccctcagaagacactggtaccaatcagaccagtatttgcagggacatattcctctcctgcgctttacttgacttcgcattcgtgaggttggaaatgtcgtttgcttggggaatatccgacaactgacctagaccgcagagcatgcagccgctttagtttcttcgtgggaacgcagtacgagaggcttcctcaacggaaccgctgcaagaataactaggctatttgtaaggcgttgactacgaggaacgttagccgattgatcttgccgagattactgacgacaaacgtaactattattcagctgaacgggagcagcagctttacgatggatcacttgcctgtcctagtaaacaaagcggtgctgctggtgaagccgtctgctcgctgggcaatttcgagcggtaacgccaaatcgtgggaaattttaatggcgaagccgcgtttgcgatcccaaatgatatgtgtgatatgtacgaggcaacggatttcgccaaaacgatatccctaaaataaaacggcactgccaacttttatggcaatccgagctcataacagtatgtgagtatgcgaagacacaatacagtcgtgcgccgttgacgtgaaacggtacttacccgattcctggaagaatcgcctggagtctcgacaacttttgtcggacagtgtcacgcatccaagaggggatagcgcgggagacaagtcttcgacgtttctttcggatggctaatgtgcaggaggttttgagacgcttcttcaaagacatgcacctgaaaaaaagttgcgcatgcaactaagcatgcacactgcttcgttttactacgacacattcagatcggatagaaatgcgttctgaatgcgcagcagtttgccctgttcttcgtttagtaagaagtcacaacacggacatctttctttcttcttcaggggttccttttctcccttgaagcaaacgtcattttcagtccgtttactgactgtccaacgccgcgcatggtggcgtcggttctaaattgtaacatcccaccttcccccgtaaaattacccatgctgtataactgaacctctggagtgtgaaccgtaaactgcacgcatcgcatactcccagaatcaaagttgtcggcagttgtgcgtccgccactggcggtgaaatttcactattagcaggtttttcatacgttgtcgactcatcagctccttcggtaaatactctgagtaaggcggtcttttacccatggtgtgacgaaatcagcggtgctcgagacccgaagaaactccatggtgcatgctctttgtccttaaggtgcccctgctgaactgagtcgacccacaaaagaagaacgtaccacttaccgctcggagtaggatgattcatttgatcctacaggcaacgggatgaagagaactagattgtttatgtagtggaggactaaccttatcgcgcggtggtcaaca

SEQ ID NO: 2740 - DNA, 2155 bp, Toxoplasma gondii
ctctcgacaggtccatgtccttcctgagtcgatctctttcttttcctgcttcgccgctgagtgaaccagggatgcaaaaaggtattattgcccttttgtgaaaggcaggcgctgtgtgtagaagttgcgaccaggcgtcttttgggtttcgcgtctgacgttccaagttgccatgtgattagctgcgaaactgctgaagtgaaaacgtctctgccagcgtcgcagagattcgcaaaaacgtacgctttctcgaaatcgaattggctgaggcaagggcaagttccccttccggtgtttctgctaaagagaatcgagcaaagaactgtaggacacagacggattcctctctctcccgtttcgcctgctcacctcagtctccttctctccaagtctctcactcccgagtcacggccctccacgttcctctctttgccttaccgcattctctcctttctcccctctctttccgactgtttgcctggactgattcaaatcgaggaacttgttttcctgcaggaacggctgcatggacttgtgcagctgcatgcacagatatatccatcgactttcggatctcacgcgtttacaaagatgcctgtgcgcgtatatgcttccgtggacgattgcgtctcccgacggtcacagatacgtatgtgtgtgtgaacgcacaactctccatagtgccgaccagtaaatggatatgaaccttctaggctctctctggtcttccataaatcgcgattttgtagatctcttcgctgaaagcgtggacccccgtttacgggtctgcgtctctcctccaaactgatgaagagacagggacaaccgaaggagaaaaatggcgatttgcgtcgtcttcacactgctcttgctgtgattctcacctctagacgtcccctggggggagactcctcaaaactctacaatctctcaatgaaagctgccctctcgaacgtccaagacttgcagagttcgcccctgccctctttgtctgtttttcgatcgcgcaaatctccagaagaagttcgtttgtgagcttggtgagtggagtgtcgttcttccttcgcgagcagagccgcgcctttgtcacgaagaaacgcttttgtcgcattccctcgtcacttctgcgtttcggcctcgcgtaggtgaaccctgtctgcttttcctctccccatttccccctcattcgtattattgcaggaacccagggttttctctgcgttctgttgacaaaagtgactgtgcttttcgtttttcctccctcccccccccgagccgtcccgcgagtctccttttctcccctcgttcctgctctccacgtttctcctttcctctgtgtcccccaccgttttgctgctgtgcgcgctcgcgcatgcaatctccgaaggtctgcgtgcaggggagaaagacgaaaacgacgcgaaaggagaagggaagagaagccgcaagggtgggtcttttttcagttcttttcttgtgtttcttgaaagattgacctttgcgtcgtcgcctctgggtctacagggagcgtctccccgcctgctggagaagggaaccagtcgacttggcaccgtttgcacagtttccattcgcgtttttctttcgtttttctctgctcctcgttcgtacgctttgtagtgcgtctggcgttctttctctgtgaaggcctgaacgcggtctttctctcgctttgtttcctcacttcgtttgtttcctttctcccgaagaaaggaaccctgtgaaccagttcgagttttccgcaagttccgagcggcgttttccaggcctttctcgctgtccttctggttcgtgtctgcttccccattctgtttgccgtctggcctcccgcgcactgttctccggtctcttcgtcttttctgtgaactccagagcgcccctcgacttttccgtccagcgcgcaccgtcaacgacgcctctccctctctctcgcctttttctcgcttcccctcgtttctctcttcccctcgttctcttcccctcgtttctcttcccctcgtttctcttcccctcgtttctctctgtgcgccttctcttcgccttctctttgccctcccgttcttcttcccccgcggcggcctgtcgcgtcttttgacctccgttcgcttgtgtgagtcgtctgttttctcctccagaa

SEQ ID NO: 2741 - DNA, 4705 bp, Toxoplasma gondii
cttttctcccaagtttgtcataacgtgtcgcagctcggccgcgctaatgaagccgttaccatctcgatcgaagaccttgaatgcttcaatcaactcttcttccgtgtcagtgtccttcatcttccgggccataagagtaaggaactccgggaagtcgattgtgcctgtagattttgcgaacagaatgcataagcgacaatgaaactgtcgcagaactgcagctgcacccgattcatgctactgtgtgcttttcgtaagtaaaaaaggttcttgttttaacaggactgccgactgcgttacacatcacatggctcccacatgaatacacactttagacgactgaaatgcgctgaaaataacgagctacaaaaagactcacagaggtcatacatggcgtaagacaacgcacaatctccagagcagttgcagaggcgccgcaccgttggtatacgcggtggaaaattacttgcagatttttattgccgtgaaaaacttaccatttccatcagcatcgacctcattgatcatatcctgaagttctgcctctgtcgggttttggcccaaggaccgcatgacggtgccgagttccttagtggtaatggctgcatcacatcacaacaccccacacagttattaaacaaagccaagcttttgcggttgtttcattgtaaattttaatagccctactgtggccagaaaatgcatttctcatgcgctgtcctttggcatcctcgttgccactgtggctgcacaacgtgtctgatgtgttgggtgaatgaacccggagtacaccgttttccccttcggcggaagctgtgatgtccttcctggcaaagcgatagcacaaactccactgttcggcattggaccagaaacacacaaaacacttaactttccactttccaaaagtcgggagcgctagaacaagagtggttctgtggcgccaacggacacccttgcctctgtgaaaagtagaggcatggctcttctcacggcctttaaagctttgctaacaagctgcctacgtctatgttgtcttcagttaaacttccaatgacttcacagacgttcccacgaaaggtgctgcacctctactctcggaggagcctaaaatctgcagaaatcggtaaccccaaggagagaagtcaaatacatcgccaaaataaatgtgtgagccacgcacgacgcacaatgacaaatactccaggtgattcagaagattttccgccggagtccactgtattatctgagttcaccgtcgcagcgcagagccacacattcccaaatttaaaaatgaaaacgacctccaccgtcccgtcttcgaagaacaggcaaacttcttcatgagtgtgagtagcgtgaagcaaagatgaaacacactggtcggcaagtgttcggagtggcagaagaagagatagatgtgccaagtttacacgagtcttctaggaaagagagcctgtactcactcccatcgccgtctttgtcgaacaggctgaaagcctccttgaactcggcaatttgttcctccgtcagctggtctgccattttgtttgtaaaaaaagaggagttttctggaacggaaatgtgagaagtgtatgtgtacgctaaccaccaccactatcggggccaggagaacacccccggacaagaaacaccgaatgtgaaaatccgaaagctttccgagcccagaatccgcgcgcgctcacagaaaaagggatttccagttcatgtgaatttttcagaaaagagccgcacgcacgcacagtgggtataccgctgcactccggggtggacagagaagagcggattttgaatgagccgtcaccaaaaccaccacagttttcgcgagcagcgtagctgacagcagcagcctgtatgtaacgccacattctcgacgcgccctccctctggcgcgcagcttaccaccggcaagcactagcggtttgtgtgttacaacaataaacgagcgcgggaaatggcaagaacccggtcaacgcggggactgaggagagcaatttaacttcatttaccctgaagcccaaagcatgctcatgtgcgcgttagacaggaacagcctttctattctagcgataaataaacgccatcattaatcaagccgccaatagcacaggttgggatcaaaaccaagttgtctgccatcgcagcaacgacggactaggtgccgtaacaaataaacacgttttccagtgtccgagatctttggtatccgacacagatggcagaaatggagtccatgaattgacatttctcccactcaccaagccaaatgctccagaatttgcactttgaaccggccaggccggctgctgtgttgtggcttgcctcgccggatctacaaagttttccgggcgagtggcgcagtttctttcgtcggcatcaacaaagacttacccataattgactatgaaacggagaaacagggacacgctttattgctcaccttgtagctcacaagtatatgcggctttctagtgggcgtgctcgtatgcgacggtgctggctgcccgtcggacgaagagaccctacggacacacactgtactgtttcgtttcacccacatgatttttttgtatggtagatggcatttagaaatgggtgcacaaataaccgatcttgtcatgcttgtaggacagactgttggctatttgactctgcatacgggggaccggaggtgagggattgagagcggacggtcacacgacccgttgccggtaaacaaaactgcaagacgaaatgaggtgcagctcgctctctgtgagacgactgttgctttggctgaggcgagaaactggtcgagtgggcaacttctgtccgtatccccgtcgtgggaacgcacttgccagcactacaggatctgtaccttcactcactgggagatacccacagatgagagggaagactacgaaccatctggagttgatccatgcagatagagtgactttgtagacatcggcagccccctttatctggaatggcacatactgtgaactttctgaagtggggagaacgacatcctaggcgacccgactcagcaggccacttcataatgtgaacaggttacggggcggatagtaccagcacaggggcactcccgtaagtcgtacagggggtcgagagtgcttgccaacctgtaaaatatctgtcttgagaagcaagaccttgcagccattaccggaacgagtgtcggaaggctgattcagtggtatccgatgcgcagtgcccttttgtttttcgctgcgagaagcgtccgatccttccaaagaaaatcaagttgttacatgatttttgaggatggacagtcggtaagcacaataacccgagggtttcacgacggagtccgagataccccgtagaatgttacaggcaaggcgctgagtgggtatgctcccgaatcaggccacactcgtacgagtactgacgcgtatggcaaaccgataggcagcacaagtctatcgacgttacgagcggacacagcagcatatctttcactctggctgctattcgcgccggcaacaaatctagagacacaaaccaatgggcagacgctgaggttgcctctcacaacaatacgtgcgaccgaatgttgaatgacgcatcgtcgccacggcttgttccgatgtcgcgcactttatgcactgcgccataattgtgaagagactcgcgctcgccgtaagcctcttgactgatggcgcagagtaattcacgaactgagctcagttcgtgtttagaggtttcggtgtgcgtgaatcgacgcgtgcgttttcgttcctgttaagccggcgactcgctcccttgagcacgagatctgccaccagtacgcggaatccagataaagggggctaccaatgcctacagagtcaaatctcgtcatgaagcaactccagctcttgcagactcttcccgctcatctgtgggtaactcccagttagtgaaggtatagatcccggagtgtcggcaactgaagcttagagcccgcccgcccatgtctgctttcaacgttccctcaggctcgattttcctgcggttccctaggtgagaggatcaaatataccaccgttcccacggaaatagcgaaattaccggaggattccccgggaattggctgatgggccggttcgaggaactatgattaagccgacagggaatgtctcggcaatgtcccgttagcaaccctggtcgcagcttcaccgtccctacacttccatacaagcaattctttggaagaaagatcaaaatcaagtggcctaaacagtgggggaacaggggctttgtaagatgtggaagcagctggtggacgtctctcgctttgtcccacacaaatgcgatgctcattttttctcgtttttcggatgtgcagtgcgaggctgacttctgcgaaactcgcacgcacccgggctgcacgttttctccaattttgttcaattacgccactttctgttcggacgaagacatgcgcccgtcgataaggcgatccagtgggatgactgtggcggcctctcaggggggggggactcgtctgttgcagcggagcgaagtagacccgttttcgatcgacacgtggcatttgctgaagcggagactggtctggcctgcgaggagacgggaagtcccgcgattcaggctcttgttacatttttccttcttttttccttgtggttaagtgtgccatctcttgtcgcgagga

SEQ ID NO: 2742 - DNA, 2169 bp, Toxoplasma gondii
tacttgctcagaggtagaatgtttcatacaactcaactgttgtccgtagatatatttcgtgcatttatctgcttatctgcattatctatatttacatatgtatacttatatatatacatatatatatatatcaacatataaatatatatatatattctctgtgtgtatgttttgcatctgcctctgctggtttcttcatgcgcgctgcagtgttctttcggctgtttgtgtgctgtttgcttcttgcctgcagtgatttcagtgtatcccttcgtcgttcagaaccttgttcgcgcagagaagatgatgtttaaaagaataactcgagaggtcatgtctctcctgttctaagggcgtgtgtctgcaacgtcttctctctctctgtcgctgtctcagtgtccatttcgactccctttccctgtgctttcccttgtctttttgcgcatgcgacgaatccctcgcgtgagatttatccgccggctcagttgtttcctcctctccgcgctccttcctttctgcctgtctgcgcgcctggctcgcgctgtggcgcggcaccggagccctctgggtttcagtctcttcgtgaactacacagttaacagaaaacattccgactgggtgccgacacggagaaacacaagaacgagacgctagacaacgaaacagagacgaagaaaagagagatcagagagaaacacaagggaaaaaacgcactgtgggttcgggacgtcgcactcgagcagaagcctgcgaggaactgcacggacggcagggggagacacggcgtggaagcgcagcttttctcgtcgaaaatgcaatttgggagactttcaacacacacagctggtcactatttcgtttagatgaaaggtcaccaggtaggaaagtccttggaggcaatgggcgctgtgcctggaagccggttgcacaaaaaacacagagatcggcacctccccgtttccgctgaagccggcgcgctggaacgcgaaaaacgccttccgcggctgtgacctcgatgtcgccactgcagccatcaagcatgcaaggcagtcaaaaaatgagcatgtgctctggggagaggatctctgtctgtttcgcaaaaaaaaataacgtggaagctgggcgcgcttcagacacagcggctcgagtctcagactttcacatgtcggcattcgccaggcgactcgccgagacgtatgagatattcatcgggaaagaactttgctcttcttcgctttgaaagacttctctcgcgaaacagtccttttttcacccgttccgtacatcgatttcgagatctttacgcgtctttccgtgtctctcccactcggccttcccgtggaatctacctgtacttttcgttccctgtgtgtgcgtatttgcatcgactcataaacttagagagaaataaattcgtattcacggcgaggagcattcaggctgttgctttgacagaagtcacgtcttccagcaggtccccgacacgactttgcgacgcattcacttccacgcttagctggctgcgtgtctaagcgaagacgaagcaaggcaagggcttttttcgctttctctgggcaaacccctcgcggcacatctcagcggactgcctgtttctctccctcctccacacttttgtctgcttctgtgtccaccttggtagctgacgaatcgacgcaactcgccacgcggagagcagcgcctttttctttccttgcgttccgcgcatggtggccgcgtgcctagtggcgtgtgtttttctcgagtctgtttcccgtcggttctcgaagaactttctctcccgttgtgtaatgcgttctcgactttcgatggcagtcacgccgtcgagactctacccctccacgctgccaccgcccgtctcttcttacgcgagccgccgtctagccattggtctggagtctctcgggaaagcggcgccggaagggcgtctggtttcccgctctcgagttgaacacaaagtatctttcgcttcgttcgcagccttcatttccgcggactttgctgacacacacgccgtcgctggggtgtacatacaccccaacaagttcggcactgcggcgacgcaggggtggccgcacgcgggggcaatggcgggtgtctgaagtttttttcttcgtttctccgcggttccctctttcgcttttgccacca

SEQ ID NO: 2743 - DNA, 3671 bp, Toxoplasma gondii
tttcgagttccgggaagggagttccatattcgattaccttagcccccatggtcgacactcagttgacattaaagcgtatcattctaaagtgtttcagcgtctgagtagtcgcgttcgcctgccgttaatatgagtgatatgagaaatccctccattacgcctggaatgaaacaaacgtggaatcacttgactgtcgtttctcaccgtggggctctgtcgacgccggggcgaggagacaggaattctcgagactttctgaaatggtgcaggaaaccggttaacttgagctcaaccaagaagcatttgtagaaacgcgaaacagaacttagaagaagattttgcgtattaacgttctgagaaacacttgcagtcaaacaatggtctgctttaggcgctaagacacttagagcagcatctcaacgaagaccaccccgagctctcatattctgaagactcttctctgtgaaatcctcttcgacaaacgacctgtgaagagtcggagattcctctcagcttagaagggagaataatggaaactgaaaagagaggcgctctcgatattgcgatgttgaaacgcattcgtaatcctttttcttgtcggctgggtcgggaccatgtgcggctgtgttcgccctcgtcgccggtgtcttgtggtgcttgcgtttcgttgtgcacggctttcgctatctcgattgtctttggccttcttccactttcttcgacttgcaggtgtctgtgaagagttctgaattcgttgtcgacggcgttttttctcctcggtgtgctgttgtttttcccgtgattctgcaaccgacacatgcggcgtgtaaccacttatttttcacccaaggtcgggcctttggcaactgtagacaaaagcttgcttcacttgatttgccagtccccagcacaatgctcgacagaaaaatccgatgtttctgcgttttcgagagaaccaataaaccttcgtgccgccgcgtaaacgcttgctttgacgcatttgctctaaatgacaagcacgttctttgccgacggcaaagaaggacatccggggatttagaaatcgcatcatgatttcccagatcatgacttttctctcatgtgtaggggtactctgcttccacaagactgggattcgctccttgggccacctagatcgcacataacagtgtcagattctctcagaaaaaagggtgacggatccgtctaccgagtcgtagaaccctttctagcacatgtgtaactcttttttctcgaccattctaaacaattgaattcggtttcgtgtaaagagaaatggcattcgcttcagttcactgtaggtctcgttcaagtatcacataggccagacacgttcaataggaatactctggtggccctgaaaagacacatagcacttgaaactctccggataaatgcatttttcacgtttttcctgatgttcccgtttggcttgagatctccaacccatagccactgtcttgtgttttgcatattttgttatgtcgtgctgtctggacaaaccgagggccccttggttcgctagtgcaggctcatcccacagcgagtctcgatctacaaataggtacatgtcgaaacatccagtatgcctctgaatctattcggggcacactttgtctttagtcagctctggtgttctacggcgcaagggaaattctgcacaccttaaaaattggcagttctgccgttatctcggctgtgcatttgagaaccacccccagaaggagctctcgcgttgcatccgtacagggagaaaactgctgagtgttgagtaaatgcaaaggaaaatgatgacaaaacttgtctcatagccaatcacaatcgcatatctacaatctgtctgagtagcagggatagagctccgcgagttttcgctctcttcgctggtcttaatggtattcgtgacttttcctgtacccatttccacctggccagaagccgtccgttcaataattaacgcgatctctttgtttctagcaccaccagtgaacgcttcttccggtctgactataagtacgcagcctcgatacatttgaaatgtcccgtctagaagaggtttgccagaagtgtcggctcaccgaacggacgtgcctgaagactcaccggtacggctgcttaatcctcttccctctgggttgttattttcgattttacgtggtgagtaccactgccaagacaaacggtttccaacagaatcgcaaggagatccgaacgtagaatatttgaacttgaactaggaaatgcgcggctgcaataagtcgttagagagactcttgtcttcgtgatgccggacctcagagcatacactttatcttcttcctcaaaccatctagtgcaaagcccgtcggagcagaaccaaggggatttaagctacgatctcattcacctccaacaggtagttcagtctttaccatggtcagtgctatcgttctgggagtaatcctctcttagactagattctgtgtaagagttttctgcttctcctgcagttcctttcccacgcatcaggagattcctgctattacacgttttaacggcgagaggaaacgactacgcacatatgctactatgatcagttcggtaccatcgttctgggggcgtacacctgtttgtgagacagaattctttctaagcctgtcctttggagggcgtatgacgaactggaccattgcttagatcttcgaggtctctgtccaccatgcaagttcctatgtcgtttctttgatctttcacaactgcctccggtgctgaatcagaacaggtaaatctattcaggcacgcttcctttcggaagaagctcagccgacaaccacaacaacccggaaatgcgtctcttttctgtgtggaacagtcccgcgatgtttccccattacaaacgaaacatagtggactaagtaaacacgagtatccggcgtaggttccagtcttcataatggcgattgtggcagtaaaaactggcgagtcgccgttgcatgcaagtgcacacgcctgtctctggtctgcgtgttgtcgagcggaaagctctttttctttacccgggcttccagctgttttatcaaaggaagcgtccactggatttctctctgtctcgaagttggaaaggtgctgacagaaaagtctacttgtcactctgcgaatgcactcgaaatccgttctttgctggtgacgtcgtcgaacgagctacagcagaagccagctcgcttttaacgacttttcttggggcagccgaagatgacctcaagcaagaaggcacaaaaatttcagacgacttgaaaagcgtcaaagaaacaatttcacagagtcgatctgtccagtctctgcagtttgcccttttacgtcgctgagcgtctcgctgcagcttgcacgaacaccgcttccgcttgctcgaggttttcctgcatggctgctctctttgctgttttgcttttcaggtcacacgcgccgttaatttcgtgaaccacacagcgaattcaactctcgtcaccattcgttagaccacagggcttttttctcgactgaattccctctgtgacgctcgatttccggctctcgcttcgtttctgcaagtcgttccgtgttcgtgtctccgcgcgactctccgacgcggcctccgttgcagtctcagtttttttcgccgtcaaccgtcacca

SEQ ID NO: 2744 - DNA, 2941 bp, Toxoplasma gondii
actcaaacatgcgaatttcgtgttttccatcaaatctatttttgacgaagaggcttgcaggtagtaccgtcaggacatgattcatgcaatctcagcattagaggttaaacggtagaagagctgagcattctccaaatatgccaggcgcaaaaactgttcatcctgttactaaacaggtggtagatgagcaaaaatccggttcgtgcactccgtacgtgtccggcatggatgcaacgacacggcaagtgttcctttcggttatttcacctctacgagagttgagaactgaaggggctctttttgtggaacgttttactccatgcttgcgcttctctttggaggagaccgaacttctggttcaccaccggacctctggagtttattcctgcccgtgcgtcatgagtcgaagtaacgaaagcgttccatggcaatcgaacggactccttatactgtttctcaacgaacattctgcgatataatttcccagttaacatcaatggcacacgacggcctccttcccctcacttttgtctgttcacttatctcaaaatgagagctgggtctgtgtcgagttggagaatctctaaaaagagtttgtactctcaagagcatgactgtgaccgtacctttttctggcgcctgactaatagttccctctcgctcttcacgcacgtgatagcaatcagtaattgtatacagaacataaccgttgagggagaaccataatgtagaatggtgaagtccagcgctgggttcgccgtcagcctctcggataccccctggattctctgagggcggcggtaaagtggatatccactgctgaggtcgcatacatatcgtggagtgaacgaacttccttttttgcgggacttcttacatgaaatgtcttcggaatgctgtatttaaagcaccacatcgaagtaggcacggatgagcgcaggcagcagcgaaggaggcagcgcttcgggcaaacgaaccaccggaaaacgagatattttgtcaacagaaagcctgcatgagggagccacagaacctcgtaggcatgcgtagctgctacgctgccaaaggcgtctgcacagggagcaaggaacactattggcagaagtgtctagctaatcaaagagaatcgaaaaggcttgagactcagaacactctcgagcctctttgtacccatccatagtttgtacattccattggcattcccgttctgagcggtgtatcgaactctgagaactgcaggggcagtgacttgtacctcgtgcctccgcagaaaattaaacgacttgttctcgaccttcttgggaagagatgttaacacaaaccgtgcttttatgtgagagtgtatgtaccagctttcttgttttgtccaggacgcttggcgtttttctgtgagtgtcctgccggcacgagcagtactttatcgcggtgtgctgtgaatctaacttccgttgacggttcggatgctcacgaccacctacacgaactaatggaaaacattccgctcctcccgtttattttcagttcgcgtccttgacgacatcgcggcttcgctggtgatgcctcaacgccacacgcaggaaaaacttgtgtctttgtttcgcggcgagaaaagaaacaggtcgagtgtatcttccccgttttcaactcagcttctccaccgaaatccgcttctgagctaatctggatttttacggaacaacttcaaaggacgcagacttcttttttccatatcgtccatacctcgaggtactcacttggttgtcgacaccggttcgtttcctggctgtctcccataacagcacggctttctcctcgactcaacatacgcacagtttcagagtagaacgcgtttcatttgctctagaaagagtcgatggctgaacttgagcgtcaccccaggcgtttcctgcggaataaacaccccctccccccctgtttctttaagctgcactgagtgtacgcgcgggtgtcggggaaacagaaagccgaatctggaggtggcttggctttgatttcgttgggttctgttttcactggtttcctcagcctctatggaacactgttgtactttgtttcgttcttgtcaacgaagcagctcgcgcactccgaccctctctgggaatgcgtttgccctctcccccctcgaccaccccccttttcttgtctcggctgctttttccgcatttctccgttccgtcgccttgaaacactgtgatttatcgtttgtcaaaggaaattcgccccgaaaaaactcggaatccgtctgtttttcacttttgcggcacagtgtgcgcttgtctcgcccctcgctcccgcctcctccgtctccggacccgcgtaggaatttctcctctcagacaaagacaaatctcgtttgttttgcttcacgtgaaacgtcgtttctttccgtctaagtcgaacttttttcctcgacacgcgtttctcccagctctctggcacccgcgcttttcctcggcaaacaggcgctgaagccccgctgtacgcctcctcgtctgagcacagtgtagagcagtcggtttttcgtgaaacgcgagtggagtgttaaacagaaaacagggacaagacggaagtgcacacgcggcattctttgtcatgcatcttgagtctttccgcgacactcacacaagacgtttcccggtctcagatctgtttcctgtacacgttcctgccctcctctctcggtctttttctgtgaatcccgccaaatagaacgtaactcccgtctcctccttctgaaaacgccccaatttctcctccctcacagttctgtctctcctctagtgttttcctctcccctttgtgtctctccccgtcctcaagtttctctcgtgtgtacggacacagcgtccaggcgagggtttgagttcagggtgtctgtcaaagaggaaatctttcgctttttcactcttcctttcaaaga

SEQ ID NO: 2745 - DNA, 5000 bp, Toxoplasma gondii
acgctcacgatatcgacccgaatttttgtttgtaagagtggatcgcatctaaggcgagattcgctggtagtaccttacgggtgatagcgcgccaagcgttgtgcctgggacgtgcccagactcacgagattttccaccacctgtacgctgagtaagcggtcaaaatccgtagggaaacttgcctgtagcgcaaaagtccagtgctagtctagacattccggggagacgcggcgcggatacagtgcatcctgcttaccaagtgggttgggtgcggattgtgccgaaggtgtttgccactgagaatactgcgctgcgttggctccccacgtgtagtctgcagctgcgacagccgccgtcgtgcctgctccatacgcatacccgtagtgactgtaggggtgaatgccgtactgcggaggggccgccatcttgacccgcccgagggttgatggctcctcctctaacgagatccacgaagccaagaacggcggaccgggactggaccgagaacagagaccacgtcccgtcaaagcgaatagacagctcctacaccactgagtggcttgcgcaaaaaaggcgtcgaagactggtttgcaggaaaggggcaaagaatgcagctggactgacccacagtggcgcgcgtgcggggacagaactttggaccggagcagacgtccggaaagacacggagggttattgactaatcaaacagaggaaatgtggaaggaatagacatttagtttgaggcgtcgggaaacagctgtttccagcttttgaatcccgttttgccgaatgagcgttgctcccgtacaccaccgcgacggcaagaaaaaaccgaagcgcagctgcactgtaccgacacgcaaaagttcttgccgtgttgtctgggtcggtgtttcgtttcccccgatacgtcggaaattctggcgaagttgatggtgtcggttcgagtggaatcgtcgcgcgccaaactgctcgaccgcaagaaaaaataggttcggttaccggcgagagtgagacacgcgcaaaatcgtcagcaaggggaggaaagctgccaaagaccgtttcatttatagcagaaatccacgacaacgacgcgtttcccaggggcgatttccaaaacagcatacgggattctttaccagcaaaccctttggtgccaagtcaacggccgtcgcaacaggaacgcctcgtgcaggggaaaagacgaaaaacacgcgggaaaaacgctattgggggggactgccagtgccaggggcgcaatcagaaaacacagcgccgacaacgtttttcgatgcagctaaccggggaaacgaaagaggattggaatgagccacagaagtcaggaaagaagaagacaccaaagtgaagcaccaaaattccataccaccaagaaatgagtgcaaacggagagagagagcttaccccggataaaaaggtgcgcactttacgctgccgcccactctctcgctcttcagcagctcgtcgtcccatgggcatcgaactccgtgaggcatcactgggatgaagcttgttcccagtgtgtggttgttgaccgtctgtcacgtcagttggtgtccgcaaaaggccacctgcaggaaaaatcggaataaaagggaaccctggcacaaaaagcgtacgacaaggaatggagcaccggccttccccaacgagtgggcgcattcgcggtgaaggcctcagcaatccggcggacccaggccctctggcaaggacttctgtacggccgtagctctgtattctgaagtgcatgtttcctgggcgtgaagttagggtttcggcatgcacaagaggttggagatctggctacggttacgttagtacggaaaaacagtggcgcgcgcttgcagttctgatggcgttccgtggcatgaatacatgctggcgactccgacgatgaagagacactccaagctaccagagaccgcgactgactctggcagtgaggtcacgataattctattaatcgttattctgtggaaatgggatgcacaagttgtttggagtcgcggtgcggatcctggaaattagtgcagtacgtcgccgtgaagccacagcaaacaggcgtagacatcacgtcccactcgtggtgaatgtaaggttcccggtttttcctgttgagtgctggaacagtcacgaagttgatggtggatggcaggttgaatgactgtgatccttgggtccctttgtaatttcatctttacacaacgccggtccctgtctcctcgttggcagttagacgaacatttcggaaatatacaaaaacatatattcgctttctgtactggtggcaaccattatgtgaagagagtctctgtttggctcgaaagacgaagtaccctagctgttgtctaacacccgtctactgtctaaacgtgcttcacaatgcatggcaaagaactatttgctaccaagagctcagaggaaaaacttgcggtgacaaacgatgcctgagcatccttgttggggctctgccttaatagttgtgcccccagtggcattcaacaggcgacgttgaagcccgccttacacttgtgatacgtagttgatgcactgcccgctcatccctacccgccaagactggattttcggttgtgcttcccaattgctgcaacaagaacactagcacattcttggttgtcttcggtgagctgctgagataaattttgtcttattgtcgatgacgaaggttctactgcaaaaaaactgagatgaataagttacggtgttgggctcgtgagtgtttatcaataccttgctgagtacaactagtagttgcacgcttgcaagagggaggattttgtctctctccgtgacctcactagtaatagtggtggacagtggtgcagcccggtatattgcaagaacatgatgcatcaaccacctaccttttcttacagagtgattcccgatagatagtgttcaggcgttaggaccgctacgggttgtgtatgcgtaggagcccttctacgtgcccacggaatagattatgaacctgagcaaattccctttccatttcgttattcggtgttcatattttatttacaaagtagagaggcccgctcacgtgccggatgcaacaaatgtcctctcgtcctagtcatcgtcggacagctgtttatcagatccgtgtggcactgtcctggatagcaacagcgggcgttccggtcgcgcagcaaaaactgcgacactaagaagacgccaaaggaaacgcgggacaaaataaatcgaagaactgacacccagaggtgatagggaggacgtggtgttaaaaaggcagcatcattgtgcgctcccaaatcctcgacgagtttgactccagcggcagcacattctgacccaataagcggtgctgaccgcggaagaagttaaacgaagggggtttgtataagttgcttgaggacatcgaagaggagtttgcattaaccactctgctcagattgaagcttttagggttggactcgggagaacgaagcacgcgcgaagcacgtccaagcgggtggtctacccaacatcgcaaaaggtaaagtccattagcaaatcagtcccctgtcggtacgagcagatagaacagggttggtagaggttgcactccattttacggagcctctctccccccgcacagaacacctgaaagaaacgctataacctgcgaggaaagagcatttaaaaccccctaccaaacaaagagtgggctgcgaaatccgtgcggctggacgtcgtagtacggctccaggatcctcccacacaaaacagggcgttctaaccaactgctcaacttacgagaaaactacaaacataagcttgaatgacctgagtgacggatgagctggctcagtgtaatcagctgaatgtgagaacaggaagagatgacagcccttcagaatttggtccgacacctcctttggtttgaaagcatgatccacccccccaaagtttatgagccccccccccctgtcagagttcatttttaaagacaggaagtgcagactagagcgcggcctccggagggtcgcgtgtacattccagcttctttgtgtagtacagcctggatacgaagagaggaagcagacaccatctagcggaacttgccgactcactccccgtacacagagctctcgtttgtgctttctcgaacgatagtttacgcctctgcgctcggccggctgggcatgcgtcgccagaaagaaaatgctggctgctgcaagaattgtctgccttgttttgcccagagaccgcatgctgtttcgggggaatacaggtggacccgcgctgcgctctggttgacttaccgctgcctggcaacagcccacgtggtcgcgggccacacagggaaagactcagtactgcccctcctaggcgtagcgatgatccgtcagcataccagggctgctcgagttttcgcttttcagtaacacctgtcaatacgaacgtgacatttttagtgtgttttcctgtgtctgtgacttctcgtgaagggaaatgctcttgttaaccgttttttgtttagtttagtgtttgcgctaatgccctgggcgacacgggactcggtgactgtggccaggggtgtcttgaatatctttttcgcgagcgcgcttcatacacgacagaacgccagccagttcagagacaagagttcgctggttttgaacaaacaaaacagcctgtcctgcgttgtcttttcgtctctttgcgcgcctttacctgttggatgttgggggggaatctgttttttatgcctcttcccagcgccaagccatgggctagccggaaatccggctagcatccagttgacccgatatgccagaaactggtctgtccaacagtgcttcgtcaaatttgcttcctccaatgcgcacttgagcttggtttctttctgcaacttctccctcttgtggagctataggctcaaacgccgcatggatcgcggcgtgtcttcttagtgtctgtttggagcgactcgttggacaagcggtcaaccaaga

SEQ ID NO: 2746 - DNA, 3230 bp, Toxoplasma gondii
gcaaaagacgggaactgggctgagagggcatcttcttcgatttcttctgccgttcgcttctcgaaacccgtgcctccagcttgcagaacccggtagaaactccagagcatactcaagacgaagtgggcaagaagcaactgcactgcgtagaatgcacataacgttgcctcgtacaaagcaaacgaaacttccacttgccgataaacctgtacgggtctggttccactttggtcagataccgtatccgtcatgaccgcgtactgactcagcgttacacgagggaagtcttctctccccgctacagaggcagaactgtgcgtgaccttccatagagaaaccgccgcaagagccatctgaagtgcccacagaaggtagaccataatctgaaggtagaaagaaacgaacgcgataaatgcgttttgttgtcccgctgcacagagcagcagcgtcgctgtgactagccccaggacagctcctgaggtgaaggccgctccccggatgttgaaatccagcacgagaaacacagaaaaagcaatcaaaaacactgcccagagagtcacagctgtgccaagagcacagcaacaacactgacgatacgtggaaggctttttcagagaacctccgagcagcggctgatcctcagccggagcctccgggtcgtccaccgccgtttgcaccgccatgaccagaaaaaagacaagaaaaggagaagctggtaggaaagagggtaaagaaacgatcctttcctacgccgacgtgggactacgaaacctcgggatgcgctctatgacatcgttagagctctgcggagacgtcgacacccgttgtcggttacgatacagaacaaagaacacacgagagaaaaaacagaggcagaaaaagcagtgggaagaacatgtatcgacgaagaccaacagcggtttctacggagagtgcagttgacgaggaaatgcgtgcttcacgtgtcaccaaaagtagacgaattctgaacctgtgtgcataggacaaatactcggaagaacgacggagaaggaaactggaggaaactacagacgcctggcagcatttaaaagccttcctttcgaggtacgagtggtagccacgaacagtagttggaaagacattcccacaagacagaactgactgacggctgtcaacgcagcgaggtagctattatgaggaggacagagtgtttgcaggcacagaaaaccgctctctagtaaatgctacatgcctgagagcacgcggccacactcgcgtggggcatgacaacctcagacctggagaaattccgtggtaagcggccctccgaagccagccatgtttctttcttccgtcgcagagtgccgagtcttagccgcgttcaagatgtggccgaaacaatgcacagctccaaaacacaacaaaccggacaaagaacgtgcaactttcgaggacttacgttcccgcgacaagacatgccacagaaagccacgaaagaggcctagcccaacaaaggaagcgacggagctagctgacccccgatcgtaaggcggctcttggagtgcaatgttttgagtcgatatagcgacggcaaccgtggcacgagcttcttccagtctctctgtatcaggaagtgctgaggattgactaaaaacggccaggtctttgtctcgtgtttctggttcatctggtgtctaaagtgtagcgcgcgaatacaacagcgagggcgtttccgcaaagtcgtcggatgtgtctgcgtagccttgcggagcgagcctcgcgaaaaccgaggaaagcgccgcatggtgcgttgttacgacgaacccaaatacttcaggggagacatcgtccgccaaacgtacggagtgtcatgtctgcttctaggaaacaaccatagaaaatgcacttttccccacgtctctcttatctgataaaggaaatggattttcccacaaaggagccgcctggtcgcagatccctcgaagtaaacgatgacgctccttccctgcgcttcacttttgtgctcagtgtgcactgaatctaggggattgcagttttcaggagacaagattttcactcaaggtgtcaattgtggcgcatgtagcgcgactcaatcttgtcttccatagtctttggttgccggacggcgtcggagtggtgcgtatccagccatttggcactagtgctcagtgtcagtgcgaggtgggtgacactttgactcggtgagaccggactgcgagagcccgttgatcgtttgagaaaaggcgcagtgcatttttctggctgcttgcacttttttgcctttcttacgactaggctgtttcccttcttttcgatatttttccgaggcattgctttccactttttccggccgtatcccgcgagtgctgcggcgacttgcgggtcccagactcctccacaatcctccagttgtcggcctgcttccgcttcccgttcattgaaatggactgaagcagatgcgccacctgtttgcgtgggtcttgaaccagcaaacaccactgagtggcggctgagagacactgccgttcctctgccagcagtcgcagctctgtacatcccatggaccactacaccaccggtgaaactcaattggtttgcacactttctcgcggcgacagcttaaacgatacagttttccggagttgttggagcgtcagaagtcccactctaccgaaagagatgaacaaatggctgctgggaaaaacagtgtcatcaaagcaagcttcagcgagtgttcttgatttgtgcggtctcagggaaatcggtcgtcagtgcacctcagatgctggagtgtatgtacaggcgaactcagttagccaaatcttcatagaaaagataaatgcgtgtcccgtgtacagttttgagccgccgtcgcaatgagagttttcgtcgtgttttggtgagtccctgtgtctgttgactgtgaaaacctccgccacccagtcagtgcctcgtctgtaccatcctgaggtaccgtttcctagttcaggcgcatcagccacggaaaacgcgtgcgcctctcggatgcaaaaacagatatttctcccggttttccccctcggcagaaactttccgtcttccgagtccctcttctgttttttccgttctgtttctcggttcagaaacgtttcttcacctcgttttccccgattttcggcactcgcttgagaacgtcgaggattcgtcccccaaagcggtcctcagtgcccacggaaacgcatgaccga

SEQ ID NO: 2747 - DNA, 4459 bp, Toxoplasma gondii
agactgcaagaaaagtgtggacgagaagcgaccggccatccgacagccgggaggagtgcggcagcagtgcagcggtgcagcgcaggggatttcaaatgaaaacatcccttcaccaagctgagatttcgcgtgcaaatttaaacgtgaacagcgctggacacgaagacgtggaccccgaggcaatggaggacgaggcgaggacggaaagcagagggtacacctgctgcagacgagaggcctttcgggggaaagaggttcggtcgcagaaaaatgaatttgaggtcgggcgcgtgcctcttgttgagaaagcaaagtcgacacggagatcgcaggtgctgacacggacaaatgggtctcagaggtggggtgtacgtacacccaaagtggcgggagagcgtctgcgccgttcagcctagtgcgggagtgtccacgtccacgctgtggactggagggagttgtcagttgccctcccttgaaaagaaaggaggaagagagacgaggaagcgcttaccccttgcatggcggccgcagatgattcactccgggcatggactcgctgctgaaccggctccgacacctgaggcgcactggtttggattgactctccgccggcaggcacatagggagtgttttctctgtgcagcgtggctcgtgtccttggttttttgccgaatggaaaatgccgagccgaacagcgcggctgcgggaggtcggggccagccagtcgcgcgcttgaagtgcggcccaggaggctccctggtgccgctcttaacggagaggcagcagcgaaagttcctcaacttccccttcaccctctttgtaggtaacacagagagaaacacagtgagtacggacgaagcaccatgacactcagcgagaccgaatggaacagacaaggtgggaggagatgtgccgctgcatgccgcggttgtggcgaggaaacgagacaacagcgactgctcagagtgtcgaacgcgtgcggatggacagccaggggagagagacggtcggaaacaaccaacaacctgctgagttagccgcgaaagaaaatgtcgggagaattcctcaaacgtggaaagaaagggtaaggaatcgcgaagcgatacaagggttcgggattcctggaaccgaaaggcgggacacctacgctgtttccgcggcggaatgccacatgcagcgacacagtgtcgcaagaagacgttcaccttatattcacccggaaacccgtaaaaaccccaaaaaaagagaagcatgctacggtccacggcaacacacagaaacgcatgcacgaagatcaggaacggggaaagctgctgccgttctcagaccgccgttgcccctgtcgaaggcatcgcgcgaatgctcggtcgggcacccgttcggtctcgccctgcttgtcttgacggcagaagtcagaaagaaagcaagggcgtccggagctcgagaaataccgttgcgatggtctttttaacgcctggaaaaacgcgaaaaaacactgtttcagaacccaacacttagtcgaagacccggcggtcctctgcccctcctggccggccggtcaagaggtctcacactttctccgagcattagacgggccactgcacactgtgcgcaaagcaaatgagggacctgaaggtgacaacgggcttcctcaccgtgttatggaatacaaaagcactgtgctggagtttcactatgatataaaaagatggtcatgcatctggcactctgcgggtccctggcggacgtacgagggttgtgcgctttacggtgaagtgcctcattggcgtcattatggacgtccttatagggtgacgcgacgccgacagcagaaactgaaggtgcagtctatccaattttttccgtgtgaggtcgcgtcaaaacttacctgtacctcctcccgcgctttcagcttggtacacacgcgctcttcaaacttacggacctcccataggttgagaacagccacgtggcgaagcggaaacgccggtgccccagaacagacgaactaaacaggcagaattgatggttgccgcggatatctagttttcgtcttgtactctggtgctgcctattcatgtggaacctatcaggaacggaattttgcttcagagggtcgcccgacagtggtggttttttatcgccaactccccgggtatagatctctcttccaggcggtttggaatgcatctaccacacaattacataacaccacacacgaaatgctgttgctcgacgaatgcagtgctaggatgtgagtagttaggaaggcaagctggaaacatgcagcggttcggcctgtagcgtgcgaacaccacacacgggtatgcacgccgttaaaagaacagatggtaaacaggtattccgctccgctcgtatgttggggaactcagctctgtctcctgaatttgacttttgttctcgaggaactcccgatcccggtgctgacacaagcctgaacatgcgttccggtccgtctttgtgctgccttggaggcgtttctagtaagctacgtcttttcacgctgcattctctctgatcggccaccaaagagtccaaatctccaacccagagccgtacctaagcatcgatgggcagagagggatgccggtgtacggcacaacggctgcccggcacatctaaccttgtaccagtggtctttccttgaagtaacggtgacggagatgagtttcagtcagttcgtttcgcgaatatcttttcagtgacatgcccaggccgtctgttatcaagggctcccaactcaacagctgaacgtcaactgtgtcgtccgactgcaagtgttacacttcaccacagagtgggacgttccgcgtctgcagagttccaccgacgtcggcgaccccccttcttaacaaccttcaggaacgagttcgggccatctccaacggcgagaactagtctgtttaaggtgaacgccgatcccataacgttttgtgtccggcacacttttagggttccgacgctaccactcagaagatatcggtgccactgcactgtagatccactgaacacgcttgctgtttcttttgactgttcttccacgataaattgcgtttcccttgctcagtgtgtcacagtggacacacgctatgcggcgtgcatcgccacaagccacaagcgacggaccgatgcgcggctctacatgtctgcctcgagagatttgtatggcatttgccaagtggtcgctcttggtacggcgcaggagtccaccggaacgccagtcgaagacaaaggattccacattcgaccgtagcacacattttcgagtggcttccgagtccggaatgctcgacagacgccgtacgcgtttgccctaccccgtcgggtatgcatgcatgccgccaatgatttccgaaactggcgacgggacgtttttccgtgctgctgtctagtatgttttccctttgcaggcaaattggaggttcatttctgcgcgtttgtcttgcttttcgcgaagtggaacgcttcgaactgtcgcagcaaaaaccgctgaagcagtcccccgcggtcacagcctttgattcagcggcagctctccacacgccaattctgggagttttgtgctgcagcctgctcagtatccggttggcgctattcagtgtaacttcttggtttcttcttcatcttcgcttccgcagcatttttctccgcgacgcttgcaaaggtcgcaatgaccctttggctgcggtgaaagattccgaaccacgtggaggggtccactccatcaacaaatacccgctctcggtttcttttccccgttgttcctctctgcacaaagattatatgctttctgtctgtttttttgtaccgttttccgaagctgtctgttctccggagctgcagactcttctcaactccgtaggcgccgttttttcaccgaggtagagcctcactttcggcggcgatgcggcagaaagacattgccgctgctgtcccggccatgtagtctgggggcagaccacaggcgctcttgttctctacgcatgttctgccgtcaatacttcacatgtttcgcagctcttgtctgaacgccttcgattttctctgaggcagcttcctcgcggcagatcctcctttttcgccccgtaaactgccaagttcttccctctgaaaaacgttcaccgtctttgtcggttgactttcgcgcaaaagtgccaggcggcgctgtctcgttcgatccttttgtgtacatctcgtcctttcgaattcatccacagctcaatcgcgtcgcaccagtcactctctgcatgtggctctgccgttccggtaggtccctccgcgctccctctctccgtctttgctgtgtcgtctttctcttgcatttcctgcattttcagagttccgtgtggatcgctctgcctccagtcttttcgcctggcgaaatcatttcgcttcctcagctgtcagaagacaaccccttcctcctctggctacaaga

SEQ ID NO: 2748 - DNA, 1856 bp, Toxoplasma gondii
tttactgacaaagaacctcatggtaccacgaaataggagattgcgttagttttcgcgcaccctcagacactacttcactccccctggaactatcgtgctcccaccgggagagctgcactggaactccgcaaacgcggtccgttcttcggtcgcctttcgtgtatccgggttctctccctcgcgttccgtttccctgactatcatacgggcaaatcggcgttacgatcagtcatatctggaaaatcagaatccatttgacactgcgtcattggcaacccacctcccgcggctccctctcaatcatgtgagcttacctatcatcgtccttgccctcagtagcgttgcctccgattacacccgtggctgccgctgacgaggtccgggaggacccgcgccgcacaaggagcagaaatagagcagcaaacccagcaaaaagaagcagagccgtcaccagagactccggcgaaggcgatctggagaaaccgaacagcggggtcgcgcgagttacgcgctggtgctgattggcgtaggaggagccgctaccccgactgcggccgcctcgcggatactcagcgaagacgccaggcacattcaagcagagcgcgtagaggaggaagaggaaggtgactctacgacagacgaggacgtactcaccatgacggagcagcgatctcccggagaaagacgctgtcgcttctctggaagcacacttgcttgcggaccccctagaacagactccgagccgcgctgccattctgctgacgtggatgaaggcctcgagaaagagcgcgtgcgcgagggttatcgtagatcgccaagaagtctcactttgcgcattcatacatactgcacggaattacagaaactttggtttaccctgaataggctgttaccaccgtacgtttgtatgaaaacggaactgtgtgtgccgcttcgtttcggcggttgaggctgacgggggaaattaaggaacctcggtttctgcctagactggtgcttctcgcacgtttagtcgacaggggaatggaaaaacataaccaggaaatgactgtaggggggaaacactcttcagcctgaatgagagctctctagacaagaggcgacggaaacctgcggctgtcagcccggcatcaacgtaaatccacgggttgtgcaggaacagaacaagcaaataaggcgagagaattatgagatgttttacatgcaaagtggaatcatgttctgaaagcgaggcagtttcagcctcacgggtaatcacctcgacacgttcacagtttgctcgcccagtgacgctgcacgcgtgctgcacggatgggctctttttccaagcagcagttttaccggagagaagcgaagaacagtgtgaaactgaagcattttttcagcgcgccatccatcggaatgaggagggaactgtatctcctgcatgccccgcttctttcagggcaatttccggtgagtttcactgtgtccagggaagggaatacgaagcgagacggcgaccccagcagtgctgcggaagacagaaaaactagagccacgtcgggaatatgtgtgctggtgtctcgttaaagtcacgtcgacactttttttcaaaggcccctctcgtttatctcatcccgaaaatagtatcgttggttaactgcaagaactctgggaaagtgcgctccgggtgagaacagaatctcccatgggcaggtcgccgagtgtcgcaacaacgtgtcttctgaaaggggagactggcaaaatcccgactacaagctgagagtaacggctccaaatacagaactgattcttccgctactctacagttccacgatgaatgttagaatgcccccttctctgcacacatagca

SEQ ID NO: 2749 - DNA, 2076 bp, Toxoplasma gondii
ccgtcgtcttgacatgtgtttaagactcgcgtttttcatggaactggtataggtaccagccgtttcctcgctggtgttaggtttttgctgagcttgagccgtcagcgacagccaacgcccctgtttgtcaaggcaccaagcaactcgggactccataatctcatggccccagcgcaaagcgaagtgtcaccgcttatgaattcacgtgcagtcgctaagagtgcttaaagagatacaaaatggtattgtgcaatacagtatgtatctaggaaggcagtatttccgtacctgcgttacatatagcgacacatgttgcacatgccaccgcagcacagccgtagctggggtgcagtttttaaactgctcctggtaggagcaaatgttgagacaaatgattggtcgtcaaacagtcttgcaggggctgtcttaagcactccattgggtggtcatctacagcagcaatgaagaactcggttgtctgtaacttcttagtggactcatattcagtattctgggtactatagtgcctctattctttttgagttttacacttcaggatagacgatcacttgtacagagactcacttgggccggtggcaacaacagcagtgaaagtggaagagtgtagagcttgcgtgaagaactgaagaacatttttgccaacagatcgcctcgccacagccacaacatacccgcacctaaaaagtggcagcttaattatgtctgaaaaggtgtagtaatcggtggttcgtcgaaaagggtgcttaccgaccatatgctttcgagccgcatgcagccccgcagcctctctcggtgtatgttccatcgtttcgtgtaaccaggcccgatggagatggcgtcctcacagaataaggaaacaggtgcctagaactgatcagccaataaatgtaacaccactgacctcaccgggaagtcaggggcaacgtcggcctttaatacgaattgcagcgaccattatactctagacaactacaactatcactacaacgtccagatttaactcctaggcaccggatgcacttgctggcatttagctggtgggaaaccgaatttcgagcacccaccatggactggtacagagcagttaccgtctccttcggacaacgccggcagaagaccttcacgtagtgctgcagcgggatatgccaaaagccaacaatcaacatgtctgagggaaaatggctcacagcaaaaccgggaaagatacaggggggaaaagaacattgtgtgactcttaaggcagcaagcacgcgtgtgtcagactccctgctggttcccacacatctctggacgggtgcctcaaaaagtcacgtttcgaggtttcgttgatactcagaatcgcacagtcttagtgaagattccgggtggagcagcggttttgtttttttcagaggtgaatcttctttgcgcaaggtatgtgtgctgtcgtctggctgactttgtcgcgtctgtggagtcctgcatctttttgccgtggcacacagttgattcgtcgatgcatgcacgcttcggcggagagacaagtctcacggctgtcgctgctctcacgtggacgctgcgtgaatttcaagcaaagaaacttcgcccaccgaaaaaaacacgatattactgagttgacactgaacgcgcgtgcttcattcaactgtttctgcgcagtaagcggctatggatgacagctggagtttctctttgtcgaatttcggtggcatagttgtttggtcgcgactgagacatagcttcgtcgcttgacaaggcagtgtcctaaggtgtggagttgtaggtgagggactgaggcggactccacatgtggaagactaccgacattttagtcaagtggccctgtgactatgcgagattcaatgaatgccgaacgatgtaggagagacaagaaacgaagaaggctgcctggcgttgtcgcgtgtaccgtgacttcccacaaaaaacctaggtgaagagggtcgacagcgccatcagacctgagaggttgcccagttcagctaaactcgtttcctccaggcaaggagtcttattgccagctgccggctgtatgcgaaa

SEQ ID NO: 2750 - DNA, 1673 bp, Toxoplasma gondii
gacgagaggagacccaggttctcccggcaagtccaggagataggtcgccgcgtcgagagccgctggcacgacctcgccaatcgattgaacgagagaggccatgagcacagggcctggcccagtggttcccgggtcagggttcgcaaaattcaagcggggctccagctgcggtcccgtgaggaacgcgctcggattctctaagaggtcggggtagcaggcgacgagctcgtggagaagcttggtgaggagcagcgcctcctcgtggaccgggagaggacgggcgctctcgccatcagtagcaaatggcgggaggggaagcagagcctggagtcgctgcacaataggagtcagcggctgaggaagcggcggggcctccagaggcatgaactggcgcctgcgagacgcgaccgccttgtcccggtccgagcgacgcacacgcagaaggctcgagtgtcgggaggcctggtgaagcgacgaagccgtcggccgagaactcttgatgccttcatggtagcggtggccagaagcagcgcggggctgctgggattgtggagagggaaggaggggggaaggtacagacccgatgccgacgccgacgcgcgggacatcagcgagcccaccggcgctctctctccaactacccccgtgatgaaaggcaaacggagaaggggtgcctgcctcggggcctcccggagagccccctagagggccttctgaaaagagtgtgcgcgcaggcacgaagaacaactggctcggtccagacaccgggtccggtgttgccgaaggggaagcttctgccgcatcagacttctcagcaccgtcacaggaagacggtgggtcgccagcccggtttggatactgagactccatgagcaaaggaagagaggaagaagaacgcacggggcacgcactctccggtgctctgtgacttcgttcagtccgcgaaggcagctctggtcattctggaaaaaagaattggcgacgagcatatataatcgaggctcgttgtgggacggagatgcgcttctcaaagcctagaagctgccatgaagtggcacggcgccgcggctgtcctgggcatgactcaggtgacttttgcggtggtacagaaccggatgcaggttggcggaagagtaacagttgctccctcgcaccggccaccctccgtggaaaagtcgggacaaaaggaaacaacggaaaatccgaaagttacgaccgaatttcggaggtagaagctcctgggcatttagccaacacgagaagtggccgacccaggcttcaccggaaaaatctcagtatcgcgaacgatgcaaggaaaatgtacgccataaaaagggggaggtaacatgtgcaatggttcgcgtcgctttttttctcactcggccgagtggaaacatgtgctgtgatgcgttgggtgactaggcgtgccaatttttttcccctgtttcaccccccggtgaacagcagcgaacagcacaggcagggaggtctagatgtggcgcagcagcgactggtttttcaggggagggaggctcgcagcgtactcgggatgacttcagctctgtctttcgcccaccacttcgcccggagtgagcaggttcggggtacgcggaggagggtggctgaagaccacctcagtcgcctaccccgaacacttgcgcaggaccggccaa

SEQ ID NO: 2751 - DNA, 1883 bp, Toxoplasma gondii
tccacctgcgactatcgcagcctctccacatattcatttatgtggatatatatatatatatatatatatatatatatgcatatgaataatacttacatcaagcacatttaggaatgcaaatgtgtatcgtatgtatatatatacatatataaataaatgtatctgagtacatattgacagcatgcttatttcggagtgcacatgtataatatatacatatatatatatatatatatatatatatatgacatacacatttaatggtggagaactgtggagatgaagaggcgagcctcaaccgatgaacgggtgcatttatgtttctctacatgtagagattaaagcaaagttacttgagaaaaggggactgaggctcagcggggctccactgcgcggggcggggtgtaaggccgcccgtctctggtcgtgaaatcggagaagaatgtgtgaaaagggagtcatctcccacggtatatatgttgtcaagtccttcaaagctccaaaaaggtctctattattctggagaaagaagaacatgcaaaggaagagcttcttgtgtctcttgaaagccgtaaacccgaactactttttgcgccacatgaccgagaatctggacctcaagctctcacgactcatcgctacgaagaaaactaatcgcaagacaatagtagaaagaagcatatatatctatatatatgtgtatagatatatgaagaaatgcgtgtttgtgtatgcatatgttctggcaagatgatgcgtacgagagagtgtatacacactgcgtttcagaacacgagaggaagcagacgaattcaggtaatgcggaccttctcaaacaataggagacttccgagacaggcatactcagtgtctcgaaaggcggtaacaacttgcacacccatctttcctttctcctcgctcttttctcatcgctcttcttttcttcttctctcgctcttttcttccaccttcgtgtgtggtcagctggtacctctttgcaaagtgagcaaggtcaagagtgagagagctttagatttccggtgccttcacatgtcaaggatctttgtcgcctttctggggaagatcttttggaaagcgactctggtttccatcgaaacgagctgtcttgtctgcccgtgtgtgttgcatgctgagaaaagcacatcattcttcgctggtggctagtggtgtttctcgggttcgatttcctcctattctcctgcttttctttttcaggggacgacaacctttcttatttcgctcttcttcgtttcagcgtgttaatagaaagacaaagacgcagagaaaagagcctcgtgactcttttcccggctggtacacgaggcccgccctctctcctggtgtcttgcggaaagccggttcgaacactggagaacttttctctcgagcaatttcattccttgtgttgtctctccttctctctagctcttcatttacacgaatccattctcacctgtcactctttcgcgcgacctctctgtttcaagcttcctctgcaccatttagggtctaccactctccttcaatttctccatttctttccccttctgagaccttctgtcgacggtaccctgaatatccctctccattctctctttttctccttcttcttctctgtttctacctgcgtcttactccacctctctgtctatttccccctctctctgtcgcgttgcctctctacctctcccttactccatctcatcccctgtgtacctcaaacacactctctctctttctctctatctctttacctctcgacttcttcctctctctccttttctcgctgcctccaacgcctgtgtatgttgttcttcctgtctggttgctacggctgagatgacgttcgttccaccctcgca

SEQ ID NO: 2752 - DNA, 2204 bp, Toxoplasma gondii
cgagcaaagacggcgctcgtcgcatgtttttcctctcgtgagcacggtggaaaaaactccgtgcatgacagatggtcgggaccgaactgaaatccgctgcagttcggcagcagaacgatggtccgtggaagtcgttgatggtaacgaaaaaggaggcgagactggaaaagaagagcgatgaactgtcacttcagagccttttctggacatgtcggatgctctggtccgcatcgataaaagcaaaaatggctccacgcgaatctcactcgaacagccaatacggaaccggcatgcgcagagagacatgcatctggagaaagaatatatgttaaaaaaatgtagatatagagatatttatagcagaaagcactgcctggagcccgagtgtccgtcgcttccgcttgtctgttgagaagagtccgtttcagcagacgttttcggttgcgtgctgtcgagctttcacaatttcgagggatggaggtctgcattgagtcgattagctttacgcgcagtcggcgatcagcgaaacgagacaaaaaaaagggatatgacctcgatacaaagcgtcaaagctcttgccatttccattaacggagctgcaaattagattctctgcgcgcccttgtggagtcataagttgacattctgacgtagccagtgttcagtttaaacgtagcgcaattagctttctatgatgtggtgtgaacgacgttttcgcacatagaaacgactccctcacatgccgcttctctccctcacccggagtgcggaactcactcccctgagaggtcgggcagcagttcaaaggagtgtctgtgtgatgcatggaaaaaacgagcaagggcttcacaaaaggcaacctttcctgaagaagtcgtttaaagaaccccaggaatcgcgaacgcattcgtccttgcttcgtcggaagaacagtcgaaacagtgtctttgttatctgccagctgctacacgtttagccgagactaaaatgggtgctttgtgactcgtgcaatttctacttttccccatcggagaaggtttgtgtgttcagtgctgcattttggggtgccggggtctttgcccggctcgtggcttcgaaaacctactccgcaacggtttgcttgaagaagttgctccttttccaggaatcagcggcttgttcactttcactttgtgttgaaagtagaaaacggaggcgacaaaagtgaacagaaacccaaatttctcctcccgcatttcgcgagagagtcgtttaagagaatggcgcatgctgtcactgggtagcgtagtcggaaccatcgtccttgtggcaagttttaattctccgattgtttcgttcttcttaaaactcttctctattctccacatttagttcatggatcagaatgcgcagatctggagtggctgcaactttgaagagctccaaaagacagtgtacgtcgtgtttgcatgctctgggtgtattttctggaatcggagctgttgtcgggaaaacggctgcaccgtagcaccctgagcaccatcaaatcacctgtattgttgtatcagattcctctgactttgtacagagatccttgattcaatcccttctgtgattgcctttttttactgagcatcgcatgctcacaatgtgctctcctgtcatgtcgcctctgttctttaggtgacatctcagtccttttctgagggctttacaacgttccggttctgtttgtctgacgatttttatatgtttttttgagtcgtgggaagaaccagggggctgctgtcgcctctaaggtgcgctaaaccttctgttcgcgtgtaggtctgttcgcggcggggctggcaaagcaaccccgacggggagaatttctgttaaaagaggcgccgattgttttctctcctgactcctgtgcatgtcacatcttcccaggatccatgctgggcgctttttctgtatttctgtgtcttccctaaattctttctctcgaccccttcacctcccgtcttcgtgtgttgtgtcatatctgcttgggacgaaggggttgtggctgtcgtaggcttctttcgccagtttttttttttgctatttcgaacaaaacagtcgaaagagagaactggcaaagaagccaacgcatgcgatccttgtgcttgcggctggaagttgaagaccaatagcaggaacgctgggtttctcggagggtcgaagtttcctggttgtca

SEQ ID NO: 2753 - DNA, 1504 bp, Toxoplasma gondii
ctcttcttcagagctgtcgccctctgaaaacgtggagaagaaaacgcgccgaaacaagggggggacatcttccatctttttgtctgccgtaattcctaacgtaacaaaaccgcagtctcaaagaacagaacctcaggcggcgtacatccactctatccgagccacacacacatatatatctatagctatttacaattgtatttatccctatgtgcgtatctgtgaccatacagcacagaggttgacatataaatacatctgttacatgtatctgagtagagagagagaggatcggaaaacgtctaggagtttccagacagagctgagatatttgggtcgtgtgaggcatcggagaagtctcttccgtcgagggtctctgtgattcagtcctgactgagtggtgtcgagctgctagcctgtcgcttcggcaagaactgacgagatctcgtttcgacgctagtgtggcatctgccattacttggcatgcatgcgtcagtgcaactaaaaagagcagaattctaggattgattcgcctatcaagcttcccgataaaagacaacgagtgcctacagtagctcagctgcgagggtattgcgctgcatgttgtgttgtgatcagtgtcgtttcaaagaagaactcgactcttcagatgctttccgagcgacggggaagggcacgaaaaggcgacaaagacacccgggggtgtctctccggagaaacgaaattccgtaaccattcaggtgaaacaggcatcacaggaattcactttctgtctctctctctgccgttcgatttccctcttgtccattggctctttctcttcgacgcttccaaaggcctgatcgacgttccctcagaaactcaggtgctgtggtcggccaccacgagccttttctatttcctctgtgcagagatatacctgcagaaaaggagaatgaggactcaaacagaaagacagagacgagagaaaggggaagtccgacaacaaacgcctgcagggaagagagataggtgccaatgaggaagagagagaatgaggagagaaagtgagaagagagattgaggcggatagacatcggggaggaaagagattcgggaggagaaagagtgaggagagatgagagcgatagtggaaaaggtcgcgacaaaaaaggagggaaaaagcaagacacggggaaatcccggctggatgcgtgcatcgactcgaaactcgaaaaagactcacacaagcgcaaacggggacccgagagagccgcgggcaatggagagacgagtcggcttatagtcggagaacccatgcaacgccggcaaaaaaaattcgctgtgcgtggcgtggcgaccgcgcactgccgcaagcatgcgcaggagcaagttcacagaggaggaactggggaactggttcgtggatggtagggaccctcgagaaaggtgaagctgtttacttgttttccatgatgcgccgagtcgcccgtccgtagttgtcgtcaaggagcttctgcaaaaa

SEQ ID NO: 2754 - DNA, 2287 bp, Toxoplasma gondii
atgtgcagataacagaacacggacagtgtaggcttctgtccagaaaacaagtggcattgtccacggttgctctctcagcttcacggggtatttcgaaccccccactgcctacgcgttgcctttcgcgtggagtgtatattccacgttgttaaagtgatcggttctaggggggaagcgtggtgtgccgggatacgcttttgaagtgctgtctaaatgttaggccatcttgaggcaagataagcaaggtcacataatgaatctaaagatgcatgcactgattttacaaatgtaatgtgtggaacccatgagtcaaagcataattcgccgtgcttcaactgtgatctgtcgagccgaagttataagaatgcgtcgcgggtgctgatgatgcctcccaacacgtttatcaactgtactagagcaagcatgcccagataaaaacgcgttggatgcgtgccccgaggggtatctaataaattgatttagtccgccggaggagagattccgtctcgacagcagcttcacacattggtagcagcgatgggtgtcatttcagtgccccaacacagcagcttttggctcacatgaatggaaaaagggtgtaaggccatactgtttcacgactgcacacttttgtgtgcgaagttgaagcaattttgttggctaaaatgttctcgaaaattcataatatcggatttttgctgtcggaagtcgtatcacggtgacagggctctcgatgtcagtcttctgcaacttgcgtggcatttgtgagagcaagaggtggaacgaaaaccgacacatgttcgggaacggaactgacaaaactcaagacccagtaagctgggagcggggctactcattgtgggggtcaggcttggctcctggttgtacttctctatttcctgcttgtgttgtaacacagtgcgctaagctaactcgcgcccggtatttctgtgtcagtattgtgtcacgaaaatcactgacggaagggcggtctgaattcgtggaccccagttctctgtaactgaacattcccatccggtatccttttgaatcgtggctgctggcaagacgcggagtgtttatggagaagaatgctaaggaggacggcctcgaggaatcacgctcatttccatgttccagccacaagtataagggaatctacagtgtagtagtcgaaaccagtttgggtcaggcctctgtcaaatgcgacggacagcacgcgtacggccatgttttgccgcagggctttagatgcattgtccagagtaaaaaacacagaagttgcaaaggcagctgaatagggcccgtgcgcaccgtttcataagccttgcaaatgaggtacattactggaatgttcttcattctgttctgggcccacgaatcacaacgctaatccattgctaaaaatgttacgcgttgtacagaaggatgtctcttgcgatgccacgattcctccgagtcgtaccttgtgtctgtgctccaaagcactagttctgcatgtacgggactccctcggaggttagtccatcatacgataggcaatgcacgtgccggtttcgggattgatttgcatatgggtttgcttaccgctcggcgacgggttggatgaaggcgccggtacatccagggtcttccgccttcctcatccagacacggtgaattttctacgcagccgtgtcctactgatgaacgcgtaccgtgtggctaaagtattgagcttcgattagcctcgagagaaagcgatcccagaccttgtccaatttgtctccgaagattgcggttgtcaaactgcggcgccatatcttattgccgcttagaaaagatgtccgcttttgtacggtatgccttatcagaagctacttcccccgctatctggcgtccttatttaacgactcctcccttggtaatgcattgatgtaaattatggtacaagcactccgctatttttgagagacactcaggagcccaaaaaaccatcttcgattgtgtctctcttaaaggtcacgtctgggttctccggcaatgtctgacgccgggggggtacaactccccgtctcccaccacccctctttgctcgtctgattgttgcggggtctactgcacacgcttttgacaaagtacgggcgcggcactagctgcaggcgccctttgacagtgacttccttctttcttgttttttgccgctgcacgcaactctcccccactcgcgtcgcttgggaaaacgttctttctctccatttcgcgcgacatacccgtgaaaaccaaaattttcccatcttctgcaaaa

SEQ ID NO: 2755 - DNA, 4626 bp, Toxoplasma gondii
atcaaacccatatgcatgtagcgaggttccaaacgatggaaacaaacacctccaagaacagaaacgcaaacatatccaacggtgtagtagacttcctcccgggtttccccttgtacaaaaatttgggtgcagtttgcccagttgaatgtctagcattcagaacggtctctctatctgtttccccccccccgcccgtcaacatccactgtgaaccgtgaaaaacccaaaaatgtactgcttctcgaggaaagaagcgtttggcggcttggcaagaagatctgccagaaacgtagggacgaagcgattgcaggtcgcgaactggaactcagcgggagcgatgtgcgacacggaaacgcaccagttcaccttttctcaatttcagcaatgtgggaagaacgcctttctgtgtcctctgtgctttccgtttgtcgcctgccgcctcacctttaagagcctgggggagtcgacgctgccgcgcaagtcggccaaccgcatttcggcgaagccgccatcctgaaactcgacgacgcaagttgcatctgcgttgctctgcagcgctttttcgccgttcccgtcctttgcgtggatttctgctagacgggcgacagtccacagtttcgttgggtggccaacccaaaaccaggaacctagcaagtcggtacgtcctgcggagtcatcgatggaagagacaccgcggcagtcctgatggatgtttaactcttgcgcgggaaggagaacacatgcctcagatgtctcagaaagggaacaagaggaagccgtttccttcgcagcagaagccaagggggtgccgctgcccgccgccagctccatcgttgcagcacacgccggctagcccgagagtggactccgagccggagttggcggaagaatgtcccgaaaagcaggagttcccccgagaaagcaggggttctacgaggtcaaacgggcgagagatgtgccttgctctgtggagggtcttccggcacacgccaagagcgcaccgagagacagagcagcaaagtcgcgagcagcgaccgatttgtacgttgacggggctgggggcgtcagggtggctctcgatctgcgtaaagagagaatcggaatctcccaaaacaggacagaggaaacagtctgtccagcgtggcaccgcgcgtgtccttccagaacagttccgtgaggaaccaaacacacagcgcgagttgtttgtcaactcacagtgtgagtccgggacggctccagctaatctcggatcgagaaggaagggacgtgcacgtggacggacgaaaccaaaaaacggcaaccgtggaacttgaggaaagagaagatgtttccgcgggtaaaggagacgaaaagcctctctcaaaattccccaacaaatctcctctactctcgggaggcgcttgcgccctctcaactccagcgcactgccgcaattcccggctagccggcaggtgagtgtatattcgcgggtgtagcccgccgcccgaacagagggaaaatgcggaaatacccggcgaaaggaattcacttcttgaagaaggaaatcacaaattgaacggataagaggaatcaaatttgacagccttcccagatccccgttccccacgagctgctctcagacgacgcaagcatgcgctgcacaccggacaagacaaacggcagcgggcgatcctaccaggtctgccggaaaacggtagaaaaacacttcagcctcgatttcgctgccgcggcataaacactgaaaatatcagtaaccaatgaatagtgcaagtctgtagtcttcgcttgggaacgagacaaactgcaccaaggacggggctttgatcgcgttgtcaatgcggtcaacggtccgagcgacttctcagccttgcctcgacctcggaaaaatgaagtcggggacacctgaggaatttaagcgccaatcttctggttaccgtggttatggatttctgtggcctcatggaaatggagaggcggcccgattctcttgctgaagggagtagcgcacgcagaagtcgttcctgtgtgacgggctttaccggccagagttacgttcatcgtgcatcagtggcgtatactaggatgtgaagacctgtcaaccgcgcgtggcatgctgccgccagaagtacacgtgtgcaaatgggctttatggctacttcacccggtaaataattcgtggacaaaagtagaaggcgacagccgcacacccgaacgcagtggatgatggcgaagccacgcatttcgatgtcggaagaagttcaggtgggcatgaatccgtggcaccggcgactgagaactaggggctcaacgctagcaaatgcacaaaatgattctaaagtatatctaaacgatatagcgatactcgttatggcttggaggacaacggtcactgcaactaaaacaccaaagttggaagatgaatccacaccgataaaatacacagtgttcctggaatatagttacaaatatactgtgttctcgaaacagaatctcaagattgcaatgacaataccatggttgaaatgaataccattaagtaagtgtaaatataccatcaacaagtccatcatcgttaactgcggaagagagacgtaattttgccgtacgaactaacataggaaagaagaaaggccgcttacacggggcaattttgagaattgcaaacaaagcattaaacatgcttggccagcgctgggagagtctcgacgcatccttctgcaggcagcgggaagcgtgaccatagtaggtgcgcgtttgatttccgcgagctcgtacgtgttacagagaagttcgaatgtgtcgttttctctaaaaaggatgagatgatgtcaggcttgcagacggcaccccgaagaatacggaagcgacccctctagagacggtcagtcaccgaattcaaggcgtttcgcgtgacttgagagatggccagatgctccgggtagcaatctgccttgcacacatctcagcacgtggtgtagattgccttagaagtcaaagtatctttttctgaagggttatgtccgtacaagatgccggagagtgaaacaggtcctgactggagcaaagaccgccggactcgcactgaatggcatgcgcacgtgatgccgtcgggccagaaatcaggtgtcgatttcaagtctcgataactttgcacagtgactttgctgaagtgttgtttctcgctcaagaacgtgtgttaaacagtgtcacgacctgcattagagagtcagttacatgagccctctgcgacacaacagaggcacctagctcggggcaacactgcacgcagaacacaatttcgactcgcgaaaataagtgcttgtgtgtgatgtaactggcgtgatgtaccatcacgagaacttgtagctggtaatgctcatattcgatccatattacggaatgccgctagtcaacacagagggtcatgaaagttcccaccccgtcgtgaccaacttcagtgagagttgatgatgatctgctctatgccgcttcatgagcgtcaaccgccctggatctatctcagtggaacagagtgtcgtttaagatgataattattgcagaaaaagaaccagttaaaacaccatgtgttagtataacacagacaatgacgttaatatgggatccttcttagcataaagctgtgttgttagatgctgcgtacacattattgtatctggcatgtcctagtccgcagcgactttcaattccgttttccctgtatcccctagccacgcgcgcagacacgtcgaacgttggtgaaagcacagcttgaaaccgggtaatttttgtcagctgtctacttaaggctttatgtcacctttttttaaagctgaggaaaacagcaccgtaaatgcagaagtcgaaaacgtcagatggggcatccggggtcgcttaggtaggaaagcgatctcgactctgggactggcgaaactgccaccgaacggagctcacagaaaactggaattatcctgcgcacgcgttagctttaggagttctttttcacgggagaccgtatgcaccggacaagacaaagttgtttccttaaatctcagacagcactgagcgccgcaagagaacaaagctcaccaacgatgacgtgacgtgcctgagtgcacgaccaagtacatacggaactcaatgagtaaacgagctgagcaagaagcggacgaatttgagaatgggttttccgcacgtgttcactgtcaacagctccatggaaatgactctgcatcccgggaattcccttagctaagcatgggagaggccaactttccctctcatccagcaaaagatgtgaaaaatctctgaattgtctctcggggggttggtcatatccggagccttgtgctcgcgcgactaaggagtgactctacctcttcctgagagtacctctgacaaaaatcattcattttttgtatctctccgcccattttcccccgagaaaccctttctgaattcctgtcatcctttcgttgtgccgcttgctggtgagtaccgcggcttactcgcatgtgcagcacacatgcagagcagttggctttttcacaggctccgactcagcgtcaacgaagtcacgctgggaaaaacgcttttccaccacgttcgcgtcgtccctttgaagtctga

SEQ ID NO: 2756 - DNA, 2216 bp, Toxoplasma gondii
gagtagatccggtgttttgggtttgaaaacagcgaacgagagtttttcttatcgtttttttaaaacgctctcgcctgtcgtcagcgacgccgttggtacgcttttttttgagtcgattgtgtcttcggagtggaaagcaaggggaagcaagagggaaacgcgtcgccatcccccccccgtcaccgagacagactgccagccagtgcaccctttccgtgaaggtttttctgcctcttcagacggtccttctgtacgatcaaatgaagcgttctcgtccacacagtcacacggcttccgtgaactcatgtatctttttgaggaactcgacaaccggagtgctccacatcgcgaaagggccgcggatgtgttgagtcacaatgaagttaagaagagtgccagttcctctccgtatcgcgggttttcatcccgttggactgtttcgtcgaatggagtaaaacagtgccacaaggagtcttgtgttgcgtgaatgctgcagtggttgaaggtttctcgaaaaaggcttcgacgcaatccagtcccgctagcactgcggtcccgcctttctctcggaaagcatgcgggagcggagaaacgcagaattctacttcgtttgcgagttcactcttcaattcagtctgcagagagtttcgccgctcctcctgcgctccacggtgtgtctcggtgtttgccactgccgactcgcaacgcagcgttcgagacagtgcgcggttgaaggcagtttctcggttcctttcttttggctcgtttcaacgagagagacagggagttccacaccgagcgagagaggagcgctgacaaatggaaaaaacctctttccgcgggagagctatggaagtcgagaaagtccactgctctacggaacttgtctctcagctagccctctcgctgtgcgagactcgccgtggtcgagcgtcctgcacagaggagagacgcggcgctcttgcagcgagaaacgtacgaagttcgccaggccgcggaaaaaaacgtttggagagccgcgaagcgtttttccaattagaaaaagtgcgttttgtgcctggcgcccctgttgagcctgaagacgaaatcgtgtgaggaggaggcggtgccggaagaatagcaaaatctgcgggggaaaaagagaaaaaccactgaagggaaaagagaaacactgctgagaaaggggaaaggcatttctcaaatgtgcaaagggtgccgtcacaagtctcaacaacgagtccttttttgcatgcaccgccaaccaggcactttttcctctcgggtcttgtcgcttgttcagctctagcgttctttcgagttgaagaagactgaagcttctgtcgagactttgttttctgcatgcgtggaggagaagaaagacctgagagaaaaatccagaggcgggcaaagagcgagaacgggaggccacagctggtacctcccatgtctccaagaaggtgtgtgccgtttcagcggttgtgcgcccagagagggagatttgttcttccttttcgtctctcagatgccttcttcagacctcacctgttcacttcgctgtctcctccccttttcctctctttttccctctctcttctttgcctctctcttttttctccattgttgtctcttcttctgtcgcctctttctcgcgttcctccgctgtgtgtcgcgcgagccgctgccttttaccgcgctcttccccctcgggggctgcgttttctttctcgccaggcgcctgcatcgtcgccgggctttctctctcgctttggaactccttcgtttcctctctctggacttctttgtctccgcgctgcggctgctctccgccttcgttttcctccgccgttgtggaggcagtcgcgagaagagactctgctctcggatttcggaactgagtagagaaaggcagcaacaaacagctgagaaggacgaacggcgagacagcgcgcactgcctgccgctcgcgacaagtcagattaggaaagaacgggaaccgctgcgtcacgctgtctacgagcaaacggtcaacactctgacggacgaaaacaagacaaaagagcgaaaagatagagcagaaagaaagggagaaaggcgcgcagcagatccaccacacagcagcggagcactttgggccaggcgctgccggtagaaatgcagtcttgtgcttgaccgagaagaggaagcgaggaagcagagaaggagcagaaagacgaaga

SEQ ID NO: 2757 - DNA, 1747 bp, Toxoplasma gondii
aaccatacacgcggagatactgagagtggaagactcaacagaagaagtctggcgaagtggacgaaggccggcggtcagactgggaggaacgaagcgagggagaagacagacgatagcatcgaaaggcaggcaaggggagagtcgaaaactgaaggggaaatggagacgaaacacacagaggcatgaaaagagaagcagacaaaaaactgcatagaagaaaagagacaaagcgtcgaagaaacgaagagaagcaaatggacggaagcggacgacaacagaaagacccgattggactcgagcgagaggtgaagggaagagttgttctagagagtcagaagtaaacgatggtcgaatagactgctggacgggcagaactgtgtgtttcagagaatcatccgtggagagcaacgcagttgcaggaggacgtcctgctctctgccgaaacaattggcgaagacgaaaaagtcggagaaaagcgaggcagacgaaagagagcacacgagaatggctgcgaaggaagagagagaggacagggtcaagaggaagaggagagaaaaggagcgctcgttttcgagacttttgctgtcctggacagaaaagccttcgtgtggagtcgaagtccactgcaggcggctcaatcgaagacggacctctttcgccgagacaagttccctttgtaatttttgtggaggagaaataaacacaaaccaaagtagacgttggagaatgagttttattaaacaacgaaggcgaactcgagaaatcccgggagaaagttggcagcagaagaaaaggcctgcgatttgacgaggtctcctcttcacacggcacgaggacctggagtggcgaggcagcgagctcgagttttacaaagttcacggccgagaagcaaatttcgaggcgaaaaagaaaagcgtacggaacgccgcacacaccggctggtctgtgaagaaccaagccgagcttgctaaaacagcttcgcgcgcaaagagagcgagaagacatgaaatcctttgttccttggaggcctcgcggagacctacaccggatacacacgtttcttgttcgagagaagccgccgtctgctgcttcagagtggcaaaacaggcaagcaaagatgtgctctgtttccttgtcttgcagcgaaaacctcggagaaaagacagctggcggcgagatgcacaactactctaaacgctaaaaagcgtcgaaggactggcactgcatgcacgtcgcttcactccacacgggaggctttttgataaggaatttctcccttttgctctttctgaaaggcgaaaggcaagcgaggccaagtcgctgtcaacaggcgaagtaaacgctggggcgtccttgtcgaaaacgcaatttccccgagagaggaacgcacatctggcgcagagtcgcgcgcaagtctctcagccccgcgtcgtcaacgggactcccaaagtccctcttcgccaagcgagcatttcatggcgttttttaaagcgtcaggaccgcgtagatacaagactcgacgccggacaggtctatgctggaaaacgcgaaaatgaaagaacttctgcggtaaaaacggccttcctttccttcttgcaggcaggcttgcctctggaaactcgcgacggtgactcgcaacgccccggtctccaggaaaaatgcagcgctcgagaaacgcccagaattcctctccagatcaaacttgcttctgcgaagtcacgaaaaaatcgtaaagccttcctcgcca

SEQ ID NO: 2758 - DNA, 3895 bp, Toxoplasma gondii
tctcctgctttgcgctcttcaccctgggtgtcgccagcttgtctcccgtcccctgcagactcagctgcgtctgcgcctcctggagcagccggctcaggcaattcctttggaggaggcacgatgtggaccagcccggctgaaaaccggaattcagcatcctcgagctcttctgcacgctccccgctctgtttacgtccgactcgtctcctcatggcgcagcattcctccttgtccctcactcctgagttcgacgaaggcgccccacacgctgccctccaagctccacaacgagacgtttctgcgcaagaagcatcgccgctagtagggcgactccccactgccgcagcagacgcagagacacaagaagaagaaggagagacaggagaaggagagacagaaggcgaggaaggcataagccgaggggcttccgtaaggtgtgcagccgccgtcagggaacggccttggttcgtgggttgtctttctccagttgcacgatctgagttggacttttgttgcgtttcaaacgcgtggcggtcacctgccttctccggtttgctgtgccgggccttctctcgaaatgtctgcgcgaaagagtccacagggtctttctgagtctccattgtcttcgcgggggttcggaaatcgttcctcggatgagagagacttcttttcactgcccacagttctcagcggccaccatgttgaacaacgggagagtccacccacggacaggctctggagaagtctggaaaccgcggcgtgtgcctaggcgtctgaggcgttagcaaaaggagacaggggcttcgccgaagtcctgtctcttgtgttccaattcatgaggcgctctcccttctaaggcacttccacaccctggcgtttccccgttctcttctcggccttcggtgtcgagcgacagccactccctcgaaaaatatgtctgtgtgttgtcgcgacgtgcagggatcttttccgtctacgcggcatcatcatcactgcaccttctcgccctcctcttcctgacgtctcccatgtctctctctttccttccggtgtcgctcccgtctccttctttgtttcgtatcccttgccaagtgtctccaatgccccgactaactaaaggattctcattttctcgcagctgcgtcgtactgggacttgcgtttcaggcgtctctgggcgttctcttgcgtcgtatcgctcccgccggcggtttctgcgtcctaccgcagttgcttgccaaagcttcttctctcttttggagcgcctgctctggtggctgcttcatatcgagggtcgcatgcgaatgaagggagagaacgctgttcacaactccgagaggaaattcgcgcgcaggaacggccacaggcagattcgctgctccgaagaagtcgcggacgcgagggaagtgaaagagaagagcagagagaagggagacactgagacggaaccaggtgcagtcgactcaagaatcgaggggaaaacaaacgctggaagtgacacaagaggaaaggagacaacggagtcacgcgaacggttggggcttccgcgctggagaaggcagccgacacctctgtggcaatggcctttgtgtgccgcgatgactccgaaccagcaacagagagggagaaaacggaaaatggggaggcgagacgcgagaagaaagaaaaagaaaagaattcatggaggagacgacgctaaaaaagcttcaaggccagaactcaacggggcccactggacgcaccccggcgcgcaaaagtgaatagggcagaaaaaaggagctgagcaaagatctctccaaagtttccccttacgcagatttcctctgtggtcatatggcatttgggagaggaagaaatcaaaaaattaacgagcccaagtcagaagaaggaactaaaaaaactaaaaacgacacaaattcacccgaactgtgagcacttgtaacggctgtccgtgctgctgctgtggccgggcacacgtttttctgtgggggtcacttttctctcttttcgagaaaaagaagagatcctgtcgctgtggcgctcttccgcgtcctgagagagagccttcaatctacacacatggccctttttgcctcaaacaagacacaaaaggaacagtcactctctcccctcgaggcctctacgcagaggccgccggtcctgccatggtcaccgcggctctctctgtgcgtttcctaagctctcgactgtcacggcgtttgaattaaagtcttcatgcactatcattctcatgcatctgctggcagttccatgctgtctgtttcaacttgtgctcggtcgcactgtgtcgagctgtctcgcgtgcgatgggctcctctgctccttccagcttcgacctgtttgcttcttctcctccttcccttcactgtggagaactctcaatccgctcaagtcgtttagctctcttggccactgtctgggttcctatccagcctaccccgccaaaccatcgctttcctcgctacctggaacgcttgggtccttgggctctgttccacttaagcgtaccaccgactgttccagctattgaggtatatacaccgcatctaacgcaaagacgttatgccgagaagagatcccgcacttgcacccctgaacaactttgttatataaaatacacggtgttcggttgttttttcttccacgataatgatcaccgtagctacactcggggctcaggcaacatcatcggcgtgctcaaaaaaaagactcacagactgaaccgtacattacgtgacctgcgttcttacatgcacatatacatgtgtatatattcatagtatgtgacgatctttgtacacatatatgtgtgagcatgtatatatatacatatatatatgggtattgtggaggcctatagagctaaatttttgaggcatgtgcggggatggatctctacatctgcaaggagaagcagccttgcactggacagtgtttctcaaactgtttttccaacaaagtgtggtgtatctcagctccatctaagtgggaagataaaaggcgagacgagccgcgtttgtgtgtatatgtgtaggtgtctcgtggcgcgtttgtgtcgcgacagaggcgcggcagttgtttgagcgcgtatcttcgcagacgaaagggaaacgcctcaacgaaaatgtaaggaagtctttttctgcgtccttatactcttcgccgtcacctctgtcgttttggttctcaaaagcgaatcgcggaaaagaaaacgaagagcgcccaatggcagggctgcactgcggctctcatcagttcagatgctctgcttgcggagcgtttttgcccgctcgagtagaaggtttcttcccggtttttttgcacttgttccgagtcaaactcttgaaaaaagtgttgaaccactcgggatagaggcggacagtcggcgttgtcttcgtcaagcgcaggcttcgaggcgggtgccctttttgtggggctttgacctctcgccctggtagccgcagcctacctgagagtgcatgcacaaaaacacactccgcgaagagacacagcgagatgggagcatgcgcgatcgagtcgctgaagtgaaagagaccaagtggattcatcttcatctagcgtcgatgcgaaattgtctttcttctacgtcttttcctacttcgtcttttgagagttctccttttcggcgcccagccgggccgcgcgcatgcatgttgcgagaaggcgaggcgcgacccttccaggggagttgactttttctgtttgaatcgaggcttctgcctccttcttggtctgcttcctggacctttctcttttgagactcacaggcctcaggagcgacaactttccggtcgaacagcgctgtgcagaccgccactaacgaacttcgcttcattgaaagtcaggagccaaca

SEQ ID NO: 2759 - DNA, 1879 bp, Toxoplasma gondii
cgttttggcgacttcaacaggcacaaccgatgagtttgcttcttcagcttttcggaagccggaacgccctagctgcagactcgttggcggctcccatgcatgcgttcgacctgctgtatgagaagttcgcgcatactcagcgggcagcttttgcaagacgccgggcggccgacaagactctggcggaggtggcggaccgccacgggagtgttgaaaccctgctcgatgcgttcagtgtatgtgcccgagcagtgaaactcgaaaacgattgcagtggatgcctagtggtagatatgcattatagtgttccggccggaggaaaagcctcccagtctggaggggggaagtcgccgagtgaaaacgacttcgctgcaggatacggtggtggaagttctggcggaagcgatgccacaaaagatgggctgctgaaagaaaacgcggagaccgctttactccgaggacttcctctaaggattggggcacacttacctgaaacaacagcccgctttgtaggcgagctgattttaggtggtgtggccttgctgcagcatgggcctgaaggagcctacgaaccaccacctcttggctgttctctagatgccgttcagaagcagtttgtcaccgagcggatgattcagcaggaaaaacttcagacgagaaggaagctggaaaaaatgggagaggggagtttgaaagtgctggacttgagacgtacagtggaggaagccggcttaatggttaatttagaagcgccgatgccacgggctagtccgtcagtacagtccgaccctggtgaagccaaggtcgaatgcaagggagatgctgcagagccaaaacggtcccctcgaagaagtgtacggtctgggggaccagatgtccgggatggttacgatgttgacgctttttgtccggtggaaggtctttctgattcagaagatagtgacaagtggatggaggatgacgtgaacatgtttgagattatgtcagccaacacgatgttacgctgcaccgagcagcttcgccaaacgtttatagccgaaggaagaatgcttgagaagatggcgagttcaaaatggaaaggagggaggagggtaaggggggtcaagaaaaagacaacagcttttccagacgatgcaaaaattgcaaaggtagcatcgactcttgggaacttccggaagggtataaagtgacgtttgccgagaaggatggaggggcaatggcccagactgtcacagttgggggaaacaagccggaaacgaaggtgcttaacttggggcaagatacatttgacgagtctatctgtggatttcacagtgtcgtaccctcgtgggaaaaggttttagaacccgttttcgctgtgtttctttggatggaattttccttgcatggttaagatgtatttatccacagcaagcgaatgcgtggcaaagcaggctggcaacggaaaccgatgcttacagtatgaatgaggtataagacggcattcattctggaagaaacgaggctgcagcttccctcgcactcagtgcttccaggtaatccgaacggcacgcaatcgcacaagtgcaccacataaagcacgcaccgatgcacgatgtcggtatccgtttgcatttgcagccccacgtgtctctgaatgctccgttagcggggccatgacgagcctccttagtactttacggtacacagaagtcaaacgtatagttgaacgcggagccgaatgggtaccaagtggttacgaggcactgaagagctgcgacaagttaccggtgattgtgaggagaacacgaatttatacctcttcagacggcacccacctccccgaaagcgctacgtatcggttttttgctgaaatcgagacctgtctacagtgacaaga

SEQ ID NO: 2760 - DNA, 4741 bp, Toxoplasma gondii
gtgggaggcatccacaaaaaccacacgcaaaggtgtgtgtgttttctgctgttttgcgaacactgtccagaacgcgttttcagtggggatccgtactgttatgtctgtggggctgggcaaaacgcaggtgcaaggaacccagtttgtggagttgtagagcgaactgcgaactcccagagggtgccctgtgccgacgaggacgaccagtccacaacggctctattttagaaacctcgagtgtttgttggaaaacactgattgaggtttggtgtcaaaagtgtgcctgcgttcgaaactatacagcgtgcgaggaggaaacgacactatcgccaagaatgagacaggcatgtggcagtgcacgtagtttaaaggttggagagtgcaagttgcgtaactcattcccttgcaaggtattcgaactgcacccaaagcgtacatcgcgattgctgttttgtacgtatggcgtttgtcacaccacgagcgcgaagggaagtaccactcatcgaaacgctgttctaagatataattggctgtagcgatggcaagcatacagcacgtctgtcatgcacgtacagacattccagctgagtggcagcaacaggatctgcagagtgtcaaacgcgcgagttgtagttcaatgaacggcacatccagacggcaagcatcgaacgacacgggtgttggatttccgtagagtttccttcatccgagtggaagactgtatctgaagctatagttaattctacctcctggacgcctggattagctttatgcgtggttaagaaagtcactgccttcctatcgtttcccgacggcagcggcactgtgcggaccctatcgagaaaagggtgctgtgtcagttaaactcattgctcacgtatgcacgactgccgtgacgtttgttgaaagagaatctcaacactaactgtgctgcgtcgtttgtgcccatgcctgctaactgcggaaaagggccgaacgcattcacacgtgcttcgcgcacaacctacattcgtccgccgaatattcagagcaaacgtggtggcggtgaaaaaaggtcttttcgggaagtttcatcggagcaaagtccgctgtcagtgtggaacgacggttcccgtaaccctggcatctcaagcgtaagtctgagagttcttcaatccagtgaacttgatagcttcgtgcgataccagcgtcttgttagaagcaacgtgacgagtgcacgcgtaccaagagggagtgtcgcgtctcgcagtgtgcaccattgcttcgtgtagtacccgagcagcgaaacacctctcgacctttttgggtggtttttgtgttttttctgttatttcgcaagactaagcgatgcaacatcacttgcgcacatgcaatgtcataaaacatcgtcccgcccgtgaatccttcgttgagcgaaacgccatttgtggtgcatctttcccggttaaaccgttacgctgtagtatgtctggagagctttcagtcgtcgctccgacttagttcgctcgcggcccgaaaccaaccgacaggtccatcatttgaaaacgtctcgctgtcttctgctgactgttttgggtccactgcggtgtaatgaccgataccgtcactgctacggcgattgtcgccctctgcgtggcaggatagtcatataagcatcagcggctaggtgtgatccgttagacgtcccgcgacctctgtgactgtgttcattacgtgaatggtcacatttggtacaagcatggatccggttcaccagcagaatagccccgccaccgacggggttccggttaacgtcccggcactggggggtttagacggtgatggtgcaaaaccaggatctagtgccggagaggtagatggtgtcctgtgtacggggtggtttggagggacgttgttcattttatttgccttgctccttattggcttgtggttcaggagatctaaagcgtcaactgacgggggtgtggaagtgctgacagacaaaagagaataagcagagacaaggacgtcaaactatgaagtcggaagtacttctctgcctctgttgaacgtgcatgcgtgtttacaattcatcccccccaaatatgttgcgggtgccagtgcgatgcgggaataaatgtctcgtgacaggtgattgcccgtggacaaatggttttgacaagcattgaagccatttcttttggtggtgtggacatgggagtctatcaccgtgttggctgcatggtctctaaatctcggtatgggtgtggtgaatcagttgtgggtaatgtcacttgggtttcttgttgattgcttgaggcacagtcagtccgtagtttgcgcgatcaatggcgagctgtggcacgaaaaatgcaagctgattattgccgtcgtctcgaatcaggtttccatttacggaacagagctggcagcaagttattctagcgcccgtcttcgatacgggcgtaatcttcgcagaccataccgggaatgaggttagcaacaatagtgggaatctgatgaaagtacagggcgacttcggcttgacacgcgtatctacgttgagaccatgcaaaggatgcgttacgagatgctgagagttcattttcgtttatttgggaactttcccctatcaattttcgacttcacgcagtgattacgtcagatgcatgtccgctcagtaatgctcatgggtgtgtgagctcaagggtaacagtttggcctcaggtaaaataacgacggctttttgaacacgaataaagcgtttttggcaatgaagttctattcgtttgcgttgaaggtggggaacaggtagtggggatgagtttattcgttctgcatggtaaaagcctgtcggtcgtatcaccagcctgacatcccttcttccgaaaaattctgaggtaacttttgcacattcagggcccttgccaaaataagatgctgacacatccaactgcagtcacatagtccatttatcggcccacgaccagagatccaagccagacgattagagaggaccttagacgtatcacagcatgacgatgttgttcgtttcgtgctggtgcgtgacctcaccgtcagccaaaatgacctccttctttgctgccgattccggcgttttgtctacctctgcaaggtctgacagctgaaaagagaatggttattgtatttgaagaaaggggaaatctcgaaatagccgtgcctcgtttagcgcttcaacaatgcctctttccgcgtcaatctgttgctggtgccgaggccgtacccgatcagtttgttgaaactatcgtgaaatcctcgtaaatctgtaatagtgtggtgcggcacgtagaacattaccacaggcacattcgacagcgatgtgggtggaacgtcgtttcgtggcttggtttcctgaaaacgctgaataagaggcatgtgcgattttgcctgcttcccctcagcgctagtgctgtttatagctcacagcagcctctctaccgggtagaaaactgtcagaactgtacatcagcgctcttggtccaggcttggcagtattcatgtactgcttctcgacgttatacacctgactatttgctgtcgaaactgtcttagcatgctgcgtaggcgtgggagaatcgaacctgcttcctgatttcatgccgaaggtcaccgatgatgctttgtaggtcacgtttcgcaatcttcatgtgcttgctgggcatcagtttcacggctgaaaggcattcatcgtgaaagcacatccgcataaaacatgccgcctatcgcgaaaattaccaactttgggcggcgcagttgcttgctgtggctgaccgatgttggccccaaggaggccacccgcgagaccgccgacgattccgcccgcaatcccgccagtggccagcccttgagccgctcctgtcagcgctcctgcaacattcgcagcaaacggactgatgaattcgctttctcccttggtctcttctgcaagaacaccacgggatgaaagacacaagacaaataacgccgtcgctgccgtgaccgtccccatgtttgctacgtctaagatacagtgttttctgtggcgcctcgacgcgagttaccgttcatgccggtaaattttggattgcgaagttcgagtagagtcgcgcgacagtattctggtgtatcgacaccttagctgaaatctcgaactatcaacgcagaacgcagcatggatatacttcatcttctgtggcagctgtagatgttttttcctgtaggtttgcccccttttatcaacacccgtacaacaatagtcataatcctggtacatgcactatggaccgggtgggggttgatgtcagtatgcgagcattgaccagcacgggaagtagccgacagttccgaagatgtacgactgcgtcacaggcgacctcatcactgtccatgctctgtgagagccattctctctctacatgttttcaggaagcttcttccggtttcgcaaacttggccgaacttcatttatttcggtcattacgaacattaggagtgcatctgatttggattgtgctggcttcgaagtgaagggtgaatctcctgagtgaacttgggcaaagccaatgtcatgactccactattgaaacggattgccttagatagattcagcgctttacagcaacgacttctgcgtaaaaggctagacctgtgaagcaggcaccctccccctcatgccatcctgccaccgtggcctactgtcacacggtcgcctctttggttgacgccgttttcgttacaagga

SEQ ID NO: 2761 - DNA, 1229 bp, Toxoplasma gondii
tctgctctttgttcttcctgtgtaccgacgatgtcaagaccttttctgcgttgcgcctgccgagttctctgcaggtcgcgcatgctctttagcacgagtttcatctcctctgcttcttcatcttcttcgtctgcctgctctcctccactccctgcaggcgaacctttcgcctcctgagcacccgcctctgtctctgcagaagactcgacggcggaggccgatgtctgtcgcgaagcagacgcttctgcagcgttcgcgtacatcgtactctcctctgcatgaacggcttttaaacgcgcgagagaggcatcgaagccccggcgccggaatcccaggaacccagcggaatacgggagagaagatgaagacgaaggcggagaagaagagggcaaggaagattctgacgaagaaaaaggcttcgtgacggcgtcggaggaagaagaacggtcgtgtggatcttcgggagattcgcttctcagccgttgtcgatgaccttcatctttttgtggcggagaacgcgaagacggctcgcgacgggagtcctctggagttctctcctgctcgggtgaagaagcagagcgcgtcctcgctcgcggtttgcggtgtctctcggaagaccgtgatgcggagcgtgagtgactgccttcccttctgcgtcggttcttctctgatttgatccttttagttctggaaggcgaggagaacgttcttcgtccctcacgttcctctccggaagaaggcgatagctcctctcggctgcggcgccggtccgcctcaatccttctatcgcgctcccttcctcgccccatcgttgcggttcgcctgtggcaaacgcaaatttcgcaccgcaccagccaagccgagactccttctgaaacctatgcaaactcctaaaacgggtccgcctccacgctcccttcaggcggcgcgtctccgccccctcgaccgtcagcaaagatgttcagaggaggaggaagaaagtggagagaggcgctttttttcgatgcagatattgtgaacctccggaaccgccgaacgcctcgtcagacgccgacgcgttgtgagaaaaaccggacgcggttcgagcgcaacctcagacgcctgagaagaagaaacgctcaagaacaagaaggtgaaagaaacaagttttagcttcgaggtcgacacagaaaaggcctttgtcctcaacgatttttccgcatgtcaaaatgcatgcgcactgcggtgta

SEQ ID NO: 2762 - DNA, 2323 bp, Toxoplasma gondii
ctctgagtccctgtctgctgcaagagaagagagatgtttgaagagcgaggcgaggaggtagggggctcctttgctctcgaagacggacgcttttctctctctctcgggtgttaaactctgccaggcgaaacgaagaagagtgtctccagcggatcacgatattcgcatgaggtctgagttttcaacagcgttcgtttccagtatttgttacacgacctaagcgtgtttccagatcgaaacctcactatgttgcgagaccacctaagagaaaaacgaagaaagaaccggtctcttcagctgtcgaacgcagacttcaacttgcgtaatgcaaaaggactcccgagtctacagaggcgagacgctgaggactttgctgcaaagaactttgagaagaagacaagacggtgagacagacgcgccagcctcgagtcgcgcagcagagcagccttataagcaagaggaggaaagggaagaaagagaggagaagggagacgtaatgaagaggagcacgcatgcgacagagaaaggtagcgaacaacaagagcagacagagagaggatcaaagaaaacgagcaaatggcggagcaaggagagagacaaagagaaagaagtaggtagagtagagagtgcgagaggggggagaagaagactgatgaaagcgagatggcagagttggagggtctgagcgtatcccagagagtgtcgaggaacaaatggatattcctattggaaaacgaaacgctcgagtcacgcgccacagagagaccgtttggagggactcactccggtccaccaggtctccctgtggctagaggagacgcggactcttcctctcacgtcggtgtcaaggaaacgagaaaatgctgacgcaaagattcgatgcgcgatccttgtctcggacaaagaagcgcagattctctctctcctccctgcagccagtcttcgcttttctctctccccaaatatgcgaattgccttctaggcgaggcgcacctcgcgcgcgtccaggcgtcctctcagcagctgcacaacgcggtgtatgtacacccggcacttccagagaaacagcaaagcaagaaatgccgaacgtttttctgctgtgctttgaagaggacgaaagtgcgagtttttcgaagaaaagaagcaacgcgggggaggacccgagagcatgttgttcgttcgcgtatcgactgcatgcatgcgagagcttgtctctgtcggcggtgccgcaggtttcttcctcactttttcttctctccgaggctctgtttttctgtgaagagtcctgagcgagagcggcacaccgactttgttcggaaatacaagagttctgtgatgtcgcagcacacgcacggccgcgacgcgcggtttttctcggttgttgtgttcgtcgaaaggcgcttggtttctctttctgtattgtctgtgaaaggttttctgtttcttttccctcgtaatctcctcggcgcctttcgcttttccgccctccgtcttctctccttccccgcgttctatgcgccctctccgctctgccagcaagagtccgcttcttcgttctcgagagagactgtgcggctcttcacacccgagttctctgtctctgcgtcgttgtcttccgctttgcgttccgctctctccttgaaacgcgctgccctgcgtctccccgcgcttctgctttggttctctgcttgactgcgctcgaggcctcgcggtcctccgcagcctccctcctcacgtccacggtgagccgtgtatcgatccccgcgtcccctcgttttcaaccgcgaagggttgcctgccttccagtctcccctgcgccggtctggctctcgaagctcacgtcgaggccgaccgtctctgagcagagacggtcgcttgatctccacttcccttcgcgcatctccgtttggcggctgtctgcggaccggcgtggattcggctgtacgcacatgtattcatttcttcagtgtacgtccagctggccgcgacggcgtactagatgggtgcttgtcgctcggcgaaggagtctcccataatcggggcctctcagcacaggcgttttccccgcgctctcttgtcctctccctgtctcccttcctgtctccttcttctctgagctgtgtgcttcgcgtcgtctctcccttcgggagtggaacgcgggatctcgctggtttcctcctcttcgaaaaacgtctctctccagcttcggcgtctgcatcgcgaggtcaggcgcgcgtctcccgcccagcaaccgacgaggaggagaacgcggcagccgagagccagaaagacaatatcgcgcgagcagtcgcggcgtccgcca

SEQ ID NO: 2763 - DNA, 1779 bp, Toxoplasma gondii
atttgtagatgtgtcgagtacgtatgactctagggcctgtatatccagagatgcaagtgtgcgcgtatatgtatgtatatataaatatataaatatatatatatatatatgtagtatcaagcggacggctaaacgcgagcaggcgtctgagatgtattaacacaggtgttgaactgcagagagcatcgagtcccttttttcgcgtctttccccatgtgtatctttgttcgttcgccgggatccagttcatcacgtacatttgaacgggctgtttgcgaaaggcttgggggatgtttttgagagcgagcatgagagagacagttgcggcgcctgtctcttccaggaggtcttgagttccgcgctcgctggctttcttcatcacgtacgccgtgaggcccgccaaggccttcttgagcagcgcaggtgagacggggcacccaggaatcttctcttctgtctctgcaggcgacgctcgagccgcgccatctgttctctgcttcttcccgaggtgtgtagtctctctgtctcccgcggatctcttgtcgcgggaggaggcggaggcggaggaagaggccgagagcgcaggaggcactctgccaggcttgtcaggcgccggcgctttgcgggaagcagaggaaagagacttgctcttcttgctcgaacccacagaccttaggccagaggacactgcgccctcctctcgccctctcttcttagcggcggcctttgcccccttcggaactccagccatggcggagacgcagaagaacaagaaggaggaggagacggagaaggagaagaaagaaaaagcgtatagcaagggaaggaaaggacaacgcaaggagggctgaagggactctcggctgcgtggagaaaaagctgtaacggggcgctaaaagagttgcgaatgcagtcggagcgagaggcagagaggaaaaagagacgggagaaaatagggagaggaatcgaaagttcacaaggaaaagaaaacgggcttcaaaagaggctcttcaaccttctctctttctcctctcgacgacgccagggccgtggtcgcggcgagaggcgacagaccgtccccgccgaggctccagtaactctcgcttctgtgctgaacacagaagcggttgagaacaggaggaaagaaaaggaagctactttgatttctacaaaaattctcagcgaccagaacaacgcgaaactcgacagggatatatgcctgtggggctgtaccgacagtgagtgtccgctacaagctgccgggggcttctaaggctttgcgccctctttttcgcgcatgcatcgccagccggggcatgcacttttttattcggaacgacaaagaatcctctatacgaaagacgctaaaacaggaagagtctcgccttcgcgcgtttgaagaactctctccgtgttagacatttccggtatcttctcttcggcgctcctccgctgctcaggtgtaggtactctgggagtcttgacccgagtcaggccagcgcgcgcctcgccgtccgagttgctgtgcctttcgtgtagtcttttcactaaagtcgacaactttttgttcgcatcattgaccgttttctcaacgacagtgctcctcctcctcaactcttgctttcggctatcacggagtcaaactgtggagacttcccaggcctctttgttcaacgctgaacaaggctgcggatcgggtgacgcgtgcatgcaaagtcagaatattgcgcatctccttcgcttcagttcctgacgaatcaaaccaacacacagcaacca

SEQ ID NO: 2764 - DNA, 2521 bp, Toxoplasma gondii
tatcgatctccatttggcggcatgccgcgactcgaatatggttcgcggccgtcctccatccccattcttccgaaaaaatgagaaaaaaaagtgaggggaagctggcggaaactctcaaatcgggagggagaaggccaagcccagcgaagcggcagaacaggggggggagggtgaaagggagaatatagggggagagagggaaggagagacgaggagagagacgcgttttgttggggagagagacgagaagaaggagccgacagtgcgaagcgcagataggcgtttgctgtgggtttcgagcttcctcgaactgtttgaagaacggagaagacgactgggcagttgcgttgaaactatggcttgcagcttctcgtttccagcgtgaggaccccagagaagagaacggagaggaacaaacacccacagagacaaggccgcgcaaagaaaagtcaaaaaccctgaagacacgcgagacgcaggcgggggcggtgctgaactggacaggggattggtacgtttttggtcggagggacggagagacaaaacgcgagtcacacggaaaagcgtttgaacggagaagagagagagaaaacggaaaacctggacaagaagagagagggaaagaggaacggaaaacggggaggagagcgacaggaaactccccggtcggcggtacgaaaaaccagccaacggtccccgactgcgacgaggagaatgtcctggaggcccacagacggcgacggcggacattaaaagtgcaaaaaatcggagtggaaaacaaaaggaacagttaaaaaagcgaaacagagaagagcacctttcattccagggtctcggggaggacgcgcgcgatgtgcagaacccccgaccgccatgcgcatgcgaaaatgccagaaggacttctctcccgtagcctgcgggcgacgtccctgcctcgattcagcggcatgaaaaagcaaagtcgcgtccaattcacagcgtttcgcagatctctccacctctatgcagattcagagagaaacatgcgatcacacacacacacgcacacagacaaagagagacaaagacaaagagagacaaagacaaagagagaaaaagagagagagacaaagagagagagacaaagagagagacagagagagagagaaggagcaggaacggaaaaagagatccaggcaagcttagctgctgcctcgcgcgtaccgtcgcgtccctgggacgactcctcccggttggcctgacgacgccggattcggcttatatacggagaacccctgaggcctcgccttaaacttggaggcgcgagaaacacccgaccccacaagaatctccacgggggagacagagcacacgagggaagcagtggcaagacagagagaggagactggaaagccttttcctgtaaagcgcgcgagagagacaggagagaaccagaaccagtacgacaaccagtccaagaacaagagagaggaacaaggcgagagggaaaaggcgagagggaaaaggcgagaaggaaaaggcgagaaggtgaaggcgagaaggtaaaggcgtgaggaagaaggcgaaggattgcaggagggtgaggaagggagagagattccaggagagggattgagagaacgaaagttgtgtcttcagctcgtgcgactttcgctgagcggttcgtttttctgtggtggtgcccccctctttgctcctctcatgcgctagagaagcggagttccgttttcttttttcttcatgttcgcctttctcctcggtttccacttccttcatcgtgagaaaaaaacgcatccaaaaaagcgcggaaaggaaggaaaaaaatgccttgaaaaggtttcatcttcctcgaggggggttcctgcctcgcggccggcgccggtgtgtcttccctactcgccatccagtggacgcgcggtggaagactggagagaattcttttttctcgaaagaaacaagtcttatccgacaccgaagacgcatctgtttcctgtgtccagggaaagatattcttggacgaagcaccaagtcgacgagttcttcttttctcgcgtcttccctctccctggaggagcaacgaggagacacacacccagtccgctctctccttctccgctctctccttcttccttttcctcccttgtttctcttcttcttcctgcctttccgccgatccttttcagccgtcgtttttctctccgctctcgtctcccatctccctcggcctccgccctccccgcttccctcatgtcttctctgtcttctctgtcttctctgtcttctctgtcttttctctcttctctctccgtcgttctttctctccacgcattgaacggaactctgcgtctcctctcgtctccttgctctgggttgccaggtgcgcctgcgtgagtccggaagagccgcgcggagaagacgtcgtctgttcaggctcgctaccgtcttcagtctctccctctgacgctcccaaacgtatccccgtctcgccttcctgtgcactcctcaggccaactccgcaaga

SEQ ID NO: 2765 - DNA, 2030 bp, Toxoplasma gondii
acgtttctctgcatccgttgctctccgtgaccatccgaaacagagcagtgcaccagagtgcgataatgtatttcttaccgattcagagagaaatgaaaagtgcgttttatctgtatatggggatgtgagaacggaaacgaatacattgaaggagaaatgtaaacatttattctacactgccgcagaacaagacactgaagtaacaaccgaacactcactgccaagtgtcaccgggcctccagtattgacccaggcatgcttattgtttccaatggaaggaaccaacaaacgtaactgctgctgggaacggagtcgaggtgtctttcatttttcgaggagcttgaagcctaggttccagtcagctgacgaaccgtaagattttttttgaacggtggacccgcggatggacccagcttgagcagcccactatcgaatgtatgccgctgaatgcacggtgcggttcggcagttaatgcatcgccgacgtacggcttaaactagagtgtcttcgaatctctaataaggtggtattcatgctactgcagaaggtatgctccacccgtgtttcacagcgcccgaggaagcggggtgtggcgcatgtcccagtgcggagttttcgggggtacgagcatgtatcgctcagcctgcacacgatgcccattgttcagacattagtcatgaacgcgagttacgagctggcacatcatgtgcaaaaggcagattagcaatgttcctgtgcatgcaccgttggtcagaagtaccctgggacacatgaacgcctggcaggtagatctctacagtgtacggttcttggccacaagagctgcttaccgtgatatttagtggatcgaagtacgaaaaaagagcgcactttgcaggcttttgctatgccttcattgaaatatcagttcatatagcctttggcctatgccatctgaatgtgtgcctgagacaatctgcaatactcacgggtggcccgggccgtcgaccgggcagtcgtattactactgcatgtttgcttgggttttcagtgttgccgttccctgacgcaagtcagtagacattcaaaactagagtcatgggcgtcgccaacgcgtctgtttacccctgcgcgggaagccctcttggggacaggtcggcaagtcaacgtatgccgcggcagccagcagcataaagctgcacggcggtcgccaaagcaaacacgtcggaaaacgagtctatggagcgatcaacaaacgcgaaggcagtgggtggtaaaacacataccaaagacttgagacagaggcaacttcggtcaatgggaggaacgaagtggcaagcgacaccattagacacagtcctgtagtcgtccgaatgagggagtacctgacttcaaattttcattgtgtgcaacgtttccacatggaatgagccccttctggaggcgtggacctgaacgatacctgggatgagtccgtcagcgtcattaagcttcaagaaaaaagattttttccaatcttgcgcatgcatgcatagtttttcggtggatagccaccgctgcgattgcagaagctgtggcccggggagagcctttgccaccttgacaagccgtgttgctgtttaagtcatctcagaagatcttcgcttccttggctaggaatcatttaggtaccacaatactgaggaatgaccgcctgtggattgcgcggtcattctgtgttatccctgaggcatgcacattcttctgaccagccgtcccgttggtgtctacaagtcgtcttcggaacgaacactttttctccacttggttgcttttagccgacgaagagtatatttgagacagttgtttctgtcgtggtcgtcctcgaattcttttccgatactgctgtgaatcctgctgcagtctgtccagcacgtcccgtggaaccgttcgccttgccgcgcggtatggagtctcgtaatgcaacgctttgacgggttaccagtgtcaaacgcgttgctattgctggaacaaatcagagactgcatgcctagttgtaccgttagcctcaa

SEQ ID NO: 2766 - DNA, 1629 bp, Toxoplasma gondii
ggcgaatccgttattacgaaacacttggacaatgtcgcttccaagacattgctaacagaagccaggacctgtttcgctgcctactcggcaaaccaaaccatgcgagcaagcacagaagaaggatcccttgatgacccggatggacttccagcttttttgccggctctgtctcgccgttaggtcactccttaactcgtagtttgaggacttgtgcgagacacaggagaccggctgtcaacgcctgaggacggaagaataagacgcagagaccgtaattcacatattgtgcctagaacggaaccgagatggaataactctaatgttgtagcaaatcgaaatccaacacttctcgatatcttgcgcagtgcagtggggcggtatcgtacaccgtgtcaggagagaaaagttcaataaacaaaggaaaagtctatcctgaagtctttttgtgctcccgtacggtgattgacgaggggaaacgtggaggcatgtctaggtttccgagagaaacctgtcgtcaaaaagcgaagattggcctccaaagagaaatttcgcgtttgaaaaatggagaccgtttcgttctgcgacaaggccgttgaaacctactggtcgttatagatggatctcactcgggtctaggcaaatcgtgagtgtcgaaggctcgaaataaacgccttttaattcgtcattctgtagatctatcacctttcgaaggaacgtgtgtaatttgcatttcctacgctttgcaaacgcaaaagaaaacgagcttcactcgtaccccctcgacaaagaaaccggcctatttttctgttcttggtcgaaggaatttcacatcggaagacaagcggagcatgtccatcttttttttaaaaaacaggcagacttagaggacgcatggaccttttcgacgacaatggaaacttaataattgacgggaaacggaggattgcctatgagcaacagaactgccgtccggaaattcgattcaaatttcaccggagtcgacctcgggtggaaaaaagcttcgaggaccatctggtttccagaacgtcttaaaactggcctagctttaggttcagttctcttcctctgtgcgaatgttggaagcaaaaaaactgcattttcctcgctttttcgcacagacaagagagaagcaggaacgacgccgccagtgaggcgggagagcgaaggcgctggttgcgctgcatgcagagactcattcagagaaaaattcagcgtgagagaaccggaacgccagcgacttcagtcttctcttcgatgaaagggaagcaaaagcagagtctttaccgaaaggaaagtttttttcttctcgaagaaccgtcttccttcttgtcgaaggcgcccggagaaaacgagaagaacgaagccagggcgctcctgctgcatacgtttccaggtttccagttactgtgtactcgaaactccagctgccgaaagcgagtcgcgttctttccttgttccttctttttccttggcatctcttctcggtccgtttggcttctcctctctggtttttcacttgcttcccggaccttgttcgcttccttgctctgcatgcacaggcaaaggaacagagaccgagacaagaggagacaccacgaagagacaaga

SEQ ID NO: 2767 - DNA, 2065 bp, Toxoplasma gondii
ttaacagacgaacaagtgcatgcaccgagctacgatcacgagcaaagacatcgtggctagacaggctctctgtcaactccaaacaggacaccccagacgaaaccggaagagaacttccctgtctctgcgcccctgtctcgctgtctctccacttcatctccccttcgactgggctcgttgccgtcgacgttcttcttcgacgttcttttcccctctacagtcggtgactctgtgtgtgcgattgcgtctctgtcatttgctcgctttcgcctccgacagtcatctctggctgctgaaggcgttacttttgcgcctcagcgacgctgccaagccgaagctctccccgcccagctttactccctgagtctgcgtctgcttcgcgaaactcgcacttacgtcacgaagaatctttctgctcatccaccagtccttcaactccctctcgatgttctgcagctccagcttcaaagacgccgccttcacctccccgcgagaaagcggttctgcaggcgcagcagtgaaggatacggcgacattcgccgaaggcggaggaggcagcgcagtcatcgtggaagagcggaaatcgagagaagaacgcggccggacgcctgttcagggaaggcctcgcgagaggacggaacgaatgcgagaacagcgggatgggaacgggagccgtcgagatagagagaaggaatccgaagaggagaaagagaaagacggaaaacgaaagaaacaggagcggaagagcaggaaagggagagagaaggtagagacaggggggggtctgtgttttacggtgtgtacggggagaggcgcgggagtcttctgaaacgcgagagatattcgcgcgacagaggacgagaaagagagaagaacggaagacggggaagagtgggagatgcggcagatggaaaaaatgcgaggaagctttcaaatccgcgaatttggggcgggaacagtccgccgtgaggtgtatgtacacccgagagacgaagacgagaaagtcacgtttctccagaaagggagacaaccaagaggccgggagacaactaaaacggacagaaaagaactgcagagaaagtctttcacgaagcaccacctcgtcccgccttgactctcttgctcatatttttcaaaaaaactgcatgcgccgcagcctcccaaagccttgcagcgtcaccggccgtgtgtgccgcctggggcgagacagcttgtgttctttctcgtttgctcgacagcgaactcgaggctccgctcgagattatcgaggagacttcgcacccgcgcgttcttctccgtttcgaactcccagcgaaaggttaagcgagacttccagaaggaggcgagggggatgtaggaaggcgagaaaaaggaactgtgagcagggatgagttcgtcgacaaggctctctcgcggtcctcagcgctcagcggcctgtcttctctcgtttctgcgaaaagattctggaaagcgctgtcgtccagaaagcggcagacgcggagcagccgaggagatcctgttgaattgcctctgccctcttctttctgtgttttccgggggaagaatgtgagcgggcaaagagaagcgaaaaacaggcaagaaagacagcgagtccctgcgtttgtggggagagcacaaaacctgggctgtctctctgcgctgcagcggacagggaagaagtttcgagagcaagaaacgcgccttgttcacttggcttctgctgttgttcatcgggggtgtctgtacagggaggctttttccgccttctcctctcgtctcgagacgtattcctctccactttgttcgcccagggcgccttcttatcgcaactctctaatatctggtgtctctctcttattgttttacgccgtgtctggccttagtcgtcttccttgcgcatgtgcagtccttctcttcttccgcgtctctgttcacacaaaagcagttttttctcctctccttcctcttcttttctttcgcttcgtcttcctcttcgctcgcttcgtctcctctctcttcctccctcagtcttcttcgtccttgatttctcgtccgagcgagaaga

SEQ ID NO: 2768 - DNA, 4856 bp, Toxoplasma gondii
ctccatcttgaggaatctcttctgttcgtcgaccaactcgaggtagagcgagttctgtcgcttcacctcgttgagtgccgcgttcagccgggcttcgcggacgcggtgtttgtacaccttctcctcgatgagctgttgccaggaaaagcccttgaggtacgtgagacaccagaggtcttctcgccaccggctcttccgcttcgcgcttccgatcggctgaccattcaacagacgagaaacgcgacgtgcgacgcgcttgtcgaggaactcgagccagcctgatgtcggtacacccgaagacgcaggtgttgaggaacgccgattccgacgatgatcccccgcgccgctttcgtcctggatgtgcaggcggccgagctgaccaaatctgtcgaagtagcgacgaagtgccgccctgttcattcgtggcggaatacgcgaaatgtacacgatgcccggctcccgttttcgcttctttgtcaccagcagagacggtccatctccagaagatgaagaggcagagttcttcccattcgtgtccgaacgctgcttcttctccgttttcctcgccgtagcgctctccacggatctcgcctcagaggcatccgactgagaaagacccacaacgaggggctgcgtgtctgtactcattgtgggaaccttttttcgcgaaacgtagaaatggtcattcacatccaccttctccagtcgaggcacagacatgcacgcacagatacacaaagagcacgtgaatgaccgccgcttacatctgtgcctcgccttcccgttatttgtcacgagttcgtttaggtctacagcctttccggtccgaggtcttccaagaagggaagcaaggaaagcggaaaaaacaccgtgaacagcagttgaggcactcgacagaaaagaggaattatggttggactgtgccggtgtggacagtggggaaagactccggggcttagcagagagtagaatgccggtgtacagtcctgcgttgaagcgaaaaaaagatcttttacgtgttcatgtgaaggggagatacgacatgccgctagctccagacggaagagaatcacttgtcagcagccaacggcaaacgaggcaaacaattcggcgaccatgacacaggcagcaccttggggaatgcgacgaatacacacagtaaacaactgagcaaaaggcggagaatgatacgggaaacgtatcgttgtaaggcgtatcacgagaaaatttccgggaagcttggcgcatgcggtagaagtcacagtgctgttacgcgactgctgcatgcgcggtttgttgaactaaaatgggaaaatctgcaaattttgtcataatctttagaataggaaatggctcacgccgccgagaggcggcgttttcgtgctgcagtccgtcgagatctttgtcttttcctgaaggtttcctctctactgcccaacacaagtgtttagggtttccgtgctcttgcgaagtcttcgcgtttggcttccagcatcgtgtataacgcgcttacttctctcccaccaacacacagaggaaaaacttccgttatgtagtgtcgtcttgcaccgatttcacagcggaaggcggtgtcattttccgcacacaagattctgtgtcgaacagcgtatactgacagtgaagcgtaaaaacgtctctgttgcttctacgacctgctgccgaacctcatgtggggatattcttcttgctctatgaaggcgagatctttcatcgcatgggaaaaatcatttgggacctgtacttcactaaaaatactgagggtcgaagatggcatcagtgtgagcggctggactgttgctactagtctccaccgtaagttgaaaccagatttgccaagagtagaagaacgggactgtggctggcaacttctataattcttgcaacggcaaaaagtatgtacccgaggagcgttttctggatatgccagctggcggtgagtcagcatggcgtactagaatggccaacgtcatcttgtgctgtttgcacgcgtggacagtcttaacactgcttgccggataaaagtgtgaatacagaagtctcttgccgaacctgataatcctctctttctccgaatggaactcgccagtgtctgagagactctgattgtcaccgtcaaaatgaagctgttttttgaccaacagtttcatatgcgttataggcaactttgtagttcatatcttgaaacaggctgccaccagtgacgcacaagaacagcaagccactacttccgttatcgctggctactactggtgtgaccgtttgacgatgtgatgtgaaagggagcaaaatacacaatttgaaaaaggggggaaatcgtcttgaattccaagatcccacatgaaacgtggcacgcattcagacgctgtggaaagcctgagcgactcctcggcatgcagagaattggcgcgatactgacggggcaaacgcacgaaagaagggtggatgccatagaatgcatttccgagccttgcccgaagtgtttttcactcatggagcgtaggcttgacaaaacactatcccgggctctctgtgcctctacttcgaatgacgctagaggtgtgcttgtaccaacttcaaatccggaggtgtgcccgaatgcaggtaatgccgacgtcagggcaccccgaaaaagcgttcctcaaaattctgtaggcgcaaattgtggatgaaatgacagtctatagcggatcgtaccacaatcaaactttaagctcgtttggccactgatcgtcaatgaggcaacgttgtgcctttgacgggctgcggcactgcgcttccgcgttagccggagatcaagcggatacacttatgttggttaagcttcccccgagacagctgctccaactctcgcaaacggggcaaccgcaaagcattccagttttctggtgtgtatcatcctagccgcgctaatccgacgcggactacacgcttctggctgcagtcaggaaaaagcaaatgctgaacaaggcacagaagccttcggacaactaggagtagcgttcacacgatgcataaactgccgaaggaagtaccgaaaatggagttgcagtttcgattcgttgtcgggactcatgcgtgtgtcacgcaatcatcgttctccacggtaaatgtcagagctggttgtcgcaaggccgggaccaattaggatgccccccgggggtgagtttttcagtagtagctagatatttgttgtagcattcgatgaacctttcgcactgcacagcgcagcaagcgaacatgataccacgttggagcgtacggaggatgttgaccacgaaaaaatgccaaaaaagtggctcctccatggcagtccagtcactgcagtctttcttttcttgttgcaggataatgcagccccctcaggtagaactgccacagtttaaagcgtgagcggagcctcgcactaacaggcagttcgctcttcttctctgctgtcagtcaagtggctctccacagcagccgtatccgtgaggaaacccgtctgtgacggggcaaagctgcacagttgctcgtcagagcgtcacccactctgcccaccttcgcgcactctcggcgtttctcgtgtggagcgggtcatcgggctggtgactgtttcttttctttgtcacatcagacgcgttttagtgttccatttccaaagttccgcgtggaacatttccagtattcaattgacggtctctgttttctgaattccagagctacaactggcatgagttgtacccgatacgacagcggtgcttcgcgagcgctgtttcactttcggaggcatgcaggtgtgcgtgtctttcggcggcagcggtgttgggcacgcttgttttctggcctagaaacagacgggtgtgcgagcgctgtgacaaaaacggaaatcggcgatgcgtcattcgtactgcggtgacttcaacaagaggtgaagaacagaaactgcggacagctggtcccacaacggtgtaaagacaccccaggtgaccattgagtgagtgcgcgtctctcgtctcagtgtgactggcacactgcaagtcatttcagtccgtccgcggcgcgtcgaaagcgtttcccgactgcggcacacgactggcaacgccttgtttgcgtatgttgtgtgtttttattacctggtgtgcggcgccggttctcgaagcacaggctgcagctggcacccgcgttcaattgatgtgttacaggcaggctgtttattcgtaccagccgtccgcaccacacttttgagagcagctgtcacgcattccgtttttccccttcaactggaaagcgccgagagccatattacacacatttcaagctgttggctggacctcggccgcgtcacgcctttccctggcagttttcccgcccgtttctgcgccagtgacatcttgttgatccgccccggtgaagtcgacagctgctttgatttcgatttcccatcaccgacgcgttgccgtcgcggcttccctatgtcatcttgggtgttcttaagtgaccagatgtgaacattttttcagtttcgtgtgcttgctcagctcgagtgttgtttagcccgccgcggcatccagggcgccggcagtcgtcgagggtaactgaggccaggatctctcggaagactgtcctgcaggcgttcccaagtgaagaattcgtcgcaatcttaatccaccctgcttgcaaactgcaaaagcggaacgtagtctctcgtggcccgtcgacgataatggaaggcaacacaccacagttggatgaacaattagtctcaaccagtgagaagccggattctcccgcctcatgtgaggtgtggtcaggggcttttctttcgtcgccttctctcatttcttcgacattaccaa

SEQ ID NO: 2769 - DNA, 1983 bp, Toxoplasma gondii
ccctcgcttctctggctgtcctatctcgtgcggagacgaagggtatagggagacgcagagccgactgcaaacaactgccatgtttttttggattgtttttgcaagcctaactcaatctttttcgataacaaaggagcagacgaccgctgtatcatcttgatatagaatgtacgcatgtggtgaaagagcggacaaccgaaaaaggccgaagtgtgctgcagagaggggaaatgtgacaacgacgcaggctacaaaatagagcagcagaaagtggttggatacaagacgtttcgcacaagtattacgtacaatagtaagtgcatgtacaggtgctgtgttccaggtacatgttgggaattcaaacgagtgtgacgaagcattctgtcaaaattggctttgcctgagtagatcgtcaagctatgacgtgggatttgagaattctttacagctcgctctgtcctcctagaaagaaagggaacacgaccgaggtacaaatttcactgtaagcggcgagatccccacaagcagtctcagcgaactcagcagaacacatgaacacaaaatactaagacagttcatgtggaaccgcttttgagactgtcttttgaaacatgtcacggtggattgtggtttgagtatatttcgccaacatggaggtgctgatacagtcgacagacgattcaaagtatgcggtttctccaccacaaagttcacaattaggcagatgcgtcgcatccctgcgaaaacgcgaagtcaggcggctggacgttcggttataacctgaggggggattcactcgaaataccctgtgctgaaggcggctccaacttgctgcgtttcctttcctgtagatatgcaaccaaacaacctccgctcgatgacgccttgcacttttacattgcaatctccaattcctctttctggccataaagaaaaggaaaagagggtgtttttcatttgtcatgcttactttagtcctgttcattgacaattatgcttaaactgctgagtcactagacatgagtcggcgaagaacttcgtttcctgttccacttccccgtggaaaacacagtcgacgaagtccgtctctggtattgggtcaaaaaggaactttcccgttttcaaccctaacaactgcgcacgtagatgcagttggtttcttccccccgtttgcgttcagcatcggaattaccagtcacctcagtaatcactaacaaaaagagtaagagtcgtatgttcatctcttctcgacgcgcctcgcgacgatgtttagcacaataaaaacggttccgagcagagtcagagcatgctttgtcttcgacggtgtccgtcggaattgagacggaagttattccgtcacacacaaacattatacaattgcgtcggtgtccccgtggtaccacctatacattctcgtgtgtgctgggaaatccggggattttctgtgtccaacgtagtaacggggcgtttcctcttcgtaacacacaataatggacaaattcccatgcagatcctctctctgcttctttgtcacttgatcgtatcacgaaatgcggtctggatcaatgaggacccacttcttctttgccccatttccccgccaaatttcagcaccatacccgttgtttattacctcacatacacatagaaggacgggtgcacatccgggtcgcggacgggttccagggcgaacgtcgtcgcgtaaatcgacgttaccccgtcgatctcattgctctctgcgtcgctgcgtctctgtggactgtgtgcatgacggctcgaaacggtccttgtcggatagaacacatcaaaaattttttctgtttcatctgtcacgtgcgtccttttggtggaagcgacgcgtcgtcgcggccctgttgggggtagtcaatatttcagtaagcgtttctagcgacacccgctacacagaacactcggttgaagcactgtgatgctggcgtttctgtccgctgtctttctgcagaa

SEQ ID NO: 2770 - DNA, 2421 bp, Toxoplasma gondii
atcacagggtgtctactccactggactgacatgggttgctgagtggaaacgtgtttcgcttgacgaaactcctgccaaagtgaaacatttctcgagtttcaatggcgcagcacacattgaaaaacaaaagcaagacaggggcgtactgcacgtcaagaaacaacttcccggttaacgggtcagatgagggctctcttgtcgcaggcattgtgaggagagctggattgctaatccaatcgacgtagattctaagtacacgcgtgatatgtggagacttctaaatcctgagcgtatcaacctgagaagcgggggcgagactcacttttctcagacgaaagaagcatacagccagaagaagaaaccgcagctgtgccgcagtctcggtcaaaaggcagtaataggattcggcgaaactgactctataaagtggaaggcttgccgaatacggacatacattcatgtgtgcacatagttacaatttctgcatagagaacgtcgtgatctgtgagtagcgcatccggacaacggaataaccaaatgaataatggtcgcacacaaatttctcctgttttccttcataccgctggaattaaacactggaaggccgttctatgtagctgatgctttttacgttgtacactctcatgaaacgttgttttggtattccttcagatagttcggtgtcttactcgaggatcgacgaagcaacatacgtggcaatgcccgctccaaagaaaacagtcccaaaaccgcatgaattgaccatacggctacccattgttcaagacagtgtattagtgttggactcttgctttgtggtaaatgataactgccgaggtaaaaacctgttcgacggccaagagccgatgttcaatacgtgcacccgagctataatgtatggtcaggcttagttcagcagctctcctcgttagcacaaggacctgtgcgaacttgatgtcggtgaccggcctcccagagacctcctttattctttatgttgtggaaaggccgataaatcgtcgttaaagtccctaccgtttattaaaatgcacgtcatacgtgttctgagaggccacggaggcagcgcagtgacttttgaaaccccacgagaagtagtggcgtgtatttcgaatcgtgaaagacataatatattctcgtacgtcccctttttccctcctgtccacaggaagaagagggctcggtgtctatgaatagaggcaaggcagtacactgattgcgcaagagggatctgcgtgcgcgctgcccttcccctgaatttcgcgagaaaaaactgaggtcgaaaaactgtgtccgatttgcgcagggttgtctttcctgcttttggtatgtctgggtacgctagcgctatgctattctccgaggcattctcctgaaacactgactttttcccctgctctttgaaggcattcacgcgtaaattgcgtctgccaaaatgtccttctgtacatatatatcgctgctgttgattaatggtctaatcgttttgtccagggagaagtgaatatgaaactgaatcagaacaagtatatggctcggtctactcgagttactcttctgtttctcggcgcgtgtgtgttttccatgtacggggaaagtctatgggaaacacgactcctcgtcatttcgtggacattcgttacatgacagtgggactgcctttgtccaggggcattcgctttaccccggcagaaactgatcccattttttggtacatttcggacactcccctttctgttgttatttcttgcgcacaaccagcggagacaaaaggagtgaatgtcacggaagaacactcttctttgtggtagtggaaggcgttgcagcctcaaaagagccattctcatctgtgtagctgcataatgtgtcgtccttctgcacttccctttcgccaaagcgctacatgggtttctccgagaacagtctcctgagatatgtcttgaaacttgcttttaccgagacaacttcacgcaggtctacgttccatattttgtcacagtcgggcacaaggggaaacatgcaggtaaatttgtgtggtagttcctttcattagatttcctctgcgcattacaatcccgtctttacatcaggaacaaaaaggaggaaccatccactccacactcggagtcctgcgaggaacgcgtgttcgaaagtgttatcacctgattccaaacaccacagtctcttccttttccgcttttctatgccgaaggtggttgaaccctggccgacattctgcctctcttagacgcatgagtctacggaactcaccgttccccagtttccaggaaggcccactgcggaacggacgaccttgttgggtttcgacgcagctgctcacttcgactgcttgttaaggcaacacgcattatgagcccgaactgcgaaacgaatgggtgaaga

SEQ ID NO: 2771 - DNA, 2029 bp, Toxoplasma gondii
aacgacgagcaactggaatgacacagaaatttccagtatagagccctatgtgcacgcagcctttcgagcgcaacggctgtcattttcctaccacctagatgtttctggacgaagcagccagcaacatggaatatggagtggacggcaagttacaagcaacaaaactggcggagccgacatggagcccagtcaagcgctttcacgaggtggccccttcgttagggccaagtcacaaagtctcttctcgcggaagatattgtgatccctacactctggataacgaaacacttgtcgctgcaaattacacactggttcacgtctctctaaaattgcatggaacttgctttctgcatgtacacccttctgttcgttggctaaaatgattacagcgtctgtgggtccagccttgagtctaggggggcaagtcttgagttcgagccgcttcctggcaactggtattagaatagattcagcctacttccgcatatactgcatctgtgcactacaactaatttttgttgtgtcgtatctcagtgggacaacacagtaaacctactaggaatgatttcgaagcaccgtacacaggacgcctctaggctgtcgggggactggtcactgaagataggtaacataggggcaatgctccgtatgttttgtgatgcgtgttcctcattaccgacgattgcacggaacagcagaaggggagcactgcgcgctaccaagaggaacaagtggacagatgcgcaagaaaccgccgacgagagagaaatacgcatcctgttcatcacggaaacccgaggtgtttctgggacggcagtgtacgagttctttgtgtggttgtcatccgctcagtgcaccgagtttaaaatacgtattgaaaatagttgcttctaacaactgaagccttccgttgatttctgtagacgtatcaccgatgaaggcgaccgcatggcaggtgaaaatggggcatttggtggtgctattgctcgcttttacagcattcgtttctgatctttggagtccttctgttccccatccgatcattccctgggaattacgcagctcagctgcagtttccgaccctgagaatgtgcactcaccgaaaccttccaataagtggaggctaaacaataaagtcattttttttatcagatgacgtgcaactcggtccatgcagacacggcagatggatttcttgccaccgcatgcacagcgagtgaaaacattttaccactgcaagagttgcgcaggaaaagtagagacaaacctctctcacacgtcacttgtcgtttggcgcaggcaccccgccccacagctcattggtcgatctagtttttcgtccagttgcttgttcctgtgtttgttggaaaaatagctgtttatttgagcccagctcgggcaatgttgtttggttcttcgactcgggtgacgacataaacggcgtggggtttcgtgaaaagcattcaacagaggtagaagggaagccttttgtttggttgactgcgatgagccggtgccagattttctcgtgaataggtttttcctcatgtgaattacaaacgttgacgttgttttacttctgcttgtgattcttttgtggtggtgtcgctatttaccatactgttccgtgtactggatggcgaagggcgattcgtgtgcagacggcaggaagtaggcggcaccgttgcctcccataaaacggaaaatattttcttttcaggagaaggcagtgagggctttgcgtgaccttccacccgcgcgttctgtcgaattaccactagctcgtccgtttttcggaaaatacacagaagcgcccccccccctccccgccccggaattcccttctcttcagacaactcgtatgcagcatcgctttccgcttgcagagctcgtggtgcccgtctgctacctctcaaaagcaaccggaaagatctggcgccgggtcctctgggctttttgaaagagggagctgcaaaccgtagtgtgtgttgactcttcgtcgctgcgaactcgaccagcgtaagcaata

SEQ ID NO: 2772 - DNA, 4840 bp, Toxoplasma gondii
cggtcggcaactccctcttgtcttaacagacggccgagacaagaggggagacgaccgaagcgaagcagaagaaactgctcgtcgactctttttgtctgaaggagaggtctgaacacgaggacgaagccgagcccagcgcgggatcctccagagacacctgcgacgaaacaacttgtctgcgcaggtgacggcgcggcagttcttcagaatatgcttccttttgtccggtggagatcttgtctcgaggtccgcaagcttcgacggcgcgcattgtctctccggcgctcccgggtgtttcacatgcaactgcagagagacgagagaagcgagagttcgcaggtccttgctctacaggacgagagacgcgtgagggagacagcgagggaaggaacagttggttgcggcactgctgaaggaaggcgacttcaccagcccttgaacgcagaactgcaaaggcgtcagccattgtcgttgtgtcttttccctgtctcgcgcactgacgattgctttctgccgtcccggcgatcgattctgcgcttcttggtgtttctcgacgccaactcttccagcgatgtatgtgacccggttggactcccgaggctgaaaaaatgcacaggaaagagtacgtagcctaagaaatagtttccctccttcacggccagcgatatgagcacccttaagcgcggttcagaaagcgtctggaaaaaattgtttaactgacagacacacacgggggcatgccagggcgaaagacgacacacacacagacagaagcagctgcttatctttttgaagctctggcggctccaaactcaagcaacgacagatgagggctccgcggatctgcggactggagaaagtaaccaggagaaacacgagtcgcgagaaaaaagaaagaggagcacgcactgcattcccttttcacttggtcaacagacgcaaagaaaaccgcgcacagaaacggactccccgcgggagagaagaacggcgtgaaagtgcgataaggcaagatcagtaagcttcagtggtgagaagccgcgcgggaaaggactgcgaaagaaaaagggtgaaggcgtacacagccacgcaaacgaccgcgaaccgtgaaagagtcacatgctcgagtgtacattcagctcgtcacacggcgagctcaagttgcggctacctgagtctgtcgcgtggcaaactgtcggggaagttctcagcttgatttttgtgggaaaacgctcgatctcgacacagaaaaaagcaaagggggaaatgctgaccaccagaaacacaccaggtgagaagcgacggcggaccagcgacaaatcgcgaagcgcgaatgcgacatcaggatccgacgcaacgagacgtgaccggagtgtccacatcaatcgaaatcgcggaccccaaactcccaggctcccaactgcgggatttgcgccgatgaaaactcgtgtgtttgcgtctgctgaacagtggagcttgccgcctaccccaaggttgctccgcgtagagtttttgcggcctgtcgagtccgcctcgcagctttttggtccaagtctgtggcgccgagaagagacggcagcacacgcgtgaaaaggaagcgcaaaacgccgggatgtcgtgataaagtttgcaggcgaagttcacgttgccgtgggcaagcaaaacggcatgtccagggacgaaataccgggctcttcaacaaacgatcttcgaacagaacaccgcaactgacttctaatgggatggaaatcgctgccatcgaaaagccagagacgcctcacccgttctggtacggtagcttatagtcaggcatagtcagtgggcgctgagttgtgcgccactcgatcttgctcgtaccgcgagggctgactgggttttgggtctgttacgggaaggtcgtcagcgacgccagggaatctgcattccgtgtggtgcctttctggggtgcgaaacggaaaaggcgttcagtctgaagaggatgccatgtatcactctcactgctaggggccctgtatactcaagtgtcgcgcctgaggcgaggcgtggcgacagagcagaagctgctcttctgaaggagcagtgcgcgacgctagaaacggggagaaaaatctgctgctgcagcacatcctgtctttcctgcttctagaaaggagagtttttgggtcgctatatctcggccgctgtgtgtgaagttcgtggtgcagcagaaagcgcacttgtcgaagagggtcaccgtgactagagaaaacgatggacgcactgttctatgcccacctacgtacagattcgtgatcaaaaaacgcaggtctgcatacagccctgtgaaacgaggtacaaatgcagaaggcggtttgaaccaaaacgatcggaatcaatgattccttcgaaactgtcgtcatcttgaaacgcatgacacttgcaactttgattcgcatgccacaccctcgtagccactggcgcgggtcccgtccccttgaaacaccctttctcgttcacgctgttgccaatctgttccagccgcatatatatacagatgtatgtataaacgtacttacatatatatatatatatatacgtatatatgaatgtgcacatacatatatatgtgcgtatatatgtatgtacacatatgtatatatatacggtttgtacgattaaggatatgttggggtttgtatttttttcacatggctcaaagaatgtgtagctggagtcatgggtgttaaactgctgttgggatgcctatccgcttggcgtcaatttttcggctaaactcggaattggtcaaccagcgcgggattaggaaagcagtacgagagtgcccgcacgtcagggtataactctataaacaggttacccttgtaaacacagacgcatccgagagggggtaaatgaagaacggcgggctaccgtggtgcaggcgcacaaacgctcctttgttgccagaagcttcacacttcacatcttcagtgattgcgtaacacgactacagacggtcaaggtaccctacgaaccgagttggagttgttcgacagcgtgtaccctcacttttgcgtttcggcagattcttcagaaccatctctgacgcgttctccaagtgagcaactagttgcagagggtgcctggctcgggcactacgaaaagcgagttgtcaatggttttacggggtcggggtggcatcttcgtagctcactgcatcagtcacgagaaggacttgctctacgggagactcgtttgtcagtcatttctcagaatccgacaacctgaacactccagttctcaaaatcgcagatcccaaccacagaagtccaactcgcagtgtacactccccagaaaacctcgcttgttcgcacccttggagtgcacggtgtgacgcgttacccgccgcaacctatcgctgctcctactccgcagctgaggctcgtccacgcatgtgcagctgcttcaaaaggataccgcgagacaggaggaagaactccagagtcttccctgccgaacaaaatccctaaacctgatgattgcctagtctgacacccccccttcctcttgaaagccagctgcaggacacacagtatcgtcgacgcacgcaaattgaaaattcaacgtcgaacactctggaatgcagtgggctgaaactgaaacggaagccgatggcagcgagctttcaattttgtatccgagtataaggcgaattcgcacggcagctcccttggcgctgccggactgttcgtggacgagggatctgttgttctagcagacacaagggtgttttcgatgcaggtgcaggcgtcctgcggctgaaagtcgatctgtctgcgtatcttctttttcgtaagaaaagcagcgtgcatgcaggaaaagaagatcggggaaagcacctgagcgtcgcggatttatttgcggccgacgacatcgagaacgactggcgcggaccagctcaccagttgtgtctcgaactctaaaacgttttcgctagagtttcttctttccttggtttcacgccttttcttgtggaggcagtccgtgcaagttgccactcagtctttcgaaggtggcgccgccagtcgacgcacaaccccagcatagtgtgtccagaggaccattgctctttcgcgttccttgctctttgcccgtctccgagctttccggaaatcgggttttcttccacttaaacaccttcgccaaaacacacggaggagcgggtgttcaggccggcttgtcgcagcgaagtcaaagacagcaagagctaacgtttcagtccgactcccgccgaatcttcgaataggtgaatgcggtcttggctggtttccctcgttcgccttttcgccgctcggcgtcacaggtttctatttcgatgattttcgcctcccgagaaaagagtctttttcccaaccaatgcgtgactgttttttggggcggcgacgtggaccgcttccaagtagggtcaacgcagtcggtcacgagagctccaagcgactctccttttttttaagagggagcggctcaatgcgtcgctccgacacacgccgtttgttttctcttatgtctgcgactgctgattcgtcgacgctgggtggaccgcatgccctgaagctctgtgagttgccaaagattccgatttcctcggttttccttcctcgaatcaaacttgcgttctcttgccgctgtgcccctccacgagacccccgtccctcgggtgtatctccactcgaccgtttgatagttgcatgcttttctaggaggtgacgtcgtcgctctcttcactggctttcttctctccccttcttaaacagtgtgtttgcaggtgggacccttgtactcaggaacatcctgtactcttcga

SEQ ID NO: 2773 - DNA, 1786 bp, Toxoplasma gondii
aacacattactacactctatcggagctcaacaaaaactttgtcgtgaggaggcaatactgcgagttcagtacgggacccagcagtcggtaggccgaccccgcaagatacatgccgggagttgccgcactgcgggtgccttcagatggcacctacatacaagaagcgccactgtctatcaattgataaaatgtttccagaaggcacacacagatggtggtaaaacgagttcacagctggccgcaaacagagctgaactgcttaactcaaacacgccatctttgtcatgtgtcatacacataattatttcgtttacgcacatccatcgccgcacgagcgactgtgtactgcccgcctgctggcggtttgtctcagtcccgtgcttcgctcgtctcgagacccgcaagtgctgcagttcatgtcttcagaaactcgaactgttccaaccgcatgttttagaaacacgtacaggccagcaggagtgcactgttacacagaaactccttagtggaccgcaccggtgaggaggaggttgtgcctttcttggtcgattttgccattctggaggagcttgttcaagtgccttttgtacaagaagctgggctttgtaaatcgttccgagtagtccttggttccagccaaacacacaaaagctgtcccccaggcgaaggacgctccaatgtactggaagtagcacctgcatttgtctcgcccgaatgcagggaagagcttccagaagagacccatagacataaacggcaacattttgaccagtcagtgaaaacaattgtccccgaaaagcaaacccgatttcgaagagaaacaagcccagaaggacgaagcaccgacgtgaactgggcacatgaacaggagaaacgtcctgaaaacggaaattgtactgaccgcaaaccaccccgagaggcagggcgtcgttccacgcacgaaatggaaaatctgcactttcaccaccagagagtactccccatacaacagtcaaacaacgagcatccctgaaactgctggctgaaaatgttatggcttttctgagtcggctctgtacgttttcgcctgtcctgcagttcttcactgggagtgccagcgatgaaacgcatgcactcgctcccgtcctttttacgcgcgatggcgacgaacacccaacagcgcgagatcctggcgcgcgctgggtagtcgatttccttgcgtttttcggtcatgtgcagtcacggcgaggactgtgcgacacaaacccctcggttactttgctcctcactagtcgttggcacgactacttcattacctgcaacgcgagttgtgtttcttttggacatcaactgagggcatttcgaaacggctaggaaaaacgttaagcgtagattgctcactctgctgggcaagaagttgccgtctctgaacttacctcactttcagcggcgtcgctctccctcggatctctttacgtttgctaattctttcccctggcttttttcggttgagtaaacgggaacaaaccggttctctcttgctctgtggctgttctcttctggtgcttagtgaattccagtatcgagcctcgtctccaagcgcagttcagcgtgagtcgcggtactctgctaagccgttctagcgtggaatccccctgggttgctgcttttggttctttttttgagacacgtcaaaaaaactccattccgtcatgcgagcttaagtgccaagggctattgagggatgaggacacacgccgtctcagtgttgtttgctgcgtaacgcgtgtctctttccgtgttcaaa

SEQ ID NO: 2774 - DNA, 4607 bp, Toxoplasma gondii
cacgatagccgtaaagacgagtgatgcgattcctatcgtggaacattgccgtgttgtgtcttcatgctatggaatggagtgccgtgttggctcagacgacagttttccagcttgaaaagccgccttaggaggcgatgtcaaactgactctgccaggtgaggcagcaaacgttgccacttagttggttcggtgataaggttctgtgaattatgttgccgtacgtgcagatatcgacaagcacaaccgtctcggctccgttgtacaacgccttttttacaagttcctttgttcggacggcatgttcccagaaacgtttcttcctctagcgaagcaggctgctttccggaaactgaaccgcaacgggtgcactatggcttctcgcaagactgaggaacacccgtttaaggagagcactggtgatgctggtggtgaagcacctgtggaagggcctagaggtccaacagcggaatgtgccgatgggccgtcgtcggtgcgtatgcccaggatgcagctcgcccttcctgaggcaatatcgcgacctgtgtctatagtgcacaggcttgacattggaaccagcggcgcactcgtggctgcaaagactgctgctgcagcagaaaatctgaagcttcagtgggcagagaggaaagtcctcaaggggtacatcggactctgcaccccagagatccactcgctccacgaggttgacgccccgctccgaaggcacccaacgcagagggggagaatggaagctttgagtaacgaaagcagatccagtttccatgatgtgtgcgacgaaaccgcacaaaaagatcactctagttatcgcattggtgcgaaacctggggtctctgtgtttgctccgcttggaggcaatggcgcgtatggcatgtttgcagcactggctctgacaggaagaacccaccagatccgagcacacctcgaatacattggccaccctctcctgggagatctagtttatggaaaccaaacagttaacgaggaactgcggaggttcgtaaagaatgttgttgtcaacccacgccatcacagggaagaggctgctacaaggatgacgagaaaagaagtacaggtttcgtgctgcgacgcagggccggatgtgttggcgcccgcgggaaatgtcaaagtgcacatgcgacccttcttacacgcttattttctacgctttgcccaccctcgcactggcgcagcggtcaatattaaagctctgccgcctgctgacatctgccaaatcgcagggaagataggtgtagattgggaattgagggcagatgctgccttcgaaagaattcatttgaacggattttagtatctggaagactggatgaacttctaaggtttttggaggccgctgctcctgaatacctggcttctctggcgaacgctcctgccacggcgggctgccttgtcagtggtattatgtagtcatcttcagtaaagttcctgtgggaaacagcattcctcagtttgtaggcgcctataggttgaaaacgaaggtagggggtacggcagtgtttttcattcgaaagaggcttcgatacaggttgaatgtcttcgttcacgtcttgagcagtgttcagtgagattgcaccgtgtgggctttggacgctggagctattgcagcgagatttcggtaagttgtgtgagcattgctcatggcattttccctggagatcagctagctatagagagcaaaaccttcctagattcggccactgtctacgcagggggtgcgtcccccgtctacttgtagagtcctttcggcgggagcgttgttccgtatagccgagcctatcatcctgagcaaggaactctggaggctcaacatacgatgttgctcgcacgaggcatgactctacaaaatggtactttgtagatttgctgctctgtcggcaaaaagcaatgaattcgaaagcggcactgcggagaaagattggtcgtgaggtgtccatacaccgaagcttagtaacatagctgggcactttattgaagagccggcggatggttcccttcgtcgagcactgctctctctcagacacaactagagatttatgagaagacaaagacacaatgcatatatttattccgccatttcggaaaaggtctcgctcgccacctgataaccctgccatctctgcatctgatggcaacacgagagaaactgcctcttcaactgcattcgtcaaagatgatacgaatagaatgtctatcatgccccacgcaatgcaaccttctgcgatgcacgacaagcggcgagcaacggagactactgtaccgttcgccggtgcgttgtccagtgtcgctgggtcgacagtcgccttcctcggagactttctaggctacgaggtactatatacaaaacgttctatgaagaaacgcaaaaagtacaagtcagctcctgcttcctgtcgttcgtgacttcttggggaaaatatcgtctttttggaattcacagcgatggtgtcctcctggtaaaggaggggagtatagccttgctggatgatgccgtaagagtgtctccataaaatgagagctcttctgcaaaacattctaactttcagggtgcggttgtggctaagtcaactagcagatgtggttggtccacagaaaagggtcccggatctactcttggtaagcaccaaccagcgcgcggctaagcgctttgcaagatgagatatcttgtagttctgggaaactttgaagtggaaatatgtgagcaaatcatggaagaggaatactcgtctgggcgtcatttcatgtgagtggtacatgggttgcggtaggcgcataaaggtgcttaacttcatctgcagtggcaactgttcatcagcatgtgcatcaatactggggacatctgccaatcctctgaggcaggtccaggctcctatggagtccaatgtgctcttccagcaagctgcaacaacatccgcggaaaaagcctgtccgcacggaggtaactacagagaatgagtgcagcactgttagatgaacaaagtttagtcgagcagcgttcgagatcgccgtctctgaaactgctactggcgagcgtcacccaatatggattgacgcattcctgaacaaacacctgaggccgcaccaacgggagggaatatcttggatgtataaccaacttctcgagggtggtggctgcatactagcggacacaatgggtttagggaaaacacttcaggcgataagcctggtgtgggttgccgtttctcaacctgcaggactgcggccacttgcatccaaatgctgcgttgtctgtcccgccagcttggtcggcaattggacacatggtaagtgtgccatccgacatctcagcaataccaccacacatgcgctcgtcagaggtcaaaaagtggctaggaaacaggcttacgtttgtcgtcgcatcaggcgatggcaaaggtacgaaagcggttctgcagcaattcgcctccgtgagcatctgtaaactggtgatcgtttcatacgaccagctgaggtgagcccgaggacagacgtctcaatgtgggaccacatgtaaaaacagctttccgccaggaagctctgtgggactatcacatcttctcttgacattctcatatgcgacgagggacacagattgaagtcatccaagtctcaaacagcgctccatctgcaaaagatccgttgtaaacataggcttattctatcaggtaggaatcaccgtgtgttttggtgcctgaaatagcttaaccttataaaacagggactccactccaaaacgacatggtacggttgacccagggctgactgtctattcttgtgcatgactcattccgctcaaggatgagctgcacgcttgctgctcattcgttcgtccgagcgccatgccaaacaacaggatctttgcgaaggttttcaaagagcctattctcagagctggtctaccgtatgctaccatggcagagaaacaactgggtaaaactctctaggtttcgcacgtatagtcgtaaaccatggctcagacttcaggtgaaaaaagggctgaagaactcacgtctctaatggtgaaccagatatgctagcagatgacaaacatcatagaagtcgcacagtctcgattcatgttaaggaggaccgaagaggtcctgaaatcctttggtgagctgttctgctagggagatctcgagttattgagtgattcgcggataaaaacagtgccaccaaagaaaacagttgctatctacttgaatctctctaaccagcaaagattcgcatacgacactgtctgcaagtttactttgacacgtggtcgaaaagacagcgcgttcatcctagcagcgttgtctgctctacggtactcaaaaaattgccccgtgcttccgatcaggtcataaacgttctgtgtcacagcaaaatcgtgaactgcccgtatgcagttcattgtgacgaactgtgctcgaacgacggaaaatgccctgttgacgtagcctctctcgatgtgaaggacacaactcaactagacgccatcttgaagtctttcattcccacaccactgtaggttgatgaagtactttgtagtgaaatcatcatccgtatattctactccagagacgtacgaa

SEQ ID NO: 2775 - DNA, 1937 bp, Toxoplasma gondii
ctctgtcgcgggtgactcgactgtttttctctgtaactgcttctctccactctgaaggtcgagggctgtggaggttggcgccctcggaggacgtcttcttcctcaccgtgtcgctctttgctcagcacaatctgttgcccgcgtcctgttccaactgcacgcatctgagtggtgtcgcatttcttctcgcgagggaacagcagcggcgaggagcagctggaaggcgcgaggactcccggcgcggacgaagcagaggcgagggcaggaacggagggcaaggcgcgaagcaacgaacttccagggagaggaccggggggagaacgcgggagcgcggcatacgcagcagcacccgaggaatcggacagacagagacgcaaacgcatgcgagaggagagacaagaaagagcgcagcgagagagaggaaccagacaagaatgagagagagaagaacgcgggagagaagagagaagagacgtttcgacagagaggcgacgaagaagaccttcaggtttcttgtcgaagtgagaacgtggaggagctgaagagctccagaacatcgcaggtatcctcgccatgtcgtcaaaaaacagagaggcagaagaagaagcggcagaagaggcgcggcaagtccgcgagggagacagacgagacaccgcgggggttcgcccggtgggcgccgagaggcggagagaagaagctagcaaaggggagagagagaacagcgagaagacggcgaaacgccaatgtgcgagaacggggaaagtcaaaaagagaattccaggactctcctcggtgtcaggccggtgagtcggcctgcctcggagaggaagacagggagagcgacccgaggcggggaagcgagagattggagttctctagaaacgaatacgatcgtaataacagacgagcgaattccctcggctttcctggtttttaactaaccacgggggtagacgcggcgactggcaacctgccctcgttcgctgcctgccttgcatgtcgtgcttctcttccagctgcttcgacaccttgcgcgaattcatcccctctagaaagacatgagagtggaggagaaagaaacgaaagaagagaaagacgagaaagaagagaaagaagaagtgaaaggagaggggggaaagggaaagtaactcagtggaaggctcgctgcgcatagctgtccgaaagagaaaaagccgagggtgtgcatgctctgtggcatgaaagacacgtgaaacgaagattgcttcgcggattctctctttgtctctaaggtggcatccacgaaccgccttctgtcctgcttttcttttcccctttcgctccgcttctcttttactcagcctcccgtgcgtttggccgccggtgtagttacacccgacgtacgacgaggggctcgagactcattcctctcaagcgcgccgccgccgcctccggtctggctccgctgattctcctctgctctcttttgtcttggagagaaagggacgcgttcatcctcaaagcaaacgcaaagtgcgtttgaactctcccaagggagctgcaggcctcgagagaacagaggcggatcgccgtgtttcgtagctcgctacatcgaacgcgaatagcaggggcgcagaggggatcatctaccaaggccagagctgatatgcttgttccagagaacttccctttgtggaggcctcttcttgaggactgtacatcgcatctgtgcaggaaacatgctcttctctgcgatacgctggttagggtgacggcaagcaggggaaaggcgaacgtctaaggttcttctgctccccaaatcggaactccacgctcctcctacgccactcttcttctttcttctcttcttctgctctcccgctctagtccctgagaactggaacctttcgcgccgtctcgcagctcgcactcgccgcatctcctttcctcgacacaca

SEQ ID NO: 2776 - DNA, 2041 bp, Toxoplasma gondii
tacggatttctctttgcgatgccgatggcacacggtctccgctttcccctccccctccctccgttcctcttcttaaagagtatggccataacgcgtatggtgaacgcaatactttcagcttgaatcgaacagagttgcatgcttggagacggctgtgcagtacgtcactactgtttgtattcactgtaaagccttcatgggggagtggtgatggatcacggaggtgaccgataagaagcaaggcatgcgaatgaccagcgagcggtctgggactgtgaattgttgctcagctggaggaaaaggtgaaggcagcgaaaaagcataatcatcagatggaacagcagaagcacaagcttgaacgtgacatcggggaatacacccggcggctacggaacttacaaagtgacacgagtctgagaacgcaggcaaaaatcatgctctacgaacagaaagtcaggcaaatgctcaagtctctggaacacaagttccgtgaaagggaacagttggttgcatctttgaaactgagtcccgaagcgtcaatgcacattgtagagttgctccggcggagcttctgtgagaagaacgacgagatcgagactttgcgtgctgagcttcagagggtggcaaagagttacaatgatactgtcttagccatgcaaagcaggctgaaacaattggggatcaacagcgacgcttttgattttgaactggttcaggacacagatttcatttccaacgtccccgcgccgtatctcaccacgactgctcccgttgccagaggaaatccaactgtgaaaatatagagtcgtttcttactttctggaagcgagagcgtgtatgcacacggaaactgccgaagcgattttgatcagcacgtcgtgtggcctagtgcctttctgcgtgcgtgtacggctgcgtcgccttcgtgtggccaacaattttcccgtaagccatgcgacatgcaagctcaatgcacgaccacacatagcttggttattatttcgaaagggaaagaagagtcactgtttgagcgcgtgctcgtggtttgtttgcgcctcatctaccagctaatgacatgcatacaagtctaaagtagacagaaactagcgttttgcttctacaggtgtagcataaagtttcgcaaagatgtcctagacggtgccaatttgacttagtaattccttcattctgcttttgccatcagctacgaaagtagctcggacattcctcagcaaattcgagtatctcgaactttgaagacagttggtgtctccccccgccgttccctaaccacccttcgcgcaactgtagacgcgttaggcctcaaaaaaaggtcactctcgctatatcagagtgccacatttacgaagtggaaaaagaagcaattctgacctatctgagcgatctccgacgaggagagcaaaagcggctgcatcggtgaaaagcggtgtctcaaacgacctcccagccaccgtggcaagttgttgacccgaagaatgcgtcgattgtaacgccacatgcgtttcgccttccaaagcacactggacatctcaagttcgtcctatcgagtttctgcccttatgaattgactatatttgacacatggtaacgagaaactgccagtttgtgcaacaagctggttgcttgcctcacaaaaacgagcggcgttttcagtagagctgcatgcgaatgtctgacgtagagggtccggtttagcagtagtcacgagcacccccgcaaatgctaagcggaaccaccgtgaggcagggttctacggatttgagagctgcgacgccatttaccgagcattcattttcagtactctgaactccttttcccgtgagaaatccccttttgttggaagccaggttcttccttacccgtctgatttcgcgtcacgtcaagcgtgtctctataggaagcctcaaacatactgcatctcttgttacgtgggaagcttgcgggtgtttgcccaccacgcggaaactggagtgaatgctttccgccttgtctagctgttgttgacgggccgcgaaaatca

SEQ ID NO: 2777 - DNA, 4164 bp, Toxoplasma gondii
caacttactggtcctttgcgcgatgctacattgagactcagctatacgttaggagaggcgacctgagtactccgagcgggatggattctgtcaagcaagtaggccggcagtaaaccaggacagtaccacaagacaagcaattttgctgccgcctcgagggttgagaaaatcgttgggagtgctgctggcattgcgtaacacgacgatcgctacatcggtggttcaacattttgttatcgtgaatgactcgaatgcgtactaaaactgggaaaccgtacactgacagcgttttcagattgctagtcttcacagcttgttgaagtcacggtggtgtgtcatcacgggtacgcacaggaacgcatatactaaagggtttttgcaatagtgccttaatcgtcatgagcgtagtgaacttaagtttagatacaattgacttctcggtggttgttgcaaccacacgatatcgacccttaaaaactgttatttcaaacggtcgattcgaaacatagtcaggctaggaggatgcagtgagcgttattttcctacatggctgcatcgcacgcttcagtagatgggtggtaagatactgatggagcgccgtctctcgacaaggactgtgcagatacgcgggcataacacttgaaaatacacatgttaaatgccgagacacttccggattttttaagggaaaactacatggttgtcgtgacttgaaggttagggtggccttcttgtttagctctacagtgcaaagaacctactgtacagcagcaggtgctagagcatacacgatatcgacgcttttgggcgacactaaatgtctcagtatgggtcaacgatcttgggtaccacaaaacaatgggggaaagtaactcattggtcaggaattagttttttcctacaaaggaaaacgtgtgtcgtaggttcttctcatcgctgttacttgtgggtgcatgtcgatgatttgattagagcaggcttccgcacccagacagcggcgaatgaattttgtgtgaaggggtgttctcactccctagtacttgagtctcacacttgtcattgagtttcagggtgccgatgaagatgactcgtcaaccgagctgttaacagcggtctaatgacgcaacaagtgggtgatggtatggagcaagagctgcgtctgcgatctgttggtcaagagtatgctcagtcgcgctagaaatgcttccttgctccccagcaaacgcttgtttatctaaacctagaatttacattggtatactgtgcaacagagaaggtagcttcagttgttgtctgattggtattacatgccaaagcagagcgcgcacatcctttttgctggcgactagactggcaagcccacctgtgttgttccaaaaccggtgctgttaggcgtggtcgaatctagcaaggcagtgcccatggacaacatatctctccccgcctgtgtgagggtgtaccaatttgacacttcaccgcacggaagagatgtgctgcaaactgggttaaagccagtaaaaggtaccggcggtgagcgaaacttgacctcaggtacaagcacgtacaagaacctgccgtcaatgccgttgctgtgtctgctggctcatcgcttggtggatgtgtagtcggtgcaggtgtccagctgctctccggaacaacgccgagggcgaaaattcaaagcagctggccttgtagccgccgatgagagctaaacccttggtacggaaggaaaaggaaaggttagcctttattttaaacaaagcaagtaccgtagctgtaagtgaatgctaaattatagagtttatctcctttgacactgcataacgtatagatactatccatcttacggcctgtccggcaagatgaccgatcagttcttgagctttagtctttgaaatgaggtcagatcatgcgcgggatattcaaacaaagacgtgcataggggttcgtcttgtaaacaacgcagtgaactaaatagatacaagaaatttgacaagcgttggtatacttatataaaggacaaaacgacatcacgaatttagatcatttggtacataacattaaacctaatacgaaatggcagtaaaataggacaggttttccgtgtacgccatcaactacgtcaacaggggatgatccagtcgaagcagactgccaagatcgctttcacgttttcctaatatttttatcgcattccgtggaagtgtggcgttttcacacgacccaccggacatacctcgcgctttgccatattgggcgatcgctgccgaaacaggcgtccccggcgatacagcacgtatcgcagaaccccgatattctctaggtccccggctcagatgtgcatgcacggcattggttgaagctgccacgtattatgatttgagcacccttctgaatccaaatttcagttcggtcgtcgggtatttcgatgattctacggattatgtgcactggcatctaaatttcggcggcgcttcagcacctcgcaaaggtctggcgttgatcttttcgatcgccactaacttctatgcggttcccatttcttgtttgataaactgtgttagacatttcccacaccctgtctccattgtatacggggtgttgacggatcccgtgcaactgccacctgcagctgctagcccctgacgcagcatgttccctaaggaacgaggcaagtacacctccggaaagaaatgctgcaaccgcatgtgtttcgactgattggcactttctcatggggtcatagttagggcagcttgtcgaattggtatcccgatacacatgtcactgtcggtcgccccgcgtgttcgcgcagtccttgggaggtaggtggacacctccatgcagaaaaatgaggacttcttgtttccaatcgtgtagtgctcacataagcatcctcgaagagaactaggacgggataccttgagataccttgagtttctggccttgagacagaatgaagtatcattacatttttctcgtgagcaaccactttcgagccagtgaacaatacgaaactggagatgctggtagtaagtgttagggtttcacgaggtgatatgcattccttatcggtgttttatgggcgccataaaaagcatcaccgaatcattctgatgctccggaaaatatcgcacctagcagcaccaactgctgaggcgacgaagagcgttctcacgcataatgacaatggtacccggtggacccacaaactcaagcaccctccttatactgcttctcctttcaaaaagcatatcgctcctcaagctgcatgagtttagagtccggccttttcttgctctgtcacacctccaggtgtcttagttcagaacccgctgtattaacaccacctcgctagtgctccgcgacatacgctgcccgagagctcgagtgaatgagactatttgagacgaagacttgtattctgcgtcttgcgctagtcacacagtccgtcttctgcggaccacttcctgaatcaaaatgagatatcttcatcttacaacgtgagttgcttttttcaacattacattttcgcaagtaccaagcatccttgcggctctgacactgccgccagcaatcgatgcaccgtgccgtgacgcacaggaaacatcaggaagacgcaggacacgactgcaagaagccagaccctaatttttcctggttcttcgttgcattctgccgtttcctatgcaacgtacaatgctaccatcgtgttcttccttccactagggggaccactcggcttgtgtggtttctgttctgttttaaggcctagtcgttccatgagacgagtgtctagacgcgacaaggccgtccgaagtatgtggtgtttcttctcacggtctcgtcacaagcatcatctctttcgcgttcgtctctgaagatgcactcttggctcattgctgtgcattgtggaagatttgtttttcgttgtggctaaggaggttgtgcttgcggcgctggtgtatcgattcaacgatcgaaacaacagtgtgtggcttcccgttttgtgggcatattcagtggctctggtgatgacagaaaagaggtccgtaatctcctgtaaagttatgacgggccggattcttggatgtcgagctgtggatcttctgccttacccacacgacaacaaccccgccgacgagctgtgaaacttgcccatca

SEQ ID NO: 2778 - DNA, 2275 bp, Toxoplasma gondii
aatgtgttccgagcagataagaaccgaagcggaactccctgatacaaataatccggtcgcagaaacgactccgagggcctctcagtgcgagggccgttgcttactcgccattggatgagaagccgcagcagggagagaaagcagccgacaatgcctccacgaagtttctttcccgaagaactcaacttgtctttttcgtcgaactcaggagctttatcgccgtcggcggccagacccccatcgcgcatcagagggatggtcaccccccagagaatgcctaccgccaagagccctaaaatacgagcgcagaagggagataaagtgtgaacgtcgtttactggatcattgttgcaccggtcttctcccggccaccgtgttatacgtgcactaagtttagctcttggaggtccgctttaccggatctccaagacttggtgcgttgttcatgaccacagacactgggttctccccgtggcttgttcgaggtttcgggtgccgcgaaaactttccaaaagctctggtcttccccgtgaacgtcttgttccggtcgtcacaccagtggggaagcaggcgatccagtgctttctacgtccgggaaagcctctccgcttgcacgagagattcttcactagaatggcaacactagtagacacttcagtcatcttattgtcagtgctttcttaaattcccttgaaccctttgattagggtgtgcacagctctcgagataccagtgaaccgtgtaacctgagtaaatgctgaaccgcatcacgtaaggtccgaacgcatatgtggagcatctcctcggaaccgctcagatggataccagcaagtacaaccagaccgcattcggggttcagcaagtgttcaatgtatcgacagggtgaatccgcggtagaagttctacaaacgcgtcgccgggatccgccattccgcaaaaactacaaagtttcgcccgttttttaatccgatttacaggagctaaaacgacgtactcgagtcccgatagcgctgtgtctgtcactagtccagatgtgaactgacgattcaggttctctttctgcaagcagccaacatcagaacttgagagtctcacctagaatcatacttcctcgtgggcgcgtgttgtcttctggaaaggtcttgtccaggaggcgtgacctaataaaactcgaaggcttttcctgaaggacgcccttcttcatgtcacaccgtcgacgcagagagagtccagcgacaaaaacaccgagaaaaaaccattcacgtggctgtttgtgtcttgcaatcgtgtcagagctgttacccctaaaccgtaatatcgacatcaagtcgcaaagaggtgaaaaatcggggcaaacatcctccaccacagatcccagagttccttcagagcctatataagctgttcttcacgtgcatttttctgtctgggctgtacttaaaagcacgagcagcgagagaacccttccgtgccggcacattgagcagctgagcatttcctgacagcagccgagacggccgttttctcaaccatgtttaacggccacctttcgtgaggattcagacgcgagcgaggaaggaaagtgctgacaagtttctcgggttatttgtttcccaacgggtgagatgctcgcgaatttcccctgttgccctcttcagggcaggcgatttttgcatgcaccactctgaaaaaccaactcacaccccggtcctccttctccagtttctccgacgccagcggttccggtggaaagctcgcgcgtttttgtcgcgtgtcttcgttccacttcttcctgcttcgttgtctcccgcttcgaacattccttttcccgggacagcggaggaaagtcccgcgagttcagacgtctttgtcctgcagccacagagtcgtcgctgcccttctccgccttctcgtttgtgtaattggcagcgctcccgtggcaattggtggacttctacgcggcagttcttcgactttcttcgccacgtttcttctctctcagccaaaccgaaagaagttaccgctcctttgcccgtttctcgcgtttgaccgcgtgtgtcacgcgtccctccatgtgtgtgtagcgtcttgtgtctcttgtactccccccaacatcttaactcgtcgactggccacttgttcttttttcctcgggttcccccgttttgtttcactctttagcgtggagacgactccacgaggatacagtccctggcggaagagacatcccccgtttccaagctctcttccctcgtttccaagttcgcagacgcca

SEQ ID NO: 2779 - DNA, 1343 bp, Toxoplasma gondii
ccatatcggtgtggatgtgtttgtttcgcactgtcgatgatcggagatcgttcgcagctgtctcttcccgtctctccacatcatgcctctcgctgttctcattacatgctgaagtggcaacgcctggttctctcttcgtcattctatatctctattgctactctacctccctcttgccattgtcaactccttgttggtgtcgctctctggagaattggaatctggtcgaacaacggttcctggtgtagttaaagcgggaatgctggaatcatcagtcggtttttgactgatttcaagggtcaagactcacggatctattgagacgtttatacttaatgcaagtacacacacagttctccagtctcatcagctttcgccatgcaaacagcccgggaaaggccagccacggtcaggatcacatctaggaatatacatgtatgcagacacggtcgttgttctccactcagagaggcataacgtgtttttcggctagctatacaatggtcttacgtatttattcatttgcacataggtattaaagcttcgtcctttcagttgatgcacatgtccttgattctctccagatgcttttccgcgtatttctgccactttgctcctctttcgtcgattcacgcaacggccttcacgacgtttggaagaaaaccttcttaggacgcacgccgtgcctttttgaagtgatgactctggccctctcctttttcccctcccagtatactcacaacgtcttctcccctgaccatcgaacggtgacacacgcgaagcgggagatgctggctttttttctgccttttcagaagaaggctgtctgcatcccggcaagggtgtgtacacgtctggtacgcgcccatcccttttctttgattttcacactgagtttcttgatgttgtagacggaatagaagcggctgttgaagcagctgtaacataataggaagcagcacccgtactggggagaaactgggcgccgccagtaccgtagtagaagttctgcattacgccggcggctgacgggtcccagtaagaatatgcctcatacccgttctgaggcggttgttgaagactcatttgctgatacgcagaggcctacacggaaccgacagagagcagagaacagaaaaaagcaagagacaaagacagggaacttttgcttgaaaatggcaaagaacacacacacacacacacacacgcattggtgtgcgcatgcacatatttgtgacgaagaactggcaatcggaatggaaatcagatacaacaggaaagagctgcgtgactgaagaggcttctctcttcatggcatcccaacagtgaagaaagaagggaca

SEQ ID NO: 2780 - DNA, 3686 bp, Toxoplasma gondii
aacgaaactaaacacgtcaataggtttcttggctgacgaaaggcgtatcaacgtcgccttaacaaggggacggacaaatctatggtaagggggcgcgggaggccactgctgccagcagctaaaaacgtgcatggtttaacgctaaacctgcattgggttcgacccgttcgaactgcgttgaactcactgatcctttcaatatcagaaacaatttcgcttgtggtgtgctaaagggtagttcagccgtcgttcatccataccccagtctgatagcaacaggcatcaaacaatcggcacggcggcagtggggatttctggagatggtcatgcaaggattcaacagtgatactaacgccagggcacacggagagtgtcggcttatcaaagtagcaaactgtgtcgagtgaaacttgttcttacaggatcgtaggcaacgggcgctttttgatgagcaaccaccattggcggtgcctgtggaagtacacgaaggagctgggcaccttgatttccattgaagaaaaattcatgaagacagagcttctgcttgccaagtggctactaaagttcaccaataagcacccggtgaggatttctgcaccactggaaagatatttccggggggctagtgcctgacactgactggtgtagtcccgcgtttgtgccaagggtacaaaccgctcgtggcaggccagatgtgattggctatcccccgtctcatctgaatgtgccggttgaaaacgctacttttgtgttgcagccggagaaaagcatgctggacgaacaggtgccgtctttcttaccggctctggagaaggacgtcaaggagtgcgcggcagccagaaaggcaagaaaagtttccaccgaggatgtggctatagtctctccagggaaagagtgaccaacttcgcttcaaagctctctaaaagcagttttagtttttattgcgtgtggcgaacaatccaacgtaaaaggcttgtcgaagcgttgcaagttcgtggtgttgtgtctcttccctctccacgcttgccattcaccgtttaccgatcggaaagagcaaaggaccatgaagtgacagtcctccgagcaatcttacctgttgaaagaggggagaaatccgagatcgggccttgttatgggcacattacaattggcggttccattctgacatccgactactcatcatgagctgtctggtagcagaaacactttttgtgggcaggcacgtaactgaaagcgttaactgcttgtgaaagtctttgttgcgctgatactgtcagaaatccaccttgagtaaccttgaggaaatatagccctgtatcatatcgtttcctgccccgctcaaagcctttcactgtgcaaggaacactactacctgcttgcaataaaatggtaggtaaccgcagtgccttccgtatactgacgtcccaacagttgtagtgtccaaatattaagcattttttaccgttccgccgaccctgccaagggacttccgacgtgctgcattcccgtaaacgcgcctcacacgggctcggtaacatggctggcaaaacgcggaatccgactggacagtttggggctaacatcattgcgcaacgctttagcagagaatcgtattcagctgccgcatgtgcgtcaagaaccaggttactcagtaccatcaaaatgcaaacatgctccacctgtgcaactagaacaatcaaaccgaagtcactggtgggaatcggctctccccgttgtacgcacttgattaacacattcagtcggtacgcatgaaaatggggtagcatggagagggatgggcgtgagaagcacttgtctgccataacagtggaacgacttgttcactttagaggattcaacatagataaaggcggcctctaatggaacgcactaatacccagcgagtgactcagcagactatcgtattaccgggatgctgagggacacttcgacgtggtgataaccgatttctccgtttcgaaaatatgctgacaaaccttgtgatgatcgaaacacgagtttgctgctttggcacgaaaaaacgttgattcgtcacagcactgctgtgtgcatccccccccgtttctgtcaacaaaatgttactgcaaaactggttagatatctcaaaaccagtcttcttgcggaacagttgccctcagtcgatggcagataaacctctgacggattctggattcagctacgagaaaatcaagaaagtgtggcacccgtttttgaatttcttccgttcgtctgcgagactcggagagacacagatctgtgcagaccgtgtccgcatgggctcggattaagaagttgcgcggacccctaagggggagttggttgtgctcatgatgttttttctcttctcttttacatggaatacttggcttctttgcaaaagactgacctcctctgcagtcacagagaggttcagaggccggtgcggcctctactgtgctagacttctgggaatccgttggggtcgaccagaagcacaactaaccaagtaagcgagggccatgtttagtcgcatgcagaaggttagccgttccgcagtcaaacggcggtccagccgctccgtgagatacatcctgcacacactcccacaaggttgtgaggagcgcgagcggccctctttcacccggaacacatttaccctgtttacttggctgtttggcaaaacacaggaattcacggatatctttaacaaatcggagttttcgttctgacaaacccgtctgtggggtccgtgctcgagacgtgtcagagaggtcgcgtgtcgccgcgcgcgttgtctattggtcgatgcgggaaggggggctcgtgtgattccccccgaaaacggcgaagatatcagtcgatgcgttcttcccaaacggaaatatctgtttccagcccgtttgaaaaaaaatgctgtcgcaagcctgtctgcgttgagggtcgagtcggcactccccttccatctgacgtatatttcgcctggagcaaccaagttcggggcctcgttgcgctttccaacgttgcgcaaacgcatcgggcacccggaccgcctcccttcccctcccaaagcggattcaccgcgctaaacaagcagaggaccctggcgatgcggagacacgttgcgcggggcgtccgcaacgctgctgttctgaggttcccgttacggaggaatccggagctctgcttcaactgtttttccatgaaattctcgtcacacctttttgctccctccgagtgaacgtgcagcctgaacacgctgtgtttgacgtctcaacttcgaagttgccacgacttcgtcgccaccgtccgaggcgtggcaaatctgctcaacgtgggccggaaccctgtaggcgtttgcccgtgcacgtcgcaggaagccgagagtgtgacaagtttttcagcttcgtcggctgatttgtttgcgtctgctaagccggaacggtaaatgagttagtccccttacaagaaagtgaatgcccaactttcgccgtctgctactgtcccgggggtctccgtgcgtctcccgtcttcagatgaaccagagagcccatacgtcgagtgctgcgccacactcgtgcgttggcgccggtgcacgcgctctacctgtctaaccatccgtgtatattggttgcagcaggcaagcacttgacagggaaaaaagaaacgtatatccttcggaaacccca

SEQ ID NO: 2781 - DNA, 3896 bp, Toxoplasma gondii
cagtttacagaacagagttacgcttagctttcaagcagatcagaaatcgtctcaaaacagtttctggctacgaaattgcaccgcaacgacacacaaggtggaagcgaggtgtcggtgccacttgtcgatccctatacaattcctgtcgacacaattttgaggtccggatgatgcctctgccgaacttcacagaaggaaccagccgagctgcctcacctgcgctgtacgcacaccctgctccgcagacgaagaagaagaggcgaggccgacggcgaaagagagcgaggcgccaagggagcagcaggcgcccgcgcggcatgagcgccatgtggacgcgtgttaaaggacattagagccgcgcacccatggatccagattagagaaacacacagaaaaaacgcgtgagtcggcaaagaggccctgtgaagtgcggagatgggaaaagagctctcaagaaggctgctgtctgccactgcagccgcacacgaagacggcgggtttggagctacggatgaaagacagagaaacgcgcaagttcacgttcgcgtaacggaacaggagaagcgaaacgcggattgctgtcctatgggctacgcatttgtggaccacacgaggacggcggagatgacacagtcttcatgggagtcttcgacgaggaatggcaactctagtcaccaagcttcagcttgtcgggatgctcacaacgggataggtggcaggaaaagttcggaccgcttcgtgtggaaacaccgtgggcaggtcccgaagtggcacatccatcggagcacatcaaacacgagaggtaagcagacgttcaatatgacaacggtttcaggctgcacgaaacttggagtctggaaatgaactgaagaacactctgtctttcaatgcacagcgcaacaaaaaaagctgacggtgtggacggaggcttttgagtttcgaaaagcgttgggagcgcagggggctccgcctgtacactggagtcgatcttctgaacgggagtttgacctggggaagaatcggaaattgaaaagacgacctctcgaaaaagctgtccatgcagtacgaacagcaaccaggaaggtgaaagaacaattcatgggttgatttttgtgacctgcacaagactcggggaagtgtcgcgttgcgtatagtggtcagctcgatttttaaagcaaggaggcagaaacactgacacaggaaagcaagaacagccggaagttccaccgtacgaatgtcgccatgacagtgaagcatcaagcaaaaaagggaaaaaaccgactcgaaagtcgagcgatcgcaagcgttgaaatttgaccgggtttcccccgggtgcgcgagagaaacatcgcgaacagggcggtatgccgcgatccttcttcccatgcgaatagcggtactgaggcgggggaaacagctggcaagaagggaaatccagcgcacagaagaaaccaaacgaccaaaaacaaaaggtaacctcggaacatgttcctcgacgagataggcagcgggaaggaatccagtatctcgctcaggtcaccctccggttgctcccgctgacataaaagacacctaggcagacttttacacgcctcagtctcacgaagaggatatgaggcgtcagaggagtgaaacgaaactagcggactctcccctcccctggaggtggcaacataaatgagttcggggagcagcagcacatgtttgaaagaagagtgagcattaatctttttccgtgacgacattttttccaagagagccagctgcaagcacaacacgaatttcaggtcgattcagctgtggtggcgcgctctaatgatgcagaagaatacgcggtagttttatttaaaaaaagataagcggttgcaaatgttaagaagcctttagtatcgaaacaaactgaaccagcaaagccagtgggttggcgaagtgattacgtcacagactgcagtcagtcgcgtggtggtggcctgtacacgtttgtcaattcttctttctttgacttttccaagtatgcttttctcgctgcagagcaaatacaattattccagccgcccgtccgtcgcttctctagtgccgagccgctgccttccacgcacacgtactaccacgggtacaaccatttttctaaggagctcatttcataaatacagtcagtggatgatttaccaattttcacggggacgcatacgggagtaccttcgctccccatggtctgttgccagttgacatggcaatgtatccattgtaaagcgtaaacatattgcactttattcttttatgttttcatactcatcaaataggtttaatatgctaaacgtttttgagaagtatgtttcatgatcgcacttcctcaccccatctgatattgcgcgtgacggctgtcctgtaacagcgtcgtaagcgcagttggtatcggtcctttggtggtacctaaatcttccccgtgaatcaccatgtttcactggccccttagcagggtgtcaaaaagtagaatttggatttgatattgacgtgcacatcttagaactggatatgcacaaccacgaacatttgcgtctgtcacgtaaaaataacactggacctttgagaagacgacgacgcaacttcgccagcaacaaagacgatggaggtttgcttcgcagtgctcaagagtagaagaggcgcacttgtgaagggatgaacctgagtgtgtctctgctccatacgcgatgtatcccgttaacgaaggttaactcttggaaggctccgaagtgagtacggcttttatttgtctactgaacgctggagaaccggcgatacgagcaagtcaggtgatgtgtgcattttatgtcgacggcttgaagaagttgtcctttatctaccgcaggcgcgagccttgcgctcgccgttaaggttgcgtagaagttgttactgtacacttcatgacgacgcagccgagactatagtgatgtaatgcatactgcagcagtgcgaaagacttcataaaccacactttatcaaaacgcgaatactcctttcaaacacaggaacatcgacaagacaatgaaagcgtatgatcagtcaaagaaaggagtatcttgtgtcatccctcaatgcaggggctaagggaagaatgaagaaaggagagattcccatacgcagtgccttcggcagtagcaaaagcacagacaatgagtgtggttgctaaagacagacgcggtgctgccagtagggacgtcgtgggtgacccggcagctctgcgctgctgtacagctgcattcgtctctgcacatcacgagaagtacgttgaatccgcacatacactcaagaggcccaagataacccaccaagttgaccactcgccggagtagtgtcatacacggtcagccctgtcaccagaatgttcaaaatactagttcgcgatgcgaatgaaatttgaatggtgtcaatatggattttttccattcatcagaggccacattcaccagtataaattatacgtagcttctcgagcgttgcttaagtcgacgtcgttccgagatttgctgtaaaagcctatgttgtcccttcgagcgttgttataaaggcccgtgtcctcacttcaagtgtcgctgtaaaaccggatatcttcccacgattttcactgagtaacgaaagactgcatcgaagttgttcggtcagttgcacaaagtgtatttacaataactgtcgtttccaatccgcactgtgaatgcactcgagcggtctaagtggctggcaagaacagcgtccaacagtatgttgaaagaggggagcttcgatagatcgtaacataattttctcgtgcacgaggtgtattagtgtattaaccctgtcaatcaaacaagttggttggtgtcagcgtgcaaatgcgtgtggtggccagaccgacggaa

SEQ ID NO: 2782 - DNA, 2013 bp, Toxoplasma gondii
ctctgaatccactcaggaaaagtagtccagagggctcatttgcggtgccggatccccgcgtcttttgtagagtcagctgctagccacattgccgccccccaggcttcccttccagcaccggcagactcactttcgtgagtcgaacaatgtgtcgcgctaccgttttccacatgatatccgcgccgttcaaattcaactctcggcatgagacagcaagggcctggagctgagcaggagacaggtctttggcatttgcgtggatgtcgcgcaggagacggaggaatctctcatccaggctcagttggctgaacgtcatgctggtttgagcgagctcttggaggtgaaacaccttgagtgacagcttcgtgtcgtcgtcgtattgttggacagcatgcaaagtcatcagcaccttcttctcctcttcgcgagacgcaaagggtactgtgaatggcggacagattcgcgcgtacgctccgggggtggacgccgacgctggcgaaaacagtggcgttcgcagctgcgaataggaccgcgtcctcacagcagcgtagcgcgagggaaggcaggctgaggagtcagtacactccggcgtcaacgactggccggcaccgccagccacacacgatggtctactctctaaatggcttttccatctttcgagtctgtgtgcgggtcctgttgtctgagctgacgaagaacacggccgtgggggcagatgtggagatgcgctgcaaccaagtctacgagttcgagagacgacgagggaatcccgacgactcacaatcgcggtcggctgctgctcaccactctctgcagctcttgcagcttcggactgcgttcgaagaaactggactcggcggcgcatcagcgtttcccgcatcgagagagcgtcgcgagtcagctcaggcgaaagaggccctcgaccccgacagcccgagaggaagcattccttcgagcaccctttcaagttcaccattctggaagagaaggaaaacaaaggggacgcgcttcccccgaagcctacacaggcaacgaccatccacaataaagtcggacgaccagaaccaaaggaggaagtcggggaaagcacctgtcagaacagggaagggactgtacggagcatttttcaaaagaaaagaaggcgtttttcgtcgtgttgcgtcgaaaggaacggctagttctcttgcgtgccacaaacgcaagagatgctcgccactgtcgctgcgattcgattactttgcattgtttttcggcagcacaaggaatggcgcggcggcagctgctcgaaagatatttcctgagaactaagcggagtttgaatctctaggaaatcaacggtatgcgtccatcgtggagagtttcactggctgcgatggggctgtcgattcaaagcgcatgcacaaaaaagttgagaaactcactccgcttggccgccacgcctgtcgagtggcaacgacgtcgattcatccgactttttgcctcgcaatcgtgcagctaggcttccgcgttcccaattttttctcactctacaacgacataatccatgtggctcgggctgaaggaaacggaggtttccagggaacgcagccaacagttaaagcagcggtatagcgatcagcgaagggctcccgcctcgcctttgtgtgtcttgtaacccagacacgacatgcgattttcggtaaatgccgcctagttgtgagcgacctttgcggttatagatcacccctgggttgaaacactctttgttgtctatcctgttgtccacacgaacgaaactggccagttagaaacaatcgactgattccgagttcggtgttctccccttacgctgcccttctcagagagttgccgctcaccttgaaaggcgcattcgagatttctgcggagagtcacatgtcacgtgtggacagtgtcgcttctttttggaaaatggaagcttcgtgcgattcttggtggagacgtggtatgcatcaaagaaggcgaaggacggcgtgcgagagggttacttgttga

SEQ ID NO: 2783 - DNA, 1294 bp, Toxoplasma gondii
agactccgcggtgccttgtaggttggatgcgtgcagatgacatctggggtcggtgtggtcgtaccgatggcaccacacgcctgtggtgatctacccaggctttcagcaaaagattcgcgtagcttttcggatgctgttcctttgggtttttgtgactcttgtgtagggacgacgccgaccacaattcggcgatcaaacggaacttcgccaccatgctacaagtctgtatcgccatttacacacacaggctgaaataaatcaaagccgaatcaacaacctacagtcaaaaatgaagatcttgtacatgcagacaaagtcggagatgatgaaacaccaacaggacccaagagtgggtttgtgaattcacaaaccaaaaccgtaatagattgtttttaacaggcctcacgctacccttctgcagagggagcgagggagctccagtgggttgcatcagtcactttttgtagtagtagagagtttttacaagccaacatcgaacattcagtcctccttcccccccaactgttgttccaaggagcaacgttgagtgggagcagcgttgagtgggagcaccgtttattgtgtgcaccgctccgaacatcggtgacgcgtgcggcaaaggtgtggaacgaaaagcggtcacaaacagatacagtcgggcaggtcaacccacgagatttggcagtaaactgtttgggagtgttggtttggaaatacgggcagtccctttattttgcgtgtgcagagctggactgctggttttgtatttcacttgttcgccctaagcccattacttttctgtacaggagaattactggtggaacccgcaaatatattttgggctggtgaaagcgtcgagtgcgaacagccaaacataaaagatacaatgcacactatcgcttctctgttgcacagatcatggcggtgtggggcgccggaaatgagacacgaaacagcggctccattctctgttcgacacaactcaaaggctctcgtatgatgtagattaatagtgctgcagacactacgagcaatgctaacccgtttccatcggggtatctgtgacaacagttatgtgtatactacgcctagaaagcaacccatgtggagcaaccgtagtgctgtaggatgctgaaatccgacacttttaggacctaccggtacgcctccgcgcacgttccctccccccaaatggtagaaattaacttcctgtcggaaataccgtcagctgtgggtctgcatacactacaaaccaggacatcttcaggaacggacgataactgcaacacttgta

SEQ ID NO: 2784 - DNA, 3193 bp, Toxoplasma gondii
gtgaggatccacgtactgtagcagaataacattagcatcgccgatgctggaggaaaatacctcttgaccagcgctataactcaagagctgattaagaaatttatgccttccatcttttccatatatatatctatctacatcaatacgaattccaaatatatctatacacatacacatacatacacttaccccccatgcaaatatgcacgcgtacacaaatacggatttcccaacaggcacataaatttacatgaatacgcagctctaatgtctacaaaaatgccgaatttcgtatctattggtcagtacacgcatgtgtgtacatctgaacaatctgcaggaatgggaagccatttgcgcgtttgaagatttctctggcagaaagcccagactctttcacgtactttggagagggctggacgttcgtagggcagcacaccctcggcagagaccatgaggaagcggatttttctgccttgttcttgctgcgtcaatttcggcagactcctagcgcgtgagctcagcgtcctgtgagatgccggagggtagggtgcgacccgtacagcggtttccttgtgtgcacctggcatattcgtaccgcctttcttcgtttttctcccaggtcctgtgggctctgttggcggcctctcagctccccatgtgtgtgactttgcctctgattccccgacttccattttagctcgatcacaagtgccttctgtggttttgtcaagggacagggagcctatgttctgggattctggatccccgggagcccccatagagcaactggcctcgggagacacgttaccaagggcatttttataaaagccaccggccatgtcctctccagagatcgtcgttccgcttttttcacctgattgtagcgggagaggctcagcaaaataatggaaaaagtaccctgcagcgacacccccgccaacgaccaggtactggacttggaccgagtctccttcggggggaagcaactgccgctctagagcctcttccccgttcaaagttccagaaagagagaccattttggcgggcgagacgctcatccagagaaaaagaaggaaaatggggacgcgttgacagagcgggacagaaaaagccgcttgtgcacgacggcagcgaggcacaggtgaacgggttcgttgatgaaccccgacagaatccagcgcggaaaaaggggaaacccagggtggaaactcagaagcagtcgtggaagagaaaattcggtctatcattccaaaaagaggggagaaaaaagggtcgttttctgtcaaacaagtcggggggttcgactcgctgtcgtgccactggtagtgtccggatagagtgagttgcgagttgcggaagcagggaaacgcgaaacaagtgaccacgcagacacatgtaagttggaaagttagaaaaatcgggctttgtagagaaaagtaaagagcgtttcgtcaccggacaaaggaatgagaccgtaacaatgggtcggatatatcggcagcggttggcaggcttgaacccggtagcacggagtacccggacttgagtcggaacgttcacgagtgtcgaaggagtgttgtgtacatgttggaaagtcccttcagacccggaaaatagaagtccttcgcacactataaacacgataagctttttatagatcttgaaagtgccaatggcgtttatcgatgccagtcaagtttccgcgtggcactcaagacaagcggactcagcatatccgagttcataggccgcgtaaaacgcacccctgttctccgagaaacatgcaatttttagaagtgagaaaacgttttccgtgaaccacgcaagagaaagcaacacctttagatcttcccatgcttttccggtcgcttcccgcctcgcgagtggcaacaaaggcgttgtgtgtgtgtgtgtctcgaagagtgttttcggtcccttgcacgaatataagccgacgtgacctagcagcaagccaaccgagaatgtgagttcttctgtcctggaaagcgtggcaggcgtgtagaaaaagtggatctggagtctgtacagagtctgcatcgcggatttgctgataggttctttgttggctcatcgttgtctcgcacaccgaaaggcataattgcctctctccaaggggaacatcatgcccctttgcggagaaaagaggtgtcggctgttttcgcctttctcctgcatgtctctcgacagtaagacaacactcgaggagacctgcaaagaaggccttttccttgaagcacagagaatccttgttgagtgcgttcattaaaagaaatttcggcttcgatcgtggtaccgcaaaccctctctccagcacgaaggctacgacctctcgtcacctctcagaatcgagagtgtatagacatcttcgacactaccggaagtccgaccaacttttccctttcactattgtctccggtgcttcttcctggtcctcattcggtttctcgtgttcctgtgtcagactcgtcgttgacgaccgtcttaatccagtttcttgtgcaggcggccaggtcacttctgcctgtttttccgactacttctttccacgacccttttagactttgagtctacttttcactctacatatgaggattttatcgcaccgaaacacacaaccttcgtgctccaatttcgcctcttccgtggcgcctctgctgaagccatcgatcgggctgccaaccttccgtattgtcttctttccacgttttcgctttgacgacacagaacaaattctcccacgcaaggaattttgtttcccttcgtcctttttcttctagagaaacagtgctctctgctcgccaaggtggtgtgctttttcccctacttatcagcgaagcctgtcccgaactcgagccgcgttctgacacgacctgacctcaaacggcgttttctagagtagaattttggtattttctgcgtttttcgcccctaactttcgaggctgaatccacaacctgcgacgttcttcctccccacatcgagagaacagcttctggtacgcgaagaaaaaccgagaactccgagaaagtcccgagacgcttcgaatcgcctggtcgcgtggatgaggtgtacttacagctcgggacactgaagaggatgaagcgaaggaggcggcggaaggggaaaacattgtgaggttgctttttcccctccttaccccgcttcaaga

SEQ ID NO: 2785 - DNA, 2346 bp, Toxoplasma gondii
tccacatgtttagagtttgtcagcagaagctgggttccaactttaacgcttcgttttcctatggcgcgacggtaaacaagacctacgctgccaccggaggcgccactgtgccttcaacttaccatatgcgattgacagaaggtaggtgaaaaagacaagagaggacttgatgagagtaagcgtgctgatgggaatcaaatgatacgagaagttagttagcgcaacgtcggctgccgctagaatggccatcggtgcgaccacagaaaggagcgccgacagaggtaaagaaggcatgggtggaagaagactaggaaaggcgcaaaagcagaggcgcagaatgagcgaggtgaacgagaagtgaaggaaggtgacggataaaggaagcggcatctgcagagtatcgaacatgaatttatttgccgccgtgaggatcaggctggaagtataccacacgcaaacggtaaaactgatgcataccatatgcatgcaagatactctgtctatggcacgacttccccccgttttggtaacatttcgtgccgtggctcgccctcggctatcttccactccgctcaattcaaggacaggcagtcgatgagcaattcgggcggccgatagcgggaggaaggttcggtgacctcgagagcctttaaggagtcccattttgccagacaggactgtctaccaacgtttctcctgagtttacacgatcacatgtcatgctgaaagtccgatcctaactgtaaaaagagtatgatcttgcggacctgagaactgcgcttccccctaacgggcaaaacgtgtcaggctcaggtttccgcgtagagaggaaactatgcgtttggcctgccatttctccatccggatccggcaggccgcaacatacacgggcgaatatgctacagcctttttcattcccagcctagacagggagccggccgtagcaaacgcgtcgacctatcgcagggtcactcgtcgaatccgaaagcgtaatagcgcttgaagatgaaagcagcgaacacgaaaaacctcatgtaattggaactgtacaaaacacggttgtatctgtagtaagacagagagccgatgtcgacgtccagctttgcagttcgctggctcggcacaaaggaaggcctggagcagctcataccaaaagcagaagagcagtgcgcacagaattgcgaacacgcgcagttgcaagactgattgtcacgcggccgatacacaggaaaatgatattggatatttccgaagagacgcactacgcactgatttcattcagcttatccttttacctaatggctacgctgcttgcctggccacatcgttggatgacatgaagtggctccgcgcatgcgaccttccccgtcagcttacaccagcgtgccggaacggcccgtcaatttcgctttttcatggaatgagaatacccatcatagaatattgttcttttcgaatgccgcacagtgcgcgggctaatcagtcattcaaagtggttgcgtggtcgtgttctaccttgcatgcctatccgtgattgtctgcggtagcgagaaattcagttttggtgtgcctgttgcaaacgcgtgcagtagtggcgggaatctcgaaccacagtctcgacaaggctatttcttgttaatgggttagaagtgtatttagtccctgactggttttcctgacgttgtaaagcttcaaaaatctgtctttgtgctttagattgtgtccgatggaccgttctagtgcgacacctcaggcgcttgtgcgcatgtaacaggcgatctcggcaattccggccaccgtttcacgtttctgaattatctgcttctctgcttcttctttcgtgcatgcctttcaaaggaaccccctaaatgaagtgccacggagggcgtacgcttcggtatgagctaggacgtcgtgtggccacagtaccttaaccaaatttcctgtgttctcatggagctttttcctgtctgtgcttgattttttatcgcacttcaacagagtgccggtgtctccttctcttcactacattcgcctctgagtccagcaacaagaactgccttacggcgttcgacaccgccgctgtggcactgcttcctcttcatgacgccgactgtaatgtgaggctgatgccagccacctgaacatttctcttttctggctacgttctagcgtggtgactgaaagcaatttacacgtctcctcgtacagcgtgcgcccccattgcaagtgggcatccatagcacgactccgccgccggtggtccgaaagagcccgacattcaaacagcagtcttcagttcaggagccggcgcggtccgcacatgaaagccggcagcttctgcta

SEQ ID NO: 2786 - DNA, 3923 bp, Toxoplasma gondii
tttccttttgagcctcttctccgctcttccaaactgcgagcaacaggctgcgaggaacgctggggaagcgcgctgtcttgctcagtggagtcctcatccctgttctccccccttcgctctctctcgttctcccccttcgtctctctctcgttctccgttcccctggtctgcgatgtcacagaggctgcgagaggcgtatgcttggaagaaggctttacatcgggatctgagtctccagaaaagagcgaagccacagtagactccgcgaaaccttggaattctgctccttcgctcaggtgtagctccagcgcgatgtcttgagagctttggagagacaggaaggcttcgagtgtcacacacggattctcgactgttccttcctccacttcgcttccctccacgttttccacctggtccgccccgcgtctctcagacgcttgtttttcatgttttggcgacttcgcccacctggcgtctcctcctgcttctccctgtctctccggacggagcgcgagccaagtgacaggcacatcgtctggcagcaggtagcagccgttctgcgcgctggggaacgggcgcccggttcgggtgtatatacaccgcgcgcggaggagtgcaatgtactcgcgggaagcctcgccgaggctgctgcaggcctgctcgctcggcagactctgcagaaggttgatttccttcaacaccgccgcccagcaactcttgagcgcgccgcttctgctcccgcccaatatctcctctgcatctttccagagagcctcgaactctgcgcggcccttcgcagcagccgccggtggaagaacgggagcggctgcgagaggcgcagcaaaagacggaggagcagagccttgagccgaaggcgagaaagcagagaaagacgacgaaacacggaaggaagacgaaggagaggaggaagcggcggaagaggcgaaaggagagccagagatggccgaaaaggaagcgtcggaaatcgtgcgcttcagagatggagaagaagggaaggaagcggcgagagcaagcaagggcgcgcagaccaagagggagagacaggcgcgacgacagaggcaaggccggaggattggagaagaccgggaaagcgcaggtcgtgtcagaggagaaggcgaggtccccaggaatagcagatgtgacagcagtggaaagagagtgagagagaaagcgagacgagaacgagaagctgccattctcgcagagagcgtggcacatcgttacttcgaggggaaagtcgaagacgtttttcctttaaaccagaaagctgcgtgcttttcatgttgtccagtaatcttacatgaagtgtatgcatgtgccgtggatacgaatcggtgtctgatttcctctgttgtgtgtcagtgtcggtctctgccttcctccatctaagagaggacactgcggcctcacgtctggtacggctgtcacgacatctcccggctatccttcgctctgacttccttcccgtccattttcgtctttcgcgaatgcgctgctttccagcgtccggttccccgaccttctttttccctcttttcctggccccctgtctctttccattcattacacacagtgagaagagtcgcgggttgtgttctgagcgttgcagtgcggtgagcatgcgcgcgagctagagaaaattcagagactctcgagcggcaggcgaggccttctgctgtcgagccaccgcagtgcagagaggcgaggaagggcgccggcctcgaacggaggatgcaacaacttgtttgcggcagtccccgttgggtggaaggtcgtttttccaggaagcaacgcgtccgcctgtttgccccagggccagtagtgaactccggtggtgtggtcctaagtgcggagcgaacgagaaagctacaaggaactttgacaagcaggacgagatttatgtaaacgacagagaggacgaagagaatgtgacagacacgcaggaagagagtctagcggagcttaacaactagcgggaagagcaagagcgggcaggggaaaacgcagaaaccaggggcatctccagactctccgggagccccaagggaagcggaaactcgagacctgtctgcaagagagcgagaaaaaatttataagatatagaaccttggaagcgagaacaacggggtagggacaggagacacgtggtgcttgttcgtcggtcagagaaagaatgacttgcaaagagggaagcgaagggtctgcgaaaaaaagaagcggcacggacttttgactttcaccctgacactgcgagaatccgcaagttctgattttcctttgttctttctccaacagactaccaaaagtgtttctccgttcgcgcagaaaagcctggagacaaacttggaaacaggaaacaatttccagctttcttccttgtcacttgctgtctcaacttacgccctcctgcattccgaccaccacgactctccccgcgggcagagaggcgccgcatgaaaaaaaccatttcttctgcgagaggaagaaggctttcaccgcagagagtcacgaagacacttgtggacatctaaagcctatctttgcgctgtttcgaggtgaatctgtttgagtgtggcagtacaaacgttttaacttgacgctgctctcactcgtgtgtctgtgcacacctagacaagatgcttcttccgcgaacacgaggatgggtgtcgggaaatagttgattcaattctcataagccacaccgtgtatgcagcgcaaacgcgtttccgtctactactgggacgtctgtaacaaagggctctctcttcagattaaccggcaacacaccttgaccgagcttcagcactgccgctggatcgtgtcgcctcgcgcaggcggtccttcctttggtcacttgcgaaggagggcaaagccgcgtcaggaactttttctcgaattagcatccaacagacgtttttctcttttctctttgcgtgaatgcttggttccacaatacacaccagagcgactagaaacgcgacgaaaacgcgtcgccggaaacggcgagacaagcgaacgccgcgtcgagtggaccggggccgtgcctgcaatcctgaaatccgctgttctcggggagctgcacgcgggaaagaattttctcgcttcaccagttgagagagattcccacttgcttcacaaatgccgggaaagaagtgaaaaatccaccgtggagacggagtgagtcggcccgtgtgtgcctgtggctcacactggggcgggtgtgcggaggggaagtgtgtgaacccacgcggcgtgcaaatacacacttgagaaatcgagcgtgtcggcgactccggagcttcctcaaaaccggagggaagacactgaaaagggggtccccttcttcgctttttcggtgatttccttcttccttctgtcttctttcgctggcgttcctcgaaagttttgagggagctccgcgtccgtttcgccgcacacccagccacctgtgctgcgctcttctcttcggccgtgctgtcgcgaggtctcgaggagaccttgccgggtgtacatacaccgcagaaacgcaccgaaaagctcgcaaacgggaacgtgtgtgactttcgagagaagtgacgaaagaactttcgttttttcgagagttccacatcctctttttctccagcggtttctccaccgtcgtgtctttgggatctccccgacactcagcgtccactgtttcgtcgtttcacgtgcgttttgcttgctccggcctcccgtctcctccctttgtcactcagcctctctagccttcttccgcttctcaactccctccactctgtccacgctcgttctcctcccgatttgccgcctttgtattcttccccttcgctcctgtttgctcaatcgttctcgcctctcttccagccttttgctgctgcgtccctggttcgtcggcgcca

SEQ ID NO: 2787 - DNA, 1174 bp, Toxoplasma gondii
tgctgcgcgtctactgttttgtttcatgtatttaagaccgtgttcatccaggtgctgccaattggaagatttaacattttttgccgtggttcgtttgagagtcttcaggtggcacgatattccgtgggtggagctctcgaggcacgagaaacttccgtatctgacaccgaatttgtttagtttctggtggattggctttttggggtggggaactccggtcgcgttcaccgggatttcatgcagtggaaactgaatcagcagcggttgggctcatctttgaacttgcgcgagttgtgtaacgttcgaataccgaagaaacctccgtgcgtactgatgatcttcggagagcctgataactgtcttgggccaacagcactgtactgttacgtattctgagtctcatgtcaaggacttccctggttttgaagacttgtgctaaaattttctttcttccccagacgtaacggcacgcacgtcttcttctcggcccgctgtgctggtagccactatgagagtcgcctcaactgtcattaagacgttcatctcataaactcttgtcccgaaggatcgaatatcgctccatagcgcatactctaggccacctcagggaagcacagtagcaatgacgaaaatgaacggatttcaagtccctcaccgcacaatagtccataaattcgagctgtacgtactgccggaatatggtgagccacaaggtagtcaattcattgctgagtttttggctgtggcaacactagggggtcacatgtccagacatctttggcctaatggtgttgcaataaggaaggcagtggtatggattcattccaggagaacagttggaccagaaatcggtttttttcgctcagcagacttctatttggtgcttgagttaacgatgcaactccgcgttgcaggcgcagcctgttttctaggtattgcgctttctgctcagatgtctgcaagcgcaaacgttggaggttccacgatttacgaggaacgacaatttgacgcacgacccgtcttctactatggatatataaataatgaccactacgagcattttctgcccgggctccgcggatcgaaaaatcggcttgttagtctcacgcactacctcacgaggtgacacccctttgcaaatatgcgtttctagggcaacaatatcgtgctggaa

SEQ ID NO: 2788 - DNA, 2488 bp, Toxoplasma gondii
aatttgtctcgtacgatgctgcttcgttaaattaccagacgggcgtaagcaacgtcatcagttggcgtgccttgtctcttgcaaagaatcatgcgcttcaacggtgtatcggtgattctgctgagggtcatgccgtcttcccgcgtcgaatgctgggattatctgtttttgtggttggattgtcctctctttttgtatggccatagcgcagtgctgctggactcaccctgaacgtttccagtggtggtacttgctttctgtgtgccaagttactttgccataggttcttgaccatttgctattgtgtattatgaaggttaaactgagttgtacttctgcggtatgaatttctgctgacaagcgacttgctcattgttgtcctccaaccacagactcaccactcgagcacgcaggcaaacgcaggaagactcccgcaccaacgaaggttcgagacgagacacgcccggctgtggggcccacttatggggagcggcggctgaggaaagtaagcagttgctacatgcagtaatatggtggtagttaggaagtcaacactgtcgacggaacagttgtatgtgtgcacgttgatttgagcggcagcactccgtcgcggtcctgacgtagtacgctttcacccgcagctgttgtcgcgtcgcagcagcgaatgtttgagactaaacagccgaagcatatcacaaccttaaattctcgggggctgaaaatgctgaggcttacgctggatgtgggtgtggtggccccaacatttcgtttgatacaactcacgaaagaaggcttcatgcagcttgccttctcggtaacacatggaacggacgtagacgtcattgacaagcttcgcagcacacttgattatctgcactatcaccgcagcaacacaagctctactttctacgatacgcgttgcaagttggaacaagcatgtgatacttgccaaatagtttttaccgtggcgagtgacctcctcaatctactggtgtcctgtcggggagacacgatactatcgaatccccacgcgctgaacatgctcatgtggccagcagtgatggattaggttttcgttgtagcatgaaaaaacctcccccttgtaagctcaatcacaacaagcaatcaaagcggcgacacttagtaagacatcaagaaactgtgctccgcactagtgtagaacccagtgagtctttctctaaccaagacttagattgaattgcattcttattatgaacctgatctcacaaaacgtggacattcggacacggtgctgcttcaccgtcccttcgctttatcacagcgtccaaccggtacgatcctcaagggccacaccgcctccatgtgttgatcccttcaaacaatttgcctcccccctaatttcgggtactccaaggaggccgttcactgcttttcctgatcaggaaaataaaagttggcagcagggtgtttctgctcttgttatctctaatctcacctatgttcctctcacttcccactgaaattaaccgactcgaccgcagcggatcaagtgatccggtggtgccacctccggagctgctttaccagtttggcagggagatcttacagtttcctaggggactgcacggttgtacgacacactagcctggaccgcttgtcggtcctttatccgggcaccaagtacctgggatcgtttactggtccattggtaagccaaatgattccggtgaccagcagtttgacagcggtgcgtgaacgagtgtatatcatgagggtgtcctggcttcaacaattactggtttccatgtatcgggtcgcatattttccgccgtgctaacgtcaaaatcaatcgaaccgtacaggcgttggaggcagctgccacccagttgcagcttccacgggtgcgtcgctggccttttctggttctgttctcatttttttacgtcgcggtagcgaccggccgcaaacagtcgatgagttttccatgacgttctgtggttcctagttgttttaggaccacaggtccgatagactggatacgcaaaaagaagtagcttgttgatgcttctctcgcgacaaccgagaccttgaccgcactggttttagtgaatgagcgtgaaagtgactcacacgagtgttgtcttgacttttggtcctcggtggcgaaccacttggtgatgactccaacgcgaagctaatacgagctgtgcataactttgttctggctgtgtcacccggtgacgactagggattttagtagttttctaactgatttcacgttcttttccagtccgtgctccccgtccccgtgtaaccattgtggaacttcagcttgtgaacacgcgaaagttcgtgcgaatgccgatttaaagggaagaaattggcttcgataacgccccgcagcgtctggcgtgtcagaagtcggtcgtggcgatccgtgggcgtactcgctcttccacggctcagaaaagacttctttccgctgtgatttccgtgtagatcatca

SEQ ID NO: 2789 - DNA, 2025 bp, Toxoplasma gondii
cctataaactcaatgaagctgattcacgctctggcagatatgcaggtgaaggataatcacccctgactgttgataagactgtcagcccctccaaccacatccccagccctttttgcttgagattggagtgtgatacggtgattgcttttgctatggtgcttccttgtcatgtttaggatgtcatggtaaagcggatgaagatgacagttgaagaagagcgagccaggaaggagctgttggaacgttatatccagcaggagaaggccgcctcctcgcggcggaccgaactcgaaaagcaactaacacttcttcgaacggagagagagaaagcctcaaacagatcgtgcgaaacggttgtcaagctgaaggcagacttacaggatgtccatgatttcacagaacaacgtctggcacagttgcatgagcagtatagaaagcgggaagcggaacatacacgaaattttgatgtacgggcatcggaacttgtagcacggatgaaccagcaacaaaagcataattccatggtgttctctcgagggaaacaggaaacagacacattgaagagcaagacgaagattgcagagaaagatctggagcgaatcatcgaaacctacgatcgtgaaatgatggagaaaaacgccagtaagcaccttcacattctagttctttctgaggggctatttgaagaattgcctacaaaacagaggccgatacacttctctaattgtgcggggtgaatgtgctgcagaagcgagagaagtcgcggaagcgaacgcaacgaaggaagagttagtggttaatctgcagaagcagttgcaagttgtcaatgaagagaatgaccggatacgtcaggaatacgaaatagagaaggttcgccaatcaatcatcgataggcagctacagaggctggctgcagcggctacgcttcttcaagcgtactggcgaggaataaggcaacgcgaagagtatgtagcaatgaaaaagaacgctcgcaacaaaagaggatggaaaggcaagaagaattagggtgtatttgaagggtgcatgcgtctttcggttcgcgactttcgatttacgacggctcgagatcgtgtggcttcctttaaacatgggaagttatcacgtgcctacgcgcacaagcacccgcttgcgactgagactagtgcaacaaatatacaccccaggttttgactgccataaaaagccaatcatatgcttcttctattcgcaaaacccagtgattgagcactaacatttgttcccatcaggtatatatgtggtagttgccgctaggttgagcgacgccactgcgatattctgtcgtttcatttgttcgtgtcgtgcctgtcgttcatcccgatgcggcaggcggcttacacagtgttcgtgatgctgtctagtaaccatcctggttgctaatgggcttgacgaacgctcttcagaaagtcccggattcgtcttgaaatcaacgagcatcctgacacttaaaaggggacacttcaccaccatcaccgagtggtagcccatcacgcgaacagcgaggcggacaggatggatacaatcgactacaggcgtatattgaacacgacagttgacaaatgtctgctggtatactgtctcaaaaccaaacacccggtcacgtgtcagaaaggaagaaacattggcatgaaaagggtagatgactcgtgttcctctgctacttaattacctgacgcgttgtcgacatgatattcgtagatcgtgatgccacttcgttgagttacgtcgcacagtgtattacattacaacagacaggttatttggcgctggcaggatggtgtgagacaaattatgcacgttcataattgcggcaatgagaaactcgcatagcctttgcatgcactgcaactgacagctctttttgatatgcagaccccacgtcacgagtgtccgtacacccaactagtttacagcctgagacggggggcatctgtgccagaaaatggaccgagccgtgccaaaattggctgtgattctgataaagga

SEQ ID NO: 2790 - DNA, 2108 bp, Toxoplasma gondii
accgagggtcatttaacctctccttcttgtctgagacttattagatctcctggcgtttctccgtgtaaatctacaagaagcagatcgttgtagagaaactccaccgctgcagcagacacctcgtccacggctctcggagtcaagagctcagccatgggtctgtctctgttctggaaagaagaagcgcccttgagtcggagccagaaaacgagacagaaggcgtcaccgcagttgagacgcgcgaatcgaagaagccaggcaggaagacagcagacaagaagagcagccggtataccgtgtcgttatttcactgtcaaaggagtgcaaagaagaggagacaaagggcaaactgaaggcgacagaaaaacgcaagaaaagagagcctacgttgagtggaagtgccggacggcctggttgttgtcaactccttcctgtcagacttctgtgaactccgcatattcctcagcgcccgaggtcggcctttgccttccgatggactctgagaagacaccgtcgaccgagaagaagagacacctggggagagagcggagacatctggggagagagcggagacatctggggagagagacgcagaaggagcgctttcatcagagggctcggcgccgcgttgagaggtgcggggacgagagcgcacagaagccatggagaggaaacgagagaaaaaaagcgagaaaggagagggaaaagcgagaaggcgggagaagacgacgagagaagcggcagagccgaagacctttcagagaagcagggagggagagtcgaatccgaaaaccgagacacggagacacggcgagaagaagcgaggaagaatgaaggagacagattgcttctcatctattcagcgggaaggaaagaaggtcgggaggagaaggattgccgcgaaaacgtcagcgttgtccactgcgaggcgcaaggctccgcgaatatctgcggacccgaaggtgtacatacacccagtgagaggtggcggccgcgaggattcgccttcgttgactggaggcaatttcacgaagaaagaaaaagaaaaaaaggccaaggacaggccgacggacgacagctagctctcccagagaaacaaggagcaattgcccacgaagcagcaagaaaaaaaaaggcctttcttgagtagtctgctcgagggacaaactgccgttccccccgagacaactctctccgcgttgatcggcagaaatcgaattctttgaaaacgagtgactgtcagactctcttcgtctcttctctccacgcttgaatttctctctctgtttctatctgctgcatcgtgcctgcttttccggggcttgcgcttttttggtgcatgcgtttgacatgctctcaaaacagctagacggcaggagatgagcctggtaggattttctggaccattactgcgtctttgtctgcattctcagctggcggtgtttcgcttttttctgctccttcccagagatcccctgctttcgcgtcaaactgggacccagagcaaccccacagatgcggcgacgctctccttgagttcggcagacagcggcggcgactcatcagcagaagcggaaagaagcctgaggacgacgaaaaaaggatctcttgaagcgaagacgtcgctggcgatcagcggagaagagaaaaaagagcgagaactagtgagagaagtcgttgtcaagaaagtgatcttgtgacgtgaggcgaaccgccgaagtaaagcgagagcttcgaaacagcgcgtgcatctggacagcttttcttttcagttttggaatattttttacttttctctgcagtcttggattttttacagtttgttcattttcggacctctctctctcaccttgtcgcgtcggccggctctctctgctggtcctgtctccatttctgtgttctgtgccctcatcgagaagcagcactctgaaaaccgaacagcgggaggaccttctgattcgcttccccgccgcttcgttcttgccgtccgcgtccaccagatcgcttgctctctctgctctgggcttcgctcgtcctccgcttggaaccgcagcgacttctgtgtcgtcttcgcgtctctctctctctctccccgcctctcgccacca

SEQ ID NO: 2791 - DNA, 2141 bp, Toxoplasma gondii
tgcttcttccagtgttcctgaaggactttgcgctctgccaggcaccgcgcccgttctgcctctgcgtcgactttctcgagagtgaaggtctggccacaggtgcttttccacttccacacttctctctcttttcctgtcgctccctcgcctcctttccacgcggtgctgtacacctcgacagcgtccgcaaccagaaatgcggagtagaagcccacgccgaactggccgatgagagaagaggcttgcgtcgaggcgccggcgccagcggcctgttgttccttcagctgctggagaaagcgatatgtccccgactgagcaatggttcccaagttgttgatcagttccgttttgctcatgccgatcccgtcgtcttcaatggtgagcgtgttcttctcgcggtcagcccgcacccgaatgctcccgcgaaatttccggccttccttctccatcaacatgcgtttcttgtcgctggcgtcagctgcattggaaatcaactcgcgcaaaaagacgtctcggtcggtgtacagcgagttcacaatgatgtcgagcacccgctttacctcggcctggaacgggaaaatctccggcgccggcgcggcacccttttctccagcttgcacacccgcggcgagagtggaggacgatgtgcttggtaaaacattttcggaatttaccccgtttcgtaagcaactcgcctgtggcgacgcccacaccctaggagcgcgagagccgacaccggcgcgatgcgaaggtggagcaacgaacgcacgcagcgccttaggcgagccggacacactgttggtttgtggagggagatctctggaaacaaacgagttctggagttctaggacagagagcggaaaggacaaagaagcagcggacgactgggtgggcaactgggtgccccggtgggacgtaggcaggagagagggtgacaaacttcgagcagagaaagagttgcatgcagacacaggagaccgtccgccggagacggtgccacctagaaccgacacacgaggactggaaggcgcgaatgtaaagccggaaacacggagtagcgaggacgacgtcgagagcaggaacagaactactacgcgcgtgacagaggacagtggcacacgcgcgcttcgggcattttgcctctgcaaatgcggcgatacctcagccacggactcagacggcctaggaccgcagcaactggaaaatgccaagcaaacgtctgtgcaagaagccccgtctctacccgttggaatcgaacgcgaggagacggcgctcgggacgccgtccctattcgcggccatgtacggagatgtgtgcatggtttccgagatgtaatgctagagatcgcagatctctcgcgggagggttagagtccctccaaatttttcattctgacgcatcctctttgttggtgaaggcgttctccgtgtttcccagccccccaaagggcagaaaaacaccagaaagagtccgcgcaaaccaacgcgtttcaccttcttttctcgcgtcctccaccagctgccacgctcttgcttcttccacttggtcgcacaagcaacagcattatgctcttaagcttcgacaccacgtcaactcagaaggtgttttccattgcgaagggccgaaggttcccgcacgcctcccgttcaggaactacactcgttacagacactctcgtttcggcatggggatgcaggctcacgaggacccaccacggaagaggtaagtcactcgagagaccacgggtgatttcgcttcacgtcggatcctgtcgagacaacatggggggctcgggctgccgcgtttcgcagcgcgaccgcaggcgcgtgcactgagctgttccgcgatgacgccgcgccatcgcgagcgagctacatgtgctcactagcttcgagctgctccgctgtgtgggcctaggaattgagagcgcgggattccgcggcgttcttgcgctacccgattgaaaagcgcagtgggattcatttccagaggcgcgtgcgctcgtgtcgacagttacccctactttgcgtggcggttatttttgagaaagtccaagaggcgcggtcctctgcagcgagatttgcttacgtttttttgtttgacttttccgcggccctgccgctagagcttgagagtcatca

SEQ ID NO: 2792 - DNA, 4554 bp, Toxoplasma gondii
aagatccactgtatctccgcgaccaattttgtcttttgtgctggtgtttcagcaactctagcgacgggtggaaagtgaataccgtggatcttggcgtcagcgttagtccggatttggcattcggactcactgcagatggggtcaaggtgaagaagttgtacgcaagcagcggcctgacagcgatcaacgacgatccttccttggggtgcaaggctcctccccattctccgccggccggagaggaaccgagtttgccgtcgcctgaaaacagcgggtctgcaacaccagcggaagaaagtccgtctgagtctgaatctgtcccgtctttgcctttgtctcaaattccctcagaagtgcccctgtcccaagagtcgccagtaccgcctcaggatggtgagaacccagattcgccacaaaatgaagacaattcgatgcaggaagtcgagaatagcgcttcgcagtcggatatcgaggctcagcggcaggccgagaacggccgtctgccgagtgacgatgaggcgtaaagattcacgacgcacctgtttttggatatacagtgtaaagagccagggcaacagacaacactattttgtggtatatgtcgcatctgtcgcgcggactggagtttcgtgcatgtccaggttagtcgggaacggtcgagcgtgaactcagttttcccggttcgtgagaacaggggccggaagtttggtagtcccagccattagagggatggagtgtttttgtctgaaagtaacaagtgcgttcggcgtccggccccaggccatcggcacgcctgtagaggtggatttattaccggaggcaccggtcttgtattctgtaggatgaactctgcaggagagtagtgacgtgttacgtggagggtttgagcgaagtacgctcgtgatacgtcggctgcagtgcacctgactatcgacaaaagcggaaactcacggccgaaatgtgtgacgcaacgcagtccttgatatttcaaaaatatgttgcaattttggagttgaaatgtttggatctgtttcctgccgacgtgtaccaagtatcaacttctcaggtaatcagcgatggctggaaaattcaggctgcaggaagctgtctctacaggggggatgggtagagcggagacttgagcagtcatcattcagaaagacgccaccatgcacatcagctattctcactgtggagcaccagacggcggtaactcctgtcaagcgggaatattcaaccctaaatgttttttcacttaaggcacgcagctgttctggcacgccggtagaaacgtaaatgcccggcttcgcacgtactatcgtcagtttacgtgtattgtggttccaccggtagcagtagtgtagtggtatgcggcagtcggagttttcagctgtgttctccaccgtaaggcagtggacgaattaattcgtgcgctgcagcaccatgtgtgtacatctagctaaagtcccacccgtccggaagaaacctgcggtatttcagagattcgtcgcatcgtgttacaaactccccttctgaactagtttggagggtgcgaattgtgctacgagagagagagactggttccgggccatcccgccgttcctgactgcaaaaaatgatacgcagacagagaagagcgacttaacactggagttctccctgcgagaggactctcaaataaccacagaatagagttctgcgacgtcgattgttgggattcggagttattctcacgatagccgagagatctacctcctttcgagaagtgatatgtgagggggcgcacgttcattttagccgcgtgcgttggtatcccatggccccacatcacgtcgaaatttatgaagtcatcgatgtggtctatcgtgtacgtccattctagaacgacggtatgaccaccaccttcgcagcatcattgctgctctgggacaccaccctctctaattctccattctccgacgcagtcgcaaactctacaactcatgttacgtgcgcttcagcactcaaacagagacggtttaccagagcgtcatgtagaccgaggtcgattgcgaagtcagcagctctggaacctgccctcgacgccgtggcatcccagtcgtcatgtaatgtgggcacaagtgcgctgtccgttgcattccatgtgcaatatccaactccaaaaagactgtcatagttctaccatatgctaagaagattgatacgatagaatcctatcgaaaagacttctattaagggtgcagaaagccaagaaactgcctgccctttttgccgagtattcgtgtatgaaatgaaggactttcggggagcgtggcataacataagcagactagtggcacttcagaaatacactccatttgttgcagttgcggcgtactagtgctttgaggcacgtttctgtcaaagtggagggtttatctgtaccccgatcacggctgcactgcctctgtccaaatggtacacatgggggtgtctcataacgagtgtcaattcatgcgtgcctcatgactcgtctccgtgctgttctgtctacagtgcgactacgtcggccacctccgaacgttacacaggtagcttacagatgagttcagtacgaagaagtccgtgtgcgacacacaaccggataaagaagtggctcagatttcctttttgtgtccggatcggaaccggcgttcctgaatactgccaaaattatccgctgatcgtccggcaacgtaaatacgcggctgtccagcgactcgtcctgcagactgcgtgcgggtcgcaactcgaatccttcacacaacgaaatttcggtaaccactccctgcgccacagaacacacgtactccagtcgagacgaaaatatctctaagcgacgctgctcacgagcacgaggccggcacctgccgtcccagtgaaggtagtctatattgagtaatcaagccttcgtcatagggggcgtgtcgttgtccaagaaagtggatcgtgcagtgcgctgggaaggtggagtgtgcactaccaacggtatcgtgaactaggaacacttgtgttgctaatctacgttcgcagataccaaacgcccagagttgtgcttggcgcgttgtcgccgtagcacaatcccactgcaaccgcctctttgccttgtccgcggaatctgagtctggcagaatcgcagcatcgtagaatacacacatgtagaattctgcagcgttttttttctcattcggtgctaccgtcgcactttgccgttctcagccgacacaacggtgtcgagatctcctctcgtttcggatcaacccgacttcctgaatgcgctcgcgttccaccgactctgtaggggaagagctgtggccacacaaccaccggtatacaagcgttccgttggcacaccgtgaaggcgtttcctaggcccaagcaagaagaagatgcggaaggtgtggacgaagtgcacgtgcgtgcaaagctttcagtttgccgagagctttctcacgtttccttttcacacagggggagcggcgcacgtcgcgcccaggtggttgtgccgagcttgcttccttttctgcgaagagtaggagccgggaccgagagacaggcgcgttgtcgggttaagtttttctacgatttcgctagaagaaacacttcccccttttctcagaaagctcaggtccatctggatgcttggatcacttgacaagctgcgcaaacacgacaggtttcggcgtctcgcagcctcgtttcccggctggtgtccgggtgtagcgcgctctggggtgcggacatttcctgctcgtaactttccctgccggtctcgagagacggctgatctcaactcaaaatcttcttttcagtcatcttcactcgccaaaacaagataattttggggcgacgactcccttcagtcgcttcaacttgaagaagttcgcttcgcgttaggggacagaaaggagcggttcctcgtccggtgccgtttcacgccaacgttcgcccttcgcttgagggttgcggtccgtcagtttgctttgctgtgtggtggaatgtgttctttttagcctttgtcatttccctttccagcaggctgctgttatccacaggacttcctctgtacgcaggcggttgtgccacgaacacggactgcatcgcgattcctgcctgttctgggaacggcccgtcttcacagtttttcagctctccgagaaacgatagtatcagctccgattctctaatagtagttttgcgggataacggcatcactctgggcggatttattcaggttttgcgccccaagtttggtcatcatcatcgtaccaaaaacagtgggcatcttctttctccagtctctcaaatccacgctcgactacagtttctttcgagtgctaagctcccatgttcaattctttctagcgttttcgaagggccctctgctgtcttaacctttctcgacacccttggctgtttctgacaaaacgttcatctcatcttgggaagtctgttgaagggtgaccctgtcgtaaaagtgggtgagagcaactttccttggttttctgccggattagttcccatcttctcccacaa

SEQ ID NO: 2793 - DNA, 2535 bp, Toxoplasma gondii
gcgtctgctctcgcctcactgtgcattctgtctcctcaccttctgaggcagcaggagctgaagagacggcggccatgcggcctgcgacagctgcggtcacctcgccgaggttcctccagttcgcgttttccgctgcctcttctcttccgcgagacaggtgctctgtcactgcagctgttacgctgttcaaccgcgtccacgcgctctgagagttctctcgctcgccttcagaatacctctctgcatgcgcaccgagccatctgccagcccccgccgcgagacgcccgaatcgaaatccgccgtccgcgaatggggaagcagaggaaggagaatcagaagcaggagaagaagagggagggagatgagaagaaggcagagaatgacatgtgagttgagccggggaactcggagcatttttcatctgagggaaagggggaagggggtcatcgccgtcgtcgtcctccatgaggaattcatcgacttcgttaaagatgtccgtcatggtcgagagtggaaacaactcgaatctggaaaccgagaaacgtggaagctctgctctggagacagatcggtcagacactacgacgtggtgaccctcagagtgggcaaagggcgttctttccacgcacaggagagaatcgcgacagcaaacgttcgtctgtcacacaacaggatgcagccgagttgaacctcgacaagaaggagtgaaaaacgaacccaatcctctgcaacagagaaacacgagcgtcgaaaacgacttgcacccgcgaaggcagttcggttttttcgggactgcatgcgttagcggaccaaagtcgcctcgcgaagtcctttctaaggcgactggcctctctcccgtaagtgtcggttctctttgtgatttacttttgcttctgcgccgtctgggtcagttctccgcagtacccagcttctgtctcctcggtctgtattcaccaccggggccgctcggaaagtcgtcgagtttgagtccccccgttttccagaaagcgtaggatgtagtcacaaatatgtcgcgggacttctcgtctgctgcctcctgctctgtgtgagcgtacatgtaccacctcgaatgggggaagggaggaagccggtaaacgaggacgcagaggatcgtcctcagataagaagcgcccggcgctgcagcgacgttaacgcagagcgcgggaaaaacacctcagagtccagaatggggaagcccaactgctggtttctcgagcgcaaaaagaatcgcgaattcgagtagctgaggtccacacacgtccacacgctatcgacggaggggggtactacttgtctgggagggcggctggccgcggtgaacgcaaaacgcgccgcttcgtgacaaacaaaaccctcgtttagagaaaaacacgcacagaaaaaatgcctctgaggcaaatcagaaaaaaagatgcacgacatgctcgttctggccgccctactcctccgccgaaaatccacagccgatcacgcatactgtctcaggagcgggaaaacgacatcgtttctaggcagcagcaccagtgcgacatcgcggcaacaatgttctgaaaaggtaccgtgcccgtacgtcttgcttgcgaaaaaaccttcgcagaattcacaactttgaaggcgcaacggtttttttaagggcgaaaattcgctgactcgaaacgcagcttctgccgagggagtcgggtaagcaaacccagaagtggtcggccaggggaaaagttgcagggggtttcgcgctgtgttccgcaagacgtgtgctcactgcattccctgcttcctctctttcctccgtcgtttttgatgtccgaattctcctccagtgtcagagaaaaaacagagaaggttgtgtgtcgagtgtcgcagaaaaagacgcttgtctgtgcccggcgtagacgatctcttcggcctctcggacgaaccgagttttcacggtgaaccttttgtgcttacttttcgtctcagactgtgttgttgttccctgcttctcaaaagccgcccttctctcacttcttgttcgccgattgccttcaagaagtgtggagttcccttccttttttctgggttctccggaagcctcctgtagcaaaatgcgctgaaattttggacacttctcgacggtgtctcgctttaggacggacctcatggtctttagggcaccgttttctttcactttttctgggaacatcacagttttctccatttcagggaacgaacaatctgcaagcgtccacttgtcctgtggctgctgggctcggatgccgcctctgtttagcaagtgtagcagggaccggatggcaagctaggtccacttcactgcagtttcaagttccaaaccaaggcatctcaatttgtatcgtgttctctgtcaacaagctgttgaacctgtcgacggagtgtcgtcccggctcctatcccgcgttcgcaagccgcaccgttttcagaacagtgttccccgtggtgttgaaagcgggctgcgaagcgcgagcgtttcgttttgtggttttttctgggaaacga

SEQ ID NO: 2794 - DNA, 4259 bp, Toxoplasma gondii
ggtgtgctctgaatctgaattcattctatcattttggtgttttagttgcagcgtatatctggaaaaccaacacttgcataccacctgtagacatatcacgattttcactttggtagtctccttaataatacagtaggctatttctgaacgctgtgattcgtagggtcgctcttcaggctcctcaaagggtgctgctgcttcttcggggaacatttgtgctcttctataaagaatttgcacagtagcggctggggaagcaaagtggtacagtggctcttggggcctctcaggagtgtaacaagcagcgatgaaggaagagtgttgaaagaggcatttgtccttccgtaagattttgccacgtgggtttgtagaaagcgtctacaaatgtcttcagcagttatcttagctcaggcgaaaacgagaaatcgattcagagcaccagattgagtcctccctatcgagactgggcgggttgtcccattgaaaacgacagatcccattagggcaacacaagaagtgagaaatggtgcagtagttcaaatactgtccctggtggccctcgtaattagcacccgtcatccaccggaaacgcaatctaccaagtgtgcactgcgcagaaaacggatatgataatagacattggttcaaacagtcgctgtgagtacgcaggaacaacggaaaaaatcaagattttactatgtacccaaagaataacccattcgctcactacattccgaaaaactctgtagagctacttttcgaagttcttcgccgcgtcgtccatgaatttcgcaagagcgaaatccttttctgtcaacccagctgcatcgtgtgttgacagctccacatcgacagtattgtagacgttataccaatttgggtggtgatctactttgtctgcgtagagggcaactcgggacatgaatccccacgcctgcaaagtccaaaaacaggcggggttaggcatggatgaatgattgcacggagaaaaacagccagaacacaagtagagtctcagtctctaatcctcggagtcattcggttcctccatcctctacacctcaggaaaacaaaactgccacgggtcactcgtggcaggtactgtctggaaacaaacgctactcccacctttggttgacgcgttggctgatgtatatcactacttgcgagagaccctcgtgtcagcaggtttagcggtcgcttacttcgttgaaatccgaaaactgaaatttcctcttgatggacaagtggccgtcggttaaatgccactgcggcactgttttgtgaagttgaagcaggcgagcggaattcgccgccaggcgggcaagtggtgccatcgtcgagatgtgtcaactcaagaaaaagagagagcctttcacatcggccaatcactaccagaacaaaaagaccttttaccaagccataggaaatcacgaaggggagagacgagcacactttcgcaaacagggcctgtagtgcgaccagagtgacgttcttctgttccgcgcggccgggcacgcaaatgccaccgtatcttttggacgctttgttttcaaaaaaggaatgacaaaacagcgaacattcaaggcatactcagaaaaatccacgcaccacatgacatgcttggtttttttttcaccgtcgatttactccaacagcttactctttcctgtgaaacgtgtgttcggttgtggttgcagccgcatgtggatgtgatcatccaggacgggacgcacaagacgaaaatgacatacaggatcttaaactcagttcattctggaaatatcatccctcttcaactgtcaggcgtctccctcctgtcctcgggaacaaacattcagtgaaatggtgccggatgtaggtgggagggctgtgtatgtgaaattgttactttcagtgtggtagccgaggcagactgcacggcggccaaataccacctctggtgaatctggatgagttttgagaccagcataatgtagcgtggcgactctgatacaacgtacttctccatgcacagatttagtattctttgcgtgccagtccatgaaacgtcctcacccatcagtaataagccacacaacgggaacgtagtcgagaagaaaacgggaaaaacggcaacatgcatcgtgcttgctgtgcagacttcccttggtgtaacgggttgcagggcgaacatgaggcgatcgacggagtcaggccatgtgttatttgcatgaaacagtgaaacagtaggactctgggttaccaatacaaacgctgaccgcttacacgttattccactaggacgttgttctttgcagtctgagaagatctcaaaaatgtgtaacagaaatgacaccaactgttgagccatgctacttcctcggtctcgtaagaagatgcgtctgttctgtgctttttggaagcgtctcatccgagctgacaaaaacgcatgacaaagctacatcaagcgatatggtgctacctcgtggattccgtgggtcgaaagaagactcatgatgctcaaaaccgagccggtgtgtgtggcgagacctcggaaattcggttcggcacctcaccacactactaatgctcccccgtcgtatcagacatattatgatatctccaaaatgtggcgcccccttgagtttggcattcgaaacgagcttgtgaatgtggtgggggggccgttttttcagagacgcatgaggcaaactacttcctcgacttcggtttgcacaacagcctttatccgactaagcagcagagccggcgcaattcagatctcttgactgtgaagggttcaatttcggtatacgatgcagctgatcgacaagtcgtatatcgtggattggtatctaccccggcgtacagagtgtttagagctgcctgtgggctgccgttccggaccgtctgttctacagaacgctagtcgcgtttcttgaggtgcgtggaaatgccattattggaatttgcatcacccccacatgtattgagaacccaaagtttcgcagcccggggcacccaggttggtcgtccacaggaagtccagctgttccccagcgtcgctggtatctctaccagccgctcgtttctaacggggagtgtgccggtttctgtcgatcagttcacactgaaactacagttgaccacacgcaatagacaaacgaagttctcactccggcgatccagttatctaatcaacgcacaacgactctatcattctgcctgccgtaaatttcagtcgttcagcataatcaccatcctcgtcacacccacatttcccgatcaccagctgtcgagacccgaccacacacttgcgtctgcctttccagctcctcccacagtcagctagtgcctacagccgaaacgtttttatttgggaaggtaaggaacacactgagagctgaaaacacacagtaactcgtgctggcagcacggcatcagatgtcgggtcggctctgggtctgcatttcctctgcgtgattttgcatgacttctcggtacagtggctaacggaggccagcgtgacaagcgagcggcgagctcgagactgcacaggggagttgatgcgatgctcatccatgggaggtggcgtgtctctcgggaccgttcttgttcaaggatcaagcgccaaacatagcagacggaatcggtaaaagtatgcagtgtcgtttgtgacggatatagaagtcaacgtaataaaagcagtttttccccgaatcgtggcggtctggaagcgactgccagtccggggtggctggtaggtagttaactgccgagagagtcttcgattagaggtacggatcacaggaggtgtccgaaatggttttatctgcgacgagtaacattttacggcggttatgcatgtggcatccccctgcagttatttcccgctttgggctctgatgtttttctcccttcaccttcctgaccgtgcgacgaatctccacccggaccacccgagcgtccgttctctccccggttagcgatttcaagcccgttggtcgaaaatttgaacatttccgccatctcacaagcgaagggaagtaaaatgaccccaaccctggctgtgttacagctaaaactccagcgcttcgcgttcctgtggacgaagtagttccccgagttcttgttctttccttccgtattacctcctctctaagtccgtatagcgcggtgcatccccgactaggccaggtataacaaggtccattttggatctttcttctagaagaaatacggcggtcgccacccgtgctttctcatctgagccacca

SEQ ID NO: 2795 - DNA, 3822 bp, Toxoplasma gondii
tttttgtatctactcggcttcagtttcgttttacatttgacggtttgggtggggctgacagttggcgtctggattttgccgcttcctttagtgaccgtgagtattctctatcattagaatgtagatacgtccgactcgcttggaagcattggcaggtaatacgagttttcttctcatctctagcagctggctgcgacaggggccgattcttgtttggccaatggcaccgcggagttacgggaattcggtaggcactgaaattgcacatcaacgtcggtctccctctggtggaagtatgtcgtggcgtctcgtgcgccgcctgcgtcggtatctctttcatgtcgaggattgctggatgttcgcagacgttccgaaatcttcgggcgtgaaaggcggtgtgtctttgccagtcttccaaagtatacagcggcttcgcctcggctaatttccggtaggtaaatttgttgttataggcaatccgttcttcctcatcctttcgattcttccagttaagactggcaggacctctgggctctgaaagcgccgcagtgcacggagaccgtaccattatcttgcacaatttatccagaagcagcttgttgtctctatcgatctcctggaatctctcatgactctgagtctcatatttgagatttcggccagttcggggagtacgacatggagggctggtccgtacgactggcttaacagccttcagtcgttcctcgtgtaagcgctgctccagctccacacgtcgtttgtaacacacgcggttaccttccactattgcacgatacatcctgaaagaccaaacagcaagcgtgggaccttcataagtttcgttgaggcgagtcacacagaactcttgttgaaaagttgagggtcaaatacctgcttgattctggcgaacttctgtgtacgctggatcacagtaagagacacggtacagagcgtctcgttcgagcatagctcatgtgtctctgtttgccgtcagcgatcatgtccaacatgttttctagaagcatgagcgtccctgcagtggaatggggctaatcggttgccctgattccaccgatgcaagctggtggcccgtgaaggaaattacgtattcggaaaatttgccccgaaacgagagtgtccctcaacaaggctctaaggagtccattctccggtaaatggcgtgtgtgtatggcatcttgtttagaacaagcactcagcaatgacgcgaggtgtgcggcacagatgcaatttcatcactagcggtccgcttgatggttcatacacggtccaactctcgaggatgatcggacagcacgagttaccagaaagacgctcaaatgttagagccggatgtattgttagcttgcaataaacaccatcgcacctgtactctatttgttgtaggtgccaccgacagttcgtcctgtgttttatgacggccgctggtcgtataacagcacacattccccaacgtggcacatgcaagcccccttatgaaagccccgaagtcgtcagacctgcagactatgtgaaaagaagcctccgatggcgacgacacaaatccatgcaactgggatatttcgtagaagcttccctttcgtgggacctaaaaatgatcttatgcgcaaaaacagcagcaaacagtaccgtgtatctatgttcgtcccgcgagagacataattcagattgattgcatatatttgtagagatggtcatacaagttttaccttataactcgtgcctcaagtatcacaatgaaggaggcaaccgactgtgcgtctctattcgagaaacactatcaattcttctctttaagtcttgccgggtgacagcacagcctggcgagagggggcaaagtgagggaaagacaacagacggcagctgccgtcctttatgattttatgctccgtgtactcgaaaatgaaagacagggcactagagtactcaacatacctcgtagcccccgtcactatgccccaccatgcggttcaattggactgtgctaagttggcgatatggaggaaaactaacgcgtgcagtgaaagacatactatgttacaggtgtttacctcgttgcatccaagtacacaaacgtttatatgtacatcttaacttgtagatttttcactcaccgctcctctgtgctcgttgtggctattgtggaatctcggcgacaaaactagtcttcagggctttcagttacaagacgtcgttcggtgtttctgcggcagattcacccgaaatcagccgaatgctttagtccctgcgagctgcctttgagatggaggcttgcaaaggatgcagcttccgttgggtggccgtcctccatccttttgtgaatggagtgcgttcagagcgaaaacgtatttccgctcaagtccaccactggttctccctgaccatccgatttccgtgcctattttgttttttcgtggctcaggcttattgtatgtgccagcaaccgctgtgagtgagcagctgtttatctgttcaacgacgggcacgtctttagaagttgccagtatgggtgagcatcataaaactcgccgttcgtacagtagcctcgccaaaaaatatcaaggtctccttgaatgtcgagacagaatatactcaaacattttctgccgtaggagtggacaacaagggtgtctgatttgttgatgctctcaggcctgaaatcagaatttgggaggacccgcagcgtcgaaagtagttcacactggctttcttgaaacaaccaagtatgttcaaaagatactccaagactgcttcttttccggaagatctccttccgcttcccattttgcctggatctggcgacagcgtttcctttttggcccccttttggcccagcgaaaattccccgccgcacgcgcatacaagcaagggaggagagaccaacaaatgacagaatgcttgggatcgacgcggcagcggagcaatccagtcgctgtttccgaaaaaacagcagttgctgctatattttagtctgcccttaactcgatttcttctgctgcgattctctcctgttgaagcctgcgctgttccataaaggtgtctgctgggcagaacttggcacactgtccagcacatctctatcgaatgcccgagtcttttttgcggcgcaccgtcacatgccactgagtgagtgacacaggttaatatagactcaaatatctactataggttacgaccgatgcatgcaagcgcgtgtagtcctctgatataaagcttgaaatgaagcgtcttccgttttcgatcaacgcctccatcgtttctcatgaccactttgttcagccggaagaacttgtctccagcgttgtggtgtgcacgcatgtacgcgtatatacatgatgcgtacgtgctgtggaccatctgaacggcgggtaaacttcttgcgtagcatcttgtttcgctgccgcttattctgtcaacatgattttgccgtctatgattttcccggatgagatcaaaagtgtctataaagcagacgcataggggacagtttcgagattattctgtatttgatactgtagattacactggtagaataacaaaaaccgtagcgaaacaaggtctttcttctacgcaggttttgacttcctctgtgcgcttcgttacaatttttctgctatggttgataatggcagttccactcctgtctttgagaccatttcgtcttctagctcgacctcctccagtgatgttccaccaagtcctaaaaaacactctggcggtgtgaaaacgcgaaaacgtttcttccttgttcatgcaagattttcagtggcttgaaccatatctacgctctgaggattccacaca

SEQ ID NO: 2796 - DNA, 1949 bp, Toxoplasma gondii
actccggttgagggtgtcgaactgtctgtccagttttggattccccttctccagcggcgcaacgcagggaggcggatcgaggaggctcttccgaggcgcgcggagcggattcggttgtcgctgctccacggaaaggttcagaatcgccctcactttggcgctacgaggcttcacgattcctcgcggaaaaggcgccatggcgaaagccgcacaagaagaagtgagaggaacagacggagacgtaagaagaggagaagaaagaggcaacacaagtggagaaaaggaggaagcggaggagaagagcgcgaggcgaaggcgaaaaaacaagaagagaagaagtcgccgagttctcttcactctctgacgatcgggcgcattgccgtcagcgattggagcacaagaatcattgcgtacaatttttaaaaaacggggaataagttcaacagtaagcggcagagaggctgtctgtttccctgtctgtgtgcggcttcgacgtcctcagacggcgacctcacaaatgaaacaagaggagaaaaacagactcccctttcttagcgcggttctctctgttcctctcgctttccttctcttctcgccatgagaggagagcagcgaggaggctcaccgctgctctctccggggcaacgggcgagaaagagaaatggacagctgagcattcagacggcagagacaaggagagaagaaaaaggagtcgaatgcgacagggatctctgccagcgtggtggcaagcgttgtgaagcaaagtccggaaccaaagcaaatagacatgcgcgtaagtgcctgtacaggtgaagagttgtgtgcagattcacgaggtgtaggtacacccggctggggttttcgagggcggccgaactggaggggaagcttgtttttccttgtttttcctctctttctctgtgtgtcgatggttcaggacgcttgcagactggcatgggagacgagaaaaagttgtgcttcgccttagacaaagaaaaaagacttttgcaggtgcgagaaagcagatggaacttgaagtgtgtcgcctgtctagctctagctccgtccccgacggaagcggagacagagagagaggaaggagacaggagacctacagaccatggtccacagaaagaaagaggtttttcacgcgtcaaagcgaaagagaagaagagattgaaagagaaaggaagagaaaggcgcgacccgtttaaagggaagtcgcggaaacgttcattccccatgcccatccagtgcatgcgagctcttcgcagaaaaaaattctacttccagcgcgcggcggtcgctgctgcgaacaagcgaacgatttgcttctctctgttctcggtccctgtgccttctcttgttgtcacctcttcgttttcgagtattcctcgactcgacaaaaaggcgaacacaacgggggagacgtctcctgaagtcgtgcgttttttctaaagatccacctcgagagcgagcgagcgagagcgacgggagctggagaagaaagcctgttttctctctctcgcttcacagtttctctgttccggctgtcctttcgttggcgaaaactggaggagttttccatgttttcagaaaccaaaggctttttctgtcttttgcatgcgtgtcatctctcggctagtagcttcgcaacgtcctcgcggtcggggagcaggtctcttctgctccagtgttcctcttcgtctctgcggtttctgggcgtccctttttccccggtccgtcttctcttcttctctcgcgctacgccgagctatccacgtctgaactgcactcctgtgctgcagcgttgcctgtcgacgagtcagtgctacgcatttcttgaagtcagtgtgacgcccagaacgacctgcgagcggcaccttccgcctgtggtgactctctctcttcgctcctgcgcgtttctctccactctctgctgcgtataa

SEQ ID NO: 2797 - DNA, 3221 bp, Toxoplasma gondii
cctgaaaaagccattttacagaacgaattcccgggctcctgcaagaagtgaggaggcaccgatgcgaaatgttctcttcgtgacaaaatcagcaccgagtgcatccgagaccagattcaaatactgtgcacaaacgtcgagagacttcactcctcccgctattttgatgccaacaatcctgctatctttatgcacctcctggtactcctttatggcacgacacatatctctgacggcgggcagggtcgcatttacggtgacctttcctgttgatgtcttgagcatatctgctccactttccaacgcagccttgctcgcgcggacgaccagatcaggcacatcactggagagcattcccgtctcaagaatcactttcagcactgctgagcctgagacctagaggtagagcaggaaaaaacatcaacacaaaagggcaccatcttgcgaatgaagcgtagacagttttacacggtatttgcgtgacttccttgtgtaaatgggatgctgccgtaggcgatgtccccggagagttttgatctgcagatgcagtctggggacaccgtggagcagagattcctatgaacttgccgccgtgtatcgaattagagcccacccacgacgtcggaatatctcacggtttcgccaccactatggggacttaagtccacactaggtcaagcaaggctgcgctgcatatccagaaactcgacccacaacggaaacaatccctccagatcagggggaagaaagcacttggaatcttcagaggtaagggcccgtggggaacacgtcagtagacgcagcatttactcgggtaccacagtttaccacaggcacacatttgagttgaactctactgacagtagaccagcgttgcgcatccggtgtgatgctagagcaaagtccgctttcgctgggattcgctgtacatgtaccttccggactgcagaaacgagagttcgaagtgccgcctcgccagcgttagcgtcgcggtttagcagctcccagtccactacaagatccaattcgtcggccccgtcactgagagcacggagagcctcagaggtcaccacttcgacactacctttgccagaggggaaattcaggaccgtagcaaccgtgagctctgcagcctctggcagacgactgggaagcacctttttgataaacttgactgccgaaggccatacacacacagccgcggcgcgagggattttcagagcatcctcacaaagtttagtaaccgactgttcggttgacccttcagaaaggtctgtcgcatcaatgagggaaatgacacgccgggcaacgtaagcccgacaagcctgttgttctgcatccatcctctacaccaagttaaagcaggactcccgtgttctgtgcacaaacattaaagcgcggcgcaaaacgccgcatttacagcgtacggatacctttgaggaacaatgatgtaagtatgagtgtatcatcgactagttgggtcgttgcccagtgaatcgcaggcactgccgttgttgaagggttgtccgttaaaacgattcacacagactccgaaaagcaattagctttccggcaaacgaaaatgcagcaacacgtcagtcgcccttccccccccccgtcgtacccaggagcagttagctcgccagcgtactgtcatgctgaatttgcaaacatgatcgtcaactcgagctgccacagaatcgccgctcgaccatccaggtgtggcattcgtgtaggaaaagatgcctctgaacagataaggtggcagatgacgcatcttggcgtccttcaacagattatcgccgacaagagtagacatatgctttctgcgggtcgcacggtgaccctgggaatcgggccagctattccggggtcgctgagaaaaattgcacgcgatggagaggcaagactaaatttcaagcctctgtctcgggtctgaagggtgcgctttccgtttggagcgtgaaaccccacaaaggtcttccctgcatgttgtagaggactcaactttcaccatttctgcctctctgtgctttcgtggacgagaactgtactaaacaagaccttggagggcggcaacatgaccccgggttgtacgtgaataggagcctcggcttatcaccaaagaacgaggcggcaacgccttctagggacggaacggcggaatggtgagaaccgcacagacaacagtccgtattagctggtcctgtctgaaatagactcagagactttccactgatgtctgactttacggtaattttgcgcttggtggatgatggtctggggagcttttcttgcgtccaaaactgtagattccattttttcctgtctgttcgcgagttcgcttctcgctgctactgctggtcgacgagggtagacgaccgtccgctttcccgtgtatctcgtaaaggaacactcatcccgttttttctcccaggtttgcacacgcctcttgcattttcctgggcttgaattttggggcacccattgttttttgcctgcatgtttgaagctcctcttcgaccaaactcgattacttctgacggcggtcggccgatttgccgctgccgccacagaaactgccgtcaagtttttcaagcccaagagggcggacgattcccccgggttccacaggagctgcttcaaatctggaaaagcgagtccagctgcagaaaacggtttgtaccgatttgtgcagctagcgttacaggctcttccccacgactaccacttcttccccatcaccggagaacagtcaccgacgaaggtcgctgtgaagcaaattcggcggtcatttcctgtggcgacattctgcagtgctgtgaatgtgtgttgggaactaaattgtttcgatttcgtcgaatacgctccctccatgactcgaggcgccgctcgtgcaaacttctccctgtgcattgcctggcttgggtccacgacggagttaaacccctcgctggtgtgatgtgtcgtcgtttgcctaccttggcattttaaacgtgaacctaccaaggcgacgtcctgctgtggcagctcgtggaattcctggaagccgccccagcttcgctgtcccgggctccgcgacggcaccaagtggaactggtgaaaagcaccttgtgctggacagctggaacagcgtgacaacgcgagatttgagggccgtgctgaagtggtttctgctctgtgcgaagaggacagcttttccgagaggaaaggagccgaaa

SEQ ID NO: 2798 - DNA, 2842 bp, Toxoplasma gondii
gagcagacagatgtggacatacaggtccggacaaagagtcgcagacaggcaacgccacctgaaaacacacagtgaagactgaaaacacgtgttggtttgggtggggaactcggaagccgctggacagagtccctgtcgtcggacattcaccaagaagtatcacaggcgagaggggggcctcgcgggggacggggagtccatcaggcgaagcccagcagatgggagagaggcgcgtgggtagatatccctgccgtacgaaccgtctgatgagcacagaaaaagtgaggcaacacctgtacagccttttgcgcgggatagtttccagcgggaaaacgtactctcttagggagaagctgatcgtggtcgaccatcaagcgatctcgaacagcggcgatgacatagtctgaaacagaaggatggaggttgagcgacgcctcgacgccgagaaaagaaaagggccaggacagggcagaccgtgcggtcggggaactcgcagaaattttggggtcgcgagaaacataaacaatggacaacgaaggcgtagagaataccgaggcgcaaagaggggaccgaaaagcaacatagagtgaagacagagattggaaaaggagcgcgagggcagtcaagccggaaagcagactgcggcgtcgcggccgccgcatgcagacggtggtggcaggcggaggaaccccttccggggaagaaccacatggaaaactccccatggttccggaaatctcttgaaaaagacgcgacagacggacaggcaaacacacgaacagacttaacggaccccgcctccgtttcgtccgtcctttctgcctgccatgcagctgcttgggctgcgcgtacccgggagcgcttccgtgttttctcccgaattctgcgagacagactgggaaaaaagttccgggaggtggcaacagtggaaaagaatcaatcgaaagagagaaaaacgacagaaagttcggcgccgctgccacagtgtggtgaccacgtcacagacccgcacagcgagccggcaaccagaatctgaaacagctacgtatcccaattgcctaccccgataacttcaaggtataaaagtgagaaaatcaccgattcatgtggatctcgcattttaggatgcttcagagttctccaccatcgggaaaaccaacaggaggatgctcacggaacctgtcttttgacggcgggctccgcgcggcttcaagggagacttgtcaactggaagcagatgcatatctcgaccttttttttaaacgctccgagtctcgaagaagggtgcagagaaacaggtgaccgatgtcgtatctttctcatctgcgaccacgctgggtgcccaagcgcatgcgccgacggcacggcaaacgaaacggtgaaaacccacccgtgcttcagctgcttttgctcacaactttgcctgagaaggtgaagcaaaaatggaaggcaagacagtgacaggcgaaagtctccacagagcgtcgctatcggcggtaatgttcaactccgagactgatacggagctgcctgtcagagggctgcatgcacacggaaggatgaggtcatgtcaagcacaactgcaacgtggatttctcggatgcagccgaaacgctaacttctttcgataaacactgtctcgctgaaggttactctttgccgttttaagaaacaggagttcctattcgagcaggagcgtctctccagcactgtcgtcttctatatgatcagttcgggagtcttagtccacttcatacaggaggaaaacatctccgcgccgatacttttcacttccatgatgcagggaagattaaacagacagacgccgctttctctttctgcgaacaggattccggtgttcttgcgacatagtccaccggcgaataggcggagaactgagggtctaatcgaacagagtttagcagcagagctgtaaaagcggctgaggtacactatcgacttgccgcattcttggacgaaaacacatcgaccttaggaggtacagggaagcactgtccgcagggtcaaaatatagctcggcagggcaatgcctgagagtcgatatccgctgtagtctaggtggttaggatacgcggctctcacccgcgcgacccgggttcaagtcccggcggcggaatatacgtttgtttccgttgttgcgttcccctcactatcatttttgcattatgtcaagtccaatgcggatcagctccattctctcttcgcatctcaggaatacttgtatgggcctcaccggttggtgatcctcagtctgtcatggctgcaggtgccccctgtgtgtcccatattcggtacgcaagccgccagtggattcgtgtgcctcatgtattcccgaaccgaatgtttggccataggcattgcgaatatggcgatttctgtgcgcggaaccgtgtacagcatccagagatgggatcacatcattgttttccgtcctttctgttgctgcagggctatcgatgcttcggtggctcctggaccacttttgtccgataatggagctgctgtggaggaaatggaacttgagagaaaacgcaagcgatttcagaattggtcactgtggaaaatatggataaactggatgagaacgtaaatcgtttgaggaaaagtggatgggtcaatccatccgctgtagtataggtagttaggatacgcggctctcacccgcgtgacccgggttcaatttctacattatatgaaacacggatactttttcttcaaaaggctcttgcagattattgagtgacttgtgtaccaggcgcagctgtgtttgttaggtgcgtgttcgtgcctctctggtggtaatccaccaatcagaaaacat

SEQ ID NO: 2799 - DNA, 1730 bp, Toxoplasma gondii
aattcgacaaggctacgggcgatatattgatttacagaatgcttcgtcttgaaggaaatggccaaaaatgcgacatcgcaaacctctatggaacaatgcttagtgtctggaatcccctaggcagcaaaaaatatggatacgactgagctgggcctttatctcagtagcctatacctttctctaggctaggacacgcaaacattctataggttcaaataagtcagtcccgagatcactccttaaatggtggctcccaccttgcagtactcacctgtgtgttccctccgctaacatacaggacgacagggttcgcgcaacccgttaccagtcggcccatctcgatatgtgccacgcagtggtttacagccactagaggaatattccagagcagtgacaaggttcgtgctgtgatggcaccgactgccagtggaccacccatgcctggcccgcaagtataggcgatgcaactcagctgcttcggctccacacgcgcctcggtgagggctcttctgactagtcccacaattttcccttgatgatgtgctgccgtttctcgaggcaggaagcccgtgccggggggagtgataaaggtctcccgagggtttgataagatatcgccatctgatgaaacaattccgacgccgaccttgtttgcgctgctctcaattcccaggcacaacaaagagccagacggcagacaccgaccgcttgaatgtggcgaggaacacctttccaggaggggttcaacaactcctggagcagtcatcttgagttcccgtgatcgttagagcctttcgccacaatcccaggctcgttctccctccagtgcttcaccagcctgggtgccaagcttctacagtgcctcctttgttcctcacgtcgcctcccaaagagttgctcgcgtcaaaggcaaaagccgagtcaactcagctgaccccaggtgctcggcgttggataacacgtaccaccaccacggggaaaattgagtgcaccggctacgatactttctggtaccgatcctcaatattaacgggcagagggaacatgcccattaaagaatgcccaaaccacgccgtcctcgagagttgctgcaaaaacccacaaaatgggaaaatgtgtaaacggttcgctttcgataactaggttggaagacaaacccactatttttcgccaacgctgacgaaaacactgtcaggtgtataagcgttgatcgtaatccggcagcagctcattggtgttgagagtatgtcagaaccgacccacataaaattactgcgacgcaacccgaaggcaagcgggattttacccaagcaaattaccttacgcatgcagcgtgccgcccttgcgtctcagtagcatgcatcttaaacgattaaggacctctgggactctacaaaatatacctatgggtgctatcatgtctgactgagttttaatagatcccatattagacaacactcgtttatcaggaaaaaaaatcattcgctggtgtgattttgcggcaacgacagaggcgcgtccgccacggcatgcttggcaaaaatgttaccacgtgcatgcagatatgacttctaatgtatctgttctcttgaggatcgagttctctgatcctctcgacgtttccatgtcaccattctacagtacacgttgtgatttggttctttcgcctcgccagtccatagtagcagcctccataaagctaatggaaagccggtcaagctaaacatcat

SEQ ID NO: 2800 - DNA, 3711 bp, Toxoplasma gondii
cagagcgcggactgtgcccatttcatgtttagccatacgcttttgtagttgtatgtaaatactttcgtatcgattgaacaaaagaaggtgcgtgcccttattcttcagtgactgacgcagagtggaacacttttgagcagtttgtttcaaatcaagtctcctttcttcttttcaaaacgtcatttgtgtggaagcctgtaatggaaaaatgatgaaagccccaatgtctggccaattcatctggcgttcaaacggctctctccgcgatgaattgcacgctggattgcgaactgcacgacagcgactgattgccggcgaattcgcctgtaactccgaacgccgcagcctttcccgctatgacaatacgaaggagaggctggtggaaaacaacgagtaaaaactattcggtcagttttaacaatgccgccagtcgtgacgacacgcttcttgcgtatcccggccactattttggatactgtgagggttagtggggctggacttttgtgatcattcacagtgccaccgacctacggcacgccgctgtgaaaacttgatcattcacggccagggcaccgaaagtctttgaggtgtactgcgttttgctgacgcataatatgtacccgctacgatcggggtatttgaaccttttccgtaggaactaacaagtacaccaggacactgttgcacttgattcccgatattctcagtgcaaaagcataagcaaataaagaatgatatccaatcattacgaagcaacgtgcatttttgcgagaaagggactacaacggattggtgaaaacatggaatctcttcagaacccgcggactcccgatgtgtgatttcgactttctgtacactttcgtctgacttctgtattgacttatgaactgagggaatcacatcattcagcaacgcaaaaataataggttaactgtgcagaaacatctcctgcatgaagagcgaaacgacgagagcttcattgggtcaatatgtcccacgaagggaatccaacatgagggtggtgaacagaaagcattacgcggcagaaggtccgaattgatagatccagaacttctggtaccaagtctttatatggtttcgtaagtactcttggaaagatgaaaaatccagggaatttgagatctattcagtaggttcgcccacgtagaaaagaccacggtgtgcaaacatttgtttttgcgatctggccccgattttcgtcgacccagttacatggttctgtgaaaccttggaccattatctcagcgtatgccccgacatctgtggaaaagtctaaacagatccgcgtttccctttcataagccgagcagtctaacagcgctgagtcggtccactatgccccatgcatcaataagccactgacacccatgtcgtcgtctgttcttttgtttctgaagcgtaattcttgccctcggatccgttcgacaaagcacaatgtcaggacgagttgttacagacgaggtcatcgcaaaacatgaagtatgaagctgccgttatgcgcccacaatttctgtggtccttttttcacgaactgaaatagcggcactcgcatgcgttgcgggaaacaaagttggctgaaaacacaccagcgaatgtaccagggtaccaaaaatttccgtactagctgggaatgatgaatagccacaacaaaatcgatcacaagagcaccactccgtaaacaccgcatagcacagcgcccaactgacttctcactgtggtacaaaatttctgtaagcgcttttaagcaagttgattacatccgtatcaagagccagatgcggatctgtgtaccctacgttgctgccatgtcaacacactttttccaagaagatacgccaacacgaagaaggtttcgcagcgttgtcatccctctttttctctcgctccttctacgcatgtgctgcagaagagactccgacgatgtgaggccactgcacagctggaaagagcggcagttcggaaagctgaagcagctgtaagcgtttgagtgagaaaacatggggaagcgacaacacaagcagctcatcatccgatcaaacattattcatttgttacataaaggagatacggagtgaacggtcctgctgaaaagcacacgtcagggacctcgaaccaccattcactgaatggaaacttttgaggcatacaaacttctgttcgtgaaacgggatcattgctcgcggatgatccccggaagcctaatgctcaagaacagctgtttctcaaaatgagtacatcatcgcggagtacaacgagtcgcctggaaagaaaccgttcccgtttacctctaggcccacaacttcacccttgtgtttctgtcaaactgttcgttcaggcagaagatgccgcagagagggcgagacaagtgaagcaggatattcaggagatgatacggatgaaagagagagagttccggaaacagtgtacagtaatgtgaacgattcatatgcatgaagtgattctgactctgtctttttcgtcagcgacgttctgattgcatatcttgactcacggcaatatctgcaaatttggcatcttgtttatgtgccgcctttatagtagaaaccttgcgttccggcttcagcagttcagtgtggcagtggtgtacaaccatcatgaggaaattggtcgcctgcgcctcataacgggtgtcttgctccgacatgtgctaccacagtgccatatggagcagcagcagcgatgcgatctataagcatgctagacgttctgttacaccttgtggaatggaattcctaggatttttggaagtgcatataccacgaggtggactattggtgtagttaagcgtgaacaggcggcatcatgtctacacaacttgttccccaacgacgattcctcaagggtctgccgccaggaagatatgctttccccgcatcctcactgaccccccaaaataatcactgcttcagaagggttccttctagaggctcctccacgtacatcttattgggcgagtgctgccatcaaacacgagggcgcaaatatttccgtattgccgacacggtcctgctggacggttgccaataaaccttgctgtgcatcttcaaaacaaataaatgagcttgagtttcgtctagtgactagtattcgaataacccgcgtcgaagaagaatttccaccaggctgcttaactcttcagagacattttgaaggcgctacagagtttcaggcatctgcgctcacattgacgggactgctctcagtgtcattgttaccatccatcgctcgcacttgctttaaataggacttatgcacgaacggaagactcggaaaaaccagaacgcgtgtcaaaagaggtaccggcttgccattttgttcgcctatccgtaccgacgggaggaatcacacctgaaattcgataagcatatcgtactagaacagcctttcctagccggtttccatcgtaattggccgtgataatattcaacacatgatggtctagtaggttctgttcgatgactgattctctaaatcccgcacatctgacactttcccctcacgagtcattcgaacacggcaaagatggtaacgtgagaaagtttgcctccaatagtggcatgagataggtctttttatctgagaatcctgtttgctccatcgtaccgaagctgctgccctgtgtggaaacatgatgtcgcttttcgcgactacccgttgaagagtcaaata

SEQ ID NO: 2801 - DNA, 2049 bp, Toxoplasma gondii
atgaagaggtgaagagatgcaaatcgagatacgcaacgttggtgtatcgacgaaatagatcgagataggtatatgcatatatgcatatatacactgagacggagttaagaaggttcatatgcggatagagggataggtatttatgtatgtatgaatatatatatatatatatatatatatatatatatatatgcatattgcgaatagagagataacagatgcatgtatatttgcgtaggtggagttaggtatacatttgtgtgtgtggattgatgcatgtagatgtctacggatggtaaaaggaggagagtggagagagatgcagaaacggataaaggcggccaaaggaattaacagatatcacatggtaaatgtagaagcctttatacctcgttggtgtggagacaaatgagtgaaagacaagtgaaggatgtatcctttttgaggcagtgggatagcaagagagaaaaccacaaatgattaagtcactctgcccgaggcttcttgagaacaccccagagccagcgtgaggcctcaacccccccccctccccgctgcccaccgaccgccatatactcgagcgcgaagtgttgcttccgtttgtagatgtcagttaaaagtagtctaaacgaacacaggaactctgacattcacaggctgtccatccgcgattcgacaagcgacaaagccgctctcctcgttctccaccgtcaacgctccctcgccttgaaggcgctcccccgccgtccagcggacagacaactaccgccgccttcaagacaaaaacgctgaagggaggaggagaacgactacgcctgccgttttcgtttttggagagcgtaaaacttcggtggttcttcttcttggccgtctccttctctgtcggctttccaggtttttttcgtttcttctatcgcgtgtatagtccacgccaggcgagtctcgcgccggccctttgctctggcgaggaaaagttgcaggtttcaaaggcgctccttggctgcgcaatttatatgctggaagttcttcagcgaaaaaacaaaaatgtgccgatttccctctttctcttgacgcgtccatctctttttcttctcgcgtctggagtgatttacgctcccgcaagccgtttttcctctccgctcttgcgaagacaaagttgaaggaggtctccgacggctggtagcgatctgtgctgcatgagaacaagtgaaaagcggtgtagcgtagcgtaaaacagagacgttgagagaactttcatttgaatcaaggaggtctacaagacaacgcaaacatcagacgccatctgcacccccttgcgccgcgagaaacatatccacgacttttttgagtgtcttcagttcccttgtttctgttttattgtcctctttttctgttcgtcttcttcgctgatggcttctcgcgtctccggtgtctttctttcagcaagtcctccgcactatcagcgaaaattgtctctctttctcttctcgagttccatttttccgcgcgcgagaacagtctggcggaccggcgcgacgtcgcgactcctgctctgcttcttctcgcgttctcttctcccttctctcgcctcctcgcctttgtgagcattcaccgcgggatgaaggaaacggagaggccgacagcgaggagcgaaacaaattctcaattcctcaggagacactgggctgaaacgcagagccgcggcttctcccccggccattggaaactctgctctcacagctctccttcccctctccctacaccttgcgtcgcatgttccttctcctgctgtaattggtgccctctccatcattaatcatcaccctctctctcctctctctccttcctctttctcttctcctctctctctccttcttcctctttctcttctcctctctctctccttcttcctctttctcttctcctctctctctccttcttcctctttctcttctcctctttctcttctcctctttctttctccttctctctcttcgttcctcttccccccaccggtttccctctctcctgccttgttttcttctacga

SEQ ID NO: 2802 - DNA, 1571 bp, Toxoplasma gondii
cgaactgacgagtgacttccggctcgcctctgaacacaaaacctcgggaggcggatgtcgaaacgcagacagcttcgtctcgtctgaatcgaccagaggcctcctccccctccccccccccgaggctctccacaccgcggtgacttgtctgtgcgcttctctccgtcaaagccagactcttcacaaagtgaagcagctgtctccccagagacttacaatgcatgcgcagacaatgccgccgacgtctcggttgaaccaaactgtcccgccgaccacaggtgtaccctgaggatgaggctggaaggacaactccattctctggatgtgaaattgaaaaaagtctctgaaaaagcatagccggctggaagaccctcgcggcgacgcctctcctctgtgatctgtcttcaagttcctctctccctcattgtgcctcgaacgtgtgtcgaatgcccttgttctctccttccttcttgttctctcttttcttcttgttctctccttccttcttgttctctcttttcttcttgttctctctttccttcctgttctcgcctttcttcctgttctcgcctttcttcttgttctcctcttctcttggttcctgctctacggttcctgttctcctcgtctcgctattccttctccccccccccggtgcttccttcggctcttctctcctcgttccttggctctccttgtctccttctcttcttctctcctcctgctgtctaccgcctactgcttctttccggcctcggtctctcttctttcaggtgcgaagagacgccgcagcgagcaacatgcaggcgcgaagatagtggcaaacgctgcgttgggctctcctccttctgtctagtcccccgttcagtctgaaaagtcagaaagctccccgcctgcgaaagcaacgactgctttctgctttcgctgcgaagaagaggcggctctgaaaaggacaaagacgacgaggggggcggcttgaggtcgtctccacgtggactctcgcatgaggattgagatcgccctcggctgacgcgccgctggcttgtagactcgcagagacagaaaacaacgaaaatgtgcagagacgagagaaaagaggagggaacagagacagacaaagagagagagaagacacaggcggtcctctctccgcgtaggcctcgcgcgagcctcgttacctcttctccgctttgtccccctatgtgaggaataaatcgaagtttttcatctcctctgaaaggcttcaggcagaaacaacgaaaaccggaaggattctggtgttttcccgtgacgctgagaatcacgagagtgtatctggcgacgctagttcaacttttcgcgcaaaaaagctacgcgagaggaaacagaagacacacactcgacgagacgagactagccgacgaagcaaacgagataaaaaacgcgtcgttttttagagtgctttgttctgcgcccttcctcgatttctggccattttcgcgtctttcctcttcatcttccttcgctctttctttcgccttcaacgactcttccacctcgtctttctcttgtggcacacccgacaaaaagca

SEQ ID NO: 2803 - DNA, 1384 bp, Toxoplasma gondii
cattcgcctcttcgatgatcggcactgcacaggtcggcgaaacgttgaagcgcggccggaggaagtcgagagaagacgtttcttctcccgaacacagtaccccagaggagcgagaagaagcagagagagaggacgaagaagagagagatgacggggaaggagagcgacagcctgcggaacttttggactcgagtttgatgtcgacttttcctttcttttcctcagtttttgtcggaggagagagtgtggcggagggagagagagaagaggcattttcagtcgcttcctcctgtttaacgcgctggagaggctccgcgctcgcagcggcctgggcgtctccctctccctctttcttgtctcgctgctcagaaggcgacgaccgagacaaaggcgcgagaccagcgacccgacggagacgccgtggatgcaaagtgcagctcatgcgtccgcacatctcggcgagcagcgaagccttgcggagacgcgcatcgcatgcaagctccggcagagctcccagagttgcaaatgccagcaaacctgcgaactcgcatgtatggcgggcagacagccgagcaacgacggagagcagaggagcagagggaggagagggaggagacaggaaaggaacgagagaagagactccctttagccgtggctgccagctcagacgccctcaagctcaactcgacagacctgagggcggaagaagcaagaccgggaggacgccttctgaccgacaggacgaaaagagagacaacttgggcgccgcgctttcacaaagcaaggaagagtttgggagaaataaagaggcggaaaagcgactcaaaagaacagcgttgaggcgcagagtctcaacggggtgtcgtgaagcggtttgaaagagtcgctctcgaaagagccaccggagcggaacaacgaggaaggaggaaagagcgcgtttctacacaataaaaaatgaaccagagagaacaagaggaggaagatgcaaagctcgccgctgacttcgttcgctggacaagaacgagtctacacactcggtcgcgcaacggctagacacggcagagctgtccagaccagcgactgggtcggttatccatacatccctcgcgttttgtgtacagtcaaagctctgtctgttcatttggcgctttgctgtttttcctctcgcctctgcgactcttctccgagagaagttcaaggattgtgccgagtctcgacgagtgctgtggcacccgcgcggccgccagctcgcccgccgcatgcagtcggggcgggtggaacggaatataagccgcgaagagagagggtgaaagtggagagaagtccagagagaaaggcgcaaaggcgccgaggctcgagaagacccccactcttctttgcgtga

SEQ ID NO: 2804 - DNA, 1606 bp, Toxoplasma gondii
atgcatcgaatgccgagaaccaacagacacccgtgacaggcttcggtggggagctttcttgagtccttctttgttttttttgtgtcatacattcgggtatcaccatagcttaccgtttggactttctgagatattctgttgcaactcacaccagacagtacgcaaagaaattggaggacccaggatacttgcactactactccgcaagcttctctctctctctaggcatgaatccgtctgcccgcccgatacaaacatgcatgcatagatgcatacgcatgaataggtttatatgcaggcagcggtgttgtgtatgtttctacgcgtggaactcactgctctctgtcgatacgccgccttctttggcttgaggactcctgcgctgtcttgccccccaactgcagccgcatcttgcatgcaagaggaagaacaagctgaagaggaggaggcagagagagaagagtctagggagttggtgagacaggcaggttccattgagctgtgcagcgtcgcagtcctttcgagagaatgcaaacgcatgtctgtttcgccgtcaggaagccgaagaagcagtcggcgaagaaaggcaagatgctgacgaaggaggtcagacggaggaagagaggaagaagagcaagaacaaaagagaagaagagagagcaacgacagagggaagaagagggagcaatgtcagagagggaagattcgggggtcgagaaagagctggaggagaagcaagactaaagaagctcccccctgcgtcacggactgttcttttacaaggatcaaagaagacgcagacgaacgtgagagaagacgaagatgtacatacaaaggaaaacggaggggaggaaaaaaaatctttgatcttagtctgggtgtgcctcgaggatcccctcgactcgttatcgtcgccgccaaaactggaaggccttcctgacggagttccttcagagcccctcagagggacagtgagacgcatgcaaaggcgcaagttatatttgaattattacaagctcatgtctttatgaacatttaaataaatactttaaaaaagtagagtgcatgcaagtgcatgcaaagcctcatgcaacgcgacggacgcgagaacgcggagacagggcagttgaacagagggcgtgagagcgggagccgcttttgtgcaaagcgtcgagactgatgaatgattgaaggaacgcagtgggtggaaacaaaggcctgaaaaaacttgttcattcatgcctgtgactcagacgaaaagggtgcccggctgttcttaccgagcgtcgctacgccgcagcgctggccctcgagtctctttctctctttctctttgctgaccgaggaagtctgggaagagtcgccgagaaagctcaaagagaacaacagagagaggacgaacaaagagaagcaaatggctgcgggaagctcaacggcgagaggaaaaacgaagggcaacgcagagaactggaaaggagcgaagaacaagggagagagaagacgcgagagaggcaaagggtcgagcctttctctcgcgaagacttggaattttgactcgagtacccgaagcgctgtatcgtcgtcctttccccactgcctcacctca

SEQ ID NO: 2805 - DNA, 2881 bp, Toxoplasma gondii
aaaattcaggaaggcacagcagcgcttctgcatgcacaggtgaaacatgcggaagagacgagcgagagcaagcaggcagtccccacctgcagtatgtagacagcgcatggagcgatgatttgctattgtgatttgttcgctttttcggtgtgccgacactggcgtgagagaggcatctcgttcaccaagaaggacaggcactgcgtgaggcctcgagagaaaaatctttttccgcgcggaggaacagaacgagtctgtatctcgtgacaggcaggagtcctagggaagcataggagacagaagcaatgctgcaggcagcacagtttaactctggagaaacgagcacaaaggaaatcctttttaaatagatatccagggagagatgccaagtgccttctccgtacgtcgtcgctccctgcgtactctaaagtcgacgaatggctctagacagtagagactcagctttccctgttttccaaacttcacactaggcagcgctgcggtgcttgtcgttgaggaatcgacgaatgcttgttactgttgttctacttgcctcctgtcgctcgtctttgcgtggaagcgcgtccacgaatatagcgctagaaaacagccgacagttcgtcagaaacagagagaaagagctcgacagagtccgcaacgagaaggggaggtcgctgcaactcgacagttcctgttgcccatctccctctctccgtgtcgattctcgttgtctatcacaagaaacgagggaagcctttgcgcagcaaggttacgctcattagacgcgttgacatcctaggtgttgaatcgtatctgcgggacgttcagaaatccgcagagttgccccagagacacaatcgatccgtctgcggagacagcaaaggcccccttacaggaggcactctgatgagagcccagggtcgctgtgttggtggttttcatggcttttaattggcacacagcgaacaactctttcgggaacagcagactgcgacgctccctcgaacgcgccttcgaggtgagagaaaacatgacacacctctttctccaagtcaccatgaacgctctgaaaaacactcaacgccattgacatatatacacaatatatatgtatacacatatatctatgtatatatatatatatatatatatatatatatggtgtggggttctgcggctttgtttggttgtgcatgcagcggatatttgtgttcatgatatgtttgtgaaactgctgcacagggcgcgtaggtggagggcgttagtctccgccgtatagagcccgatggtcttggggataattcactcccgctgtgaggaacatgcgtcagatgaagagtgcgaagcaccgaggagcggcctcaaacctctcctctaaggagaagctttctcttcaagatagacggcgaagctggtcatcagaaccgcgtatggctttttattatgcgtttttttcaagacccacaaaaacagaaaggaagcgccagtcacaagccagccaagcgagcatggtctagtggctatgacgctcgcctcacacgcgagaggtcccgggttcgatccccggtgctcgtatttattgttaatctttcctcctggagcacaaggactttttgattgttcagaaaaaggtggattgacgctacagcgtattctctcgagagtcatcggcaacaggtctttttttaacggagtgtttccccccttggtcgcccagggatgacgcgggagcggggttgccatccaagcggcaactcaatcattttccggagtcgaacgaggaagatactctcttcttcggctacatgtcacggcgtcagtctctctcaaagtctctgccgccagtctttgtgagttgttcagcctctcgtctccatcgaaagaacgcaaactgtgtccgtgctcgtccgctgtcttaccgtcgggtgtagggcccgaaggagagagagacaccgtaccaaaggactgggagcagcctcgccgtctctctctgttcttctcgcgcctaagtttcctcttgcgttcttccgttcagtcctcttatggacgagtgaagctcttctcgacgagaagataacaggggttcgttgcgtcgcggcactgcgcgttgtggagacagagagacaccgggaaacgcacaccttggagcagacgctcccgctcgctgcgcatccagagagagaaacgaggcagagtcttctctcctcacttgttcagcaaacaaagatggaacttccagcgagacacggttctcgtccacgctccgttttccctctcctcctctttgtgtacccctctgtgccggcgagttcgctcgaccgtcctgtctgacaagacacaagggcgcgtcgtggagaacagacccaaacaggagggtcgaggcttgcttctggaccccagggttttcgaattttctcgtctctgtctccgcagccagcggaaaaaattcgccgattctgacggatggataccccaacagcctgcacaccacagaatgagaacgttcgctgcctacgcggcgggtcgcaccatacgtcttcctttttccccctttgattcagtctaaagcagacactctctccgatccgcgacgataccttgccttctccctcggctccgaacctgctcttccctaccttcttcgctgccgtgtttcctccctctcctcttgtccccatagtctgcgtctcgttccttcgcggctgtcggcttttgacctccctcttgttctccgcgtacttattcctcccgtttcctctcttcttttctccctcctgttctctctcttcttctctccctccagcttctctgtggctggttctcccgcgtcgcggcctcctctgtgtgcggccggtggctgtcgggtccttcttcgtcgcta

SEQ ID NO: 2806 - DNA, 2280 bp, Toxoplasma gondii
aatcgtcatgatgttcaattcggcaatcttcttcctgatggtcgtctgacggagtgcacgaatcacattcctgggggcttgtcggcttttttcaggcactcgaggaattgcttttgcgcatgttacgtttggaagttctctggtcgttactctttttagccggtgggaagtgaacggtgcagataacagtagactgtacgttagcgacgagatgccggtcaacagtgcgtgcaggagctgtgctgtgcagtaacgatggaaaaactgcggcgacttatctgcgcttgtcagtcggtatctcacagaaatgccggagaaaatctggaaggcttgtagtgttttgtctgtctctgttgtagggcggagcagagatgatcatgcgagcgcgattcacgtcgtcatcaccggtgacagcgtctgcagcgtaccgcaaggaattcggtccaatcagcatgacgttcgagatcccgatgttcaatgtgtcaaatctgcaggtacgttttttgaaatcggagtgcgtgtttgcaatgtagactcgctttccttcctgcctcctcgtgtttttcacaaatctacggattttgcctcggacagctgaacgcgaatgtgcccccacccgtccctgttacgcactcccgacgaggaaagatacgctcgaccgaggatcgcttcgtcgttcgcgcttccgagtttgcatttcagagcaagtgaagagaaacatgaggtgggcgaaaaggacacgagcagaagtggaaaacaacggaacagaagaattgcttaaagttgcgtcttgcgtgcgtggccggtggtctttttcggcggatggagaattgtgggatacaaatgccgtttacaagagatgaaggagaattctctgaagacagaagtacggatgctgttgtacaactcgataagccccatacaatgtcgctgttgtggtggtctacgctgttctccctgttcaggtgcgctacctgcggatcgccgagaagaacggagtcgcgagtccattccgctgggtccgctatgtcacccagtcttcctcgtacatttgccgggtgtgattcttttctatcctttttcaagcttcttggaccatgtggaatctttggaccgaaatataagtgttcagaacttcttgctggtccacagaacgctcaggaatgtcaatatgtgcaggcgtgttggttacgatttcccacacctctagccaccgacttctaaaagtgcttgttagcgaatgagaaacttaaagatgtggatggaatcatctgtctgagaattgtttttggaatggcacaacgtcgcacgcagtcacgcgttcatctttgccatgcggtacgtatgcgcttgtcggctactctctgttttttgttcaccaagtgtcatttccacaccggttatgttctaggcgtaatagatggattatggttattgctcgtattaaccgctagagaaaactcctcctcaaatgctagtatgatcggtaacatcgttggcttttagcctattcaaactactgcagacgtattacatccaccatgagaacgcgttaagacggtatgcatcctgagtcgagtcaactactggcagcacatcgcctttcggcgttgtctcgttctcttgtcagtaaaacgagatgcaacgcttgatgcgcacgtggcaagtgccgcaaagtttttgctcagctcttctgagataatacccggccagcggtcctgaatgcccctgcttgttctttcgccgttagtgtgaccttaaagctcgataagccatagacgaatcgtccaactgaattcggtatgcatttggcatccatcattgaagtatgtggagaaaggcaactttaagagcggcgtctacaaccgcatggttagttagagccatttaaatgtgagtaaagggtacgtgaaacttagagtcaaggggatgagtgctacgtagacatattcgcagtggttgagatgtgtgtcacgaacgaagcgacggcatggcgcgtgatctgaacagagtccaagaagctccagtgacggaaactggctccacacactttgtagaagctggcaagtataaccgtgtaactctggcaacgtacaaaagcacgcacgagaagtcgttgctgcgaatgcaagtcgaggaaaatcagggaacgaataaacacaggacccggacaggcactaccgcacacggcagaatagcgatatcgaccgcggagtcgatacaaacctgaactgccacaagtggctctgacgaccacgcttctggcgaccaagggtttcg

SEQ ID NO: 2807 - DNA, 2339 bp, Toxoplasma gondii
gttcagtggcgtttagtcaagtcacttttatagaggacttcccgaagaagactcgcagccgcgaaagctcggtttcttcttgggagggtccggggctgcgttgtttgcgcctcgaggtgctcttgtgtcgacggcagacttctctggttaaagaaagttctgcagcctccgttggaaagtgtactccatggtgaacgaacttttttgacgggtgataaagaactcttttcagggatctgaccccacaagttagctgcgtcttgtattccggtgtacatacaccggggtttttgccagtacgaggggcaaccgccggttcagacgcgtctttcacgcagcctcatgaatggctttttgtgaacacttcctcacacgaaatggaaccaaacatcattcaggataatagtccgcgagttccacgaggtcaccttcatgattgcacgccggtaaaacgggtttttcacgtcaaaggttgccgattctatcgttgaacatgagcacctgtgcgtagcatctgcgcaagtgtcgtgctactcactgacactttctgggcaaagcgtgtctgtggcgcagacatcagcaaacgagattttctgtcacccactgctagggagaagtttctccgccggctgcaattctcaacacttcgattctggattttctctcactgtacttgattaatttgcaccgtcgcccgtgaaatgcaaaactgcccagaaagtcagaactgtcgatcccacggcacgtggcacagaagctcccggtgtgtcacaggacttggtgaatcgggccctgtctctgatggccttctaagtctctaacataccttttacctacaactgtacggaacgtaacaaacctccaggcaaagaacttgatattgttctaattccccgtggtaaacacaaaaatatacagagcactacggttgagattcaaccgtgtgcacccgagccgtcagagcgaagagttgtcgggtctcgaattcctacatcgacataagaagtacagagagaaatgggtgtgaatgtgcgacacagttcgttctgagattggtttgggacagcgttaacactgtgtactaggctacaatgtagtgttcaggtacgacaccgcttggttgtctggtatagtctcgtatttccttactacagcggctgccttcctcggatatgtcctaccacggggacgaaagagtttctcgggtgctccactcatgccactcactttgaagcacaggcctggtacaaataccgtgtgtttcgaggtgcgcgtatttgccgaaagttgcaggtcacgtcttcatgtacttctaccaccgataggtgtcagcagaccaaaggtatgccttccacaaactcgtctttgccgcagaactcgagggcgaagagccaggacccagagccgtggaacgggtctgggccaagtgtggcttgcacgctgtcgcttccgagtgtgcaaaaacttcacggccgcatacttcaacgctccaccctcctgaacgtgctcacactcactttgtttccttggcttgtgcgtttgaatctttgtttccaactggctttttcctgctgcacgcgccactctgtcggtccacacagctgcggtgcatgcgaccgttttccgcgtggagtcggactttcgctgtatttgcttctggggggctcgagttttctccccgggtctcgacccctttgcccgggctcgtgtagtgtctggtaaaagtagatgtttagcggcttctcggaatgcaccaccgagatttccgcacgcgcatgcactccgttctgcgaccgtgcgagcgggaggccgtcacctggggttcgcggggacacggtgtcccctactaaaaggcgagggtgaagtgcgttgttttcgcagtcggtggcggcgaaaaagttgggggattgtcggctcttctctctgtgcaaattgcgtgtcggctcagaacgcgacaaagacatctcgcgagacgatttgcttgcgcccgtgaaaattcgaggtccaaatcatctttcgaggcgtcctgggcatggtcgcatctgtggtgtatgtatgtatatgtgcgtgtggcatgtgcgcgcctatccgcttttcttcgcgtcctttctcagtctcgcgcctcgtccttttcctgtgcgcttctcgatctcgcgtttcctcgccgtctctctgactgtgttctctgccccgtctgtcgcgtacggcgaggacctggagcacgcaggctggcattcggactctctgcgtggagagtctctttcctgagtgccgcgttttctcgcgaaacacccacttggtcgaccgcgattctctgtctgtccaccgcgttggcaaaa

SEQ ID NO: 2808 - DNA, 2703 bp, Toxoplasma gondii
tctctgtgacaaccttttctttcagttctctcctctctcctggtctcttcctctctctgcgcctttctcccttcccccttcggcgcccccgctgcccgctctcggccgtttccccctacctctttctctgtctcctcttcctctccgtggcctggcagccccccacacacagctctcgtttcttccccgcccatgtcgcctctttctcaccgagagcttctcgcttggcagctttcgcagcttccttcgctgcctccttttctgcctttttctgcgccttcttcgacacgggcgcctcggctacctccgcgaccgagggcgccgcctcctctcgcttcggcgtctcttccggcatggggggcggcagagaagacaaacaggaaaacgcacggaggagagacggtgttgtcggcgaagaagaaaccgaaacagctgaaggcatgcgcctgtcgacctctgctgagtgacccgcgagagaggaacagcgagcagaggagaggggaagactccgtggcctgaggagggcgctggacgaacggaaccgcgagacgcctatgaaggagacacttggtttcaacgcctttgtggggagtgaagagaagcagcgagaagtcacgggcgctctagctgaagaaggcgagacagaagtgaagcaaagagaagaagaaggaagaacgcgcattcgccagttctctttgtttctgccaaagcagcggtcgccgggttcggcggcagcgaaagcagaagagcgaaacggactcctcctacgagcagcacaagacgagagaaaagaagcagagagagaagagagccaaggaacgagaggtgcagaagggggagagctggaaagctcagaaactcccgacgagcgcagcggggagaaaggagaggaagtcgagaggaaaaagcgagaagcgggccgttgctgaggcaaaaaaacttcttcagtgtcgatgagaaacaaagagaagataaagagaatcggagcgaaacggaacggtggaaatcgcatgcagagagaacagagaccgtctctctccatggactgcgttatcagctctggaaatcgtctgatccgcactagagaagtgaaaaaagttgcggtttgcgccttgtttctgtgtggctacatgcacatctcttcttcagactgaaggccaaagagagcacgaaaaaagaagaaggcacagggaaaagtcaaaagaaatggggggcggagacggccgtcgcgaagcagcgacggacccagcgcgttccacggagtactcatacaccctccaggaaaaaagtgaaagaggacgcggctctccacgctcagacgccacaagcgagaacaggaaagaaaacaaaggagaaaacgagggagaacaagcagcggagatgctgtgttggtcgcccccctgtctctgtgcgcacagtcgactcagcgggcattctcggcgcgtatgttcacctccgagggatcccagaaaacaaaaaaaagaaatagaatacagagaagaaaatttcccggtctccatcggagaagacacacctgcgcttctctctgggctgtttgcgtcgaatccaatgagtctccgcgtttcgtctcccgcagagccgacggactgttgttcggacattgttttccgaatataaggcggtctcagcccctcctgagaagtgtcacccgctgaccgaaaaacgtttttcttccggcgcagagttttctctctccctcgcatccgccttttctcctcttgatggctgcgttcgcgttactccatgcgttttttccgcgtcgtgtatccggtatcctcggtcggtttccctcgctccgtcgaaggagatgcggcactgcaagccgcccggcgcgttcccgtccccggaatggcgtgaggccctgttcccatctttcctttgggttctgaaaagtcccgctttttccgagtttttcccccaagtttttgccgttttctctccgggtttgacgccgcacgcgcactcgcgcagccagagcgggtcttcgttgttctttactgttttgtgcggttttctctccctctcgtcgacgtcttctcgacgacgccctaaagcctttttcttccaattaaagcgcggaaacgttttttctctcccgagacacctgtgaatagccgaggcgccgcgacgcagcagactcgcagccggaacgcttgcctgcgaaaaacaagacccactgaaacagaaaactgaacattcgggcgcggtctatcgccattcactcgcaactgtcgtgaacctgctttgtagagacttcatcgcacgcgtctctagacatatgtaacctcccagagccttcaaaagtggaagtggaccctccctgcccataatgcgtaaatgcttctctgcaagtccggatgacgccgcgtgtcaccggctcgactgcttgcgtgtgtatgtggagattgcttccatcaatttggatgaattcgtcatctgaagactagctgcaactctttttttacgcatgcatgaacgtcttcttcgcgtggaaacggcgcgaggtctccggattgctcccgttctcttcgtcccctgtcgtcgttcgcgtcgctccttctgtgcgcagttctgtcgagacagtttctctccaatcaggtatcttcgccttgctcgttcgtgcactgtcagggggtcttggtcgaattcgtttccagttgtgacgatttctctgacgcagaa

SEQ ID NO: 2809 - DNA, 1241 bp, Toxoplasma gondii
agttaaacgattcgagacgggaaacactgacgcttgacaagtcctacctgtttaatcgagcctcctgcgccagcgtccagagaggcgtccgaaccatctgaggctccgacgctgcctcgaaatgtcttgactttccatccagcctgagaagctcccttctccccttcttcttctaggcttctcttcctgaaatctaaagcggacgacccttctgctggatttgttgacgagcagaaagatgacgaagcagatgaagaagcagatgatgatgatgctgatgatgatgatgatgatgaagaacgacagatccgccgaacaggtccatcagtcgggacaatgtaagtgacaacagtccccgaacatgaggcagagtcgagaggacaggatgacgagagagcggtcatggtaagagggaggctggaagtcgaaagagaagacagagacgagggaggagacagaaacgaccaggaaggatggcagggagacagaggaaggatacgaaaagaaaagaatgagaacaaacaaggagacaagaaagatggcttcgtcgagatttggaaggagagacggtagggtgggaacaagcgaaaaagtgacttctctttcctctgaatgagatgacgaagatggagagactgagggcagcgcgagagagccgcccagagacgaagaagatgcgttcgatgacgttgctggcaacaacacagagagtcggaaaaacaggggaagagagagcgaactgactaggtcaagccacgagcggcaatcgacacaccgtaatcggaacaagaaatccgaagcaaagtgcatgagaaacatacttcttcctgcctacgagttatcgctgttctctctcaccgcgagggtacggcgaagagacgatctcttttcagtgagtttttgaatgcgctccaatccgaggtgagaggagaaaagaggaaagtgactgaaacagacgagaagagacggcagacagcatctcgatgttcttgtctcctgtcgatattgatggaaataaccgcatgcgggcgcgactaccgcgatttgcattcgctcggacggcttctaggcagcgcttcttctgtctccgcttctgagagaaaaggaaaacgtatttttttaagtttgttaattttctggcgactcatcgcgccactccacaatatggagttctcgatggagttctcgacaggcacggttccaggtttttcaggtcgtgctgcgtttaacgcattgcccca

SEQ ID NO: 2810 - DNA, 2043 bp, Toxoplasma gondii
gtttcgcatgttttctcagtccctgctgcgtcgtcggacagcgacagaccatgtctcgcgcagcgaaagaagtcgaagaacagcgagaagaagaggaagaggagcaggaagacgaagaggcacaaacgcgaggaagggcagcggaagaggaacaaggagcagctgagaagccgagatgcgtgcgactggattggcgacgagaggcctgagagaggagagcgcgagaagaccgcgagcacggcgccagttgattctccaccgaaagttctgccgaattttgcggggacaaaagaggccgggccgcagaagaagcagcgagatgcgaagaagagagacgagaagaagaagaagcagcgagatgcgaagacgagagacgagaagcagaagaagcagcgagatgcgaagacgagagacgagaagcagaagagagacgagaagaagaaagacaggaggagtccgagtcatgtaggggggtggagagagaggtggggagacgcgtggaggagacaggtcgaaggacggtctctgacgcgtcggacgcgaggagagggcaacaggatggagaagaggaagcgagaaaagaaagaggcgctggatacgagggggaaacgggtgagcaggcctcctcaacggaccggagaaagtcaggaaaagcctccttcgaagaaagctgcggaagtcgcgaggcgaacttgaggcgtgtggcgcgtcctgccgcctctccaaactcctccattttctttcgccaaagaagagagcaaacgactaagactttagcatctgtaatagaagtcttttcactattaagtattacgaaagaaagtcgttttaaaatcttacgtaaagacaaagttttagagtgaagacgcgagagagacgaaacgagagagagcgcctccaagacaaaggagctgcggagctgagaccaagacggaactcacaaacagagagaaaaggcctcgtcctgcacagactctgcgaagggaagaaaccgttaaggacgtcccttggaaaggaagcaaagcagtttcttcagaggctttcctaacctccgttttctggggaggacattctgcgcgttcgcccaggtgaccgagagctgcgacaagaaggggagctgtcctgcgtttccggtcttcgcccttcacagtttctgcccagagtgcagccgacgtggactgacaagaatcaacagcacactgctggaagaaaaaagaatttgcatgcgttggcttgcagctcttgaaaatccgagcaagctgaatttaacgcgtgtatataatactcacgagaatgctcctcaaggtctgctgagacatgtatgtcgacttcctgcctgaaactcgccgcgagtctcagcgagaggacgccttctccgcgagagacagacgcagcgcggcttgtcttgtttcaagaaagaaaaaggaaattctacacatcctcctcggtcgttgctgcttcgccgacggtgacaggttcccttgtcgagacactgccagagcaagctgggggccgccttttcccttctcgcgcatgcgccgccggccagctgaatcttggcgcaagtggaaaaacgtttcgttttcttttttttccgggaaactggcactgtcttgacactccctcaagcgaatcgagaacatgcagaaagaaagcaagaggcgacaggcgagaggcgacaggcaggacgctttttcatccgtcgccttcatgttcgtctcctttctcttttctttagatgtgatcctctgcctccttaccagcctactcatctaatttgttcttctctctagcctctccatctctcttacacttcctctcgccttcactcttctctctgtctccttgtatgtcgtctgtttctttccgtcctcttgaattccggtcgatcttcgcctgtggtctccgcctaataccgtcgtccgttctcgctttcagaacttttgtgtttctttctctctcgcctcacatcgcgtcttcggcgaaagtctccactcttctcctctccacgtcctttatattcacttcttctttcctccgcaa

SEQ ID NO: 2811 - DNA, 2418 bp, Toxoplasma gondii
ttttgtagacgtcgacaaggagcagatgtgaccgattgttcaccagtctgcgtttcgtctctccggaggtcgtcacagggtttatgttcggcaggatgttcagtttttttccctggagctttctgggtctttcgtttctccgagacctcggtattcagtcacaaagaagggccgggggagtcgcgtatcgtttgtgtttctgccgaaacgtttctgacagcgttcacttcccggtctcgaaggcgaaactcggaacacctagccgagcaggtccgccgctccagaccatgtggtgacgctggcacttctgctcgcgtagtccagttcgctgtctccagatatcctgtttctctgctcaaagtttgttaaagatgtcgttctcctcgtcggcgaactgccggccctctttgcactcatctgacaagacggtccgtcgaaaccggaggacctgcgaattctctggaggccatttaccgctgccctttagaaagcaaacatgtgagatgcagagcacaccccgatacacaagtcacagggtccacagcttctccgttcctggccgtccacgcagctgggcagcatttctcttccaaccccgacgtaactttgacctttcgattttcgtagctgtcacgacgcgcgaaaatgcgcggaagtgctgaaccgagtttttcgaagaacagagagtggagtggcacagagacaagacaatttgagattctttcgtggacccccttcaccgggcgaccgttgtcggtttcagagaatttcgctcgcaggatggtggcgcctgtcccaacatgtgaggagcagtctgtatgcgcatgtgcacaacggtaagcaggtaagaatagagatgtgcatgtgtcgagagttgggttactgtctgcgagacttccgctccgagtacgctggctggctgtcatctacgctcgctgcgaggaggaacttgcgtgtctgtatcaggaaataaagaaaagagtcagcggcgagcttctccaccacaccccgaagacggggttgtgttcactaaaaccgcacagaaaacaaatgttggtcgcttgacgcacgggtgcgccgactgtacaagtgtaggacgtggaaatcgttttcgacgcttttcctttccgttcccagtctgacggcttcccggagtgtttcaaatagtgtacacacatttttgcgccgcagtttcccggtaaaagctttcgcagacgggtgagcacacatgcccgacttcttcgagactaacttgttttaaagtttcagcaagtccgactgctccacatctcgaaagcctgcatatgtgctgtatccatgtgatcctcagcgacctgtggcgagttttcttcactcacaccgctcgtcatttgcagtccacaagaacgatggcgaatcgcttttgcccagtcccttcgaaagaacctcagactgctgacgcagctctcgaggttcgctgcagctgcgtttctccggcaacttccgctggaaatccgggtggaaacagtcgcctctacagcgggcgaacctgccacagcagcctcatccttccggagttttgttctgcccattccaggcaaaagactgcttgaaaatatatgcctccagtgcgcgaggaccgacattactttctccaatccttaattcgacccgtttctccaataactgaattcgaacacacaacgagacaccccccgtcgagacaggaggcgtgactcctagccctcccttcccgtcgactcgagagtttcagattcgaagatcctgccggacagatagtggcagatcaccgagtcggcttgtttttcattttcttcccaagaaaattgtgcgagaaatccagagagatggttttttgccgcggcttttacgattcgtgtctcgtcctagcgacaagacaagggtgagcgtttcccccgtctccgtgtcagtttctgggaaacactcgcaatgacgatttccctgccaaacatttgtgatttgcagtgagcacttggccgaatcgtcgcgccttcccttcgaagtctctctggaaacgtctcggcgcaggtcacggccgcgagcctgtgcatgcacctcgaggcgctgacccttgccaggttctcctacgcttgttcgttccgatttcttcctctgcccgtcaactgaaaaattcgcttctctccactaacacggaagaactccatccgctgaattcgctactaccctgcgtggagatttacggagtccgccatgcaggacagagtcaccttttgagaggcggccgccctcgttctcgttttccgtctctccctgcccgagacttcttagcgtgcgacgaactcaaacactcgtcgttttctctcgctttttagggggggtgcgaaggtccccgaattctctctccccccgtttcgctggaagcctctctctcgacaa

SEQ ID NO: 2812 - DNA, 2364 bp, Toxoplasma gondii
agttccagcgtcttggatgcgaacgaacaccagcagaaacacaaagtcaacgcgcgagcctgcccatctgcagacatcgcgccgtttgaggctgtcgaccgacgcgtctcatcgctctttgctccttcgagcgaggcagaacctaccgccttcaagccgaacatgatgacggcgaacggccagtgaggaccgacgacgagcacgaggccccccggacgaggactgaggtagagaatccaaatgtttccaatcttctcgcgaccccacacaaacccagttcgcaggcgagagagacaaaagccagtcggccggggaggagaagccacggaacgagaaggagaggaaggcagagaaaaaggagaaaagggggaagaagagggagagccaacagaaggaggagaaggagaaggaggacgacaggaaggataagggagaggatgagcagaaggaggtagagaaagagaaggagccgagtttcgggagggagaggcaggttcttcgtgatctgttgctgaagacagaagcgacgagcgtcttgctgcgagaacagacgcaacagacggtgaggaaggagaggcagacggggagaaagaggacgggagaagaaagccgtccgtcagaatcattgcgctagagacctgcactgacgaggcctgcgacgcctcctctccaaaacgcttctcctccctctcttcgctgctcgcagccgccctcctctcgatgtcgtcgcactgcagagtctccattctcagagaagtgcaggaccacagagagagaaagagagcaaggagagagaaggaaagggagagggaaggaaagagagagggaaggaaagagaaaacaagagagaaggcgagcacgggcccaaggggctggtggaaaccaggttcgtcgtggacaggagttcatccgcaaacggaagcgagaaaacacgaggtaggaggaaaaagaagactgacgtgagagagagcttttgtctctgaaggcgaccggcatgctggagatcgagagaaacgcagacttgattgcaaagcaccgtcggccgtcgagagtcggcagaagaggagtttttctactggagagcagcagagttagcacacacccgcgattaagccttcgaatgatcgctcaatcgcctcctttcgcctggttgaatgggagcgaaaagggagctaaaaaaaggcaggtcgaaacgcatgagagaagacaattcggcgtcctcctcttgcccccctcctccccccgtctcttaagaagacaggactggacagcggagagagctacgaggcaacgtgctcggtcttgtttccatctccatgtctcgaggatggagtttctgaaaacaatcaacttttgcgatctgtttcgcccaagtctactttccagctgaggttcagcgctacacgcgcaagagcagtcgctgcgttgtttgggtcgcatcgcgagacacgaccgcctttcgccgaaaggcctttcttcatatcttccgagaagcgcctttccagaagtcccgaggctctctttcttttcctctactacatgacgcacaggagaacgaaagaggactccggtgcgtggtgagaaaaacgggaggcgcaggcggcgagaccatacgcaaagtcacctcgctttcctcgctgccgtatagagggtaccacacacgacgtccattcggttctccttctgtttcagaaaggtgcgtcaatcctttagtgttttgtgccaagagggcggcattctttcgtctcccagttcctcgaggccgacggaacagcgaagcctctgcacacctcgcacagagaagccgacttcttcgctcgcgccgactagcgactctcttctcgcgccgcgacgtggaggaaaggtctcgcgtccagacctttcaaaaaccggaagaggaagcgacccgcgtgcgtccttccccggaaaaagaggcagggcgcctcgtagccccccaaaaatctcttttctccccactcttcaggggcgtttagctcgagaacggcgacgacgacgacgagagtggaaccgggcacccaactgggggttccagggtgtgtgtatgtggtgtatgtacacctcgaaacggattctgctcttcttgtcggaagacgcgtggtggtggaacggcatgacgcaagaaaagaggctacccacaaacagagcttcctttgcgcgtcgttttcccgcttttctcgcttcgtcctcagcatcgttctctgcgttccttctgtgtgttcggctcttcgtctcttcgcctcttcgtctcttctctccctctcctcggttcttctcccctctccctctgagacttccttcgcctcttctgcttcgccctcccccttcccccaccccccgcgacga

SEQ ID NO: 2813 - DNA, 2872 bp, Toxoplasma gondii
cctgatcatcaggcggagaaacgccacgctgatttcttttcttattcccctcccctgagaagcttggaggttcgtgggttcccacctgcagaattatgtgtctgtttagaacgcgcaggacccaccgagggtcaccagtggcatttatttctagggcgggaaaacaggatatcgaacgctacacatacctcggtggttcgcccattgctacagaatatcagacataacacaagttcgctgagttcaataatacgcaaggttacactgtggcttggtttcaataccgaagacaaaacagtgggtgatgcatggcgtctgtttttggtacgctaaacacttgcgtgcttttgcaggtcgcatttctgttcgccccctcgattaaaattccttaccgtacagcgccttatagtacgcaccacgacccgactacagaaaacacagaagaaccacaaagacacgattccggtacgtgtgatatggaaacaggacaccacatgtgtggggctcaacaaagcctcttctgaacagtcttcctgactattcaatagtggatacaggcgaatacctgtcgcgttttggcttcgctcctgaatttctagagatccagtaacgtaacacgacagttaggggctgggaaagcgatccaagaagacgaagagccagtcgcagtccgacttcactcgttggagagccgcgagtgccagcgcaagagccagcagagacaactccaaccttcccacgatgggacgaagagtctgacacagtaaacgcagtgtatgtacagctcaccatcttggtcacgctcggactctttggacgcaattcagctaaagaccggcggcaataatcgggcaagcgggtggtgttcagcgagtccgggtcgttccagggaataccgcaattctgagatgcagcaagaaggacaatgagacgtcatctgcaacaaaaagcggtgcttaatatttcctggcttttagtggaaacgcggacgtgtgtgatttaccgctgtgataggcttacacaaggttctctctcgaaacatcagttgactcgcagcatacaagttgttgagagagaagggaatcgcagcttggactgaactgcagtttccagaaggaagaacgcgggagagagtgggagatgtatagcgaagaatcgatggagggcagtctgcgtcactgaaagtgccccgctgtcaaataagccctcgatttgctaccagagccttcagcacaactgaaatcagacctgtttcgagttcggacgtcagcggccagcgactgtttgataggaaagaccgctgtcttcctcttatcagtgcaggtcccgccaagacgcaccgcgcttctctcgatgttcgcttgcttcggggttgagaacaaccacgcatgcgtgaacgcatacagtatgtaagcaaaaccctatacacctatacacacttgaacgcattcaacaatctctgtagcgaggtccgtgcgtccgtcgatgtctggccacaacgagctggagtgtcgctcctcggcccttcacgctgagagcgtatcattaatagaagagacatggaacccgtcgcagccaatccaatgcggaaaatgtgcttacaatgacgggtaagcgtattggatgtcttttacgacatgtgcgatgcatcggcgaagactcttcggctgcaacctgtaagcttttcaatagaaaacattcgagaacataacgcatttctcattgaattcgcatcgacgagtccacgcaatatgatgggccttaacacggatactaggctgactctcttcgcaaagaagcagcacagcaggtcacagcgtctgggagggggagaggcgctgcgaacttgcgaggcaatcgagaatgttacacctgcgcgttgtttactggtcttcgcttttattcttcttgatctggaaactgttcgtcaagaccgttccgtgttttgttcgcttaatctagttgttcgtggggacgctccgcactggcatcgccagagcggtagaccagagaacggcagtgacggggcgccccgtttgcggatttctgtggaattatgtctgttttcttcacctttgccaatactttttttttgagttgagaacgttgtgcgtcataggatatgcgtgtcgccttccgcttctgttcagctggggctggatttgcgcagcgtctccacatgttgctacaggggggcagaggcctttcccaaaccactgtatcctccatcactgagtttttccggattcattcgattcgcgccgaatacgttcccttgtttgcaatttacaacggcttctgctgagccgcaaatgcctccgttgtttcgatctgcctttctaacaccgtcgccccccagaagtgtgcgtggtggccggtcatcgtcttcctctctccacagatttatgactttctcctcctgtatcccgcttcactgactcttccgaagacactacacactttcgtcttcggagttgtggctaactcatgtgcttattcctcccacagtgtttttctttttcactcgtaaatcagattgagaccgcgacgaaaaggacaaaacgcgttgcagtttcctgagtcaggcattgtctcccccgtatttgttgtccccaccaaggcgtcggttacctcaaacacctttgagaaacgttgtagggaaagccccgtttcacgtaaagcggggccgccgaaccgagagtgggcagcggagaagatggagtgaggtttccgatatggacgagtaagctgtcggctgcgtgcagccgctccaggttctttctgttcacgattaccctacatttttgtacatcgcctctccgtttctaccgcctcggcatctctcggcgctcccaggagctagacgccaaga

SEQ ID NO: 2814 - DNA, 1145 bp, Toxoplasma gondii
ttttccaggactacagaaaagcttctttgaacttcctgcttcttgagagcgtcggtagcgtcatgggacttaccatacagcgcgtcgcttcttgtttgaaagagacttgtgacgacgctcactctcttcattcgtccttcgtgctcctctgtctttcttcccctctccgttctctttttccttctatctgttcttttctcgcttctatgttccccctttttcttctgtccccttctttcttatctaccttatttcttcctctctcgttcttgttctccttccttgctttccccgcccccccccccccgctctccctcatccactcttgtttctcctctctctctttctacggtatgcagagaacctgtgtgtcttcacagaacaaagcgcctcgaaaactctcctttcagggtgtttcctcgcaaatgccacaggggcgtttttcttcgctctcacttcagacatctcgctatcagtccgtgtgtgcaaactgtacagacaaatcaacccgttccccacaatggtgggccagcgcctgttgttcgtacttcaaggagcttcgatcttctgcattttccttcactttccttctcctctatagacacacagagtgaaggagcttcgatcttctgcattttccttcactttccttctcctctatagacacacagagtgaaggagcttcgatcttctgcattttccttcactttccttctcctctatagacacacagagtgaaggagcttcgatcttctgcattctccttcactttccttctcctctatagacacacagagtgaaggagcttcgatcttctgcattttccttcactttcctctccctctaaaaacacagcacacggtgattcagatctttctgggcctttccattttcatcagacgcgacgttgcagcagatgcgccaggatctctcgggtggtgcggaaaaaggagatacatgcagctcgtgagtaagagggagaggactgggtttcgtggctgggcaaacgcgttttgaaaaggacagaaataacgcagacgacatggcaggaaaaaaaggggtcgcaagaatgctgtctccaaggaactgggcgtcttaaacttgtgtggtgtcaccggcggagaggcgcactgagggggggtgca

SEQ ID NO: 2815 - DNA, 673 bp, Toxoplasma gondii
agaacagaacgcagtcacagtcggcgtagtagtctttccagatgtccctcagcgtctcgcgaccccccagatcccaaatcgtcacctggaacctctcgtacacgaaacgcgtcaggttgaagcctgtcgttggacgcacttgaggaaggagaggcgggggagaacgcgaaggtggggtgaaggaggaagagcaagagggagacgcagactgcggagagcaagaagaggaagaagaggaagaagacgaagaggagaaagaagagaaagagggagacgagggggaagaaggagagtttgccgtcacgtctacatcgtgcctgtgtgcaggtgcagcttcgggagccgggagggtcgcgtcggcaggagcagcttgatgcgcatgcagggagggagacgaggaaggcctgagagcagagcctctccgtttggagtggcgcgccttcagttgctccagaaaagtcgtctttccactgccgtccaggccaacgaggagaagacgcagttcgtcgtaggagaacagccactgatagaggccggagacgagactgaacattggcagaacgcaggggagagactgccaacggaagactgaaacctgagtcacggccggcaaaatgggccgagagcgaagcaacgcgtgaggactgaggagcgaaaacgggatctgtggcca

SEQ ID NO: 2816 - DNA, 1908 bp, Toxoplasma gondii
gaaaagagcaacgatcgccaagacaggagcgagagcatgacacactccaacggagggaaggccgaggacccaacgcagatgccacgttgatgaactctcgcaccggcccttggttggtgcagagaacgcgaatgctgccgtgtagactgccgctccgtagtttgtagccaatgttgaaaggcccattccggctgaagaagaagagggaggatcggaggacggagaaaattcaaatttattagaagagagcggagaaggtggatcttcagaacccgcagcctcgcgggtgaccaactggagctcggacacgagctcgcgaccaagatgtctagcttttcttccaaatcctcttcgccgctcaggtttatgataagaaactgtccgggaaatgacaaggacgccttttcgacgcgtgtggctctgttttcgttctctcgaatgccgagtttttcctcacgtggatgtcttcggagatcccggttagggaaatgaaccaccagatgaccaccgcccccgctgcggaatggggtcgtcgaggcatcccacacattcctcaacagaaaagacaggcattcgcttgatgccatgttgtttactgtccaggtctggattggcacgaaccctccgctggcaaaagatacacgtggctcacgagctgctggttgatgcagtcgctacactgtctgactccaacgaagccagttacgctctcaatccgcccgacagcctcaccagtattccaaggagagcgcgaggggggaagaaaatgaagaaatgactttgattaccctcacaggagaacatgaaggtgaaagaaactcgcaaggtacatgctggcgaccacccaattcttgcgttgtagtggaggtcgtctcgttcatttgcacccctgacgctatggtacgggcaacgtgtttgttcattatgggtggcagttgtaagacaacggatccggtggcaaaaagcatgtgttaggcaaaggcaaaatagcaagcacccggcttcgcgccacgccgatgccaccacaatacagctgcaaaaaaaaagtgatctcctcatctgtgtccgccgtataagaaacgaacagccacttagtgtgcagggaggcaagaaacactaaatgatattgagtcaactgctttttaaataggtctattacttttaactccagcatgtatgtcggccaagctcgcttgcaagtctgctgttccctgtcggcttcgatttttctcgcatgcgaagaggcgggtcacaaggcgacggcaggaagctaggggaaaagcgttaggtaatcggcaaagatcccccggtcatggaagaacattatatatcagactgtggagaaacagcatgtgacaacggcaaacgacaccgcctatctgtttaattccttgggagaaagaatctaccgtcgttcccacgaaatgcgagctgttcgagcatgccaatgagctgctctgctgttttgccgttgtccaggccctagggtttcggcacgcatatttcgtgaataaagtgaagcccaaccgtacacgacaggctttttgatttgtattgttttgttgtgtggcgccactattaccacatgtatttcgttttttctctctgcaacgctgcagcaagtgagtcgttggctgatggtactctccgtccaaagcgcgaagacatcgtgccggctgccgggtcaccacgactcaccatcaacgcttcggtgactgccccagcgctacaaaggggtctcaatattcccggcatatcacagctgttcgcttcacgtgtgcttttgtgcatgactccttcgttttgacagagtgtcgcccctttttcctggactgtcatttttaccgtcccccggcatcggcagtggtgatcttctgacacgttgggggaaaagccgacgaacctcca

SEQ ID NO: 2817 - DNA, 2006 bp, Toxoplasma gondii
cgagaagctggagctcgaaagcttgacctgacttcgcttgttgttcgtcgctctctgttttctcttctcgtccttccccgtgttcaccttccttcgcagccgtgctctccacgcaggagagaaatgcgagagctttcgaagtcaaaaaaaaagttcctttccttccgcccaaagaaacatcatggaaggcctcctccaggcgcccagtcaccgcgcctccctcctccatctctcaatacgcacggaaatcgacaatcttccttcctccgcgcgtccccatatatatatatatatatatatatttatttatttatttatatatttatatatatatatatatatatatatttatatatatatatatatatgaaggggcacacagatgcgcatacacgcagatatacggaatcacatgtctgcagatttacgagcatatatgcatgcgtatgtttgacatgaagctcgacaccgagactggatgcgttgtgatgctactgcatatgaatccacaggtgcacagagagacatctggagagaacagcgaacaggcgaggaagggggacatctctcgttcgctggaacagacgcctgagtgagaatcgatacacccgatcgcaaaggaacaacggagaaacgacacggagagagtggaagaagagagaagcgatcttgcgtcggcgagaaaaagcagagagaaggcgaagaaccttcgcgcgaggtcgagaaactggagaacgagggcggaggctcaggacttctgccaaaactaccgtaaaaaacagaggatgaggagaagaagttaggactcaaaagcgtagaaggacaacgatttctcgacgcgcgagaaatggtgtgagcgtatgtcgtcgccgctttcggcgacgcgtggacatgcatgcacagaagtacatcgacaggagaaagactctttgtttctcacggagaggaaaaggaaggaaggaaagggaacccttcaaggtttattccctcgaaaaaggactcttcccagagaaaacggattcgatttcatatcgcctagccagtgtgtgcatgcagagttcgctcttgcattcggaaaagcagaactcaggacactcgagagcgctgagagcgccttttttcgtttttcttctcttctttttcctactttttattttctcttctcttcgtctgtcgaggccttgaaaaccatccaagtttctcacgtgtctctccatgtgcagatgtcctctgcggttgtgtctcacagctgcgtcgtctgcaatttttctccttccctttctccgaggatttctctggggctttaggctgttttctctgtttagcaacgtttgaccctcttgcgtcgcctctgcggtttctcggttttttcctcctcatcttcgctgtcctgcagaaatgccaaaagatctctgtgtccgactgcaggcctgagtcccttcccgctctctccgaaagagcggcgttcttttcctctctgtttcccgatgattcgttttcttcgtccgagttttcccgactcgtagcctttctcgtgagctcttgagtccgctcatctttcactcctttgaactcacgagtcgttccctctgcatctgctgttacctgtcttctctacctgtccagtgggagacatcgacagacgcgcctcgcttgtctcccggagacattgcgcgtctccatttgtctcctaactttgagtgtgtaggcaacagtgtttcgccgcaacttgacggtctctctcccgacttcgcgacagcgagacgcagaacttctgcacatagctgtgtatgtttacgtctggtggtgctttctctttcgcatggattcctacatgcatgcaactgtcgatgcatatgtagtcataaaagctctagaaaggcagtagagagacacatggcgagagttgccctgtgcgtccgcgcatctgtgctaaagagatggaagaggtgagggccggagctcgtgtctctttaacattttcgctaactccggtgcaagagaca

SEQ ID NO: 2818 - DNA, 2606 bp, Toxoplasma gondii
tgaggtacagcgaactgtagcagaagaacgtgaggagaaactgctggaaaaaacaccgagaaagaccccccgacgcagacacgcgccgagacgaagaggcaaacagcgacgccgtccgacaccacgtcgaagaaaaggaagaagagagagaagaagagaggggaggagagtgtggggaagagaggggagaagagaggggaggagagtgtggaggagagtgaggaggagagtgagggagagagatcgaggggaaaggagcacgaagggtgtgagtaggggaggcgggcggcgggagaatcgcggtgaattgcctgcttccatgttctgagagctgcgtcggacttgcaaacagagaagacacggaggacggagaaagttgcgaggaaccgagcgtcgcgaccgtcgacacagaggcctcgcactgaggcgcatgcgaagcctgacttcctttcctggaaaagtggagacggaaagagagggcagaccagaagttgctagtcgatgcatttctatcttctttcaaatcctcctcgccttcgttctggttcctcgccggtcttgctgccttcctttccacatggccttcaggcgacgcgccgcccccgccgtccacctgcttccgcgtgtggcttccgcctcgtcgctcctctggcgcgtttgcgcgggcagtcgagagggaacttttgcgtggagtcggattctcgcgtctgccagcctgtctgggttccccggcaacgccgtcgtccaccggcggagtctcttttcctccgcggatggcgacttccttcgcctctttcgcacgctggggcgggccgcgacgcgcgcgcccaggcgtcttcggagtgaccttccgcgctgcaggcgcacccactgtttggacgtccgaagcaggagaaggacgacaggccttcttcccgatcctcgccggggacggagacgctctgcgagcaggcgctgctgccgcggcctgcgctcgcgtctgcaccatcgtcgcggggggtgggggaagggggagggcgaagcagaagaggcgaaggaagtctcagagggagaggggagaagaaccgaggagagggagagaagagacgaagaggcgaagagacgaagagccgaacacacagaaggaacgcagagaacgatgctgaggacgaagcgagaaaagcgggaaaacgacgcgcaaaggaagctctgtttgtgggtagcctcttttcttgcgtcatgccgttccaccaccacgcgtcttccgacaagaagagcagaatccgtttcgaggtgtacatacaccacatacacacaccctggaacccccagttgggtgcccggttccactctcgtcgtcgtcgtcgccgttctcgagctaaacgcccctgaagagtggggagaaaagagatttttggggggctacgaggcgccctgcctctttttccggggaaggacgcacgcgggtcgcttcctcttccggtttttgaaaggtctggacgcgagacctttcctccacgtcgcggcgcgagaagagagtcgctagtcggcgcgagcgaagaagtcggcttctctgtgcgaggtgtgcagaggcttcgctgttccgtcggcctcgaggaactgggagacgaaagaatgccgccctcttggcacaaaacactaaaggattgacgcacctttctgaaacagaaggagaaccgaatggacgtcgtgtgtggtaccctctatacggcagcgaggaaagcgaggtgactttgcgtatggtctcgccgcctgcgcctcccgtttttctcaccacgcaccggagtcctctttcgttctcctgtgcgtcatgtagtagaggaaaagaaagagagcctcgggacttctggaaaggcgcttctcggaagatatgaagaaaggcctttcggcgaaaggcggtcgtgtctcgcgatgcgacccaaacaacgcagcgactgctcttgcgcgtgtagcgctgaacctcagctggaaagtagacttgggcgaaacagatcgcaaaagttgattgttttcagaaactccatcctcgagacatggagatggaaacaagaccgagcacgttgcctcgtagctctctccgctgtccagtcctgtcttcttaagagacggggggaggaggggggcaagaggaggacgccgaattgtcttctctcatgcgtttcgacctgcctttttttagctcccttttcgctcccattcaaccaggcgaaaggaggcgattgagcgatcattcgaaggcttaatcgcgggtgtgtgctaactctgctgctctccagtagaaaaactcctcttctgccgactctcgacggccgacggtgctttgcaatcaagtctgcgtttctctcgatctccagcatgccggtcgccttcagagacaaaagctctctctcacgtcagtcttctttttcctcctacctcgtgttttctcgcttccgtttgcggatgaactcctgtccacgacgaacctggtttccaccagccccttgggcccgtgctcgccttctctcttgttttctctttccttccctctctctttccttccctctccctttccttctctctccttgctctctttctctctctgtggtcctgcacttctctgagaa

SEQ ID NO: 2819 - DNA, 2288 bp, Toxoplasma gondii
actttttatcaaggtctggctcacaaatgccggttctcgagataccgcgcgtgccccagcacgcagtgatgagccccgagtgggggacgcacccgcagtccagaattgattgttggcaatgcacgacggacgcgcggttctagggcataagtgtgtgtgtggtcgtcaagaaacaggtcaagttgtgagaatgtgctcgcgctgtctcacaaaatcgtttgaaagatttcgacatatgtggagcagcgtcttaaaaatagacgaattgaactaaactgtaaacccaagtcctggggtgtttgttaatggtttcctttttttaattgttgtggagaagctgcgtacgggcttgagttgtatctgaaatcatttttcaatgtagagacggatttccctggaacaacgtaattccatacccggcatgtcgttatacacgatctgcccattgagagcaacggtaccgcatccagagatctccgcaccgggaagtctgtttcgagagacgactggcgaaatcgggtcttaattccgcttgaggggaccatctacctttctgcaacatcttgtcagttacatgtgattgtggcaataccgtactgaactcacgcgcgacgggtcgcaggaagtcacacgaactgcactgcatacgccccgtgccgtatgctaacctaagaaaaggatgggtgttttgggcaaaggctgccaaaaaatgtgtggagtaccagccgcaacctgtccacatcaacgttatttttaaagcgtcgtcgctcaactgaatgctggcgtaccgtttcccgggtcatcgcattcacactcctgacaaaaagtgtaatctgatcaaaagcacacaggagtactacacgtttcccgccagttccgcgtcacacacactgcgtaccggacaccaggaaaccctgttcagtctgttggaaggctgacgaaggtatgagttattccattgttagcagtggaaaagcggaagctaccctcaccaggggcacatcctgtgttcgtagcaaggacgggggtgcaggtgaaagcaaacacacgattaagaagaaaaatctgatggaagtacctgtagctacgggagcacagcacctctggcacacctgggcagaaagcgaatgccaactcgtaccgggtgctcatcccaagaaaaggtttacctccggcgtacacattaaggcgttggagaccccaaaaagtctacccaccagagtaactgtaacggatacatgaactagcttcatcttcaccacagtgcttgattctataaagttttgtcagccctagaaaagactgaccaccatatcacgagtcttgttagtgcctgcctcgcggaaaatgagaacccatactaccgtcttacgttgcatgaccaagcaaactggtgacctgtacatacactcgaatgttaattcgtcaacagttcatgactcgtcaactagttggaatactggttcagatcttgaaggtctttgtttaccggatccaagttctattgtgttatcattctaaagggctcggaagggtcgtgctcgacgtcaaagtcgagcgcagctccgctgtcagtttgatccttttgcggttgttgccgcttgctgtagtgatcttctgcaatttcttcgaagtttgggttctgtttccagttcgcttggctcagcggggtagtggtgcaagtaactcgtgcgttggcagctgctgctcgtttggacaatcggctacatgtggcggaccggctcccgctggcggacggcttcggtaacaacttgaagctcggagtgcagccgttttgcggactgtgccagactttcctcagcaaatggatcaatgagcccagaatgagaaatggttattaggtgcgtgaggtggcacatacagaaagtgcgaagatggcagactggtgctagcgggactaccaaaacgtggatggtctagaccgaagaattcgacttcgcgtggcagctgcgatgttctgaatgcatagatactgccgcgcatgcacacggacggttcgttgcaaagtgactgagaggcgaagcgtttactttgtttcgttttatttgtccgttaacaaaggctctggtatctaacgaaaaggttctgtctgtggaatcgaggaattcattttctacagtatcgactgcacgacaagaccaatctgtcaccaaccgcctgcttcaaagcatagcccgtcgccgaattcgcggcacattggcgtgtttgtggctaaacagcgggctggccatcgaaacaatactcctttctgccccagtcactgaaaa

SEQ ID NO: 2820 - DNA, 2251 bp, Toxoplasma gondii
tgccagcatgggtttcagaatattcccagcatccatgccgctttcgccggcggacccggcaccaacaaccatatgaatttcgtctatgaagagaataatctgtcctgaactctcctgaacctccctgatcacacttttcagtctctcttcgaactcgcctctcagcttcgcacccgccaataacgcacctagatcgagcgagataagctggcggcctgccaaagtgtctgggacgtccccggagacaatccgctgtgcaagaccctcggcaatagcggtcttcccaacgccagggtcgccaaggatgatgggattgttcttagtgcggcgactgaggatctgaatgacgcgtcggacttccttgtctctccctatcacaggatctaactcattggccattgctgcttctgtcagatctctgccatactttttaagggactgataggacacctccggtgtctttgtatttacccgccgagtgccacggatggccttgattgcctgccgaatgtcattggctgtcagcttcgattctttcagaaatctaacaagaaacctcgagtcttcatctgccaaggcagccgccaagtgctcaacagatatatactcatcatgccactggagccgcaagctgttggcgctcgacagcaccttctgcagcaccggacccaacgtccgtgtgctattgtcagaaacagtcggatgtctttcgacaaaatcaacaactccgctgcgaagcttgtctaggtccacacctgcctgtttcatgatcattgtgaacaggccatcttcaccttggtttaaaagagacagcacgagaagttcggtttccaacgtcggagggctgtattcttgcgccaacgatatcattcccgccagggcctcaagagctcggtccgtgtagtcatctcctttcagagaaaatcctggagtgttggcagctgccgagaaacaagaggcttgcataaagcggggaatgtggtctagtgcttcccgtggacgtcgttcgaagcccaataggtctgaatacgacagaccaaagcgaccacggtacctactgctgaaatcccccgaaaagatgagacggctccctcgtgtggagaagctcctgagagaaactaaggaggagcatcctgatgaacgattcacggatactgcacgtgataaaggcgcttccttgaaggcaaccgccactttggcgggtccgcgcagcggacaccgacaaccctggcgcagcatcgccgtgaaaatcgtcgaattacctcaccacggagtctttgacacgccaacgtcagacactgtctataaaaagtgttttcttacaaagcgctcggtttcttctcctctgtgagcaggggtgcagtctgtcaacggtaagcatacttgcgacacacagaacgtaccagcatgcagatcccaagctgtaatcaggcaatcgacaggtaggtgcactgcattaccagttcgggctcatattctttggttgtgatggactactgacatattttatttcctccatctccgttagaggtgaacgtcgaggcaaaacagtagctagaaggcactgtgtctggcgaataactcgcgagtttcctacttgtacgccaaagctaaccgctggcatacctacttttcttcggttcctcacttcaagggcatttcctgagagctagtaagttttcgctggctttcgtggctattttgccacacacttctataaagatgcaaccgctatttctctgaaagagaaatgagtgtttgtgtgagcctgcgcccagggacttggcgcaccgtttatccagccgaactcaatagcgtgtgtcttcagtatcgtcgctgttatcacatgccactatgctaatgaatctgccatactgtcgttcttggtaatggttttgagctctgtgaagcatgtaacgtgtcctttgacttggtcaccgttcccgtctttacaggtgtcctaggaatcagatggataagcgcactgttagccaccgactccaagcgtggtgcgaccatgttgagaaccaaacgaccttctttttgtgtcgtttccggtgccatcaagagaagtaggggagagagagccagtggttgtcaactctagactttttaacgtggctgcgcttctcgaattgtgacatcaggtggctgctcggcgcacggggacaccgccgtctcccgcactcttggcaagcgtgtggtatctgcgaggagtttgcaaagttcgacttcgaaaaaggaagcacaa

SEQ ID NO: 2821 - DNA, 2108 bp, Toxoplasma gondii
aaagctcttgagctggaatatcgtaccagttcgccagatgcgcctttgccgcgtcccgctttgcaagccgttcctgttgctgcagcttccccgcgtccaccagagtcgcgagatccgcactgcgctttactgtcggcgggagaagaagcgctgccgcctccgtcgggggcctgtcgctcccagcgtctgccgcgccgctgggcagactctgccgcgccggcgaaggaccaaccagaagcgttccctgcggcttgtgcacacctgaaaccgtacccagcagcttctttttcccccggtggtgtttcgcatccaaagtgacagatgcagccgcgcgagcgtcgagatctattcggtgaaacgcgaagcgtccaggggcggcagtaaggtcgagtcgaggcaattcatgcattccgccggagtgttcagcagcgccctgagcgtcctcggcaacagcggaggcttcttcaaacttcccagacggccgggaggccgacggcctttcccgtctcttcttcagaacccgctgggaagagaaacagagctctcgcgtgtcgacgcccggatctaagtggtcgagacttgtttgtgaaaccgaagggagagcgagagaagacaaaggttcatcacttgaagagcgcgcgtgcgacacacactcgaggacggacagagacgtcaaggcggggtcagcagaagatgccaacctgaaagacgaagctgaagctgaacgacagccggcggcagacgaagaggacgagcacggagaacaaaccgaagggacaggagaagacgtcgacacagcgggatcggaagtcttgcatgcatcgtcatcaggcggcggagggagaagacgagccgcagcctcgattgctcgaagcctttctttacggagttgcttgtgcactccgcttttcctgctcgcctcgtcgcctttctttccacccttcccttgagagcctttcgggatggcagacttcatggctgcccgagaagagacgagaagagaggagaagaaacgagagaaagcgagagaaaaggtccgggacagaaactgaggtaaatggatcttgaatgagtgcgtatcagcggctgttgacagagtctctcacacgatccaggtgctagaaggggaagtacgcggaagaggggaaaaaatgacgaaaaaaacagaaaaccgggaagaaacggatgcggacgagcgaagacccaatgacccccgagccgtctactttgagttgaagcaacgtgcgagtttgagagggctccaccaacactatttgaatgtcacaaaacagatgaaaaggaaaactccgaaggattatgcgtgaaaaagggcggattttgcggtcgctttttttctccagatgcaaaagaaaacggagaagcacgcctcaactcagtgaggcatgaaacttgcctggggttcaactcggaaatctccgagaaaaacctggaagcgtccctcaagacgggaggatttttacctcgaaagattcactttttcaggattcagaagtttgtatgaaacaagaaactcgccgtttcctctagccccacaaaacatctttctaaggtgaagatgcatgcatcgcgcgtgtgaaatcgccgcaactagaagcacactctgagcgagttgcacagcaaagtgtgcgcaagtcacttcttcttgccgccgcctctacgtcatttccattctactcagagcctctcataagtttcttttccttcatcccaatggagtgacggatagaagttgtttcaattctttttcaagatctgcaaacatctatccctgttgtctgagggcgtgagaggactcgtcgcaagacaacggcgtgcgatgttcgctgctctgcaggggaatgtaaggaccaagcctgtgttttattaaccacaagcaaagactaccttcctcgtcttctctggaatccttgattctcgaaggcttcggggctcccgccgtctgttcttcagtcttgtctccgctctcgatgtttcgtaactgacacaggcggcctttctcttgactgcggcatgcagccccaccgaagaaggcgtccagagtctggatcgccaccctttgcagagagacataagttcttgaaattgga

SEQ ID NO: 2822 - DNA, 2394 bp, Toxoplasma gondii
ggcttctgctgctgcctttgcgctttccttgcatgcaagaaggaacgcctgcacactcttcagatactctgggaaatgagcgtctctcttttccagattcgcttcaggaacagaggacctgcacgcagtctcttctgtctccgccgcccgagacaactctgcgattgtgctctgcagctgcagcctcagggcttcgccttcagtgactccggtctctgaattcatacatgaagacggacgcaatggagattgaatggacgaaggcgagcaagacaacaaagccggcgaagaaggggaaggcgaggcgcgaggagaggaagacgaagaagcctgtgtctggcgttcgcgcagaaggcgacgaagagcagagggtcggaagacacctgcagatgaagacgaggaagagaccagggctatatgagagaaacgatacgaggaaggaacggagaaaagaactgggggaatggaaggcaaggagcaccgacaagtcgagggattgctcagttgcgtaaggcagctgcagaggcacagaagaggaggaaacacgccgacgcgagcgaaaggtgagtgtggggggtcgggggggggggactggacggaacggcggtgttaagagtatgcagagatggaggctttctgaaagagcggcaagaagacagggtcacggaaagggtaactcatcataccagcagttccctcgcccccttactcagtgctgcatgccgagcgaaggcgacctggtaggcatcaggaggctgaggagggtggtctgccagtcgggcgttcccccttgaagggaccaaggatacttgatgcatggctgtgttcttgctcgtggagaaccgatattaacagtttctgttttgtctcctccctcctgcctcgcgtagctgtttctcgccgtcggcagaaaccccaggatacaggaaccgcattcgcgacggcaaccacagttgcgactcataaagggagcggaaaatgcacggcgaggcggaaagggagagagaagagaattcgagtcacatgcaagacggaacgcggaaggatcaacgggtgatcaagagacaaagggcgctccgtgcggccggcgcagacaccaggcgagagggggataaagaaaaacgaagggtgaaaaggggaacgagactgagaagggagagaagacgagaggaacgggggcgagaagaggtagaagcgaaggggtccgcaagcgaacggtgtgtttgtacggtcgacgtcagggagaggagacacacaggagacagggcgcgctggagaggtgtgctagaagacacggaaaccagggagcgaaacggggaagaggaaacacggagtgaggacgatgcagaaacagagacgattaattaaatgggaggtggaaacaagagaaatccgtagcaagttgacgtttggaaaatgcgaaggcgaaccggatagtcgcgatttcggtagtgcccaggcgaagctcgacgccaggggggtgagagcaacgcgagtgtggaccggggagttgctccctttgagccttctgcttggaatacgagatatctttgtgcagaaagaagtgaggaaggttgaagtaaagggtgcacgagaagggcttttattggagaaaccatgtctctctctatcgtgtcgggaggggttaaaaaagaaccgcgggccgagatggcttaatatctgctgtctaccggggttcgtgtccccgtcctagtagttgtgcctcttttctagctgctgtggaagggtgcgttttccgtcccaaggacactttcttgctctgaagttccagtgtttttgactgtctttctgaatccgcgtatccgccaactgcagaaacagcaagcgatgggagccagcttcgctggccctgcgctggttgcacgataccgggaaagagttcttttcgccgtctcctggtgggtgggagtcgatgctaccccgacagagagaaccggaggcgccgagattctcggaaatccgcgatgctccgggccaaagtgcgtcctcctgcacagccgcaggtgtggcacttctctcggcgcggcggccgagaaacttcaacgaaacgcggattgctccggcgtctcagacagcgggcgtttgtctcacagtccggtctctcagcaaacgagacgaaggcgccgcggctggaaagtccatccgcggaccagcaaccttttcgagcactcggcgccgtcagcgcgtgaaaagactcggcccccctggaccccgatgttgggctgagcatccaccgtgcgcgggcgtccgagtgttcctgcggcggctcaaaactggtgcgtcgccgattttctttgtaaggtcgcgtacttcttttgcttttccgagatcgagtccgcctttcctctgctctcccatatctcccctccaaga

SEQ ID NO: 2823 - DNA, 2303 bp, Toxoplasma gondii
ggagttatttgcaagcctgttcaattcaataaagcatgcacttaacgcagagaaacctgattcactcagcgagtgatgacacgtcgagtggacttccctcgctcctgcgatttttttcaagagtcgtcgtagtgcgctgacgcatactctcgaaacacactgccctgacaattctctctgctaagtgggtgcagacgagaatttacagctctgggctctgtggagcttcccagttgttccatttaaaccctttacaaaagagttcctccacgaccaatcttaccactggaagggtcgtgaagtttatcctataggtaactttgagaaatcatccaacaaaacgcaggtatgtctctccaccatcccaggcccactccaaagctcggaacacattacccggcggaaatctaaaatgtttgactgttgtacggaagagacgcaggacgcgcgttttgcacatgctcctcaaatgtatccttcctttccgagccaatgaaacgcaacgaagttcagtgaagatgtatattgggtactcgaccacaagggaagtttgggtctacctcggtaactccggaaaagggtgaacctgctatcggttgtaggcggtgtcaaagaatcctgagctgtgtcagtccgcagccagggaagcaccgcatctgcagcagcctgcatgcttcttgtatcctacgaaacgcaccccgacacgctccgctttcagacaagaaatattttcgagcatccgaatgtcgcgtttctgctggtgttgccgtgactccaggagttgggttcagtctcgacatgcatcactttcccaacagtaatcgcgtctgttttcctgcagctgattctgttgcctgcagacgaacgagccacgaaaacggggttggtaacagagcagaggatagttaccttcactcgaaatacacacacctgtgcatcaatctggatgctagagtcactgaactgttcaggcgagaggccacagtcacagtttgttcgtctgccgttacatttgacatcaggctgctgattagatgccgttgcatcttccactgactgaggaaagtgatgtcgaaaagacgcttagaagcgcggcaactgcatatagtacactactctctccacggcatggtgcagattttttgtcttttctgcacatgactgaatctgaacaatcgcacacctgatacagcggatacagcaaagatatagtcaacttggacgtgtgaaattctgttttgcgtctgctttttaggcctggctggtaactccccgggcagttgtcgtgtttgtgtgagtatttcctctaattctctcgcttatgcgtagccgaaggaaagtcgtcgagttgccactttccagcaatttagcttgtggaatgaaatgatagcctggacactctcaccgtgcagcgagcgtctccgttttttacgcagtttttcgggactgcatgcacgaacccgccgatctgtccgctgtctccggcgcttggcgttccttgtgcctatgattgggttcaacattctttgtcgtttccgtttttttctgtgtgtttcttttcccagtttgtgtacgcctttcactcgggtctcaccttgccgttcttgccccaaccaccggcgagacacacactcagggcgtcttgctgtgtatctaatgtcttgcggagcggcggggtgccccgcgaacgcagcactggaggcgaagggaaaattcaaattaccttcgttgttgttttcgctcgctagcaatccagttcttgtccttttttcttctaataggcgtccgcttctgtgactgggatggacgagatcgacgtcttgtagactcctcggtacagatttcttcacgtttctctggaccttgaacagcgttgtgcgggaaaaaggaagaaaacaaactctcttgaaacgccgtgttcggctgtctctgatgtctgcacttccggtgaatggggacgaagacgttgccgggagttctttggtttgccggacactcttctacttctgcctcataatcaaagggttgatcgccggttctgggggctctgtttttcgcggcatcggccgttgctgttcccgtttgtctctctctctcttcagacagccttcaccgtatttgctaaacaaatcttatcctcgaagagaccctctttcagaagcgaggcgtctccttgtttctctctctttccccgtctactttgctcacgcgtggtgcagcaatagttcttttcaggtctccctctgccttttgacttctcattccttccctcttcggatcagtgttgaagaactcgctacata

SEQ ID NO: 2824 - DNA, 1978 bp, Toxoplasma gondii
tttcagtagcccattagagggttgcgaactgcagacccatttttagctgcgttgtcgaggcggaagacgattcgcggttgtcatgtgacgcccgtgaacgcgaggcttcttgcgagggcggagcgcgcctttgtgtttttcctccttgatatggacattagctgccaaatcaacgacgcctacaaaggtgcatgaagacgtgactcactcacttttaattcgaaatgtcagctttgaaaaggatggcatgataacttctttctctctttttctcgggcacccaggcacccttcgtctgcagtgtccatgccgttcctcttttggaaatggcctcccgtcttaaagcagcacacagggaaagtctagccacgaaatcactgcatctaaagtgcgaactgtagactagtcatacattatatatatatatatatatatatatatatataacaacatgtatatgtgcttgcgtgaatgtatctgctgaaccacttgtgtgaagctgtacatccttgagtgtgccaatgcatcgattcatctcctcgtttgaaacggtgtatgcacttgtgcgtcagggtatctagccatttacttgtatggccgtgtatctatgtatctatgtatgtgtgggtatgcttgaatgcaggggcttaggttttcagaagggtaggtgtggagtttcttccgtcgggagaggcgaaagagccttcagtgaaggaggcgagggatgttcttccgatttcaaacgaagaagaaagaactctctgatcaccataaaagtccagctttctttgtcatctgaagatggaagcagctttaggcgcgccttggcacacagtatctccttttaatgggaagagacctgaaactaatgtccatccatgagggtcgtgattcaattggacagtttcagtacgtctttgactactgaagtgttcgttctgtatgcccgctggggagaatcaggaaagcatggccgagctctcttccgtccctctcagccgtccccatgtccgtaattgtttgcaccaggaactggacctgagtctccagtagacgctgaaatctgaggcgagagaacagtacgcgcagatctgcaggctctgtctgcttggcagttccaaccccgcaatgactgaagctgcacttcctgttacacactactcagaaataaatcgttcgcttcttcttctgcgtacatccagcacgtcctgtatacattttttatggggctgtcgatttcggggctcctggatacggcttatactcgagcactgcgagacagcaggagaaaagactgtggtgcgccgcctctgcaagtttcaagctgggttttgtgcttctaacgcgcctcgcgaaaagaagactctgtcaaatattttattcgaaaggacaagctcccgcggctttttctcctggacgaacggagtttccgaaccgttggcgcgctcctttgctcgcgtcggggccccggttcctcgttttctcgttctctgccctccgtcttcggtgcatctttacgcctttcttctgtcaagagactatactgtgccgcagaggtcttgtcttcaacggtgcatgtctttccgctcgggcgatgcgcttcagcgcgtcacacaaacgaggactttcgtctctcggcgcctctcccattcctcctcgtgaatcaaaacagtctcgcccgtccatctgtctctcctctctctgacagctgccgtcctcttcaccctctctgcgtcaccttctctctttttctctccgtagtctcctttggctccttcgtctccttagtctccttcgtctccttagtctcgtctcctttgtctctttttgcctgtcttcttcgtcttcgatcccgctcctccgctccccttctctcgtctctgtttcctctcttctgcttcctcgcttcttcttccttcctcggtgtctctcctctgcgcgacctggccatctcccatcccccccccccatcccccca

SEQ ID NO: 2825 - DNA, 1918 bp, Toxoplasma gondii
aggagacaaccagaaaatcagatcatatccggataccgtggtgtcgggtcgcgtgctccactctgtgtggaggctagattttcctggaaccggtggaggtgattctcatatctgaatctgaggtttaggaagttgccagacaaatgcatcaatggttggcgagaaaagcgggtgagtgattcggacagatcgcttgtcatggcaggttagatgtagttatcactcgcacccgttagaaaacatacagatgcgatccagccactggggtagaatggaatacttacgtctgcgatcacagggccaaggacaagtcgagatccgtcacgcatgataattcggaagctcgcgatttggggagatggtagaccgtgctgaaagcctgcttttctagaaaagcatcgcaggacgaacgggagacagtgggctcctctgtttccttttcagatttgtgtcaaaacgctagtggtgacgggctcctcggacacgaatcaatggcagttgacaccggttctgtttgaagagtctgtcataagttgctgcatatgaaaaggaaaaggtcatggcagagcaatgtgctgcgacaggcagccgagcacactgttgtaatggctcgcttgtagatttccactcctgcaacaagcccttgaccagacagctttgtcgctgccccttcaccttttctctgaaacacagtgtcggaaagaaaaatgcggattcgcagcgccagccgtgctgggagagagagacctgtcgtgattctgagggcgtgaaattacaatcactagtgtcacaggggaaagccggagaacacttgagaaaaagaaggaatcggtggagccatcaaattcagattcgcctgccaaactcgtagccaggcggcagtcgcaagtttgcgttcactgtccacagatccatcagcgtgatgcagctcaagcggtcctatctcagcgactgtcaccactggcggaaacacgtggtagtcgcagggtataaactctatgttcaatagttgtaggattctgtctctcattagttgcacggctcgaactcaactctcaaccgttgttccttgacggcaggagcagtgctgcagccacgagtcctttcatgaatgatctgccgactgaaccaaacgacatggcaatccagttctcgtattgcacgagaaaccctcgatgattgaagagaggtacgcgctctttgccactctgcaaggtggcgcattacaatccgtactgaatgaaatccccactttcaaaggcagcgcctggccagcgaagacgccacttgagggtacaatggtgcgtaccgtcaaagaaaatgtcctttcttccgtttctacggtgctggagtccacacgccgtggtcttactcgcagtacaacgcggtgaacgtggacacacgtaggttaggtgtgagacaaagcttgggtgtgtgttcgtggtatgtcgatgcccgcgggcagtttcgggtaaagaaacagcgcgagtgggcctgtgccgttgcgcatagacaagcactctgtgtttgcgcggcctgtctcacctcgtcgtttgtttcttttgctacgcgacgatgtgtcacactcgtcaatttcccgcctttctccgcttttctgtgtcaccgaagtaatcggcagtatcaaggttggactgctgctgcatgcccaccaccgagagctagacacgctcttcccgtagcactagttctctgcgtttctgattgttgtgtccctctgcttttgattgagctacaatcacgatgctcctgtgtgttcccgcaggcaaggaggctgacttctctgcgtattttttcgtactttaacatctttttgcgactttttacacacgaggaactgccgccatcgcggactgtcttgacgaaagattgagtaacgtgtcaacgcgcgcacaggaaa

SEQ ID NO: 2826 - DNA, 2645 bp, Toxoplasma gondii
tcgattttcggatgtgtgtgttgcctttagttaatgtgttcatggccatcacggggtcgcttcagctgtaccgcgtgttcatgcaccaccttgcggagaaggagaaagcttcgtcggcagctccgtcgtcgtgaacacgaaggaagtgtcaccagcatcaagcgacggctttctgtggtcttgaagttgctggagcagttttccgttagaagttgtgttagtgaacttggatgtgactcttgaagcggcagttgccgcaagggcgtcgacgagaaaacgtagaaaccgtgatggggttttttgcgtgcgtgcgacgcgtgcacctgcgctaaaagaacgggaaggccttagggcatcttcctgcgtgccgttgaaacacaagtccagtggtttgctcacacctgtaattagcgtgaatgacaacaagagtttgagggagacgcgaggaaccgaacgcatgcagagacgattcgttaggtgctggtccacatcggcgccttcgaaatcgccccagccgatgctgggatgtggtgcgtggagaaccgcgtagatctgtcgatggaaacccgtcgatgctcgtttttatatgtgcatctaaatgaattcattctttccgtggtgaaggaatttcactacgtgctacaaaacgcggccgaaagagaaatgcatcgaacgcccatgcgtctccggtacatttgacacagaaatgatgttgcccacctcgcagctcagtttgacacactgcttccgtcgggtgtacatccaccgaaggtgaccacgtcggcggatccaacgacagcatctgggacatctcgcgtttgcttttctcttcgtcatgcgttttcggagcaagagtgtgtcaggggcttgtgtgcccccagcaaagaacaacccgttttttgataagaggccgtttgtttcgctgaaagaagcagcttttgcaccggttccgtcggcgtgtgtaacgctagaccaagctgcacctgcgtgtcgagttctccgccgccctgtcgcttctgattagggagtatcgatgccctgagtacgacaggaaaaggaccggttaactgctgttcaaaggttaaccgctattcaaacacaactgttcctgtagatgaccgctgttcccgagagtttaagtatagtggtaacaagagtatacttgagaaagcagcatgtgaatacgctgtacaaatatggtactcggtaccatacactagcaagggaaaagtgtacatgagataaaaagcgagaaacgcggagacgacggacacctgaaggacgccaatccaccaagacataaccggctcacacagaacgcaaacagcaaatttggtccatccacgttgtcgggaacacagaacacactgcttgtgtttgagcagttctgtaccggcagcgacatattctcattgatgaggagacacaaggaacgtagactggcggtgcaaggtctgtggtcaaacttcgcttgctgctttctgtactgtgtcgcatggtaccgtgagggagatccgcggacgaatcatgaactacaacacctcacgtggctcctaccctctaaggtattggttccatgcttttcaatgaagcttttgtttcgtggaggtcataggattaccgctctgcagttttgtacggccgaatgcgtgtgaaaacgcaaacgccttcgctgttggttgtatcactacgaccagtttcctgcaaagggacgtgtcttttaagcaggcttcaaactctacgaaattctcttgaacatccggtggacacgcgatccttcacaaatacacgtactgaatcgcgagtgacctgtttcttgtttgtgtggtgtttctcccatctcccgctttttgggttttctgcctccttcaaaagcgcttatgtctgtttttgcgctttgtttctgccaggttgttctgcaggagggggtcagtttctacgccttgagtcactttttccgttccaggtttatttcctgtttcgtgcgtcagaaaggtactgtgcttgtccctcgtccgccacgtgtacgcaggtccgtgatcgttcgctttgctcttcctgtctattcattttgtgggctaggggtgagagattctgacagcgtcgtttgttttctggtgtggtgcgcgaccttgtccagtgcgttatccgatattatttgttctcaaactgtctctgctgttcaggatttccatcaaaaacgagcaagggttaccgctgtcgtcgctggcagaactcggctcgttttccaggtccgagtttctgaccagggcatgtgcgaagcgtgcacatgtgaaagctgagagattttcgctattcttcagaggttaacgtcaactgcctgcttgttttcgccactgcttctgtgtcggagaaaacgcttaactaagtccgctcccgcaaaaaacggttgttcctggcactcagtagctgagagtgaaatcaggcgaatccgaggtctgatgaattgagcaaggccttccaattttcatcgctacgcgtatatctctgcgcgtttgcgtgacgcagtcacggagctagtggctttgaaactgtttgcgttggcatgtgcagagatcattcctttattctcaagaccccgctagaccacaaacacgcggtatgttatcactgacagcgcaaaa

SEQ ID NO: 2827 - DNA, 4224 bp, Toxoplasma gondii
ggcatctccacatccggacgaatacgcatgatcactcaaatatcagccgtctacatggcaactgtttgatacgcagtgctctccggaacacgacattcagatataactgtactacatagacgtatatcagtacaaagatgaataggtgtgaatatatgaagatgtgtacgcagtgtaccagagtggagtcctcgttaagtcaacgggatggctcgcagctgattgcacatctacggtatgttcgatatcgacggtgcgcggcacgcctgtcggcctccgccatgcgtagtcagcttttctggatagtgtatctgtggaaatgagagttgagatgccccgattggtaagtcatgatcacatttacctgcaggtcgttcggacaaaaccaatggtgaatacgttgccttttttttagcagcaggtttccactgcaatcttagtcgtgaacggttgaatatatcgaggcacaaaaaggtagcaagcatcaggtgtgcagggagagaagcaactaattgtgaatccgtcgggtgaaagccattctccttgcaagggagtggagatgaataaccggctcccagttcgtaagaagaaatttcagtgacgcaccgcaaccgctactacacccgaacaccgtgcaccgtgggggtacccccgccggggaaagcgaaaaattcattttactcacaagagagatatcgattcttgcagcttgtagctgtccgtttccactgtctcctcatgtgaatgttaataccccataccagaggaattggcagacctgccgtttctcagtattagtcaaaaactgctacaccgttaggcttgggtgtcgtccgcgtaaccgattcacccatccaaatggaagacaagccgtgacgagccactcgtaaaacatttggagatggtattgcaggcgcagcgtgtcacatctgtgcagctgtcttcagcagtggcggctgggaactcgcatctataaaacagcagcgtcgcgagcaggaagctaattccagacgatctagcactggccttgccagtagagaactgaaacaacattgactgtggatatgcaacttctctctagcgagctcacacgtctaaccagccccatgtttgaaactgatagattaatcaggcttataacttccgtttatgctccagcttgcttgcgccgcggctcgccgttaatggttgtctcggcatctgaggaacagaaaatgagcatttgcagctggcaggtccgcagtaatccgcctggtatatatggataatagtcgagtcttctatagtttaaccgctacagctgggacgcacgcgaccaatctgaagaagatgtaccggaaatgcaagttggggtcgccaccagctacgcacattgctagattcagaaacagcctgcttgtcaatcgaagggtcgctggctatcaaaggaagaagtgttcttgaacgctctggcagtccatgcattgcctccgcagcagaacacaattcaagtccacaaatttccgttgcgatggtgtgcaaaacgtgtggaatacttcctgggtgttctgtcccacgacttctatggaattctgaaccgcgtttgttcagcagttttcaatgctctgactgaagttccttgtcccttttcgaccgactggatattatgttgaaggggcttgtttcctgccttcttttgtttgacagtccttcttgattgacgtccacaaccctaaacaaacgcagcagcgagacgcgtgatatcctagcgagtccccaacctctttcacaatgccgcagtgaagtctccgcctcttgacgagttagtgccactgaaaaaaaaacatcttcgctccccatctcttgtcgcacggttacaccagcatcgtttcttctctatgctcttccttcttgaaggcggttactttgggcggcgaatgttcattatgatgatattcaagctcgcttcctacgctacaaaaggtagttgtgtggttgtggaccttgaatcgccggaacgtcgtccgataattgctgacgaagaaacgatttgcgtccaaagccagtctgtagcgacccagccgcagagaaacatctctcgccccgcgggaagtcatacgggcaactcgtatgctcagtatgttcgcattgtctccgacaatacggtacacgcatcgtacaggtgcagaccaggttgtgtgtgcacttgtgtgatcgcttagagtaccaacaggacgtcaaaaatgtgaagaggttgcatggctcactcgctttggtcgaaattcccatactcagacacagcgccgggggttctaacgtatgtcgatcggggcatttcgtcgaacatctccggagcgctaggcatgaatccgaattctttggctacagaacgtcggggtgcatcatctgacacgcaccccccgccaagtacaagagtggactggtttctcttgtttctgctcctgcacgtttcgcgattactagctccctcagcgactgcagcgaacaccaactgctcctggccctgctttccccgcaccggatgccccctgcgctcttccgcaaactcgaatctctcctgatctgtcgcgtctccgaaaatgagagttgatttgttgtgctcactgttgacaactttcccttgttttgtgtgtggactgcctacacgtgggtcgagtacctggtcttggtgtaggctagaaagaccagtggtgtcatccccaaactgtaccgaactcttgtttttgtttacatgcctcgcagccgttgtcacctgttcgacgtagaaagacgggtctacgggcggctgctgtcgctgctgttcgacgtacgcaaaccgttctgccgaagcatctcccccaaggcagactgtcgatttgttgtggtcgggattcggacgaacatgtggatgtgggacagtgccgctgcgatcgcccaaccctttgaacagtccatcgtagggctgattcgcccgtctgtcgtcgaggcacactttgctacgatcgtccgatttgaaaagtgccatcgtgttttacaggtaggctagttccagagagctgcagctcccgctgcgagcctgtccaggttcgcgctagtatcgaggacaaccgagggatttgtgtgagcaatttgccacgccattcagtgtgacgtgtcacatgtcaccgaaccctcgatttagcattgctacctggtaccgtacagaaagcagacgatggtacaccatgtgaggcactcagcgccgtgacagcactgctctaggtacacaagcaaggctacgtttcattaaacagtgggttcccaattgaagaaaccagttgtggctaggtatccagttggaccgacaatgacacctgtagtggcttcccgaacttttcttagtcgatgtttgtgcttgcatgcgaagccggtggccccatggcggaagcgccttttccaaaactcggctgcaggcgcacacgcgtaaccggctaggaactcaatcatatttcagtagaatgacacagctgagcacacggcctgctggtgtcgagcggaagaaaatgactatagtggctgggtttgcgttgaatagtgccagggtgagaaagccatttgcagaagaacggcagattgggcaatcgccaacctgctgcgcaagccttttcttgaacgtgctctctgtgactcggtcaccagtggcccttcataatcctcacacaagataattcagtctaccagatcttctttcgcagcggtgactggggtgacaaattaagtcacgcttgactggcaatcgcatcccaccacacgcctcatagcttggtgtacgccatctgccgacaggggggagttgcgcaactacggtcattatttgtcggtgacatttcgttgttggagtacaaataaaaggctggctcagtacggcctctactcctgggggccacgaccgctcacgttggcaatgaacggccgacaagtgagacttctgccgatgcgttaaacacaatatgatggcaggcaagcagtgttccgcaagcggcaatactcgacttcgatagcagcgccatttcagagcttatgatagtgctcaaatcgtactccaaagtcagagctgacctattggacgctgtaccgtagcttacggaaagacccacgcactgctggaaaactcaccaaaaacaattcgggcagccaccatttcttgtctctttcgcttatttgaagagccagcatatcaacgcggaaaggatcaattcgtgacga

SEQ ID NO: 2828 - DNA, 1625 bp, Toxoplasma gondii
ttatcaaaaggtcttttctggaaaaaccggtgtgaactccttgctgtgctacgggaacctagcaacaacagtgaggggtacgagtcaccaagtgacagagacaaaggctgtgaaccttggcttatgcctgtgtgtgcgaagggagcatttgttgctcggtgtcttgtttctaactcacaagaagaaacttccgcagcgtagttcctccggtgacgcagaggcacatttatatccgtctccacttgtgcaacgatctacagaaccaatagggaagtgtgaccgacgacggcagtggaccctcttttctgataaaaaccattcacctgatcactgctgcgtacacgagaaaaatgagaaacaaaagttcttcctttggttctctagaactggtggtacgcgcccactgctattagagaaggagaggaactgcctctcctttatctccatattctatggagagagtctaattctccctcgcttgagtcacgtacacgtctggcgtcgtaggacggattcgaaaatcttgggaattgcttttccacgagttgcgtcacacggtgaaagtcggagagcgtctacggggcaaagcacgagggaaaagaaggtgtgaggacggtgttggcgctggacgaaacgtaacgaaactcgtacaaattcggaatgaggtttccagtcaagatcacacgacagtttacttgtacgcaagcatataaaagatgcattgacgcaggaatccggataggtgcgccacgctgcagcagtcaggcaacctcagtctgtgtgtgtccgtttcgcggacctagatgacgagtccagtcgagagcgaaggacgcaaatgatcatacacatatggactaaacctttctggaattcagtctgtcgtgggggtaaaatcccagcatctaaaggagatccttccgcacgacgactaggtaacttcgctagcaagacgactcaaacacttctgctttgccccgtctgctgactcagcttagtacattagtctttgaggcaattttcgtcaaaaaaagactctccgactctctgcggttctgtgttcgccggtccggtcaatgaccggaggcaaacaggagcgcgtctatgccgttcgtgagactcaccagcggttctccagaaaaccagacagtgccaactcccacacatgagaggttgcactgagatgcagcgaccttcctgccatttgagagggaagcaacttaattctttaaacaagtgcacaatctcccagagctgcatgagctctaaggtcagaacgggaaacgcagtccgtagaagctcgaatcagacagactgctcagctcacacttccagccggtgcctttacgcatatttgtttttaaacgtaatatgcggttttgcgttgaggaaaaggttgttcgcggctttccaggctctcttaccataaagtgtgaggtccgccgtgcctatgtagcgcctgtctcccgtgcatgcagggaaacgtttacatgcaggcgacttcttggctttgcgtcgttttgacggaagactgcaggatgttttccttccaccatagcccgtttttctcgttgattgacgcgtgcgttctcctcgtttagcgtcgattctcacgctgtttctgctga

SEQ ID NO: 2829 - DNA, 1573 bp, Toxoplasma gondii
catgagtcacatttttcatcctacgggacatgcaggatactgaaacatacatgaagatggatttttgtgtatttttgaatgtagatgggggcgacagagctccccttgacaataccttctgtgaggtcctgcgtttcctggaggagttgttcctttcttccttttcttcttcgtcttctctcttgcggtctcttctgtctctttttctcgcggtattctgctcgctttgcccacttcttctgtgaacgcggcaaccgctttgcatcaggggctgacgagtaacaagcagaggaagcaggacaagacgaggaagaagaggacgaagaggaagtatgagaagacgaggaggaagaagaggatgaagacgagggagaggacgaagaggagggagaggacgaagaggagggagaggacgaagaggagggagaggacgaagaggaagaagaggacgaagaggaagaagaggacgaagaggaagaagaggagggagaggaagaagaggagggagaggaagaagaggagggagagggcggcgggcgcgccatggttgctgtgtgttggtttgattcgtcaggaactgaagcgaaggagatgcgcaatattctgactttgcatgcacgcgtcacccgatccgcagccttgttcagcgttgaacaaagaggcctgggaagtctccacagtttgactccgtgatagccgaaagcaagagttgaggaggaggagcactgtcgttgagaaaacggtcaatgatgcgaacaaaaagttgtcgactttagtgaaaagactacacgaaaggcacagcaactcggacggcgaggcgcgcgctggcctgactcgggtcaagactcccagagtacctacacctgagcagcggaggagcgccgaagagaagataccggaaatgtctaacacggagagagttcttcaaacgcgcgaaggcgagactcttcctgttttagcgtctttcgtatagaggattctttgtcgttccgaataaaaaagtgcatgccccggctggcgatgcatgcgcgaaaaagagggcgcaaagccttagaagcccccggcagcttgtagcggacactcactgtcggtacagccccacaggcatatatccctgtcgagtttcgcgttgttctggtcgctgagaatttttgtagaaatcaaagtagcttccttttctttcctcctgttctcaaccgcttctgtgttcagcacagaagcgagagttactggagcctcggcggggacggtctgtcgcctctcgccgcgaccacggccctggcgtcgtcgagaggagaaagagagaaggttgaagagcctcttttgaagcccgttttcttttccttgtgaactttcgattcctctccctattttctcccgtctctttttcctctctgcctctcgctccgactgcattcgcaactcttttagcgccccgttacagctttttctccacgcagccgagagtcccttcagccctccttgcgttgtcctttccttcccttgctatacgctttttctttcttctccttctccgtctcctcctccttcttgttcttctgcgtctccgcca

SEQ ID NO: 2830 - DNA, 2284 bp, Toxoplasma gondii
cttacagtgaagggatagcagaccgctaccgaatgagaagaacaccccagacgcccacgattggagcacgacgacaaagcagagcgaccggcatgggccgagcgtccgagcggttcgcttccggggacgagagactcagggaagttccggttctcgtccttcttctcttggcgtctctccccgtctctctctgcaggacagtcgcaggcagagcagagcgaaacgcacgcagagccaaggagagagggggagagtgagatggagtggcgacgaagaagaagaccgagaggggactccaagacctgtttgcgggagctcgccgctctcgtctccgcagaaggcatgcgagaattgcttcttccaggagggaacgccagcaagacgagaggagaatctttgggcggagaaacggagaatgaggcagccgtcgactgagacaaagacttccgtcgtctcggccgacgccacaaatcgacgcgagtgccgggtgtacgcgcgacggtatgcgccatgggggagacgctagtgagggaatgggggaacagaaggacagaaaaaatggaggtggaaacaactagaaaggaacttaatggtggacagactctgaaaaaacgcgggggtgaacgtagtgctgcaagacttgaagaatgggtggggaggttggggacgccacacgaagtggaaaagccggcgatgccacgaggcgaaagaggaaacaacagaacaagaggcgtagaaagactgaagatacattcagtgaaatatcagtaacgatgaaagctcttcggtgaacgtatcaacatagtagatgaagcgggtggaggagaaaataatgcgaggcaggtcgacgctgtaggtgagagagttcaaacacgatggagtgactattttcgcatgcatgccacttggaacgttgtatgtgcacttgttcacgaagaggaaaagtcaatcgacagtcaagagaagcgaatgaaatagcgcaggagaggccgcgcgcgaagaaacgcggtgcttcgcagcgacgggtattagatgagaaagcatgggttgggtccccctcttaagaagaagacagaaaaacaacagtagcactcgattcagaaggtgacaaggcacttgcctttgacgatggagagaaaatcgaggtgcacggaacacactcgagcagtgcaaagtcgcccggccggtctccgcgctgtttggggctgagcctcaacggcgggaaggcggaagaaagcgcctggactcgcgggttctcgatttcgttttgttgccacaaggcagaaaagacacagcagaatcaaccggggtccgaaatcgaagaggagagggattctaacggtgaatagcgagggcagtaagacgcagactgcagaggagcgaagagcaaagccgtccgttcgctgcccccttttgcgaacaatgtgcaggctgcatgcgcttccctggagacacgttgcagctgagagatccaacagaacgttttccggagcgtaagaagaaacgaggttggaagaacaatctccaggattagggcaagagcagtacaaagccgattcgcgctttgcgtgacgccacagcactgcaggaacctcgtcgtgacagcagaccatgctgtgtgtatgtatgcacttcagcgcgagtggctctgcctggacattcatcgccgattcctgaaaacgcaggaacgtctgcacgagctgattcttcgagcgagtttctgggccaatttctccaggcggtagttttctgcgttcccgagattctgggttctccacttgcttccgattccaccgccacaaatcgggccgtgaaaagctgttcggccgtctcgcgatatggcgttcttttccagtgcgctgctcctgacaggagagcctggcttgcagagaagcggtttcgtgtctagccaataacctggaataacagttttccgtcggtctgttccctggatctcctcgtttcgtcgcttttcatgttccagatgttgcaaagaagaccctctcactccaaccggaaccgctcgacttgcgcgtgtcctgtggtgtctgacactacagtagggtctcagatcctgtccgccaggacctttgttcttagccacatcaagcgcatttgacttccattgtgaatccccaccaccgttttctgccatccgcagtcgttttccgtatccactgcgagcaaaggtctcgaacagcgcctgctcggttgttcagcaggtgtacaaactcagggctgtggccgctcgtgactttgaatctgaggagtttgtcaaaacgca

SEQ ID NO: 2831 - DNA, 2629 bp, Toxoplasma gondii
cttgtttcgaaagacgcgtgtttgaacgcgacctttcccagcttcgtctgacccgtagcgacggccgtttcctcaggccctttcattccggccttgcgcgggggctcttgctccgaatttgtttccaaactcgcactggccgctgcgtgaagatcctgcaccgctccctcatcgttgtcgtcgagaaagcgcctacgcggcatgaggaaacccgccacgaagacgcatacgaggggacaggcacacgtgtagccgagcgctacagactggaaggagaagccgtaggcatccatgatggcattgaggaccacgggtaccgcatagcttgtggacactgccgatcccaaaatcgtgatcaccagcccgccggcgcccggaaagaggcgcgtgatgcagaaggtgggcagaaacgcggtttcgcagcccagcgccacggttgtaaagccaagatagtaaaacatatcagatttgtgcgcgaaagataaacatatccagccacataagttgaacatctggccgaccatcgccgtccagcgcggccccgcgaaatctaaaagcgcaccggcgaatgcgcacatggtgctgcagatcgcccaagtcatggtgtacagacgctggacagctgcgtcctgtttgtcgcaaatgtacggtttgtcatttaccacgcgctgatcatccacgaacgcgccggttagggggtctctctcgcacaaactttcaaagccgttgttccggaagatcaacgcggcaacggacggccacccgtggaaaaacacgcctgtgctcgtgatgtagagggcgtaaatgacgagcagcacgtagcgattcagacccaagggcgctttctggttcgcgggaggcacatcgctgaacggcagagcacgccggatcgcgtgcaggcacgcagaccaggagcgtaaaccccgcctccttgcgccctcagcacgttcagggccgacggcagcgactgaatgtgccagagaaacttcttcgcgcagaaaatcgtgggaagacgaactctcactagacgactgtccccctggcttcggagcgggctctccctgggacgccgccatccttcacagccgcggcagacgaggcgacacacgcgaggggacatggaaaagactgacctgcgagaaagtcgcctcaggtgtggaagcagagccgggggttgtagctctggacgagacaaacgcggaaaaggacctccgcagaaactcaaggacttgaaacggattaaggaacctgatcgaggcggaaagaccggttcgctgtctggagattctcgattcctatcagtcgcacagataggaatacggaagagtaacgtgcaaaatcgaacacggacaacaggggaatcctagcgcacaaaaggccacgctattcaggtgattaaatcacgcaaaaaaaaccattgaaaagacgcagaaataccgctgcgtccctgtttcgtccttctcaggtaggctagaacaagagaccgaaacgggaagcagatgaccacctacaccgggcggccgacaaaaaaagacagtgtcgctttcacgtctgctagtagaaagcctgcgaatggcgaaagccgtatctggtcgaaacacagtcgttgcgggggctcttgggtgttactcctgtccaatccagatttcaaatgacgcaactcaccgaataaacacacttgacagagaggctgggcgtctccagagatcgctgcctgctgtctacagcatgtcgacgcctcgcctccgagcagacacagatgaaaaaatgagggagagagggtcttgaaaatgcataaaagaggtaaatggtgtccggaaagagaggagaagccgatgggacaagtcgccagcttccctggggtgtgctggtgacggacagaggccacgactcaaacaagctgctgtcgttgcggtaaaacggggaaacgccacaggcaggaccgttcctccgttggcaatccacaaaccgcgaatatttcttgaaattcttgactaatcttcctctgtttcacaccctcccccccccgcccccctttgaaaaaggagaccatggagagattttcgaaaacagaggtggagacggcaacaaaaccgaattctagactgaccttctgatagcagacagcatcaagctccgctcctcagaagaactgaagtgtcattatacggcctttagggctctatcgaaagagaggacctccatttttttcagagaatccggacaaatcaacggcgctactttaccccacttctgccgagaacgcggcggaacagtggcagccacgggggtagtggcggaagcgaccgaggaagagtggcagaggccaacagcgctagatgcaatttacgacgccggcaaacgacacgcgacagtccagtctaatgtttgttactgcagaagacaaagcagcagctgtaggtagaccctaccgtactacagaagggcaacgatgagcattctccaatctgtccgcgtcgcctggaagacctacggaaacaaatccgaaaacaaggcggggtttgaatttgacgacagctatttgaaaaactacagggcaaccatgcattccgcagccaagaggaagtggctctcataagagtctttgcaataagtagcaaaagaggga

SEQ ID NO: 2832 - DNA, 2693 bp, Toxoplasma gondii
aatcaggaaattacactaggttccatcacggaagagctcgacatgagttacattgtccaactcgcacacactcgtgtatgtatgtaaagatatctatatatatagtgtatgtacatgtatatatgtatatataggtgcatgcatatatgcagagatacgtaagcatttggagcgtatggccagcgctttctgtatataaaacacggacatttgatagattcacaagcgtacatatagctatacaggtatacacacatatgcagctatatatatatatatatataagcatgcatgtatgctacaagggtttgtgcagctcagttgtggtagttctgtactttttcagagaatttctagagttttgacagggtgttcaggtcttccattagcctctgtctcggatgtgtgccctgaaaatcgtccaccttatttcatgtagcgcttcgctctgtaggcagcgttgacaacctcttcctgttccagctttgcagtcgactgcagtttcttcatcgttcaaaagcaaggcagtccagaccactttttcggactggctgtggctcctcggggcggcgaggcgcacagtcatggagaggcactcagcgccaaaggagaaaaagagagaacataaaggtagcagccgttttcccgcgtttgattagaacctaaaactctgtcgactggacgctgagactgcgagttgggggaggaaagggtaaacctttttgtgaggaactgaaacctgtctggacgttcagacacctttgcgttttcctaatgagacaatcagtttcgacgcaaaagtaagaaaaaatgccctgatttacctgaacggtgcgccacgcgtgtttagacttccctctgtgcctagccctagtttccaaggaactgttttacctttcagtgcttctcctgcgtctgtagccgctcccctctcaatacttgtctcactggtactgtacagagatcggaaagaatgtaattttctgtgtatgtcatacgaggggatataatagtgcctttagaagttggtaaaaaccccacgacgttttcagagagaacatgcacatcccgtttgaccattcttttgcttttggtggcgtctctggaatccgagaagcgatgccttgttaactgagatagaaagccctcgataaagatgaaccccgacgggatatactgacgatggcctcggacagctatcgcaaacacttgcaccgaagtctcttcagacacacacatgtatacctatcccttaagtcggaggcgcaaaacacgttcacagagttaccaaacaggtactaggccaacaagaatccggcccgtgtacatttgcaaatgttggttttccaaatagatgctgacgttaaatccgacgacatgcatcggtgagaaattaacattgcaccagccaagaattgatgactgcctggagatccgccatcgtacattttaatattcccgccggcgttttcttacccctggctcttgatgggccactggtaacggtaagactccagcctgttcctcattatattgcattcatctcgttctttagacattacccagagccttttctctccgcgcgatagtcattctttcttcactgttccagtaaccgacaagcgggagtcttgctcaattgaaccctgctacccctcctcagcagggacttgcagacgcatagaggcgagttatctagctgaagaagccacggccagggtggcacggtggcaccacacatcgcacatggttctttctctttccacgattccgattctcaacgggcccaacggatccactagtgacccacttgagagcgccgcaaaaaacatctttatgcaagatctgcaaatctgatatacgtatgagtacagggttgtcccgctgctgctcctccagtatgtgtgttggagaggctacgtccactggcaggatttgcagactcgtggcgcccaagacccacccgtcctcgacgaagttcttttttgaacactggcgagacggtgtttgccgcatcaattgtttgaggaactgctttagaagcctctttcccttggaaaactggagaaggaaagctacaaaaacgctggccagtaacgctcctctctgcctgtccgttcttgagtggcagcccgtccacccgcttgactccgcgtactcagctgaccgactgtgaaccgccatttctgcgctttgtggctcccagaaaacacgtcaactttcctgttttccggtgcatacttcgcgataaaggaggtgcccttttgtcttgcgagtttcccgcgcgcacatctctcatttagggggctttttcgcacccaaggttcgacgctgggtcctcggatttttctcgcagcgtgtttgagttacgggccgaatctctccgggaagtccatcgaagttttcttcccatttggacagcagaaagacccacctttcagcggaggctttccaatcgaagtttcttcttggattgtccggtgtgtagccttgagcaaggcttacacccacgaggtttctgtggcccgcaggcgccaatacatctattttcttatccattcactcttttgaaaagcagagttcgggtatgtcctccactgggtgctcctgactcatttgcggcactcgaggagcgttctgacgccgtgttccgcgttaaagttcactctacttgtcttagcgaagacgaaaca

SEQ ID NO: 2833 - DNA, 2415 bp, Toxoplasma gondii
acaaagccctcagcaagtacgcgaaggacgcaggctcgttcttcgaggcggaagagcaagaagagacaggtcggtaggcgacgtttcgtcttccgcgtccgcgagcgcgggaacctcgcgcaggagcggcaggagcggcagaagcgcgagaagaatctggagaggcagtggaggtgcaggcgccctggccgcggtctctgcctcggccgccgcggcgagcgccgtcgggtgtctgtccacctgctggacgagacgacgcgggcagcgacgcttctgtgtggcttgtcattctgccgactctggattggtaggagggcaagaaggaagaaccgccaccgacggcggcaacgaaggcgaagaggaaaggaggaggaaaggaggaaagggggaaaggagggagggggggcagatgaggagagaggatcagcgaggcagcggccagaacgaggcaggaaaggcggagttcatgaccggaggagaagcaggagtgagtgcgggaagtcgcaggtggagaggagagaccgaagagagaaaacaagggcaagaaagcgaggcagagacagaacagaggagctcatgcgacggaaaacagacacacaccgttcaggagggggacagagggaccagtggatacaccaaaagcgggtctcgaaacctgacaatgacacggaggtgtcgagaagcgtattcaaaaaagcaacgcagcagaaacagaagtttttttttgaatgtcgaggtttcgaagagagctgcactccgagggaaaaggactctctgcgagactggatctcaccagtcgtgggaagacttggggtgcatgtggacttgcacggtggctgaagaaacgagatatttgcaaagagatctctcgtctttcgcgacgctgggaagaaccgcccgcagaacgcaggccaaccaagagaggacgcgcagacggagaagtcgaggtgctccctctctccagctctgtctggacaggcggcggtcttggattcggtgaagccaccctctacaagaaagaatggaactggaagaggcgcgaaacgaagggtcttctctcccctcttgggcgtaacgcagacgaagcaaaggacaagaaagacaccggcgtcacatggccgtcgcgcgctcccggcgaaaagggagagaggcggggggcggaggtgaatcccgaggcgaacagaagcttcccctgggataaactgttcacacatgtgtggatgtgaaggagagattcgcaaaagcaaaaatgcacgagctggaaggcaaacgggggcaacggtgtgaaagcgatgcacggatcccgggagagagcagccgagtcaaggcgaatcctggcggctgtcagggacggcgacgcggagggagaaaaacgaagaagaggaaaccgagacacgggcgagattccacagtgagacacacctcgagaagctcttctgacagccgcaaatgcgttcattttcagctccctggactccttcgtccccctgagcagaagccgttcggggccgccgcgcgcgttgcccgctgcatgcatgcagcacatgcgaggaaagccggaaaaagctaaggcgcccgcgagatacacggaaaggaaacaggcagtgcagggaaggacacaagtgtggcttccgaatcgaaaaatcgtctatttccacgcggaaggcatttgggtcgcggcacacgctgggcggcggaccacggttcagtggacgtgcactgcaaagagtcaagaaggctgacaaaaccgaccgcgtcttctgtcagttgcttctcataaagtcagcgtgccgcagctgggcagacatatctgaaaagcgtgtggtcaactctttgttttcttgactcgtgggaaacgcaaaaacgaacggaggacgggcaagttccttcgttcgcgtccgttccccgtcagcctcagagattgaccagcaccgcggaggaggtcgcagcgacagcgcgacggcaagcaacttgcgcgagttcttcatcctgctctgctcctctctcccactgttttccgtctaagtctccttctgcgctcgcatatttctcgtcgctgacgcatatcgacgcctcgcgcagcgaactgatcggcgcggtcttccaggtgccagctctctctggtcgctgtgtgtcagatcagaggcagcgacggcctttggaaggatacacgcagcaggtgaatttgagaaatccagaaggaggacgacggaaaaagagttccagcagcatcaggagggagaaaacgttgactgacgcacaggggtacgaaaaatcacttttcttgtacgccagaataacagcacaagatatttagacgttcatctgtcgcggacatctttaagactacctcgtttcacccgtcgttcttttcctcccttgtctccttggttcgctatttccagtctcaaacca

SEQ ID NO: 2834 - DNA, 3423 bp, Toxoplasma gondii
gacctcagggacctgtttggaaaagaactgcacacgaccactcggattcgagagggaacagaacaaagaggcccaccgacggagctcacgagactacagagaaaaagataggcggagtcggatagcttcgggatacgggagttccccatgagcttcaaagatgtcactggagtggacggttccatattcaagccgaggaagacgtaaatgcgaatacatccgtcttcttcagttctttaggacgaccaaacgaaaggggaatcgaccgcgaggaaccttcgcggtacaagcatggaataacaactcgactgctccacacataccgcagggaggtaacacaggggactcaaatcggatagacattccatcccagagaaacggcttctccttggattcacttcctcttcatattcttcctctcccttcgtccgtctctttcttctgtagctacggctatctcacggggaaccagaaccggcatgttctcattaccttcgtctcttgttttgacctgagcggaacgtccccctcattcttctatgttcaccttcttttcacggcttcgacttccatcgttccttcttcccagtttctgctctttgccttttccacactttttcactcgtcaccacgaaccctcaggcgttttcgcgttgcagcaacgaaagacactcgagacagggggtcagcttcctgccacctctccttttgccgccaaaggcagcacagacgcgaaacagagtataacgtgtttcggtatatccctgtgatccgcgcgaatttctctctccacgaactcacaggacctgcgcgctcctcccagtatagtcgcttcctcgggtccctgcggtttctgcgacctgcccgccccctctcgtgcacaaaccggtccttctttcgttgtcttttcgctcgatcctatctaggagagaacgcggccggtttcttcccgaacttcctcgccgagctgcacgggcgacgacgagagcgttttgcgcgcctctggagatctcgactacctgctggcttcccccgttccactttccgggagacatcctgatcagactcggaaaatgaggattttccgagttctctaccccttccgtcgcgactttggcagcgtttcctaccttggttttgcgattggcgagcactcgcggtgctggtatccaagtgctctcgacgcggcggcggcgcagagccacggaatctcggagcgggaggaaaagatgacgacgagggaagacctcgaaagaaatcgcaaaagaaaacgaatttcggcaccggaaaaggtggacgagtggctcacgaggcgggacaacggcgcgctaccctgggggcaaagtggctgcgcgaccgcgtgcgatgaaaggaagccccgacacccgtttccgggcagcggatattctggcttcacaaaacagcaacttagcacgcgcgctagcgaggtgccgcacaatctggagcaaccgggattaatagaagctaaattccgtgtgaaaactcgatcctccacacacaacgacaggaaactcgatttatctggcaagatgtacaacaagatctggaaaaacaaaggtctaacgcggcacgcgcgccgctgcgacaccagcggtcaaacgccgtagttccgaatataagccgaatcggagtctgaggcgcgtgagcgctttcgagcacttctctccaggcgcaagaaaacgggcgaaccagccacaggctagactgagctgaaacccgtggacatttttgaccccgagttttgctcagaggcgacgagcggtccagatcttctcgtgcccaggcattccgagcggggcctgcgattcgcggtttcttctggcgctctgggaacgcacagagtgtgtggaagtccgcgttttctgctagctgtcgtcccctgtagctaagtgaaattggtgaaattagacagaagtgccgagaagtggagtcgactccacgagacctgtttcgctctgagttcggggtgcacgcccattgcgatctgctgctgcgcttccgtacttgccagtcctgtgaaacgcgtggaagcagcaagctcggctttgcaactcggaagagggtttcgcgcatatcgtcgcgtccgctcccggacacgtaaatctgcatttgctgaacctacaatctctatagtatgcttgcgggtagacgtcagtgagatctaggcccatagtgtcgagcaaaaggagatccggtttctctctgctgcggacggcccttcttttcccgtcttgtcttttaagctatcgatgctgtcgaagagagcgttgcggcagaacgcgcagcttgtctcccgctcgagctctctccaacgagaaccggagtggaaggctgtgttgtaaacgcggcgctttgtggggatcgaaaacgaatgaatgtgaagatgaactctcagattcgcgcctgtcctgccgaaaaactctgccgagcctcctcaaggccgctttcaccaaactcgccactgagaacgcgtgtgttgtcttctcgcagtcgcgtccccgcggggccggagtcgtaaagttgaagacttgcagacaggtccagaggaaaattttcagattttttgttcgcccgtagccggtggggaggaaattctgggttttccatacatcctatttcctgccagacttgcggtattcaaccgagcagaacatggctctccgaggaccctctgcttcacgaggaggggcagcgccaggagacagtaaaaaacggccccgcgcgtgtgtctcggactcgacgagggggtgagagaaagaagaggaagccttgattaagtggaaagcgagctccattgcgtgcttagattggcctgtgttagcgagacgcagccgaagggtaccgaggaagctgctgcgctccatacggcggaacattacccagcaagcgtcgttgagtgagagaagcccggctgccgcttgatctcactgcccggcctcttcctctagatatttttcgtggtggactgcgtcttttaagaaacatattttattccactggaaaacgctttcgctttctggtggccggtgggggggcggcgctgcgtggagaaaccggaagagaggattctacgaggaagtgcgctcttcctgtgtccatacaaggaagggaagataagagcgtggttctctctctccgcctcgcttcttacgcgtttcctttttgtgtcctcactctttcaccgtgttggacatcccactcctgtctgttcttcccccttgcctgcagcctccagtcttcctcctttcgtttgcttcgcctcgccatttgtgtggcattcgcctcaaactctgcgccgttcgcacttgaatttttgtctcgctggcctcctcgcagctttaccctgagggtgttgtctgttcttcgcttcttctcggatctctcttgtgtctgtcggcgaaa

SEQ ID NO: 2835 - DNA, 2322 bp, Toxoplasma gondii
cgtctggagacggagtcgcttgatgaatgttgacttcgttcgaatgcctacctgagaggactttgtatctgtggggacagtctgcaaaggcgatggcgacgtccgagtcgacagctcctctgtacgcctcgcgcatgcgtttttcgttgatgaaagtgccattgaccgcactcagctcgaggagttggaaagaagctttgtctctggacgcactgcccgatctggagcgagagcgactcgaggagacactgcgccctctgcgacctctgcgggagtcttcgcgcgcgggtgttctgtcggcgttctgcgtttgacgtctttgtgtggcatctttttccgagaagacagagagctctgcatgcttgcgagagatcgacgcatgaggcaaacgaatgccaaccgcacccgagttccggccgatcacgtacgtcttccgggaggccaggcgccagcactgcgtcggatgctttccgtcctcgaactcgacgaggaaagccattttctgcgaagagaaagagaacgtggaggagaatccaggacgcgcgttcgccgcgccggacgcggaacacggacgcagccgagacactcgagctgtgaggcggtgaaggaacgacggctgcagcgagggccggagcggacaggagagagaagagagacgaaggagacagggaagtacaggggaggcagagagacgagaaaagacggaaggggaggagagtgaagagaaagaagggaggcgaaagaacgaggaaggagtggcggtccaccggagaacaagagagaaaaggggagaggaaacagccgggatgcacggggcaggaggaaagaagagggagaagaaacacaagaaaagcgggaaggaaactgacagaggggagacgacgcgagaaaaccaggtgagggaaggccccaggaattcgaaaatcctcgtccactaagcgcggctttccgtttctgaagaaaagaaaaaaacgcactggccacgacataaaaacagacgcaacagaagaaaaagaccgagtgtatatacacccgaggaatgcacggacagcgcgcaggtgcgaaaatctttcagcctgaaaggaaagaagagacgaagaggtcgcagaatcggctcgcctctgtctttctccggagaaatcttgaaaaagatttggaagacaaggacaggaggagaagaagagggaaggaagacgaccgtccctggggaaggagaaacgcaccacgcgatatcccaggcggatgcaaggggatgaaaggcgttgatttttttcccgtgactctcgtttttctttccactttgcaaacaccctcacagaaaggcaaacacgcaaaatagttggcgaagacgatgtgatgaagaagcaacagaacgccaagaagaactttctgtaacctcccgccccctcatcgcgctcgattcgagcgctgcgtagttgggagaagatgagtctcgcgaggaggaggccttcgctttgaaggagagaagcgtcgacaggaaaaagaacagaaaacggagaacctcggcgcattcctcgccgcgccttcggcacccgcctcttcccctcgcgcgcgcatctcggtgtgcaagaaaagtcgcagactcagctgtcacgctttcttttcgcagtcgaggtggaggaaacgttctcttttctctcgagcgatcaccgagtctccagcgatcaccgagtctccagcgaccgcagagtgtcgagcgaaggagagcgaaagagacgaaagggacttccagagtgtggagattttttcggagactcggatttgaaaaggagaggagaggagagcctgtgtcgcgaagactccgctggacgtctcatcccgtttctccgcgccctcttgtctctcttcttccccggagaaacggacagagtcggagtggggagtgaggtctctgcggtcttctcctttcttctaaagtgtacccccaggactctcaaggtcggatggtgtttcctcggagaaagaaaggagctccggaaaaaagagtcttcagcggtcactctcgtcctgcgtgggcatttccaacttcccctttcgacacaggcttggcggagaagtcacggactctctccccagctcgttctctcatcgccttcctctctgccagtctgctccaccagttccgttgaggcgatttcaagagctggaaaccgaagataacgatcaagcaccttctcttccctcttgtctggcgttcgttgcatgtctgtgcatctgcaactcaactcttcccgttcctgccgctttttgcgacctcccttgcttccacagacacactctacagtgtagggtgtacagtca

SEQ ID NO: 2836 - DNA, 1283 bp, Toxoplasma gondii
cagtaagcaaacgaggttcaaaagggccgcctaaagctcttcttttgcagcttcgggtgaataaaagagaccagcgatgaacatgttctggaacgaagcgctcctccgcatatcctgagactctccgtctcttgcccggctcttgttgactccgaaaatctcaagtccgatccccgacggaaccaggggacaccccagagacgaaatgtctcgaacaactgaggatggaaaacggaaaaatgacttcgaagaagtccaaaacttgatggagaggtaacgggctctcagccgcacagaatcgaccttctacatttaaggaatgtccatgttctctcagtgaacggaatccacatgtccagaactgcctcctcccacaacgcgctctgtgtatgtgaaaagataccttcaacactcacacggatgcaggcacacacgcacgtccatgtcgatgcaattggaggctttgtccaattgcatgaaaggtagcgctcactgggaactctaatgacagcaggacgaagggtggcagtcacagaaagtgcgacccgtctgtcgcctagaagcggtatccgagtcattaacccaagagaaaaagaagtcaataagctcgtttttgtctgctgagaaaacctgttttcctccggaagagaacaggaggctccagggacaggcgggtgtccagggggagtgatggcagtaatccatagatcacgcgtgaaacgaaaaaagtggagcagctggatatgaataggcaacgaacgcgctgccagtgagagaaaggcgcaaccgaccaaacacgaaggcagagaaactggcgatcgacgggggtagaacattaaaggtccccgaacgcgcacatgggacgcagggggaaaggagaagtcataactgaggcattggaggtacagaaaaaggtaggacttcgcctggacgaaagcatatgattcgtacgaagccacttgccccagaacaaacgcaaatccttgaaacctgcgcggacacctgactcacgtagagaggcgattcattgggctttcaggagttcggcgctgcgcttgttccacgacataccgctaaaaagtggagagcacagaaaaaaatgaactttaagtactctgtcacattttcttttgcactctctctttctccgtctttcccgtcttcgtctgctcgcctcgcctggtcacccacccttgcgcgtggtcgttgccgcggtgcttggtactaatcctcagaacagagggagacactgcgaaaaacagctcgcgagggagcttcacgaa

SEQ ID NO: 2837 - DNA, 4690 bp, Toxoplasma gondii
ttctcgtgtctgcttcgctggatctgcatgcatgcccattttgatccgcttgcggagctggtcgtctgccctacccttggcgcctccgggggcctcactccctggggctccaactgtctccgcagcttcgggtgccagtgtggcctcgtgggttcccgcgtctgggtgctcggcgaggctgtgcggcttcagagaggcgccgcttttgcatgcaccgcgtaggcgactggagagccagggcgcctcacgcagcatctccgagggaagctggactgctacgcgacgccaagaggcgttccgcacgaaaaccgaaaccaagtcgtcgacctcgaagaagtcgtctgtgggctctcgacctcccgcgaggtccttcgagctctggagcgcggcctcgggagactcctcctggtggccgccgcaagcactggggcgcctcgcggaagccgccggagaagaggaacacggctgaggcagagccacgcatgcacaactgctgcatgcaacgctgctgcagaggggacaagggagtcggacgccgccgcccaaactctttcggcgaagcagagtctccacggagcctccggacagaagcagcgcgccgagtgccggcgacgcagaggcctctcgcgccatggcgccgattgaggaaaactgtcctttcgagggggctaagctgtagtagagcgtcgacggcgaagacgacctgctttgggggcctggagagccgtcaactccacaccgagccggttcgcgcttcccgaagacgcgaggagctggcagtcaagaggagctgcttctcttcctcaaatgctcgtagcattgactgtgaagacgacccacaggctctgagcggtcagtcgtctgtctcgaacggtgtccttgttcgcagctgagcagactggagggagactctctcaactggtttcgagagaacatgcatggggaaatgcaggaactgtgaagaagcaaaagctgttttcgccagcactcgaggcagcgacggggacatcgggaacaccctcgaatggaggaggcgcaaaagaaggaaaaacgatgttgaaagaagaagactctctcagtgtcgctgaagagaagggaagaaggaaaggaagaggaaggcggggacggacagcaacgacttcgaccctcgagtaagaccttccactctccagctttcgacgcgcgagtttcggctgttcggcggtgaatcaaaccgcacgacactctgtcctggtcgctgctgatgcggaactcgttcacgaacgaagtcgacctctttcaaggcctacggctttcgcagacctcgacttggcctcaacttggctgacgacggagagctgcgcggccaagagaagaatgctgggagagagtcccttcaggcgcagagaaaaaaatcgaggcggaaggaaaaattggcgtccgacggcgcgtggatagaacgagagagagagagaaccgcactgcgtcctttggtctcgaccgaacgcgttcgcggaccgtttttccggggaacgggaggacgcgttcgtcgcagggctgacgcctctcaaacccccaagagagaccgagtccccgcgctcgctgagaaaaaactgcgcataggatgctcccaaacgcgtcatgagaagagcgaatgtggcgagccgaagcggagccgacaagtgttgacggcggccatgtcagaggttcaaggcgcacagcacaaccagcgttcgatcgcaattaccgcagaaagacagcgaacctgcgagtgtggcaagaagcgaggaagctgtgaacgcgttccccgttgagacacgcggctcgagagctattttcccagggcagggagagtctccagcgccgaaggaacgcagcgtctgcagctgaaccctcgagtgaggagaccgcgatgtgggaggcgctcgcaggagctgttcctctaaagttgcccggcaaaaaacgcgaatcgttcacagatgactcttggaaaagcttgcgggagtcgaaaagcgtttccgcgtcaagaaaaagcgaaaagacgctcctatctgctccacgaacagcgcggagaatcggctggcggaacctgccccctaccggcgccgtcagaccaggtacagcaacgcctcgaaactcgcctttggaaatccacgtttcctctgtgaaaaaactcttgcgcgaatctcgctccgcaaaaacctccctcactcgaagaaggcaaacgcgcgagctagcagcgaagcgagcccgcgacattcgtccttcgctagcccgccgctctgcgggtggggagacagaaaagtcgctcggccggcagtccgacactctggcggaactttctgccgagaaaacaccggaaaaacttattctttgaggatacttccgcgtccttgacgcagagattgttctcgacgagcgacggagaaaacatatccgccgccgacacggaaacaacgccctggcgacttccagtgtgcggagtgcgacgacgtacgaagcccgcctcaggacgtcgaagaaagaatccggacacaccaactctcctgtcgaatccaatcagacacccattcacgctcttgcgactcgcaaagaaaaactcaacgacctgcggcaccctacaaagaatgcgagcaggcaacgcgcttccctcttatagtagtggggggtggaacgcccaaactctacacggcggaaaaagcccctcgctctcaattgccgacacaaacggatatatttacgtaattacttgcagttttacgtacttagttgtatgcgtatacatgcatgtatggctacatgcagtgggagttgtacttgaaagcgtatctgtagttctctttagcgactatatacatgtaaacatatatatatatatatatatatatatgtatatgacgtatgctgttgtgtttactgaattgggaggcatttgtgtatgatttcgacgttgtgccatgggtgccctctcgaggaggattgcgactaggagcttaaactcctcgtcgaccagatgctgaggaaagctctggaaacttgtcgcaggttgagacagctctctgcacggtttgagatgcctttcccagagcaagcgagaaaagggaaaacgaaagcaaaagcctcttcacttgcgttgtcgccgagcagcttccctgttgttgccttcgtccccgccgcttggcaccgtctccatgtccctgaacccaacacagccctctccaagaggacttgtgtgtgctggtgcgcagaattgcagaagcgagtaggtggcgactgcgttgaggagctaagtcgccaacggaaaacgcgagagaagactcgaaaggtcgtctgctgaacacaccgatagagtcgcttttttccttcttgaggcagcctcgcggccagcggcacgaagcgagtttgcgctccagggaagaagacacgcggggaaaggacagcaattctcaaggaagtcccacagtctgggtgcgttaggcgctcgggacggagcgacaagaacgcagaagaaaggcgaagaagtaagagaacctacacaacgtaggtcgcggcgcctagcctccagcagcctcaaaggactcggtgtcgcacaccccatgtgggggggggggggcacacccgcgacagagcgagaccgaagagcggctgccagccagctgggcgagacggggaggtcggcattgagacaaaacgaaggtcgacaacttcgtcgagttctttaaagcagtttcaagaagacactttactccagaaaaggatgtgtggactccacacccgctggggagggtcgcgcgtctttggctgtgttgagcgcgcgacggctgcgttgacgccctcgtgtcaactctgacggccgagagaaaaagtccagctttccctcagttaggaacgtctcattttctcgagtcttatgtcatggatatgaactcccttcctcgcggtggcatccagagatccaccacgggttatgtgcgtggaattctcgggcagcctcagagacaacgcgcggcgcgtgcagcgagattggcttgagcggcctcgctgtgtcgatcgtgcctctctctgttcggaaattccttcttccacgctcgtttgctgagatttctgaccgctcgccgctgtgttcgagagagcgtctgacgctcgaaacaccagcgaccacgcggagtgcagggatctgcgccagtgttttctggatttttcgcattcgtgtcgatttctccttcgctgtgctgtctcttctgttcagtcgcggaggacggggacttctttgggaagaaagggtcctccgcgtcgacctgtgcatgtgcggcagaccacctggaaggcagaaagatccccgtttcgcggcgacctggaaactagcgagtgctgcggcggttgaaacgcggaacgccagtctctctgtgtgctgtgctctctctcagaagttcccaaacacaggcaacctgaagctccggctgtcaccgagcgcctctcagtcctggccagtcaggtgtatgtacaccgcgggagttggctgttcaaacgcagcgaaacgcggaccgagcaccatggcggttttccacaggaagcaggggacgactgaagttcgtttttcgccggttctccagctcgactgagttgaaggcttctttctgctcgccgcgcggcattctctgtacatttttccgtttcgtttctcgtctttcgtccctgcggcggcacacga

SEQ ID NO: 2838 - DNA, 3120 bp, Toxoplasma gondii
aatcgaaaattcgttcttggcgctcaatgcaaccaagccaccaacgaaccggtcttcgttgtcagacgtgaagtcttcgcctaatgctgcgggaccggatgccgcatgagaacaacacgaagaaggaggcgggtttagagcatcgctgcactgcaggacatggagcgggttgcctctgaggatgctatatgaaggcctagctttgccgttcgctcgggtgttactcagaggaccaaacgatgtcgaataattctgttcgttccggatcgcggggcaggaagtgacacaaggcggcgacggggttggatccaaagagtcacactgagatggggactttgacgtcgcacccgagacggggagaaggttctccagcgcagatttctgggcagcttttcgccattttcggcgacaagtagacgatgtggtccgtagggaagcagcaacgctgttgagatacgcttcggctttctgcgtagtatcaaacgctatacaattatattgacagagggtcaaaatgtccagtagcgccaggcgctgaaacatgttcccttcaatgaggacaatcttggaccgcgttgctccaggaaatatgagcggcattgtgactagtgataaagcttagattatgcagtctcactgccggagagaaaaagaagataaaccaaaatcgtggggattagctattaccacaggggggaacacagaattcaccgtcgctaattccttcctgctcgctgatctatatgtatcttctatgaaccaaatagcccccggaggtgcctttcctcagtgtgctactcggactcaaacgcactgagtacacataaagcagaagcacatgcagatatgacaagcatttgcatgtaccgcggtaaccttagtacgttgtgcgttgcagaaaggcaaaaatgcgtaccgtgagcccacatcatagataacaatcataacggtgagcagattcccatgagtggttctgccgtgtattcacaaacacaacagtaccggtttcaaacccccatcaagaatgcccgacgcccggacacccacacgatacaaaacatgacaatacagttgacgcctttgacaataacgtggtacaacagaaaacggcctctcttgctggcgtgaaggaatacgacgacgtcgcacgcgaacccctatcgtgagttgaggctccacagtagcctgtttatcatacaaccttaaatatgcgattgcctacatgtgcaccatagtgaatgcattcactaccgtccacattttcgcatactcggaaatccagatgtggtacgtgaagggcgacatggtgtctgaacgtctcggacacggtgccaacattcgaggagaggggcgactgtctcacacgatagcgtcacgtccatagcgagaggctttgcgttttacgagatcctttcccatcactctgactggcacttggcggttagaagttctgcagaccggctaactctcgaattcgttcatgaacacgcgtagacagatagagcactgcgcgaaagaatatcgcggcaagcagaacagccgtgagcagaaggcaaattaattctccggaaaaaatgcactgtgtgctaggaaccaccgaagacactttcacccctgcggccccaaaatgtagaacccctccggcgggaaatgaaaacgacgaaaaaaggcttgcttttcaatggcgcaaacgcgggagaggagaaaacagatattcgctccgctcatagacaccgacgccttgaatgctagttaccggacacacgcagagggggacaacagaagttttactttcagtgagctagcgtttgcacgtacttagtcccactgaccaccggtagaaaaaatgaaaaccacacagctcacatgtgaattaggcaaaggctggcgggggaatcggacatacctcatgaacctgaggaacggtccctcgggatttgtagaaaaaaatagcgcccggcgacctgttcacttctcagttcgcagggcacggtcagaaggagatccgatgtgagggggccgaaaacaacctgcgtcacttttcctgcgaaggccctcgcaaaagaaaaatggtgagggatttgcaatgatcaacatgaccacggacgagcgaaggacgctaggctctggcccggtggtacttcattcagaaggaccggtggtctccacagaaagtcgctcttcgctggcagttctgcgcaggcggctctctgcaatcgagtctctacctacttagacgcaatcttccgacaagggaatacgttccacgaagaataaagagtggcacctagtctctgtgtcttcatatacgtccttgggtccttccaatgggatcctgatcaccaacgaggaggcacaatcgtgtgcgcagctcctaacggaagactctatctacagctccctgatcagcgtggttcaagtggggtgagctcgacagcacaacagtagacgaatcactaagagacttttcggaaggcaagacaagaaacgctacttccacgagggggtgcgttagtagtcggaatcggattccgccaacaacaatatgattaattgcgtgaccgtcaacttcatccgcgcaagaaagcaatcacgtctcaatctcgtctgaatctagcagaggaggccactcgtggcgacggtagtcttttggcttgacgaggcgtcactcaacttctgacgctctactagcttgctacgtctacaatgccgtgtgttcctatgtgttcctgaacatgacgtcccgggctagcggtcgaacagatactgagagggggtttcgaggaactcacgttgcacatgcgatgtctgtttttgtattcattccagttcattttcagcattccgactcaaaaatccctgcttcgttcctcgtctggcgtgcaaattctgcccagccgtaacccgggacggttgtggtgcttgactggtgtgctgtcaacagcgaattcactgtttaaagcgtttttgggtctcaaggctgcctccttgcgcagctgccgccagcttttgttccagcacacatgtcgatacaaaccctgcaactgctgagttgaattctcgtttcccgtcatcagaggatcttctgcctcgtgttccacccccgttctccgttcaata

SEQ ID NO: 2839 - DNA, 2337 bp, Toxoplasma gondii
ccttctctttccgcacctctctttctttgcttttctctcctctcgttcctctactgtgtctcccttcctgtctccccctccctttccttcttcgcatgcggttcgcgtggtgtacctgcactgtggccatcgttggagagcggctcggtttgtccctgttcggcgtcgcgcagctcttccagccctgtcttgtatccaaggtagattctcggcgtcttcttcgcgcgttccttcgtgacggcggagctcaccctttcgaaaacctcgtcgtaggcgaagaccgtggagtcttcagcgagggccttctgttgctggacttggtgccttctgtccggtcctgaggcgagacgcacagactgcatgacgccctttttctcagccgccttcgcctcctcctcctccgcatccagagaagcctggaaaagcgcagacaccgaagaagctgaggcagcaggagcagcgaaagaagaccccgacgatccagacgaggcagaagaggctgcattaggcggcgctgaggccttcttcagactcaaggagaagcctgccatggtgagaggagaaccggcgtacgtggaggaggacggaagagagagaaaaacggacaagagagagggaagagacacagtgagcaaagagaagaaaaacagaagaagggaagaaggcggcggcgaagacgagagaggcgaaggcgacgaggagcaagagacggaagagaaaggtgaggagaattgacaggaaaagaacgagatgcaaggcgtaagaaggaggtggaaagagagtgagagggaaggaggtagaaagggaaggaaagagaaggagaaagaaagcacacgagagacgaaacgaataggtatgaaaggggaagtgagggcggcgagaacaacggagagtccggaaagaagacggaggatcgaagtccaacaaagacagagaaaggagagacgaaatgaggggagacaaaagcgaagaaaccggtgagtaagaaaaagttggaaacaaagagattcaaaaggaagaaaaaagacaagaagacaagggcgagatgggcgagacggcgcccggcaatgactctggtctccttgctcgcaggggccctgtgtcggacgaggaggaaaaaaagacaacaagagaaggagaaaaaaatggaagactctctcagatgtggaaaagagagaaagagaaaaagcggatacaaaagctggggattgcaaccctggatatgcacggacgttaagcggggcctttttctttgcgccctccacctcaaccgcatgcgcttctgtgacgaagacaccttcgtcccgttttctgctgtctccgtgccttctttcttcctcatttcttcttctctttgtcctttcatgggttagctcctctccgtcaccctcgcttcgtctctcttcctctttgtgtcgttcgaacggtgaagagccaatgcgaaggagggatacagaaccgtcgataacgcggcgtcggagcgcggcgccgtgcggctcttctcgttccttgtttcgcggacttgactggtgtgtagacgaaaaaggcaagagatgttttctttccagtcacattaaactctagactctaaacatctctttggcgcgcgcccgctggccccgacctctcaatgggcgctctccgctctctttccttcagtctttctcgcgctctctttctaggttcctctctctctctcacccgttcccttcccccctcttctgctccctcgccagtgcgctttctcagtcgcttttcctctccgttggtgtgcctgcgcggtctctggagactggaggctgcgcggactggtccgttaatcgaagacggctgtgctgtcgagcgcctctccgggacttcgagtaaacgccatccaccatttcgcatagccgataggccttcgcctctgcagacacctccggcgtcgacaagcgccctttccatctctcactttcgtttcgggcctccacctgctgtgttgtcgagttttcttcattcctctttccccgcgcttctgctttccccttgcgttcttctctcctagctgcttcttgcgtcgctcatgtttctcgctttccccctctctctgcgcctgcggtctgcccgctccacatcgcggcaaactgccttccctgcactgctcacgaacgacccatacgtagacagtgttctctcctgcttccacccgctttacgagctttccgtcgcagtctgatcgcgccactcgatccccctcgcgaagccgcgtttcaaccgccaaccagtccagtcccactgctgcgtctgcagaacgtcgacgtcgggggagaaggctctttgtgtttctcagtttttcca

SEQ ID NO: 2840 - DNA, 2705 bp, Toxoplasma gondii
cctcggttcgagggtcctctccacccttcaccctttaggtctcttccgcgattctcctctctggagtcgcagttttccccgatcgcactctgccaccaagaacaggtacacacgcgcgtttgtccgttgaacaaagtggagtggcggcttcgggacagccgctttcgcctggagattgcgtttcactggtcagaaaaaaagagccgaggttctctgtgtctccctgcccctctgggcatctggcagacgcacgagagaatgtgagaacagcgcggatggcttgaaagactctgactggttccttcctgagcagtcctgagtcttttttcactttcgtagccctcgagtcggacttcggtactgcgggggagaactcgcgatttgacggtcgtactccaaagcttttcatttcgccgacgattcttgacttcctgacagtgtggagagactcgaaaatcgcctccgggatgattctccctcggcgcgacacaaactcaggtttctgcgttccttttgtgggatatgttcatgtgatctcacgtccttgaagggaccgcgcgaaagaaagtgacagtttctctcagagacgcttctgccaacttgtcgagagaaggaaacgcgcgaaaaaaagctctcgtcaaacgcggtgtcaaaagcactttccttccacgcgaaacagtctccaacagacgcaggaaccgctggggtcttcgacgtcggcgtttcgcgaattcggaagtcgccgcgatggaagcagggaactagagactctgcacggaaaaatctcttcttcatcacctgctttcatatacatatttatatatatatatatatataaatatataaatatatatatgaatataaatacgtccatatagagatatagctatatacgcctgctgcgttctccatacacaggagaagttttccctcggcttcgagtgttcgtttgtgtccgtgtttatcgcatgcgattgaacatacgcagaaaaaggcttttccagttttctgttcggatctcttatttactctcctcacagtctattcaagcatttgtcagatgcgttgagaaaaacaagcatccgactctcggggcgtttttgaagtttcacagtctctccggacagactctcacgggaaccgacccaaacccctgacgacagatctggtgtatgttcaaacacaaaagcgtggccggttcctgtatcataaatatatatatatataaacatttatgaatataaatatatatatatatataaacatttatgaatataaatatatatatatatatatatgtataaactttttgtgaatgtgtttgcatcactggggagtgagttgtctcgggacgtagaacctgcccgagcagcgcaagtgtcagccaaaaaacgaatacagcaaatggagatatgcgtccgtacctcaatatgaaagttaaaccgatacagaaagaagtgaggagcccgtggtttttttgtgctggcttttttgagaggagtagtaggcagctggagcgtctctgaaagctttagaagagtgaagagattcaggaaactccgcaagagtcgagaagaaacatctgcagctcttagaacttccagtttcgttgattctgtcccgcagaccgtgcacagtcgacttcgtcttgtcaaaaaggcgcgccgctgcgacgagatgtccgtacgcgctgcatgcgcttgcggcgcattgcggtcctcgtctgtcttctcggtgccccccttccctttcgcgaagtctggtctctcagcgaagcaaagtggagagctgtgtcgcgtctccacttgtcttgcaagttgtccaattcgttcggcgcttcggagtccgattcaaacgcgtcttgatgcgtctctggctttttcgtcgcacgaccagaggcaatctcgcgtccgccactcctgtcgatgcacctgcatctgtgcctcctcctccctcctcaccagtccactgtgttgcgcgaaaacgaggcttttcttcctcgaagaagaagccaacacacatcttcatttcactttttacttggagcgagagaaacgcatcccgcgttttcatggccctttcgctcttgtggaatctccaccccaggggtgtgggcagcactgccaagtcgatgtcttgtcaagaccgaggtggactcgtcttgaaaccacacatggccttctcggagttctcgccttttcgccttttggcttcgacgggcagctcttcctctcacgaaaaaacagtcttctgcagtctctttcaaacgcggggcttctgctttccttcgcctctctcgtggacagagaactcgctgcaggcgcggcctcgtcgcgaacgtctcgccgtaccacagggacagagagaaacactgatggatagagacttgcctcggtctgtacaccgtggaaagggcaaccatttgaacgaaaatccacatgcagctttgcgtcgttgttcggcgactgcggaaatccgttctggaactctaaagggtggatagcttttctgctgcacggaaaaagaggaacgggagacaccacgtttagcgtgtgtctgacgcaaattcagagagaggccttaagaagatgagaaaggagggatttggcgcgccacaagagcttcttctctccaggttcttcttcctttctgtcaaaggaattctccccatcttccctttctcactcgccccccatcgtgcctaa

SEQ ID NO: 2841 - DNA, 2066 bp, Toxoplasma gondii
tcagtcggactacagaggttccttttaacaaacgcaggcgcgtgtcccctgcgtaattatgtcaccaacacggcgccactcagaagaattaagtgccccaaaggcactcaggcccatcgtaaagagctgattttcgaaatgttatgctcgtaactttcgccgttaatggttgatttttgattatgaagtgatatcccatttggaccatgtcaagtgcaggcgctcagttcactgcctgttttttcttacatgcgtcatttgcttgttgcctcgtgctcggcagctgtccctgcgatgtgggcacaccgccatccctcaatttccgtatcagtagacgcggagtagcgagggtagatgtgcccgtgcactgcatctccctttcttgtcaggccgcttcaatagacgtatcattctctgatcggcaggaaaggccggacatcagcgattgacttgcagcagaggagaaggaatgcgtacgtatgggtgactcaaaaactacaactgcgtcgtcagagggcacctaaagtgcggccaaggatggttggaatttgtacagttggatgtttcataattgttcgtgaagagtgaaacatgcagcagaggtggctgacagaattggtattttacgttcagtgtcattcagctgctccctcgacttcgtctcatgcgctcgggttcagctgcgtgtcaaaagttgaaagactactcttccttgcaacactacgttgtccatttcctttgtggactgcttctttccactgtagactccgcaagtccgtttcgctgtggggaactcagtcccgcgacatccagcgtcaactgagacagccatgcctacaggatggctccactcgagtttcggcagagattgaaacttctcccgatccggcgggccaaacggagaaagaaaacaacttttggatcttccggttttggtgaatacggaagggcttcatgtatagagtgcatagtcacatgcgagcggagaggagtaattcctgcggcccgcgactttccgccggacaagcgaatactgcatctgcacaccgcgtgtttgtgtaactgtgtaactgatcgttgagtcggcagccgtcctatggcagagccttttcaaagataagacacgcgcaagtggtgcggaaaagatgttcgaaatactgaagttgagataacagaggaaactggagagtaccaccgagactcacagaagcatttctaggcctttttcgtttctggcaacgacgctggaagacatcgcatccaacaggaattcaagattgagcaatttaagctattcatgaaggcgcatgagttgcactgccctgaagggcaccgatacccattgggggcgagcttaagatgcgtaaaaaagcaaatcactacagacagtcgcgttctgattcatgattatttagaatagtgccgttctgttccctattctcagcgcacgcattcgtagtgtgcttagctacgaaaacacgatacatttttggggtgcacggaattccgtgtggcaacgtcaagaatgagaagtgagatgcgtaaacttgtgaggtgttaggaaaatcacgctcgactgcctagcatccgatgaacgcgtggggagaatcgctgagcaaggaatgcgactccaatgaaacaggcaaaagcggacacggaatcctggactctgctctatgctgatgtgactaagtcgtctcacttttggatttttcttcgacttgccagcgaaaaaagcattcgaccttattttgtctttcagaggactcgcgcgtgagccacgacgcatggtctgtcgtataccgtcctcaaactcgtcaccacctgacatagccgagacccagtcaaagcgcgtttccgatatttgatgcacgggaccagcctacctaccactgcaacaagttctctcgttgctggcttcctttgccagtatttttcttcattccgtttttttctgtgcctcattttactgcttctgcggtgaggaaaacaatctagccgcaaacacgtgttttactccgaacatcgacactcatcgttgcaccatttacacttccagctaacaa

SEQ ID NO: 2842 - DNA, 3516 bp, Toxoplasma gondii
ctcctcctctctgcgttcattcttgctacgctttcctctctgctctcttcactgctctaagctgtctggactcggttcgctggtttgcctggtctctactgctacttccttttctgtctcggctcctctggcgaacgccctgcatacaccgagtcgctgccctgcgccagtgcgaccagtcgattgattgggttcgcctcccgggcacacggtgtacgtacagcgcctgccagccagtgttcggtgtctgtgcggcagctctcgcggcgtctgtctcgcatgcttcgcgtttgctccggaagacttattttcagctctgagtgttcgtcctttcttctgcaggccgactgtggggccgcgcacccagtttcgcgctgtctcgcgacagcagacacggatcaccagaactcatcgggactccacactgcactcctcgtcttcctccttcctctgtatctcttctctgcctcccctccccccggctgtccccttctcgtctcctcccccgtacaccctcgtcgatttactcctcctcagcgctcgcttgcgcgatggctccagcttcctcggccttgcgtctcgcagcagcctcgagttccgcggccattttgtcggagaacgcctgtcggatttctgcggcgaagcggcgggcgctctggcggtgcttcttgtgttcctcgcggttcgcctgcttcttcctgaggaccagggcgcgctgcttggtgccttccgtctgggcgaggcgcgccaaaatcttcaagttgcgcgccgcaggattcacccggcacaggacggcatggttcttcaggaggttcttcttctggccgcgcttcttctgcggcgcgacgcgcgcaggccgcacgacgcgctggatctcctcagagttcacgatgcggctgaggtccgcgttggacatcaaggctcgcgggagatggtagcctttcttcagctgggcggtgccggtgccggtgtggcggccaaagaggagctgcaggcgcttgaaggcggacgcagtgtacagacagaagcggccgagggcgccgccgggggcgagttggaggagattcagcgagtcgaccttgcagagttcgacgccggggatgttgcggaaggcgcgggtgacgccgttgtcctccgcatagacgacgagcggcccgcgacgcatgtgtgttctgcggccgcgcatcttgcccttgccggcgcggagtttcttcgcgctcgcccgcacccgctcgagctccgcggtgcagccgagcgtctcgaggatcttcaccgcctcgcgggtcttgctcaccttctcgagtttctcgctaacgacgagcgggagctcgggtacctcgtcgatgcggtgaccgcgggccatgaccagcgcaggcaggccggtcgccgcgaccgcagaagccaccgcatgtcgcttctgcgtcacattcaccttccggtgccaccgtctccaggtcttgttcggcgcaaacattccgccgccgcggcacatgttcccgaaggccgcctgcccggcgcggtgcgtgcctccgccggggacgcgcggaatccgcgacaccgcgcgaccggttccccaggactctgcagaagtctggtaccccgcgttcggcgcgacgccgtacggctgtcggcggtttttcgccatgttggtgtggacgaaacgcaccaagtccggccgcagcggagagagaaacacggagggcatcagggacgtccccgacgccgttccgtcttccggcttatagacggagaccaacggacgggctgtcgccatcttgaactcgcaggcaaagaagacgtacaaagggggggggggagagcgagagaacgctgcagacacacaaggacagagacacagagacaggcacatgcagagaaacagaaagaaacctcgagagtgtgggcgagactgagagaagaacggagcctgagggaaaaacgggagagctcacggagcggcgacgcgctccgactcggcgcagagcagtcggcagaaagcgaaagagagaaagaaagagagagaaagagaaagagagacgcgcgactggtgtgttttcaggcaggtgcgaaacttccagaagtgacgcgcggcaacacaagggatcactcgggcaaggctgttcaaaaaaacggcaggacgggggacccacacaacgacgctcttttattatgctggacacccggcggcctctgttttccacgacacagcaaaaagagcgcaaggaaacgcacgcgtccgacaactcaactttctaaactcgttcgcgttcggagtcaaaacgaggtcttctcgcggggcatacgacacacacacagacgacagggtgagagcggcaaagacggacaacgcctttgaaaaacagcgacggtcgaaacgacagaggaacgcgtctccccgaccctgcaattcggcggatttctggtgtggaagaagcaaagacgccttcgcttccctgtcggggcatgtctctgagaacaacactggtgaaccgatctccaaaaaaccgggcacagtctaacgacgaaacgttttcaagttcctcctttttttcgacaaatgaaagccgactcagtttgtcctctctcgcggggtgcgaccgccctggctccccccgcggtcggtcgcacgcaactcttcagtttcaggctctcttactgccactggtttttctgcccaaaacgatttcctcccctcacgtccggccgccgacccagcagtggattgcggggagacgccacggaaaaagacaaggaaacgaagtcaaaaagaactctcgaaacacacaagcggggcctctcgcaagcttgtggggaagagaacttcggcctcgcgttgcgcagagcgtcggggcagggttccgcagacttacgtcctctcagagtagacgagacaatgtctctccacgactttcgcctgaatccgagaaaaacaaaatacagagaggaccgacagggaaacccagcctcctcctgcaagcgccgccacacacgaaagcaatcgtctccggtccgcctcttggaaaacttctctcccctggccgcgcatgcaaaccctcgcggcgcccggcctatttacgacgaccgaagcgtgttgaacggtatataagccgaattcgttgtctcgtgtgttccccgcggccaggggactggcttccggcgcggtcgacagatcaggcgctagaaaagcggagagaacaggggtgctcgagggtgtctttcgttttttcccgagaaggtcattgtgcatgcatccgagaggcctgcgtcggccgctggcgagtttgcaggtcacaggcgaaggcgcgaagacagtgaggctcgcgccgtgagcgggagaggctgcttttcgccgtctgctttttgtgtcgagtaaaagccgagcatgtcgactcgactctcagcgcgtggaagtttcggttcatctggcgatctacgctgccaaaaaggacgggtgccagtctgcgcgaaaaggaggcattggcattcgcaagaaggcaaacaagtttcagactcgca

SEQ ID NO: 2843 - DNA, 1791 bp, Toxoplasma gondii
cttttctcgctttgccgcgagtacctgtgaggttgcttttgctcaagctcacaggctgtccacctggaaaagagtctctcgaccaaccgcacatttttcgcactcgctcgcgtacgcgctgcgcctgctctggaggcagaagccccgaggcgtcgccttccaaaatccccggcaactccgccggcgacacagcgagactgtggactggagaagaagaggaagaagaaggagaagacgaagaggaagaagaagaggaagaagaaggagaagaggaagaaggagaagaggaaggagaagaagaggaagaggagcgtagtttctcgccgtgtgcagttcgtcggccatcctccggcggcggtgggatggcctctgaatggagagcgttcatcgttgaaagacaagagaagaaggagagaagagagagaaggagagagagacgaggaaggagagagatgaagaagcaagaagacggagagggagacgaggaaggagagagatgaagaagcgagaagacggagagggagacgaggaaggagagagatgaagaagcgagaagacggagagagagaagaggaaggagagagaggagattgagagagtccagcgacgaagggaagagaagcctacattggtggcttgcatgttcctatttcgttcttcatctgcggttttctgtctcacagttgcgtctaatagagaggtgaagtcctcccagacaggacggagatctttcttggagaggaaacccaagaggctctgtgaactttgaggaacgcggagagctttgtcggtgaaggcctcccccggagacgccaagaaagcgaaggaataaaacgtatttgttcgaaagtggaaggagcccgagagaaaagaaagagaggagagagaagagagaagagcgacagactcgagcagtttctttcgagttttttgtgttgcatgcatgcatgcgcactcgaaaaacgcttctcttcgtcttttactggcatggctgaggtctctgggtcacctggcaaagcacggaagtcggcgcagacgcttccttcttgcttccgttgctttcgccttccttctctgtcttctctctttcaccttctggaagggaactggggaggcaaagagagaagcaagaccaacgcagagagactcaccggatacatagggtgcgttgtggctgcacagagtgagatgcggcgactgacgttgtgtggaggaagaaggaacttttggatcttcttctcttctgttagccttttacggctgtgtcgccgaagcagaaaacaagggggagatggcttccttctcttcgctagactgttcctttgcagccagcgtctgcgttcttctgcgctctacactctccaagggtgagtatctcccccaaaatgtgatgcgttctccagcttcccggcaccactaacaatgcgccattctggtttggccctccacccgcagcgatctcaatggcagaactgcatcaacgaggaaaaataccacgacttcagagcgagacttcacagaacatccatccgaccttctcgacgcggaaaactcctcacgcgtccatgcgcgcatgcagaaggcgagttggtggaggggaaccgcggctttcaatcttgttccccgcagaaggcgacgcaagagagataaacgctctcgcaaacatgctgtgcatgtactccccccatacgtcttcgcctcctccctcgtccatgcgcgcagatggcggctgacttgcgcgacgctcttcttcccctccatctgtctctcggcgactttttccttcaacca

SEQ ID NO: 2844 - DNA, 2438 bp, Toxoplasma gondii
tcgcttccttttccggcgaagtggcgaataaacgcgaaaacagagccggcacgcagcctctgctccgcatatcaggtgtacatacaacagcactgaaagcgccggttccgggctgccacctgcgccgtacagggtgcagccgagatatcggaggagagaaagtgggttgaaaaagaagaaatttaggaatgaagagggacgaaaacacaactgaaacacaaacagatgcaactgcaaacagtaaaaacgacacaagagacatatacgtgtatgtatgtatatatctttgggacagcacgtgcagatcagagcgcctatccatacgactgcagcgacctctttaccattcgcatgtgcaagtgtatacgcggcggtacacgtatgatacttctttctaggtatactcggtgtattcacaatcgtagaactcatcgatcttgcacgatttttccgacctgtctgctctcgagcgtgtcgccgctcttcgctacgttcgctgggaatctgcggtgggggtgtatgtacgggccattccacctgactccctccgtcaagccgtccgagcatgtttcttcctcatagcttacctgttctcttggctttgcgcaaccgagacccattccctagtttttccgagaggaggggcgacgaggcaggcacgaggtaccgcaagtgccttcccaacaggggcagccgaaaagccggagcgcacgaacctcttcggcagatgaagggcagcagacctcatcgtgaattctgagaactaggttccttttatgtcacttctcgggctcccgggcttgtcaggagctggacaacttaaaggaaagcgatctgcggagtctgcgaggtcactcgtgcctgaggcagggtcttgaggcagctttgaggagactgactgccggcgcacgaggcagaaaggtgaagaacccccaagaggaacgaacgcgcagaaaggagagtttcttgagaggaaagaacaaaagtgttcctgcctgcgggttcaagaccgtgcgaagccgcaccagctgtgaaaacccaatgtggcgacagaagccaaaaaacggcctgacacaagacacttcgtcaggtgtacgtacacctggcgacgcgaggaactgacacgagtgaggtgtatgtacacccgaggagctggaagccccgccgcaagtttcgcgttttttggcgactcgagacccgcccaagatcgactcgcctttgcgaccaagagcgggtcgaggcacaccgccgcacgttttcgtttcctctcttctcttccggctttttccttcgatccaaatttcttctgtcttccttcttgcggaagaagaaacaaggaccctcaaagaaggaccaagaacgctaaaccccaaacccttcttggacacacgacccttaaagctcgctcgcgcccgcggctccgcgacttcgtccgcgtcggctttttcgttctgcctgccgcatgcagataaaatgcacatgcacatgctgcagagagagagagactgacgtgtcgggactttgagggcgacgcacttccactttttttctttctctctcttctctcgcctcagtgcagagggaaagaagcaaaagcgaagcggagacgcccgcctttcccccactgttcgtctctccacgctgcagagcgccttctggctagaaagagcgtttgagagaggggggtgacagaacgacgatcggttttttttcaccctttctctgcctactgctgctcttttctgccgcgatcaaacgcgcgaaaatgacaaaggcgcatctgcaatctcgctgctccctgccgtggagagacacctgccgctctcggtagcggaagcggactctggcgggacacagacgacccgagaaaccgatattcctctctataagcttctattctctcttcttctctcgtctctgcctctttattgtcttccatgacttttcgtttctgccctttttttcacatcgtccgtctgaagtgcgacgcgggtccgtggtcctcgctcgcgtctcgagaaacgattcgtgtggagggtgtgtcaaaaaacacatcttggtaaaccaggatttctctgccgtccttttgtggagcttgtgagagagaagactgacgacgaggaagggtcaagcctcctctctctcctcggttgagtcatgccagtcccgacttttgtcctccgtgtttgacgctctctacatctttaccggtgtgttttcgtctcttctccctctcttcgttcttctctctcctttcttcctccgttgctgtttcgcgtccttctcttccactgctgctacgcttttcctctttccgcgctgtcggctccgtctcttttgtttacgtttttttctctcctgcctgccgttgcacatttgtttctttcggtgacctctccgtgtttttctttcggggtgtccactgacctgtggccaga

SEQ ID NO: 2845 - DNA, 2470 bp, Toxoplasma gondii
ggtttgaggaaaaccaaagggcgctcggctttaactttgtgctccacggtggacagagagaagcccgctgcatgtgttagctctctccggtagtgaacgtagaacgcttatgatacacagaagataataagaaggggggtctttacaaaattagttatctagaatagccacacgccatctgagagccacatacaacagagagtacgcacagcaacccgaaaactctcacacgacgtctgttggaaagagttcgggcaagatatggtaataagcgctcatagaagtatacatatatatgtgggtttatgatttgaagggagaacccttgtcaagaattcagaacagggaagagaattgctgatgattgacgagactgagggcgatccacagactggttacagaagacacatgcgcttggtgcttgcttaaaaacacgaagttgtttttctgctgcagtgcctttgcaaatactgaccgcgcatcggctctgatgtcacagcccctggaccacatgtttccccgccacccgaaaactcggcaaccctatagacatttgaaacaaatgtgcaaagccgaaagaccagtccccggctgtgacctacacatatatataatctatagatatcttggactgagaatcagtgaatgcctatgtttgcgtttgtgcatgaagcaattcgaatgaacagtggcagtcccttcgggatttccctgagggtgaaagaaagactgggggaattgctgaagtgaggcagcgtagaaagagaggcctgttacacttcagagaaagcaaggtgtcgctgcgggaaatagcagggttgagcacttgctccctctcgcgcgacgagacaagaaagcagatttgttcattaactagcagctctcccagggcagcttgagcgtcagcaaaaatgctccggacaagaagaaaagggggacagaagtgttacacaactgagtcacgaaatgccatggaatcggaaagaaatccgtgtctccgcagatacgtcaaacacagtgcaggttacaaagatgaaaaaatggtcgtaggcggagcgggaagcagtgtcaactcgtactggaggggtagcaagcacttttgattggatggcaaaagcacgagatgctttttctccctctcttctcgaattttttccctaaaacctagcgtttcgaaccgcgcacgctggagtaggaaagagcatgcatggcaaactttttttcagaaacaaacgaacgattttggcctgcctcatgctgtcctcgtccgcgcatagtttcgccagagaagttgtcctgagcctccccccgccgccccccccccctcgctcggttgccgttgagcccacgagtgccgtttgagaacttctatgaagaccttcaaaagcggagaaatccgtgcaagtcgaccgacacgaagacggagcgagatgcaagtggaatgcaaagaataaaaatcccaagacccccggtcgctctagaaactggcattacgcgtgccacgggaaactataaaactgagctcacaaattgtctgccgcctgccagccaaaagagatcttccaacccaaaacgaccagccacgcagagatccagaggtacacaagaatctctgccctgtgcagtggttcacttgtatctgctttttgtgtaggttacgaaaggcctacgaagggtgagatacacaagaatcggaggacggcaacgcatggcggttcagctagctgacaacccgtagtcgatatgtcccaagccacgggacgtctgcgtcactagtgtgtgtcgctgtcggttagtcgctttcaggacggacaattttcctcgtcatttgccagcagcatatgttctcgattctgttaccacgttaccgaatattcggattttctgctcctcaagttgaacgaattcggcggcagcccccacgcagactgtggttccctcttgctctatcgccctcgtggcggtctgagagctggcacgacaacactactcctatcaaggggctcttttcttgctccgccggtgcattcagcgaaagcagtggtgacataacacttcaattgtctctctactttggcgcccgtagtacgtttttgcttttcacctgtgcgtcgtctgcgttttagctcggcgtctctcactgaggcataaacgcagttgctctgggaaaagaacgtaaagttgttgtgccgatggagaattaccgcacaacgaggagaggcgagaatcttttcggctttgtgaaaacgagagcggcgaaccagaacgtttttcgttactttatcggggatttccccgtacttctttgcatcagatatttttgagaacagggaaacagttttcggttccgcctggggtgcagataaaactgcaaatacacgaatacggcagtctttgaacctttgcttctctttttcgatctagctttttctgtggcaccctgccaacttcgctgtctcatcccgaatca

SEQ ID NO: 2846 - DNA, 2932 bp, Toxoplasma gondii
gagaacacccaactgcttgaggcgacagagatagagagacatgagcgaacggggggggaggcagagagaactcagaggcgagagagagagaactcagaggcgagagagagagagaactcagaggtgagagagagagagaactcagaggcgagagagagagaactcagaggcgagacagacagagaactcagaggcgagacagagagaactcagaggcgagagagagaactcagaggcgagagagagagaactcagaggcgagacagagagagaactcagaggcgagacagagagaactcagaggcgagagagagaactcagaggcgagacagacagagaactcagcggcgagacagacagagaactcagaggcgagacacagagagaactcagaggcgagacagagagaactcagaggcgagacagagagagaactcagaggcgagacagagagaactcagaggcgagagagagaactcagaggcgagacagacagagaactcagcggcgagacagacagagaactcagaggcgagacacagagagaactcagaggcgagagagagagaactcagaggcgagacagagagaactcagaggcgagagacagagaactcagagacgagggagagagagaactcagaggcgagagagagagaactcagaggtgagacagagagagaactcagaggcgagagagagagaactcagaggcgagagagagagaactcagaggtgagacagagagagaactcagaggcgagagagagagaactcagaggcgagagagagagaactcagaggcgagagagagagaactcagaggcgagagagagaactcagaggcgagagagagagaactcagcggcgagagagagagaactcagcggcgagagagagagaactcagaggcgagacagcgagagaactcagaggcgagagacagagaactcagagacgagggagagagagaactcagaggcgagagagagagaactcagaggtgagacagagagagaactcagaggcgagagatagcagggagaccagcggcgagagagagaacggagaggaccgagggaagaccaagagagcaccgtcgagtagacagaagatggagagaggagagaggactcacaatctgtaggagagtagaacggatttgcttcatgtttgtcagggtcgtaggaaggatcaacgtagacgacagggagatctttcaccatttcctgcaaatagacttccaggaaactgtcgaaagaccggacgtgagggaagaccgcttgctgcagagttgcgttgaacgcggcgcgaggatggggcgaagcaggcatcgtcgacggacgacaagaagaagaaggaagacctgaagaagaaggctttggctcaacttcttcatctggagaggcgcctcgtggtcgacgcttcttccaggctctgtcgtcttcgcctgccatcttgactcctggaacaattttggaagaagacttcgaaagagaaggaagaaggacggcgagagaacaacttggaggcgaagcagattgggcgcgcgggtgcgttcggaagcatctgcctcgtctttttcacctttgtgatctcagcatgtctctctggagatggctgagagtgaaagaaagtccagtggaagaaagagaagaacgagagaagaagcatcgagaaccttcctgtcgggtgtgtgctcgagtgaacgggagggaaggggagaaaggtcaggaagacgagaagttgcagcgaggagaacagagggaaatccggaccgcaaaggaggccaacgacgaagagttctgttctgctgagattcgccgcctcccacaagagttcaaaggccctttgaaaggctcgagtcaattctgtcgagtttcgcatgcaacgcgaacgctgcgcggctctcatacccgcagacgcgcgccggacgacaccgatgagcagaatcgcgccgctctcgctctccctccatatatcgcctattttttcgctctcgccttgtcgcggtcggtggtgtggacgcatcggttctcgcctcctctttcttgccaacattcctttttaccgcgtttcttcgtcagacagtggttcagtgtccaggtgtgaacaggaatttccaaagggtctctcagaaggcgagagattccccgaaaaagccgcaagaatgtcggcgagcacgcatcgtcccgtggcgctctttccgcctgcgctgtgcaaagactcttcccttttctgcgtctacaccgcgtcttcttctctttttggagagcgagaactcgacgcgtagtgtgtctcttcggcaaaaagcgagagaaaaagaaaacgcctcttcacctgctgcacatgacgaccaggcagctgggcgccgtacaccacgcgaaaagagacaagaaaagcgagcaggcgacggacatccttgtggatgcttcttctgcttctcccctaaaagggtggacttctgttcttctcatggctccggttcgctcatttccatttctcactgggtcgtttgactacttccgtcttctgcacatctgacaggcgtcgacggcttctcgcgcaaagatacagggtcctctcggacgaaccaagagagaagaaaaatcgtccacgcagcttcttccaggaactcaacttgcctacaccttcttcagactctctcctatgaacgcctggcttcgctgcgtggatgctccgaaagaggtcactcgaacaaaacgcgagacttctctcaatcgaggaatcccagcaaaagctccttggtgaaaaatacgtctctgcctcaaacgtcgacctttttcttctcttcctcttcgatcccctcgtcctccgccttccctcccctcccctgtcagtctcttcctccctgttttcttcgcctcggtcttcttctccttcctcctcgctttcttttcttcgttcaaga

SEQ ID NO: 2847 - DNA, 2608 bp, Toxoplasma gondii
gtggctctgagcgtgcctgaatgtgcagaaacgtttcaagaaaatcggtttttcggacggtgcggtgcgggcgttcccaatcccgagtacattccactggctcagcaagggcccactctgtatttgtctcggcaagaaccggcgaacctcacgccgtttgaaagggcgctacttgctcgggacgaaaggctgctcatggaactgaagagtgtgtctgagcgatacgtaagcgctataccgtggctagacatttatatccagatgcggctcggggatgtccacaggcttcttgtggggtgtcacacgcagggaaaaattgggagaatggagcttctaacactctcctctgtagcggaaagggttttccggcagcagctgcacacaccgaccgtggcaagacctgatcccgtgaatgacaaccgccggtctccatggacaagccatgagtcgagaaatactaacagttcacgtgcagaaccggagtgcgctgctgaggttgtctactggtcgaggctgacgtcgctgttgttgcaattgaaagagttcgccctccagcacagggacgacgacggaaaggcatttcttagaattgaactgactgacgagactacgtttcgcgtctaccgccgagcacattcccaacctcgcgtatccgttgagattggctcggccatattgaagtgctcgttatcaccgacgaggtacggtagccagtccattggttgcccctctttgcagtgaccagatttcctctgcaattttgtggtgaaacaaacgcagaacatctccgcgtcatgcaaacgtcaataaaggtggcttctgggaatatttgtttgcacaccaaacagcgcaagccgaagtttttgtggtcagtttcctctgttgcaggtaccatttgaggggtgtgctatttcgttgacaccactgcgcaaaaacgggattgcagatctgtcccattgttcactgtgtgctacgacctgtgctcctgtggcattctcccgtatcaatcctgccttgagttcgagaaggctcttaacgctgtctcgaagaagctcccctgcgtcttggattcggatccggtccgcatgtgaccgggcgacatccccatgcgccgctttttacgccctagagctgctccacgaatctttgccaatgaaagtattatatcatcaggcttgctgaacccggaggagggaggtgccactacttatctgaatcctgctggaggttctgtgaagcagtcgttgccctcccggaagcagcccatacttcctggaacgtttcgtaaatatcgttgttcttgcttagcccaaaagctgttttcctctagagacagcgataaaacggtttttactcaacttcagtgtaggcgacgtcctaaaatgagcgttgctacgggtcattcctggagcgagacacattccgtcgagcctcgtattggtatgtcacagtcagaactcccgccacaagactagaatatcaaggtgcgtgaggaaggcacttgtgagtgttgctgtgtcttctcaaaatgacaaaggaaaacgcggggaatacagatgagatcatggacgccgcatgggggtgcccactcctaattccctcccttgtatgcctgccgttacacaaacaacagtattcagtaacggtttgcatcgactagtggatggttgtaaaaatcataggggagagacgtcgaaacagcaatacagcgtattatctccctatcgcgatgtttcaatggcacactgcggtgggctgcttcatgagagttgcgttctccacagccagattctggtaggccttgtgccatcatacacgcgtcacgcaggaacactcggatctcatgaacttcgaattttatctgaaggaggaataaacaccgggatttgtgagaacgcgacggctggctgcagcagccgttcgtatgaaacacacggggaccatgtttcgccactacggtgtgtagttctccggtcatcaagctttggagccttctccagaagtctcagttgatatggccacacaagaacttttatggtgtccattccattcgcctagtctcttttggcaggcagttctgtgacatgaaagtggtcgtcgcacgtacgtgccatctctcgcgaaaccatgtcaggtggttcgctctttcgtggtacgagctagcctcggggacctccccagaaagtggcaccttgtgtgtgtgctggccagaggagcccataaagaagcatctgacagccttggatgctattttgcctcctggaaacacgatgaccttgaaattcacggtaaaacacatatcctgcgccctccccccacccagttggacggtgttgttcgagcggaaggcggcaggatcagctgcgaagagacgtcactcgacggcgccccacaaagggagaatagggagacctgtcggagcgccccagtgaatcgttaagcctgatccacatcttttcccgtctcttcgaacaccacagtttgcggccggcgtggggtgtctgagtcgcgcgcgctgtgcgaggggtgatacgcgccatccgcgcgctgtgctgaaactgtgaaaaagccaacgacttcttcgccttttgcgcagtgcaaaggcaca

SEQ ID NO: 2848 - DNA, 1865 bp, Toxoplasma gondii
aatattatgtatggtactagtcagtctcgaagatcttttcttctctcgcgtaccttgctaagcgacaaaactcggctggtctcctgttactcgattcccgtctgaaagttgcttcacactagagccaaaagaagtgataagctgctgcagaaacaccgatagcagacagactcgcccaggagcgccgtaggcgcagattatcgtataaggggacaattgtgtaacggtacccttccgcacatagcattgtcgattctcttcagttcccatccgctccacgatctcagtgcatatgcatgccagtatcgtgacaaatatttgttttgtcttgtgtacgtggccacgacgtcagtcgattcttaagctgtttcactatctttctcggggccactttgcagtaaccgaagaagtagcaggtagatcccgccagccatttccactccaggctcgctttaagacgcatagaatttggtgctaaaatccatgcaatttcaactgcgacagcgtccacagtcagcgaccagtaccttagtattgatattaccccccactgtttaccgacgaaaatgaccaccgtcaaaccaacagcagcgctgacacactgttgcccgctgaactatactgaacatccgtacggctgttgggaatttatctacagctccacttggcatagaacgggacaacacacgagtctggactagcatagagataacccgtctttcgtacacgttgccatttgtaatgctactgttccacagaatccggacgcctgcgtggaccaggagccaacgacagctcaccgaatgcgacctgaacaacgtcgatttccggagaaagttctcgggtgcactcggtcggtttcatcccaccccttcactgtctcattgtagagagctttctccgacagtgggagatgtctgagtagcagaggcaaaccttgacgtattcgttcgccccgttctggggcacttgcagttcttagtgctgttttctgatccgcagagtatgtgctactgtggcgaggataagagctgccgattccttcttcgcccgactacgcaaccttctgaaggcattatcgcaccaaaacgcttttgtgagagcctgtaaactgcctcaccggtaaaaacggtacctcttcggcggtagcggggaaagaagtactgtttataacgtaggaccttgcgagcgcattctggtgccttcccacccctggcttttttccattccctttttgaagataacagcgtcgtaagcatggcggaaggcggtcgaatctcacacaactgtcttctcatatccattactctgaaacgagagtatcgctgtactagatatttattctacatgctctacgtttcgggttcccacgacacccattaaaccgcggtgagggtcagctagcggtccccagactgccttgacaagcacggtcttggcgcagattatgagataattcgccctttaaaaagtgtttgtcgtgagctcctgtgcagacgagcgctcgcagtttttgggggtgcgcgaagtgaacagagtaattcaggcaatccacacggttccccgtaccgggtcgcttacccacagggcacaacaccaataggagcggcggcaacccgcctgagcatggcttgtcgctctttcttcgatcctcccagcgtgtctcgccgacaagtcgagctggctgttagttccagccccttggtgggttagctcaactctggaacaagcgagcgccataggcatccagtgggccactctagccggaggggatggccacacccgggatcagctagcccacccggttgaagtactggggctcccgtagaacccttctcgctggcttgcctcaggcccgaatctaa

SEQ ID NO: 2849 - DNA, 2703 bp, Toxoplasma gondii
ttttcggcgatcaaatactcgggtccatggaacaaaatttgcccagcaaaaaacggaaggaatccgccaaacattggtccctagggacccgtgtgcttctcgtcggagcccgcaagcggaaaacgcctgctccggaccatttcacagaccaagtcaaatgacgttctgtcgcctcaaactgggcagagtaccttctggaagcactacgcctaggacacaaccgatgaggaataaagttggggtcgtaggatattgatattcagcacatgcagctgttttttgcagccccgcgggggagggaggctgtatgacaatcataaagaacttggttgtctgtatcgcacgacaagaattataatcggtcactgcttgtgtctgtacctcgactcagatcttctgggggaacggtatgagcgcgaccggctccgccggccgacactggacgcccgacgatcgtcgccgtttccactatcttctcgaagttcaccatcacgaggaggcgatctgtcttgcctcggtgaacgctcccgcgagcgagagccgtcacgcgagccggagggtcctctggacgaccgccggtccattttcacgtcttcggcttcctcttgagccatgatggatgaaacctaaaaaaagcaaaccaacagccccacgaattcctcacgacttttccgaacactccacactgaatggagcttccaacacgcacgagaaacgcactctactcttcgaggaagtgacagacagcatcttcctcggccattgcattgaaactccgtgtcctttctgttcacatcgcagactaagccggcttgtgattgtggcgcgtctaccagcagaaacgacgctgaatctcgtggtgaggtcctgtcgcaagaatgctgcacaggtgcactaaccacggagacgtgacaggacacagagttctattgagaattacgtgtgcgattgccgaaccgcctgccaatcacgacacggttctacggaaaaggtaaaaaaaagcgtggccgaagaaatgacacaggctgcacccgccgaacaagggtacgaggacagaggagctgtgggggaaaccgagacaaacatcgcgctcctcttgataggacagaagtccaaaatgcaaatggtgcttcagctaacctgaataacggctgaagcgaacgagaaaaggggatctggcggggtagaaaatgcctcgacaggtctgctgctatggcgcactgattggtagtttctcccgtttccaagtacagaaacacctccttttctgatgagagaaagacgaataagggaaagtccacctcacaccagacaaagcctgacgcgaagcaggcagttggcaatccactttgaagaggtgattgggttttccttgttaggagaacggcggcgttgctttccgtcaagagtgcagccgggttgaaaaacgagagacagaccgtaccgaggtggtgttggcaattgctggatggggtggatccccccgcaagtggcaattcccgaagatacgccggacccttcttcctgccgcgtctagcacagaccagcacgtaaggattcgcacgcagccgtcgtcgcggctctctgaggtgccgaaaaagcggacaaggtatgctgaaaaacgggaaaccgtttgcgctttcttgtcgtgcttggcatcttttcatgacttgagccgtgaagaagtctgctacctgttttttcccggccacaccgaagtagccgcctcaccacgtcgtccgggatttgtgctgctttcgtccagcgaccgcaaggaggaagacgttgctgaaggcagtgtgtgtcggacttgtcatgtgtggcacactggtgctccggagggagcttttgcgtttcgaaggacagcatgccctttctgctttgaaaatactctctgtgaacttttctcacagctttgtcgtaaataaggagagaccgcggcagtacatattccccactatggcctttcgaaagatcaaagcgcttcggtgccacctgcagtgacgcagcaaacaggggattagcgtggcccccggactcaccagattacctgatggggtccagagatcttcgacaccgtaatagctggtgatctagctgcctattgtccgcctgcggcttacaaaccctctgaaaaagacgagtccagttcctagttgctaatttgccacggaacacaccgcggcgaatgcggcggcaaatcacctgaaattttcaagtgggggcatacggtcacacgaagtactgtcagaaaaagttatgcacgtgtccgtctccctgtattcgcctccctagtctctttccacgttagagacgtatctcaatcctagcaaaccgggactccagtcagtctcgctctctatcccagtcagagctgctcttcactacgtgtggcgtactgatggttctcgtcgtcttcgatgctccggttcacttcggacaaaaaaccggaacatgtcttcaccaaggaacagtttgtctgcctccttgtctgaaacctcccctttagagaccaaaccggcacactcgtggagagcttgaattaggccgggtccacgctttctgaagcgctttctgccgtcagctttttcgtctgtgcgtgttcgaagtacctacgggaggagtgtaccgtctacttgttttttcaatgcgtccgcaacggattgtggctgcagttgccgcgttatcgctaaaaaggcacaa

SEQ ID NO: 2850 - DNA, 1734 bp, Toxoplasma gondii
cctttgacgaatcagcgaacgacccttccaacgagtcttcttcatcgctctggatgaaaggctcacagcccgcgaaacgtgcgggtgcgttcgagacattcgtcgggagatgcttcacattccagcttcaaagttttccatgctcgattgctgtgaaagacccggttgtggagctgatccccagcccctacccccagctaaatagcctcaataaactcacgatcttcggtttcttctcgcagcgggtagttccgctttcgatagtgttggttgcagccattgcgtctctttttccacagagcgtagaaatgcgcgggttcatccgcaagcgagtgcagaactgctgagcgaatggagctgacgaatatgtcgccgcagtaaacccccgttcagtgcgttgcccgctaggcagttggttttcccacgttgatagagcactaggaacttccgtttcacacgcgaggcggccagatatggaaggcaggaccgagcaaagtacagccggcacggatgggccacagttagatgccaaggaactggacggcttcccggtcggaacaaaatactgcgaaggagcacggatggagaatttgtggaaaaacgacgaaaggatgcgtttgtgtgtgtctaggaaggcaggacgaaccatggaaatttgtgactgtccgtagaactgcagagctgggaggacagcggcgctgctgtggacgtacacctcatgcacagcgtcgggaacgaaggtgcctagaaacgacaaacaaggtacaagagccaaggacgagagccaagttgccctgaaaactgaagacacaattcgagctaccggtgtagacgagtgactccttcgcgtgtcttggaaacttcccatgggcagtggaaggaacatggagcatcagcgtgccacagtaactgaccgttctgtgtctgagctgatcgcaattcaactgggcggtgcgcgtatgttccttcccgcttcgacacgaaacgcgcaaaaggtccagggaaaggcatgcacggagatttaatcacgtcgggtgtgggtgagtgaggatgagtcactgcccgaagatcctcgaataagtaattcacacgacagaaccttcaacgtctaggaaacacgatcagaatcaaaatgctatcacgccattccagcagtccttcagacccaagacagaagagaccaccggaaagggcaacaggacttgggccctcagttgcatgcatgctgacacagaacagggtgccggggctggtcacgagccgacgaacttactgtgcaaaaagtcacgccacagacggcttaaaaccgggcagtatcgccgagaataggctagagtggacgcacagcaagccaaattcaggtagctttgagagaattgtcaagcgcgcggactgctcaggcagatgcacactgcgcagcaacaggagacacgagaggcggcgtcgtgcatctgaacacactttgttttcttttccacacacgcagggccaggcgcccctcgggtttcctttcaggcggaacgtccgggacgctgtggcatcgtgacggagtgggctttttttccgtcttgttgggaaggagcgctggcggggcgagcacgcatctccaatcctggagaagaaaactattcctatctttttctcgatattcgcgacctcgtttgctttgtgctggcgtgtttgcttccttcttttgcggtccttccttctatgagacgacttagttgcccacga

SEQ ID NO: 2851 - DNA, 3041 bp, Toxoplasma gondii
gacgaagagaccattctttttcggcgtggctggtgtttcgatgcatgaggagaggggtgcagagtttctgggcgaaggcgacgcagaatcgtccgacacgcgacctgggggttgtggaacgagtaatcccttgatcggcgcgcctgtgatttttctaatccgggacggtcttttaggcgggaacgactccactgaagatcgacacctgcgggttctcgttcttcactgcaagagtcaagacgttttcaagagctgctgtgttgcggcgtgcatgcgtcacgggaaaagcattgcagactggaaaggtctcctttttgattcgttttttcggtggagacagtgtcacttgttgcagagacttgacagctttctgtacaactagttttatgtgccggcttcgaaaaagggcataaagtggtttgactcatatacgaggagagaaggcgacgtcgtgctgtggtaaaaatgatccagggggctctgttcgccctttgggaggccgagacgcgttctgcacgtggtcctgcgtaggtcgcgtgtgagaggatgaatcgaattaagtatgggagagtttcagcgttcgtcgttaaacgatgagtagaaaaaacaacgttaagcgcccgtttccagcctcgtcagaaatgtgcctcagctgcatgcagcgggaatgtggaagcgcgcaaccagtggcggtttcatagatgcgaagagtccacacaaactgcattttacatctacatttgacgaagagcagtatggatgatcctcgtttgattctacctgtgaattctcgaccggtagcaagggtcgcgtggggagacaccctgtaatagttcggatactgcgttcgacccaagcgatgagagacaggcaaacgacggatcgcagctcagcaaacgcgaagacaagaaaccgagtatcgactcagatggacagaacacgtaactgatccttgtgctatttgtcttagttgagtcttcagattaagcgatactaacgtttttcggaactaaagtcagcaggctcgaagggaatgtgtgcagccagcctggctcattaaaccggcctggattcgtagacgaaacctcaatggtaagattgactttcttccgggaagcgtccacctgacgcctggtgtatgtacaccccatcgcggcgtctcactggcaccgagtttcggtgatgtctgcaagaagaacgcgtatgccggagagagatcctgggcttttcgaatcgccagagttggcaagtgtgtagactgagcttcttcgaggtcgaaccgtatcggatttgcgccccgacaaatatgctgaattcttaccttggctcgtgagctgcggtccgccgtgtaaggcagtagtctccgacgagaaaaagcgaggcacatcgacgcgggagaaacctgattcctgacctggcaagccgcgttcttgggtatgtttttatcgggtttagtggcttagcatgcttgtgaatgcaggacatcatcccgcaaggggatcttttccagaggtttaccaagggcacaccgctgcctcatctgcacggtcagtgcacaacgaggcgccattgctcgtgtttgagtcgaggcagcgctgtgcgtgtttcgtctctatttcccaattcggacgcccaactttttctcgcgaaatacccctcaattgtgtttgctcaacgccctcccacaacttctctttgcgtaccgacagttcctcagagcaactttttctgcgggcagtagagacgtacggcctgcaactcgtggacttgcacaagcaaagggcccggtaaagaacaggttcagcattcctcttgtggggcaacaggcgagaccactgcttgcgtacgtttgtccttgttccgcaatttccctccatcgtctagaagcgcatgcttcggctcaactcaaaaaaccggtctggccgacctcacctttctgcaagggaaataaactcaaacttggagacgcagcggagcccctccgtccagcgcgcaggcgtctctcagcgaggggggcggagatttcctctgcgctttgacttctcccgcgacctgaggcggttgaggaaagagttctccgctctggagaagccgctgtcggcggtctttttgaagagtctttgggacgcggagagcttcccagacaacgttcactaccaagtgtggagattcttcagcccctgagctccggagagcacgctttttcgttgagcagttgccgaccgacagaggacgagcatctggatcccggttcgccccctgcatctagtggtgtggaagcatctacgttttctggaaggaacttgaattgctttctgtttctacgtttttaaccgtctggagcaatttgctcctgcgactattaatacctcgcgggacgcacgagagctgccgccgccgtgttggtgttgggagtgtcgcccttgcgagacgaagcgcgttcgtgctcttgtaacgcattgttttttttaagtttcattggctgttgtccaagtcctctgacgcactgaagatcgcttccccgttttctccagagctcttttccaccgagtgctggtggccagcagtcctgtctctcctgtctcctctcctgtttctccccccacgtcccccgcgtgaggaagtctttgttttgagtcggcctattcctccacgaattctcacactgacgctttgccgacatgcgagtgcacctaaacgtgttggaattcagcatcgtacgacggtaaggatttaccacctaaagtatgttctcggcatttccagttctttcagaagtgaaacgtgggcgcgctccgcgggactcgtctgttttccgccgtgtcatcctcgaccttctttccacgttgtgttcccgcttgaactcccgctttttcacagaaggacgctgtttgagtaacgcggcttcgtccacacttttttgccgtccaccccagccgcacagtgtgttcgagcgctagcgggccgagagacccctcgtctctcctcacacatttaccctcaatcccaggcgttttgccctgaaccccttttcaccgcga

SEQ ID NO: 2852 - DNA, 2646 bp, Toxoplasma gondii
atggtatcctcagtactgttcgcgccaaaagtctcgtggacggttgcggtgctgtgcgttttccagttcaagtgacactacgatgtctctgtttccaaaaggatatgccgagcaactcaagaagacatcgttgttgaggtctcgatgtacgacagacgcgtggacaacgtgtcagtgtaacagttaagcgcatgtttgtttgcggtgtccgttcgcttgacagggctaccacttggtcgtggtgtcgaatcaactcggggttcagaaagggcatacgacgctgatgtctctgacggagaagagtgacgcgctgcagcagacgttgaacgtgccgttgacggtttgcctcgcggttgctgacgactttttccgcaaaccacgaacagctgcagcctctttcatctttgctcaccttctgccacatctccaccaggtgcagtgctgtgtaagctcctctcagtgctgtacagtacggtgttcggatggtggatgggcattcgaccgagagcgacagctgtcgctcccaccggtttttttcgtcggcgatgcggcaggaaggttgggagttcccagtagcacaagtgtaggcgagaaacccaagggccagagggcaaagaacgagaaggcaaagacacccaaggatcacagtgcggcagatctgaaattcgctctgaacgtaggagtgcccttctttactccggagcagttttttcttgaacaggacgaagtgccaccaccgcttattgcgtattttgggaagggcactctccccataggttcggtacagagtggctggacgcggcacggaacgcactgggctggagtcggatccgaagttcactccgaccaacgcatactaaattctacagcagtgataacagaggcaacctccaaagtgaaactgttcgtgcctgctgagctggtgaagaacgctactccgaaccggcgaatgagggaagagcattttgggtggctgcgaggtgataaggtacgcagctcgtccgttggaagcacaggcctcactggtcccggcgtaaagtccgaaaacggtgaccgtgttacaggtggtgctgaaaacgactcaaggggattcactacggataacgctggcaacgagaccggtggtgacaagaaccgtcacgctacacagccgcaactggtaatccttattggcgctccgggaagtgggaagagcactctgacagagacagtgttcaaggattacacgtgcattcggcaggatgacctgaaaactcaagcaaagtgcgtcaaagcgtgtgaaaaggctcttagcgagaagcgcaatgtcgtgatcgacatgcaaaacgcgacatgcaaaacacgcgagccgtatatcaaactaggaaaggcactagggactcatcggatacggtgcgtcgttcttaaatggcccgaagaaatgtgcaaacatatgaatacgtacagagcgttggttggacgcgagagggcaaaacgatcacgaaacgcgctctcaactgatttcgagggacagcgacgacccaccaaacagcctagcacgcgattccgggaggaggctgttccgtcgtttgttctgaaaaatttttacagacaggtggaactgccgtccgccgatgcagaaggggtggacgatgttgttatccttgacgacgcagaacggcatttcatgtgtgaagagttctctgatgatgatgaaatggtactgtttggttctttcctcgactgagcctcaccttgaacatattcccattgtgtgtgtgctcattctttctgcttgacatgcagtcatgaaacagtgggaagactgacgcaggtcaacaaactggtgaacatggttgttgtatctaattggccaagtatagatgagccttttcttgcctgaagtgaaacacatcctaagcgtacagctacccttattgagccgtctcgtatgtcgaagcctacgaccaacacttggcttaccgtcaacagcggtcgctgagccgcagacttaatacggttgtgccgtctgtacaaacacattgccagctctgaagatggctctgaatcctgggttaacgtcgcttcggcgtgagagcctgcccaataccaacagctgtaaacacagagtttaaagccgatggcagtgcttgggcgcgcacggagcgcggaaataacaaggagttgttcttcaacacagctgagcctatgccaccgacacgaatcatcgatgaaaaccacaagcagagttatttaccagcgcaaaaattggctatttcaccgtatatattagtataccagaagattgcatcgactgttcggaggcaactcgccgctacacggaattcacagtgacaccagcaggattagggtggcgtggggggttctcgggggacaggtgttttaatcgagaaaaaaattcagaagcagaagtcctaaattcgccaatgacgtttgcgtccggtagccactagggaattctgcccgattataaagcactgggttctgtcatctgccagagtgctcccggaagtatgtacaccggccgcacctgaacactcgcaccaaggatgggagccagctggttgtccagtctgctgaagtaacgcttctgtcttttggcgcaccctccactctttccacaggcgtcttcctcaatcacagcta

SEQ ID NO: 2853 - DNA, 3046 bp, Toxoplasma gondii
agatgcataaaattacaatatccgcctctgcgacactgtccatcaacgaactgccggcaccgtgcttcccggaaatctgtaacaggggtgaactcggcgtgaatctgcttgcctgtaaacaacacaccagagacacgccgcgacggacaggtggccatgaaaacacagctgaacgcagttgaaaagctcaccagaatgctacctgctcctacacccgctcgtgcatcacatacctgagtaaaatcttccttgcaaggcagccagtgccttgtttgccgcttcttcatctgtgtattttacgtagacgtttccgatgatgtggtcgcctatattgtcgcacaccaccatatcctccacctcaccgtacttcgctaactcctcgaatacttcagaaaaaaatgcctcgaagtggtccgctgcttggtcaagtagttcatccgaaactgaacaaccacagcacacggattcgcaagacgttgctacgaatgcaactgcctaacccgttgacacctttcctaaacgaagtgattcctaaacgtgcacactagtagccacaagcccctgcaaaactgaccaatcgaccacaatgaagaaaaccagacgaactgcaaagcactaactagcacaactatgcgtgccggaattcaacaatagtggacggctgaacgattagtcttggcttaagaagaccggttaactatcctgtgatgactatccttaccattctgtccttctgcaattgccacagctacgggagggttggggtacatgtgacggaggacgattgttggcgacgatgtcggtttatagtgcgaccgagaacactgatctccatgacgacaggctccaattttccaataaaaaggacagttcactctatcctcctccgtccctatgatacgagccagatgctccgccatcgtggatgacgaaggcagtgacgcagactgtgttcaacaataaaaacgtattcagcgcaaacgtatttagcagattcaccaagggcaagatataattatacacactaccaagtgcgcaagacaatccagtcgggatacaaccacacacccagagaatcaagaaaaagcaacaaagccatgaaccgatgataagacaaaaacgttaccatccatacaaaaagagacagggttttaaaaacggtgtcgcgtgaccaaaaagacgcctactgaaagcatacaaaagccagttcagccttcaacgagccaacccgccaagcgaaagggtggatctttccccagctgttaaagacgctccgaacggtgcaggaatcgaacatcaaagcaccgcgttcgaatgtgacacaagacgtttcaaacaactcttctccagactacgaggactctttcgactgacaagataaacgggacgcgaaaactacgtcgttggtcgtccgctgttctttgccgacttcatccatagtcttcctctgtatgcatcgcggggaatggggggacttcttttggatgcactggaggaaaaacgccactgcgcccgttaacttttcttcaatgaaactgtcactctttcatggaatgacgtttttccaccatgtaaacaatcagaaaacactcttttttgaccgtaacatacggcagcgcatcctacaggcagtgccctcagaagaaaaactgaaggagcttgtgctatacttcgcatagtaccaagtgattcacgtagttaagctttcccctatttgcagaactccgggaattctctgcacacgccaacaaagaaacacagcaactccaccgtagtgtagatatccgtccctcattagggaacgggcgtgggctctgccgaaaataagccgtggattttatgttgaagcggtggctggtattctgcgctctctatgcgagagtgaggggtgacacgccaaaaagcgtgtccctaatggccgtggattactttttgtcctctttactttagtgggatcaacatgccgtttctaattattccgtatcagctgccggtctactctttgcagggtcaggagacagagtcggccttatactgaaggtcgagcggtctttcgcgttgcttcctacgttccaccgtccaccgctgttttcagtgagcaaaatgcttctggaagtcaccggtttccacctttttttcaaactgagacggcattgttctggtgttggacctaaaattagcatcatcttctgtatcgttcgtctcacggcgtagatatgaatagaggaaagacgagctcactatgtacgcctttggctttgactgtcgcctgtcgcatgcaccgtccctcctactacgagcctgcaagattcctcttccctttgtcacgcccgctgcagcgttgtcccgcctacaaagacacgtcacacaatcacccgtatccacctgcataaagttgagaaactggggcgttatgtgtgggaacaaatcttcgtttctttccgaaaacgacgccgtccaccggacgtttgagtagtgtcagtcgcagctgcctaccttgatcccgacattttgtcgtccgctattttttccgtctttgtgcggttcatctgcagttgttggctcagccacctgatttgctgatgttcttctatctcactgatctcactgctgttctctcccgtgtttttgtatggacaatccgcctgtgtgcgtggctctcctgcacatgcacctcggcaacagaaagggccgtctgggtttgcgcctcactgtcactcttttagaggcgactgacagacacggtcccaaacgagtgttagctgcgcaactgcccgcattttgttgagtttgttgcttgctcggaaaacaaacgctccagcaggagacccgtcgatcagtaccaacaggatttccggcaaaaagtgccgcatcaccgaaggcaagcgaccgaggttacctctgcgaaaaaggggacatctggagcagcgattgtcgaaaaaggtcttagcagttttgcttcctgcggacgtagaggccactgcgactaccgcggaacggacagcactagagcaacgcgtctcgcagaagccccagagagaacaaa

SEQ ID NO: 2854 - DNA, 3874 bp, Toxoplasma gondii
gaagtggtgttcgtccaagcttcgtcgtctcgttaactgaaagacctaggggcagtcgttcattcgaagacgacggcttcgttgaacaagtaaataggtagcggtgttggggaaggactgaagctgatatctgctgatcagtgtacctgcgtctagtcctagctgaaataggtcgacctctccataaaaagccgctgtatcagaataaacgcacatggcagcaaactcgcacccccgcgagctcttcagtagttatttgcctcattcgttcgttggtatggcctccgtaaccgcagagaacaacaccgacccaccgtggtggaggatggtcattccactctgaggatctttgacgctgtagtcgacatcaaaagtctggagcatcctgaaacatgcaagaccctgtgctggtggaaatgattcaaattggcaaccgtgacacagtgcccaagaagaagccatcatgatgatgtcttggtcatagtactacttgacggaagcaaccgacgcatcaaagtcacttcagccggtcctgacctcaccaggaacagagtcagggatctcaacagttagcaaccacttaggcgtgaaggtagtatgtacaaagtgaggaaagcgggcagttgggaaagcactcctacgccgcttcgtggctgaagtagctgatttgtgaggaggataaacaatcaggtgctgatgtttttgcagactgaaagagtaagcgtgaaaatcagcatacttccattggcagtatttttcgtgaggtgaaagcgtgcgaaggggcagtgggctgtggtttgtaggatacctgagtttgttcatatccggcgcctccttcatgatttcgtcaaggagctaagaacaaacgaaaacagcagccgtgtcaacgatatttgcagacccagaccgtaggtagctccacaacagagtaggcgacccggctgccgcgcgcttgggagcatactaacttcaagctgcatccgctttttgctgtttgtcaagttgccaccgcgttttgagtctgatctctggaggccatcgtcggtggatggtttctgcttttccgaagcgggcacatccgcccggtgcggagacacgacgcgcgacatcgaaagagagatgaagagatggtgtcctctctttttcgaaaccgactaacacatggaactccgcttttccacacgttcgtgatcccaaacggtttccatcaagttgttttcaagtttcactatttcttttcacgaagtagtcggcaaaagaatcaagtatattgaaggatgtcaggatttcagttgtttcatcgcttaaatgattttgtacattaactagcacgaacattgaacctgcatgcgaacctggtattgtgaacagaagctgtgctgttgatgtggcggatcacaccgcgtaaaaggtgaccatcttaagaaaatgtcaacaaaatacagaacagacacaggttcttgcggttccaagaatccacgaatgtctatttctaaggctggtctagttgatggaggtcgcctgtcgcttacggtggatttcagtgtatcaggattttgttggctgagagtaaggaacacaactgttgagcatgcaacaagaagcagaagcagtctgccctcgacatcactttgtttttgctcggtcaccctgggggcgcctacctcgaaaaccacccgctgctttgcaacaggttcgtggaagcttttagaaactgcacaaggatggttcttcctttagccccagaagtgttggtccgcatgcagaacaaatgcaacccttgtggtagatatcgattgctcccaccatcaagcagtaacacgtgacgatgacaccagacgggttgaatgctcctcctatcccgattggcactatgcccattttttgcgaaacccgaaagacatgtggtagggcaagtgaacgcatcaatgctgaacgagttgccttaaaaagttcttctgctgcccctgctgactccatgtttgtgaggaagctccaacaatttggtgatgatcttacagtgctgcttcattcatagccgcaatctagggagacactctgaagtggcaaaaactcaagaaaataattcaacattatcatacctgcgttagctggttcaaagcttcgttctcgcccgtcgctgcagaaaactgtattactgacgatcaatctcgtacagtgaaacagtgacgtaccgacttcctgaagtgccttcacatcatcttcaattatcgttcacacgatgttacacaaatgataacgccaatgcgaatccatctacctttctcgaaagcccataaatctgccagggaacgtctgagagagcgtttctccttcccgaatcgcagtgagtctagatggtcgtcagcactctcctcaatgtgaatgttcctggaagaaatgtgtttgccgtcttgccatagcagctggtgtccggcattttttctcacaaaactgggtgaggagggacctgaaggtcccccagcagcgccggtagcatgtcctgtgttcgagtgattttctacgaaactagaattactcaaaaacgaatcttactttcgagcgactgcctgccgcgaccgtagcacagaggcacacccatgtgagagtggcgcttgccatcatagtttttggaagggacatagtacagcccacagtatatatcacagtattcgacggaaggaatgcaagcaggggcgagggagaatgaacgtagcgaacatgcagtcacacaaggttcttctgtatgtacacgccacgtcactcgctgtcggtgatcaacctcagcagctatgcacggcatcgcctgccgatgccgaactacctgcgatcttttctctttcctgtgatggttatacgcacagataagactggtcgttatgcatggcagcctgctcgctggctgcttatcttgccagcggaatgcgctgtggctactgtcttacgataatgtcaaacgagacatgtcggcagcacactgcgctgagtttcaagtcgtacctacaacaaatgctcaaatgcaactgcccataagatagttgtggctaacctatctctgtgtcttagtaatgcggtataaaaagctttgccgtgttttttttgggtgagcacgaagtagttgatgacactcatatcaacgtcagctactgtgttacggtcttacatgagagcgaccccactgcagacaaccattctacagacgtcttggccttcaagatgttgcaatatacgcgtgcgacggtgtaggccacaaaacaacaagcgagagtgaatcaacagcagcgcggtatatgcgatgtccgctgaatgacagtgaagactatcgggtcacgatgccgactctaagcgtgcactccatttaacgcgaataaccaatcgttccggtttacaagacagttgagaaattaggggtggaatccagctaagctacactcgagcgacgaaacattctggttgtgcggctgaagtttgtgaaaaagccttggacacaggaggtcgcatgcacactgttaggatacttcttctcgtcacatgcctcctacacttgatgatcctgctactgtgagatcatcctaacggcggaaagggaaatgtgtttcaaagaaaatctaaagcagatgtgtgagtgcattaagacgacgaagggcgtagattatataccgatacatcttagtcttcaagtaacatgcgaagcttaaacttgaggacccagatgcacgtgagtgtactgacaccgggattaatcacctaaggtgaacagagcaacatcgtgcctctgtatatcggaagaaggtgcttcacacaccagacttgactgcaaggcgccttggaatgcattgtaggagactgctgtgactaaacctccacgtatcca

SEQ ID NO: 2855 - DNA, 1925 bp, Toxoplasma gondii
aacagtcaggaaggaagaagacaaagaaaaaggaagaggcgcaagagaacgaaggaaacagaaaaggggagagaaggggaggaagagcgagaatgaaaaagaaggagaagaaggggaaagaaacggatcctgtgcagggcaatggcaacgaccggcgaacgagaaagtgaaggcgcatgcgcagagtcgaaagaagcggaacgcgaccttggtacggaggcgagagcagaagcaggctccgtcgcagagtcgaaggatgccgaacgcaaagagaagacgtccctcgaggctgaagcgccccgagaagaacatgcgaagacagccagcaaaggcaacgcacaagatgatgggaggcagagaaggtgagagcgaaaaggagaagaaagagagagtggagaacgagaagagacagaggacagagtggagaacaagcagatgagcacgaaagaagagaggagagacggagcaaaggtctctggtggaagagaggaaggcgagagaagagcagccggtaaagccttcctggacaagacaagccggcgaagaagagacaaatgcggttcgcaggaagaagagttcgcgccaaaattcgaactctcacgcgagccgcgaacgtggaagcaactgagattcgtgctgcgtatcaaaaaaggctcagagaagacgcccagagaaaccgatttgtctgtcggagaattgtgtacacacacgcgccggtcgactcgcctctgtcggcgccgagcttctttcgcttcctccgtatttcctttgcactgacgcctctttttctcttcctcgccttctcgttcaagagtggagatacctgcatttgcgtgacgactagcgagtgaggacatacacgagagccggagtccgacgccgtcctcctcgcgcgctgctcatcgccgcgcagagcgaagaagacaaatcccaatcagaaagaggagatggagagaaagagagaagacagacagagaggagatgagaaagagaagcggaaagaaaacctccggagttctctctcgcctcgaaaaaacgcgagacggcgctcgccgcgccccgagtctgcgtgcatgcaacgccgtccaaaaggcggcttttctctttgtctcgcgtcacggagagagagaggaaacgagggcagaacgcggacaaccaaggtgactggagacgcagatcgaattgaaaggcggaatcggagtctcggcgcctctctgtcgaaacaccgtcccggtttgacacctaaaaaaaagacgagagagacccacaaacagaacggctcttcgggactcggtctacctacacctgaagcttgttccgcagaaaaagcggagaagactgttcgaaacagccggtggccgacgggagaaggaggcgtttcgttcaactgtcctcagttttccggccgctctccactctcatcgtgcgtccgtcgcctgcggcaactggccgagagctgcagacgccagacgcgtccaggtcggtcttctctacttttcttttcactttctcccgctgacaggaaggacgcttcgaacggcgagtgtgctcactcttgcctgctgcctcgaacagcgagactctctggatttcttcttcaacgacgccgcgctccgctgcgaggacgtttctgtgtctcaacatcttttttgcgtatcctcgattgggtatctccctcgcgtcttcggcttcttctctttctttcctccctctctgccgtctttgcgtcgacgctcgctgcttgcggcgcccgcaggtccgatttctctcggcgttcctctccctgctgcgtttcttgtctctccttctctgcgtgtgtcaggctctttgttcagagccgctcagctccttctcctcctcctctctgtgggccaagctcgtcaggacttccccgcttggctgcaggctccaacagaagccgaaca

SEQ ID NO: 2856 - DNA, 2952 bp, Toxoplasma gondii
tggccgaactcgagttgagagagacgtttctgtcgcacttggtttttttccgcgaccctttttggcaagcgaaagccagatagacgcgaaattcgattcgcgtttccgttcaaccggtgggaattgtcggctttctttgtcgatgcatacgtttcactgggagcgctatcgcctcgtttatgtagtcgaggtcgcggtgcaggacggacggaaatcttccccgcgcttttgctcatcccacattgtagagaacgcaaatgccgcggattgtgtatcactcagctacgggaaacagtgtctctggtgtacggaagccatagttcccattctttcaaacgacacaccggtaggttttcgacaacgagcagtcctcgtcgtttcctctcgctgcgtgagttcgcacatgccaagcacttgacggaagagtttgtcagtagacaaaagcaaaggggatccgggaaaacggcagctcgtgccaggcaatggaaacgccaactgagagccccgaactcagggcatgcagcagagtcagatagctgcagcagttccccgtgttacaatttttaagaggggactcaataggagtctttgtttttcgtaaggcgcagacgagagtcgtgagagagaatcacgcgccaaacctaactcgacaagaccatctctcacgacagcatcggatgtgtaacatcaagcatcctaaacacacagatacatattggtgtgcatgtgagcatggaagtccctttgcactacgaaacgcagagcgtcattgtgcatctgtccagtagaaatgtagaaaaaaacgtctttgaaatatgcaaattgaatttatagggatgtggtatttccttccagctgaagtgggggattcaagtagacccttctttccaagacttttcaaagacagagtgtgtttcgagttgccagcatgcgagtttcttcggtctcacataggaagagttccactttcgactccggcgttttcaactacatgattcttgtctttcatcaaagatgtgacgcaacttcaagatcttccgtgaactctgtcgggaacgagagactggaacggacctcacacggtcgagaatgctctatcgtcatgggtgtgttttacatgctgccggcaaaatgttccggtttctctccgtgttggcatgtacgcttcgtggcaacaaatttaagggcactctctggacccttgaagctcccgttttcacggcttctctacggtctaagaacaagacagaacacatcttggccataatgggctctctgcaaactctagagctgcggttgtcaatttagagtttgcgccctaataattctaagatccaaagtggttcctttatctgctatagtgtgagcgcttctggattcatcagaaagcacctcgtacgtcggtcgaccctatttttccggtctgaaaggtgacacacacagttcaccatacatttgatttcaactttggcaggaacccaatttctcatggttggaatcatggctctcgattcgctgctgttccgtggcacagtcatggacaccacttttcaggtggtgatgccaatatcaaaagtgaggtggagggtagtttaaacgagttattgggtttgtaaattcaactacagcctttgatggctgtcttgagcgtcaaaggttcttctgagccgctcgacgattctggtttcgcctgtggcaaacatacttctgacaacgtgccgcaatgatgcttccgtaattgcttgggcactctcaaagaaaccccaatttcgagcgtttttcacggtggcattttttagcgcggggccccccaggaaacgctggactgtttcgtgacccttgcgcctttctgtgcctctttctgtattttccgggtcggcggcaaggaaattccgtggatttgtgggtgtgtcttcacagcctcacacgctttcgtgtctggacggacgcttcttctgtgggaatggaaaaaccaaacaagacacctaaaccaagcggggccgcgtcgcttccctggattctccggttgcgcttggctttctccagtctttggaggaaacaaaggtcacggatggtgtgcaaaagatgttctcgtaggaacgaatgcagacggagtttgttctggaaacaacgtaggcacgtgaggagcaaaaccctttatccgttgtctaatcggaaaacaggcagaacaacaggggaacacaacggcagagggtttagggaaagttagaacaacgaaagttgaggttgtcctgagttcaagaggttcccagaagttatacataaaaactctgcgcagctaagactctcttttctgttcgttttaagtgacagaaaagtctgctttttctcgacttaaaaggagaaacgaaatggcgcattggcacagctatggttttcaattttctctccctttcgacagagccgacctccaacctgtctgtggttcctagacggcaactgccttcttgctgtgcgttgtccgagctgcatctccgaagtcaggaacctgtgaacgtcactgcctttcagctttgacgaagaacgtttttctctctttaagaatcgcaaccaactgttgtctccccgagagctcccgacacgttgctgtcgcctctctcgatttcgtgtttgtttcttcgcactgcatgacatattcgctctcttgtctttctgtccgctgatccacttccgcgcgtttcccccactgactgtctcttttccgcctcccctcatttcctcacttccttcaacactttctgttctgaattctttcctggcctcacgttccttccttctctcatctctccgccctgcgagcgagtctcctgtcgcacgtcggagaaactcaaagattcggtcaatctcgccgctagggcgctgcgtcgcaccctccgtcggtcagtgccctgcccctgtctcctcgtttttctctgcgaattttgaaggaca

SEQ ID NO: 2857 - DNA, 4464 bp, Toxoplasma gondii
ggagataagagaggaacgtgacgcaacaggatgtagagagacgagacgacgccggtcgagcgctcgcgggtgtttcagaagatacgcactcgaagaaggaatccggaaaaaagggggaacgtagaagtccagtggcacacacaaaaaaggcgacggagacctccctggcacaacaggtcgaaggaagatcgccaaaactgagagattttctccaaaaagatgattttaaaacgaaagacaaccttgcagattctcgacacaaaactcactgggaacagacagtccgcaaaaatctcgactttttgattgctcggcgagtcgaggctccaaagaacgaagcaggcgaacccgagcgggcgtcgctctccagaaaaagctcgaaattccctgcagtgaaactacatgcgccacccgctcttcatttgtagactcgaaagctgacagtcccgcagacagaattacgaaagacgtcccaatattccacaaatcaaacagtacacctgtctgtgccatgcataaaacaaatgcaaacgcatccctatgcatataggcatatatatacatgcagtgtcagggattcggactgcagatctgcagcaggaggatgagtccggaattccgtgaacaagccctcaggcggtcacgcacctcggttgagccaagggggttctccctctcagtggaggaagctccggccagcaggtgaaaatgcagaattccgacacaaaactatcaatccggagtagagttgtctctggagggcgccagatcgatcgatcggtgtaaagtttcacagcagctacatgcgagttcgccttgtagggcaaagatgtgctcggagacacagggagcctgcgtcggttgaacggcaacgctagatacagctaataccgcttccaggtacggctgcggatgcatctctccggcagacaacgctaaggtggggtgcctagacagccaagcaatcgcgtcggcaatctagtttttggacaacggaacagagcaggaggcagggcgtctcgttcggcgaagaaagaacgggtcagaagcgaaaaaaagaacgaaaaaggcgagacaagaaagcgacgggtgttcccggcgaaaagccaagtgtcgggtgacggcgaagcagcgggggtgtagtgacaccggaaacagccggcaaacagccacgttcgagaaaacgaaccgaatctgtttgccgttttctcgagaccctggtgattttttcttcgagttcagaggccacacgcatgcgcgagagcctcggcgggagagcagtggatctggaagactgcagaagctctagaaaaaagaaaaggaaatcgctgtcgcactctgcgggtcggcaaaaagaaccgccggctgcgacgcttgccaagcagccacagatcaccagccggagaaaagaaaatttccaagtcccggagacagacaggcgtgagctcaacttaaaaccactcaagaaggcgtggacatttctcttgaaagcttttccccggctttcaaaagaacatttttggtgtccgctgtgttccagcagagcgcgagactgcgatctaacgaggacgaggcgcccctcgtgccgggtcgtcgacgacggggaacgaaaatgccacctttcccgagagaggagacacgaaaggaaagcaaaaggaacgccagagagagagggcagtaaaaatctatccgttttggggaagtggaaagcccgcgaagaacagagtgagagaaactgctgcggatcgggagcgcgagggcggagagtctttggaacgacggaggcgaggggtttttcgcgcctggcgggtgtgtatcgggggaggcgggggacttcccaggaacttgcatcgaaaagcgaaagatcgccgctttcggaaggaagttttccgcagccgagacccgcgaaaattcgctgaaatccggaagtccagagaccgcagagaaccacacctgcaccgaccccagttgcagcgcgtaaagggggctgctgacgcagatgtacgcggaggtcggggaaacacaggagctcggaaaaccaacgaagaatatctttgagaactctcgtttgaacgcgggtttctctccgatcactgcaggagacaaaacgcggaaaaaacggcgccgttcagtccccgtgggggaagcagatccacggttttgacttggggggagtcgagtcgtccaggtgtacagacacaatccagacgacaccacctgagcgaggccgccttcttggaagactcggagaaacgaacaaagctggggttccagaatttagcgagcagggcactggacaaagcaaaaggcagaagaaaaaaagggcctcgtgttcacgcgagaaaaaaaaagcatctgcgagttcggtgcgggcggtgcggctaacaggccgagggctgcgaacaatggagagaaccggcagagaatgccgagagctttgacagcagcttgggagcctgtagagatttcttctgctttgaatgcgtctgctaaaatagcgctgatcataaatgcggagactcgtgcagaaaccgctttcaagagttgtgcgtcgaaaccgcgtctggcgctctcaaggctattcagcgtacatacacaccccggaggcgggtgtcgtcaggacatcctacgtatggcagacgaagacgacccgcggtgaagtagggaagaaagtggattttcacgcgagcctttctccgaggaagactttttgccggtagagacgagagaagtgagagcaacgcaacagagaatctccacgaagcccgaggcgtagtctagtgtcaagatgatgcatgtccagcaccttcagagcacgttaatactccctttctcattttccttccatttctctctcggttcttttgcgccaggctcttttctacacccgccttgagggcagacctagcgccgccgagtgtcttcttccagtgtgtgtccaccctgggtctcctgatgcaaccgcgagttactctcgcctgttgagttgcttcatcccggaagatgaaatagccaaagtgaagaggaataaggacgagaaaatccagatggggcgcactcaactgtaaacgcaaatgcctgcaggtgcccgccccttgaggctccttgaggcgagcgcgtcggtggtgaggtgacagcgacgcctgagacacaacgaggtcaggaggagcccggactgcggaagcgtggaggtttgacgacgagaaaagatcgagtacagcggcaatcagcgaagagaaagggaaggtgcaaagaacgagactaggaagaacttggtgcgttgctctatcgaaaagtcttcgaaagggcaatccccgtcgaccatgcgtcgagagtgttttttgcgggagggactcaatccggtgcagacccgcgaacgacgccagcgtgcggtccgcggccagtctgaaaggcgggtccaggtgtacatacacctcagcagaggtgcgagaatctcagaatattcgctgttgaggggaagcgagtggaaaagaaaatcgactcatgtctgttgaaagcctttttcatccggcggctctcctgtgtgagcccgcggtcgatgcgcgcgtgggtggctgaaggtagtaagaacgcgcttttctcgacttgttgaacccaggaatttcttctggcttttctctacgctttctttcgcctttgtttcctttccgttcggctctgctttcgaaggttaacgccgcaactttgtgccgttttccccactctccgatggcctccatcgagactcctcaagcaatcacgaaaaacaggccgtataggcgtctcgatagatgatgccagccgcaaagcgcacggcgacatcgatatttaaagggtgtataagttttcttgccttccttctttcattctccgtttgatctctatttccccctttcccccgtctgtttctctcgcctcattatcatctccatttccttgggtttctcctttccttaccatcttttgctctcccctcctcccgcttctcttctctcgtcctcgtctccctttccttctttcaccccttcttttcttcgtcctctctttcctctctcccttttctctttcttttcttccttctctctttcctttattccagtcctctgcctcctctccattgcttcgggcgtcagcttcctctgcgtccctgttttcttctcacctttctggctcatcgacttcttgtctctgaggggagatgtgagttctcactcctgatcgagtcggttttgctgtccttgctctcctctcttatctagctctttcacttttcatctttcctcccgtcgttgttctcctttcttcctctttcgtctcctttttctctctccatccgctcccttctcgtcctcatctggcttaccgtctgcccccccccttcccggcttctccgcccttctcttctttctcgtctttccggctgtctccttttttcatgtcttcatgtctcgctttttttgccga

SEQ ID NO: 2858 - DNA, 4579 bp, Toxoplasma gondii
tatcgggaaaagagagaagtctcttttctacggttttgaccactgaaggccacaccgtctcacagcgaggctctgcatgttaatcgacgaatgcatgcatgtgtgtatgtacacctgcacgtgcatgtatgtgcatgcaatacatgcatttctgtatctacgtgcgtggatgtatgcacgcacatgcaatctatttagataggaagacacattcgcatgtgcatgcatattcttttgtacacggtcgggatgtttggagaggggggacgtggtaaggttactggggggtcacgctcattggggacgtctacttcttcgggaaatctgcactcactagggacgtgctggcgggcatcgtctcttgctatctgcctaggaaagaggccaaggcgtcttctttgttgtctaggaagaacaagtgcgtgttactctgtacttttgtcatcttgtgaaattgaagtactcccagacgcacgatgtgaacagatacagtggcacacactctcctaggcacaggtgtcagacaacaagtggaggcgtgacttgaacgcgaaaacagagaaatattgggcagttgagttcccaaggagctaatgcgtgagaactgtcttcagcactgtatttcatcacaatcttgcgccagcgaagaaacgtgtgttgccctaggacgcccacggcagagagacaggcagcctcttagtagtagatacacgggcatacttgtcagccatgacaagcatatttcttattcgtccaggtactaaggtctttaattggatgggcacctatgtcgctagtcataatactatgcgagcagaagatctgtggccgctcctccactctagtgaaatatcgttagacaggcagaaccttgtaactggaaaacaacagcgcctatcctgcaaaaaataagtctttcaaactacacgaaaaggctggggaaaaagcggatgcaggcaggcgccagctcaaattacacttccgcacggacgaagcagctcggttacgaaagggaacggttccgaagcttgctcgatgctgactcggaggaagctaatcacggcacacagatagtcgaacacgttcgcgggaccagcacgcgaaaagtaaaagaacaaaccaagaaaataaagcaacttcggatgtttaacggacagggcgatttctcgatccagccactgttcaaacataagtctaggcctcgcctgtctgctggcaaaatcactgccacactaccttcagcagtcaaccagacgcgcaacacaatgatacttgcacagtttaaccctgccctatttactcagtggttgtaaacgaaggactccttaacttgaactgagaactcaagtgggtacaaaccgtcacatttttactttttgcaaggtttaactcccctcgaacccatcaggttccacgtggagtttccaatggagtttctcagagccttctcagcctgaaaacttttgcaacaactgggtcgcatgtgttgcgtctggcacattcgtggcgttgtcacaaatgcatggcgtctcttcgacgtagtggtgcaaatgacaagcagaaaaaggatgttgttgatgacgtctcctgccacgtagtttgggacaatcggggggcgcacatgttcacgtgctaataaagaagcgggacagagatttccttggtcacatttttagtaaccctcatgtttgcgccgcatattcggagcggttgagtttgaatatattcaattcagctattgctttttccggcgtccaacgccgactggggtctttcgctaggagcagccgaataagctgctggatgcctgcaggaattccattgcagttgtggaagtttagcgtctccggcgtattctgatcgaggatagcaacgatttttctgtaatcgccttcttcgatggctataccccatgggaggcgaccgcaccagagaaagtagatcgtgaaggcgagcatccaagaatcgtgggtcagctcaacccgaacttgagaaaattgcgtagccattcgaatgttctctggactgaaaaaagcccaagtgataattggaaaagtagacatttgacctcgcacatacgcgtacgagaagtcgccaaggagcacgatgccactgttggacacaaggaagttcgacggcttgaggtcgccgtgaaccagaccttttcggtggagtcccgctaccactttgaccatttggactgtagcggaaactctcgctgcgaaactcttctgcgtggtgtcaagaagcggaacgacatcttctaaagttcctgccgcgatcgggaacgccagaaaaaaattgtatatcaccgttgactgttccgggaaaaaccaatcatttttgccagggagccgcagcacgtcgctggggactagtagccggtcgttatatagaatatcgtcgagatcttgattgcctagaagctcggaaattcccgcttctcggcgcataattttcatggctgaggcgccagctgacaggactgatgccaaattagtcatttgagcgtaactactcaaaattttgactgcgactttggtgccgtcctcctgagtcatagagtagacattgctagtacctccacagccgaggagctctccccttgtaaggttgactctcgatcccggattgaacagagattcaaacacaagatttctgtcgggaggcatcacttgggtggagattagcaagtcgctcacttgttgcgcagtttccgtgcatgcctctctttccgtcagacgaagcatgccacagtaatcggcaagcgcagcctgaccagtctcaagacccatacgaaagttgactgcgggaattggcccatgctcagtgtgtcggaaccgacggcgaacggacgggcagatgaacggcctgcaaagtcgccaagccaagcgggcgaaatgcgtttgaacggctctgaatctgttccacactggtcttcgctgctgtgttcgatcaacagcatacgtcccgcttcttcctgtagatgtcgcactggaaggtgtctccagaggggaggcactgatttcagatatccagtcgcttcgtctactcggtgaccgtcccgcagactgccttctcccgtccgggcttgcctgggagaagccgcgttttgcccgtgagtctgagaaacctgtctcgagtgcagattcttcaggctgagtgtcagcagggagcctgcccactttcttttgtctggacgtaatctgtagcttgataccgaaaacaccagtcgcaaacaaaaacagggacaaacacagtgccacctgggctcgcatagtgccagaaatactgtagaactcttacagggacgctcagcagctcatcttgacacaaatcctgtatgctggagaatgtttttcaacgaccggatgatacggtaccacaaccgtgaacaaatcgcaacaactgatattgactttgctgcgcttggcatccgggttctgcccgcgccgtaccgactgaagagagtgccaatgatgactatccacggttatgacgcacattacggacccaaaccctctgtctgtcttccattcttctttcacggcctttattagctaggcagcagatgccttgcggtcaaactcagttatgcagacacaaggcgaaagccctgccccgagccccatgaagctacacactctgcacctcaaacaagcgacacaaacagagcctccattccccagcctcccatgacacgtgggttttatctgaagacaacctgagatatggaactgggaagcgaagagtaagctctgtctctctcactagaacgaaacaaaacaatacttgagacggctagccgccgtgcggccgttctccgccgggtgctgtgctgtaatggctggaggggaaaagtcgcatgttttcttgtgctcagacttgcttgtagactgacgttttgtgcagactctctctcgctctcagcatgtctgtattgtcggcttttttagtctctttcccctttcaagtcgttcgtattttccactgtatagggcttcgaaaccgcgacatacaccgcgtagcgtaggtcaagcaaacgttcttcacttcaaccactccgttcacgaaaatcaaaaaggctttgactgattgtttttatgagatgtgattagttcatttagccacatggtgcataacgtagcttagcaaagcgaccgtttgtctgtagcgaatattttcgacaagtaggacgacgttgcagacatgcttcgacgggggaggtgacctcagaagcaagcgtcttgcccgcaagcacactcaggggaccagtagggtgcccgatgagttgggagacgccacagaaaaaagctcgacaacgacgtgatgtgcccagctcgtagagcggtagactcaccggtcatccgctgacagctagcgctgcaaagccatctctagcagctttcggaaataaacaaagcgttgcatcttgcatacacggttttcgttttgccgtcgcttcagagacagcgaaattctatctatcaaacgcgtgtacgccttcacggtcagagactgtggaagttgtggagagaggtggccaatctcgatgcaagagaattatcgcgtaatacca

SEQ ID NO: 2859 - DNA, 1199 bp, Toxoplasma gondii
gagaaagcagaaggagaagaaaatgtggaaacacagacttggccctcattttccgtaagcagcgtgcgtcctccccttcgttctcctcctccacacggacgaggttgatgttcactccccatgttcaggccttcgctttttctattgttttttctgtgaaagacattgctttctctttcatggggatccgagaccaccgcaacaaaggaggccttttctctcctgcctcttagctgcctccgcccaacagcgtctcggaatcatcgtttctgtcgcgacgctccgcacagctgaggcgccgacggagcgcagaacagacggctacaacgcttgaggagatccgcagtcgactgggacctccaaagaagaagaggcgaatgcagcgcggagcaaaaggacgacacagagcagacagatggagaaaagaagagcacagcacggcaaggaggaagacgaggaccggaggatgaggtagagaaggatgcaaaaggaaaggggagaatagtagacaggggacaaaggaaagaagaggcgaaggacgaagacaaagagagcaggaggaagaggtgaaagggaggaaagcaaagaaggaagaaggaggcgacggagaatgttaagacgtggaggacgaaggaggaaggggaacaaaacgaggaggaggcggaggagaggcgagaaaagagacggaggaagaagagaaacgaggcaagtaggggaagaaaccaggaagaaacgcgcaaggaaacagtttcacttgcactggaaagcaggaggccgcttgtctttgtacggaaagagtgaaaacgcgacggtcgtcgagccaggaaatcgacgcaagcttagaaattcgagggaacgtccgacggacgccacttgacaagttgaagggaaaaggaaactcaaaaacattgaaaagagtcgaaattcttcgcaagtctctcgaggaaaaacgacgccagtggaatctcgcaatctgcagtctctctatttttagcgctcacgcagttctttcctcccattttctctgcactacactcccttttccacttccgtctctccgctcatcgacaccgagaggaagagaggacgccaaatcaagaatacggcgtggatctctctctccacacataagcaatgacgtatatgagtgcacagctatatacaggtatttttataaacgtagatagatgcgtaattaa

SEQ ID NO: 2860 - DNA, 3618 bp, Toxoplasma gondii
caagggtgtgtagcctccagacgagtacttgtagctgtgcaaattttttagccccagagggggaatgtagtgtccaaacaccatctcggcggttcggtgaaggactgaacacgaaggacaggcgcgcggaggcagcggaaacgaaacagaggacgatctggggggacgcagcaacggtcacatccacccctcgtttctccccgcggcgcctctacaggcagtagggcgtcttcttcgatgaagagtcaacaacagggccgcttcttctcagcaccgaaggcagtgcacgcagaggcttgaaatctagacaggtgaacgtttgccggagtggaggggaggacagggactggacttgtcgctattcacgaaaccccgcgaaggagtgcgctgttcgtcgactggcacaagcgacaccggttcgacttcccgtttgtcggtacagcagagttcactcaacggcgaacgcctgctcagcaacaagggggaggaaattgtccaggaaggccccgcccctttgacgccgtgctccacggtttcttaacacaaggcagatgggactacacgacgacccaacgcagagcgataggagaaatcatacatgtggccaggtcacgaagaaagagatgaggcaggctcacagtccgactgggggtctgcgagctatcgagcctcttcaacttagcagagagaagtcaaaggaattcacagagtctcctacagtagcatgcttgcatcgggcaggaaacaattgacactggaaaagatcgaacaggacacccccgtcagagaaaaactgtcagaaccacccggagaatgtcgaacccatgccgcacacaaaaagtgacctagaatttcgcagaagggaagaaccaccgcgacaaacagagggccgcatatttatgatggacgaataccgagacgataaaaacaaaagaaacacgcggtctccccgagaccacggaaatggggaaagagaagggcggcaattcacgggacgagttcggcgaccgcacatgcactcgaagcgtgagtttctgaaagaaagaaaagcgcagcgcttctcaccctgaaacaaattctacttcggaaaatggtgtggaagaaagccgggatgccaggaagcttgtggcacacacgaccctatgcagcgcgtgaagcaaaaaagtcttgtcctgctgcagaaagtacagagagcgacgcagaaaaaaacacatgcacgcaatcagtgtacgcacggaacagctggtgacgatgaatgggggggcgggggtagcagagcggccccagcgcaagaaaaaaaacgattttttgtcgcttcgagaaatgaagcttgcaatactgaagctcaagctaaaggatgtcctgaagtcacagcggtactgtttccctccctccagcactgctgtccctttacggctgttcacagccactcttgtctctgaaaacgcagtcccaatagacttgattttgttatcttctcaatctttgtatccgcgtaggcgactaaatggcagaaacaaagctagatcccataagaagagtaattcactgcaactccaccgagaacagtttttggccttctctcgcgtccactgctttgttttatatgagcagtcggcctctaccatctctttctggattgtcttgccaaaaccacacaaatagccactatttaaaactgtcccgcatcgcccactcttcgcagcacacacctcctgactctacttaatagtggaacttgtataaaggagtgccaccagtaaacagacatcacttctgaatcggaagaaggccctgttgaaaaacgccgtgcctcgacccgacgcactgcattgtatgaagcgtgaacgtgtgacatagcgccatagagagaattatggccctcgaaggcgggacgggactcgagagcacgctgctggtagcggggttgttcgctgcagaaccccctgaccctgattattcttttgttcctagatctatcgttggttacgggagtaatttcaagcaggtgtggcatactcacagactcctttaccaaccaggaagtccaccacttctatggagctccatgcgtatccctgagcctccaaatcagagcaggccatccaccagtctgcggctgtgttccagaacactgcgggtgcaccgctctcttcgtacatcgtctggaccttacacagaatgcgtggttccttggggagtccagcatgcagacaacgaatgagatgtatgagaccgttatagcctctaagtatctgctgcaggaacagccacggtttcggcggtagcaatttatttttctcatgaccaacctgcctttcagaaccgcccagcagtcacgttactcactcggttattcgctgtcacaaatagcacaatctcaaccgtcaataccccctgttgttcagcttcctctcacctacgcacaccgaagttatgtatgtatcatagatttcagtctccccctaccgataaagtcttcagctgcagcgacgaagtgtaaaacttgctgctgttgtaacactgaattcaaacattataccagtgtgcttaccccggagataatggccccatactccgtctcgcgacgaacgctgtcaaacggggttgtgatactcgcttacacaggctagtcggtttcttaattgtaattacctgtccataagtactaatttcgtcgaacgtttgaaggggagcagcgaatgtacacaaaccagccgccccccttacaacagagcttctttcttacaaaaagagcttgtgagcaatacccctaaatggtgaccgcaaacgctcaacagctcctgccgtaacaggattcccgcttggcatacggtaccgaatgcgaatcagcgaatccatcaacagaatttaccttctgatttgccctgtttcgggactgctggtatctactttacactgttgccaacagcaggtgctttcttttattatccctgccacagtacacggcgtgctaaggtttagaacatgatttccgctgcatcaatgagtccactatcatacttacagcacgaaataacttaatgccaagtgcacactacagctgttcctacagagtcttatcgcacgtcgaggaaacatgccaggcttctgatttgaacggagagaatacgagacccgcgcgtgagtcgcagtgccccagttgacggttgtctcttttctctgtctgaggtgatgaacacgtcttgaattggcttgtcagctccattttattccaaattctgtcgattctcgcatgcagcgctggcattttccggctctttgggtgcgtctcatttgtcgaagccgacggttcaaacccgtctttcagggcgttgaggagctataggttcaggtgtaaatgccatgtgtatagtaaatgtcgtgatccacgtcccagttccatgagtcagcttgatttaattgacttgcgagtgtttttttgtgggtgcgtgcaatttctggcccagggcggatcgcgggatgaaaacaaacgcggcactcctattgctttgccggcagcaactcttaagggcgtctcttctgaagtttttgtgttgagatcccgcaggtggatcgtattttaggaaatagaataacggtcgcttggtccagcga

SEQ ID NO: 2861 - DNA, 1889 bp, Toxoplasma gondii
tttcgatagccgttcagaggtttctttttgtggcgcatttggtaagcattaactgtggttgtgggggcggcgtattctgaacacagttcgtcacgaagagctcccgtttgcggggcttaaagcggctgtcatcgtcagatccagtttcgcattgaagaaacaaaaaagccttccaacaaagcgcttcctgattctgcattgtctaaagcgccgaaccatcgcattggcctctgactgcatggttcatttcccgagtcagttttcgacacggctaggagagaacggtgaagtcaacttcttgaggcatccagttggggctagtctgtttacatggataacactcgactctccgacacttcactcgctactgctgggagtttatggactgatgctcatctgctttcggcatcgctgtaattatttcgaataaacgaacagcatggattctcgcaagtcaaggttttctggtttctgtgggtttatcccgcacgcctgggtgcgtcttgacaggcttgtggcattcaatcaactccttcacgaaatttgaactgctaactcttttctcgtgccgcgtctgtttcgccggttcgaatgcaatgctgcgtgaggacactcgtactaaaatggatgtttccgttggtgtggcgaccggtgttttggcgtacacgctgtgtaactcgtacaatgtttgcagttgccctcggtggttccgatgccagaacattcagcttagagcttcaactaggcctcagaggtgggaaaagggatcagatccgcttcgggccttattagccgtcgtgtagcacagtcatgtgtctgtgtcaagaatgaagcatctttggaatctgctcagtgaagcacctgtaaatcaaacaagaaacagcaacgggtgtttccccatgctttttgcgttgcaactagcaggcactatccctgccgcagcctttgttggcatcattgttatccttgtttcctgcattcatttttttttcggtctgcatcctactaaggcgcttggtggtatttcgacagactgttctgccgtctaggcaacgtaccacgcagcaagtgcgcgatttttgacgttccagagaagctctttcactctggtcctctatcctgtgaagccttgtgtaaaagagaggttttgctgtacatttgtcgccacagaaaagctgacaaagaatgcttgctgcgcaggaatcgtgaaccacaaaatagggtctagagtcgccgagtactccgccgagacgaaggagaagcgctttctaaggcatctctgctttcatcagccgacaaagatcgtcggcaggattcgtctgaaagcacctcctcacgctttcaaggcactcggtgcgcataactccgaaaacagtgacttcgaggacgagcgcactcggctgccaggggcgtctttgcgcaatttctgtagatgaggggacgcgggtcttttctcgcggttatttttctcaagtgaaccaacaagctagcgttccgcacggaaaatgtgagttgcctcaaaaggaggatcaatatcgggtgccagattcttttctcaaagaggctgtcacatcttgcatgtgctgggccgcgtttggctgctgccccgtcgtgacccttttccctgctgcttttccaacgcgctggctgcttaacgtcctcctttccttgttcgttgcgcaacagggtttttcgatttctgcctcagtcctattaaaaaccgcgctgcgcgagttaccgacgtgtctgccgccgtcgtttcgccctccacaaccccccgctccttgtctacgttgcgcagccgctttttcctggcttctcccgcgaaaacctgtctttttcgccttttccagcagctggacggaaagtgaaagggagtccagccacga

SEQ ID NO: 2862 - DNA, 2037 bp, Toxoplasma gondii
gaaatgttggcaatccttctacgcgtgttagttcgctcccggaatacggagggactacggacagcgctcatgaaaccccacaattttgtactgcatcaacggaaacatatctgtacgtcattgtacagtcaacgaggaggagcttgtatcaatcatcgcatgttccagcaggaatgcgacattaggggtaccgcgcctctgtccgacagatttgtaacaacgtacgttttccagatgaagtcgaagaggtcttgggcctcagcggttactccgacaccaattgtgtacttccgtttctcgaattcagcgatggcaactttttcgttatgatccacggtgcctctttcaatgacgggaggctttgacagattctgccgagcttctccattttgtctttcggacactacatctgcgacaactcctcggcgaacgacgtgaaagttggccttccctggttccgtgtcttcctctgcacaaacacagtgtaggaaagaaaccatgacattcgtccgtcacctccgcgtggtgcgagctggaggtagacagcagcgtccgtgcattcgcgcgacttacttagagtgaccaggcctgtaggtccattctcataacagtacagttctccccgaaacgtctcccctgtcgttgtccggatagtcacccgataccccagatcggcagagaagtcgaaagaaggaggaagcgtcggagtcgaagacggcattggagtagaaggcgcactcgcctgtagtgccatattaaagagatacgtggaaccccaacatcggccgcacaggcgcagcacctgccgtaagacagcgtatgtctcctttcccccctgatttcgggtggtaagaaaaagtcgaaattaatagtgttggttcgaggtggcgttcatccccgacacaatggcgctggatttcttccacctggggcagttctgccaggcaacgtcacggcagcgcacacagttcctgcgttcgaatccagtttatccctcggttgtcgtcaaacaaaatgcgaaagcaccgtgacctgtggatgtctatagcctccatccaagctgatagtgcctgctcctccgtggaagcctcggacgacgagcacgtgatagcatgcacgtcaaatgcagtaggagttgtgtcgcccgaacacaaagagacggttcataatcggaccagctgagaaagagagcccctgttaacgcagctgaaaactgaaaattcgcaggaaacctccggctgactctgctacagtgtcatgtgaaagtatcgtagctgaaacagcgaagcaatgaatgagggaaatgcgcgaaaaagtggcaactgtttgcaactcccgtaaatacaagttcaatggatatccattttccgtcctcccccacgcttccctgtttcatcgcgaaagggagaaaccagctggattcttgacgaaaacagtaaagtccggaacttgtccgccatcttttcgtatctggccgggaggctggttcctggcttctatactgcctgctgtcgcactacagacggtagtggcctcctctgcctgtttgatttttttacaaaatgacgtctgttgtcttctcgataaagcacacaggataaattgaggcgtttctccgccttgcttcccctgcctctgtttgtgggcgtgttgggttccaacaagacaaacactttttttcgatccagagtcgggatcctgtctcctacatcggtaggaagcctcgttcagagttggtactgtcagacaccctgacagcgcataggagttttcttcaaagagcaatgtgtgtattccttccgttggtgacgatggtgattccattttagccacatgaaatggatactgtcttgctgtggctcttagtatgcgcgtttcagtttcaaagctctggctgacgctttgttcagacactgaccgccggttggcagagctgtcgaagcaaggtgccgaggacgacttgacctgaagtacgcagggcgtatcgattctagctttgacagactgtcctaaatctgtatacgcgtcggctcacaa

SEQ ID NO: 2863 - DNA, 2234 bp, Toxoplasma gondii
gtataaatatggcgcaatactgacgtgagagacatggtggaccgaccaccgtgtcttgatggtattggcacaatgtctgcctatgttttctgaaggaagtaacagtgagcaaccgagtggatgacgcaggatacgctattggcgcatcactggaggcgcacgacttgccgtagcagaagaccttcaaatgcaattttgcacctttccctgagtgagcacatgaaccacgtcagaactgataacatagaagcagtgcaatgctctgaatacgttcgtacggagggacaagcagtaccagcggaagcaggggagatgcgcttccttgaaagcctcacagaggaactaccctgccggttacatgcttaagctataccaccgagcaaaagcaaaaatgttcgattcaaacatgcgctggaaccactatatcttatgcactcctgaggatcatgcacaatgcattatgactcaaaaccgggtaaaaggctttcaagttatataagaaatgtaaaagaaagaacaggaagaacttgggtgttcttgtaacagtgtccagaatatgcacgcaactgaaacccttcgtagatacgtggcgcgacactcgtgaactctgcaagggaagatgtgctcggatatcgagaggtcagtcgtgacacgcaagatttcaatggagttggttctacgagacagccggtgaacgtcacaccgactacaaaacgtctggttgtgcacggtccaacaagtgccatgcagtctctagcttccgtgaccacaccctaaaccttgcgaacacattgtatttcaattcaccggtctccgcgacattacgtaacatgggtcgtgatgctgagaagagcaagggtgacacatgagagagaatgcaaaggaacaagtttctacgaagaactaacgaaacggtagcaaagtgtctcgacaccctgggccccggcgaaagcgggcgtctcgccgcaccatgcaccctccacggacaactcgttcttaaaagcatacctacaacaaaacgaagtgtctaatccactctcatgagttcaggaaacgggtatattaagacctacaggtatgtcaggtttgctgtacagcaaattcgtaagactttcatgtcgaggatgagcgtggtcagaacgccgcagccactcaaagacaaaaaacagctaaaatacactttacccgcgcgccgtttcaagctgagatgtctgtttcctgttcacgcagttcgtctggaatttcatgaactcgttcgctgcattcactgtctttctcgggttttcactcgatgttcgaagacgttgcgtcggctgtcccttcgattgtgaggcggcaagacgcgagcgtcttgttatgaatcgtcagccctgcaggtctttcgcgtcggagttaccctggcccggggacgcagttttgtccccgtcttttcaagagaatatctattttcggagccgttctcttcgctgtcagtgacagaggagaactctacgcaccacatgtttcaccaagggagcgttccacttttccgcgagtggatgagatgggcggtcgggtcctccaccattttcgtgtgcggcagactagaaaggacgaacgcggtgctcatcgcacacagtctcagagggcgctgcgttgcggtcctagaactgcattcacaacaatccctgctcgtgtgagtatcatgttttgtggaaggacgttctttcaggatttggttgggctggcgcggcagaggactcagttgcacatggcgaatccgctcccttgcgtactttttctgctgttggcctgtgcagaggggacgacgtccacgcggcgcacacaccgcgcacgagggagatttgtctttctagaaacagtggagatggtttgtaactgaaagctggccgaactgcacagaagtaggggtgtctgcattcggcagggaagcgttttacgctctttgcatatcccctcttctttttctgtcccgtcgttttgtgtggtcacacgggacggggtgcccggtggttcggcgcagtcagtgtgtaccggtgcgggaaattgccttttttttgtaaactgcgaagtcctgagagcaggaggacgcatttgagctattttttatggtgaggtaatttccgatcctggagaaaaccagtactgcactgcgtgattcgcctccccacggttctttgcgtccggtgtcggtaaagagggggaagacgggccaccccgcccagcggcatcca

SEQ ID NO: 2864 - DNA, 1924 bp, Toxoplasma gondii
cgttcccttggaaaaggactttagcatttcgtgtagcggtgtcgttggtgctttgttgagactaggggccagctgagaaggtgcggaagccattgcgcggaaccaggtttgtaaagacccttgaagaaatctcacgacgggcctccatgccaatacaatcgcgacaggggcggtgctacggagaacgcgatcttcctgtttcctctctcgccgacccccgacgccaaagccgtccttaatccacacctgagtccttgcgctctgtcgtattctacgatgacgcgggaagttaaaactcgaattcagtaggatcgccctcgattctaagcttgtcagatcctttggcaaagccagaagcaagaatgaggcagggtattttctttcgtatcttcctcgcggtccgcttctgcctaataggcagcctgcccgtgaaatcttcccgattgtcgacggagcccactgaggtccgaggcctacagccgcatgctctgaaaacccgagtttgatacaggaaagaaaatatgcgacattctggagaactaggaaaaaaaagcaaaacctcgcaaaactgccccggagaaaaggaacagatggacgggacgagtacccttgtcggggatatccagttttcgacgaggcccctggtctgctgcaaaaacaaggttgtgaactaccgtgaggcattgcggagtttaacagaagtgtttgcagacggcgacttcgcgtgtgcattctttcactgatgcggcgtcctcattttgaaaaaaagaaacggttcaagcatgcagactaccggcgttcctgtgtttgccatgaactctagcagcaagcttcatcgagcagtcgcgtagtgaagcacacgcactcgtacccacagacggaagcacaaaagacagaaagctcatggacaaagcataatggctggtgggttcacaaagaggcacagataccataccagagttgcatttttacaaaggatcatctggtgcacggggaaccataataacgacttcgctacacgcccggcctaacggtcagtgggaaaaaagggacgagcactgatttggttgtcggacactacgccattttgtataaggaaactgctgaaagccagcgacatttggaagtctcgaagcccgatcgcctcagcgtggctgcatgcagttttctcgaatgtgtcttgatgcaggtaccaccttgctcctgttgcggcacaccctttcccgcttgcatgctagctattgctttgacgaattttcaaacaagccatggacgacgagttcctccgtcgtcattcgcaagttacggcttacgcgaataaccggtgactggtatacactcccgtgtttccccaatgtcgggaccgagttaaattcgttgttggtattctttcggttccgcctggtctcggggaggtgtacgcctgtggccgcggtgaacacagcgaaattttgccgtgtgccagttgcatacacacgtttctgcgcatccgtaacagatacccccaagtcgcaacgacaagaatcatgactggcgcatagcctgtcggtttcgtctgtagagtatggaacgcgcttacccatcatgtttcgcatgctaagcacttgaagaagttttctcattacagtgtctctctgcaaaagtgtttcgatggaagggggaaactggaggacgcgtgcagcgtattcgctagccacaaagacgccaatgtggatatatttcaatactaacagggatggtaaagataggtagtttgttgcagggaaagctcaagagcaacatcaccttccgcgattcgccacactcgcgttgcgggcaactctcgacttaccgtttctggcaagaacttcagctacagctgggaacggcgaatgtgcggtttcactaggctgcaagtttgtttaatgtttcaggttatacacga

SEQ ID NO: 2865 - DNA, 2432 bp, Toxoplasma gondii
cttgtcaccactggagttgctcttgagttaaatccgcgccggaattcagtcttattacgcaattcaggaaggcaaacaaacaaaaccgcgtagaatgcgtttcctggaaaacggataagactcttaatggcgtggcgcgtgttagtatttacgtctagtatgtatggctaggactcgaccttactccagcacagctgcccataactctgcgactaggttctgcgacgccaacaccacttttattcactaagttgcccacatatcctgcgagttatctcccgaaggttgctttgtctgacacttgaaaatcttaagagtgtacgtttgtataaattgtatgcaggttgtagaaacgcacggaatgccaacaacacagtctttcgcagtgccacgcgccactttacttcttccacaagccgtcagagggatcgcggaatgtcggaatgccactttcggcagagacccccgcgccggtgagagccacgacatatctgaagagaaaaaacagtggagagaaaagatcgcaaatgtctctgcagcttgtcttcgttgtttaggccaaccatccctagcatgatccgtgaaattaacaaacccccagcgaaactctctgcatgaaacactggcctactgccgcggcaagtgacttcccctaggtcgtaggaggacgcagcgacacagacgaaagtcgtgttctctgtagaggagagaggctcaacccattatttggggaggaaaagacggtttgcctataaattcacttgagagagcaacgacaaaagtccatgtggacctactttgccttccgaacgtcatcggcgaggtcttcaaaagagatgaacgtcgtgtttttcttctggaaatatgttgcagcttgccccatgtcgtctctctggtggtagtcacttcccgcaggttctgttccggacatgagggaatcagctacttcactcccataaactgagtgcatccagacgattcgaacgtctgaatggaagtgagagaaggtggccgttctctgttttctcaagtgacagctcgctttttgaatcggctgcacgcgtagagttgtagacgctctcgtaggtacagcgacgagaaactgttcatgaggctcaaagaggcacgcaagggtgagcagaaaacaacacgaaataaccaaaaggttcattcgttgttggttttttcacgagagctactagaggaagaggggccgctctgcgactgcagattagcgtctttcagggacgcggaagaccctgcagacgtcgaaacaggcggtttccgaagtcgtaacgattctggcgatatcgcgtgtggagacacccctcccttaagcgctgtcgtagactgcccagaaagagtgtcagggtagagcttctgcctcttaactggggccgatttcacggacggcaatttcacggacgctgttttgttcgctgcaagatctttcaagaagtaaaacagccaagcggcaaatgcaagagcgtggcaaataacgatcaatgtgatgaacacatagaggaaaaacggcatagacacaaaattcgtgctggccccaccttcaggtcgcttttctcgcggtgaagaccccgctttgtcaccctgaagcacgccaccaacagtctcaacagcgttcatcttactacaaactagtgaaaaactgatttgcctgctcacagttcccccttccgctttgcacagaaaacggccagatgaccgaccaaaagaacctcgagtctacaactgtctaggcaaagcgcatgctgcgattgcaaggaccgagggaagaagcctgtacatccccccaaattcgtggagaaattacggcagacacgaatataaaaaacacaggaaatgttacagttactgtcgaaaaaacataccttcctgacggtcacacgccgctccgtgtgcagcaagcgtccagcgtgcgcgcctgctgttcacgacgtttgcagaggcacttcagagggttgagggtaagaggtaggaccttcctttctaagtaacctattactttatgtgtgaaatgaccttctttcaggacaaatggtttcaggcttacacacacaagtgacgggcagtttagtgggcgatcggcactgagtggtcctccacgttgcagggaagattctgggcattctccccagcacttcaacacaaatcaaccagaactgctacgttcacaaggaaactgcggcctcaggtcacatttccaagcgaaatgacccaatgaccaacggatcctgtatcatagatgacacttgttggcttcgcactgtacgcacacacaatcagcacgctgtttcctcatgacagtgcctttaactgcagtagccttcagcctacgtccatcggtacaacaaactcttcgtctggaataaaatctttttctcagacggtgtaggcaaattcgcctcaggagagca

SEQ ID NO: 2866 - DNA, 1952 bp, Toxoplasma gondii
agctctcgtcgtatattaactctggagatattcgcttgtgctttttagaaatacccgttcgacattcctcacaagaaaagagaaagctgaactgattgagggaaaaggcgaaaaatgtgccagtgtccattcttcacttctatctgtttccttttctgaaaccatcaagaccgcatacatgtgattgctgagcttgctaatatcaatctgacacgagagatatttcagaaggaatgcattgacgcagacacattttttggacaaacgaatctgtgatgaatttcctttcgatttcccagtacaagcgtacatgaaaacgatagaatcgcgatgagctggtagtgtcgccttcgtgtctgaagggttccagaaatccaacacaaccaataattacccgggattttctagacagtccggtagcacgggtctgttatatgctatatcgatctacacttgcatgcctccatggatttctcttttcagggtagcgcgaacgggaaaattgttgcagtgtctgctgatgtcaccctgaatcccggcaaagtcaacttcaccagcggttgagacagggagtgccagatcccacccgtgcatgctcaccaacattattgccaagaaagttatgccgccaaatattccatggtttccataaacaggaaaaaggccaaataacacgcttagttactgcaaagtgtcacgcgatggggagagagccttacgccgcatgaaactcagcccaagacagttgcggtacccgagcaagaactggaagcggaaccgtagaaggtgccgcttccgtgtttgtggctgaacgtgcacacagaaaaggagctgtaaccgccgttcgcggcatgacatatgactagagggaaaaccgggcgtgtttcttgctagaatacaggtagtagtcgcggccagatgctgggcgctgcctttgacggctgctctctcgccgccgccgtgtcatccttccccaacagcaatttgtggaagcactacactgccggccctacgtgcaaacccacaagcttaatgggaaacggcgttcggtcatcattcacttctgttgctggtgacccaaatgtaaccatttcaggctgcgggttatatagcatcacatttatgcccacctccccagaaatgccgttgcatgctccgggtgcatgcgaatcgtcttccatgataaacttcaaatgcgccagccccggtcccttgctatcaaccgtttgtctcgccttctagcacttgtggggctcagctgtaaaaacgtactccaagagagatgctcagctaaagggccgttttttcaggaaattctctcttttatctgttatgctcatttccgtaatctgtgctctcgaaagagcaactggagacggagtttgatacggtctcaccccgtgatgccaagtgccgctatgttcgcttcttcacagcgcggtgccgtttcattacgaattcagttctcacaacgacgtacagccgaaattttgtgcgtgttgtgccggttctcctttgtgaggctcagttcgttactgttgcagtgccccctcgggacgataccgttgcttgctgttttggcggatttcgtgtagctgatgcagagctgcaaccgcgtttttcgatttgcgatctgtatttgcgctgcagtagaaaacgtacttcggcgcttcgtttttttcatgtgaacgaggggtctctgggtgttttctgcctactgtatcgcagggcgtaccccgcagttggtgtgttcggtcgttgctagtcattattcagaaaaggaatttgcgtcgcctgtgtgtgtcaacttttccaatccattatcagaatttgggagttgttcatttagtcagttggtggacttgcagctgttcttccgcggtccttttcagacgaatgctgtccacctgcctggtgtaaacgtcggtggaatctgctgacgtttcgttata

SEQ ID NO: 2867 - DNA, 3193 bp, Toxoplasma gondii
ctttctgtgtatttagagaactttgcccggacgcttgggtcccgagagcagctagccatcgcagcgtttgcagaggctctgctgatcattccaaagaccctcgcggtgaacgccgctctcgatgccacagagctcgtcgccaggctccgcgccgtgcatgcaaaggctcaggggcagttgcttgacgcggctgggaacggggacgaggaactcaagtggcatggcttagatctaacttcagggaaaacgaggaacaacatggctgctggagttatcgaggctgctgtgagcaagacgaaggcactgcgctttgctacagaagcagccgttaccattctacggatcgatgacttaataaaaatcgcccccgaacccgaacggggccaacaggatgactagagtaaactctacaaaatgatggtagaaaagcgaacaaaaggactagagaaccgcacgcgggacttggggagataactgacatgtgtgcgcttcccgacacgttctcgcgaactttttgtattgcgaggaaaaagtccgtcggttctgttgactgtttccaccaggaagcagcgggagatcgtgtccactggcacctttgttttcgacgcacgcgcgtggactcgtgcttcgctctcgactgccgagtcactcggtttttcttcccggtttgttttccagcttcgctgcttccgcttctctctgaacgacacaacggtgtagggtagttcacaccgaagaagtgccgctgcctcgattcctagctccgtaccatttcaaggacgcaaactgatcgttatcatgtgagtcgcctgtctactctttgcgcattcttggctgtactctattttcttacatggttcgtgaaaaactgttctccgaactcaactgttcgctgcgaaaaagaacatcgaaacaaaactccaaacttcgaaaacgtatagatacttctctatatatctatctatctatctatatatatatatatatatatagatatagatatagatatataaatatatgcatatagcgctacactttctgcttgagacatttgtggaagcgatgcggggccatcaacgtatcgtgtcgttggaatcgggtgcatgaggaagcatggtcgagcctcgccacataatgctcaatttgggcattagagtgatacgtgtaatcatcggaagtgcaaagaagccgctgcaactaagaaccggggtttcgtcgttactgtacacctttttcgggggggcgtatcgtcgagtcggacggctggttgagatctttaaggcctttgcttaccacatccaagttctactgttagcatcgtgtcgagaacagttaccatagatttaatatacgtctattttgagtacatgcagtattgactcggtacacttcaaatctaaatttatactgtcaccctgtagtatcgtgcggctgctttgccctgcattcgttctgaaagtttcgcttttgggagtggcgccccttgacgacattttgcgctttatatgacgggaatactaatgcatcacttccttttaacagcgcactatatcctacagcacaccattcaaacaagagacctctggatagaggtgagggtcggggagactttgcaattcattcaccggtaagaataggtcaacacgaacatgataccagtacggataaaaaacaaagtcaatcgggtttaatcttctgtgcaagacacccgatggtggcagctggaacacggaagttaaagggattgttcgaatacttctgcgtccaggcttccaattgactaacgaatggctcgagtagttggaaccttgacgcatatttggaaccgtgacgcagaggcggatgagaagaactacgcaatgctctttctgctcttcggcctacgccgttcgagtgtaggttccaagaaactcttctagcatccttgttgtccacacaatatatgcgagcaaacagtgcttggcatgtcttgtgtgggaaggaacgtttctacggcgttgcaactcccgagttttcgaagctggactcaactggagttccttctatcccaatcagacaggcgagttcttgacgccacttgttaagtttcctgtttctttcttgaaaggcgttgtgtgtcgcccgcttctcacccttggcgggacttcgtcacatgccaccagagttgctctgaatccactgttacaaaatcccggcactttcaacacgattctgctcacgctggcgacgaggtggaccgacatgccagcctgttcgttccttccaaggacagcagtcgtgcaggcagtgtaccagcaaaacaaaactctttactgacgctaagatctatggatcagtggtcctttgcttcctcacaccggggacacgacgctttgtcaagggcggaaaacttctcgagcttgtgaacggttgagcgaaagactggcttcgttgaacacgcaacacagcaaaagatcgcctctgacccataaaagacaagataatctgtaataccaagacccatttcgatgttacatcaggtatgctacatcaggcaagtaaatatccttcaagtagcccaggtaaccctcagggaagggtcgcgtgtttcatcatctctttagcatcgacactttagatgacggagagagcctacaagtcacaaaataattctcgcatttcgtgtgacttgatgacgaaaaagaaaagcatctctggttacatcaaaacgagaacagagcagacgaagaaaaatttgtccgaaccaggaatcgaacctgggtttacacggccacaacgtgttgtcctaacctctagacgattcggaccgaaagtcggtgacggaccagttgccctatcgtgtgagatgctattctgtcagccacactctttcaaattcatgcaagaaatggtgtacttctgcttgccttcaggtctgaaaaaactgtatgttcgaatatcaatgcaagccgaaatgaggtgggggggatctgcaggtggtgcacgcaaccgctctctgcagcacaggatgctgcagcgctactggcatggggcatgccattcgttttcgagaatgttgaagtgcctgctcacaggagattgctttggagagagagtgaactgtagatacgggaaaaggagtaatagagcagtggcattctaaaaacctttggagaggcggcagcaatggtaccctcgagaatgtgtggagacg

SEQ ID NO: 2868 - DNA, 1493 bp, Toxoplasma gondii
atctagagccacacgagagcgcaagtaaacgacacgatatagaaacacatgccacaggatctcgtagattatgtatcggtgagtgatccggtttaattttcgtctcgcctcttcatctttaaacgctgcttctctcagcgcacttcgattgatctctgtcgttccaggtaccaggatggactggccgaatacagataccacttgcctatgagccgcgtgaccgggatgcaaaatttcgcgtgcgatcacgtctgcatctataatggtaaaccccaaatcgtttgctaggcaacgggaaagggtggactttccggaggcaatcccgccagtgatcccgtaaacgcaaaatcggcttcccaagcttataccaaacagaagtatgccggcacacagcttcgcaaccccagtctgagcgaagagttgcactccagcaaggcctgctagcacgaaggcaatcaagaacgcgctgaccactctcggtcgcttatacagtctgctcgtgtgtgcacatttgctagctagcaggccggagagaaaggaagaacaaaatgctagaagaagaatgatacattgccaaaggaataacaccacggcggtgatcgccatttaggaaactgtcggaagaacaactcagccgtactacctttccgcccaattagaaaagttgtactggactctcataatcacaatggatgcagcacagatccagaaattcgacacgaggctcgagttactgataaaaagaggtcggctttttgggcagcaatgaactcttgcgacagagctgaaacggtgatgactaaccgcgaagtgtcacgttacactgtgctgattggacgaaaagacggcccgtgaagaacaggacttagctgggactccgtaacagcagaaaacacaccgagagtaacaaagagagtagaacagtcacactgaactgacgaaaacgcatgcgcgtacgtctcttgcttcccacttacggtacctcgttcgcaagacacacttgccccgttcgttgtccgtctcacttgagacacactgaataaacaaaattggacgaatgaaactatgcgacgaaatagtgatgatgttcgtagtgggcacgcatacataggtgggcagcattggcaagccgtaactgagcccccccgtcggcgcatgcatcgatgcatgccaggattttgatggtctacatccgtagccatgcggaccaccagagaggaaacatattcttttatctccatagctgacgaacctacttgtccttcgttcagatatttttcggcttagatctttttgttgagtcgactgctttccatcttttccaaaactctctttgcgataccccagacaaacagctgcatgctgctaccgcgctcagccacgcgctccttcgtaccggaaatatgtaaattcgtcgcgtgcgtcgcgtcagtcgagtaataagggggataaggggagtttgacagtggaaatagacgcccctttcttcccta

SEQ ID NO: 2869 - DNA, 4931 bp, Toxoplasma gondii
tgcacactgttggacggctggccacatgtgcgttgttttccatttgctgaccgggtgctgtctgtttcgctcatctttcccctggatcctgcatctagcccgatccgttccttgccccttccagagctgctgcgcagcgatgtgcaaccatgttgtggcggagccgtgagagccgctgacgatgtcaacgacggtgacaatggcgattcacaacccgaatcctctgaccgcgtgcttcctgtactatcaactccgtcaccatttctggacaggtggaagtcactctcagtcttgcggaaagcagtttcgatgctctccggaccctcgctcgtgaaccgggaaccatggttgcctgtttgttgaggccacagatgtatctcctccaaattggtttccgcaacctctcgatgagagtcgacggcatcctggccacatccgtcctgcagcaggctgctgtcccctgttaatagatgaagggttgcttcgggaagcgcgctcttagctgcttcaccgcatgcgcggaagaaatgtgatcttgccactgccttcagctgaccactagagttccgtccagggatgtccagatgctcctggagagaagcattctcacggctggtgcgcggaacttcagcaagaccatatctgtcctggcaaggggcattcccatcgtcgagaatgcgctcccctgaaattccacgttcgtcatctgcgtccatgtatcgacggagtctcggcggtcttgcgggtgagcgtggcgcttcatactctaggctaattccctgttccgtccctgtgcacgatgcggtcgacgtctccactgagttgtaacctagaaaaaaaccatgcgacgaggacgattttagccattcctctgctacgaggtctgaagcagcgcgcggcccattgctatcatccggtcttcgaacagattggaccggttctcctgtctcgtggcaaaagccatcgtcctcccgctcgcacatttccatggcatccactatcataataattctgtgccgcagaagagctgaatcaaatgtctactacggttacctacgtgctgacatccaatacaacactcccccagtctgtcgttgcctgtttactaggagacgccaagcgctaaacactacactctagaaagcagatgccgcctgcagtggaaatcgaatggatcgccgcaggcggtccagactgaatttacagaccggcgaagaacgaaagctcactcgctggagcaaggtctaccacggaggcgggatcgcttggcaggcgactgcagcctggctagatatgcggactgcccacggcactagcgcacacggttggatcaaaagtgcacaagatggccgctaacttttggaatccagcacagacagggaaacggtctgcccatacgaaaatgacgaagaagggccactgtccccgctgtgtctgaatcagccacttgcaagtgtccacctagtttggcttacaatagtggtcggcagcggaaaggagacgcactaggaacccgcagcctatttacggaacactccaactgatttccgaggtgtaaaggatgaagaagggaaccaaaacgaagaacaatcgaagtgggatttcctactgcgcccgggggccaaagcgttgagaggtttctgtgaaaaacaaaagaagattacgccacggatacggaaggtggggacaccgtcaacccgcaggctagcgagacggcaaccgcaggcagaaaaagtcactttatcagaaccccacaggagtgaggcagaggggacgcggccaaagccaacactcctgaggctaccttgcagctttatcctccgaagctgaagttcacaagaaaacacgtaaaccatgcaaactcttttatcccgacagggttgtccgccacgcggtgacaatggtgatacagagagccaccggaaggttgcggacggtggacacctagctgaggcagccgaaccgtgaggcggacgagggtggtacggaaggtggtgacaggaaggctcggcggacgtttgaatcgcggcttatatatttgctgaaaaagcgcagagtgcaccaactccttgtagatttcatagactcaacacaaaaacagctgtcaaaagcaacgcgacatcatcgagggcgtcgaactcagccgagcatctggtaaagctggacggattgtaccgtaacgttgtgagtcagaggggggtggcggaacggtatccgacacaaagcgggcgctggcgcctgttgcaagtaatccccaaagtaaatctccaaacagcagtgctcaacgggtgaagggacacatgtaccatacttcgcactaaaggttttgttggattgccctgaaaccgacaatccgtgcggtgccattgcaggtgcggtgctctggcgtggtgctaatgaaacccgaggggagacacgcgggtgattagcggcccgaggacaagctaggatcgcctggccagctgtttagcgagagttcgtcgcgactggccgagtcctcatcaatggcgactgcttccagcagccgcgaccgtccaatgccctagccataggcaactgcctatgacgcaatacgtttaaaatccgttcctcgaacggtttctctgcgagaaaggagacgcgtgtcaggttttttagaaactcagagtcggcgaccgcgctacagatggggagcaaaagagggcgacggaccactgaaagcgagcgccgtccacgcaccacacgtgaaaccacatgaacataggaccttagaagaatcggtaatgaaactatgcatatacggacgccgcgcgtgaaagatgagtcaggggtgtgtggaccgacgggggcgcggcaacccctgtagctccgtacaggaagtagtgtaactttcctaggcggctgtggtcggttacacgtggttgtagggcacaggcagttaggaccggattgtcaacaggtgtgaacgactgaaaaagaaggattcaaccagaggtcagcgttgacaccgctggcaccccgtgagtctttggttaggtaagttgtgtgtaagtgcgggaccatgaaatccaagaaagcctgctgcgtgtccctaatcgaatcccctcactacgaaaactgcaccagtcgggacggcaaacatggttatgaatcctgtgctccaccttaggaagtagtcaaccatagcaccagcttcgctgtgacgagtctaaaagcgaagccgcaggaaatagttatgcaccagtttcgtgtgtagtgtgcttgagggggcgggacgactggggcggccacagtaatacggcttaatcgaaagtgtcggtgctgtcgcccgtgcgtgggcctagctggttgctttccccgacagacggaaagatatgaagagatactccaaacaatacaccggatatctggttattaattgtgtagtggccgaatagaactacattcttgtatgacatcgcggctggagcaggtaatgcgcaaaggacgccgtaacggtgtcagcgcagttattgatcggtttaaatggcgagtaagtacccacattaggaggggttttcttgtggttactatggtagcagatgtttcgcgtcgtatctaaattcttatgcaaccctgcagttcatcgctggaccttgatgtctgaccgcttcggcgggccacgttttggccgcctatacccgtcaacactcggttagagtggaattctgtgctgatcagcttcacacgaagacatctgtaagcgagcgctcgtccaaatctgtattgtcaagcctgctgagcggaaacgcaggatgcaagggtggaggctgatcaccgtcctgtaccgtcactgcgctgactgttacgttgcagatgagtaacagcatgcgacacattggccctcagaagcatcgctaacacgtgacatacccttccacagttaacatggtccaaacgattttgcgtacggctcctgcaggttgacgtgtggatgaagatatttaagaaaatgtgtgggcaattcgttctgaatcatggaggtgtacacagtcaaggagcggcggatatagcggaaaagaagggaaactcttcacgggatgcttctactcgaaaatatgtccatcgctgcatgctggtcatattctgtttgctggcagacccttggcgaaccgtagtttccacgtgttgatacaaaacgagttttaactggatggtggtgcgcgggatctctaatggtaggcgcccctatttcagacctgctagccaacccggattacgtttcgacacgccacaacgggacagtgcccattataatgccaaggcaacttcgaaacccataccactgaaggcactctgtgacgttccatatggtcttacggtattcagcgactgtcttaaaacggttgaagttgaatagcgattgacacaaagcaagaaaccagtataagtgtttaagatggttcactccgtccgtcagcggcgaccgtgaggtgcacaaaaaatgctgactctgaattcttcgccttggcagtcgaaaagtgtggaaggacggctccccgcactcccgtgaccatcgaaggagtatggcgtcttattgtgagtggttgtgttttagtatcgttggtgctttcgctcactgggcttgacgacgatgtgctgacctactccggcgttccttctggccgagtcccagcctcgagacctcgagaagtactcaacgataacgccttttgatgctgtattctttctagtatacatttcagtcatgtcgctgtcggtgctatcttgggattctttaatgaaggtgtgtatagctccctgctctcggcgtagcatatggatctctggtgtcagtgacattcttgtcggtagaccgtatggcttcaagtaaatgcaaatgcacgaggcaaccgcactcactgtccagcttcatttgtgacggatgcaacgtggcatttcgcgactcaaca

SEQ ID NO: 2870 - DNA, 1749 bp, Toxoplasma gondii
caaagcttacctctttggtgaggagcgcgagaagcgcaagactctcgaaggagatccaacgcctctttccagcaggcgcacccgccccagtcgacgcggacagcgcaggcagcgagaaggagaatccgaatgtatgtcctcctgcgacgactgcggtcgacgaggcggcggctaggcgcagaagatcctgttgccgcttcaagtgcagcatcttgaggtagcgaagcaggacagacgcgacaaagaagacgaagaaggtgaggagcaggagaaagaagaaagatggaggacagacgaaggggacgagaaagacgagaagcgaagacgaagacgaccccgtcgtcaacgcagcgcccgccgcctctgccgcctgggcagctgccgagacagcagccgccggcaagctctccatccccgcctgcggaaaaacagagggggagacccagaagaggggaaggaaagagacagatcccccgcagaagacaggggaagagaacacggaaggggcacacactgaagaaagccgagacagccaggatggaagcctgaatcatgggcacaagctaaagccccgaaccatccagttgtctcttcagaaaaaggggaaagagaaaagcgctacctctctgaaaagaagaaggagatgcactatctcagcgcgaaaaagagaagagagagcctctccgaaaaaaagagaaaagaaagatgcaccaccaactcccccgaggaaaaatcaccgtccctctaagaggcagaagagcgtcctcggcgtctgccaggctggcacacatgagaccgggcgacgcaaacctggcagcgaggtgtatgtacacccgaaggggacggaaccattgtcgacgcgggggcgagagaggagaccgcagacgagagcccagggcgccgggaagaaacgaggaacagagacgcagagcagaagtgtgaaaagggagttggagaagaaagaggaacggggagacagagaaccacctggaggcaaaaggagacgtgacgaggaaagaggaacggagaagccgcagagaaggaaagaaacaccgcaaaagaggaaagaaccgccgcagagaaggaaagaaccgccgcagagaaggaaagaaaagccgcagagaaggaaagaaacgccgcagagggactgctctccgttgacgtccgcaaaaagaagagcctggcgatgggagcagcttgcagttccgctcggcaagacagcgtttagcaggtggaaaaagaaaaatccacgaggaaacagagacgcgagaaaagccggcggtgttcgggcacgctgaaggaattctgtcagagaaaggcgatttacgagacaaggacgagtccaaaaagcagacgcagttcgttcatgttctcctcgcgagtgacaccgaaaacagggaaaagggcatttgcgttttctacgaatgggtgactccaggctgtttctcttcctctcacacctgcatgtcgaaaagaaaaccttgcatgtattgttccgtgcactctgtgacggagtcggtagaaactcgactggcgaaaataacaacggaaagggagtctcttttctcgcttcccgtttctcttccttcgtttcgcctgttcagcgccctttttctctcgcagagacgcacgctctgaggtgtacagacaccgagcgcatctcgccacgcgccgaaaaagcagtcgtcttttttgtcgcgcttcgggaggaaagacgctgggggagaaggcggatttcgctccgacgca

SEQ ID NO: 2871 - DNA, 4806 bp, Toxoplasma gondii
tcttcttcgggtgttttaagctcacttttctgtcttgccgccgttcccctcgggaggcggcccgttgtcttcgtcgtcttcgtctcgacttccgtctgcgtcttctttcttctgcgtcttaggaacttctgaagccgtcgcggaggtcgcctgctgcgaggctgatgccggcggcttatagtctgggttgaaggctcgctcttcttcctctgtgagttcctcgatcttgttcaccctagcgggtcggctggaggccgcagccgcggctacgcgcttctcttcctcctgcttcttccttgcctgctcagcctcgcgctgtcgcttccgctccaactccttcctctcctcggatcgtcgccatccctcttcaaacactttgtccataacctctcggcagttggtttttcctgccgagaagaaatccgtcttccgctgaaggaagccgaagaagtagccgaacaggccgtcgattccgccagcctgctgcgccacggtcgtgaagaggccgtcgaaacgcgaatcggtcatcgcctcgtccagtgtcggggtgtccatctttgtgcgagccggggggggaggggggcaccgcgggaaaccggaaaagacggggggctcagccgagggaaagaatgggagaaaaatcggcgacgaaaagatgaaatggatacttctgcactcgaggagccacgcaaggaccgaagaacgctgggaaaagtctcgacaagatggggagtacagacaccttggcggctggggttcgaggatgcctaaaccccggagactgggcacaaaagaaccgagggcaaagaggcaggaaattcgcgaacgtaaaaagcagacgtctccagagtcgtcgggatgaaggtgcgagtacttagctccgcttgttgtcttgcgcaaccgggcgaaaacctacgcgaatgctcctcgcgggtgccctcgtcccgccactgagacgtttccagtgactctcgaccgcagaagaaaaaagatgaaactgaggcagagaaacgagctacggagcaatccacgtgcactacttgtgcactctttacacaacaagagcgtacgtcgggttcttcttcgcggacgcggcagacacgtgggcgttgaggctaaatcggagaggaacaaacacttcgttcgacactctctgtggcggcaaaacgcgtcgacaagggtgggaaagggaaagaaagaaggtaatttgtaaagagttccaagaacgtagagaaataggtcgtgtgctggctgctgcggcgacccacgcgcgagaaaagtcgccaggcatcccgctgcactcgaactgcacagaccagcctggttgtcgaaacctcacaggtggtgagacgctaaatgttggattgcgccgttgggtgtggaataaagattgaggaaatggtctagtgacggaaggtgatggcatgcgagcggtcgtagagcggaattcagcagcgtagacgcaggagaaactggacacttcatggtcaccggtcgatcgccaacagctgatgtgcctggtccgttctcggaaagagctgaaggaacagtagaaccggcgcgacgccttatattttacgagtccagagtgttgaactgtcaatccttctagcacgtcgagtgtaacaagcagatctaggcgcaagtcttcgctacactcaggggaaacggagctgcctgtggcttcggtcggtgtgccatgaacactttctcctagtcgctacgtttcgcactgcacattggctcactacaccccgttcgcttctgggtcgaaatggcagcctgctgaaccgtgtcagcagcaaggatgcccttgcgaaataccattcacgttgcacgatcaggtcaggacacggtggcgtcacacgtggaccctgatccctgagtcaccacaattgtaagccttgtcgaacttcctggaacatctcactttcagacactggcaggctgaatcgtgaaaagacggacgggattctgacgaggcgatagcaaatgacaccatggtagaaccgaaggacgatgaacatgtgcgttcctttctaagtcgtagaacgacacggcaggatacacaccgatccgacaatgacattcttggatctcagcttctctgcgacgaagtcgctcgttattctcttgtttgctgtcgtcctattttccagcagatgtctcgcacgttccagggatgtctggcggcgacggcgcagtgtctgtctccctgtgtgtgccttctcaaaaacgacccggccgtttcggaacaactctgttgctcaagggtagtatatgcatatttatatgcacatttgtacgcatcctgcgatggggcacacggtacgatgtcgaagacaaaggagttggtggtgtactgctagcgtgctacggccacggccacatatggggctgaagagtcttttttcctgtgctctcacacgcgacttcagcgatgctggaaaaagaccatggaagagcggttcgtgtcaactggtgcagtgtcgtggcagaaccggttcagagggacacacccctttcaacgcgtaattgtatgacttccttattaccgcaattttttcccttcttccccaacgatgaagtccaagccaaggtgaatctcgagacaactctgcaacgacgtgaggactctgtatgacatcgccaccagttgcgaacatgaagagttcgagcatcggtccaaggggacagcgggggggggggttggggggtcgaacaaaatagtgaagctggatgcagacttgacaattgcgtacgggagttggcagtctacatagactctttggtggcaggactgtcgagcctatcggggatgaccaacaccggcttcacaacaaaacactcgagaataaaaagcactgccacataaagttcgagcatttcgggtgcacttcgtcatggggcgaacgccgtcgataccgtctatggcgattacttgtctccagccgatgatttcattttttagaaactgcctctctccacacttctctggcgacccagaatgaaggtgctccttaggtcagatttatgctgcatatggaagcgtgagagtttcacgtgtgtgtgtggtacttgcaatacatggcctagctatatctcaaaaagatttgtatcacgtgaagtatctttgtagccccggcactatacttctgtattagttaacaattcgtcacgtgttttgattaatctcacataacaagcatcactcgcgtggataagcacgccttcaatggttatggaacctcgcaatctcatcaccacagttgcacaagcatggctgcgtttcaggcgcgagttgatgaaacacaactcgctgtccgttatacatttttggtatctgatgtgaagacttttgccaaaaagtagatgctcttcatctggcgccgtatcccctctccaatgcactgctgtacaacatcgacttccggacggccgcggcacacaaaccgaacagagggggagcagacacgcggaagccacacctagagagcaaccaaaacagacgccgctgatggagaagaatgtcgagaggagtagggggcgagcgaagcctgtgtgtcgctggagaccagcttctgtcatacacgtcttcagaaatatggaaaagaagcccagaatactcatcataagaaccgctgcagcagagcgctccttcacagccacttgactggaacgacctgctttctcatacgcgacaatgagacgagaagtgcgaaggactggcgcagagtgcgtgaggaagaagtcctttacttctttcaagggggacaagtgtgttgaaatgtcggaacttccgtgtctaccaagatcatatgccatggaatggtgtagaccggcaagacaacgggggtcatttctaaagtgactgcaagtgatgaggtgaccgacaggcgcgtgggttccatacaaatgagaagggcacccgtccttctaaaaggagagccgtggcggtctgtgacatacactttagttcaacctaaacgccgtcttcgttgaagtacagagtatcgctaacacctggatgtgaccaccattcatgtacgctgtaagcaaatgcctgtgaccgtcccatccacaccctgacagggtactctggacgaagagcttttcggcctcgatcatcatcgataatttcgcgacatcgatgctcgtgtagcatccgaaggaccaaagagatcttcggcctgcggcttttcaaccgcattccacacggaacgccgtgcagttgtgtgcgtgcctgtgtgcgtttgcccgcatttgaagaagtggtgcagcgcattggcacagtcgaaatgtcggagggcagcttgacgaggcaaagagagagactagacactcgtgacaggaagcgagggacaaacgacggtttcggtggagaagatggagcttgaagatacctttttgctggcatctgcatgaaacgcgctcctatatcgctgctctgttcccgtagtattcggggtagtcgaccgaggacctccccggcgtgcaaaccgtccggcgggtcggaagggtcacgcgcgtcgcggcggcggttgagtgcgtctgggggctgtacgagcaacattcagaccctttgaacttttcacctttaggttaattgcgggaaagtgccgtttccaaggtctgttgggctctgtgcaagggacacccgttctggtcaggttgcccaggaggcgcacgcatacgtttaaatccaaatacaggtgctgcttttcctcacctctgcttcggtgccgctagcggcaggactctgtccgacatttagtaccgcagctttgtcacaatgacctatcgcca

SEQ ID NO: 2872 - DNA, 1937 bp, Toxoplasma gondii
gaaaactttctgaatgctcaactcgcttcttcgcgtcagcattcctacatacatgaacatgcagaggctaatgcgcttcacttgccctcgcaagtgtctctttcaaatcagtcgcccttctcggttgaagagtacttctgagaaccgggaaaaaggtgctctgagtgttgactgcagtgacagcacgtaatgatcgatggttttgaggattttcgctcggaagcattgtttccgttccccgcccaacagccaccgctcggggacgagacgcttctgaagtggactccaagtccaacacagcgattccagaggcacatcagctgtcactcggtcgctttttcgacaaggaggaacagctagcgttgttacacttggtgagatattggaaagcggatttcgtctatttgtcgccattcagcaactcttttccgaacaactcgcgctggctcttccgtgggtattcgcagcttcagcagcctcgcgcgcagctgtcgcgacacgggggaagtccctgcaaacttgatcgaaggatttcactgtgccattcctttgcttgccacgattgaagaatccacagagaacacctacaataacgtgactgaaatgcacaccagtgagaagacacaggccttaaccaaaaccatcgccacctgcagtggccataaagacaacgctgtgttcgttatttcgcgacagttctgttgttttccagcgtctgcgtatgcttgagaagcgtcttgcgcatttgcgagtgtcttctcctaactcagtccaaccggaagctttgtccccaccgtcgaatccggagaggaaatagctgaagacgaagttcctcagaatacggtgtacgtacacctcgaatcaagaaaacgacggctcttcagccccactgtccccttcgcttctccctccttatcagtttttactcattcttatgtgaccaagcagttcctctcttcgcttcattttgtcagacgagggtctgagtcaagtgtttcgcttttcttcccccttgttcttcctgtatgagaagacactgcctatcctcacttctgccacaacgcaggaaaaggaaggcgaaaccttttctccttcactgtcttcaactgtccctgagtgtcccgaactgtcaccaactgtcttcgagtgcctccagatctttccttttcggagtctatgtatcctagcctccttcgttctgcgttttccttcctttcgtttcactgggctctttccgagccgttttgtgtcgaataatccaggtttgtgtgtcttgttttcctggcgtggtgagatcatcgagctctagtacatgtgatcttcatcaacaggacgcgtttctgtagaaacacacttcctgtgcgcctccaatcaacctgggggggaagcgaggcctcaacttcgatgtctgcattcgaagtataaagcacacatagagaagagcggggaaggagctctgttgcgctttttttacgagaaaaaatctccaggaattcctgcgcgtctgttgcatggaccgccacgcacacatcggccgagctgctgcgtaaagttgtacctctctcgactccggaaacctttgtgagaggcgagagagagcgagaaaacgctttcctctcgaaacatctttgttctcggatgaatactcttcgtttcctctgcaggcgactagggacagagcgaagaatttgcttcgtggactcttccgctctgtttcgcctggtgtacatacactggagaagagcgcctaccaaacctcgagttgacaaaggcggactgtctgcgagggccgcgcacattgcggactcttggctttttcccaagcttcgaaaaagttcttcccaagcttcgaaaaagttcagatcacccttttcttcaagtttttcccccgaacactctctcttccttcgctttctgtcgagtcacctccaccacaa

SEQ ID NO: 2873 - DNA, 4126 bp, Toxoplasma gondii
ttcagtgcccttcgacgagtcgacacccactgcaatccatctgaatctgcggcgaatggaagcactgccaaaaagcatcgagccgttctcactcgcataggtcaagaccctgaggaaaacgtggttgcgtatgtcgtctgtcaccctctcgcgttcgtctctgtcttttccctctctctccccctgtattccgtccatgtttccttctcctctctttcgcctcttctccccttcattgccagtgctctccctctgtgtgcctctgcttgcctcctgtccctcgcttttccattgtgcgggtctgctgcccagaggcggcgtctctcttaccaaggaagacccggcgaagaaggacgcgtccgtgagactgttgaggactcgcgcgtctggtgtgcgcgtctcgtctgttctgagatcgctttcagggagaaactcagaaaagtcaaagtcgtcgtcgacgtcgtcgggaatgaaaatgaaggagtcctccgggccgcgggacgcgtcttctgtctcgaacgcggtccgctgcgctgtagctacacctgaacacgccgcggcgggtgtcgcagacggggcactcggagcgtctgttccgaggtcggaaacaggggacagacagcgaagagggggagcaaacgagctcggcgagaggcagaaaggaacaaggagaagaacgaagagagcggcaggcggcgggcgtcgaaaccggcgcgaatccagagagaaaacggaagaaacgcgggagcggagtgcagggggaggtgtatgtacagccgagagaggcgacccaccctgcatgattccgcaagagaggcacatcgtcaaatcgctctcacttcattttcttttgagggagaaaagccagagaggagacatacaagcaaaagccgggacgaccatgtttgctgcagagcagctgtcgcagtctgcggcatgtctccgcaaaaaagagaggcgcgaagacacccggtgcagcgagaaagggagaaacacgagcccacgggaggaggcgacgcagaagagcggggcgtctctgtccttttcgaggagaaaaagtccagaaaactggtcgtcacaaactccgaaacgcgctggcctacgagacagccaagaagcttgggacggcgcccggtgaggaacttttctgaaacgggaaagagagacttctcggatttttctcgacgcgttttcgctgaaacgtcgaggggaaatcgtctgggaaacccggcgaaaaaagctggagaagccagagaaaaacagtgaagttgccactgtctctgggaagaaacgcatgcacaggcagcatatatggagcggtgtcgcacactctgttttcgacaccgaggaaaaaaggaaacagatacacctctacacgaatgatcgacatggaaacatcttcatcggtctgagatccgctttgccgagatggaagtatccgcggagcagcgagtaaaatcgcgcttctgtgctgaagcagtcgaagtacacccggaccgagctgtattatacaggcagtagacgtagcagcagcagctgtttccgtaggaagactctctttaagatagtccattgtacatctgcatcgtcccttcacgcgcttctcacaaaccactttcgactggctttctccgttgtccaaaactcttcactttatgccgaaacgagtgtctgcacatggttagctcgctccacaccaggaaagaaggaaccatgcgcgccctaccttttgagcatgaaggcagcgagagaagcaagttcaggttcttccctgaacgaagggactcgcgagaggaactcgctcccagagactgcactaactctctgttcaaaccgtccagtgaggacctgggagagcgtcacgcagcgcgtcgtcttcgaggcgtcgtcgacgaaacgtatttctctcagtgttgacacttgattgccatgtggaggagaggaagcatgttttctcccagtcgaatgtcgcggggccggggcgcgcaacagacactgtcttcacgtcttgtcggagtaagaagcagagtgcctcgacttcttttttcgctggggcattgtctcacccgcacagaaaagacagccgtcttcggcaagaacatgaaagcataaatctgaaggcgccctctgattgaggcgtcgccgtcgacctctgtcttccagagatgtcgtatccgcagctgcgacatctcagtgcgagaagcgcgacggcggtggaaaaagagagagaaactgcagtgcccagttgagaagccagctgttgtgttgtcgctgcgaaaccgggaagcgaagcactgaaaaaaagaggaagcgtctacgccggtctctctctcttcagtcactcgacttccctgttgggctcgcctggctgtttggctggacgatactgagatcgaactctcggtagttcgccacctgttcaggaacagaggccgcgcaaagcgcgagggaactgggatttggagaacaggaaaagtcgaggaactagcagtccagtgcgtgtttctgcgctcaagaaaaggagtgaacaactgtgcagagatggctgtggagaggcgaacgcgagtgcaagagagaggcgtcgcgtgcgagcaagacctgcaaggcagagaaaacagttgggctgctgttggaggagaaccgcaaaaagaaaaaggccaaggggggacgttgacgccgccttttcacgcagagaaactgatcttcagtgcccaaatcacctctctctacagacgcgcgtcctgccactatgatactctgttcctgtcaactacttgttcattcttcatctctgtcgatctgtatgcatgtataatgtgtgccggtccagtagtctccatcaatttcaggcctcctgctgcgcatctcgagtggttggaatccctggtccgccgttcctcgatttctccctctcccgctcgcttccactgctctctctcttcttctctcactcgaaaatgtgaaggctgttctgaaaaaagcctctcccaaacgagaagcgagaagacaaccaacgaagtttccagttccctcatttcccgtgttcgccctccgtccgcttgcagcagaattccttttctctcctcttcgctgagggtgttttctcgtttcatgacaaatctcggaagagacaagaaaaaattgactcaggggaaagctgcgcctccgtttcttccgggatgtctctcttcatttgaagaaaacgagctcggtcaacgctctgcttccacgcccccctctgcccgcctcgctcttctccttcacgcgctcgggcgtccgtacacctcacagacgcgaagcgaggccctctcgtttcttgctggaaaatagcggagtttcctggtggagttttctccattttgctagaaaaacgaccatttttttcactcctttccctgcatcttttctcttcttcctaacggtgaaaggcccttggcacttcgggtgtctttacgcggcagcctcagactcaccttctctgctcttgtagctcacttcttcgcggctctcaggcttagctggtcgttgaatctttccaagcgtttctcactttttttctcattttcgtcctgtctctttgtgtcttccttctctcgaactcgagcagggcctctccagtctctccctgctgcttctctctcccctcctgccgaccttggaagtccgcttttctcccgctttccttcgcttcttgctgcgtgttcttcgggctgctcttctgcggagaaaaagaccgttttcctcgttctgtactgcctccgagtctctctttctacagagacacagacagacgcttctcaccttcctcttcctcgtcaaaccggagcgcggctctgccgcgcaggcgttcctcccctgtctttcccctcactttctcggtctcttccgtaattttctccattctgccctccttgttctcgctctctcgctctcgctctctcccttgttcacctgtgtctctcgaatagagagctgcggacttctaggtgtacagacagttcgagcacgagccacgaggcgctgcttcctcgcttctcgcctcttccggccgtcctcacttttctaaaaactccctctgcatgtggagggcgagggacagtcggggagttttccgcgagagcaacga

SEQ ID NO: 2874 - DNA, 1670 bp, Toxoplasma gondii
acatctgtacatacaaacagtgctaaagttcagtacaagcgtatagccgtacgtattcgcagaacgaaagcaagttcctgtagtcctcgccactagaggattgtcagaaagatgagcgctcctgagggatattgtcacaagtgggaaaagctatgttgcatccccttcactttgtggcaaatgcttgtaaccaggcctgttgccagtcccaggtctcactggctgtacacttccgtgcgggattgacagtaaacaatgaaaaagtgggcgaaggatgtctcgcaacagaagttgcagacataaagaactgaatgaaattacaatatcgttcttggtcagttcgtgagggattctgattgatggtgggtagcaccatgcaaatactcacaggaataccctatacaaatcagaacaaggcacaagatttcagttcagagaggcataccagcatcgtcaacatagatacattttgactactgggttagaaacacacgggcagcgggtggcaagggcgctggtgcatcgtccagaaggcaaaaaacagcactcaccacagcgtcgttgaacagtgatggcctaacaggacagtcaacagtacgtcattgagaggaaggcctgaatggctggctgaaagagtatttggttgtggctcgggtctttcgagcttcctcgctcaatagcctggtcagaagagaagggattctcgtcagttcacatgttccccgttcagccaccgcgcttgagttcactaaatcgacgagtgtgtcgcgaactccatgtctgccaaaacactctggacgtgaatgctatggattcggtgaggcagatgatatggacttccgttctaatccgtcttcgagggccaggacagtccagtttcctgaaaacctgaaaacgcgtggtctattatcaccacactcacaagccctccttggtagagcgaatagcgaaaacaagcagtcgattgaacacgttttctgttactaactaatgcacgaacccgcttgtgcagcacattcgttttgacgcattgtgatgtcagtgagcatctcgatatgagagagggtcacacgaacgggaagtgcgattctctgtgctagctcttgtctgccgtctcccgccgtgcgtgcatgcgctgctgcgaaaaatcaatgcagtttccagcaggagagagtgtcggcgcgtatcgcttaccaagcttcgagcacaagcctgcatactttgtgtttcttatcgcttgtatttctcattcttgccgggacaagcttctgttttcgtagtttttacccagtcttcgggccctgcatgtcttgcgggcgaccgcgagcgtgggaaaaccagcccacgtctccagctgtgcgccgcggccgcgaagtagttgtatttgaccgattccgttgttttcctcggagttaaaaccacaaaggaggggctttgagagttcttgaaagtgtcgaggccggaacgcgccgaaggtagcagcgagatttccgggtttgctgccatttcaggcgttgtgctctctggcgtgggttgagtttaccaggcagccccgacgtgatcttgtgagggacggtgtgcttttcgaggcggctcaaggcgtcttctgcgggcgaagctggattttttcatctttcaggagcttatatcgcctgttctatccgaagcca

SEQ ID NO: 2875 - DNA, 1927 bp, Toxoplasma gondii
cttcatagtctgcggacggaaaatatgcctcgatatgcattgaaactgacaagcactctccgcatgtgacagtgtttctcttgtcaagctcatccaggctgcacgcccctatttaccacaaggccgttgccaaagtgttacatgaggaagacatccaaaaacgtttctggacgtcttctgtagcggggtgggtcatgtgtgaggctttagccggcagcccttgtcaaggcaattgtctttcatgtatcttttcaccaaaggaaggcgcgcagtgaaaacacacgcagctggctaggttcccagagatgcaaggcttgccgtttccccactggtttttttcggtggcgtcgtggaaaacaagaaactcatcagttcggttgcgtatggctgtgcctgatctctactcccgtctgcaactgttattgtttcttgtcgttggtgagatatctgtgctgtgtcgaatgccttgactgtttatgtacctatcttttctcttcctcgatcacgaggagttttccatcacccccgacttgccacggcgtcttttcgtgtctcttctcccgtcgtctccgctttctcttttcacggtttttgttcgtgcgtcccccaactttcgccgctgtcgaactgacggacaaagccgaagtctcctgcagaaaagcgagcgacggtcgcaggtggcacagcgaatcagcgaaactcgctgtttcgcatctctcctgttagccccggctcactttacggccactgtatgatttattggtggaagaaaaactggatacttataaatgccgctttgatagcgacatgtttcagcggacagactgccgacagcatcttgaatgagctccagtccgtcgagccccgagacagctcgattcagcagtcgtccttcgttccacgagaaaaacagaggacatacaaaagcaaagaaggcagagaacactacagggaagttgggaatgaacagcggtgtatgtttagctcgattcctcatcctttcgcactttccccgtctcctgtctcaagccagaagaactttgagtacattcaatcgtacacaatgtaagactttctcgtaaccatttcaccatctgaactgcctctcaatcgtacgtttctagctctcgtacgataattcaacgacatagtatcttttttgcttacaggtgtgttcttttcttctctgcagttcgcatttgacgtcgttcctttttagagggggggcgacacagagacaacgggcgacagacagcagatacccttccggcagagaaaaaactaccaccgctgggctgtggctaaacttcattcttccaaggtattttgttcgctccttgtgtctgagtaaactcgagaaaacgaaaaaaaacctgtttctcttttgtcacgcgctgtgtgtcggcagaaatgcctgctttgcacacgagcgattttgggaggtcagcgtctttgcatgcgccagcgcgacctttcttggatccgtttctgttttcttagcaactctcctgctgtttttctggaaacctccacttcttaagagttcgaaggacgctgctttttgcggcgcggtcagccgagttcacatgctgcttctccctgtcgttttccttcgctgctcttgtctgccgtctcgactgctccttgcctttgtaggttttaagtgtgctttcccttccagttctccgtgtagctctctttctcttcactgtctagacaccgcagctgacgactctcttttctgcgtctttggacgccgtttcggcagggccgcaacttgcgacagataagtctcttgttctctcgcagccgcagagtgccgcatttgtttgagactttgcactgccacaatgcaggttcgaagtcgaactttgtagagactgcatagcttccaagtaaatccaggaacgccatcgaagggagaaaa

SEQ ID NO: 2876 - DNA, 2623 bp, Toxoplasma gondii
catcgaactgctgcgctggaaaaggctgactgtccctacgtcgcttgctcacctcgcgaggcctttgtctgcaatggcggactgaacggcgcgaatcgcctcgagagcctccttgactgcgcctctgaaacgcgtctctcccatttcttccggaaacagagcgtcgacgtacgctgcgacggctgcgtcgtttttggagggaaactgcagactgaagctgtcgatggccgcaggcagacaaggcgccgaggaagctgtagctacacctggaggcgcgaacgcactcgcgcctcccgcagcggcggagggcgcgtgaggagaagcaaaggcgggcagaccggaagtcggcggagaagacgcagaagtcctgctctcgagcggagacagtttgagcgtctccggggagacaggtggaagagagacactcggagcgccctggaggagagcgaggaaagctgcgcagatagcgtctccattctcgttgtttccaaagactcgccgaaccttcaagatcttgaaaacgcgggaactcgcgtcgagaatccccgcatggcgttgcgccacctcgacgcagaaggcgcgaagcggcgccagcgcgagttggaggagacacaggcaccggcgacttgcgctcttctgcagtgcgtcgttcagaacgtagaggagaaagagaagcttctcgctgtcgctctgggctttgaacgcgtccatccaggcgccgaggaggcagtgcaccactgggtaattccctcggaacagcagcgcgtcgcttgcagccacgatgctctccatcgaacctgtcaaggcttccagagacacccgaaactgagcaaccaagcgacggtcttcctcactcaaactctccagagaaacacaggcaggcagcagcgacagatgcgcagcagacagcgaacaagatgccagcagaggctgagacgaagaagcgggaggctgagacgaagaagcgggaggcagagacgaagaagaaggaggcagagacgaagaagaaggaggcagagacgaagaagaaggaggcgaagcgcaagcaggcgagaggacgtatccactctcttgcgagggggacgcatgagcagaggagacactcatgttttcgacgaacattgttctcggggaagaactcgagtacagagagaaaaaagcctgcgtgggcgacgagagcagagaaggcaggccgaagaagagagaagggcagagatcggagagaggagaacagagagagaagaacagagagagaagaacagagagagaagcgcagagagaagaggagaagaagaacaacggagaaaagaaagaggagggaagaaaaggaagaaacagatgcagacagagcgggccaggagcggtcttggcgttgcggtggaagtccaacaaagaagagagaccccagagagttttagagagagaaatgcctcagaaaaaaaagagaggagagaaaggcgtcgcagctgacaggggtgtgcagatgagacaggccagaacagcaccagctgagcagtgaaggagagggcggggagagaaagaaaaagtccttccaagaaggagattctgaaggatgcagaaagcgaattgccctgcaaaaaaagtctgtcgagagacgctggagttccagcacaagagttcactcgagtgatttacgacagccgcagcgagaaaagaagaacgcgtaacactcagccgcgcccagctcgtgaggaagaaaagaagaaagagaagaagaaagagaagaagaggagaagaagaagagaacaagaaagagaaacaggaagagagaaaggaagagagaaaggaagagggaatgccgataaatagaggacagagaaagcctagagtccaagacttccccagagagagtcgagggagagaagacagaaaaacgtttaggtcttcgtatacgagcaaagaaggttctagaagaaagagacagcgcagagaaagcgaaacgcctctcctctctgttcactcccagtggggtgtgagcataaaagccatccccacggtatacattcaggatacctttcatgtttcttttctcacgacttgttccttttttttcgtttttcaatttcgaaagcaagcttttttgttgtttttctctcccttgagagttgaggggctctagtccttccctctttctgggggggggcgaggcgtcgagcgacgaagcgctgtctctcctccgctcgcggctgcggggagaggagaaggaactcaaagagaactgaaagagtccgagaactgtattttttgccgcagatgtcaaaaggcgtttgactgccttttcgtgacgaccatctggcaagccttgagtctctgtttttttccgttaaaactcgctgaggaggaactcgaagctcctcgaatttcttccgcaccttgtcaaccgcgctctcccgtccctaccggcggtgatgttcgtttctccttgctggcggatctttgtttgcttctttccgtccaaaaacgcttctcgcgtcttcttctcgtccttggaacgccagcagagaagcaggagagtcgcgtggaaacaggcgcggacagagagagcgaccgagcagaaaatggatttcctgttgtgaaggagtctctgtcctcttctccccga

SEQ ID NO: 2877 - DNA, 1944 bp, Toxoplasma gondii
cttccttctcgagtgttctgtcgagaacgcgcgtctcgtctcgcttctgctccgcgacccgctctcttcgccttcttcgcctgccgggagagttccttctcttcagaaggaaccggggagtcttttcagctgcagagtctctccagagagaaccaagagagaccgaatgcagaaagttccagctcttgagattcaggagcaacgctccataaaaacacccaaatgtctggccacagaccctcgcgtacacgaaaacgtatgcagactccgagactccaccctcacgcgtggaagagtgtacctgcgcatgtgtgggcagaaacttttcgcggtcgatgtatctctttttgctagcagatcgatatgagagtggagagaagaggagaatgcaggtgaagcaggtgacggaaaggcaaggtaaacgcgacagtgaacgtgtaatcgagatgcgagatctgttgaagcaggtccgaggaaaagagaggttctaagcaaagagaggagaagtgagagacaacagccttgtcctggagagaaaaagttgaaggactcctgcgctggatgagattctgggcgttgtctttcagcacagtccggaggagtggcggtgtccagcagtcacagctgcagacagctgagagcggtggacttcgctatctctcggcattgaggttgtcccacagtggagaaaggaaaggtgccagaagtttcggagagtctcaagccagagaaatccgcaaaaacagagaggcacagaaaccgagagagtccgaaagaaaactggagaagaggaaaactctttccaacgcagctctggacgaggcgctggccgcaaggccaagaggcgccttgcagattatgtgtcggatttctggaaatcgctcgagttcgcgggaattaacggcactgtccacgctgttgtgaggcagattgagggacttggagcttttccttgagttcacgagaagagaaccgagaagaagaggaaagaaaaaaagccagaagagccaagctccacacagctactcgcctcccgcttgcagctgagtggacgaggcaccgcacgcctcgagactggaaagaatctcacagcattgatccgcgagcagagacacgcgtttctctaggattggacgcagagagagaaactcacgaaaagcaacaaaagacaaatggcgtttctcgcgtttctcgcggtccgagacggactcaaagcgaagaaagccgcaaggcactactcaccgttgcgcgggggtgctccggcagaggaaaagctgctgcatgcagagagcacgagaaaagagaaaggcgttcgaacagtgtgaagatcgaggagacggtctccattttccttttatctcaaaagcagtctctgctcccttgatgctgtctttgtgtgtattctggtgtttatgtttgtgtgcgtgtgtcttctccgccgctgtctgcggcccagttttccaccacgtccggcgtcctctttttctcgcctttcttgacttcagcggctctgtgtttcttccctaactcctcttgggagactctccttctctaccctctcctccacgccacattcctctcgcggtttctcgtctttttctgtcgcctcttcctcttccgcggaaaaaccaaacccgacactcttgaacctgtccgctgtctgcgcgttcgctgtctcgcacactcctcgtctcggttttcctgatatagagtcatttgcgtacatgtctgtatgtctaggcatataaatgtacatataaacgtttttacgtggatatttttcctgtcctatcgcctcccaagacatctctgtgtgtgtggcactttcggcctaaattttgcttcgtcatcccctggactgcaccgggacttcttctccacaccaaaatgtctctcccttagacccccgagagcgactgtcttcacagtgctttgccgcaacaa

SEQ ID NO: 2878 - DNA, 2245 bp, Toxoplasma gondii
gtcatccactgcctccgtttccttcttctgcttaggcgccatcttcgagaaaacggagcgaagagacagacacgaagggagagaagacgcaagcgaggcagggagagaagaggcgagagagacggagcgagaaagaagagagtcagatggaaaagactacgggcaaacggcgatgcgagtgtgggacgcaagaaggaaagaaagaaacccgacttagaagaagccctcgagtgaagacaagacgagagcgcagaagaggagaaagtccgttccttagatgaggaggaggcggatcttgttggttggtgcagcagagacagtgacagaagtggagaggagtctacagttcacaggctcaaaggtaaaaagagaaaagggtacagaccgagagagagccgagtcgaagtagaaagaaaacacagcgcttgaaggtggagagaactctcggcgcgacggggacagacagcggcttatttcataacgagaaaggaggattcgagaaagctttattctccctctcaatttgatgcagaaacgtcggggacgcgtcacagaaacagccgtctccagttcagagacaggacctagagtgctcagcttcctcgagaaagtcgaggcaccaaggtctgtgcccgcaggtgaagaagcaaatcactgccgcagaattgggagtctgcgtcagcctcctgacaaggcagagaaaaaactgttgcgctgtttctgaagaggaaaaggacgaagaattggagttcaccgtgtcaaaacagacgttgcttttgtgcgcgtttcctgtttctgtggaaaacagcggccacacggagcctctgcatgcgctcgaaatgtctccgacacgcggctgatgttcgcagagacgaaacagtctccttttcccaagaagactggccgaaaagagagccaagctgaagacagaaagccaagtttttgagagacaagacacagatttggcgcatgtcagaaaagcacggttttctatacccggagcagcggaggcagccccggagacagtggggttgtcgacggcagaaaagcgcaaacgaaacacataggactgcagctggaaaaagcgaaacaaccagatatgaagaatagggaatgcaagacaaacgcggcgagagaggcgaggcgaagaagctgcgcaagactcctcggcttcccagagtcgcagaccgttcctggaaggaggcagaatgagttcgggtcctttgtgccgctggaaataccccacgctgaaaaaaaggaaattgggaatgactctgagtggcatttgctggtttccttccggattctcgagggcgtctgaaaactgcggggctgcgaaaacgtcgcgcgcggattctgttgtgcttttcgcgtggccgtcttatcggagaaaccgcggtcttttcccctgttcgcaattgcaggcagtgacacctgatacccaggtcgccagaacgcgtgtgaaaccactcttcctcgagtaaactacgcttaccgaacgggcagagtaagccaaccagacacagactcccaattttctttctgagaatcttcacgcagaaattgcctacgtctcggtgtgccgagagcacccgcctcgccttcgacgcatgcaaccagcggagtgccttgccactcttcgagcgaaaaaaggtcccgaggagtgccaatcggcgacaattattatccatttcctaaccagacccattcaagctcatcgtaaagagccacaatttctgcacacccgccttatttgacgtgctgcgatccatgcggtttcccgattcgcagaagatcggctttctgccatggacgccgcgacattcgggtcttgtggcacgccaggaccttcgtgaatgtctgtcgacgcgagtgccggactttttcgatctttgctaaactgtatctcggcttttcattcctccgtgatccggcgcatatgctgccgcgaaactcctgcaaaattcttcgtgtcttctacgggattttcgtttgtctgcctcgatctcgagtcgtctccgcactgttgttgctgcaccctggaagctgaagccgcctccttaccggcatgttctgccgtttcacacgcttgacgtcctgacggactgcagttgagagacgggaaactgcgcgccaaactgaacggggtgtgtgtgcgttgtacgtacaccagagtccgcggcggtctggcatgagagtcgcgttccgtttccgctgtattacacggcggtgcagagcagctgaa

SEQ ID NO: 2879 - DNA, 2138 bp, Toxoplasma gondii
agaaagagggtggaagagaagggaaggaagaagcgagtgaagagaaggaagacgatagtgaagagaaggacgaagagagagaagagatcgagggcggcagagacgcggaagacgaagatgcgagagttcctgcgcgacctaggagggtccaaaagacgaggacagcaagcgaaaaccacaaggcgaggcgacgcgtgaagaaccgaagagagccctcaacggcagggaaaaacagaagcagcctcaagaagaggggagacgcattcgcagactttgcatgcattgtgacgtcgcatcttcttcgaaaaaacgtaaacggatccgtagattacatatctcaaaaccgcattccgttgcgccgcaaatgcaccacagaagagacaacaccatacgccgactcgcatctagacttgttcatgtacctacatgtatatgtatacatatgtatatgtatacaaatgtattgatgtgtagacgcgtacagataaccgactttgtgtgggtgtagagagggagcagtgttcaccctcgtcggtttacaaggcctttttttgggaaaaacacaggaaagttgtgacaaaagtgaaaccgcgaatggagatcgaccacgcgaagagcaaggagacggagagagaagaaacgaaattccgacagaagacaggagcaacagaaagggggtaagagaagaagaacggaagagaggcggagagacgagacgaaaaggaaggcgtgtgctgcgacagggcgtgatcgctggagacgcgctcgacaggacaaccttgaatggacggacttcacaaaatgtgcgggaggcagaaagatgcaaaggcgaagaaagaaaaggcagaagcggtcacgtctaacatcaggctcagagaagagaggggggtctttctcgcaggccactttcctcacccttttctagaagggctcgaggaaacagcgacttgcgaggaagacgaaagaagcagaaaagtgcaacagagttcgccggtgtcgcgtttcctccctctctctccaacgccacgtgtacatacagctgagtctcggagcggggtacccgctgcctcgaattcgtctgagagcacccgtatcgttcgcttcctttccgagaggaaaagagtcgaagttccttctctttcgcctctctgccttggagtctcgctcgactttggtccacggaaagtgcagatctttctcccgttttcaaggatccgcgacggctgtacgtacagccgaggaggagaaaagctgcagaggccgcctaggagacttgcaagactcgcgcggctccttttctcgaggcaaacgcgagaagattcctcaggtttgcgaattctgcgcttcctttgcagagaaaagaacacggtctggctgaaaggttcctgtttctgttcccaggagagcagctggcggagaacccgccttccgcatggcttccccccggggccggagcccgcacgagacacgccacgaagacacgcacacggcattaccggcgttgtgttttttcgtctgttccttttcctgtcttttctttcagagggacgtttcggctggcaaagaaacactccttcaagcggaagcgattttctccacgctttctctcgttttctttctgcgtgcgtgtgcatcgactcctcccgacgtcgtctcgctgctacgtaggattttcgacttcgcacacactttgtcactgcgaaagttgccgcgccctccttgttgcctttcgcgccttcttttcctttccgtccgtttctgcatcctacttccgttcctctgtcttttctcccctctttcttctttccgctcgtttctgtgctgccgcggactctccgcctgcactcgcgcgcggtccacgtctccacctcaacgggacactcgtggggtagctccgcaagaaagcgcttcttgaagagagacacacgcagaatttcccttctctcttgacagacaggcttcctcttcgaggagagggcgactacgtctttcttcgatttgcttgcttttcctcgccgccttgagacgctgaatcccggcagaagaggaattcggtatcgacgccaagcgttgcctttttcagaaggaagtagcagcggcggagaatgacacgccgcaattagattcgctttccaaga

SEQ ID NO: 2880 - DNA, 4723 bp, Toxoplasma gondii
aagggagaatctcatacgaaccgtcgggctttctcggcagctggtggcgcgaatgcagagtcgccagtccctgtacgagcgctcctgtcatctgcaaatgacatacactggtttcacgcgctgtaggcacttgacagatagcctgatttgcccacagcaggggtttgccaagatcatcagtgaaaaaccctggtgtggcctggaaaaggtcacgaagaagcggcgcacctcttccatccgcttgctgaggctgttccgcctgacggaacaatttcctatcttcagcagctgtttgctgttcggacggcgcgatcccccgtgcttctgtgatgacaggaggaaaaacagtgtcagacacagggctgcatgctgattccagacagagcggacacgtctctagaacttcggagaaacgtacccggctgaaaccgtcacgcgcgctctggtcaagaactccctcaggagtaccagcaggctttttctttgacaaacgtttaccatgttgtccagcgtcaaaggcggacatctcccgggcaggaatgtcgaaggagccgaccgaatgctgtggatgcaacgcattcggattccatgacatatcctcgcagcctgacaaactgtactgggttccttcaaatttaatcacatcttcttcccgcaaattcctctgggagtccgcctgaccagcgacccaagaggaacccacacgccatgcacaggggccggaatcgcctgtgtcctgcttctctgactctaaaagatattctgcatccatagcttccgtgactgggtcacatttatccacacgcggggtaaaatctcccggtgcgaaggcagttctaacggttgggtgcacaggagtgttgccgtgtctggtgcacatggtcgcaaaatcagacaatatctcagtagtcaacttttgctgctccgaaggaaacccatctggagggcagccaggttcacaagacctcgggacggcggaggcaagctcgcctgtcgcttgcaaacggaacacacagcaagactcagaaggatccttaaccacgactaccggtttgctatgactatgtgacttctccatttcttgtacatcgaaaggcgagagaggaaacggcttcaacagcctaacactcgcctgtcccgcaggaacatccacgggcttcgcgaactgcgtgaacgtgagccgtcattaatatcctcaaaatctggggacaaaactgagagcaacgaggtaaatcggtaggcgacaaagtaaagaatgtccatgtcacgccgatcggtttctgcgcgagattctgcactgcagaaaggcgttcacagcatcggaatctgatttcaatgctcctcagaaaatgagaaatctcgcttgagggaaccacattactgtggaccccttccggcaggcgcctgacaccccgaggtgggtcaagaggcttctgtcgtctagcagagtcgccactatggacaaggcttgagaccctcgtcagcctttacgaaaactcataatttttgccgtacggttcggtggttccagacccatttcgggaccagaagttttccctcgcacaccacgaaaaccgtgttggtaccacgacggatgaggcccatgtcgacaacttggtagcacagtgtatcctaacgaaggtaaatccgtaaggaaaaacattcaattctctggactgtctcgggggcagtaacattcataaactgcttgacgtacagaaccaccgcgtacatcagcgttactacgcagatttggctatgaagaagagtagcgcgacttcggaaacacggaacccactaatactctcgaaacgtctcagctacccacacaatggcgtcgctgagcctggaagcaaaaccgaatgcgggtcagaaaggccgtaaatcaagatgctctggcactttaaaacagtctgtgttcgtttcggctgccttcgcggcgcgacgctacaaatagctcatatctagacaagcagctgcagacacagaagcttgaagtttcgagttactcgtccacgaagtcgcgatgtatgacaccaattctcttcagacacacgatccatttttcttcgttgcctccaacccgacttgcgtcgaaaacttaaaattgtctgcactgcaatttcttggttctgctaaccttccggttctcttttatcttcttggagggctgcctagagagttgcatgctctgactttttgaccaccgatacagcctacggccagagggagctttcgcgtttcaaacagctgtagtgtgagaaaagacacatgcgtgacggaacaagaaacggagacagacctttcctcagcgaatctaggggcgaatacacttcccctaccagttgttcctttgcaaaatcgtgaagtaatgtaattcggcgcgattgacatgttcgttaaaaaccgactctgtcgcgcagcagtaccttcgtatagatgcgtggactactgattccttcatgtgagacatgacagaatcaaaacaagtcactcacactttcatgaaatcgttttggtaaacgaagagagaaattcaagtcagtcgttatgatgtagacgcttagaaacagtggcctcgcctgctgcaacacgagctagccgcagctcccccgcatcaacccgtgaatgtgatcatcccatgttctccaaatcgctaccagaatgataggtgatccagatggttgcttcagcccttgacacgcgaaccgccactgctcagtaggaactactccatggttacaacggcgatcccgctgtgagtagctgatgagtcattcagtgcacatgtgtaacggttgggaactaaggatcgccgagtttcccatctgcgttggttcggtgacacaagtggtccgggtcatgaagacactgtctctttactgttagtagggtgcttttgcgggggttcgcaccaaccgtgcatcatctaccgatgtccaagctatttctcatctatcctgctgtgacgccaagctgttgttcggatcttgcaagtttttttccatcgtaaacttgtgcacctacgactggaaccaataatctggtggtgagtgaagtctcagcaatgtacgaagacatctttgcgaatgtggcacaacggtcgtacaggagccaatggcgctcaccgcatccagcaagcttgaagaatggctgcagccctttgaaaccatttatggcagcatagtgtatcctcatattcgccaaactgcgcatgaatggtgtgacatctggaattctgggaaggccttgtgccaagcgtctgccggagaccaaatattcctcaaatcccacacgctcatcaaagtgccgtgtgacgtggaacggcgtcatgggcaacaaacaacacagagtggttccagttcaccatgcctcaggacactttgtgggggttgtctcataccgacctgaaaagaagccggtggaccagattgcaccgcagtccgacggtcagttagaggtagttgtctcagttttgaagaatctaacaataacacaacatggaataccttagcatctttgtaagatggatcgtacgccagactgcctacacattttgacgcaaggtacttcagagtttaccatgtttactggggcgtttttcactctctgccgaatcgtgtcgggagcccttccccaccggaaagacagcactgtggcaaaggcctactcacgcagaattgcactgttttgcacacggatcatatatctcggataaaaaaacagcagcgccttcaacgtggaccgtccccgacttcatgcctttcgtaaagatttcttgcggtgtcaacaaccctcacgcagtatacagacagacatgttcaggcatggatccaaacttttcgcttagcgtccccctgaaacctataacggtacgaactggtgctttcttcggttttgtgtccatgcaacctatggagggggagcgccgaaaaacgtgtactgttggcaagcggttgcaactcgttttgcatgcatgcaggtgaagtagccagaaagaccagcaatgctgacgagactggatgcttgtcgttctcagtttgcttcactgtacgcaattatagacgtgatagatcccctccactttgccaaacacacgaaaaagcgttcagatgctgtaaaattgaaggctacagcacgtgttaccgccttgtgttcgtccgatgttaacctcccagcgagccagctgacgacgggaagtacgcagatttcttgatcgcaaacattgttccctgcctcccctttgtctgctgccttggaactggcaaataaggtgccgagcaatttatgtttcggcgccgcctgtgtatcctgtctcgtttttgtcttcactcctgcgtgtttcccgacctgcctcgattgtcttttgcagttgttctcgggtgacatgttgaaccgtcaacttccgggcgtctgtgcgcccactgtactttgaagccggatcgaactctgcaaaaacgtggccattgcctcccatccttagcaagatgaagcgccttggccgcacactcccacgtgaaacctagggttgacgcacatttcgttgcctgtctatggtggaaaccgtatccgagttgtagtgtagtgacgccatgtacgagagaatgaactccaacaggagaaacgaacaatccaaatcatggtggtagaagggacccgacaaggcacccctacagagagcccgcgaatcgccaagatctctgcactgtctggtaaccagcga

SEQ ID NO: 2881 - DNA, 2869 bp, Toxoplasma gondii
gaagatgagagaagcaaagaagagtcttcaaaaccggattccgaaatgcactcgcccctccacacgcgaggcgtctctctcgacgtcgtctacgtttccgatccctcccaagaggaggcgaaagcgaacaaagtgtgtcttgtctcgactgtctcctctgccgaggaccaccgggctgacagtggcgaccggaccttggaaggcagagaagaagacggagaacacggaggtgacggccaggaggcgcgagtctccgggaccgacggcggaaagaaggtggaatccgagagaggttctgttgccgtctccatctgtcaccctcgaaacgcggttgtctccccagggctcctcggagttatcgggtctccgccccgcagtcacgacgcgagtggcgcgggcggcgaggcggagcccgcagaggacgcatggcaggaaactctgcctgtcgtttcggacgaagacaaacgggacgctgagacgattcctgtgagcagcgactcggaggttgcgatcgaggacgaggcggaagagcgagcaggctctggcgacgaagccgtgctgctgctctcccgttcgccctcgctttctcccgcctctgctcggtcgtcctcgcctgcatgcagcttggctcgagccgcgccgaagtcgccgcgcggggacctggtgctctgtcaccagtgcaagagtttggtgccgctctcagaggtgcaggtacacctggacgagcacatggctgcgttcgttttcaaggaaactaatccgaagtgtttgccttcgacggcctcgcaggcggtcgcccaagtcgaggcgtcgcagagccagcgcgtgagggagcgcatgcgtcgagagcagcagctgctcgaggaagaaaatcagctgacgctcgacgcctttctccgtaggcaactcttcgcgaaaaagcggagagtcgatttttagagccaccagagatcccccccaaaaggcagaaaacgcttaggaaagtgtagatgcaggggccagaagggaacgctgtgggctgttagagaacaactggtttgtgttcagtccagcgcgaccttcagatgtccgaaaacagcagaggtgtagaaaggctcagagactgcgagtcgcaggtctcttggaggtctgcatacgccgatccgatttgagggaaggaacgaaattggtttgtcacttcaaacacagctacgaactgaaacagcggggggtctgctgcctcgcgcgaaccgtttcagattgtgcctcgtccagttttttcttcgaaatcgcttaaaggcagccggccggatgagacgacccagcttttctgtaaaaaaaacgcagtcaagttcctggaagagtaaccgcgaatttcgcaaaccgtactgttgtagagccaaaacgcgcgcgtggtcatgcgacgaccaccaaggacgcattttctagaaaacgatagcatataattggtagatgaaacgacgccagagcgttctgtagtgtggacacgagtcgccaaacaggaaatcttgtcaatgaaaaaccgtccgagtgttgatagtgacagtggacctaaatcccacggagaagtcataaagaacttggttgtctgtagtgattaagttacgttactggtctaccgtcgaattagcgcagaggatacccccgtcagatattgggtgtttcgagattcacaaaagaagaggatgcagcgagccttctgaggtttcgtagcgtgaacatttctgcaaaatagctcaggtcgcacgtatctttggtcgtcgtcaatttccgcgtgtcggttcctcactggtgtggaatcacgcgcctttacttgaggcgcttgtactcgtacagggtacatggaaataagatgcccttattttgtttccttctgtattaaagaacttgcaatatcagaatccttcaaacgatgcttcgaaatgggcaagaccgagctgcgaaacagtgcgaggggggttcactatccagtgtttttatgagatcgcttctccctccgtttcctatgcaaagtccgcactgagacgcttccgttccgcaaaacacacaagtgggcgcacgaccacagcttcctgcgggtttgagtcacagaaagtgatatcctcgtgagcggattcttcagcacgcacacacacttgcgtttcgaacccaggactctcgcgagcatttggctctctgtgaagtttgagattctgcatgttcttgcctttcccttgttatgttaagtgcatgtggagatatgcttcggtacgccgtgtcaaaccttgttcgctgatcaacttcctcgaaagaaaagtgaacgattgtaaacgcagggcagcacgcttctgaaagctcgattgagtcgttgagccgaggtccagagaagctgcagtcgcagtgtttctttggaagctggtttccagtgtttcttccagaatcgagcgacacttgagagtggccaaaaaatagaaacggatcagaacagtcaccaaaaagccggcatctcaaggcgcaagatggcttggtggtcggcacgttaacgagatggcactgcgtgtaaaaaccgatccttgtctgtaggaggaaagaccaattgcgggtcttgcttgttcgcccgcgtaggatacatcaaaacgtgtatgaggggattctgtctgttgaaagagaacgtaagctccaccccatgctctgtgtttttctcgagcttcggttacccctgacaagaacgcttcttctgatttttgtggcaaggcttgctcgcttcagtttctcgcttctacagggaataggctcaggaacaggtgctgacactttctcgagaatcctgtcgctgcaatttctgagttctacgattgttccagattcccaggttcctcttccaacaaaa

SEQ ID NO: 2882 - DNA, 1818 bp, Toxoplasma gondii
ttagaaatgggtcgagaatgaattttggatgtcagttccgcaggacgtattcgtgtttgcatagaagaaaataccgctgagtaatcacacatgtagccccaggttggtgacatgcatgtaacggagagtatgtgaggcccaagaagtctcagcgaaccagcagtcgcgctgtgcatgagatgcagtcgttctcacagccaccatccagtcgtctgattgacaaggcgtaggatttccgaatagaaaaccgaatgccaaggcagagcgagacttgcacatcttcgctgtctttgactcagaacggatccacccatggaacatgggacttcgcagcaaacaattcacatgggcctcagctttcactgctagggtcccagcacatccctccagtgaacgcagctcacaagcacaaaagagaacatgccctcttaactggttagatcactgaatgaaacactgagcatcttgccatacgtgccaggcatgtgtctcaacgcgaccagaaattcgaaggcggctatgtttggacaagtaccggaagacgatagcttacacatatgacgcgagaaacggaagagcaaccttattcgaaggtagttagacccggcaaacgcgtcaagtagtgtgtgggtatacaggctgcattcgttggccgtattcctgagaagcgggaagtatccggtaggtcgactgacctatttatgggatactgccaaattagaactagtaagaagacgtctccgtgcaaactatcggacaaccatgagcctttctcaaccgaacgtgtgtatgatctgtcgtgaacgtctgcaaggggggggggggttggggcacacggaagcaggggcagcggaaaggggattgcgaatgaaaggttgctaacgtgatgacagccattgaacaggagcattgtgacagtcagtgtactgttggctaggtcgtgactatctggtactcagcagcaagacgtgctagtgtggcggatgactgtctcccgctgagaggtttaccatgctttcacgctcagccgtcatcgctttgtgtacaaaggcaggcacgtacgcagggaaggcagacaaccatatgtctgctgagaaaaaaaaacctgcaagcctgtgaagacggcttcctgcggtagtttgctttttttgttggttttttttgccacacggtggagtgtccctattccacagaaatgtagcggcgttcccgggatgttgctccacggcacccatccaccgaaaagtttacttctgagaccctcgtattcggagtgcccttatctccctccagaagcctgtcatcgatacgctttccgctctgctgaaggagtggtttcaaaatgaaacgaattgttccaggggaaggagcagtacagtaaatgtggtgcatgcaattgtctttgttagtcgacgctgccagcgcgaccgcccctgtctcttcttgtgccagaccagacgcggttccgacatctgctgccaagtggacggcgcctccgccgtacagtgtcccgtatacctgcttttcggtggcacagcgccttcaagtgtcagcagtagtcgactatagtccagcaagtcggcggtgtaccgttcaagtttaggcggcaaatcgcattgtgttctgtgacgtctgtgggattatctcaattcgggtatttcctaacgaacaaccgttcggaacccagtgggtggcggtcgtggcatgcacatgccaacgcttgtttggggaggaaatatccgcggttcgggaatggtggagcagtgactttgactcctccaaatattgctctcaccttccttgagatttccgacacga

SEQ ID NO: 2883 - DNA, 2794 bp, Toxoplasma gondii
gaagcctgcgtgtcgagggcgtctgagcctcgaaaaagtgtgtctggggtcagcgtcgcgggtaacgaaaggaccgtgtggaggggtcaatcgcagatcactgaaactacaaagatgtggatctcagatcctttgtctctttctgggtgctgcgcgttgtgtacactttcttttgaatttgcggtctgaagcaaaagagagacaaggggtgagtcgccttcttctcttggggacgcgggagtgagacgcgtttgttctcgggtgcggcgcacccgacgactcttacgaaagttttcggtgaggaattgcgtttttgtgggaatcgtttcgatacttgtgcatgcgaaaggacgagtgagcagtctgtggaagagacccggatttctcaggcgctgctctcggttgcgaaaggaacgcacaaatcccgagttgggaggtcgaacggttgcaagtggaatttttccctagggtgatagaagtgtccatgtatgggtagaagtaaaggcgatctgctcttcttaaaaatactgaattggtgccgttgctacggttactgtcagtgtctgcaatcaagacatccagatgtttcgatttcatgtccttgtcacttcggggagaggacgttttcaatgtgattcccgcgacaggcggactgctcgtttatgccttcctgtcagaagagaggacagcctgacctttttttggtagcgatacccacgattctctcctttgaagaaacattgtatcttgtaaaaggcaactgcttttggaaggtccttgccgctgtcaatccaaagaggaaacgtgaattgtgacctcctaaaaagcaaacagccggctaatttagcattcgaaacctcaacactgcagtgacatctagatctgtcgatgtgcagccctctcgtttacggggctccctggacgcggcgtggttttctccgctgaaacaactgtctcatttcccgtgaaaatccgcacaaacgtcgcattcgtgacactcttgtttcaaggaccatgtttcctcctttcacgctttttgccagcactctttcaaatgcagagaactacgcgagaaatgcgctgtcgactgcagtgtgctcctccgaaagctgcacagcgctgcaaacagcgttaccctgcttcagttgaatctgtagctttacctccgaccagaatgtcgaggattgtttcacggaaagcgtgcagaaactaagccggggaagaaaaaaaggctgtttgttgggaggcgcgtactcaactgttgtcaggcgaggcttcctcagcagttatcttctgtgacacaccaggaagcctcaaggtcgagttgcccaaaatatctgacactgtttgcttcgtggtggtatttgtgacgtactccttcgcacttctcgatcaggtgcccccgtttcgtctgcagaatgaaaaggtcatctcctcatttattccctacgttgcctacacagagacgttgtgtacaggccttacttcttagaacatcagatcggaaaagctacattcaaactagtcactgaatatgccttcctggtagcttactacacagcatgggagcgaagataaaaacggtaaggtttaacacacagaataaacggaaactgaaagggcgttgtttttcctggaatgttgctcgcaccttctaaatgaagcacaggatttgcaagaaacgtccccatgtttgcttgcgtcactgcctctcttctgtctgccttgcaactttagttcgagcgaggcgtttgtcttttttctgtcgggtaaaaagtcgaacagccgagaatgccctgcgagacaaggtcggcgtgtgtgttggcgtccagcttgtctgcatgtgccacggaactcacgtcggcgattttttgacgaaaaagccgacgagcgaattgaaacatctcctcgtattggcacagatccccattcctgttttctttccgtcttttaggtggttttttcatggagaaaatccctctcctttgcacatttttcggtcgaaatgtggtgaggaccacctgcgctcgccaggccatctttcctgctgcagggacgaggttcctcctatctgtgtcgtttctttttggagggacctcgatacccctctttactttgtttttcttcttcccagcgaaggggagtctggtgtctccttatctgccctctctgcgcccacattcgcctccattccaccaccaggtacgcgctaccctctgcgtgagcttcgcggttatacacctgtcacacgcatgtgcagcggtaaagaatgaggttctctctgaggaggatgttccggttttcagcgaacgttgaaggcgctcaaaaagccagcacccaccgttctgcctgtggaaggcgtagggtaccgagcgttgagcggccagtgttctgttgagacacccgatgtcgaggacttcgttttccggatccaagttcgagtctgctttcgcgaccgcgtcgtgcttccagtcgagtttgttctgctctgtgagaaacatcggggtgcccccagaaagttgcctctacttcgccgagagttccgtggtccagccgtctcgcatatgcgcgctgctgagcacgcagctgtctactggaatcgatttgggtggtctctcgttggcaccgatgaagacacatgcagtcatcggaaaatacacaggacttcggaacatgcaacgggacaagttacagacaaatggttcctcacctgggcctgtggactcaagtaggtgccactggtcgccacagttgtttgactgaaatttactgtgcattctgctttccaccaaaa

SEQ ID NO: 2884 - DNA, 3444 bp, Toxoplasma gondii
gctgtgttatcacgatttgagcataagccaaagtacagcagccgtcgacgggacacggaagatatgtctctctttttcaatcatattcgttttgaatattagatgcgcgtgtatggacgtgaaaccgccgtagcgacgtgtattcgaacttgcatttgtcgatgtgtgattcgagaacgcgctacttctctcactgtcctccgttctccaggaagaattttttgtcaacacgtttcggaagaaaggacccgaagtcagatttgctttccacgcctctcgatatatgcatgttttcgtgccgtgtgagctgacgagaccgggcgaaacgtgtgcctgttgggcaaaaacggaatgactacgcgacttctgtgtctttttgctactcgacgctatcacccgaacaaccagagacatcaaggcaattgcagatgagaaaagaaaacgtagaggccggatataagcagtaacggcgtctcagtaggtcacacaacttgaggaacagcaccaacggtttctgtcgcctcgcagatcagtacaggagtcactttggattcaggttttgcagttgacatcgtttctaggttctgttgcacaggctccttgccgagcgagtgcccagatttttcgacttcacctgctcggtcgcttttcgtaacctctgagtacgcagaggtttgagaaacgagggcattttatgaccgttttcgtctgttgggcgtctactcaggtccacgcgtatgtctgctatgaaggactttcttaccctgttttttgtcaccttcccgttttctctggaccacaagctagagtatctcggagcagcagagtgcacacgaaggcggcacgtacagtggagatttttggtcaaatgccccgcaaataatgattcccgtgtttctggctgcttggctacacgacaccgcatagcgggtagagacgcacgagtttcatgtttccaccatttgagaagaggcctttctctcattccttggacagctaacgcctgagaaattcccatagcacctatattatccattgaactaccgcaacacttctcacgacgagcgcatgacattgttcatggggctcgagcgatacgtgtggctgttgttctggtggatcaactttgacgatgcaagactcagctttttcttgggcatagtttgaccgttttgcggaggcgctgcgatttcaggttttcttttacgttattgtagtagaatccaggactgactccggacagtggcttcaaaaggagttcttctacaagcgcgagacaaggattttcgttagaacgaacacgaactgagaaaaggggaaaggcctcgttcggcaacagagaagcatgtctcgcccggtccagccgctaatatgcaatcatccaagatctatttatcgtgggctcaatccaatgtcctgttgtatacgtactttgagatcatacggcgagccgtcctgtataaacgatcaccgatcgagacttccacaaacaaaaccgaataagcagggagacattctagtgcagagagtcctgaatttccaagtcatttatatcatagagaaaccagaatctctatgagaaaagtggtgcaccagtccaccggtgaaagcggctgaccgtacgttaacgtgcatccaagcagtagttgaacaagtgaaaatcttgttatacactcctcgattcatttgaatagaaatacacagaaatacggaagatgctactgcagcactgcttacccttctaagcagcggttcccgagatttcacattgctgcagaaagctgacatctgttggggttctttgaactttggcatggcggttgtgcagagacagtgcctacttacaatgtgataactacaacagatggcccagctatgatctttgtgttctttatacgaaggattccctagttctttggtttacatgaaaagtgaccgtgagcatatgagaatttgacatacgcttccagatgcgtgtccttgttcttgggtaaagacagacgaaaggaagacgccggcttgtgccctttcggatttcttcgtacgttctcgcgttgtggagaaagtcccgtggcttgtgttattctgacacctatcccgtattccgccccatgctcgacaagagtgtgagatgaaaagccctttatttacagttttttcttccttcttgtttgtgaaccaagacacttagcaccacagccgacagacagggacgtctccgcgcatttggccggaccaagaacagtaaaagtgtgtccttaccacagaatataactgacgcggactagccttaatgccgtgggatatttaaatgcagtacttctaccggtccttagcagtcccgtggagtgcttttggagtaccagcaatgaacatcttgttgcctgtctccggtgcgtcgaatttaaaagctttagggtacgctttcagtcctctctgcgcctttcctcctttcgacagggcgcgtgtcacgtcttcaaagcagaaaatcctccagttgcggacagaagtgacaaacatgacccaccttgcgggctgtagctgagcaaaaaggcatttcttccactgttttcagtcccgggtccgcctgacccgacagagacgcttccattttttcatatatttccatctccgccgaatcgacaatatttctgagacgaatgtccacatgggaaggggcaaagactacgcggtcttgtcgtttgcttccgaaagtgaactggaggggggggcagggttcccgaacgaagtgtacctgtttcagtgtgcctcgatttcgtgtcttaaactgtattccgccgagaaacccgccgttaagtcttctcaaacctcgtctctgacagcggtgtctcgtgtgaaaagcctgccacttcaacattttcgtcgcgtgcccccgcctttacacttttgcacgaaccgcccctgtggcattccctttcgggatatctcgtaaatgcgccgctggaaacacgttctacgtctctctgctgacttgcagactcatcgtggcgcccggcgcttggccttgtccagcttgcacctgcgaaggttattcagcgttttcgtgaaaaaactggggtgtggcgaagcacagcttttccgcgggcgcctccggtctggcgtagcgtcgctagctcgcttttgtgtgcatttttctggcggcccgtttcttgttttcctttttgtctttgaatccttccgaattcctttagtcgccgtgcatgtgtcgggggtccgcatttccgaggtcacttttttggccgttctaccaggatttgcgagttgtcgggtgtagttaggaaaggagcccctgtcgccagtgcaggcagttcgcttatctgactttttcctgtcttttcgcttcgccctttcctttttttcacccgcgactgtcccatctttgtttctttccggactttacgctcggttcatttcttcgcaaca

SEQ ID NO: 2885 - DNA, 2099 bp, Toxoplasma gondii
gaaacaaagttctctcccgcttctctcccgtgtatccggacctccgccgagtgcatctggagctctcggagagaggcctctcgcgggggagaagacagaagcgagccactcggagacggccgccatcttgcgtcgcaccagagacaagtatggcgagagcgaagaggagaagagacagagttgctgccctcgtgggaggtcctctcgtcgccagacctcgcggcgtgagtcggcagaggagacctccagggaagcgcagacagcgtgaggtgtctgtacacctgcaggccggcgttccggatgctgtgagtgagaggcgtcgccattgtatggggaagcccctctcgcaggaactggagcgtagccagctgttgacgacgaagaggcagaagagaaagcgacgcgaggcgctgacgtagcctggaggagaacttctggtgggactgcaaaggacaccacgaagcggaggaagttgaacagcgttctctcgatagaggaagcgaaaacgtcttctgttggttggttgtgaagcacaaagtggctgcgaggcggaaacggggggcaggcagacgcttctacgctgtgaggcgaagtagagcgtggaattccctcgagggggcaaggaaacgcggacgcagggttcgcgcccgcggaatactcgcgagttcgtctcgggtgtctagacacccggatgtggggctggcaatcgtcgggatcggtctctttcgctgaggctctcaaatttgcagctgaagagaagtgaggaacggaagttctttcgggagcgagacgagtctgagggacggccgggtgcctaagtgcggcgggacagaagtctgcttggtgcattttgcgcatcccaacagagaagtgcggctaatcccagctgacgtgcatgcacaccccagggcagcctccccgctggaagtaagaaaaactcatcctgcacaggtgggaagttcgtgttcaaggacctggggaaaggcacggaattggggcgctaaccaggtgatccccaccctacggggtgtacatacaccgcgagaaggcggatggaaagtgttcgcaggtgaaaaaatgatcaacagaacggaggagaagcgacagagaggaagaagtcgcgaaaacagtcgaaaaagggagaaaaacgcccaaaaatgtccccagcggagctcagcgacacacatgcgccactctccggcccaagagaaaatgtttcctcgggggtttgcgagatgaacgcatacacggagaaacaaacttgctttcagcactctccaatgaccaacgggcagctgcatacgttcagaaaagattttcttgaaacgctgcccacatacataaatatcgctgccctttatgcattctgcgctggccaaaaggaaagaaaaatcgcaggagacaccagccaaaagccaggttcgagtgcagctggaaacgcgtgaaaagtgtcaacggatccgtgcaagaaagtggagatttcccgaaaaggtgagatataaagtggaaaaaaatgcgagtctctttgggccgagcagccatttctttcgcccaggcggaggctcggtctcgcggcctcgtcaaggcgctgtctgctcaacagccgtctgcactatgaggttttcttttcgtgcatcttttcttcgcgcgtttactacacaaacaaaaaaaagccgtaaatattgaaactcaatatgtttctcgacctccttcatgccttcagtcgccgtgtgtttcgccctcttgccgtcgtttccgtcccgaccgcaaagtagtgacctttctccatagctcgtactacctttcgtgtacagagcctaaaaaaactacagaaaaacacatgtctaaacaatctttggcttccctccttcgcttagcgttactcgatctctcagccgcctccctgctctcctctcacatctgtgtatctgtactgttctttccttcgcgatagcagtccgagtccttccctttcctctcctcctctcgcctgacatactgccacggccccctcgttgcggactgtgtgtacaccgatatcggcctgcttcctctgctgactttttgagaactccgctttcttgtttccacgtccacga

SEQ ID NO: 2886 - DNA, 1575 bp, Toxoplasma gondii
aagacgaagcttcagaagaaagagctaccggtgaggaagacaatcgaggggaagataaggaagatgaaaaagatgaatcaggaggcgcgacagaagaagacaaagaagtcgaagatggcgacaagaaaggagacgctgtatgttgtcgagaactggggacgctccgagttttcccggtgatgcaagagtgtatttgcttgttccgatgagggtgtgtctcttctgaggatgaggacgcgctctgaggaggaaggccggaggaccatatggcttcttcgcttctctcctgcgcggcgactgcggcgaactggcgactcgaatgaaagcctgcagcttcgaatggacgcaagcttcctggaagaagctgtgtttcttcgtcttcgtcatcttcactttcgtcttcaacctcttggtgcacccagcaaacttgcaggccgtccattgcttcaggctctccgcggagccgagaaaagagagaaaaggcgaggaatagcgaggaagagagagaacggacctggagcagacagaggggggtcggaaggccggaggtaagacgaggaagaaggaatgacgaaggacgcttggaaaactccaaagaagaagatgaaagggaaaggaacggaggacgaaggcgaagacgatggaggcaagacagaagaaaatgacacaaaaacaagccgctggagaagaaccgtttgaagggaacggatggccgcgagcgtctcacgcgactttgggtgctagggagtgaagcaaggcgaggagaaggaggtttttaccatcggctttctccagaggtccctgttgaccgcttcggcagcgtctctctgcaaccgaaagccacaaaaaggaagacgcgcccggcgaacgaggtcttctgcggagagtgagagtccggatggacccagccgaggcgctcgagttctcgtctgttgctcagaaaaagaggaaagcttcgatcccaaaaacagaagaaaaatgacaagacaaagaagcaacgctgtcgccgagcacgcgccggccagcgtcgagaggggggtgggcatgtcgcttttttgcgaagcgaacgcatgcacaaaaaggaaaacactcggggctcgatggagaaaatcgaagcttttcgccagttctcttcttccttttcttcttcttcaacgatcgccgtgatttcctttctctctcgcgtctgccattttttctgatttctcgctcttttccgccgttctccctgacttttctctctccgcgttgttgcccgacacagacgttctcaaccgcgcctacggtgtgaaaacagaagacacctcgatgtttcctgtccgaaaaaaccgttggttttctttcaccctcttcgttctgccttcccgtcttcatagggaaccgtcgccgagtctgtcgtcctagaatgcgccgtgtttttttctcaagggagttcggcgaaaccgcatgcattcggcggtggacccgggtggctggtcgtcgcactcaagtccgaggggaaattcaagtttgaacgttttcctcgccggacgctgcctctttccttcgctctttgaccttttctcgtcttcttca

SEQ ID NO: 2887 - DNA, 4375 bp, Toxoplasma gondii
gatttctccgcatatctttcgcgccgttgacatgtctcgttgtttctgacgcaagtattgtttccttcgtcgcgcggtcgcgccgttggaggcgctgtgagagaagaggaaggcgccggggagacgacttgcgcagagaccgaaggatgctgcggatcgatcgaagcaagcatgcgcgtgggttcgactgcgcgtttctctctccgagagtctcctgcgtccactccgacgcgcaagacctccctttcctcctcttcgtgaggcttctcggctgcaaacaaagaggccgcagacaccggcagtggccggcctgcctcgtcgcgtttcaggtggaccttcacctggccgccgttgcccgactctttctcgaccggtgtgggggcgacgcctgacgacacttgggccgcagcgggagatcccggcgaaggctccagctgcacaacaggagagacaaacgtcgcaacgcgactggaaggaaaccagcaacctctacaccttctccggcgaagggagaaaggccagtgtcgacagatcttcgaggaacagagggaggtagaaatccctcctcaggtagggaggaagcagagatctgtagattatcggcggcgggggagagacatctacagatttctagtgaagaaaagacatcgctacagcacattatcgagagggttgccggacatctatgtattttctcacaaagaacaaatgctgtgcttctttttgcaggaaagaccgaggtaaatatgaaggaagcaggtgtcggaagaagagaagcggacagctggagacgaagaagaggagaaaaggagagaaaaaaacagaagagacacactggagcagggacagagacaacggaagaaggggacagagagatggaggagaggaagtagaggagaggaagtggagtccagaacgggagaaggctggagaaaaaaacgacacggagagaagagaccagcgtgagggcttgcgtttggggagacatcacacaaaggacgagagacgcgtcatacccacagcaaaaagaagaacgacgctccactttatgtctccttccgacagaagcgatgaagacaggaaaaagctgcagcgtgtacataccgagatggccgacgttagggagagctgtcgaggcgaagcgaagagagagaagagcaggaagaggagagagaggcgagaaaagagagaagacgttgtgcagaaagaggaggaaacctccttcagggatccccgtccattgggagcccccacggggtccggtctgcaactgtcaggcgccatggagacagagacaggggaggagagcgactcgacgacggcctgaaaatttggagggagagaaagacgaagagagaaagacgacgcgaggaaagaaaataaacgcgttcagacgaggaaaagcggaagacaagcgacgtcgcggacgcgccgcaaacagtcgttgacggatgtctctcctctgctgcagtgcgggcaaaaatccgaactcgccgaagagaaaaagcgccaaagggggattttcaggtggacatacgacattccatccacggcgctcgccaggggcacacatacacaaagacgccgaggaaaactttctcgacttttggcaagcaggcaacaaaaagctggcgagagaagtgaagacgaaagtcgatcctttccccccgtctctctctcttatgccgccagtggtgtctctgcgggaagcgagcgcggaactctcgaggacggctcgtcgactctcgcggcgggattcccccattcgcgcgcaaaggagcggggaaatggcaatcggctctgattttgcggaaacgttgtcttttcaggaccttttcagtgcgttggagggcaagtggaagaaacggggaggagcgtgactggcgaaaagtgcgtctaccgagaaacagccgttgctttgaaacacaaatcgagacgaggctcgtaccgcggttttagggaagagaagcgcgagcgccgagacgactccgtttcgcaggaaagaagggcagctgaacttgtgagtgcaggtgaaacatggaccgtgtctcatccttttgagccggacttctgtctgtctctgtcccgacgaaatggactgacgcactgttcgtcgcactcgtcgacgagacgacgaagaaaaactcacgactgtttatcgacctcctctggtgcgtgtacacggaggacatcgcgtcggcgaccggacggttgacgcgcttttgtgcagatgtcgactgtttctggtcgacgtagaaggcgagagagaccgttcactccacgttaagcgcggtatcaacacctgcagagttgttagaaccatttaaatgcaagtcgagaagatcctggaactgctcgcacaggcggcgcgagaaagggacgtctctcagaaggaggcagggaagaagagtcccctggagaggcaacgagacgaggagagtcaacttaccaaaagcgaagaacgttcgagtgagcagggcgactctgtcggagtcggcaagctccaaatttcaagcggatcacctgtgaggcggctattcgggaagccagacgctacgagacctcacacccgctacgggctgctggcctctctcccatcgaagacacctcgtttatgtaaacaagttgcctgtctgcgttcgttcgtttctcttcgctttcctcgtaccgacgcttcgagccgcactacgcatctagaactacgcaaatgtgtagggtgtctcgttggcagacgtaaacaaaacagacggagggcacacaggaaaagcatgcgacgcccattctgtgtgacgccagtcgttctttgtggtgacttcgcacccctcttcggactcttcggactgctgaagacagccacaggcgttggatttcgagcgtcttcgtcaccaatgatacctgacacagacagagtaccaccgctgaggcagtgaatgtggtttcggcttgagatggaacgaagtcccgcaagcgtgtgagttatgacctctcctcttcagaacatttgtgacagaccagacagaaaaaccccctttcaccacgatatccagcacagagtggcccaagaagaggcaaggagtctagaaaatatgcttggaaataaagtcaagtgcgtgttgcggagcagaccagctcgaggctgtgtactccatctgcacaatggtcatgccggccacgctagcctgtgatgaaaagccgattgctcgcggaggaaataaacagaaatctgctcttggtggagaaggaatcgacagaaacatcggcgccgacctgcggttctctgctggccggttttctgtgtgctcggtcgcgacgctttcttcatgaaatctacccatcgtgtccgcgtttctttgtctctctgagcgaagcgcggggaaaacaaacttcgaaagttcagtggaaaatccagaaacagcaaaagctgcaggccttggaaaatcgacttccccccctcctccggtcgagtctccctgcgtcctccgctcacgcatgtgtgctgtcgctgctcccgtagtccgagtcgcatatctcccgcgcgttgtttctgtgcttcccttcgaaattccttctgaactgactcccgcgcagcagagaatgtgctcctgacatgaaactctcactgtggctgtgcaggcctgcctccccaggagaagccgcggtttcgcgtggaacttcgcgtcttgctgtccaacgcgaaaacgcggtcctgccctgcgttttcgcccgtttcgacaactcatttttctttctcagacactccgcaaagttttccgcacacttcttcgccgcagggagctgcgctttgcctagaagctcgatcttttcgcgagctgcgcgggcgccattcgcgcagacctgaggcggcaagacaagcgttgcgcgacgtccgccgagcgccttcacgggaaggaggctgcggagaaagtagattacgcactgcatcgctcgcgaagagacgttcactttcaaaggcgttacaagggcgatttgcaccgcaaatcaagacagcggaaccgtcgcatgcgcgaccaagttgccggtgtgtgaggtgtacagacaccgcagtgtcaacggagtcaccgagttccaggatcatggcggtcgccgggaccgcagttctccagagtctcgagaaaagagacttttctctgacggaactcgaagaatggaaggccgtcgtgtctgttccttcttccgtttcgctccgtgcaaactgtttttttcgccttccagctgggaactccttcatcggaccggcgcgaacgtcgatcctcgaaagccctccagcgcgctgctgaaacaaaccaccgacagagaggggtgaagaccgacgaaccagcaacgcagcaaagcaggaaagcggccgacgtagaca

SEQ ID NO: 2888 - DNA, 3834 bp, Toxoplasma gondii
tgttttgcagctgtcagtgcacacggataaggaaaaggcactctggccgccggcgaacccctgcagtccccaaggtatgcaacctgcacattcagatattgctcgtaccgcatctggagggtttcttacacagggaaaggggaaatgcaaggcccgtaccttcggcagttgtgcagaagtgctggttcattgctgcagggaagcgccgcgagctttcagaggttggacgagaaagtcgagaaacgaaagtgggcgcgcctgttgccgcatctgtaagttgttgagcgtagtagtgaacggaaatgtcaacttcagttgtggaatccaacaagaaggagacaaatagacggtcggggtaggaggggtcctgcacgcgaacacagcaacatctgcaatcgagaacggcttcagcggcaaaaactacgaccaaaacaacattccttgggcctcggttatgtatcgcccgtagacgttcgtctagatagctgtgcaaaagaaaattcagggaaaatcaaaaagctacgtcaacggagaattcatggatagctctggagtgccaacctctcaacaccgccggcttagtcttgcattccttctctggggacatgtattcgagtctcgaattcatgcaaaaacagggcgggcagaggcctgccattactgaaacagtacatgaaggaattgaggccggttccctgagacgtgcattggtctgtcggattcgtcgagacccgacagagtatactgccatgcaagaatgtctctgtatacacatgtacatatattttcgagaagtcactgggtggccaccggccacctgcgcaatatagaatagaaacctgcagcggttttgttccccctcgcgtacgtggaagcattttagggagtgcttgtgcaagttgactgggttcttgaccacgcaagtctgctgtacactgagccgcggaacagcttccggattcggtacaggaacttcactttgcgggtcgaatcgagggtctgttggctgctgaagaggaacgttggaagttccagctcggccccccacgttcggattctggctggcaggaatgaaaacaacctgctgagggccgtaactcagtcggctagagggctcttgccggtcccggctgactcctccacccatcgcgagggcgattctggggaatgacgcaggagggagaaaaaccaggttggagcacccgaagtggacgaaattgtcaaaatatcagtaaaaaaaaggaaacaaaaggacccgcttaccttccgcttacgaaaacaaaagaaattaccggagaccggcaagacaacgaaggcaacagctacaactactcgcttcgttccagagaccttgaaaattccgtgcaattctctgtttaggaacagtcgtgtctcgtgcaaaagcggaaagctgagactgtctattgtgtcttgccgccaacactttttggtgttcactattttagagagcgaagaatattctccgggggaagaggtgatgcaggaaaaaaatcgaatcacgcacaaggtaaatgcatgacgtcagtgcgagttgtcgcagcgcacatcggagggcgagacggtaaagaagccgccgcgagtttgctactttctttcactgttgaaaagaaaccgattagtcgtgttgttttctttaggttggttgtcttcgttctccgtatgtgccaagacattaaaaatagagagagagaaacgccccttgaaacctttcgtcacacgcatgtgcaaaaggctcctttccttgaatgttttgacaattcccattcaaagtacccatgctggacaacacaggcgttctggtgtccttgaatgttttgacaattcccattcaaagtacccatgctggacaacacaggcgttctggtggttcccgggtacgctgtattctggcagtcccactcccggcagaatgaatacgaaagtggcgtctggtctgcgtgatggaaatccccctgttcgcatcagtgtccagtggactaagaaaacaaaacccgtgaaagtgaaaagtcagaagctccttaccgcaggtaatgctcggcaaggggtcctgtacgtcatcacagtgaaccgtaccccatcacaactccgaaactatctgtaggaatgatccaacggtgtttctgtacacacatatcggccgtctgtttgaaagcaggatgagcagaggtagtagagatactcccatccaccggtagttttgagagcgggagcaatgcaatgccacaaaccgtcctttgcatcgttgagtttcagaaatgacaagaaaacagtgagatggccaaaaatgcagtaaaagtgtacagcgcggtattttgggagagcgaaggctcgtttgttcgttggcaggccgaatcaaggaagttactcgctagcagaacggtgttgacaagggtaaaccgatcacgtatcagagcgcctacttttcttctgtgtgccacatttcccagtcctggatttctgtgggggaacttccagccacgtaacgtgattagcttctcatttgccccctacgtcaaggacggacatcgagaaacttctgcgcccctattcctagagaaggttctaacgctgcagacggagtaaatatgcgtacggctattcacccctttcagataccacagcagcaagaaaggacatacttctcggttccctgtagtcttaaaaaaaccgagcatctccagcacggcgttccagtgaagaatctctggaagcgactttctggatacaattctatgggtgtaacatggaaagtgagaaacgatttctatgaatttcgcttgcagacacaccgctcccactccatcaacctgatatgtagaaaaactggaacccattgatgaagaatacgcgttctcatgttgcgtgtgtaacctgctaacggctggatagtacgactgtccgctgacacgttgcctcagccttgtctagtgcccaaaaagttctacccgattttttttttcgcgactaatggccgataaattccttcgtatgcttcacattccactcgtcactcttgcagggcaacgtcttcgacggttcgcacttctgagaagtattctctacggccattcgtaccccctgtgaaagggcagcctgccgcttgttggaccactatttgtcgggagcatagccgagcgcgaccgaacggagacagacgcaaccatcccgaacaatggctaggagcaaagatagagccatgtagagagcataacacattcaaaatccactgctccagacagactgggttcttaattttggtgaagtggatggcccatacacgcagacacaagacagacttccctggaatacacatgcgtatgttcagggcgcgttttacgtggaacgaaatcaggacagtgatcgtgaactgcacgccctgacccgcaggctaccgcagtcaaaaccattttgagaaacggttggttctgctagaacggtttttggataccgaaggtctcctccgttgttttgcttctcgccgcattcgcacggaccggttctgactctgtactacacgcagtcgcgtgacacggggtgaccgcgaagcctcatgcagcacgcagattttcttgcatgcgccatgtctagggctggttggtcagaaactctcagactgctacttctcttcagaaagatgtaaccaggaggtgttaacactctcacacccttgaagtgtaactgttttctttgcgtccagctcgggtgtcctgccactcttcaggacgagtttttgcggctgcgtattgcgcgaccaggtcaagccattggctttgtctttcataaattctgagtcacttttccccttagtcataa

SEQ ID NO: 2889 - DNA, 3623 bp, Toxoplasma gondii
tctcctatgacaggtatcttttcggccctaactgcgtgcggctaaccctctgtctgcgtttctgtgagtcgctccatcaccttcctgcaaaggcgcatctcgcgcgtcagagagtcgtaagttctgtttgttttcggaccgtatataataccgcccgcgttgccgcattctcccctgtcttctgggcttacccgttgctgtcgtgaaggccccctcgtttaccgcttgctcgacgcgcagatgtacctttcttcgactccctctgctctgattcgtgtctcttttctccggctatttctctttctccttttcggcctcaatctccgatagacagctgaacgtcactccacctggggttcttggcgtccttcatcacatcgctacacacagattcaaaagtggttgataaattcatatttaaatatacatgcgtggatgctggaccactccacacttcgtagcctaaacgtgtatacgcatatgcttttaaggatcgaaatggagagatctgtacttcgtacattgccagacaccgccctgagctgcgtagagtaaatctgcacatatatggtgcaaatgatcatgtttcgtcggccagccttacgcaagaattaggggatacaaatcctcttggttccagaagcttacacaattgtaagccaagcacaactccattgagtggtgtacagtttctcatacaggcgttgacaatcgcgtctctcgaacccgctatcagtcgtttaaactctttcacccgatcttgtgaatggacaatagctggcgctcatttttctcctctttcccatacacaaatttgacgcgtcgtagtcttcttgttctcgcgtgaatgatgccacgcacgatacgagtgttacactagaactaatgctcacttggtattttccttgaactctctgtactggtatattttccgctaggcacacgcgtcttttggcatctacatgacaagagccacttctaagtgaaccatgcttttgaataaaggtactttcgggtctagttgacattttcccgcagggtgtattgcagagatttcctgctgtgcatgactgaaatggatggcgagtcgacgctacatggccgcatagcgaatctcgttttgaaaaaggtttcagtgtcggattttcctctgttgcttgtatgtggacatcaatttgctcctgaggagtaacgaaccgtaaaaatatccggaagacggacagacaactcaaaaaaggaacagaaccccagagcaacactctagaagatacagccgcgatctgccgtttgtcccttaggtatcccttatggtcgtgaaccaccaactagaaaaatggctgaaaggactttattgaaaaagatggaagaatggtctttagtgttttgctcttctgcgcatttgacacagttcgacagcagggagttgccagcggttccgggtctgtattgtttcgcacgctcccagttgcacaaaaaagtgtagggaggcgactaaggaaaggcattcttctgtagactcaacgcctttttcatacgcttaagatgctttatgcaagtaggtaaatctcaacagaacacggcttgtgccttcctgtctgtttatttttgaagttcgtagttggctgtattagaacgggacaaaaaacagatcgatacgtaaagacgacatatcccgccattccgcttcatgcattgtatctcaatttgtctcgtttgcactgacgaagatccgagatcagtcttttatcgtcaacgtcgtcattcagaaaacaggtgagatctctgttttcttctgtaccttccagattgcgcccagtctgctgtctcgcgtgcagtgcggtgccgccggatcttgcccatcgattctactctgtctcttccggccacagtttcctcttttttctcccatgtcttctgtggtttgcaattcaacttgctgaataatataacaggtgcgtcttcttccgctaagcattgctcaccaaaaccgatatttccaaacgctgtctccggtggtggaccttgtggatagaaagcacgctgagagcgatttgacttttttgctattcaacttcctcattttcttcgcattttgctctgtctgcatcgcctgttatcaaaaaacatcaatatgtgcgtggatgctacgtgtgcgatgccgccagcgctatcgatctaccagcgccgcaaacacttttgtggcttctgtcgccttttcattcttttttgaggtgaaaaagacggtgcgtgtctgaaggtcattctcttttgttccacagtgtcatttgcgtacaaggaactggctcgttttcgatttcagtgtcctgctgctcgttttgactctagaaaacgctagagaaagcttttcccgttcttctcatgcacctcgtttctttgtggtaagtttcgcttttgcttcctctctcctctctgctgttgacttaaaagttccgattggcaatcgcatgagaacgttggttcacctgtttctagctactgtttttcctgtcttttgtacacagtctgaacggctctaccgctaccgagcgagtgtatctttcgaacattttacctctttttcctcgctttcctgttgactttgcttttcgattcgcgtgttgactctctgatgcatttccttcagtttgttgtttggagggaggctagaagtgccctgtttggggggacaaaggagacagtcagatctcggtaggtttcacgcgaagtacgtaaacgactctgagggtagacttgtgtggaccctttcgcggtgcacatggaaatgccgacatggctctgagataccatcctgcgcgcgaccttgtatttgactctcacttgctgtctgtcttcttcactgcaacgtgttttctgccgttttcccacatgtttcccttccgattctgtccagagaatcctctggcgtcaaaggtttcgcttgttcctttaaagattctggaggggaaaaaggtggaaaagagaggctgaagacttcgagagaggcggaacgttttgaagcttgagcccaccccgagtaaacaccttagtttgacattttctttcgtggtcttttttctcagattttttctgcccttccctcaactgtttgattctttggtatcttatccaccgtttgcggttttgccttctctccgtgtctgtgtcgatggagaacacaggagggaagtcagcctccggagggacagtatacagttgtgctgaccgctctgacacatgtcgagatcgatatattcgtctctcgatgtcgccgtctcttcgtctgctgcctgttttctgtctgcatctttagtctctttaggtgtgcctctcccctcatcttctctctctgttccgttttccagtctatcctgcctcagcgttttcttcgcagtccaacatttcttctcatttctcttcgttttgtccgtctatttctttcacggtttcgcgcgcgccagcgatgaagtcgagtgtcaatagagagcgaaagacagaaccgagactgcgtgcggcggcgttagcagttgacaattcgagctactctcgcgatgcaaagaaaaaccagcaaggctgcgcgggtccgaatcgagagaaggcggagagaaacttgggtcgacagccga

SEQ ID NO: 2890 - DNA, 3297 bp, Toxoplasma gondii
gagagaaaacgactactcatatactagtattatcactaccatcgcactggcagtaatcatctgagattgaatagaagacgtgcaagaatcgagtcgcttcttcacctatcactaccatcgcactggcagtaatcatctgagattgaatagaagacgtgcaagaatcgagtcgcttcttcacctacacaggctctgagggtgtgagtcttacctcgctcttcgctcaatgcagatgtcagtggtagttatcttcatgtctttatcactgcctcagtcttcgcaactagagaacgtcgcgcgagagaccacttaggcgcgaattgtacagaacttcttgttactctaaaaagatgctgacaatgttgcgtttgtccataaaagtatactgtagtgcgggtcaccaccattactcagctgagatcggtgccatcctgcaacccatagaaatgctcgagaaatactttgactcctccagttcctaaggaaaagccttgtcttccaccagttctgtcattctcaggcgcgtccgaaaaacatggaactgcgtgccgtgggattgaattcctgtgaaagccactttttgtgttccacgtgcagcaacatagtcctccgtcgatgatttttgggacgcgtactgggacacacagacttcgaattttcattgctgcaattccgttattcgaagctcatgaagaatccaactgcagaggcttacgatttcccgttttttcctggagctagtgtcacctttgcttaatttttcgctcgtcataactggaacgaccctcaacctcggcattgtggaatcatgatgttcatctatgccattactctcctcttgtgacctgaagagaagactgccggcttttggaatatcatgctcagaaatgcatgcgttttgcttatcatgcggctccgacttttagatcgtgacaattttcagttctttcacgaagtcccaaagctgccacaaaaaagcgatgctgggaaaaggccggtggagcagccgtctgaaccttttgctatcagtggtggctgcttgctgccgctgctgttttccacacgctaagccttgcacaagccatgagaagcaccaagcatcgcctggaaaaactgctacaccagcatgtttcttcttggtggagtcgtctcgcgaattaccaggtgttcattacttttacgcgctcctagagaagcatggactctccttcgctttcaattgctgcccattcctcaggaatattctctccagataaatgcacgccactttctagctcggcagttcatctgctaagatgccgtaagagccaaaacggaacgacatacgttctacttattgctggaaatccctcattacagcagtttccgggatgcttgagatgctttgacagcaaagggaagcgtttatggaataccgtaagttctgcgtacggctgcagtgcctccaatacatcagtttccaggataatctgctggagctgtacgatccgacgctaacgtggttcaacgacgtccttattccgctcgtttctttgcggttttggaatcgctgcgcagcctatatatgctaagcagttcggccggccctttgagcagtctctcaaaccagtttatttctgagaggtaacggacagcaagccagtgcttgcacaaacacttctgcgacctccagatccagggttttgtccaggaggtgcggacgaggcgcgaagagcatgttgacgctccttcgacaattggttttgcgagcctctctgtccgcagcggtacagggagctggaaaagggtttcactctgcattcgtagtggtgcggtcacgggaaatgtctggggggaatactcgagtctgtcgtctggtgctgcacgaggtcacgcggcacgaggaagactgctgattctagagtttgtctcccatcctacgccaataaggttgttccacatcggctgtgctctaaaagtaacacatgcatttctgttacaactcgtgtttatcttgctgctcacatacaagcagggtttctcgaggtgcgtgtttcattctcttttcttttcgtagaaacacgtcatctgactgtgtgtgttgaaagtgtacggagcgtcaatggatggagcaagcttgtttccccgcgccggtcctccgttcacacttgatcttagctggtactcgagcagcctgcctccgttttcactgggcaaagaagcgcattcgtggaggtcggttccgtccgttttgcgcgcgtgatcaccctccttggctttcccgaactccacctttggacttctgtcactgccaagctgacagcagctgccttcgtctttaccatttgttcctcgtctgtctcgcttcacgttccgtctttagttcgcgtcgttttctccccggttctttttctgtgggggattcctgcgaatagggtgtccccggccgcctctgcttctgtgtgccgtggccgctgctccagttggtacctcgtcctttcgccgcctccgaagttagcgcagtttgacagacaagctgttttgtgatgttcttgccaaaactgttcgtttcttttcttccctttgcgtcaagttccgtcgcagacccgttgcatgctactcgcgacgtgccgggtttaatgctctgaacgccgctgtgcgatacgcagtttttgccgtgctgacttgtgttctttccgctccacactatcattcatttttttcaaaagtaccttccgaattcccaccgtttaaccacagctacttaagtccacaatcccccaggagctgccgagtcccgcgccttcagtaactcacacgatgtgcaggcagtccacatagctttcggaagcctggtgacgactttctgtctttctgtccaaaaaacacgcatgcttgatctgtgcccatatttcccctcgtctggacagccgttcattctttttttgccgcggctcgaccgcttccatgcttctgctgctgcaccgctcactggaaaagactcgttcgggagagccagtggttgtgtcccgacttcctgttgcatgttcaaagggtaagcgttctagaaacctccccgtcgccaggatccttttgtgttgttcttggtgttttccgcgactccccgtccgttgcagtcatactcgcgctcatcctcgctcgcgatttgcatggtaaactaaacaaaccacctcggcggggaacgacggtttccctggctcagaccaaggcaggagcctgttgaaggaatttgagggtagagagaaggatgaaaagatttgcgcctgtgaccgcgtgaagaatttctcaatctcaaga

SEQ ID NO: 2891 - DNA, 1842 bp, Toxoplasma gondii
gacctcaccgattgtgtttatggttaaaaatgcgtatatcgtgtgctgcacatggggatggaggctgttccgtaaacgaggcacttgtgatctcctttcctgctgaaaggatgatctttctggcaaaggtgtcctctcaaacgctgagcgatgcaggtttttggttggaaccgctttgtacgtgttctctgtaattgttttaaacagctcttaaaagcggatttgtaggcttaaacggctgaggaggactcgtcttgcgcttaatggacacaagtatacattaggcaatagcacacagccaaatcgtagctacgggacgttaaaaattttttggtagatcacaactattcagcgcagctgagctgaaagcaggtgtagcgcacacggcacccactgtagaaaaggggaaacggacatcaacgatcattttcctaaccctggtagacaggctggggtgactaatctatcggctggacattgcatccgttgacaaggaaatgctttcttggaaaacggctgaagcatcatgacagatgctctcaaaatactgttgacattttggaaacagcctttgtactcaggagcattcttggcggttatggaacagggagcttcgccggtggatcccacagttgaagttgggcgtgttcttccgaaactgcacacatgcataatgttgcttttgtctctccaccgtagtttagggtgttgcgtcttcccacccgggactgaatgcgcacccacgttagtcaaacagtagttgaaggtttgcgttacttgtccagcgaccttgcaggtgtcacagcctcaggttcgccacagtgaaaaatggtgttctaacttacagaggataacgccctcatcttagaccacttcagcagcacctaaacagtgacccctgtgtttcttatgtgggcgctggcctacaacaagggagcgttttttgaagattgatttgagtttttgattcttctctccagcaaatagttcacgaaaaaggttaacgcgtggtgcttggggtgtgctcacaacatgttcaagtttcaaaagttataaattaagtctgcttcacagcatcacgccaccgcatggtgcttgtaggcaccagtattaacgaggtgcagcgtcatgcacctttgttttgagtaggcttcagcgcggttgcttctgctgatcgaaggaaaaacatcccgggaacagctgcccagagtttaagcgcaagctgcatgcgcaattcccgccgcgaaaggtgtcgtagagaagaagccttatccttttcctcttttcgaaggagtgagacacctagtggatgcgtttgattcatgccataactgaacctgttttttccgagtacgtctgacagtaacttctctcttctcggtagtatttgtaccatgctgtctgctttcggcttgatcaacaggtaggctattgtttcaagaggaatagagagagcgactgtgactatgtgtgtttgcattttatctgaagggtatccttttggcatcttcctcccactcagagacagacataatgctgttgctgaaaagtaggtcttcgccagcagtcctcagttgaactgagcaatttgtgtcggttgcctatttttcgcttattcttcaagtgttgccgaatcgctgacaatttcgacagatttttttctgttgtagaagacgtgtgttgaaagactcagcactctgttaaagctggactggcaccactactcagtcccctcgtcatagttgtccgtcagccacagaaaacgaggtgcgcaagcctagaccagctttgcggtttgttgcctgtaagtacaaagcgcatcgcacaaaacagacacaaaca

SEQ ID NO: 2892 - DNA, 2484 bp, Toxoplasma gondii
atttgtacaaacgactcctgaaaaaggtgtaaggcgaccgactcgcaaaatggtctcggtggcatgtttacctgttcttcatcatcatgttccgcgtctgaatcttcggtcggttctcctgccatttctttctctgttttttcttcctctttctgcacatgtcttttgctttaacagcgagctgcttcctcgcacctctgaaaatgtaacgcacctctagggcttcctcatcatctctcagtttttctagtttctcctcaacgccctacgcgaaactgtatccagtgtcaccacagtttttggtttttgggtgctactcacctcacacttagaagtggataatggtggcttgccgcactctgtgttcagctgcacaatgtgacgctctcatcctgaggaattcacagaccaaacttgtgttgctcccacctccgtagatgattcgacgtcagaaggcttcccgacatcgagtctgccctgaatgaaaagtggtagtgttgaaggcgatgagttctcataggttcttactgctgctaaagaagaaccatgcggttttttatctgcgaatatctgccatgaccagactagtgatatcctatgacggcacgaaattctgtacctgctccggctttcaggtcgccatgcgaggaatggaagccagtcaaggcagcttccgcgtccgtaattgcccgctaaatatgtttgtacaacctgccttgctctagaaatgatgcatcatactcacgctggccttctgttgttcttccgcaaaaacttctgccccggattcagcctcttgctcgtcaatcttcttctgaagctccagttcggctgggcagaaaataggttttgcggttgcgctgagcaagcattacaaatcacctttggcatctttctcaatcatttttgtttccttcactgcaaacgacagttagacgttagtcgacgagtacccggtgcttagtccctacttgtgtcggttcgaatctgatccttctgctgagcttcatctatcttcatctgtgctatgaaagctttgtccgctgcccttttctcacggtcctacaaatgggtgtgacttttgggcatgacatcctcaactgagcataaaacacgggcgtacggccttcatttcacgttcttcctcaatacgttctaactcttcgtcttctgcctctagtttagcttgacgctgcaccgtctcctgttgaggaaaataggcttatggactgcagaagtgcccctcagttccaagctcaccacatcttcctcatgggagagtgcactatcagtctcagcttcttccgatgcgtgaagactcgtctctgattctgtatcaggtggcccttcgcgttgaaaagcagatgccctgccgttcacttttgacagcagcttgtcgattggaacggcgtaaagattagaggtggctgacgccatcccgacaatgaaaaccactactcttgagaagtgcatttctatgaccagtgatgtctctcactgagacccaactataaagtacatcgcactgcttaacgccacgttggatttgtggcaccggaacaatcttgtgttgatcctagctgtgcagaactgcggtgtagtgacactccacgccccactgttactagatcgtgcaagtcactttcagtccctctcctccgaagactttatgtaaagcagtaccctcccgcacttttatactccacctgtcagtaagcgttctaatgtgctgagacacttccatcatgggtctttcatcagcaatcgtgcacgggccgcaggagttgtgtgtctgcaatagtgctcgccgctcggccgggttcagccgtgtcgaggtaacgacgccatggctgtagcatggagttaagtttaaaatggcatcagctctagtggtggcaggtcataatatttttttatctgttggttcgtccatagatgagagctcctgtttgtgctacattctaccgagttgtgtctgctgaccagaagcgcgtcgctttttgcctcattctataaaaatcgcccgacatacgagcagagggaaccctagctgcactcctggactggcccagcttttcctgcctcatttatgccgccttgattgagcgtttgcttaactttgtctttgcatcgattgtcatacttgcccaatgtctgaaatcttccatcggtgttctcccagctcatacagtttcccacggctcaactgctgctcgcgccaggggggcggcagcgtgcgtccagcgcatcccagcgtgtagtgtgatacgctgtcacacgtacacgtctgtttcagtttcgcgcagcgcgccgggatcaccaaaatccagaacgtgctatccagtcggctactctacgtcaagtttgcatggttcctagcttcagttgctgttgcacagctattcttgcgttaacaaccgtgtgacctctccgtgttgtaaacggtggccgccgacccctctcgttcagagagtgtcttctcga

SEQ ID NO: 2893 - DNA, 3217 bp, Toxoplasma gondii
atgtacctcactggatggagtcattacttggccaagcaaattggattcgaactcctgagggacctggtcgcggcgtgggtgcatgcgaagctgcaagtcgacacggctgtgccagctcatcgtgtaagccaccgactgacaggaaagatccgttttgaagtctgatcctatttagatagcgatgcgcatgcttgatacatggatctactttatatctacatggagctgaactggatgcaacacaaatctcgtgaaacgatgcggatcttgtcacctcatcatgtacatgcatgtgtgtaagcacaatgcttgtacgcgtcgagcgatgagaacgaacgaaacgggagaaagaagagatttatgcaggtgcggttgtggacggacgacctgacacgtggaatgagggatgcactgaaattgtacacggctgctgtcattctctacgttgtgcttttccaggactcgctcgagagttgggcggcggagtcaacgaacccacgagatcgtgtcgctgacatgggcacacagacttccgttactctgcctcctcccataagaacagtttctgacaagcccgccggcgctccatttgacgctgcgaccacgagcgatgcccagaatctggaagtgtctagatcgacaagccaagtcatgacttcgcaggactcgggcagagaagccgcggcatagagtccttttcagtgttgtgtctcttttgctggaacgccaactttaaaaacagcgagattgtcctttcaggactgcttgtggagaagaaactgcatgacgaaaagccaccagaagcagacctggtaccggcgggagtaaggggggttgtgggagttcgccagcgcgtttcttccattactgcgtggacatgcccacacctttttgcacatttctggaaggaaactgaaggggggaaaggcgaggcagcgttgcgtcgtccatttcgatcgtggcagcgcgacatttgaagctgagaaacctgctgtcacttcagttttactcacaccgtttttccgttttattcacccgtttccgcgcacttgcgactcgctgtggaggttacggtggaggcgatccctctcgtagcacgagcgtgacccagaaaggaatcgccgctgcaccttgctgtgactcagctggaacatcggtcacccgtgttcggcctcatcggtggaaggctttttttgcacaacatcgggtacatgcagacgcacccgtgaattgctgttttttgagaaactgagtagcgcgatttgttcgtggaccagtcagtctactattcggctctcctgtatacacacattctcctacacattcgcatcttgaggtttgtgagcagtcgctcttggtcgccgtcgctttttccgtttttagccctcttccacaacggcaatcattgcgggcaactgcgttacaccagacactcacatcgtggaggagacgaccaaagtttcaaagccatgctgaaaaagtagacacagtagcactttggatcctcgtggggaagcacctctccattctctcacacgaaatcatcccttctgcacactgatcacgtcacggaggggctaaacctgcagtctccccaattcaggatccaactgtcattagctgtacatcactgccggtagataaagcgcagggctttccgcctcatacttgcgcaccacttttgaaaagagcaatcgaaaggaggcatttgtagagcacggagatggatgttcttcaaaatctttccgcacatcagtgacttatctcaccatgttcagaacgttttccccgagtttcacgcccgaaatgttagacggctgattccccactgtccagcatcatcgagtttctctctaaagcaccggcgtttcgtttccattttttcctaatgggggacgcagagcccacgggtgtgctaacgactgggatggcgatggaaaactactcttcgctgctcccctcccgacgtctgctccactgaaagattcctagcacctgtgctggtcctctacaagctcggtcgcggcaccgttccttcgtgtgtctttgcaggcaccagcagcgcggcagcagccccgtttccgtttcgtgcttgctttcgacaaaaagcaacgaatcaaattgaaagcgtttcctcgcttgaacccggtttcgcagaaggctagctgtgcagagctggcgctcactcccaccccgcagccgtcttaatggcgggggttggaaatcgcttgcaagacataacgcgacaggacacgcagccgtggcgaggcagaaacgtggaaggaaaggagtggctctgaaagtagacattttttcgtgggcacactgaggaaaaaaggaatctttacgcattatcttgtgagaatcagaccactggctgatctgtaatagtcggtacgcggctgcccgtcgcgagcagggtcgacttaccggggcggctaggttgcgtaagttttgagattttttgctttttcaagtgtgcctgttgatctatgccttttgcgatgattagaccgccgagacgtccactcttggaaagggttcggcccaaggtttcaccacatgcccacttcaacagactccaccggaccgatataacttgactcaaatgctagcgcggcgttgctatggcttcgggggaggcatggggtctgcattgcctctttaccatacaccgttcttccgcctttcatgtctctatttcaggcattctctggcccgtccaggaaatacttccttcccgtgaggacgacagggctggtcgcggacggcttacgagcccaatccgttctcccttgacatgccgcccggtcgaatgcggtagaactgggatcgcaatgctgcgtccgaacccgtggaaatgtcagcggtggagtaaactgttggcagttctcctggaggaggagagtagagatgaacgccgtatgggtgctctccagaggacgctgctctcttttggtgcccgcgtctagtctgggtcacgcgcccgtgtctcgcggaaccgccagcaccagcacgttgcgttttcctcagtcactttctgcagagtcgttttctccgagcctcctcttgggtgcgagtggctaagaactaaaagtgagccgtttctcctctgttctgcgttttaaaactgtagctcctcagtgttcctccccatcgtcttgcgtccagactcgagtttccctgagacactttattccccctcgcacaatcctca

SEQ ID NO: 2894 - DNA, 4122 bp, Toxoplasma gondii
aacagtgcatgcatttggtggctggtagacaacgttacaaaagaggctcgttgaaggaacgcggtgagtacgcataccgcggtttgcttcgcgtggctatgttgggatacgtttcattgtctaaaaacatcgtggagcatttctcacgtgtcctgaaaacaacatgcttctttttcttgtttactgagaggcgcgcgcgcgtgaattttgacgtgcgacctcagcgtgaatgctttctgtggctaaaaaggtcttcttttcgtgtgttggatgaccccttgaaagtaggccgaaaaagccggcacaccttctagtctacatcatttgtatgaagaggcctccgcacatcgtttgattggatttttttcgcccaaatcccatcgtgaacaattacctgtgtacgtaaaccacctgaaatcgaaggacgaagaggccaccacttcagccgacgtcaaggaagggcgcggtacaggcacagggtcgcttggatgcggttggggtgctggttgagatggttctgatggctgtgactgctcggttgcctgtggacgaggtggcgtgtatgcgggctcgtcgatcttcttgacgagtttcagcgtcacgtctgcgtctgtgtcatcggcgacgtgacttgcggatgtatgcgctgcgagcacggggctgcgcgttgagaaggcgagacaagtggccgagagaaaaactagagagaagcgaaggcaccacatcttgtccgctggcctttgtcaaaaaggggaaacggaaggacccggctagacagggtcgtgcgagcgacgcctccttggtcttgagcagctgaaaagcaaggaaacgcaagctgaagaggacgagtacagagtgtatttcgcaaacacacatctcgtggacaagatggaggagcgtgaattgcatgtctggggtcctaacaaacgaacattgaccggtggcgtacaccggcgcatacccaacagtgcaggaaaggaattaggaaaagagagccacagtttctttatttcaggaacaggacgggcggcagtcattccggtagatcgtgattgtcgggaaagtgaactatccgggaaacgcggccgacacacgatgtgaggtaggtttcatctgcgtgtttacataaaaggcctacagctataataacttgagcatgaacacaagcagactcgcacctaaaaatagtagagttcataccgacgagtttctaatgcacaacgtagaggctgttttactctttcactaaacgcggcttttaacattgcgcgacacttgttttatcacgacattttcaccgcgttcgcgggaaagaccgaccggtggacaagatccgtcacataaccgtatcatgggtatctataaggcattcgctacattcacatggagcttcccatggaagaacgtgtactgcagagagaggaggccgcgttttagcgatgaaaaacgaaaaattcaatccttcccaggctcgatgacaaactcgaatttcaaggccccgcagcacgcatcctgcattcgaggctggatatagttgaaagaacgaagtgcagatgccgtcatgtggctccttttggacgtatctgcatttccacattccgaacaagacttcctggctgcaaaagaaaacggaaccgggatgtcgacctcgagggatagctgtctacaaaagaaccgttggagttccacgccagggtagtggacgcaaccgagcacgtcgacacttctctgactctttatcaaagtcataaatacactcatagaatgcaatcacacaactctctacaagccgtcaacatacatcaagaaaggcacggggacgggctgttgggctgggggttttccagatgtctctcagcgcgcgttgagtcccccgggagcgcagacacggcccggacaagactggaaaaatttgattaagggcgggcctttacccttgcctgagaaacgctccagagtatttgtattcaaatcctgttttaaaaaaatacaaggaaaggttaaacgggtgccttttccaaacgaccgcagtgccgtgcgtactgcagccgcggccacaacgcggctattcgagtctgcagaaaactgatgcccgatatctggggtctccttcagcaccacaactggccttacccgagaactcagtcgcggaaacaagggtgtttctcctcgtttgaagaaataaatctgcaaaggtacccaaagattccgaatgtctagctcctctggagctgagcgcgcgggcgcggacctagcacggaagacctcgcaagaccggctgcagaatgagaggtaaaaaatgaagatagctgtttagaaagcgagaagtgggcatgactcaagaccctactcattggttttttctccgtcgtttaacagtttcttgaaacatgaaaaactccgcgaatcacagacatagaagccttccccgcttctttagaagaaagactctcgcgttcgcggacgtgcacgctcgccagagcgcgcgcgccctgggtgttctttttcaaagatctctcgagagttgtccgagcgcattcagagactgaccgagcactgagaccgtttgtttcctctcttttctctctgccctgcgactttaatggcgtagagctctcacctctgaagttgtgtggccgctcttctcccttccactcacgttttgtcttcgtaagttccagttcgggctacctcgactagcgctcttctcccgccttcttctcgcccccagctggagtcacagttacccccgaagttaccagtgcacagagttcctctgggtccgtgtgggatgacgaaacccatctttcagcagacagctgatgctttttttcggactttcgctccaatcgcttttctgcggtcctccgccgctgtttctgccgaaagaaatgcgtccaaaggctctcgccgtctctgggcaagacacgcgtcttcttgtcgcggctgctcgcgtcgtcgctggtccctcttcttccgccgatagtattggccttctttagtttggaacggcacccagcgcttcacatactttgtctgacaagatatcggaaaggggaaggaaccccgtatggttgaaagcgccggactttccggtctcaagcaacagcgcgcacaaagtccctcgattttggtcttttcagcagttctcttgcagcgaacgttttcctcttctccggcactcagctactccgttgctaccagtctaactgtagacctaaaagaatttctgcctcgtcttttgccggagccccgcctgactgtgtcttagttcacagcccccgctccgtgtctcgtaagcgactgaggaaagtttttcatgctgagagttcgggtttgagtcgtgaagacgggaagaagccggaaaaggccggattccaccttttgtttggaccgccgccctccatcgcattgtttctcctggcgtctcgactgccgtgttttaggttttttcttgcagaaacgcggcattctgtgtctctgttcgtgcacattcctaaaagaaacgcgtctgagcgcgacttacgtcgggaatgttcattgggtttttccctcaaaaccacaccagtctgtttggcacggtcgctcacggcacgcgactagaaaacagcgaatcgaggtgcagaggaatcccgaggaaaacgcttttcagcgaatcgtaaatgtgtttttcttttaggtcaaagtgtccgtcgtcaatttcgtgttggccagccgaagctgaaattcggtttgttttaccgagtcacgtgtctgataatcctccacttggcggcctgcccggatgtgtagcgtatgcgatcctcacaatatcttttttaaaggctcctggctcacttgctccccttgtgttttttctaccccgtcttctctttctccctggtctactgtacacctttctcccacggtcgtcctgcccccacgccgcttcgagctctgctgacgcgagtccctcaagaatcctcacagtttgagtctttttccccacttttttgaaggcaaggacttgctgctcttgtcaccaaacggctttcctgtttctccagagatcggagaccgacattcaccccagattgttcttgtcacttggaaacaacattatcccgatccacacattcacga

SEQ ID NO: 2895 - DNA, 1840 bp, Toxoplasma gondii
caattgcgagaggaagaatccgagcgcgaagatgcgtctgaagagacgcaagctcgagagggatgcctcgcatgacttgaagagccaaggtcgtaggaaggagaacgaaaaagttgctcacgaactcgctcgctcgtgtggagttgcctggcacttacaccatacggtctttttagctatgatctcagtgttctcagcgtcggcttcgtaaggaggttagagtgaatgttttaccgctatttatcagaggtttaaaagtcggcttccctcgagcgaacggaggagtcaagtaggtccacgccgttcacggatgaattgggtccgtctaagttgatactcggttatcaaggttaaacgcgaacttcccgtgtcaacaatatcttcaacagatctccagggctcactctcatcgattcagcgcggacaagactactcaacctcactaacggccgatcctttcatcagaaaaacaacgcacgatgagacgactttccaatcgaaattaccttcatacatttcatgagacgctgttaatctctcattggctaaatctacttatgcgtacaaacatctctatacacatatatacatacacatatcagcatatatatatatatatatatctgtacggaaatgttctcgtttacatttatgtatatgttgaaaaggacgtttttccatttacagctgcgtaaggtgtggcatgtttgcgagcgtgtggcgacccagatttccttgttttgacgcttgaggagagacgtttcgcgtgagtcttctccgctgaactttctcgagtctgctgtcgcggatgatgctgtgtgtttgtcggttgcggctgccttagtctttgatgtcacagaagacagagagaggtttcatttggcgaatccttttagatgggtttcagccttcaagaaggagaggaaaatcagagaaatcgtcacaagtctctccgcgcccagtgtggcgaagtctcggtgcatgcaacagtccgcatgcacggttgattggcgaatccatcgactgaaaaacgacgttcttcgctctcctcgtttccccattttcctcaccacagacctcgtcttgcgccttgctttctcactgcctctctgtggcggagacgccttctttcctgtgtctaaattcgcggattccttcctcaagtctcgagcaagctgcggctgcgcgaagcagcaagtcgacgcattgtgtgtcgagtttctaccagagcgccagtcacaaacagagagatttccgactttgcttcctcgcgtttttctctgtctttcgggccttactccccgttctttccttcacttctgtccactgcggcgtttcttcgtcgtttagaaaaaggctttctgcagacaacgatcgacatgttgcctcgcggtttgtgtgcacccgacttttggacagcagagctttcattctgggggccgcaccgttattcttgacgaacctctttgtctctttcgagaaccatcatgaggctctcgaagctcacactcgtcagcaggtccccgtttcccttccctcaaccgctgccctgctccgcgcttcgtcgccgtcgtgtctcccatcgtctcttcggaggcgtcgcgagcgtcgtataagagcgcgacaacggacagcgacgcgtcgaggaggcttctcagctcggccactgaatcctcttcgactgtcaacgtccccgtcgcgaaacgagtcggcgtagctgagactcgagcgcgcttcttgcgctcaggtcgaccaggaggcggccgctgtcttccagcaaccgctggcttccttcttcggtaaacactgtcgagagatccactgcttccaccaaacacca

SEQ ID NO: 2896 - DNA, 2885 bp, Toxoplasma gondii
ttccagccaaggactctgtagggtcggtgctgaacttggagcagaagtctcaggaggacgcgaccaggaagatacacgacctgaagatcttctgccttgactcgcgctctgtctcccgcgcgcgtctcgcctctccgccgtctgcgaccgtctctgcgagcggcctccgcgtcgcttcgagtcctcctcgacagcctctgtctctcgggagagctctccgcgtcctccgtctctccacttggaaggaggaaagctggcggacgaacgtccccgtcggtctccgaggaagctccggaagccgctgcggcgcccatcggaagttgacaaggcgaggaactcgagaaggctcgggcgccgtcggcgatcgcggaggcagacctttcgcacgcatcctcagtgcgatagacaaacattttgatcgctgacgaccggaacgcggggaacgctcgagacactcgccagtccattctgccccggccttccccaagccactcgagcgacaagaacgagacctgcgcccgcgaagactcagcctccgagtcgcttgaaacctcgccgtcgccgcctgccgccctgtccggtgggtctccatccgcgccgccaggaaaccagctcgcgaagccgctctgctgtgcgtttctgcaggcctctgcggagtctgcagcgcgttgtttcgcgcgtctggcgcgccgtttctcggcctgcgctttttcgtcgggactggggcggaattcgaggacggcctgcacatgagcgaaggtgccactgccgaagaagaagccgccgaccgcgcccgctgtgttctccatccggtgcgtgatgatgcagagccgcgtacacactccgaaggcgacagggaaggccccctgagcgtcgggtcggaggcgacagggtctccgatcagagccgcaaacggattcttcggcttccgaactcgcctcgctcccgtcgtggagatgcgcgcgaagaaaggcaatcaattcttccatcccctcgatctgagaagactccgaaactcgcgagtcagatgttcccggtgtctcgcccacggccgcctgccgctcttctcggtctcgccgctcttcgcgctccagcgcctcattctgtctccgcaactgtctctgctcttgcgcatgctgaacgcgcagcaggcgcgccgccggctcgcgtccccggtccgacgcttcttcctcgcgcatccccgaggacgtctccgactcgccgctgggctccgcgagcctctggctgcctggagcctgaccggggggacggaagaatgcgtcgcgcgcttgacgctcggcctgtcttctcctctccacctccgtcgggtggcggtgtgcagccggcggcgaagaggccgcagacgcagaagatgacgaacagtgtttctcgatgggatcggtgcgtctgagatgtctggctattcgtcgacagcggcgggcgttgtggttgctggtccacgaagagagagggccttgccagtagcactgcgtgcaggtgaccgggaggaggttgtagttgagagaaaagtcgacaattttctcgctcgaagactcctcgacaggctcgagttgctctgcgtacaccggacctcgacagagagggcacatgctcgtccgcagcaagacagcgagcatgcagtcgcggcaaaaaacgtgaaggcagggcgtcacgacgggtctgaggagcagctcgaagcaaacaggacacttgaagtcttcctctgtgtagaaagtcgtcaccgttttcgcttttctctcgcccaccccaaagaggccagctgtcccaggaaccacctggacgcgagcgactttgcgattccgcaacaaacgcaacgcctgctcctgcagctgcggtcggacgtctcctgggtcgttctctcccgggagaagtccgacagcgccgccagccgagtgcagcaggtacaccagactggagatggccccgtcggaggagaggagcagcggcgagaggccgcgctgcagcgcatcgacagccgaggaagaggccagcgacgcagacgcgccgagagtcgccagctgtctctgcaggcgctggcgttgctgcggctgccgcaggaagcggcgcgctgcgagggctgcggctgctgcggatcgagaggccgtggaggcagaggcaaaaggcaggagaaacgccggtagttcctctgcaggcgcatggtcccggcgctgctgccgcccgctgttgagactccgcgaacggcgcgcggcctctgtgtggacgacgcgggggtgccctggagacacttcggagctctgggcttcgcggccgcgatgccacagcgctcgagcagactccccaggctgcagctgtcgcctcaaccgacgcccgtttggcaacgcaacgatcgtcatcacagcctctcgttgacgttccgcttctgacggacgcggcagacggcgggaggggtgtgcaggcaacgcagaagaagaggagagagaagaagaggagagagaagaagaggagagagaagaagaggagagagaagaagaagagagagaagaagaggagagagaagaagaggaaggagaagatggggaggaaggagaagagggggaggaaggaggctgaggagggagacgagaagttcgaggtcgtgtggtggaggaagatgcagcggagacagaggcggaagaagaagaagaagaaaaggccagttcttgacgtcgccgttcctgttgacggacttcgtgttcacgccataggcgtcgctgctcctcctgcagccggcggaagtcctcgggaggcatggaggaaaaatccattttggagaaccggaagagaggaggcggtgcgagagtagagcagggcgaggcttcggcgagttagagacagagaaggacgaacacggacatcaaaaagca

SEQ ID NO: 2897 - DNA, 1560 bp, Toxoplasma gondii
aaaattcgacagagtcggtggttcagcataagcgctttggtcggtgaaggaataacctgtaaacggtctctatattggaaatgataactaaacgaagtggtcttagaaaatgcaatcgaacgcagatctggaaaatatacagacctctcgagaactgagtcagtagctgagctttcgccgctgatcttgaaacaatgcacggtgtcgagaaataaaccgtttgttcgagaatgtgcgcatttctcgaattgattttctcctttccatcgtgacaactttcgtcacatccggttctactcaacattgtcgtgtcaatcagagtcgagaactgacttggatgaaccgctgtcatctgaggagtcgaactctacgactgggagactgcagctgccacgattggcgtctgaggtccgtttcgcttctctgtaattgttttctcgcgaaaaaaaattgctttccttgaccttgtgaatcgccgcttaggcaactacaggcttctcagcaaatctgccgcttggggctgcaaaaatgtatgaggggctcttccgtcgcttctttggtatcgaagctgccacgcaagacaagaagctgggggaaggacgaggtcaggaaacagagaaatgcctcttcatcccaccggcaaatcgctccagtgcgccatcgaagagacagctttctacaaagcaaacccacgagtgtaaaagtcgcagtgaacgcctcagaaaggaggccttcttctaccctagctcgaaacgcggttggatcccctctgtgtcccccaaggttgtagtcgacgcagaaggaagctgaatatacacttctatttatcctgagtagtcagaaacgaaacggaacatcgggtcttcatccagcgaatgaacgccgggcgaaaacctactacttctgccatgcaaagtcacacgcaatgtgcaaggctgtggacgggtccggcttcttcttttagcctcggggtttgctttttgaggaagaacctccgaaattttccgatctttctcttttgtgtttcatgcagtcgctgcggcgatctagttcacgaggaacaaagtggctaacgatgcttctccagaaaaggagaagcagccgacgaaattcgagctttcttgtctgatgaccgcagaaggcgtaagaatccaagtgctgtgttgttttctgacgatcgtgacttttccacctcagcgacagagcttctttcctttgcctacacacgcacgtactcgtatttatgtatttgtacttgttgggatagagggatatatggaggctttctattcattttcaggaatcgacacttgtttttttcgtccggatgcatgcatgcagagaggttccgcgttgagtgttttctcgactcgattttccgaacgcacgcttttcttctcccgcgtttgctccactctccgttctcttccacgttctcacttcgttttctccgctctcttctggcttttctggtccgtcgttctcgcttctcgcaggcaaaaggattctcctttccccgttcgccgcccattgcctcgcacgagtcctgaatccccgaca

SEQ ID NO: 2898 - DNA, 1537 bp, Toxoplasma gondii
tgtggacctcgtcacgcgaccattttgtgggaaaagagcacagccccgagacgaatccgaaccggcgagaatagaagaaaggcgtagtcgagcagagacgccgaaaaaagaggagaaagtgtgacaggcaagtgaagagacaaagcagaaggacgtttctcgcgttcgtcgcaacattttttcgctctggcgaatctttgcagacacacaatagcacgagggaagcgaagagaacagagatacaccgatcggaggggagttcaacctttttccgaagaggcgcttttagtggaaatctgctctcccttcgacttccagacggcttctgccttcctttctgctccaccgccccagcacaggggactcaccgaaacgctgtcgccctctggactgctgaaaaagttcatcgccatgatggacctgaagaaaagagttgctggaaagacagaaagactacacacacacacacaaaggaacaaacaagaaacaagtccgcatttccttcacatgtatatgcatatgcgtgcatgtgtaggcatgtgtctgtgtgtatccgtttaaatatgtccacatacatacatgtatacacacacacctgcatacgtgcatgtagatgcatgtatgtggggaatctttacagctttgaacaggacgtgtatacaaaaagccatcgagaaatcgataggaaaagaaaggtagaaacgccacgtccgctgttggaatgtcgaaatgtttcacgcggacaccagtgaggctggtgttgcgtttgtgaaaggcgcgctgccctaagccgtagaccctaaacaggttggagaggccgacgatgcaagtaagtcggtgtgcgttttttcctgaagagagactgttcccggaaagtttccctgttctttgtctccgcatttccgacacagcttctctcctgcactttccttgagagtccaataaaaacacgcggcgatttgagaaatgtcgaagacgcaactgggagatgtctttctcggtttgacagctgaagaatgaactctctacttcctctcggacgggagaaaactgaaagggaaggaggtcaggagcagccacagttttccataaaaacgcgaggccaagcgagctgggtttcctgagttaaggtatgccctcttgttttaacgccgggaactgttgggcaatgtcctcacatcagttgcgcgcagagtcgccgctaagaagcgcgggacgtgctcctctcttgaagaaaaaagtgaaacagcaaacagtgtcgagtaggttgaagtggactaaccgacgagttgacgtccaggcagggcgaagcaccgagtgcacccaaaaatccgggaaaccgctcagataacagactgagtcctcaggtcgcttgtgcaaaagacatttggagaaggaaagttccacgtccctctcggtgacttttgatgttcctagggagaagaccatgtcttcttgcatgcgctagatcacggcagagaattgcagaaaaaggaacaaagataaaggctcccagcacttcgcgaggtttcgcgtg

SEQ ID NO: 2899 - DNA, 1428 bp, Toxoplasma gondii
tgcagctgttgcagctggatccgaggatgttggagatcataaatgctccgtttaagtaatgggtggttggcccaagtgccacagagaaaaatgcgatttgtagaaccgtaacgaagcgactggttcacctaattcctgcgtggcaagtgactcccgtgcgggtgtctcaacgggagaatggtctcagatttcaatgttgtgctttatatcatctcgattcactgagcgtcagctcttcaatacattaaggcggccgacagttgtgccccagacccatgtataggcactcgcgcaaagggtcccgtggtcattccttcaggaaagcttgttgtgctccccataacttgtcttttcaagctattcgattctctagattccgtgtacgaacccctgaaccgggtcaactcatccgcttgattcgcatcgtctacacagaacccaatgaactacaccaatgcacgcagtctagaaaactgtccaataccttcagaaggtggtgaactcgtgctcgagatacgtaacttccccatgcattagtctggttactgggaagagattcgttagttcggcgctacgttgtagtcagaattcttggttgtctgatgaaacacaagagcgctcttgacccgcgaagtactgcgggtgagcatgtagacgcccagcacgagtgtttcattcgaacagggaattcccacgtagctccgcatgacctgacaacttcgggtgtgtgtgcattctgtatactgattgagctcacttggtaaaaccttgattctggaatgtccgtggtacacagcaatgtcctcgtggacgcgagcgagttattcgccagttcctttcttgtaattgtggaccatctgcaggtctcgaaggaagattatcactttttaaacggcatgtggcgttttcgttaggtcacatttaggtttccactcccccggtcagttgccaacagcaacggaaagcacaaaggaggaagctggtgagggacttcacgggcttttacacagcgcactatggtgcccagtcatggtatacgcttgcatccagtgttcgagcacacaaaggcgaatgtacaccctttgacaaccgaagcgactccggcgatgcctactctctaatggattgaaaattcgtgcatgcgtccactctttcgaaagcttgatggagtgcacggcgacggaagcacgcttcggtcacgcgttgttctccggcggtggtgttcgtacatcgcgttgacgcaacacaacgtgaaactgcatttgttctgagttgagagagattaatgtttcttatgggataaaagttgtgcttgtgttctcttccaaatctgttgcgttcaatctgggcaacaaggtgagcctccatgccacccacctctccgcgtttcgaagaactctacgaaccatcatcgtggcacggaggaaa

SEQ ID NO: 2900 - DNA, 1610 bp, Toxoplasma gondii
acacctaagctgggagtcatggccaacgtactctgagacaacatcttcgccagagaaggacggaaccacagaatgaattttgtgagattttttttatgcgtgtatggactgctgcttgtgaatcacttgcttctgtcggctcgaatgtgattagacgccactgcaagtagcgcgttacggaagttacttcaatgcttgtcgttttattcgtcttgacttataaagtcccgcacggtccggcagcaaaattctgttatgcttacgagtatgccggaatcaggtctacactgtccactatggttgcgtctcaagtagatagactttctttggcggcatccaccagcttcccaatatcacctgcaggctcgcacttcacgagattagatatgttttcaaatcgtgctgcgttagcgacgcaaacagaaatccaaacagactgatggctctggtctttaagacgtcgtgtttcatgatacggtaaagtcaacaccacaatcaaaactgaacagttttaagcggcgatgtcacgaaccccctacccatcgaagatctttttgggggaattcacgttattttcaccagttcttgtagacatacagtgatgcgttcaataccaagtctgtctattctcgtggacggagtccccaaagactaaacaaaaaacaggactacaagggaacgatatggaaacagggtcttcgcctcttgtggcatcagagcgatccgccatttacaagccaaatgggaatgtgttttcatcgccgtataggttacatcagaggaagcaatgtgccgttttatggaagcagttccgtttgatgatatcctaaagttacgaaaaagaagaaaggactagtgccgtcaaactacagaaaggagcgtcggatggctgtcaggaaaagccaacgagcttgccagtaaacgtcaccgcatatgcatcgagcgactgttgttccagaaaaggccccaaaccctctcacaactgactagattaggagaaccgaactgtgagcctaaggaataacgccggacacttgccctctgtcgcgggcgtgtttgtagctggaaggagacccatattcaccacagatgtcagctctccttccggacgcgatgtctttctggaggaattggtttctgtcgcaaactgttgtgcacttcttctttaatggcttgttccctgcctgtgtgaagatgaaagagcaactgtggtcaggagacgtctgtctcgtgagtcctgccgtctccacgcgcatgctgcatgcaattagttgacccagcgggtaagaggttcgctctgtttgccggattcttctcaaaaggcgcgcgtttcggtccgacacagcaagagtttcgcgtgcgagaataaagagcaattgcgtctctgcaaagatgaacagagtcccgcggcggtagtgggtaatcgtgcctcttttctatcgcgatttgctgcggaatgtttgttggggcaatcgctgtccggcaagtgtttctcgtccttccaaaatgtgtgtgtcctccccccttttccagttctcatctttatggtgcatcgttcctgactgctccttcttcggtctccctgtgcaaacccgccgcgtgacgtccga

SEQ ID NO: 2901 - DNA, 2926 bp, Toxoplasma gondii
ttttccttagtcttggttctggagttcagctctcgtgttcttcccgctgtgtgctctgctggcctctgctttgtctcttctctcactgtcttcgattcccctttctcgcacagtctgtcgtcttgctcttcatctttctctctcctcctgtcttctttcctcctcttccccttctctcgtctcgccttcggcttgccttgtaggagacggccgaggtcgcttgtgcgttccggatgaagccgatcaagtacggcagaaggttgccgatggtgtgcgagccgccgagacagaagtggagcaaacaggcgccaagaatgcaccgaaatcgcagccatttgagactccgcgtcttccccatttcgctctctgtcagcatgcagcgtcgagaaaaagccggcgacgccgggaacgaggagaaaggcggccggctgagcgcggaggagctcgacgagaggcctcgaagcgcgcaagaggagacagagggagacgacgacgaaggtagagtcccagatgagggtgagacagagtgccgaggagacaccggagaagcagaaggctgaggagatgccggaaaagcagaaggttgaggagatgccggaaaagcagaaggctgaggagatgccggaaaagcggacatggcgcgacggggagcagacgccaaacgcggcaacgcgcgcgcacggaggagacgagggggaaagagtagagaggaataaagcgagcagggaggagaaggagaaagagaagaacagagaaaaaacgagaatggaggggagaagaagagagagttctacaggaggtagagagggccgtaaatatcgcaagtgttcatggtagacagacggagcgctttgagggagagcagaggagcgagagcagacgctcaaggcgtcctgtctctctttggatcaacctatggaggtaagaagcgaagaaaagcggaggaaagaaaacaagtgaagctggcttttgtctccgtggagagcacggctcggtgtccagctcacaggagtggagccattacgtttggtgtaccttggcgactctttttcgagatcttttgaagcgacgaagacggaaacactcaacgaagaaggctagagaggattcgcggcgaggagaaagcgcacctggtggacgacgagctgccactgtacggcgtaggaaagagcgagaagatgccggagcagagggcagagagattgcagcgcggaagaaaagagattaaaacatgggaagaacatcgagactgactgtgaggcatgcgtcggcgaggacgattccgtagacactcgcgtgtgtgccgtgttctgtctcgtctttcatccgacgcggttcatcgcgcccgcgcagaccgccagtgaaggagacgagaggagaaagaagcgacgaacaaacggacttctagaaaagacaggagcaccctcgcttctgaagagtttcggatcctagtcaactctcgacggctctgcccgtccagtcacgggaacgcgagagatacgcctccgtctgaggagggactgcggggccatgcacacccctgcggtgtgcaagacagaaaagagagcagtacgaggaccgaggccggcgagttttttgtcgagaggaaaggcgatgtttctcctatgaagaggcgaatttccgacgccaagaaacagaaaaggcttcggcctcttcccggatgtctttggagtgtctgtacaccacagcccggcaaccgagtctcgactcgacacagagaggggggtgggcgcgctgaacagatccggcagctgcgcgcgttttctccggttttcgcggcagacctgaggagagaggaaacacatgcgcgtccacgtgcttgaacgagaaaccacatgtgaaataacgaaaactctcaaaaaaggcgcctccgcgatcccagccacgtgcggtgtatgtacaccgcgcccgctcctcgtgtctccggacagcgcgcggaaggagacacgttttcgtggcgcgctttttcagatgcgtcttttctctctttcgaaccagagaagcgaaagctttcgttccttcgtgctcctgtctttatcaggggactggttccatgttttctgtcgagaatgccgtcctcgaggcccgctccacccctcgagtttcttctcttcgctcctgaaaaaaggtttccgcctccgataacaatacgctgagaggagaatgggacccagagatttcctctgcctgctgcccacaactgaccataccctgttctcttctttctcggctttctatccctgtcttccagctcatcacagctgtatgggtgtatgtacacctccgaaaacgccggcagagccagcgggtggtccctccgctggcgcaaaagtgtgtgtgccgctgcgcggtcgccgttctgcggtgtgtttattgtccgttttctggaaagaaaagtactctttagtttgtgtctacgtttctcgcgttcgctaacatggacggaagggtgtgcatgcgctcctcctttcccgctctctcacctcgaggaagaatccagtaaaagaccatcacgtattcttccgacacgacaggatatcttgcttttttgtggcagttcagccatgggccgatgtctccattcggcaggttgcttgtttcgtttttcctcagtcctcactctctgtgcctctccactggttctcaagtgtctccccttttctcgcatttttcctcccaatttcctctctcttcctcgccattttcctctctcttcctcgccattttcctcgcgactttggactttcgtccggctggtgtcgtgacgacagcctccaccctcgatggaacctgtggcatgtcgtcgcaggcgaaagggtgggagagaagaaggacgagcaaagccgtctccgctcatggaaaacgacgcttctcttctttcccctgtctctctctgttctccaaa

SEQ ID NO: 2902 - DNA, 4509 bp, Toxoplasma gondii
aagaaacgaaacgtaccctcaggtgaaagcacagacactcccatgtcggacggcaactgaagcgtgtacaggcgttcccctcatgaagcgcgcgtctcttgagtcggtagcaaggtgggcagaaacctcaaagacggagaaaaagtcctgctgaagcaacaaaaagacccaatgcccccacgtctgaaagcgtactcgtagctgtgcagcaggagagccgactagcgtgtgccaggcgctccgcgtccatgacaaaggagacacggggagactagtttctcgttctgaagcattcgcgccgttttgtggtcgtttgattcccatttctttcgccttctgcggtttatcgctggcctgcattttctgtcgctgcgttcctgccgcgccggcagagttctcaggagacgaggccgccatggaggagcgatggcgacgtctaggaagaacgaattgaaaacgcctccgcttggagagtgtccgtggtgctcgtaacctccccgattccggggaatacgggcgcgattgagacaagattcagtcggatgctcgacagcagagaagcagacaggcgaagcggatggaagaagaaaccaatgatgtagaatcctggctatatctccagccgcggaccttggtcaacgaacagaacgcagacgaacacgcgaaaaaggggaaaacgggcagatgacgaacagatgttctggatcgaaatgaacgcgtaaaatgggagacagaagagagacgcacaggggagaatcctaccgaggtgtgagtatagacggaggaacaagcgataaagaaacctactttgccacaagagcagtgaatctgccgtctcgagcactcagaatgggcagcgcagggcagacaagaaaatgacgaggcgggttgtgtcttgccactgacgtcactcttggaagtgattcaaaagaatttcttgtgcgaatcgcaattcgacacggacgatagagacccaaggaagacagttcacgctgtgtcgaattgttctatccaggcgtgaaatgcgaaactggcatgcaggcctgctcgcgaaaaaggcgaatatcgagagaacgacattcgacaaaaagctgcggttcgaaccactgagtgtaggaaccgaataaagcaaggattcacaaggcgcatgcataagggaaaagtctctcagcgctgtgccggtgtgtgttctgcggtgcgccggaactcgtgatcctgccccaagaattacgattttccgggaattccagcgtggtgacaaagcaagacacagacccaaaagtgggtgggtgcgttgactgttcctgttgtggataggaatcgacagaggtaaaatgaaaatgacatggggcgcaagtgggcagtccgctcgggagccggaagcgcatctgcacactttagcggctgccaagtgaatatggaacaaaggcacgagtttgtttcgacacttccacgctgtcgcaatttcgtaggatggcagctggctcagaggcacacgaatgctcgggaaggaaaatgaaagagcgctggcgttacactgtggctaggttgtgtcggtgccgtggtgtcagcgaacgaccgtgacgggtgactaaatggaaaaacagaactggcgaacacgaagactgcaaagggtaaggacacctgagaatgccaagagcgacaatgactatccattttcaatgcctgttcagagggaagagcttctgccgtgctatctggacgcgcaggccacatcgcttgcgccttctgtacataatcattccccgtgggttgcagcctgtaccatggcatgtagccttcaatggggccttcaaggagaagcggtaatatgagctagcgacactggcagcactttggaactgtggtgtcctatggcgagaacgcaggatcgtgtctctctccatctcactcgggtgcggtctgcgttggaccgagagggtagaaactagaacgaacagcgactgtcagtacgacaggttgcataacacagaactagtactcatgttcacgactcgaaagagcttgtgttcgagaagcttcatactaacgttttcattttgtgtatggtgacttctgatttgagttgttataccgtcggcattcgagtaaggcggagaatcgtcttttttgcaaagttggctccgcggctatgtacaaccgctaccgtcgtgccgatcgtcactgttcccctggagcataaattggacgagcacgtgaattagcaaatcggaaccgtcacatttttacgggcagaacatgggtgggaacgagacagtgttccacagcggcacgtagtccgcttctctatcgaagaaaagaatatcctttcacatggaagcctcgccattgtctagcgtaggcgcacgagcctttatccaaggtgggttctgtagtcgagcctcctttttgacagacgacagcgcattttacctgtttacgcgtctagtttcgagcgccatcaatgtcagctgcgcgcttgggaagcaatctcccgcaaacgcagaggcatttcccacgtttttccctgatccatttcacagagattcaatgacttgtgtcctccaagtaattacaagtgccaccccagtgttttaattcggaaacaaatgttcagaatcaatgctgtgacaactgtggtgtgtaatactccacccgaaggtgtaacgcgcctggaagcgtatcagagctctcagtgaacgtgctttctgcatggtaacgcagtggtcaagcctcccacagacctcctccgatgctacactagtttcttggatcaccagtcgaatcctaggctatatactacgtctacaatacagctagggattgtcttagcattttctgcgtaaaatgtgacagcttttcgtggacccgatgtgtgtctccacgggtgccttgggacctggcagactttgggaacaggcttacaagcgaagcagggaaaaagcacgaaagtataccgtatgctattggtgcagcgatcatcaatgcgaagtctcggatggtctgatagtccgaatggtccaccgattccccacgagtagccgtgtatgtgtacgatttgtgccgcgtaccctgggtgatcccgaaagggatatcggccgtgttctttgtttcgcccatatagacaatggaaacgcctttgaatacacacactctctagctcgtgagcgtctgaatatatcttgtttgagtccatctgcccttccgctacgtaaggacaaatgcgaccgtacacttcctctttgcctgccgcgaaggtgcgcggggccgctaggtgaaagcccgtggcgtgtctgcctcaacgaggactcgatatagagagtaaaaatcacggtactagcgagactgtttagccgtgtccaaacagaaatgctcactgaaaacgggcaagctcccccacgcacgtcaacctgtgggcaatcccgtcgtcggggacgcatttaacatctttctctgtcctgcgctacagccgagctgccgctacttgacaaggaagccttctaaaattctccgtccctttgccccttcagtttttctcactcaaaaatatagagacgaaacatagcaaaataaatgtgccttgtagtggggcgtaacccacatcaaaaattctgaagaggttaaatcgagcaagagacccgacaactacagatgaggatccggagagcagaaatgacatgacgatggctggcacgcggatcaagcgtttgagagcggacgcggcgcgggtcaacgacggcgggcaggctgcttgtaaagtgtcagcttccgctcttctgcattggccgcaaaagggtgttacttgctgaagatatttgcgcaatccctcttcagagagctcagatactcgttcctatgcatacagctaatagtgcatttccccttctctgagaggtctgtctcctgtgtcgcctgctgctgcggctgctagtacgggctgcgtcgcggacaagcgcgcggactgtggcgccgaagagtcaagcgacaattcttctgcgttctacggagctatcgttcttctgtcgtgctatccggtgtgttttttaagtgaatgtatctgctcggaccttggcgacgtgtaacacgacctggtcccttaactccttgaccagcactggagatccggagtataccgcacagcgttgcaggaccgggcacctctggagccgcacggactgcacacacttccttttgatccaaccatgctttgaaactttcgtaaaaagcccaattcttgtctgaaaaaacagacggcacaagcctcaccgattctaccccgtgcacagtaatgatgcgctggaagtaactcaccgcaaaacagtaaaccccagcaagtcaacaaccagctcaagttcttgaccactgttttgagtgcaattctaccggtgaagttgcaagctgtcttaccagcagcacccagccgtacctcgtgacgagtgtatagtacggcaagtcttcgttgtcggattgtcgggtccagctcaaaggtttgtgtccgtgtagcgacga

SEQ ID NO: 2903 - DNA, 1960 bp, Toxoplasma gondii
aaaaagaggagtgacgatggaagggagaggcgacagacgaactttgggcgtggagagaagcgcgagagcggcagagggggaaagaggaggaagcgaaggcgccgtccgtcctcgaaaaggagaaagccgcaggggcaggcgccttcattgtgtcggagacaaccagaaagcagagcacatggacgcacaaacgaggcgttcgacagaacaggaagcggaggcgatggccgagctgcgaacaaaaagaagagtcccgaaaacaactgtggaacctgcgttaggtgccgccgtagagaatccacggatttcgttgaccgcgccctgcatgtccttgctcgcgggggaggagggcaggctgctgaggctagagccgagacacagacctttcagtggattgtgagacaacaggctgtgaatttcgaagctccctctctcctagacacacgcgaaaaggaagagaggactttagagggagggagggagacaagcatctgcgacgtcctgacagctgagaggcggagaagcaagcgtggacagccaggtctccttgttcgcgcaggaaagtccttctttctctccgcacgcaaaaacgggagacgggagtaaaaaagaggcatcttctgcgtagctttattccctcgacttttgttttctattccagaggcactcgacctgtttccaggcttggccggaggactctgtgaggactccggaaactgtgcattcgccccggaaatctggcgccttctcggtggaggaagagggcacaaccggacgcagaaacggtctctcctcaaaacaaattttaaaagacacactcaaatccgtgagaagacgagtcacgcgtgtgtggtttttgtcaaacgagaaactgaaggcgacgcagagccgtggttgccaacctgaaatggggtggaaatggtggagaagacccttcgatgtttctttcttttacagtcccgtcagcgagcgagtgtccatgacgttgactctgcgaacgaaaaatctgcaaggtgacgatcgaaaccggcgccgtgacccagctacgaaaagacgagagtcgcgatcatcgcgagacttgaaggagggcgtgtgaacaggagtcggagtctcgttttcgagacgcccacccacagaagttgtcagaaaagtaaagcgagatgctcgctccttgagaaaaggaatttccgcttgactcggctttcgttgaagattagattgagaaaagttcagcgagagttgagcgctctttttcgaaaaagagaatgcatgcgtttgtggcgctttctgtggcgtgcgcgttgcgacgcgagcgtttgccgccgtccattctttgtttttcttggaaaacgactttttcctcgtctctctgcaacactgaggtagatgacatttgcgtagtcttgtcactcgtcccatggttctgcgcgccgtcgccgccgttccattcctcggcgcaattcttgtcgcgactctgtttcgttcgccttcgccactcttcgtgagtgtttttttttgctgaagaaatcttttctctcgcgcttcagggaggtgtctttcttgctgcgagaggcgccgtgctttttctgtcttcctacagttcttccccctcctcgcccgcttctcctctgagagtgcaggggtccctttttttgtatatatatatctgccagcgttctctggctgtcgcagattttccgctcttcctgcaattattgatgctcatcggttgagttttatttctctgttgagtcgtctgtgttgctcgccgcgtttcctttcctgcgattcgggaggggctgtcggctctgttccgttgtcggcctttcctgccgttctggaccacggatttttttctcgaagtttcctctgtcttttcgtcttcctttttcgaaggagtcatatcctccctgcgacgcccctctgccgctccagcagttggcttgtttcttcgcgaaaa

SEQ ID NO: 2904 - DNA, 3570 bp, Toxoplasma gondii
ggtgttcatgacggtcgcaggcagtttagggtatagacggagttcgggagctggtccattgcggcagaactccgtgtagtttgtgtgctttcgaattgtcaagaaatagtgaaactttcagaggattcggatcgttaccttagctcgctaggtatctcactcttgtaaattgattcatctatcctcgcagtgaaatatgcagctgtgcagtctagatcagacgctttctcaaacgtggatggtcgggggaccaacacagaatgaaaaaactgctagggacgctcgcattttcaagtgtgcctctgatacacaaagtgacgagactctcacttgtggagtgaaggctggactgctcatgcgagttacacacataggcgtgctgattgtcgagccgcgatttcttccggtgcttttcaatcagaatgaagaacgtgtttgcttgttcggggtgaagtcaatgcagaatgcatcaaggacttgtggttggtgaaattaaagggggatccggcggccgaagcaaggcttcgactgtcgctcttcgtttatctcctgcaagagtgccgtgtgttaaccggggcaaggagacgtgctgtcaatccagggaacacacttgcgagcagcggtatatagaaataatgcctcgcccaaaaagcgtttgtcgtatcatggtgtcaatgtctattcatggctgaagcactcgatgtggcacgagagtgtgaggttgtaccaaacgttcgcttcacgagcttctatatttgcgaccaacgtgagggcttttcttcgtaaacatccatccgtgggaaatgtcgagacgctcatcgcaaactttttctccaactcccgtcagacccgatgtggctgttggcgttttaatggagagtgagtcattatggctgcacggtgcgtgtgtctcagaagggctaatgcattggtctccgctgatgaattcaaggatttattcactgttcgatatattgtctaaatttgctcattttttcaagtgaagccgggttttggtcattgtttggtacataccaaaggactatactgcttcttaagtcatacggtcctctacggatcactctctgacgtccaggtaagcattcgggctgttacacaagtgcatggaagcacgccacattgccagcaatatggtgaatgagtgaatctagagggtgtctacacatgtgagtggtaactctgctcatcgtaggctttgccacggatcgcaggtacgggacactccgcttgtgttacagacaggtaaagcgcttcacgagtagctattcggaaaaaaagaaaacggcaaagacggggacaatatactgtttgagggtactttttggcagaggaaaatttgcttttttatcccaacggcggacagacggaatggttttctcatggaatagcatgcagatgctgtcggtagactccctgaccacagaacggtgttcagtggaccgaggaaaagaactgctcgcagaatcatccattgttctgagatgttatctggctaccggtcacaacttcctctcccctggagacaaaggaaaggttcagtggcacttcttcgctgtctcagaggccctacagagcgtagcgtgttctttattcttgtgtaccgccatctgggcaatcttcaggtgtctgaggctcatagcagtgcgggaggcctgtttccctgctttctctctcctaagaaatctgactgcaccgctaagtcgtgcaacttaacattacaaaagtgaagagtcaatttagatagcaagatgctcaaggacgggtttagggttaccgcctgattagaaatagtgtcacgttgtgaaggcgttattgttagcctggtctataaggtatatcgaggaaaacacgacactaagtttgtcatttagagattctggaaacttaaactgcaaataacggtttgatttaccataaagggggggacccacctcgggctttagtgtgtgccacttccctctttgtatgcctgtggattgctgatctgctccgcatttccttggaacaaagtgcgctttccgtcgctcgtggtcaccttgcagtggcgtgtgtttgcgcttcgctggcagaaaaataaaaagactagcgcgtacgttggaaaagcactgtgaactccagcgttgccttgtcgcagcataaccaaagtggcacgcgtgcaaaaggaaaccatcaggaagtctgcgtgtcacggcaagtttttttgtccggtaagaagctcagttcatacttcggttgtcgtgcatgtcaaagcgcgttagtcaaaatccagcgcttctagcgtaggtttgtggtagaagggagctcgtagcgtactcctcaccatacccctgtctgcgacggacagtctctttgcatctctcgctacacacagaaacccagtcgatcacttggcgagaaactcgtcttttcatcatcatgataggtcatgggaagctgcggtggttcttgcgaggagagtagcattcccggtactaaccctagtttcgagtcccgttcggccgctgtggtggctgctccggtcttgtgtgcccgcaggttgacacagtgtggctcatccacgtctacttcgccgttccatatctcgtacgcaagcagtttcttcatcgaaggaattacagaaactctgctggagcgcaaggaagctcaaaggaaactgaaccggaagttccacatgtcttccttcccttggaaagccggtgtgctggccagccacgcatgcggagcggcaacgcgatattcgcacctcagtgttgtggacgtcgatccatttgagtctttcacccgtcgctacgtaagggcatctatccgtcagcacgaacacaaaagcacgttcttcttcgttgaaagttcctgtaggtggcttttctgtttcaagtgaggcgagagaggcaactccttcgccatcccggctcatacgtaacacagtggcagttagcaaaccctggcccccctcaacccagcgaaccgtgacttttccgtttcgactttcttttctttcttcgtggaaagtcggtatgttctttcggaaaagtgccgccgtctgtctgagttgaccaaattgtggtatggagtttgtctctgacgatcttccgcttccggcggtgaaatgtgaggcgagacacagaagccagcaacgttacaaggctgacccacccggcagcattgcgtgagattcgcatgtattgggtccacaaaagactgtgcgctcctctctgcgtagtgacttcgcatcataatcttgcctcattcactgttaacgaaagaagggcttaggcgtttcgtggtcacagacagtgctcttgtaaagaatgagggcgatgtaagattctgacgatcctgtggcgggagtgtcatccaggccccctatattttcatgcaaggaagggtaaaggtactctgcacatgtcattcgaatggtcgtcgcttcgctcctctgagttctggagttctccggtccactcggctttcaggtttctgcccatctcgagtactgaagcgacgctggcatcttcattcagaactctgtttgcaggccacataaagaaaata

SEQ ID NO: 2905 - DNA, 4062 bp, Toxoplasma gondii
ttgtcatttccgtcaaagacagcaaagtccagccagccttgctgaataaactcctggaaggcaggatgtttggagcagaacgcgacgtttgcttctgccacatccgagaagacgtagagaaaaggtttttccgggagccccaggtcgcgaaagaggtgttgatatctcaagagcgcacgcagcagcaggtaggtgaatcggccgtggccgccgccgatctcgacgatgacaacgcgagtcgccagcgaatcttctgctgccgcttgagacccggccctctcgccctggacgctggacgccttcttctgcatcgcaaagagatcctggaggaagttgaagatcacgcgagcgtacgagcgacagagtcgtgagttgctcgtcacgaagctcgggacgtagtcctgtgcccaggccgtgatcgccatttgtttgtagtaattttccagcatgtcccacaaaaccgactcgcaaagcagcacgcgcctttctacgcaaaacttctcgtccggattctgctccaccggagcctcgccgccaactgtcgcgattccggagccttcgaaagaagaggcggaggacgacggggaggaagttgaaggggatgctgcaggttgttcagatccctccttgccggaggctttccctagctctgtgtcggccttcatcgtgaatgtgtggatcgggataatgttgtttccaagtgacaagaacaatctggggtgaatgtcggtctccgatctctggagaaacaggaaagccgtttggtgacaagagcagcaagtccttgccttcaaaaaagtggggaaaaagactcaaactgtgaggattcttgagggactcgcgtcagcagagctcgaagcggcgtgggggcaggacgaccgtgggagaaaggtgtacagtagaccagggagaaagagaagacggggtagaaaaaacacaaggggagcaagtgagccaggagcctttaaaaaagatattgtgaggatcgcatacgctacacatccgggcaggccgccaagtggaggattatcagacacgtgactcggtaaaacaaaccgaatttcagcttcggctggccaacacgaaattgacgacggacactttgacctaaaagaaaaacacatttacgattcgctgaaaagcgttttcctcgggattcctctgcacctcgattcgctgttttctagtcgcgtgccgtgagcgaccgtgccaaacagactggtgtggttttgagggaaaaacccaatgaacattcccgacgtaagtcgcgctcagacgcgtttcttttaggaatgtgcacgaacagagacacagaatgccgcgtttctgcaagaaaaaacctaaaacacggcagtcgagacgccaggagaaacaatgcgatggagggcggcggtccaaacaaaaggtggaatccggccttttccggcttcttcccgtcttcacgactcaaacccgaactctcagcatgaaaaactttcctcagtcgcttacgagacacggagcgggggctgtgaactaagacacagtcaggcggggctccggcaaaagacgaggcagaaattcttttaggtctacagttagactggtagcaacggagtagctgagtgccggagaagaggaaaacgttcgctgcaagagaactgctgaaaagaccaaaatcgagggactttgtgcgcgctgttgcttgagaccggaaagtccggcgctttcaaccatacggggttccttcccctttccgatatcttgtcagacaaagtatgtgaagcgctgggtgccgttccaaactaaagaaggccaatactatcggcggaagaagagggaccagcgacgacgcgagcagccgcgacaagaagacgcgtgtcttgcccagagacggcgagagcctttggacgcatttctttcggcagaaacagcggcggaggaccgcagaaaagcgattggagcgaaagtccgaaaaaaagcatcagctgtctgctgaaagatgggtttcgtcatcccacacggacccagaggaactctgtgcactggtaacttcgggggtaactgtgactccagctgggggcgagaagaaggcgggagaagagcgctagtcgaggtagcccgaactggaacttacgaagacaaaacgtgagtggaagggagaagagcggccacacaacttcagaggtgagagctctacgccattaaagtcgcagggcagagagaaaagagaggaaacaaacggtctcagtgctcggtcagtctctgaatgcgctcggacaactctcgagagatctttgaaaaagaacacccagggcgcgcgcgctctggcgagcgtgcacgtccgcgaacgcgagagtctttcttctaaagaagcggggaaggcttctatgtctgtgattcgcggagtttttcatgtttcaagaaactgttaaacgacggagaaaaaaccaatgagtagggtcttgagtcatgcccacttctcgctttctaaacagctatcttcattttttacctctcattctgcagccggtcttgcgaggtcttccgtgctaggtccgcgcccgcgcgctcagctccagaggagctagacattcggaatctttgggtacctttgcagatttatttcttcaaacgaggagaaacacccttgtttccgcgactgagttctcgggtaaggccagttgtggtgctgaaggagaccccagatatcgggcatcagttttctgcagactcgaatagccgcgttgtggccgcggctgcagtacgcacggcactgcggtcgtttggaaaaggcacccgtttaacctttccttgtatttttttaaaacaggatttgaatacaaatactctggagcgtttctcaggcaagggtaaaggcccgcccttaatcaaatttttccagtcttgtccgggccgtgtctgcgctcccgggggactcaacgcgcgctgagagacatctggaaaacccccagcccaacagcccgtccccgtgcctttcttgatgtatgttgacggcttgtagagagttgtgtgattgcattctatgagtgtatttatgactttgataaagagtcagagaagtgtcgacgtgctcggttgcgtccactaccctggcgtggaactccaacggttcttttgtagacagctatccctcgaggtcgacatcccggttccgttttcttttgcagccaggaagtcttgttcggaatgtggaaatgcagatacgtccaaaaggagccacatgacggcatctgcacttcgttctttcaactatatccagcctcgaatgcaggatgcgtgctgcggggccttgaaattcgagtttgtcatcgagcctgggaaggattgaatttttcgtttttcatcgctaaaacgcggcctcctctctctgcagtacacgttcttccatgggaagctccatgtgaatgtagcgaatgccttatagatacccatgatacggttatgtgacggatcttgtccaccggtcggtctttcccgcgaacgcggtgaaaatgtcgtgataaaacaagtgtcgcgcaatgttaaaagccgcgtttagtgaaagagtaaaacagcctctacgttgtgcattagaaactcgtcggtatgaactctactatttttaggtgcgagtctgcttgtgttcatgctcaagttattatagctgtaggccttttatgtaaacacgcagatgaaacctacctcacatcgtgtgtcggccgcgtttcccggatagttcactttcccgacaatcacgatctaccggaatgactgccgcccgtcctgttcctgaaataaagaaactgtggctctcttttcctaattcctttcctgcactgttgggtatgcgccggtgtacgccaccggtcaatgttcgtttgttaggaccccagacatgcaattcacgctcctccatcttgtccacgagatgtgtgtttgcgaaatacactctgtactcgtcctcttcagcttgcgtttccttgcttttcagctgctcaagaccaaggaggcgtcgctcgcacgaccctgtctagccgggtccttccgtttcccctttttgacaaaggccagcggacaaga

SEQ ID NO: 2906 - DNA, 2401 bp, Toxoplasma gondii
ccctgaaagctcgcagatgctatagcacgttctatccgagtgaagaagcctcagttaaacggcggtacaggttattattcacattttgcgtcgagcgagtcgtgcatgcaaaagaactcagaaacagctggattttccgttgataaagttcagcgctctgatgctctcgagctccaaatcgatgttgagccgggctgtaaagacaccgcatgcgactacttaagccgcagttcccttttgtcaacagttcgagcagttagtggatatccacgcgaaccaattgactgctgtatttgatgttagcgaactgtagccacaacagggttgtgcatgctggggactgcgagtaggggcaaacgcaagtcaacgacgcattgctgagaagtgcgtgtcatcacttattcagagaggagacgacgtccgcatcttcctgtatatgcttatgggcgtgtttgcctgcatttacatacgcattttgggagtgaaacatccacatgtgggcatctatatgcacatgaatacacgcacgtctccatatctcagtttccacaacattttttaataactccatgtctgtatgtgtttcagccgacacaaaaacatccagtaaatacgtctacaatcccagatatgcagtcggttcgcatagacatataacgtacgtaaacagattctttgcagccatgcggacagccttacctacaaagtgtctcggttgttcgacatcacagccccacacgtgaactgtcagaaggaaacgtgaagaaagtgcagtttccactagagcaaccagtgcgactcttttgctcctgccgaaaaagggtgtcggagaaactctttcttgcctcatttgtcgcattctcattggacaggaatttctttagcccgacttgctttcgatggaaaactaggtgtcaagacacccgatcaaggcatgcaacgacgcgttcctatctcccctcattctcctgaaaaccgaatcgacgaagtgggttcatttgtgtgtgcagcaatatcggtagacgtgtatgcatatttgtgtgtatctgtatgttgtctcttccttttctatctgtgaacagagagatatcgagaactgcatatgcatgaggttctgtgcagtcttcctcgatctggttgattgttcacaagttgctctgtgtatgctgtgtcacgtattaccctttttgagatactctatgcgtaaatctctctctggatcactcgtcatctattcccacgacagtgtacggtccggtgaatgaactgcctttcctgaacacgcacaagtgaagaatcttcccacgttggcaaaaatcaagagaaacaaagagtcccgctaaagtttctcttcggagtcaagctcttcagggaatctctaactgtgcctacacgccagcgcaaaagcgaacgcgccgagctcgctggccgtctgtacactgcagcacaccgcgggtgtgtgtcgcactctcttcgtgtgtgttctttgcggctgtttctccgtgtttctttcccctggattccccctttgtcgcttttttcctctctgtggcttctgctgcttccgagagacccgcggcgtttccacccgtgctcccggggtccgaccgcagtgactcttagtgaagacaaagtcggcagcctggcgggcgccgcgagaaaagccgctctgcgcatgcacaaatcgaccgttcttgcctgggaatccagagacctttctcgctggaaaatccgcgcaggaactccagagaaaaaatctgccgtttcaactcgctggatggaacctgcgtgtgtggacgtgggtcgctgtacgtacaccgcagatgtggacggatgtgcatctgcacaagcgaagcagtgtgtttgtgtgtcgttgtccaggagcgctcccgaacaatcttgatttcttttcaaggagctctgcgggagaaatttgtccttctgtcctcgagcgtttcatttctgtcgtcgtcctgtctcttccccgtcttcgcgtggaatgtgagccacccatgcacagtctgtagggaagggagggaaggaagggaaggaacggagaacggcggacgaggaagaagcgaggcacagtggaaagggagagaaacgagtggagccgcgcggcggccctcgtctgcgtgttttctcgtctagagaaaagaggcggactgcgcgtctcttgtttccctcttcgcctcctgtgcaaatctgcttctgacgctcctccaagagacaactggaactttcacctgcccaccaccccgaaagcgaagacaacacgaaacgaagagtacggggcgagacgacagagaagagggaagattcaagaagatcaagaagggcatggacgcgagccgataaagagcaaagaacgcagatcgaagacgtcaaaacgagagcaaga

SEQ ID NO: 2907 - DNA, 2072 bp, Toxoplasma gondii
accgattattgactgtggagattccacgggtacaatcgacagagaagacacggtggcctcctccccctctactgccctttgcttgtgaatatcatgtgcctgcctcttctcgagcaaccgccttcgcacactgcctcggcgttttcggatggctgtctcactgcgtcgagctgctccttcactcccacgagctgctgaaggctgagggaggcgagactggcgggggagcgcggggcctggctcgcggcgcctgcagcgatggcagccatttctctttcgcgcagaaagtggaactttgccgtttctttggactaccacaggacagcaagcgagaagaagctgcgacagggagacgcggagacgtagcgtgagccggaaaaagaggaagaaaatggtcgcgttccaaaacggttctcacagaatcaaaaaggcaaggtgtatctggaaggctgtcgaggcagaaaagccaccgaggagcagcttgcagagaagcagcgaccgacacgacctgtacatacacccacaacttccctgagaggcttgctagagccgaaagaccggtgaggaggctgaggagagaggcgcgtaaaggcgacgcgacgacggggatggaaagttcaggtgcagctcgacggagaaggatttttgtgaagcgaaggttttgagaaataatcgaattcgtgcaccttcaaccaaaatatgggatgtgtggaagaaaaaacttgaaaatggatctcagaaagctcagaagacgacctcctggatttcctgcagacggctttcttccgggaagaacacgacggcggttgagccaggagagacgaggaccgcgacggctgacagcgacaggaagcttcactcagagcagaagaactcatgcatgcgcgtttgtgcactaccaggctgtctttggagattcaaattcgcttctgaacgacacaaaacagcgacagacaggtgaacgtttaggcctcgcctctgtatataggagagagcgcgacgctgagagctgcctcccagagagggagagacgcgagagtccaggcgaaaagagaggagacggagagggagaagtcggagagaagaagggaaggaagagagagcgttgaattattgtggcgcttcttgccggcggaagcaaaaggagaaaaccgcccgtatgctccgtgatttttggctatccgacacaacagcacctgcggtggatgtacactcgaaatggagttgcggaactcgtccttcgaagtgagaaacgcgcagtcgcgaacgcgttttcttgttgtgcattagaaacaagacgcaggaaaatcgaagctttagtcacagtcaccttccctcactctctgcctggacttggtctcccgctgtgtgtacacacaggaccgcatgcgcaggtcctttttgcgcgattttcttggtgtgcatgcgtcgccggcgccaggtacccgagaaaaggtggaagacgcctttcgaaaccaagaaacgttctactttgtcctcaaaaggacttcctttcgtctgtgccgcgtatccgaccgtcctgagtctcggattcgttctgttcgggagattctgcggcgccattcgttctccctcgatctatcgcttctgccgcgcaacggggagagagagtcttctgcgtacatctcgctgctctctctcccttttgccgtcgaagcagacttaaaccatatcccagtggcacaacagcttgtttttcgtctctagcaagcttaaaggtccatggtaggcttctcgccgtcggcctcaccgcgtctcttttcctcgttttcgttccttctctttctctgctccccttcccgacacattctttgctgttttccttgttcctctttctctcatttcttcgtctttccccacgctccggtcttcttcagcccgcgatcgatgtccgcggtctctcctcaacgtcgactgtgacgaggtcttcacgtacctttttgctccagagcctctcgttttcttcttcttctctccaacaatctttgtgtcctcctgccttccctcctcctcttgcgactgtttcctaaacaggtatctgcttcgcacga

SEQ ID NO: 2908 - DNA, 2773 bp, Toxoplasma gondii
ctgtagatggttgagaaaagacaggtttctgtgaaatttcatcgaaggaaatggagggtttcaatctcttatctcgtgatcatgactgtagcatctctcgtgggcaaaagacggtgtctcgtcttgctctgctctgcgaatgtcgacgttgttaggcccctgcatcacacgtcgctcccgcgttttgctgcagtaaagtatgctgtgcttgcatctacaattttttacagaaatatgagcacatgtttcgactcgagctccagcagaaacggtgaattcggtaaagtggcaaagatggcaagttgaaaaaacactggcctcagacggaagcacggctcagggaccgggacaccagccagggaaaatgcgaatcgccttctcgtcagtttgttagattggagatgcacatgcggatgtacatctgtggggactcctcctcgaagaatttctgatatgttagaagctcctgcaagataaaacatgaacagacagacgaaaacatgaagcggaatcgtacacctctgactgctgcattctgcgtgccgtgaactcacacagaataagacatcggggagacatgatagggggttcgactgtcggatttcacagaacggacggatacaaccggatcttccctcttgtttttaagctctagaatatcggaggtgaaacggcttcataccagggtcctatcctttcagatgttgaatgtgcgtgtgtgttgctgcatgccacaaagttgttgggttgacagttctgtattcgtaaaacacatgatctctgcacgccgtactagcatcttgctttccgtaaacagacccaagcgctctagtacattcagagtgttttttcctcccacaacagatcgtagcagcagacagtacattggcggctcagttctagtgcagttcagaagggtctcctcgacgatacggcttcgtgttgttgtgcacttctatatcctgaagaacaaccatacaattgaagacgagtatgtcgcctcccgcaacagtttagtcacctctcctgttgcgcagtagaaggtcatagaaggattaaagattcaggaggaggaactcctgtggtgatcaccacaatgtctgtgcaaggcgttgcctccccttcgtagtccaccgggcccaatctatagtgtgactcggtttatatttagagtatgtgcgtgcatgtatacacgtacgtcatggaggaacacactcctccagatgacggtccaaagcacgcaagcaacgaccacgacaaagtcatacaacacgaactttagcgtctccacatttgtgagtgacctggtgaagcaacgcaacacgatttagacgatgtgccacaatgaaaggaatttccagaacgcttccgcgtctcgaaaagggagtgcagcgcttgtgtttcaagaactgtgcgaaagcagttggtacaaaggcgtccgctgttttgcctctcgttcttcctatagtctagaacacctcatcacatgcctgttgcgagctgtgttgtagtaacagtgcctatacctttctgtttctttcctattttgcggggggtttgtcttccacggaccatctcaagtgaacattttcccgtcgtccatagggaacggcttcttcatgttttaggccacagggcacatgtttccgctgcagtattgccacccccagaggatctaaaaactgctttcctggtcgcttcgcgcgcctgttgcggattttctgccgaaaaaccgaatctctaagttccctgtttctctggaaccgccgtgaagtcgccagaaaagattttcgtagcctagttctcaaaattcacttctggggatagggaagcgctctgcgttgtcgaattcctcccttcccgacccctaaaggttctgttccccgtccgccccggttgacgactttctcgcgcatgtttttctgtctcagcatgcttattggggtgactggggctgagacgtttgcagctagttgggggtttgcttcggcttttttcgaccgtctgatgacccgcttttcctttcgacgatctggcgcttcagtggttgtacttttccgaaaacgccggacctccgggagcctcagcaaaatttgcgcctgcctgcatgtcggtgactgccgcgtggcttctcgccttttgcgggtcacagtttctcttggccgtggtggcagcattttctgaacacttcaaaagggatttttttcaggagattttgcgcggggaattcgtttcgcggactagagctgccccccaaaggtgttcgactcgtgaacgttcctgcgtttccgacgcccggggcgggagaccctgcatttctggaagtcagccttccccccagcggggtgggcatttccggagactgaaatttctgcttcttcaaatgtgttcgacgtggcttttttctgtctcaggtgttgtttttctggtgttccctcgagcgatttggccctccgccgtttgcgcgttggcaccccaggcgtacccttctgtaggttccactccctgcggcatttggtcacgttttctagtcgctttttagcgaaactctttccacttttctccttgaatttcccctcttctctccactccccgtctccatcttccgcttacatatctccggaactccagtaaacccttgtttcagctgtcgagttacaccgtaccaggccccgccccttccctctccctctccctgctggcctagaaagccttgcttttttccgaatttctgcatttgaaccgcgtctgctttctctttagcaacaaaaaa

SEQ ID NO: 2909 - DNA, 2105 bp, Toxoplasma gondii
aaggtgtgtgattttgaaacgtctgaactggtagaacttctgtgttccatgtgaattcttgtctgttttgctttcaggaggtgaatcgaaagatcaagaaagcgttctgccctgctggcgttattgacggaaacccatgtgtaacttacgtggagcagctggttttccctgcattcggagagtttgcagtcaaacggtcggaagcaaacggtggcgatgtgacttacgccaccgtggaggaattcagaaatgcgtatatcaaaggaaatctgcatccgggagacctcaaggaaagtctcgcacgggaacttaatcgaagactggagccgattcgcaagcactttacggaaaatgagcatgccaaacaactgctgcagcaaattaaagcatacaaagtgacgaaatagggtcgccgtggctccatcaatgtgtggttccttaagtgtctacacatccgatgtactgttttgtccccggtacgggagagaactcggaaagtcgctattctcactcagtcgtgtcaggagggtctcaaatgtgtttgggaaagcttgtacctcgtgttaatcgccgaactgtatgggggggagacgcccgtgtttggagacacgagaatttttggatccgcgaatgggcagtggttgggttgctctcagactcttgaagacaccgtccacatattcgaccgaaaaacgatcaaaagttctccagtgttctgctgccaacggagacacatccacgtagaatgcacacagaaaggagagtcaactggctgtaccgcgcgcctgaccatccacaaaaaaattgtgaaccggtatcagccaacgcaacggattatagttcacccagctatcagtaggtatatcacggttactgctttccatattccttggcacagtacatgtggggagttagtatcaacgcaggtgcatgttccgctaacgatactgctgatcacgttcgacggcccaccggcgatggtagagcgtggtttcgaatgatgctgacttatgcagagagaacagaggctgtgtgtcagtggacgaggaccggagttcttagcagactgtcagcagaggaaatcaaggttgtccatccatgtgagcgaaagagaactggagttcttggtagattatgatttagaagtgaccccatttgagtcccggcgagacgggcattggcaacaaagctttccaacgacagttcgattcttttggatacatactgagcgttaaaaaactatgtttctgctctgcttactgtcttatccagagtttacaacacagagtggttcacgtaccgagtagcttttccatattgggtgaagaaccgactggatgcatgcagacgagaaaccagacatcgtactcccgttcctacggttgctgagtttacagcttcctggtttttgactagaggacgcacagaaaaagttatcagcttgcagggattctagtccctgagtaggtggtggcttctagtgaagcctaaagaagacattcgggaagtttcccgatgtgagagccgtaaaatctagtttccattgcaaagctgccgagttttccagttaaaccggagcaaacgcattcgcaaatcgtttatttgccagtgtacttggtgacggccttggtgccctcagagacggcgtgcttggcaagttcgccagggaggacaagacggacggcagtctggatctctcgggaggacagagtatccttcttgttgtacttgcagagcttgccggcctcagtggcaattttgtcgaaggtatcagcgatgaaagaagtcatgatcatcatcgacttcttgctgatcccagtctcggggtgcacctgcttcaacaccttgaagatgtaagagctgtacgactccgctctcttcttgcccttgcccttcttgccagagtccttggacttggcgactttcgcggacttcttggccaccattttcgtagaaaatgcaggaatgcgacgtaaacgattggggagaaaaaggtcacaaatgcgtgctttcgggatcgaaaactagaatgtgattctagtgaccacccccgcacgcgaccatcacccactctttcgtcccggcaccaggtgcacaaacggcga

SEQ ID NO: 2910 - DNA, 2579 bp, Toxoplasma gondii
tcgcgcatgcgttgctcagccttttcttcttgttcttcgtcctcagcggcctcctctgagccggttttcagtcgtttctggccgtcggctccaccgtcgttctctccgctttgcgcgcccgcctcccgcttcttccgccgcatctcgtccagcgcgtgcaccgcggtcttcgcgtataaagcgacctgccgcacatcggcgtctggccaggcctgcggcatcactttctcgaggcggtcgtcggccacgaggctccgctccccggcttcccagaaaggcaggccttcttcgccgcggctatctccgtcgaggtgctgtccctgggccccctcgagggcgccagggagctttatcggcagggtggggtcgaggaccaaaagcgtctgcgtgcgagaggcagccgcgtcgccgagcgcaggcgcgaagacgctgctggggagctggcttttgtccccgaggcccgagtggccaacgggggcgggcaggggcgcgccggcggagcccgcgagcttgttggcggcgggggagagagactcgaagaaagagacgatcttggaccgttccagcacgttgatgtaccgatggcctttctgcgcaatgtagctatatgtgtagagctccttcggcgtcgagagcagaagaaaaatgtcggcgagagagaacgactcctttcgacggctttccaatcccgaaggcagagtcgcaggcaagtagcagttcaactcggggaagacaagggcctcttcgccgcggacgacctccaagcgacaggaggctgaagacgcagacttcttcaaacttgcgtggagcagcgccaggggatccacgctgaagccgctcgctttcccggtagagtcaggaagcgaagtagaggaaaaaaacgacgcagaggagacctctggcgaggcagcgacggggccatcgctctcgtcgcgccctgccgccctgctctcgcttcctgcctcctccatggtgacgaggccaggcaaacgacggcagacgacgagacccgaactgagttgaagcacgcaggattgaactgagagtcagttccgcacaagtcgagagcagaggaacacagaaacgacggcgagcagaacgatggtcaccggaaaacgcgggtcccgaaacaccgaggcggaagaagacagatgcaaatggaaagccgtgaggacggaaacactgaagaaaccaagagggaagaagctttcaccctcgcactgcacctgcctcctcccttctctcctctcccgtcgccgtcactcaccagatcagcgacgccccaggaaaaatggcggccaggctggactctttcgcgctgttctctctctgtgtcctcgtttgtcccctgcactgcgtcttctctcgcgaatgagaggagcaggaagaactagtaagacgtttacggggacagctggaagagcgtggaacgcgaagagggtggaagcgagtagcctcgagagcaggaagagaaggcaactgcagtgaaagaaagtcgagcgccgcgtcctcagacaactctcgaacgaggccctgaggtccggcggcctgcacgggaggacggtaggatggagtcgggggtttgaacgtggggacgcggactggaaagaacgatatgggagagacggtggacatcaggggaggacaaggcgaggaaaaacaattgaaaagtgagtttcaggtctcttttctctgttcagacggaactggagactgccgctgtcgcgccactgtgagagttggacggcctaagaggtggcagacgaaaaggactgaatacagactccggagggaagagcagagctgactgatgcgtcctcgttcgtcttggctatctttgtcttgcaaactcgaggcaaaagagaaacaaagaaagaaaggacttgaggtgggggggaagaagagagcgacgagatgtcgatccccatcgcatgcgtgcgctcgggtctccagaagtacgcgaaaaggcggaagaagcgggctcgttgtttgtagcttcattgacggaagagaaaggaaagcaagtccccgtcactgaaaaagcgaggcagtattatgtttccgcatattctctgccgatccgcaaaaatccgtgtcattcctttgctccagcgaaccgctgcaggccccgtccccagccagccgagcatctcgctcttgagcccgcgacccgtacgctcaactgttgtctttctcgtctttctcctcttcctttcctctctctcccttccctccgaagtgcccatgattctcgcttcgccacctgctcgccttttctcctgtttctatcgccgttttttcttcctgttcgcgcgtaggagcttcttctgatcgacgacttgtctccagttgggggtttacccatgcgtctctcgttcctctctgtctccttctttggttggtcagtcgcgtttcgcctcacctgactcgccgtcctgttccctccgaaaaacgcgttacatttctttcccccagaagcgcgtttctgactgttttgccgtcctttacgttgcttcacaccagagaaggtttgggcgtcgacagaaaagtggggaaccgtttgaaagaatagacgaaga

SEQ ID NO: 2911 - DNA, 5032 bp, Toxoplasma gondii
gaacgcagaactcatggtggcgaagggacgacttgttcgaaaagcaggggagacgggagaagggccaaaaaaggcaggcactgacgaagaggaagaggcagaaaatcttccgcgagcagcttttctgcgctgagtggaggattcagaggctgtaggcacttgcgtatgagccagatcgcggctgcatcccaaatcacccgcagtgcatgaatgtaggaagttgcttgaggctctaatctcacttccactgctggctgaaagacgcgtcgaagcgcggctacacctttccgccgaaatcggtgtgcaagcggagctacagtctctccctagatcgctactgcgaatgcccctgcggatctcgcagaccagtgtctgaagtgcacagggaaaagaaataagcgatggacgagcacgaatgcgtccgcaagatatcgagaccattttgctccccttttgccaaaagtcgcacagcaaaggatttcttttcgttaaacaatacacgacaacacaccaggtagaaacacgtggagatgtggcatttggaaattaaccacagcggccgaggttgctgtacgcgttgaaactggaagcaggggcttcgattacaaataacacatcgggaactttccgcacaaagaacatatgtggtaagtctgccgtagtcatttgaacctctcgacgcatcggacaccttcacctgaacaagggttcttcaaaggcaaacacgacgaagattgctggtgtaacagaaggtacagtggcgcgggcatgctggaaaacatgtgattctataatcggtgcaagcacacatctgcgctggacagtagtcatagcggatgcctgtgtgagtatattgctgacaacggcacgtggcttaaggggatacaattttccagaaagacaacataagctgttccgatgcccctgcagacgactgtgaacacaacactcagaacaaatgaattggcagaaaagacaaaataacaatataacacttgaccgcgaacatgtgagagatgtcatcgactagcagacaaaatttgtgcatgcactgctcgtcagtgttgacaatgtcacgagcggagccacgggcctaaaaaggagagaaccaagtaactcagacaaatttcgttccctgacaaacaccatgcttcttagtgaagaaagcaaacacaaacgaaaaaggatgcggagaaacggagtcaagcgacaagcggccacacgcgcactagcagcacagagacgtgtactttgcgcggggctccacggcggaaagaaatccaaagtacttctccaggaaactgaacaccatctcttgagagaacacacagaacaggaaggattgattcctaacaaacggtgccttcggaggagcattctagtgtcagagttgcggcggctctgttgactgtgtgaccgtaggatagtgccgaagatagcgcagacaaaaggttcctgccgtgatgccgatctgctacccagacgatctggtcgcttattgctacgggatccccgcagaaatgccagttttccttaccttctgctctgcgccgaagcacccaaggagacgatctgcttcctggttctctccaaaagttgaaactatttgcagacagttgagcttttgcctgctgaagtaggcctgagcgtccacgtggccagtggtctgagccacactacaggagcgacggtcagcgctgcttggaagtagagcacgaatatcgttcaccattgacagagaaagaagacgggataaattgtaacccccagcttaaatctttgcatgttcaaaagcccccctttttcgcctattgattttcccaggggggcattgagtggcaagttgaacagttggccgaggttgaggaaagcggcaagcaacgtcatggcagctggccgggacaaggcggccggtaacgatcagatgaattatcagagaaattattccgtctgatgtaaatgtgtcagtgaggcacgtggtgcatctgtgggtacattggtttgatgattgatagaacacagaggaaccactactgctgcttaacgcagaacatagagccactagccgtactcaatttgaaacattttctgttgggctggcggagacgatgaggtctttaccagttgagctatgttgtctgggatgtgcagaagtcaactgggttacggaaaaaagcatccgggatattatctccatctcccgctgttccgcattcgccaattcacagcctgagggatattctactggatttcaaagctagcaggacggaaacaatcatctgtgccgctgttagcccaacacggttatgatatgatatgctgaactgccggaaggtgaatcaactgtcacactcagaccgttgagcgggtgcctgatcgaacagactgtatcacgggttcgccttttcaggggagcacaatagaaactcctgaaaagaccttcagagctcttaaaactagttccaattaacatgtgcgaatatttattcttgtagcgcctccgttgccccgcaactaaacggcccacttcaccggccatgaccggtcgtcaggtttcgcgaggctggttattgcgtctgtgcttttacagtattcatcggaggtgtctgatcgaaaaggatcgggttcctgaaatagcttctggcacgtaaagttgctaaaatcgaatcaccagggacagtcaatcgagatgtgcgtgatgcgttgcatcaagcaaccgatccgacaatgagttgcgacaagtgccatcgagactgtaggacggtgtgctgtaaacgaaagagacatacggtccctgccagcaaaggctttactgatgtggaaagccttggtgcggaactgctcgcatcgggtcacaagaccaactgagcggaagaaactgtctttcctaaagagcgaggaagtgtgagtatccaaggcgacgcagcagaaatatttgcgcaagcattgttcagccactatatacgccagcatcccacttgtagtaggagagatatgaagaactgggatttcctgcatggtagtgaatccgttatttgccaagaaacttctttcatgctacaactggcagaacgtatctatagcagcggggagcatttgggggcactcccggtgcgctgatccgaaaagcggccactcttctaccaaatgacgcaagaagggcctcagtcagggatctaaaataagccttccttggaagcaactggtaggagaccctcacctcagaggcggcagcatttgcacacgcataattctctacaggttcgctgtacagaagagccagtgaaagctgtgtgtcatttggaggcacatatcccttcgacaactgcttgcaggggcggataatctggactggcgttatccacttttttcccgttatcgttcgcgcacatggactgccttcactccgtaaagctgcttccgaaacaaacaaaccagcaagacacaaactgacaatgcatctggcgcctctgctgcgttggctttccgcttttccatcccgcggaaggtgatagacaaaacgccctaagaactcaccgcctccgaggtttttcattcggcgaccatctttagtcgacattcagtgaatgggctctctctgcaatgcgctcacccgcaaacaccggtgaaaaaaggtcccactggatctacttcggatctttccggaggagatgcagtgccttcgacaattctaaagaacgatgctcacgagagaaaacgcagaatcattttcggattttcgtgtgccacatttctttggttttgaaggcactgcatggcactgttccaaacacagctcttggcgtcggtgtcttgccaacacgctgcgcgaaaggcgtcacttgtcttgctctattcttcgagcgactcccgcaggttgttccgacgtggtatggatatagccgcactccgattttggttttttctgcttcttttctctatcctggatactttcttcaagcccacggaagctacgtcccaagagccggtgcgtcgctgtcgcgagtcatttgtcgtcacgcgacaccgtcagcttgaacagacggtccgcccctccgcatttgtcattgaatcggaagcgtttcaccagctgtggctttcgcaaaatcgaaaacaattggcttctaggccagccagaaagtcgccgagacaaagcgattttctgtgaatctggtttcccaagagtcctcttcgtttttttttcagctactcaagatgccagctcgacaggagtttgtttccctaaccttagtttgtctcaccgccgacgatcgacatttccggacctgattgcatccacatctatgaactgaaccttttaacggccaccgtacgcgatgtgttggcggctgcgtgagctgcgttgcttcgctcctgactcactttctcgacaagagtaccagctatggcgaagcgaatcacgctactccaccgtggcggttctcgacatagccgtattaacttttcccgttgctgcagccttcaacgaatagcagtctgccgttaattgtgttgtgcttcatacatcagtgacaccgcacacggtgccgaacccctttttgtatcgtctgttcgtccttttcgtacatcgttcccggcttttttctttcgcttcaaagaccttctggtcttaacagttgtgcacgccagcgttttgtgcgttgtttcttgattgaaaggtgcgtgtcatgcatcctgctgcatggtcgctctctgaaactagtctctggcttcgtatggcgtgttgccggtgtctgcgaccttaccaggcgtctgttccgcgacctgcctcctttccccttcactaccatttgtaaagttctttcgaatcttatgttagatgtcggcaaaatggctccaaactctcacttgcttccttctcgcccgagtgccgcccagcgctcgttaccgtcttcagtgccaggaagtcggaaacagagtgagggctcaaactcggaagcagacagtgcactcccgtgtagcgcctcgcacaccacgtcggattcgacatctttgtttcgacacgcggcca

SEQ ID NO: 2912 - DNA, 1786 bp, Toxoplasma gondii
tcgaaaacaggccttcgattggttcatttccaccttttcgcacatggagcgtggggttccccatgctgcgcctcctaagcctaaggcgaagaacggtttacgaggatcgaagccgctgcaaattgaattcagcgacggaaaacatgttcgcggctcgcagcgaagatgtctgtacatgagaaggagtcgcccggcatcggccgagagagctaaagaaaagctgcaggttcaaaagaatgagaaacatggtgacacgatgagaagtctgctcagaggagtttaagacgatcgtggcagagtgagacatgcttaatagaaagcgttgtactcgcgacaactagcttgacttcaacgtctagtaaaaggcgtcacaacaccggaactggtcattcaaagagacagatgttgacagatcgatttgagaaaagatagagagaggtaggcaggtggatcgatagatgtcgtcagatggatttagatttacagatggagaggtagatcaaaataggcatagatagatggatacagattgatgtagatagaaatagatatagatttacaggtagaaaaagatgaacagagctgaaaagagttaatcagtcagtgtacgtgcgtcatactaggtggacgaatgtaacagagtatgtttgtgttttctttatattgttttgttgcctggttgctaaccgttcctctcaagttctctcgagataaatgccaaagtgtcgagtgttctgcatgtaagccagctggatgggactctgtctctctcgctttttaggagaccacgaaatagcggatgattcgcagagaaaagtatcttcctgtagctgtcgcggagctggagttttgaatgttgcatcctgaagcagccttttctgaatatgcgttctgggcgttgatgcccacgacccgacgactgaagaaaagaggaagttcagtcatttacctaccgctggcgctctttttgtctacctctctgtacgctgtgctgtctctctgcctgtgtggctgcttttcgttctctctcccagccgaacaacaagaactgtgacgacctgttccgtctcttctctctgtcaaggcatgcagagaaataagaagaggtgaaacattgaagctgtggagtgacgagcaaggaaaagcgcgtcgtgctgctcgcatgcgtttttttttcgcgttgcggactttttgcatgcgcgccgcgatcggtttttttccagcaattctgccgagcattggacccgtggttctgggagttttcttttttccaaagtcgcatttgcggccagtccttcctctcttgtcaaggttggaaagagagtggatctgaacggagtttctgcgttctcttggcctgctccggagctgggccgaagaaaaaaggagacgtctcattgaaaaagagaaagaagacaccgcggaaaattcatccagctgcttttttttgacaattgctttctctccctctcatcggcaatcgtctcctttcttctctcttcttccctcttcttctctctttttttcgcttccaacagtccactcaagcgttcccctcaacggtctcccgtttctttctcttgttttcctctccttcgtcctctccttccttcacttcctttttgcctctatcttcttcttctgccctctttctcattcattctctcctcttcttttttcctcctcgttctctctgttcccctcgttctctctgttccgctcattgtctctgttcccctcattctctctcttccccggtgttctctctgcccattctgactcgaga

SEQ ID NO: 2913 - DNA, 3418 bp, Toxoplasma gondii
atctcgcctgttagtcctttcaagtcaggcagagttgacaaatgacgattcgggtgtgtgcagttcgagtctcagcaagcgtagatgaacgtccggtggcacagactcgcacagtctaccggcttcggcagaaattcctcctgacgccgcatgacacgctagaaacgaacttacaggtacaatgtcaagtgctgctgcaaaccggtagattcctattttgtgtcggggggtcggaacgttccagcgaaccacaggccttcaccctccctcctcctgtgtctgttgtccacctttcgcggcttctctggatctccttcctagagacagcacccaaacgcttacgggagagtgtacagatgatgcaccttgcatttcccagacgcacaaaatagcttcacggcaatcggcttatattcgggtcagaaacctaggggctcttgcacagaagaacccccttcccccttcccccgcccggtgtcgtgtgccgtcgatgccaccttcctccgggcgagagttgcggcagagtcgacagtccagtgacagcgagcggtttggtgagcagctggagggtgaaagtcaacaggtgaaagcaaagtagacagagtttttgcgttgattcggttgcctcattgacgtcattgaggggcatcgtgtgtcgacagggacagccgctgtgtgtgggttagagcgtcgcccgtgaactctcagtgctgtgcagttcgacgggaaaaaaggagcgtgaatctacctgtagaccgacaggcgtcttgcctccaaaaaacttgggaaaccggcatgctgagaagcagatttactcacaggagctcgcgtacttcttcggcgagtcctaaaacatcgaatgtccctgcatagaggaccgctcttgaaagcaaggaagcactcggtggaagcgaacctctggaacgccgagaacgagagtctctggaaagcgccggaagccgaaccgagactcgagccaaggggagagtgacgagtgtgtctgtgcaggcatgcagtgacctcgtcgcgccccgaggtggaaacagaaggcattctcgagaggaaatgttcagtcacgcgttccgtttgtttcttgcatgcgtaaaaaaagaatggatgttgtttgatgcatgtttatatccttgtgtttatgtttgtatgtgtcagtgggtttcggggcaggcgaacgcgaacatgtaggtctctgctgctttctatcggcgcagattcgcctccccagagctccagagagcgctgaatcaatagacgacttcccagaggacgtgtagacgcatacatgcgaggttgtacaaggaactgcgttgatccgttcttggagagacgcgcttccagtgtttttgagagccgtaagtttgtcttgacacagagacacacacgggaacagaaaggctgtttcgaaaaaccacgtcgcggaaaggaacgtctgcgccggtggagtgcaacagttttgacatgcgttgcaacgaggtgtgttcgagacagaaaggagccgtgactcttaaaacgatcggctggagaagactggaaagaaggcaggaaagaagtatcgacttccgcagcgagcagcaaagtccattcagaccagcggcggaataaaagaaaagaggaagggtgcgattgctggcgtcgaacctgttcacacctacgagacagacagacacatgttcccgagtctttgaagacgcggtgaactggtgaactcaatggcacaacacagttcggatccgggcaaacaaagaccttgaagatctaaagcccaagtccacctcgcgacctgaacgcgtccgagagaaaacgcctgtaactgatcctgtctgagaggcgactcctctcagtccttcgctgattgagtttctgtgagcaggcaggctgttggcggggagacggggactctttttcagagactaggctcctttgagaaaggtccgagcctgtgatctgtcttgggttgtgaagtggagaatccagagcttttgtcgactctgcttgtgtctgttcgcatccggttcggtcgtcggtgtcacctgaccgaaccgagaaatttcttttcgacggttcgatgcatccgtggtctcgaccgcgttgcgctgttcagctgagttcacgacccgcatcgagttcctttccctccgaagcagcgagcagtgtccaaacacagaaactgagaaacgagaaaaaacacaaaaacggtgaaagaaatgcggcttgcgcatgaccggcttctctcgtgaagcggccacaataaactggctctgtcaaaaccggaagctcgagagcccaagccccctgtgcacaacgaacgccggtgcgaggtctgaccatgagagcgtctcagtttgtgtgcatccaggaaacgctcgtgaactgcgtttttcggtttcgaaagttcatccgcgctggacaaagaacgaaaactgcacacgttttgtgtgaggacgttgtcgatcgccgggcgagacggagacagcgcggaccggacgctcccagagggcgcgcctacctgcgatggcaaagaggaatttctcgctttttcgaggaaccgcacaggcaaacgtagctccagttgaaagccgacagagaacgtcgccttgtcagaagagaaaacgctctctgtctgaaaagtcttgaccgccagtccgcctgcaccctccggccgcaaccccccaaatgtcttctgtcgaacgcgttcgacttttcgtggaacgccgtgacaaaggaggtacgatgaagagccgaagagcctcaagaaatagaggagacagcggccagaatggagaaacattaagtcacaaatttcagagttgacactcagaccgcggacggcttgggtggatgggcacctgcaaccctcggcgggaaccggacctcttcttgtctcgccgatgttcacctttcctcctgcttttggtcgacttgtcttcttcccttccctttctcttcttctccttttctgtttctcttcctctgcagcctcgcttgccgagattctttgcttctctgcatgccttcgtctccactccccgtcctctccttgctcctctctcccttgagagcccagcaccgtcgacaacgcgttcctgttctgccgacccagtgtctgtgctttccttgcccgttttctcgcattccgcttgccgacatgaaaaaatagtctcggccagctgatctgccttcgcaccaacctgagacttttgtacctcgcgtcctcttctgtctcctctctccttctctgcgctcgacttcttaaaccgtcgcgtccaacatccaccagtcctgtcttgcgctctctcttcttcttctccttcttctgttccttcttctgctccttcttctcctccttctccttctcctccttcttcttcctgcttccactggccttctccggtgccgttcgcca

SEQ ID NO: 2914 - DNA, 1854 bp, Toxoplasma gondii
gtttcttttctctctgcgtcctgtcgacctctgttcgaagctccatgtcccccccctgtcaacagacatgtcctggcgcttcgccccgaaaacaggcgccctcccaaactctgtgccgtcacacaatcgcatcgagagagacgtgaggcgcgtgagagaacggagacaccgcgtccctcgcttaccagagcgagagtatagacagtgaagtagaggacggcattgcacagcgagacaaagtagtcgaactggccgagaggtttcgagcgaattttccctgcaatttgattcagtgtgcccagagacaccaccgcggctgcgcaggcgatgactctccagctgggcgaagcggcgcccggaggcgcatgcgctggcggcgagaaggaagcgttttcgctgctctccgagcggcctgactcatcgtcttggctctcttcggaaatccgagacccagcaggccgacggggcaggacgcctggggtctggtgtgtgctccgcgccatcgcggactttcggcctctactgcgttggaagtccttgggggaggcattcgacagttgtgacgttgtgtcggtcaccagacgctctcttccttgcctcccccctgctgcagcaatcggttcggctcgagatgtcaagaggaacgcaagcaaacggcgaagctgcctgggtgtaccacgcagcggttgagggattcccagcaaatgtacggcggcgtgagctcttcaagcgctgactggcgcaactcgccgtcgcgtggaccttctccgctggaaacgaagaagacgcagggagggaggcgcggcgagtggagattgctgcgtctcgaagagctcacgccggcgcgctcgtcaacttgccgccagacaggcgggaggggggggagagggcgggcagggaagacgagagaacttgaggagcgaaggctaggcatgaaaaggcgacgacgcaagaaaaggatttgtctgtgaatggttagccttgagacagaggcttgagagaacttgcgccggggactctgccgacgaggaaagacgacccaggaaccagactttccagcgcgagaagtgacgacgcgtcccggagacaggcgagaccggctggagtggaaagccaaggatgtctggacgcctttagaaaacgcgttgtcatttccaggtctgcagttcacttctcaagaagaaagcgaagagaaggagagaagaaggcgagagaaagaacgcgtcacgcacgacgaagccgccgcgagcaacctctccgcaaggccgtccccgtctctagacagctagggccagaaccagcgaaaaaaaaagatgcttcaactctccacgttttcctcaagccggggaagacagcaggaaaggaactcaaaagatagcgctttcagctagcttcggtttcttccagtgtgcacagcattcagctcgagctttttgcgggagaaaaaagagccgctgtctctcaacgttgacgtctcttcgcgccgaggattcttgcccccattcttctcttcttttcgcttttcgcttttcgctgttcgctttttttttctcgtttctcctttgactctccgttttttctctttttcgcccccaccttcttctcttgccccgcgcgtccgcgctcttcttctcgtctctcgagcttccggttcggtgctcccttttctccttttcacttgactccggtttccgcctccgaggcttctctcgcttcctccacccgcccgcgcctttccgagcttttttcatccgaatttcccctcgttcgctccctctccttcctcaccagaggtctctctttttcttgtccgccgcttcttttcatgttgctccttgaagactctcgcagcca

SEQ ID NO: 2915 - DNA, 1722 bp, Toxoplasma gondii
acattcttggatgaagacgatgtaataatgaggacggtgtctaacggtacccgcgtctgtagttcccgcggtggtttcgccactttccgctcccaagcgatgcaggagctccttcacgtggcagacgcgccggaaggtttcgcggtcggcatcttcggttttatgtttcttagctgtcatagtctcatccaattcttgttctgaaaaagcagtgggagtcggtcttttccggtggttttgtggtagcttactcaatgacgcgtgtgccaacatttcgtgttcgatgctcttttcgatgcccgcacgcgcttcttcgtgattcctaatctgttccgatgtttgcctgaggcgtttttcgcactcggcaatcttggactccagatcagccacttcctgttcagtctaaacagaacaacgctatatgccgtgcaaacgcagcagctgtcctacagaaactcacggacgaacataggtcctcgttttctcgtttccgtaaaagttcggtctgcacgtcatagtcgagaagccgcttgacagcctccagctcgttaagtctgttgtctgccgtggctgtagctcataatttcggagagagtatgacgcttacctggcaagcatctctctgaacgcatcgctttgactcatatcggcactcatcttgaaagaaaacaagcagcaacgtgcagggtgtgccaggcgagggagtggcactttcgattgaaatatccactgaaggtgatcgcccatttgttcgggtaatttgaggtggacatacaccccgtgctgcctctaaggtgggtttctgcgcttacctctgatcatctaaagatcctgttcgaactctttgtggttaatggtggaaggttagccatctgtgaatactccacagacttgagtagtaaacagtcggtctttgctattcagttgacggcagttctagcgtcagattcctctgccagaactctgtaccggtgccccctccgcgctgtgtttttctcgagtgtaccagtcgcgctctaagtttttctgcagcggtgacccactgattccacacctttggtacatcacgccaagcactggctgtcacccgagactccaaccagttactctattctgcattcaggttctttcactgcgagcctcgctaccgtccaagaatgcctccgctcgcaccattatcactgagtgtcgtctggtgattgctccatcgtgtctgcagcggaaaaatccttccagagctgcttcagccgtgtatccatgctatatgcagggtaattacatattgaatagcacgtagtaatttccttgtaggtgtccaaagcagctgcggcctacttttgtggttctaactgcggtttctggacaagaatcgcatgcgcacgctgcatgcgactgcgattgcacgcttcacggggcctccgaagactagacatggtttgaaaattgttgaaaattgttggtgattcattgtttgtgacgctgtcaagcaacttcttggcgagtggggtacggaggaaggcatggcttggtgaactgtatgtgcgccttccttcttaacattctacacgtatctacggagatcagttccacactacgaggatagaaacgccttgtccctgatggtagctcttcggcatgcgacggggggtaccgggcgctcataacggcaggactcctctctttcattcttctcaaaagcctaacgtttttctggtttcgtca

SEQ ID NO: 2916 - DNA, 2057 bp, Toxoplasma gondii
atacatttcttgcaactcgttatcctcttatgcccagtgagtaccttccgctcgtgttcccctgttggttcaattcctcggcacgccaccgcttgtagcgctcaggacgaaatcggaactgtgcttgttttctaactcgtgcgcttaacagcttatcgccattcgcttctctccacgctattccaaaataatgctccccttctaacccacgatgtccaccacatgcgttctccgcatttattgagacatctgaaagtgtgtaaaaggaccgatgcaactccacggttccttcaagagccctgggggaatacaggagctgcagatctaatatagggttaagcgagtgggttactcctatctcagtggctatcggaatgggaaagtggcaacgcttttgcagaatttttttcagtgcacgttcttaacccagctcacatatcacatctgacggtgaactactgtgcctgcctggatcttgttcaataccaaggggacaatgggtcgacatagaggtgctgatgctatccgaggtttcgagctcccgtagttatccggccggttatccccggcgtctctggcgaccgtacggatgcaaaacacctgccacaatcaatttatttatcttttttcaaacagacttccgctttgatggaaccatgaaaccccgaacgtcaaaggacagttcggagcgcacgtgatcctctagcctcatccgagccacaactgcagaagccttcatctgtatctgttacaattctcggattggcagacgcaagtttcttcgctctcgcttttaaaagcaagacatgatttgtgttcctggtgccactagatccgaagatctactaccgagtagacgtcaaggcgaagcacaggctgtttctgtgggcgccgattgcttgtcagtgagcgctttagagtgttctgcaagaaacacaaagcttcaaagcatccgcccaagacattcatccggagattcgattcgtttccagcttcacctctctcccaaggcgtgcgtgcttcctgtggatgcggctgaggtcaagcataaaacgtctgtctatctacaaagcgcactaaatgatcgtataaacgtagatgcggatgttcgtttgttcaaacacggctgcagaaacccagattgcctgacaaatcgaatgcagcttctttgcgcactggaaacagacttttccagcacatccacacggacaccgggggaaattcttcgcattatacataggaacacatcgaaaggactttcaggtatggaacggggcatgaaacaaaatctttttcaaacaggaacgtggcaaaaaatgtgtggttggcaactggcgcatgcactgtgtttgatttttcgcgtgttttgaggcaatggcctcgcgttgcatgcacgttgcgttctacgctttttccaacgccgacaaagtcttcgccacattttgccgacacgaaagacccttgttcacgtcggaagctccaaatttgaagttgtgagccaaacgttccgcgttgcatttcaggtggaccagcttttctggtgtggaaaaacactgtgtaacccgtcatttcgttgtgcgttttccttttgccctttcgtggacaagggggtttgccctctcgagttcgttaggacgacgaacgcgactcttcaacgcgccagtgaacttgttctgcgtgaatgcacgcgtctccgcctttctctggaagctgtcgccactaagttcggagaggagaacccctcacattcgcctgcgggagacgttcaacgcggaaaacgcggttcgtcacttggaacgacattctttagagcgaagcagcgagcagacggactggaaagtgggcagaacgaagcggaaaggaaaagacggggacgtatgacttatctgctgcaggcgtggacgcacagggaaagaaacacttgaaaggggtcacctgtctttgttgacggagagagactgctgtggagagaagcgacaggagagagtgttttgttgtcgttcccagaggactttctggaggaaaggagaggccggaggaaagaactgtcgaaacta

SEQ ID NO: 2917 - DNA, 3495 bp, Toxoplasma gondii
ttcgattcgctcacagacgccagtgcggagaaagcaacacgtttcagcctggggggcttctctcccttcttcccctcttgcttcctctcccccgagtctccggaactcgtccgttgccgctgcgtcttccttcgcttcttctctccgttcaccactcttttccgtttccctcttgtctccactcttcttctcttcgtctccacgctcctcttcttcgagaacgtcgagctcctcgggctctctgacttgtctgtgcaattctctgcactgagggcaccacaggaggtagagggacagatagtctctctctgagtggaggcgcgattggtctgtcttcttcacctcggtggagtgggcggctctgaacggcttcgcttctccggcctgtgaagccttcgcttcgcgtttcctctcgcgttcgcccgtctgacttctctccccgcgttgctcggcctcagcaagttctgtcactcttcttctttcggaactctcgaggtcgcgtctgccgtcgacatctccctgggttctcgtggacgccgggagtttggattctgccgcgtcaatcgaactcagaagcgactctccttgcaggcttcctccaggcgttccactgcatgtacatcgacaccgcgaaaagggaggaggcggcctgtctgcgcggtgtcgcgcgtcaggcactgtgactgctgggggagaatgtggcggctccctttcgccttcagtgtgtagagagggtgaagaaaaaaaaactctagaaactgagagaagcgcagggtcgccggacgcatccccgaccagcagcgcggcttcagagtctctcgccttccccacgagagactcggcctcgccgcgcggaaaaaaggagctcgctcccgcggagaagcctggcgcagacggcgaagaaggggaacaaagcagacaacgacgaatacctttgcagccacaacgaggcgcaacagacgactcagaaggggaagagtgatggggagaacagaaagaggaaacggaagaagaagaagaaaacgagggagaaggagaagaggaagaagaggcagcgtagagacaagggtgcgcgggatcgattcgttgctgtgttggcgggcgctgttgagcgccttgcgagttgtgaagtgccattttctttcaggaggactataggcgtggagtttcgagagaaggaagagacttctgcgtctggggcgaggagcccgaaacgctaagacatcccttccactttctttgagtttattccgacagttttgaggcccacaacgcggtgctgtgcaggcacatgcaaaacggaacgacgccgacgcgcgaagggcgcttggcgaggacctttcgtcgtctttcctcttctctctttcttctctctttcttctctctttcttctctctttcttctcgctcttctttgtcttctctgctgctggtgtctagacactcggcggggccttttccgtctgtttcttcagtctgcatgtgtgcgacgccttcgcgatttggaaaggctcgcggaactctgcgcgggcgcgcatgccctccctccccaactcaacatctctctcgtgtctccctttgcttcttctctccgtctcccgctcttcttcctttctccccgttttcttctcccgccctctcccttctccccggctttctcttctctctgtcatctctgtttgcttctttcttcctgctttgtctctcgcggttgtctttctgttctgctctttttcgggtgtcttcgcgccgctctcgaacggcacgcgacgagtctcttccccagccgaccgcgcggtgccagccaggaccgtctctctcgcggcgggcgcgctagcgcagctgcggcgccgcgcggcattgcgagtccgcaggaatccgacgcagagagacgggattctgcagacaccaggccgttcggggacttatgtgatttctcgcctcaagtttctcggtccaaagagcgactcgtgtatgagccaacctgcgccggcgaaaaggcttctttcggcgtctccgcaggtcccggtcgcggttcccttaaaggcggcaccagctctgggggagggtcgcgctccagtgttgtaccgacacccggccaggtttctgcatgcgcggcgagcgcggcggatttctcgcgtttccgttttttttacatttctcagcggagtctcgcgggtgtctagcagagagccacacgttgggttgctggctcgcgacgctcgcgaccagacggcgaaggcgacgccacctggagagccgtgcagagtcctccggacttcgagaaggcggcctggctttcgagagagagaatccagaaaaaaatgcagaatgcacgcgccggatgggtctgacccctcgcgggcaggccgcagagcacggctgaaacgcagtcggagacgcggcagcgccctccaacgctggctggcagaggagacagagacagggagaagcagagcaagcagtcggcagcggagggtgaaccgtaagaggtgcgagagatggggagaaagtgacagagacatagcaacagatgcagagggggggagagaaggaccgataggcagcgacagggagacagggggagacgcagagagggagatgtagacggagagagagaccgagaggtagacagcgaggagagtaagagaaagagacagacgtagggatggatacagaaaaagaggcagacaatgagatcaagacaggaagacagagaccgaggcaaggagagagatcaacaggttgatcgctagaggagagtggggatatgtggaggtgaattcgaggggatgaatgtttatggagacagacagatggacagcggcgtccacttcgtgtaagagtgacactcagagaaggctcccagagacgctgtatcacagaaaatcgcgtcttccgaatgtactgcgccgcctccatggaagctctcttcagaaaaagtttcgtgcgtttctccgtatcgctacgtacagagaggcggccatcgtgagctcctgcctctgctgtgtgtcttctcttttttcgcagcgaaaacggcgggagagcagcctgagagaccaggaaccgtcgtctctccggtcgctgcttccccgtcacctttcccggtagtgtatctctcgccagacaaaggaagaaacggatcagagagagagcgacagagagacggatactcgtggttgcatccgtcttgtgatggttttggtccgttcatgcatgtccgctgtgtctcgacttgcgaagttatttgtgccgtcctcacggctccgatgcgctctcctgaagtgagttcccttccttctgcctgcctgggtgtgcgtcgcggatagcacggactacattttcttttttcctcctctctccgttccgacctccgccgagacgcctgtggccgacagaggcgcggcgtttctctgctgtctgtttttctctcgtggaaccgcttgcgtcgggtggtgctttttttcgagagaaacccggaaaacttcagcagaga

SEQ ID NO: 2918 - DNA, 2627 bp, Toxoplasma gondii
gtttctctgtcctcattgacttcaccgatttgcgagaagggaatctgaggtacaagcaggcacttggtttcctcgaagattcccgttctagtcgtcctcccgactgcactctttcacaactacataatactgatcgctccccttgtctgtcttgccgaaacctgtcaactcctggtgcatgaaccgcagttccgattttctctttggaaagttgtgtgcttgtttttcccggcagcttctaccttgcacagtccagatgggtgtagctgcagtaataattctgattggctgcgacgcataacgcgagtcagagtcggtattctaggaaccagcatgttgctattccttcaaatggagttaaacgctagtgacacgaaagagcatcgagggcgggacactgtttaatttaacggtacaacttgtaaacaaacaagtcgtcagtttgtttaggcaagtaggtataaaccgtagaaggattattccattagttgcaggtttcgggagtggctagactgttgtgttgttcatcaaatggtttcggatagtggtgcggtaagtcgtgcaaagggctgggcactgacatgacctggcgcttcagcaaaagaaagtcttccccagaactgacacgacccttacttcctgtaccattgggctgggactgtatcatgtgatcttccggtagcactactaagcctcttcatggcaatatattccacggaaaagcttcgttattgatattccgttaacccgttgacgacatgaaacaaacgctccataggtttcggaattatataggatactaccgaccccaagaacagcaaggcctccaattgaccaatcagaagcctcgggacttttacaaccatcgagatagtccttaattgaggatttggggaagggattatgtttgctaaaccccattgttccagcttctaaaaactctatttagtggcactttcgcgagacgcacacaggggctcgaagttggcgtcttcctggacaacgtgccaacctgaaacctctgttctggaggaatgaaattgtttctgccaagacaagattcgttggcatgaagaacacgaaaattccccgccacgtcgctcaggtgttgtttctcgctttttggtgcaagcgcatgtgccagctggggagtctacggtcgacgaggagcggtggtttactcgttcgttctcagagcacgacaatttctgcgatgtttctccccaattgttgaaaagaagattggtccgacctctgtttttgcgacggataagcaagcgggtcagtaacagacgaaattctgttatgcggtcgctctcccagtcttcaactcccaccagcgggtcactggggtaacgctgtggtgattttttttccccactggttttttgttgcaggacagctaaaatgctttccagtgacttgcaacagttctcttcctggactcaaaagtgcggcatcggtgcctgagggggattcccctctctcattactcgaattggttcgtgtacgcgacacggtaacacggtaacacgcaacatcgctgttccccactttccttacgcgagtatttcagattttctcaaggtcgaggaaagcaagcattctcttggaacagctggagctcgtacaaacggtgtggttgtccttttagaggcgtcttgctctgttcgtatccagtgtgcgcagtggaacaggcgcgggcacgcagaaaacagggctttcccccgtaaattcccgcaacttaatttttgctgagaacggcattctactgaagagttgcgacaccacggcacttcggttctacaccagagtggctcccagacctcagaagataggcttttattggcaggtggtccgtttctcgacctttcgagtaacggggcaactacgagatcacaccgttggtaaaatcagcagatgattggcaggctcactgccgagatacaaatgcaaatacacacagttaatcacggacagctctcaatttacgatacgcacctactcatttattggcgcgtgtgtgagttaagagtttatcatcagtcacttccctccatacacaaccgtttcgataacattgtaaatatatatatatatatatatatgtatatatatatatatatatgagtatctgcgggtgtgctctagtcatttttcaccaatcccactttcagtagattctcctgcgcttcattcgctgtggaatctgagatgagaccaccttccactcgagtctcctcgactcagaagcaagcaattaatttatttcctgatagaaacgaagcttcttagtcctctgcatccgaaccggcttttctttgcttctcaatgcactcgcaccttctccctcctcactgtagaacatcgctatctgtcatacaccggcctgccgtctgttgtcaatccaaagctctcccgggcgcctgtcgctccctctgttcgggccgctctctttcaagcagcctttctgtgctttggcattctctccccgtcggcggttatcggttttcgtgcgtgctgctttccctgccatttaaacatcttgcctcatactccccaacttctctttgtcacttgtcacctttctgtcccacgtatccccgctttccgcacagtcgagaaaa

SEQ ID NO: 2919 - DNA, 1730 bp, Toxoplasma gondii
cagagatgtgcatctgcatacacgtgtggaaaacgataaataggtatatgcagaaagtcctatataatatatacttaaatatatgcacgttcatgcattgagttattggggctccggcctcagtcagatatcgtttataacgtatatttgcgcatgttaagtcttgtgtacgattcaacaggttacgtggcttctcgactgaaatggactgcgcctttccgtctacattggtggggtagtatgacgttctacagaattgcttggcggcaagggtccagctcaaacctccactcactgtgaggtctgtatcctcttcttcgtctgcttcgtcttcaccgtcttctccctgtcgtagaagttcctccttggtcctcgctttgaactggatttcgtctccgtcatcttcttcgtcactggaactttcttcggcgcgctcctcggcattcacgacgtcttcgtctctctttcttcgtcggtcgccctcgccagaaacagcggcttcgactgtcttattgcttcccttcatcttccgtgagtgagcgactgtcgtggcggagacgcagaggacgcgaagacgggggggggactctgggcaccgaggtgagcaggtcttagaaagggagaggcaattattgctcctagcagatgaagaaaagttgagaggcactggagagtctaggccactgttcggcggcagacggacgggactcaatcccggcagggccccgaagtcgtcgagcccagacgagcggacacggcgagatagcggaacaacgagacagggtccaggggagtagaccccgcggcgtgcttcacaaagggaaaagagaaaagcaatagaggcaaacgaattgcaagaacggtggaatcctgcgcagagatacccacgcctcgaaggatactacagcgacagcctcgtagggcatccgcgctgtcgatggctcgcgtcgacttttctcggagacggcagggtatgtcccttaccgacgagacgagactacgttacgcggagatcagggtcaaattacagagactttccgtcttgagaaaaacacgttagaaacgcagcaaagtgactcctgcaaagccgtcttcggcctttcattggaacaccgccaagagcaagctgtccagccccagacactccgcttttcttggggtcgtcaggcaaacagcacacaacctgcgggcagatcagagaagaaggcagcttcagtcggagaaaggccggagacactgtcctttctcccgaatctctggttgaaagtcgggctttttgacaatatgagagcggcgatggtctctcgatggtcggcaagtctgaaggcgcctctggaaacaatgtttggaaggaacggaagtctctgggacaatcgagacagccctcctttctgtggcgaaacgctctgcgcacgtttttctctccgtgccgccgcaaagaagaaccgtggggttcgttgcaatctgtctggatgagacaacgcatgcacggttgcgtagtcgtagctgggacctccaaaggcgcgcaagtaggaaagcgaatcggcttatattccggttgccgcgggcgccagcgtgtccaatttttctgggaggggaggacgacccactgttttggaaagaagccccgcgaggctcgcggttacttctctcttccctgagtttttaatccagtgaaaagaaggcagattctcttctcttgttgcgggagctcttccggatcgacaaaa

SEQ ID NO: 2920 - DNA, 2302 bp, Toxoplasma gondii
tccatcttggttttgatctcagcgaacttgcaggcaatgtgggcagtgtggcaatcgataacgggggagtaaccgttcttgatctcaccagggtggttcaggacgatgacctgagccaagaaggtggcgcagccctttgcgggatcgttcttcgagtcggacgcgacgtagcctctcttcagctccttgacggaaacgttcttcacgttgaaaccaacattgtcaccgggcacagcctgctccatgacttcgtggtgcatttcaacggatttgcactcagtggtcagaccgacgggagcgaaagtgaggaccataccggccttcaggataccggtctcaactctgccgacggggacagttccgataccgccaatcttgtacacgtcctgcaggggcagacggaggggcttgtcgctgggacgcttgggggcctccatggtgtcgagagcctcgacgagggtcttgcccttgtaccagctcatgttggtggacttctccaccatgttgtcaccaacgaaaccggagatggcaacgaaggggaccttctcggggttgtagccgaccttcttcaggtacatggcaacttccttttggatttcgttgaaacggtcctcggagtagttgcaggagtccatcttgttgatgccaacaatcatctgcttgacaccgagggtgaaagcgagcaaagcgtgctcacgagtttgacctgaaaaacaacgcaaacatccacaacaccagctcggtgacttcggtcatgttgcctggggttctcccttggctgcccaggaaaattcccgaaactttcctccccgtcgagtgccacgaccacaaaaaattgtaaaacccaaagtttaacgcattggaacattaaactgagttgtcccacagcaggaacgcagtatactaccttgccgccagcacggcacactgcgtcccgccccccgcggcacgagtgtcggcgactcaaaaatccatcgtaccttccttggagaaagcaccctcgaaaccaccagcctcagcagggacgacgagaagcgcaacatcggcctgggaggtaccggtaatcatgttcttgatgaaatcacgatgtcccggggcgtcgatgacagtgtagtggtacttcggggtttcgaattgccacagggcaatgtcgatagtgataccacgctcacgctcggccttcagcttatccaaaacccacgcatacttgaaggaacccttgcccatttccgaagattccttctcgaacttctcgatcgtacgcttgtcgataccgccgagcttgtagatcaagtgccctgtggtggtggacttgccactatcgacgtggccaataaccacaaggttaatgtgagtcttttccttacccattttggcggacggaactcaaacaacggaaaacaaaaaaattcacaaggccaacggcaaccaggaaaaataagcccaaaacacaaaagattgttttcagttcaagcgtctccatcccaccccccccctgcctccgactggtggggagaacaagagcggagcgggacggggtgctgcatcatggatgcgcgccctcgtccgcaagcaccgctgccggagcggcaaccgaatttggcgatggcgcctccccacatgccttctgcgacgagaagctgatgacgccagctcagataggggtggggtcgttcgcctattaatccgtgcaacaccttcgcagcatctcgcaggtggcacagcgagttcgtttcagcacatcaacaacgtctgagtagacaggaaagcaggagacgaggacatactcatcccgcatgcagggtcagggctgtgcgtggggtaatttgtacacgcaccggcgtagacacgagaaacctctggaaaaagtggacaacctgaacgcttgcgcgacacgcgacgctctttggtaacagtcatgagtaaaagatacagttattgccaacagtcaggagtactagtgacggttgtttccaacagtcaggaggactagcgatgctggttgacgccctggacatctgggagagaatggagaggtatattgtgctgtagatggtccatgaagaaattatggatcgttggtctggtggagacgcacgtaccgtgcgtcgttccgccatgtaggttgccatttcaggcgaagacgacctcctgcttcgcccgtttggcgtcaatgtcttgagcgtgggatattgacttttttgtggtagcctaggaactgtcggcttctgcagcgtcagtgtcgagaactcatacaattatcctcatctgatctgcccccgtgcaacaagtgtcgatgcca

SEQ ID NO: 2921 - DNA, 1418 bp, Toxoplasma gondii
gtgccttcgtgtacttgggaaaagcgaaagaacgatcatgtatctgtcttcttgtgatacctacgttcgctgctgagtgcgtcggctgtgcaattcatgcacctcgttttgcatcagcgcacaccaactacaatggtgagagaaactcggtagccaaaaggcagctcgtaacctcgtcgggattgattattgcactgtggaggacgacgaaaatgatttttgctttttcctgacatagcctggtttcaatcactagtgcgagggcaccagtgatagacagggacgcaccgtcaaatcgacgctgcggcaaacacgaaccatcagcgtcgacatgccggctggactgttatcttttatgatctccgcaccgccgggatgttcttcagttcgcagtacaaccacatctgtcacgctctaccatatatctttttgccggcctcgcggggtacaagtctgtttgacgaaggacacgatcgagacacaagtcccttccaacgtccacgtatacacacccgtaccgatgaaaagacggttgcacgcgttccgggacccacacgcttactggctgcatttgaagacagacttccttcgacaacataggactggaactagaatcacacgccataggtgactattagccgcgctgttccggattacaattaagttggtcatttcatcacagcagaacatgcccgcaggttgctcatctcgaacaagcgtggtgctgagaacctccttttcgttgtttgtctcagttcggcaatcgctacagtacagccacagcatcccactcactcatcaactgggtgcaagggagttctgaaatgagacgaagacgatgtgaactctcgggtttattctctcggttgtaacagctgcagcagtttaatagcgacaagtccggcagaaagtcacggggaacagaaaacaacgaaaatcgcgttctcttcttgtaatgtagcgtttgcacgagcggtcgtcagagagtactctcgagcgcagcgtactagagcacgaggaaccgtttcgctcgtcttctcagctaacttagtcgcctcattggcgtgccgagttcctgggtcacggcctctctcaaaaaatgctaccgtcttctgacctttgttattccaggcttcgctcctctgccagtcggagcacgctaagtgagaaaagtaatctctttcagaatacgccaggagcgaggcggccgagtacctcggccagcccttcctttctctgtccgtctcgagcggtcagcgctattctgccgccttcccagtgccaaccgttcacgcagagttctgctgttccacaggaacattccagtgcagacgctaaaataagaggatgccctgcaacaagcggagctttatcggttgctcggtcggcgttgccgaacaacgccctgcgagtggcga

SEQ ID NO: 2922 - DNA, 2585 bp, Toxoplasma gondii
caaacacgaaatcggagagattgaaaaactcgggtacagcacaagtagtcgtcacctggactatgcacgcatatatatatatatatatatatatattctgtcaatatagatgtgcgaagcataggccaacgatatttcggagtgtacatggaagcatagttaagagtgaagataatgcagaagtagaaccaaatgaacatcgtgtagtagtaggagttttccttcctgatgctagtccacacagagtgcatgggtcaaccaatctatacagaaaccattaggaatttggcgatggtcttctgacagacgtttgttgcgttctaacatacttcctgttcgaacgaaaaaaactaactacggcagaccgttataaaaccgtatgtgagctttttaagatgcgcaatttccgtttgctttttcaaagacagtacgcggacggcatccgcttcacactccagcatgctcgcaggccccactccagagtgcgcaacctgagattcagggagattcatggggaagtgtgctttcaagagcagctccttgtcctcggaaaggtgcgtttcatgtatgtgtcagagagatctggcgagaggctattgtgcgcgcccacctcctgccttccgagagactttttcgtacgtcttcccgtcgatccaggtgaatctttgtgagatgcctcattgctaagagagtgaaacttcactacgacatgtcaatattcgtcctgcagtgatctgctctgagttgaagaagggatatctgtcccaggtacaagggcgccgtgttacatagtttctttcagcgtgctctctaagcccccacagaagcgccctcgacctcccgatgtgcctgtttttcttatcacatgcaccccctctttgcgcttgtctcgtttgtttccattccttctgaaaaggaaccagtcgagattctgttggtgtcttgcctcagagcctagacctgaacagagcacaccactatttcctaatgctgctgactgcagactcgtgccttttcagggaaatgatctccacagggagagggtttccggtgtttgttctcatgcaggtactatctttcctcgcacagctgacgaagaacccaaggaacctgcggaagcgcatttttacaaccgcgacctgaaacccactactacagaacgaacacggtctctcgttgcttcgtgcgtcggtacagttcccttcgagtgccgaagacattgaggcctggaactcgtcaacagccaataggtgcggactcctttttcgtgatacgtagcgactgtagatgcgtttcaacagtagtcaacgattcgcgtggatcgggtcgtctctcggattgcgtccgtggcggcaaggttgccggcaacggcgatcagtcttcaggaaatttcttttgcctgacgctctgtgggatgttcgtatgaatggattgcatgcacctctctcctcaatgacattttgttcgtttccctgtctcttccttcgttttcaaacagcaactgaaaagcggaaaaactccgcaagacacagcgcgtgcctcttcgcgctccctcaccctgtggccagcgcgagtcgctttctgacggcaggctgctcgcgacaaaaacagcgtaaactcggtttccttctcgatgtttcctgccgccagccaaatcattttttagttgatgaaacatcgaatccgttcttgtttttcttctccgaactttttctcagtctgcttcgtcagctggacgccgaaacggcgctctaccggttgggcggtctcctgtgtcttgccacagtcggtttccaacagcaactgcagccgcaaactcgttttccttacagtttcccgctaccatttctcccggaggaatttatctcttgtatgttttttctgtctgtggctccaccgccatctgctcccggataacgttgccgttgttcctctttttcgtttctccgcgtcaactcggcagctgcttgcccgcgtgactctcgacgcagagttgcttgcttgtttgtcggcatcttttctcctcgtaagttgacttcgtttttcactcagcttctcccattgacggcatccaatttgattcgccctcttgggttgtgaatgaaaacgcgcgggtgaccgtcgatgccgtcattccttggaaaagcgaaaaaaggcacagcgaagcgttagacgcacagtgtgtgactctctactttctttgacgttccggtttggtcaacagaaagagggtttacatcgaagatcctgcaggtgcgggtcggtcatatcatattgccggctggaaataaacggcaaacagacgtcgtgcctctaactgccccagaagcctatcgccgtcaattttgtgaagtcccaacagcctctgaatccccttttcagaactcttttcattccgctgtcatccgtgaaggtgactcgtctgtcgtgcaaagcttcctgtagatatccgcagcggaggcgagagaagcccgttggtgtcgagttctcactccagaaattcataggtctctcagtctccagggttgacattcgtctcttgctcgcgacttcatactgatccccgggttcgaacagaataacaa

SEQ ID NO: 2923 - DNA, 4751 bp, Toxoplasma gondii
ggttgttgcacttgccatctaccttgatgtgcgtctgcaagaatcgttcctgcaggaagccatgttcaccagaacagacaaccatttttcttaccgaatctttctgcctagggaagagactcatcctttaccgtcagcagaacaaagaacgctcgacctgacatgagatggtcccagcaccctacggagtaaggacacgtttgaacaggaagcctctcgaaattcatgcgtgcacacctgccttgtcatacagttcccgaaaatatactgacacaggtctgcggcgatgtgaacaatcccaacgtaccaaacgcatgtattcaaaatgaacatgtttctaccatcgaggagtcgccccctcaagggagatcgagaacgtagaaagtctaattggtgagcaccaataagtacatcagggttgacccgtgccaaaaagccagtttcgaggacccgctcgcgaagccgccggtgcggtgcacgtttcaggtgagcaccatccagtattgccacaacagccagaaagcatccatctgaacggaacatcgataactatgtcacttctgtagtacggtgacaatggaggactaccacgtgatgacggtatccaaacgtgtgaactggggggcgtgaccgtttctagactcttcttcggtgaaagcgcggggagaaaacacgaggaaagatccaacatgtcgcccagacccagagaaaatctagcggctagaggtgacggtgaagaaaaaatacgaaaaaacacacaacaaacacagcattcgcagaaacaatgtttgtatctccactcccgggacacgggtggggcgacgaaacgtcagcgcatgtatcgcgttgactaatttgcattcctggaaagacctcctgaatcctcatttccaccccaagcaacagcgtaccagtcccttggcctcgataatgttgtcgtccacaggtttctgacagtcgacggtaaacttcaccttgaccggtttcgctgcggcgcctttcttcccaccagcgccacggccagagcctgccgccctcatgtgggccttcgccattctgttctaaatcgacagaagaagtgagaagagagcgggcagagaaatctggaacctaactacgaaagatctgcgggtacgacacagtggaatgttgccaaagaagcctctttgccacagagaagacatacaggtcgcacgaaaagcgtcggcgacgcgagattttacatgcgccgacgaagagtagctggcgacgggcatgttgtactgggggaccggcttaaattcgagcgcactgtcgcgcactcgtagcgtgcccaatgcatccatcggtgcccgtgagagatttcttttgctttttacggctcacactatctgcctgaggaagagaaggatggtgtgcatctcttgggtctgaacaacgacaaacgggaataactcttgaatcaaaaaggcaaccatcagtgtgtgcggaacgaccgcaacagatcgttgctctaaggtacggctctgctggtaggcacacggctcctcgctgacaaatcccactgtaaaccgggatcttctctactcacaggggaagttcctcaacgatacttgctttcggcacagttggtgcttcttgagtaagtgctccgtgtgtcatgctggatcgaatatcgaaagagacgatggccttgaacttcaagacgcagcagggtctcgtactaacggcgctaatgatgccggcgggtgccatgcatgcctgggtcgaccgacgcctcaaacaatgctgcaaagcggcctaacatgctacaccttcatgcagtgtgtggccaggctggtggcaactacacgaccataacgctgtcgtggcgcacccatcgctcagttaacgattgatggtaaaaatacatgcgcgtaaaaagactgtgcagctgtggtcccttcctctctgaaatgctcagatgacaatacgtcctacgctgatggcttagtgaaacgcacaacagcctcttcacgtagtcgctgaagagcagcaagtggtgcgaatgatgtacactccgtcccgttcatgagaaaagtgacacactgacaaactagtagtttattctgcggggtctacttaaccctctaaccaggcacagcaggcgactttcttgttatgtccggctcgcgacaaaacaggttcgaagaataaggagtgctccgaccccgggttcactctggctgaattcggaacatactgcaataaagtgatggagaaacaacgctcgcgtgggtgactacattcagtagctcatgctttacagacagggagtggccttcttgtcactttacatgcacgaacactcactacgttggatgcagcgccgcgcagcagccgcagcgcatcttgcatgtggatttctccaatgtagactggaatcgggattcgctgcagcatatccaacacgaccaacattatgtacagttaaagtagtgttcataagtttcggaccatgagtgtcagcagcacggcacgatccgcagttccctactgtactgactggtgaactcgctggacgacacgctcttctcggaagcattccttgctgattccagcatgcctccatcacctgacgcggtattggtcatcagtaggaatttgacgagtgccaggactgtgttcctgaatggttgattcactgacgtcgtcctggtgaagaggcgggatatgcggtgccggctcataacgaaccacttcttcaaacatgggtacatccacatatctatcgacgtactttatctgaggcatctccttatacgtcaccttgtcaaatgtcactggttttcgcttgtacgaaactcgttcgtgaataacctctttcggtacgtacttatacatgtaccgagtttctggaacctcttcatacttgtcgacatacttgatatatggcttttcgacgaacttctctactgtcttatggatcagccgtgggacttcgacgagtttctcttcgtaggtgactttaggaacgaatctgtcaactttcttcaccaccggaacttgcacaaatttcgtcttgatatctactggctggagtacgagaacgcgaacccaatctcgatcacatttctctccgacgacgctgggcttcagcacgcggctgtccacgaagtcttgcttccatgagcgacaatgagagagaccgtgtgcaccaagaatgtacttccttcgctgccagtcgttttgctggcagccgctcatgatggacacacacgagggcccgcgaagcggaactggtcaacttgaagatatttagacctggaaaaaggtgtgttgttctgcagtgaggcagtcaacccctcaggcacaacacagtgtgcaccagaaacaaacgggacggactccgagcagcgtcgggacacgcacgaccttctcagggatgtgttgtgcgcgctgctgaggtgtcggttaggattagccagaggcaaaaagacttcctgatggagaaaacactgacgtaacgcagggttggcatgatatgtgtttccgaagagttagcatacatctgcgtcgaagaacgatgaagcttaccgaacttactggcagctacctcaccacgtcacatttctccacgcagtggaaggatcatgatctgattcaaatgtggtgccagatgatgagtagggcaggattctagttcatcgcgacgatgtcgcgcgacaaactgatttttgaactaaaacaatctcttcatgacttttggcagcttggtaagtcaacggggacacaaaaaagtaaaaaactgcaacaggaaagcctcaggtcgccatgcatctgagagttgaaattcgagtcctgtggctggttctcgtcaagtcatacccgagagcaatcaaattgaccgcacggacgtctcagcaacagtctgcccgcaacggctgtcggggggggagcgtcgatttatgtaaggtggccatcgttggacactgcgcgaatgaggtgactgtgtgttcactgctttacagagtcacaggcgatatgtctctgcaagccgattaccgctatccctgacttgttctttttccactgtgttcacagatgaggaggtggaggtcagctctgcgcgcgcttaacagataatgtgacttcttccttactaacgctagagctcccgagttttgcccatcctaccccgtaaacagtgcgagctggacgtttggggccggccgccgccgctagccagtatcctggatcactcgacaggaacctgctgcagtgcacccggcatttgtgttcctttgtttccacatgttcatgttcgtgacgacgaagtttcctttgtctctgctgccctgttgcacgttatttggagggaattgtacagctgttataagaaaatcgtaagaccaccgtgagtcaccagtggcaccattttaacggttcttttcgtggtcacctgcggagctgtgtgtgcccctgctgcgccagaccgttgagcctgttgcttgtaatttgtggtcagtcgtcatttcaatcacataaatatcaccattctttctttgtacagtatctgtcaggggaaaacagtgggcgtaaagtctactgagatgaacgtatccggcctccgcagctcgggctttttgttttgactgactggcacacctgcagactatgaactgcagtccatcggttattcacaccatggctcagtaaatgacttctaaaccgcatccagccttgcaagcttgccgtctcccactcttcattcagaggtggtgtccgcaaaa

SEQ ID NO: 2924 - DNA, 3780 bp, Toxoplasma gondii
gttctgaagaagaacatcttcgtccaagtgcaagaccgagagcgcggagcgggttcctgcatgcgcggactcctgcgcgggcacaccctcggaccccaagcgcgactgcgccgaggcgcccggcgcggcgcgcagcagccgccagcgacagcggcgatccacgcgcgccaggagactcttcacggatccgtccggacagaccccgcgggcacacacgacgccgatgtcttcttcgtccggcgcaccaaacagcgtacatgcaggaagggcagaagttgacgaggaacccgaggacccggtaggaaatgcgtggtgcccagatgttcgcgagctgtgcaggcgttgcgcgaactgacggacttcggttcgacgcggacaacagaggagccaaagcggcgcgcctgggtgaggaagtcttgactgcggttcttcggaggtaggcacaggctgatttccgccacccaaggggaaagaacgcgggagacccgcgacgagcagcacctcctcattcgcgtgcacgatgtcaccgacagctggagaggacgcgcgcaacagagaaaactccgagctgcagagcggccggtacggatgcgaggcggtgcagcaaagaggcaaaagaggcgcgtctgcggactcagacgggagcggggcctgaaacggcgagggtgaagccttagacgtgctgaacgaaaaacccggtgtgccagaacttataagcttttccagagaagcggtgggtccctcggaaacactcgtaacaccatttgagacgcctggaaactcccccagactgacgtagtacggctgcttcgcgctgtaccaggcgtccagagtcgaccgcaaccctacttgcgccccgtacgcaagggaggcggctaatggtggaagcggcattttgggaaacacgcgcgagatacagtagaacaaaaacggactatcactattaaaaggagaatggactttatagccgcggcaaacgagatagcactccgcgtgctgatgaaagacaagagatgacacactgcagcagggggtggcgtggcgccagcagctccgtccgggtgtacggacacttgagagagcgcattcttcggctggcacatgccagaaatgccacataaagcttgctcttccttctagtcacgcagttaccggtgtgcaaagcgatttcaaggcggacacacaataggcggctcggcgtttcccttctcccccccgccagaggctacgacacactgtcatgcagcgccatttccccagcaagtcgttccatgtgagtggaaaatcttcacgcgctagaaatgaaaaactttccggtagaaaaggaagcgaaggaaaagaaggagaagggaagggaaaggaatcggaacctattcaaagtcggcctgagaactcgcgcaaaagcgcacgagtgcggtagagaggtgtcgcaaaacgggcgcaagacagttacccacgtcaacagttctggagaaaacagagctaagagactgtatgcatttaaccctgtatgaaagcagtacatagacatgcaacgtgccgtctcgatacttgcagtgtcgcgtcatccctcggttattcggcatgcaacaagacaagggacgctggggggtggagggtggtgccgcgaatgttgcgattatttcgccgattaatttgccacgatagccatcgaaaattgggaatggagttctttacgagatattccgactgtagatgcgatgaagtgcggatctgctccacttttaaaaggacaagaacaatgacagcgctccttcggcagtcgctgatctcggctgcccagccgccggtgcccgtctcaagtgcatgcacatatgtgaagtatcggttaaatgaccaggaaacctgtcattttcattggttcccttccactaaagtgtcacgacatagcttactctgcgaaatagtagaagccgaagtggacgagaatctctgttgaggctgggaacggcacacctctctcgccacgacagagatattacaccagagtagaacgcgcttgtgtgcctttctctctgggtttggatgcggcggtctagtgcaaagcatggatgaggcttgccacaaaccaccgtatgaaccgttactaatatcgggttcgagctggagctgccgcagtaggagttcggaacttcaacgacttcgaagcggtttgtgttttccaccgtttacgagcacaccctcccggcctgaacgatctgaagacgaatggttgtcttctgtgtccgtcgcacgtacaggtaggaaccctcggtgcgacatcacagcacaacattagcagctttgtaagtcgacaccaggcgtcactgtgatcttgtttccgtacacgttccagctcgatttccttcctgtatcggccaaacgctagcgaaactcgtcagggtcggaactgacacagtgtgggtgccactactgcgttcacggggtaccaggaagcacttacactataagaagaaatcagtgagacatttctgccggtgatgtgtgaaacacgaactgtgcaagacgagcgtcgtacagcagcgtggcgtttcagaaataagacgtcttcttctaaccgtcatgcaccgacggatgcccgccccggtgaacgacccatcgagaaatgagggaattcaccagcctacgtttttcagcacaagctgcacacaaagtactctgagctttgaccgaggggtgatctaggcaccaaccctatcaggaccaactatgtttttttcagtgttgctaagaaatggaggctctttccattgcgcgtgagtctcaaagaagtacttttcttcgtccattcacccaagtcttccatcatgttttcccgcagtagattctctagtgaggtgactttagaggagcgtgcgtgcaggtagctgtgaacacgaaacacgtagcagccagtgacgaatttctccactccttgtgtcacagcttctcaaaaatcggatatgtacgcagaacagccgatggaatagcttgttttcctgtactctttactggcttccagcagaaagcaccttctgctgcccgaggcttcgagaagatggtgtggctttgtgctctgactcgagagcgaaactgattcggccgtgtgccgtgggagcattctcttccgcgctgccagtggttccgaaaagttcattcacacacacgccgtgtactttgtcacatcaatacaattcaacactggctccacacgcaagcgcaccttccatccatgaacggcttctcgagcgaaaaaaacatgcacgcgagtgattcgaacgccgcgttccggaaaagtggtggagagtgagcatcggccaggcaggagggactccacccctcctgtctcgggagatccgggcacttttcgagggttctgccgtgctcggatggatccacgcaaatatctatctccaaattctaccaagaaaaatcccagactgccctgatcatccctgtcacactaatgcacagtgtgcattggtctcgacttctgcggtagcaggcacctccgccacattgcctgctgacagcagactttggatgtacacaaagccaacggactgacttcctgggttgctgttccagacattgccggaatcacttttgactccacataatatgctagaaaataccgttcatgtacgatctaaagaggcagctgtccagcgaagctgaaggcagtgtctgtctcatgggtgcccggttcgtttgtgagcgcgtcctttgtgtgcgcaacttgcagaaagacaggagacccaacctgacgaggaaatgtga

SEQ ID NO: 2925 - DNA, 2298 bp, Toxoplasma gondii
ttcctcgcatcaattgggtacacctgtatgagcagttttccaggaaatgcttgcgcgcaccaacagttaatgatcctctggcacgttttataatgaagtctgtctcatgctagagtctcaaggtgcagggaataacttctacaggtatagcggcgtgtgtctatgtgtaactatgcttcgtatatttgcaactcatatatatactcacgtgtatgcagacattttacacgggtgcacactcgtgtgtttcagattgttttaggcagtttaagctctgtccagtgatttgttagatggctggtttttcgaaatgacccacaaacctcgctaaaagcacctccgtgaagtcgcctgtgtggcgagaaatttccgttcagcatcatcctgaaactccgcgatgttccagaaattctacttggtgaacatttgataatttctcaaatattcgtgctgttgtgaccgttggttcactactcttgttcttgccaggcggcaggaagggctgaaggcatgatcggaacacgaagcagagacttagccagagatctctcatcatgaatatcagtagtgaagcactaatcttgacttactcctctgctctgatttagttacagaagggtctcagtggggatgcgccacgggtcctccttcatgagcaaaaattaaatgagaggacacggcagaagacagggaactgatttcgacgttttctcgtagtgcgtgcagtcatcactgcaaaaacacccccgctatccgtcttcgtggcaccgccgtcaagaatgcatgtagcgtcgtactgtctgcatgagtgagtcattcaaattccgacagaaagatcgtcttcttcacgaagtgatgcaaacgcgcggaacggttaaggcgtgttcgggtggcgctgtctccacagtgccgcctcgtggaaatatatactgctggcattctctgtcatgtattggcaacgccagtgtaggtatgtaccaatcagaatcgtatgctaccttcgaaaaatgacgaatcttaactaatgttttcctgggtgcctgtgttgcgtgactagcatgaaagaatcaactgccgcagccagaatactttcagcctgaggcggcgcctctgaaggcggatgtcagcataaatggtatccgcgaactgaaatggataagaacgcctgccgataatagatgcacacgctgggacatgacggagggaatgcgcggaaaatttatattacgtttggtgagatgaaaacagttacaatactatggctttatccgtattatacggcagaaaaattcggacctgctctaaggtgccgcttattcactcgcttaaaagcgagtggaagagcctgatgacagcatctgtgtcggcttattccaaacctcaaaacacagttgtgtggtcaccgtatttttatccaacacttgtcgagtagccgcagcgtggcatcgcagccttgttacagtttacaccgccgtcgacgtgcgataattcaactgcagctgtccgcatggccaatgaagtaccagccagctttggtggtttccaatttttttgtgaagaaacgtgttcagtatatgttcttgaacgggacagcacatgcttgcctagaggctgctgcctacctcacgcttgctgttagttcatggctcttgggccacaaatatttgatacagattttagtcagaaagggcatctgttaccagcaatctggcgacagggtacgccatagagaggagtcgggctctatcgcagaagggaggactcctggaagcagttctgcagcatagcagagtacgcagtcactcgagtgtaatcatcacgcgtggccagctgagtcaggagccgggcaaacgtctcgtcaaccttcatcgctggaaccgttcgcgttgttcttgccaacccagatgccgagttcgtagaatctctcttcatgacctttatgttttttgtttcataatttcccttccttcaaacagcgtagaccagaagccgcttttccgttttgttttcagacgcttgtttttgtcacgtcgcgctagcggtcgaactgatgcaaggttgtctgaaagtttgctagctacgcatttatgtcacttcagtcagcgatgcaaatcgtcacgcgtacacaagttgttgtgctcgattctcaggcttgtggcatgaagatcttccgcatgtgttccgtgtgcggaagaagcatatggagtcccccagttcgcatttaaagaggcctggactgggtgatattgccctcttcccccgcatgtaaccagttcagttaaccaccaggctccacaa

SEQ ID NO: 2926 - DNA, 1922 bp, Toxoplasma gondii
tctgcttctctcgtacatgaggtgcaaggatgtatacctacttggtgcgtcgtacctgtcaaagacagtcagcatctatgattaatatccgcaggtgaaaggcaaccttatccgcgatatctacacctctagggtccctagaaccatctagatgtaagttgaagatcaacgtcgcacctaagtgttctaagtcggatacccgcaacaagagacacggaagagccttcgttttactacagcttcatgtctgtcttctgcgttgagtccaaattttgcgtttccctccgagtcgatgttgagttttcttgtgactccaaatggctgcggggcagcggacttgcacgacggaatgataactccaaagaattcttgaaatgttcgtacctgtcgcggtgcgaggtagcacgaattgacgaggttcccgataacgttgaccgcagcagccatgtgcaacttgctgtagccgacgcccatgtagcagacagtcgagagaagcgtcgaagaaagcacggtcgacgcgcagaaaaaaattgggtagtggatcgactgtacttcagctgaacagcgggcacgcacaccaagtaaaaagacacagggcattggcattccttgcttccatagggatgcggtcgtggaatgtttgctctgccgaagcagtgccgaactgtagaatgcaagaagggactgcggacgtgtcatgccgtaagctgaaaagatgaaaccccacggattgtgccgttttaacgcgttcagccgacgggtgtcctcgctccgatcccagcagcgaagtctcatggccttatcactttgaattttttaaactacgaatacatcgatcattatagacacacacggcacgaatcatcgcgaaaaacgaccccaagtcgttctggaatgcagctgcctgccatgtgcctggtgatgttgaggacacttacccagcttgcacctgctcaacgttttccgaagaacaggcgacatgacgaagaaaacccatgttgccgagccgaaaaggcagctgaaactcgtgttcacgagagtcgacaaaagccttagcaacgcaggagacgtctccgctaactgaggcacgcatgataggagagtcgaggggaagaaatacaccagcagcgaagccgttccgcacgcagcggaaacgtagggcaatttactcaaacagttcgtcatcttgtctgctcgcgaaagaatacacaggaagcaaaaaaatatgattcacacgaggaacgtcgagtcgcgcaaacgttcccaactttcccgcctaatccacacgctgtcacgagtcaggggtggtgggaaggtggatgctggccgcaaaggcgcgcagctacgtttcgattcttgagcaaaacgaaactgaacggagctgtcgaagcacctatgtcctctgtaattctactatgtagtatcccttcggcagaacaaaggctttcatggtacgacagcagctcttggcgctggggttgaacggatgtctggtcctctcaagaagcgtgttcaagtcttgcatcgctgtccgtccgcgtctggaggaacgggactacgggccgtgtgtctcgccgttgtggtcttcgattatggggatctgccttattgttcgtgttcgtccagacgtctcagcatgagtgtttcatctcgtctagcgcaatcgtgccactgaaaaacgctgcgtggcttctcaggtgagtcgtggtcttcctgcgttgcatgcaccaggagtgctggtgtgcaagtcgatgtctccgaagaactcctttgggttctttcgctgttcttctcccgaccttctgcgccactcagttagtgtgtgtgctgtgtatacagatggctcaactttcagatcgtggaacctctcttgagatttgccagggtcgccctatggggcggctcctcccttctgggagcca

SEQ ID NO: 2927 - DNA, 2569 bp, Toxoplasma gondii
acaccggaaccatcgttggttcaggaacgcgatggttgcctcgacctgcagagacacaggcgcgcctggatagagagcgcgcagaagcggctgcggaacatcgtcggcctctctgagggtcgctgagaagcctctgggggagcaggaaccacagcctgttaagtctggcctcccttcgtctgtgctctgagagaggcgagcgacaggagacaaagcagatgaccgagaaaacgcagaagaaacagcgtctacacggagcctgcccgtctccgcaggactgcgcggcggctgtacagccaccggagccgccagaagcgaggatcctgtcatggtcgagagggtgaggggctggcaaggcgagggattgagacacaattttgcgtctttaagctcggatgaaaggacgaggcagataagtcagaggccagagggagggagggattctaggacggagagagggaaggaaacggagacagacaggtggagaagacaaagagaaagacaaagagaagaaagagaataacgacctgtctgtacacggaaaagtcgcactgaaagtgccacggcgacaacccccaagaccgccccgcaaaggcctccggcaacacagcgcagaaaaagtggaggtgcatttgaagatgcacaagtacacctgcatacacttaaagaaatacaacatctgcatgcgtatgaagactctttggaagagctccatgggcaggcaagactgcagttttaagacgcgataacgacagaccttttgagagctcttgtcgcgtctctcgaggcggcactgggcgcaggagccctctggaacggaatgcgtcgcatgaggttttctcgtatcttcgaaagcaaacgagaactcctgccttgacatgcatgcgcgtttgtgtaagttctctaagctcaaaagcagccacaacacactgaccaccgagagtctgccgtctccttgtccagtggagacacggcgcaggcttctggtacctctctcgagagacaggggaaaagcgtctgcgtgagcgatccaggcacagagcagaagaagcacaaaaaagttttcgtttgcgcgttcgctgaggatctgtagccacagagagctttccaggtggcgacagcatgcgagtctgtcgccacgcatgccgaagacgcgaaagacagaactttctgtttgtctcgaatttctggagtctcctgctcggtgccaaggctctctgggatacactcgagtccgacagacgcccccgggagattcagagcaagcagagaagtcccggttttggatatgaacgagcctcaacaaatcgaaacgcgtccggacatgcgcggactaccagcaagctggggtccagagactgcagcgcgggccgagtccgtccttcggagttccagggggtctctgcacggaagagaacgcgcgaacaggctgttttcgcggtggagaaactaaagaagaaagcgaggggtcgaggcacctgagtttcggtcgcggtatccgagcaaaaagtccgagtttgaccgggcgcgacttgcgacgaaaacgctcgcgtgcaaagcgcgcagcgcgaaagcttgcagtgtgcatacacccgagaggtggggcgtcttgagtgtgtctctcggaaaaagcgcgaaaaacgcgtttcgagctggttctcccagcctttctgcgcttgtccttctttcgagcgcggaactcgaaaactctagcgagttccgccgccgttgacgcctgagggcacagcgcacagagcgaggacccccgggtgtatgtacactcgctgtttggcgggcaacgtggtttgctcgtgaatttccagcggttttcgtcgatcctttctggcctcgggcgttccttcgtttctctgaagattcacactgctgtagagcttctttctgcttctttcctttcgccgaacgaccctgttagctcgagcctcgagcgtttcgcacggtggccggctacgtctcgcttccgaggtctgcccaagcgtcgtcgctctctccttcttctgtatgtttctctcctcgcgttccccgcttgcgtctccgcggtccgtcccccttcttggacgcccaggcgtcttcgatctcctcacctgggctcgcgttctttttttttggtaacgcttggctgccgcgtggacagagagcggtgtcctgtctcgcacaacgacctgcaacaggtcgctctttttcaactactagtttccgagtaactcctcgctcttcgcaactgctttccttcgcgctcgcttctgtcagagtgcccagcttctctctcttcccctgcctcgtcgtcgttctctccctgttgtctcctgtgcttcttcgtcttctttctcttccttcttcttctctttgtcttcttctgtctcttcgtctgctcccattcgtttttcgtcctcaatctccttggtggttctccttcctcagcgtctccgtctctcttgggaaacccccctcccccacccgcgctgcgtcttccctccagcgtctgcgtcgtcttcgctctctttttcctcgttcttattgtgtcgttctttcaccgcacatgcagcgagga

SEQ ID NO: 2928 - DNA, 1179 bp, Toxoplasma gondii
cagccatccacagaccttttgccgggttttcaacaaaggaaaattcgtcttgaggcaattgtcatccccgattcctgtagcaactatctctcccaggaaaccatcgccttcaacagacggcggctttatatgtatatatatatatatatatatatatatatacacatgttctgtggggtgccctctgttatctcttgagcgactcgacaactcttgagtgcagcaagaggccggggaagaactctgtctgctaagcctagcatccaaaggcagggtttgcggaaaggcattctcctagagggtacagacgcctgcggtgaccccttcgaacaaattccaccacgatgaagctggtcgtacaagcgtttctcgaatgtcaatggatgaaaaacttcacacaaaaagatgtgcaccataagagtagtacagctgtggcactgtgctgcgtgattggaccactgcgtgtctgaacgagaacgagtgatcgagagactttatcactgttggcgaaaagaaaaaaaatcccttgtaggactgtggcatttccctagaaggaatccgaacagggcatgcgcttgaaattctctgcttttctctcggtgatccccctgaagaatacactctgcggctctgtcgctgtggcgactagctggcgaccgagtcgaacaccgccgtccacaaaattttcctacgcatcctttgacagcaaatcggacgatgcctaagcgactcctagcgtggcagaatggccatcaagaaaataattatcagaacggaaccttcaactagggacaaccagagcaatctgttagtgttgcgcgagactttcgttcttgtcgcttaatgggaacgcgttcttccagcgtataatccgtcggtttcacgtttcttggaaagtgcatggcgtcgaggagtgacatgaaagacacagttccgatccatcttcttcaagtttggacgaaaagacgaactcgcagtcgactgcgctgtccatccccctctgttgctcacggttgaggggtcgccgcggccgtttgaactgtttgtcatgccgtggatttctcttcgcgttttcacacagttgttttttccgtcaaactctgcctgccttgcgccgttgagttcatctgggctcgcctttcctgcccggaaaactgtatcgtgcctttaacgcatgca

SEQ ID NO: 2929 - DNA, 4190 bp, Toxoplasma gondii
attattgcctctactgctgctaaaaggtagttgtgttacgtgacaagcggtatgtttaataccagtgtttatgcgcaaatatagtttgatacaaagaagttgttatatcctccgtacaacgtccgtatgagaggaaacctctgcgaaatctgtcaacaaagcggcgaacagtgaacgaacaaaataaatgtgcgactgtttttctcaaaaattgttcagcgcgtacaatcgcagataacccacacaagacatcagacagatcgcttttctcgttgatcggaaccgttcctagtccccgagagctcaccctgtttcaagctgagtacgcgagtgtgcgtgcatgggttgcccccattcacccgtatgtatccaacccgctggacgccctcgtttcttggcgagtgcattgcaacatcggacttacgaaagcttctgttttgtgggcaacgtgcccacaagaaccatagagtagtagtgagggatgagaactgagaaggtgctaggatgtgcccctccattaatcttgatgacatctacaagtagcggctgggcactgtatgccaccaagaagagcaggacgacgccaacttcgatagcatgctgtctggtcaggacggctcttaacaagtcgccccctgcctgtcccattgtcgaagaacaaacaataaacagtcgccgacctcttttcgagttccccggtgtaacaacgaacggtaactaaactgagtgtcggaatccagtggctgtgaacatcctcttccgaaagagatcagcacatgtgttgcctgcggcgctgaaggcgcagctgtaaaggcgtcggactgcgagtacgagtacgaaaacagtcgcttcttcgagttgcagtgcgtttgagcatgcaagtaatcgcgcagatgtcgttacagcgattttttccttaagtgattatgccagacctgaagtggttgaacagggaacagaggcagtggccaaccgggacagggcatggttgtatggcacgcggagggggctcggctgacctacagttcgcgaggatagagaaccctataaacggcgaaatcggatgtggtacttctcggagacagaacaaaagtacaaaactgggccacgaaagtcaacacacgggtccaatcacggggcggaaaggtgggtgttgccggaaacggccgcgttcgctcgacgccagaaccctgtggcatccccaaaaggcaattatcctaatcttttcggcttccttcacgtccaagttgtaaatgaaatccgcctcaaaaagtcttcccgccggctgaaactaaaaggaaaacaaaacaaaaacaatgaaccgtataggctccgtaagctttccctggcgaagaccactcgacacgctggtccagggtacatacgaacggttgcccgcggagacaggcacacaacacaggacggaagacaaggcaaccagtgtacgctgcataaaagaggaagtgtagaaagccgaaacacttgcttgtcgcagaataacaacgacatccgcttttgtaagtggccttctcatatgaggagaccacttgccaaatcgtcttgtggggatagtagcgttacatggcattgccagcccgcgcccttccagcatgcgttgctaccacccccacctgcatgcaactgagacatcgaagtcaaggaacccgtcggcgggtggtgactgtaaggcagtgatgaagaggctcctgctagagagcgtgacagaactgcatctgatgggaatccttatagtggagacgtgccgcggattttctgccgacgcatcccctttggggaaatgcaacttgcgtatatgccgttgggggtctcaagctgacccgtttggctggccaaaacatgcgtggcacatttcctgtgtcaacatccggtgactagattcttgtaggcaagcgaaaagaaactccgcattatgcttagcattctgaagctccagagacagcagtgtttattctctcagtggggcactccgcagtggattgtacacttcactcgtcgaggcgaagaagacaaaaaccacctcttgagcaaaccctgaaatggaatccgtctgtgggggacgaatggtagtacaggacagtcgctttcccgttgcgtggtctgagcggtcagaatctttcgggcttggtcaatacaggtagggcacgcagtcttggcgagcattcgacctgaacagcatgaaaaaagtgacatatcgctccaagcggtgcacgttagtcgcggtcttctgtcctgtggttaatttttgcaacgccgtatatttagagatgccagtttcctcccgcatcgccgtggtaatgcggcaatatgttgcagggtgctatgtgtaatgccgccgcaagcaggccatagagattgcgtccagaagtaggcgctccggtagggccgtagtccgaggctcatcaacagcagctgtcctcgcagttgtgggatgtttgggttagcgctgtccaacaaagaccacgtatcgcctttcgcgcacccaaaccgtgcagtcagatgcgtagcaacattcggcagctgtggcaaacgtgggggggtcaaagacgcagaaggcaacattctgtacaagcaagcacccttggaacactagtgcagacatcgtgttctgaaagcgggcagccggaaagcggtgtcgcagtagtaacgttggtttcacgtatctttactgcagagacatagatcatttctgcacactgcatgggccgagcgccagagggaaatacattcagagcatgataattctttcacagctgtacggtatggagattcgttcgttctctttctagatttatacgcaaggggacccacaaagtccacattaaagcacgttgaatcctttgacgatgcgcggattttaccattaccgaagaagcggagaacacacgcccgaaatgctgcaagtctgtttgcgtgttttgagtttcactgttattgtggtttcatgagaacactacacttgccggcaatttcttcagtgaggtgcaacgcttcgcccagcataattacacgcgtttgcggacaccgtgcgaagccactgcagttctttgaaagtgctcacatgcggttccaccatttagtctctttcagccacttagacatgtcggcagggatcacgagacactcagcagaaacggaacgacttttatgttttcgtcttttctgagcttgttgggccagacactacgctgtaagttgcgaagccgatctcaattcctaggtcgacgtgaaatcggaggttattgcattgtcgagctcatttcagccactggttcctgggatgccgtacctatgagaaccaagagaacttgttcgaacccaaactcaccttagtagctatgctggttgaatttattgcaaataacaagccaggcctctaagatcacaaagacaccagtaaggtgacacgcgcgcaaccataggagactaccgaattccgagctgctggagactgtgccatccccattcccaggcaaaaaaccgtcacttatttacagagcgataaagatactttgacggtgtaaacctcagtgcaggaccttgtaacgttcaaggtgttctggggaattttttgctagtgttgcgccgcagcggtacgcacgatgcagcacggtagttcgttgtacttgtgtgcaagactcaacattctggctcatggaagcgttgaagattttatggcaatcttgaaagcacatgcaattgcgcatcgttacctcgagccctcacagcaacagccatgtcggaaagaccatgtctccgagacctttgtaagtggagacagggtctagaacaatggtgttcatgtttgtcgattatgcagagcctcagtgttttgtgccacgcaatatggccggctcgtggatcattatgttaatcttgtaaacgtgaaactggacgtggtggccaggtaaaatttggtagaaagtcagtgagtcctgcgaggactctatcacacactcacccggcaacggttgatggcctactggtgtgctcctatgggttgcacacacaggacaacaccatttcactcttccgtgtcttgccagatcgcctgattgctgtgcctcaaaacagcgtgtgctcctatgatgtacctagtgctctggtcgcacatatagaggcactttttcatccgaaaaaaagtgggactgtaatttgttttgcacatacca

SEQ ID NO: 2930 - DNA, 1600 bp, Toxoplasma gondii
atagcgagagaaaggcgaagcacaagcgagagaaggcaagagctttgggggcgaactcgagcgagcggcggcagctccgcaaggaagctgaagagctcgcgaagcgtctgcgctcttctcgacttgtctccttcgccctgacagccggcgcctgtcctctcctcggacaggtcgcggcggtcggtttgcctccacgagtttctctgccgatgtgcggggaatggagacggcgcaaagaggaggagggacagaaacacaagagagagaagagaaaaacaaaggagaacccgcagcagcaggagctctgacaagtacctgtccgagcttcccgcctgcggggcacaggaggtgtcgagtaacgagcgtcatttcgccgacagacacaagagagatccgagaagaagcgaagaacagacaacaccctcagggtaaagctgcgaggaggccagcgagacaaaaattcaagtgcgaacggcgcagagtttgaggcgaatgccacacaaatggcgaggcgaagcaaacgaaaggaggaagactggaggctgcaggcaagggggaagaacagacaggagtgggatgtccaacacggtgaaagagtgaggacacaaaaaggaaacgcgtaagaagcgaggcggagagagagaaccacgctcttatcttcccttccttgtatggacacaggaagagcgcacttcctcgtagaatcctctcttccggtttctccacgcagcgccgcccccccaccggccaccagaaagcgaaagcgttttccagtggaataaaatatgtttcttaaaagacgcagtccaccacgaaaaatatctagaggaagaggccgggcagtgagatcaagcggcagccgggcttctctcactcaacgacgcttgctgggtaatgttccgccgtatggagcgcagcagcttcctcggtacccttcggctgcgtctcgctaacacaggccaatctaagcacgcaatggagctcgctttccacttaatcaaggcttcctcttctttctctcaccccctcgtcgagtccgagacacacgcgcggggccgttttttactgtctcctggcgctgcccctcctcgtgaagcagagggtcctcggagagccatgttctgctcggttgaataccgcaagtctggcaggaaataggatgtatggaaaacccagaatttcctccccaccggctacgggcgaacaaaaaatctgaaaattttcctctggacctgtctgcaagtcttcaactttacgactccggccccgcggggacgcgactgcgagaagacaacacacgcgttctcagtggcgagtttggtgaaagcggccttgaggaggctcggcagagtttttcggcaggacaggcgcgaatctgagagttcatcttcacattcattcgttttcgatccccacaaagcgccgcgtttacaacacagccttccactccggttctcgttggagagagctcgagcgggagacaagctgcgcgttctgccgcaacgctctcttcgacagcatcgatagcttaaaagacaagacgggaaaagaagggccgtccgcagcagagagaaaccggatctccttttgctcgacacta

SEQ ID NO: 2931 - DNA, 2152 bp, Toxoplasma gondii
gagtagtgaagccacacgggtcgcataactatcatatcttcctctttattgttcctgttgtaagtaccgttcgacgtaccaggtaccaaggaactccctcgccgcgggctgtgctgttctgtgctgctcttgttagtttgtctgtctcttcgctattctgctcggtctcactgctccgctgagagggtaatgcgtctctcactctgacgaacttctaacgtttagaactgcaaccgggtggcacgcgtcgtttctagccttaactggttgggcgtcacgtgattgtgcccagtattccgctttaatattctgtttcagtgtccagccacggcttacgcggcagaacatgaccctttgcgacttcagcaacatgttctgaagaggactgctgacgttcaagcggtcaagttggtaacactgcagcatatttagcgtttacctttaacgcactgaaatgtgttctgctaatcaactacggtttatcatccgctgtcgctatgcagaatttggaagttgcggtctgccttcctgaagagtgtccgctgtgtggctgtttccaccgacagtcagaccggaaatcgttcgaagagccgacgtgaaattcgaaaattgcagtgccttggtaattagcttgagtagcgagcagtaactgagcttcagctgaccccatgctttccgctcgtccaaatgagaaacgaaatgcagggacttacacagtaatcctgcacgacagtaggtgatcatcgcggcatgcagcgacctgacatgcctctcacacaaggtttccctgtgtaaacgcattttggtctgcaatcatccgattgagtcttaaggaaacagagaaccagcccgctatgttctgacgcgatgtgtgcactacgtgagagaacattctgtagaatcacaaagtgtatatgacacggcgacgtgatacgctactgcgttgtccgtttgtcgtaactcagtcccctaaacggaacgcagcttgcagagaatgggagaaacggaggacagtgcagccgacgaaagcaggcgtgtgggtgaatcccgctccagacgccgggttttcgcggcttaatcggcaaggggcgtcgggaaaaggtgcctacatttttatatttctgtgacgtttaatcagccggagccgcctccgagcggcgcgctcaggctggcttttcacgagcaacggattctgtagtttgtaccatgaccataagcgcgcgtgtgaaaaatacaagtaacaacggttactcgagacaccgttaagaaaagcccccagctataacatgttccctcacctcggcgagtgtgtatcgttactctgtcaccggacgaaaagacttcaaacctcggaagaaatcacggttgtcacttttcggtgaagagtgcccatttctgggaggaaccacatcttgtttgtgtctggtcaatttccgtacgtcctctgcagcagcgcgcatatgctacacaaccgatagctttatacagacaactgactgccgttactttttgcgggagcagcaggctcacagaaaccagccccgtaggccgcctggaggccccgacgcgtgggaacgtgaggtggctttagcctacgaaaggcaccgtcccgagagtcacagcacgacttagaggaagtggctgtggtaagggaaaaattttttgaggcaaggatagagtataatgagttagagtggaaggcaacgcgaatcatcgaatggtggggaggtgaggggaggagagcgactcagctcgttagtgcttgcctgccctttagcttgttttttcttggactgtggggctgtataacacagcccgtgaaccgacgacagcacacaagcggctcaccaaggcctctcatgacactttcggcgagcaactcgtcggtggcaatttggcgcccttcaaggtatgctgccttgaaggaaggctctttgctacggggtggagcagtcggcttctttttttgtgtccaccggagcatttggttgatttccgtacccagcggctggctttgcaggttgtcaaagctctgccgcccggtcgcggcacaaaacaccgcgtgtttgttgcaggtacaaccgcttcgggatatgtcgcctgcttttcgatgaggagatgacgctttgaacttcctaaacctacgccacca

SEQ ID NO: 2932 - DNA, 2471 bp, Toxoplasma gondii
caaccagatgtcgatggtaaggaaagtggaagtctttttgtacgggaagtcgctgcagtttccgtgtcgttttcaagtacttgtcgatatttcgagttcgccagaaccgagagggactagtcagtgaagctcgccaaatcgactcgagcatgcgaaaaagtgccggtgtcactgtgtttcgtggtctcggggattgccgctggccctaatgcctgcgttcgttcgcgttccttgcacatgtgagttaccgtttttcgtctttctagcttgaactgttcggccagaaattattttggccacccgcttctgttcatcttctagtggcactccgttactggaacgctctgccaataatatcctgacctgcgcttccaaatgtggcgtccccaggactgcctctaacagatcgtagttgcacaagcgttacacgcctcctgacacatcttttgcttagagcacctttgcagtagacacgatagcccgtattctgtaggagctacatggtggtacccgccagtaacagaaccctttcgggagcaggagaggcagtttgatgcaagggaagccaggtgtacatacacctagcaggctgctcacagccgtcacttcgccagtgactcacacagttacacattgttatggtggaacattcggtgagtgttaatttcttggcaccaatttccaacagcatcggttggccatgtccacggacggctccagaagatgcgtgtctgactttaacggcctctgctgtcgtccctgcaaccggcacagctcgacttcgtccactagtcccgcgtagggttttgctgcgaggatgtcgtctggtgcgggactctcggggttgtcgctgaaaccgcagcgcgctgacggggactgagggtgctgtggatgtccggtggccagttgtacataccgctgcgaatgcttatttcgcagaacgcccgcgtctgccagttacgtgggtcacaagcgcctactttctctcaagcgaaatgctgggctgttcgcctgttgatggtacgccatcagtcttcaacgacgtctcaagcggctactgttgaacagaaacaaaattcctgtcgagcgggaaacaccgctttctcctcttgcgcttgttgccggtgaaaaaaacactcagccgattgaatgagacgcctttcgaacatgcaggttccctcgaaagtccccgtccggaaagactctgcgcgcctacactgttgcgggaaggctgctgatgtttacgggtcagttttcggcacatggagctgacctcatcaagagatgaaatgaggaaagagccatgccgcagagactagaggtatccttgactcgtttctttgtgatctgacggtttgtgatcaccgtcgttctgttgaattacactgctgcttatcataacacctgttcctccctttcgccagggcacacagtttcaggggccaggatgacagttcgttatctgcagagtcttctccatggaactcgctatgccagttggaggctgcagactcccagaattctgaggttgggtaacgacgctttggtttctgtatcgagatgagacggcaagaaggcactgggacgtggcacggcaagcataagcatgtgcgccaactcagactcttgcagccaccggcgttcttctttgagcatggagctagtcgccaaacgaatagtctcttgttgtctgaagcgcatctcatgacctgtgcagaaagtctttttacacaagacatcgctggtgctgatgctcatgtcactcttcaaaacccctcaaacccagaggctgaagcaagctcgagaaaccactgattgttactgtccagaaggaggcatcctttctttctgcacgtccgattcgtggaccctgaggaagtccttatatccctactttgctaccgccaacacaacgcagaccggcaccctcggtcttgacccgccggcaccctcgaagctggactttctttgcgcggtgtgtcaccgcgttccacccacgacggcaaagcgcttcttatctcttctgcccacaccgagagtttgtcgagaccacacacactcgtgcatgccattaggtgtctggggaggatgccttttaccaaggtacctttcctctcaaggttgtctggcatcgatttgaggtgcacgcatgcacgcgcgttttgtcaaccgtctaagaagcgtcaccgaagcctgagaacgcacaagaaacagaattgtttccgcttagaaaaacgctaattcattcaggtatgaccgggcagcctcgccttgtcattcggttgtgtctagctcctttctaaagttcgtttatcctcagagcggctgtcactagaccggagacggcgcacgggtggcggctgcagaacaagacacgcgacttgtcggaagcgtttcagagttttcacccttcactttggtctttcggcgacggaggagtttcttcagatgcttcaaactgcgcggaaaaa

SEQ ID NO: 2933 - DNA, 3957 bp, Toxoplasma gondii
gcttctccgtacgttctcgtcgacgtagaagcatactccttggcaccggcgaagcagaatgtactatttcatgcgtaggagcctgatcgccagacatcaaacacttccgggatgaatagttgtggtagtgcgcccacactcttgctccagggataaacttgaacggtgttgatgtggtgttgtgggaacacagcgtcaaatattactatagttgtcaagatagaggagccgtcacggtttggttgaacgaagagtaccgttatcctgtgtgcgctgctggcactcttcaaagtctgcccacgtccaacatgcttgatgtgcactggagccgacaagcgcattcagcatgggacgaagcaaacggggactgatcaagacatcgagagacggcgagtcttcagtgcaccctgcgacagacctcgcaactcgaatactatcgagtgctgtgacgttttggctcttctacttgcctcaaatttcagcaacgactttttgcctctcacgctgtgacgactcaaggccaggcgcagaatcgtgtttctattcggtgcctcgtgtgctaacctgggaacagacctatggatgacttgccttaccctttgttgcatttgtgggctaacgggtcgacgtcatcatcgttgaagatgactcatttgtatcctttccgccactgccgaaaaatgtcatcgtagaactccggacttcggcaaagaagagtggccaataactccggagtttggtgttgggacgtggacaaagacaccggagttcggaagtgaggagtgggcgaggactctagcgtttcgcgactagcagagccaaccacgcgccacaggccagctcgacgaggcggaacaaacgtgttcgacgcgcacgtgctccgccaaaggagccgccatcttgcagttcacgcgaggacctctccgaatcgccttgttcggcacagcgcgtctggtccctctggcgagcgagcacggccagcacaaccagcagaagcgttgtgaagaaaccccaagccgtcgtggactcgatccctcgctcaagcgccggtgcgagctcactggtgttgcactctggagtttcgtgcgcaaggcggccccggtggagaggacacgaggccaaagaaatgtggcaagtgccaccgctttttgaaggggaaaggcgcgaagacacctttctgtgagtgcgcgttcgcgcaatagtgggtacgggcccgttgagcggtggcgggcgtcgctcgttttctttcggctttcttggaggatacaccctcgatttgaccctgtggcgaagtgtcgtgtcgttgttcgtgcggcttcttttgttctgtggctgtgtcttttggctgactgttttcactttacaacattgttaacctgttttgccttcctgtcaagtgactcttctaaattttggagaaacgggaaaaccacgagtttgcgtacacgaattgacaacttgtcagctgtcgatgttagaaacggagaaaatggcatcttcgacgaaaaaccgccttagcaacgttatggaaagcgttagagacggtagtattgccgggcctactcaagaacactgtctgccagtgcagaggaacacagagggagatggtcttattcgagtgcacattcatcagcagaggtgcgtttctggcatggtggctctacgattgccgtctaggtaagtaagcgtttttggacgacccacgtacgtatccccaaagaaggtggaaaagaatgaaacaagcacagatcaggaatttgtcgtctgatagcaatagtaagggccactgttttggtacataactgtggatgcagctgcgccaaccgcgttaccgaatttcgtgcgaaggaatcttcagtagaagtgaatctgcatgaggtccccgagaacgctcagcatgtggctgaagtgggacacaccttgaatagtttaacttttcacgagttctcatgtgttgcttaacaaggggagctatacagtgaagcgccatcgttcaccgctgaaaagaaccggtgtctgtgccgttgatgccacgttttgatcgtcaattcccttcgaaacccggacaccaacacatgcgtgagggaaggtaaggcaaacgttgaatcaaagaggtgtacgtacacctggctacccactgtagtaggttttgggcccagccacttgctgagaatcagcagtttcatttcagtatggaactgtatgcggccaagcgtctgggggaacgtaaacccatgaattgtgtaacactcggcgcctgatgctaggaataaccggcatggacacgccttttcgcaccgggtcattttgtaccttcttcctgcctacgttcactgttttagaattctaccttgagagactttacgctcgcaaggcctccacgaacctgagcagcatgcctgcgtacatacttctacggagacaaatcttactgctcaacttgaacagtgtccttttcggtctcggtacggaaaaagcctgcgacaagaaagatttgagtccgcggctcccacagaggctttctttcttctgcaacgcttttgtagtgtaacaactctcatcaaacccgcggcgcaggctggcgttagaagcgggttccctgtatttgaacatcaaagatgcactctatacgcttcttctgcaagctgtagttattctctccgtaaacagatcgttgcctcagcccatgggcattgtacctcgcagcagcgcccataacacaccaatgttttgaaatacagttcaagttactcaaagtttctctgattctcggtctgttcctcccctccttcccaccacactctaataaacacttctgatgctacccctctatctcgcaacggcaggaaaaaattcacctccatgaaaccccgttttctgtcgtatgcgacacaccggctgcaggtgttactcggttttggcatttacgccatgtctcggcacctgataagcgcaaatggtaaggaactcaccgccacacaccttcgtatcatggacgcaccccacgtctctgtcgcctgagcaccgacagctcgagtccctttccgctgtttttttgttgtccagatggtacacaagaaagtgtctgattctaagcgtcctttgagcagaggcgacccgttacgcggtgccttcacgcacgccgaagcggtcgggtgggaggctccaaacgccttctgtgcgttctgttccctcccgttgtcgcccccctcaaaccatctgtcttgattgcggagactggaagcagtctccggccgacactctgattgtcgcttctgtttgttttgctaaaaaagagtgtgctgagcagaatacgccgaggcggaaaattctgttcattttgcgacactcgcggaagcagagagagaaactgggttctgtgttcagatttcctgcagagggagaagaatttacgaaacgccctggcaggctgtgcgcccccctcgggtacacacccagagcaacccccttgtgcatactcgagtttcaccgggttagcgtactagcttcagttgtcctttactctgctgactgtttttctccattcatcaagatccaaaccctctcctttctttctgttgttgtgatttttactgcgtctctcgctcgttggcgggctgtggaggaaaccagtttcgccggcacaccgcctccctcctgtagtttcccccctttgttcgccaactggtcttctgccaagtttttcttctcgttcaaggaagcaaatttcctgcagcaaaccttttgttttctcccggtcaaaatcgtctttctctcctttgtcctcgtacttgtaccctcggggtgttattgtccacactgcgtgctttactccctcccgtcctgtctctgtctcttcttgcccggggagactatctttccagaacgagcactctccgtctttcctgcgacaccgccttcgtcacttctcacccgtcaataaaacgtctacaaaaa

SEQ ID NO: 2934 - DNA, 1531 bp, Toxoplasma gondii
catgagactcgacgttggtacggtgctcgcagaacgaatgacgaacacggaagcacacacatgtccacagagcacaagagaagaacaagggcaaaaaaggcaggacgatcgccatgatgcttgcgtttccctgaagctgcagagagaagagccacttccagactccttcttccatgctctgcatagactcccgtgacggatttcattctcagaggaaacagtcatttctatggctacgccgcatgagaccgtagttcgaagagaggtgcctggtagacaaagtgtatatggaacctcctttggtcaatgaagaagcaccaattcctgttactcacacaaaccacttcagcgctgggtaatgcatacgaaacagagttgcatacctaaaattgacctctcctgtactgatattatatcttcgctgcaagatcaccccattagagcccccgaaaaatgagagactccagaggccatggggatatgtttcacgggaatatcttcgccacgaaaaccaacgacatcgtatacacgactgaaactgccctctgtagaaatatgtacgtcctgactctcaatagatgtcgctgcgatggatcagtgtggctttttagctacacaacgacagggtcactgctcgagaacgcgcatcgtgtgcctgcacaggaaaccatggactgcaagttcttacgatcagagtacaacaagacttcaggtcgttacagtcgacaacgtagggaagttaaaaaacctcttcacatcctctggacagaaatcaatacgctccgactaatactttacaaagtcgaaatgcgtacgtgtacggtcaaactgattgtaacatgcccagtgaaatcgcgtagctcagagaaaatacaccatcacgaaaagcttgcgtccaggaagcctttcagatgttgacactaacagatttttcgcatgttttcgaagctggatgaacgcaacgttggccaaaatctactgtatgtccttccggtgtcctcgaggacgcctcctttcaccgttacaaggtagctgcatgcgcatgtgcatgtcactcatttccgctgcttaacccgtgcgattggggattcccggttgctttttgttagcagcatgttggtgtgtatgagatttttgtttaatgaatgacttgaatgtgttctggtagtgtctccgtccgagatgcgaaggatgattcagccgggaaagctgagttctgatgaaatgtgtgtgtctccaccatgttggcataatcccgtcgactgtcaggtgaagcatggattattttggcgatttccctttacgcgaaaagcgcgcagtctagtcggcaacagtttcctcaagcatcctttcgggcatcttctcagaggtgtggttcgctttcacaccgtttcacgtgtacacctgcatagccgaaaggatcgtggctgtccaacgtgctactgtggtaaacacagtacatgtcctcttctctgtgttgctgcagccgcagaagggtaacggtttgacgagtttggagcatgcgagcata

SEQ ID NO: 2935 - DNA, 1648 bp, Toxoplasma gondii
gatgttggaattcctgtgacgcacacactttggaacttgcctgaataatcagaactttgtcgggccgaagtcgtttttgttctcgtacgaagacgaggagaggcggcatatgcagcgagtcaggaaccatcgacggatggtcgaaggaaagaaaagagagcagccgccgggaagcgggacgggaaagaagcggcagccttgccaagaacgtcgggtgtactgccaccgagggaggcgggcagctttctgcagaggaacgcagaacggagcagttttcttccgctcttcgactcggcttcggtcccagcaggttgtcgcgcgtcggcgcttccggacgcttctgcgtgtggaagaagcggccggacaggcgggatgcgtttgaagggaaatgagtctgcctgtctgaaatcgcgtgaggcaactgaatggtcggacgtgcgaggcgtcggtccggatggacaacaaaagcgacgcgtcgagaagaggcaagaaagggcaagctggcgcgacagccacgcaactggcctgctgcgtcccttgcagctgccgaaaagaagtccagcagctgatgttgcccaagagtggcccaccctccgcagctgctgtcgcgtttcgcgaccttctgtaaaaaactcttggacgtgcggccgtgcatcttgttcgcggaaagcaaggcattgatcgaccagtacgcttgcggaacggagcaggctaaaccctgccggcaaccgcgctgtcgcggaaacatttccatcagcagtctcgcgttgacctccactgagatgcacacaagtgaaaagagaatcgtctgcagtttccagcgatagcgcgcgaaagaagcggagccgcggagaggcgcccccggacccgaagcgggccgcagagcgcgagaggcaatggagcaaaaaaattcctgcctagaggagaatcgccattcctggtcacggtcactgcatacagaatcccctcccatcgtgggtctgatgaaaaagagaaaaggacaccattgtggtgtggagccgcggtgccgtctcggctttcccgttggtcaatgcagaagcgcgtccccagtgactagagccgaaccaccggcgactccaacaaaggggccttctactccattcaggggtgtcgcatggtaaaactgagttctctaatccatggcacacctcggaaaaacactactcacagtcgtggaatatcttaaatagtcgagcgctcaagagtaccaagctgcaatgcccagctgcctctcggacaacaccggtggactaggcagcgcatcaaggagacaccccccagaggcggccttactccagaacatgcgaaggatgtcactgttgatgcaaaatcagggtactgaccatcaagtgaacagtttctagagtatccacgtggctccaaaaagtaaagtatggccccacatcaaaccgagactagcctgtcttcgttagaaacgctcgtgccgatgacgtcagtgcatgcacgctgcagacacgacccaaagtagctgatacggtgaggaatgagcatgctgccgattcaaaatcgtcagtcgcggctacagcagtgttttatgtacatcctcgttttctttttattcaagaaacccaggtaacatgtgcttgaagggcggacttgggtagaa

SEQ ID NO: 2936 - DNA, 1755 bp, Toxoplasma gondii
tcgaattacgaaagttgtggtagccgcacaggcgttaccgaaagtggcgttgcctcttcagcggataatgcaaattgctgtattactctgcttggatcggtcgaagtaccacacagctttttctaccagaacgtgtaaatcagcgctgacaggtggagaacaggtgaggtattacagtctagttgctgcagaaggactacttgtgccgactgcacaagaaatcgtgttacccaaaaaggagtcaggggacccaagggatggaatatgaatattcttccgcaccaaagaacacgcccgtgcctgggaacgggtggttaattcttttctgatctcgaacaacccacctgccatttccgtacatctgtagcatagtgccaatgttgtcttccctcttactgtgatatttgtttcggtgcctgaggaacagtgtggctgcagtgctggttaattgccacagcagaaggcgacgacttgattacggacagcagccactggtgcacacttttgtgagctgacaagtatgtaacttcaagcaagctgggatgtacgctcatctgacgtgcatccctacaaccacaatccactgcacgcaagaaacaaaaccaccgcggaaccagctgagacacgttcccaacaggcttacggggtcgtgtcgttccttcctctcacagctgcagcaccaggcactttgccgttcctgaagaaaagaagtacgtgacacctggaggaaatttgtgtgctcctctctcaccttcacgcacgacaactggcacggtcactcgacgtacacatactgcatacgtcgttccacgtggagagcttccaagagctgcatgagttgtttcatacgacacaatatgtcgttaaggatccttactgcggctgtgaagacgcgattacctgacacagcaagaaatactgaacattaagtcgctctctgtgacagatgaatccgtgtcgacatgcgtcttcctgatgaacagccagacgtcagaaagagcgacgcgcaattgggaaactaaggaaagcagtttctacatcgatgacagacattcagagaaacttcagagcaaactaagctgggcaccgcggctgctgacgccgtcgagtacgatccaaagggacgggcatcttcctcatggcgctgtcgagtaaagtgccctaatcaattgttagtttactagcacaaagtgcggtgttaatagtgatatcctttgaaaccagtgggtgatttgttagtatttatgtcattcctccctcgcttagtacttttcgcttcgtggcaaatggcttcaaaagtcacgcgagaagcgattacgggacgtgccacccacatattttggatctgtgacagtgcatttgcttacaaggtggcaccgcgccatgttttcaaaaagattttttaagttgccagcaaaacgttcgacgtagcaattatgcacgcgtggtggcgatgacttaggcttgccgcgacaactgcacaatctcttgcatgcatgcgatccaagcacacactatcggctacggaaaggaggcttgcaaattttcgaattttatgctacatcattcccgcatctgtgtcgtctaaggttacatgtcctgcatactatcagccttttccacccggaggtcctcaaggaagccggtttggggtcatccatgcttgtataacgcatacaagggtagtgtcagtgctagctttgtcaagtaatggtgggttcaatgtcgcaatcaactcgagatgaaaatccacaa

SEQ ID NO: 2937 - DNA, 2351 bp, Toxoplasma gondii
gaagcagcttgtcactccttcatgtctgcatatctgcaggtatagacgactgtccatatatacatatatatatacatatatatatatatatatatatatatgtacgggagcgctgacaagccaccgacgcgcactcgcacatttaccactcatccactgtagagtgaatatatatgtatatgtttatgtgtatattttcaatgcatgtttattgatagtcgcacatagatggaaaagtttttaagtcggtgtatggatctgcatatgcgttgagaggaccattgtgcaccagagtcacttcaaggcttcgaggtgcgtttcactagggccgaagaacttctagagttcgttgcaatggataacaggtgctggtgaacgcggaggtcccatgctgagaacgggaggcccgcgtgggttctgcaggaacactctgtgcaaagatgctccactagacggccgcgaaagaatgcacaaaacagaagcggcgttgaggaaccaattcgtaaaaatgattctattcctaacggagacgcgactggttctcccaacaggctcaaagtaacctttagacaaatggaactctcgctgtatctctgagctcagcagcggcagcagggagagacagagaaacgaatccgtagtacaagaccaggccacgaactttgatttcctttgttctgttctcacgttgagctccacaccgcgggagtgcaccgccagtcctgtcacactggctcggcaaaaacaatgtgtagggtctcgcctcgcaactgcttttcgtcagtcccccatcccgtagtcttgagagtgcaggctagcatacgagatgttttctccagtgacgacgagtgttgaagaagcgcgacacaaggcgtcgacgcagtgtcatctgccagacatcccacaagggctgtcggtgtgcgcgacctcggcggcccaactttttttgaatttctgaagacactaacttgtttgaaacttccattttcgccgttaggatgacttcacggtctaccggaagccacctgaactggaaaagagtacagcagcatcccgaaccttcagcagatgagtgtaacttggatgactgtatatattggcaggtaaggggcaatcagtgcgagcgtaaggtttgccacgaaatttactcgggaaaacagactagactgtactagggttagatttatgatcttcagtacaaccggcaggagcgggtacactgtgcaacaggctcgtcacgcacttcctgtacgcctgcggaacatcttgtctgaagatcgtagacgaatctgtgagagttttccacgttcccatcttccagtggctcggcttctctcacttggcttccagcaacagaggcggttgttaaagagcgtttccacttttttcaacacctgcaggaatgctcaccactctccggcgcttcttccctgctttttcctgggggtagcccacttttttgttgaagttttgtcgagtccgcatacacgtttcgcggtgggtcaacgaacccccgtgtgcattgtgcccgccagtaacctgcagtttgtttcggcagcgagcgagaaagagcggtggattgcaagcgggaagacggctctgcgtttgagtctgtttccgccttcttcagtgtgtaaatagcggttgggacccgtcacttgtctaggaatgtctcttatcgcggatagcctttgtccgtcattccggcgatggtggctttctcgtccgcgtggatagtggtgtatgtttttcccgaaagcaattgaatttggcagagtccctgcagctccattttccttcctccggcagagaccctgcattcttgagcgaagagaaaggcggaaacgctggcgttttcggggaacgcagcgccgtctctcccgaagcgctgtcccgtgtccggtcagcgcgccgcgattcgcaagttccgttttttctgtcacgtgcatgcagatggacgacaggatggcaaggaccgcttttctctctacgaaaattctgctttcaaattcgtttctccacctttctctgtcttctttttgccgctctcgtgcacatgcgctctccaaacgttcgtacgcaaggggtacaccctcgacgcgtgggccgcttttggtgtccgtccgactctctttccactgcgtccaccagctttttctctgacagtcttcccgccgcgtcacctctgtctcggccttcttcaggccgtcgtccgtctcttacaagcgtttcacgcggagagctgcgcgcgaggttcccccgccgcggatagctcttttctaacctgtgccgccttccttgtctctcctcttgtctctcacgcccccgagaaatcgacttgcgcatacaaa

SEQ ID NO: 2938 - DNA, 1522 bp, Toxoplasma gondii
ttcagactcaagaaaatcgggttcaagtctggagctgcgaatgcgaaggctgatttgcagctttcttgagagtcgcaaagcacttcttttttttgtgccgatatgcctccttttttagttcgacatccttcgtttcgcgtcccgcagtcgccccagaagagagtccgggttgcggccgagcgagaccgtttgctttttcggattagatgcacattttgtgcctctgaaaatttggggagtttcgttcatgcagaagaccatgtacagcgtgcagcccataaccctgtggagggcaagggcgccattcatctgctgtagcgctcgagtcgcgtctaagaatagctgaaccgcgctcggagcgctctctggaattttcgcgaattcattccagacccacgatgacttgccaagattcgaccgcggcagaatctccggagtgctttctgcgcagcccagaactttgcccgaagatgcatgcgaccgtttttgccagcgcaaaaaccgtcaaaagttttcgatccacctcgaaccagtgctggattatggctctttgcgtctgtcgacgtttgacgtcttttctgttcgagaagcgcgacacgagagaagaaatacacgctagcaaaccgaagcccctactaggtatcgataccacacacacccgcagccttctggaaggagaaaactggtgttgagatgggccattttcaagcttttcctaaatgtttctaccacgagctcggcgactggggtttacgtcttcagtgccggtatctaccggaaccaagttctactgtgctagcgtggcatccaacacacttttccccacagacgttccttttaccggcagcgtttcagccttgtcagtgcaaggctgagagatcttttacaggactgcatggaacaagcaaagatttgggagggagatgcgtgttcatttccgcggtatatcagcgctgtgtcagatgagaaatccaccgggctacgactttgtgttcaggtgtcggagatcctgtgacaccggtggacagacagcaaagacaagatataagaaagcgtgcatttccatggatgcgtggcttatggtttgtcggcggcagcgagagagcgaaatcagacgcgccatacagtgcagtagaagaaagcaggccttggaaaatccgattcaacctccttttccgagtcacgccccagaagacattcccaactcgccctgtttacttctggctgagacaagacagctccccacaaacaacccgtgtcatgcaacttttgctgaatcgatttaagcgttgctcactcttcttccactccgaagaaccagcagcggtctcagtaaaagtgttttctccagacaacccagacacccgagtcccgttctcgtcaaagtgaacgaacgacgtaccagaaacgatcccagcacagacagaagattgatctgagcacgagtgttgcggagagcttgtaaagttattgtcgcgataaacatggtggaaacaacaggaagaaaaatcccggcttccag

SEQ ID NO: 2939 - DNA, 2842 bp, Toxoplasma gondii
tgaatcggatcctcgtttacggcgaggtctgggaagactgactttgcacgaaccctgtgctcgtcagttgtcgtggttgcttatgaatggccgcttgctcccgtttgtcagtcgctcttatattcgtcccttctctctgagcgacgcgatgacagtgcggtggccatgacagattcgtgcttttcattttgctccgagcgctctcagtgactgactattttctagacggaacaacggcaagagaaaagtcctagaccgatcagaacgcatttcgcgtatacgggggactttccctgttggtagagttctctgttcaaatgaaaacgaaccagtaaagcggaaaaatggccgcggcactgtatcttgagtcacacgccatcggctgacaacacgcgttccccgtttgtctagtggtcaccatcagtgacaggcatttggggctcacggtaaagacagcaagatcaagtggtggattctacgtgtcagggcattgtctgtgtccacacaaagttgccgacggatcgattattgctggagaaaggaaatcgccttcgggccgcagattacgctaaacccttcctataatacagaacgtggacgattcccctggatggagttgcttactttactaaagaaatcggacgtaaatgcccaccaagtacacagcaacactcgggtcagcggacgtcaagcgtacaaacacaccctaaaccctaaacagagtctgagtgggccgcaatcaatcctatgtagatgaaatagattggagatctcgacaggaacatgtgctaaagagctatatgaaggcgtactgcacgtgctgagcaagcagtttatcttgacgtggcttgtgactgctactcgcacggagacgcctcgaaaagcagtcatcggagttggcagatgtggaggtagtcctcatagacgagcaccgaaggttggatgatgaatttgggtggagtttggggggggagtgtgctagtgggacaactgaaggggctgatttatgaattctgcagaaacaccttcatctgaagtatcaagtagccttcgttaaacattgcaacacaattcagcactgcaagagtagcgtaggaatgcgttaagagctcttttcactcgacacactaacattcctcatgaacgatagaaggagacacagtaactgctcttgtgagtgacatttcgttgttattcctatcactaaagatacttttcgccgcaaaaggcaggaggtcatcacctgctcccgccgcaccgccagggtaggacaggcaaacatggacgtgcatgaacgctttctgtgtttggattgcgattttcagatatttgcagctataggattgtatgcgccggtggagtctgcccagaggatttttctgcacgagaacggtgagatcgatactccagcaggaccagcgaattgccctgtcgaaggatgactggggcgacactgtgtctcgtcctgcggaggttcagacagaagagtgataagagcacacctgtggaaggacaagcaaacgatcataaaggaaactaatggaacagcagaccaccaggacgagtgatcttgcattcaacaaaaggacaggaacatgtttctagcaggacgggcgaattgagatttcaagtattgattagagcgacactcgatcgcatcctgaggaatcatgtggaagaccagtaaccccccatgcgcaaatacataattcgagctgaggcgtaccagggcaagcgaggtttgatgcaacagaacatctagagcagtctatcggcacgtgaatcgcttaccgtgcgctgctgtgccgcacgctgcacgagtggcatgacctccccccgatgtcagtgaaaattcggcaaacgatttgggggtgctctgtatgaatgaaaatagagatccaagcctctcagcaggatggatgtctgatgagcgctgttaaggctctccaactgcaggcctagcttctgcagacgcccgtgtatgtgggagtttggctccgcactacgatgcaagtgatacctgctcgactatggagatccagtgttgctgatgggcagtgtttcgactcataggttgtttcgaccgcaacaaagtgcttagggggcccgttgatatggagagaggcaattcgctatgttgtgactggttctggccgtcggcagccccgggcaaatttgacagatctcgccaccacgtgaaacgcagaaagtgcaatatatgggctacggaactggacaccatcgatgagattctgtcggaatgacgcacagccccggatttaaaatactcgaagcagcactggtggctaaccacataaagacacagtcaatcccttctgagaagaggcacatagcaacgctctcccgcagttatggcttggtgtctgtcttctgttgacctgaagcgccgtttcaggcactcttgaacttgtcggccctttaaccgaagacggaggatttccggtgaccaatccagtttttttcctgctgactgtgagctctttccggaactgcagcttctaaaagcttgcgcatcgaagaagagacccttttgttaagttcggtagtccgggacggcccgtgtgaagggagcagtggcaactcgtctttctcggggagacacactttttgtgtacagatctgtcggtgaacaacagttctgcagagttcgttctcgtagtggcgcgcccccgtttcagaatccttgaaacggacaagtgcagacagtcgaaaagttagtaaagacaggtagctatggagggctatctctgtcctgctgctccgcgatccggaacgacccaaattcacagctggtgggtcagccttcagggaaaagcatcga

SEQ ID NO: 2940 - DNA, 3295 bp, Toxoplasma gondii
aaagcgaacaatgcatcgggttttcgccagcgtttcagcatctccagagtcttcctctacatttgagcgaggggcgtcaactccagcagagagctgagagtctccatttgccgcatcttccatttttgtctattggtaaagtgatgtgtggatgtgagtaaaggtgaggagcggagcatgtgtgtaaaagttcttggcttttcgaaagggtttctcgatcagggcagttccttcgcggagtagaagcatgataatccaaggtttctcggcggtttctgtacagagttcgggaagcatgagagcaccatgtatggacagtggcagcacacaacaggagagtggaggagagaaccgcttaaaaaacgacgtccgaagaataaaagcagcaggtggcaaacgaccacgggcatggttccgcattccgaaaagtatcgatcaattcgtttgggcgggcaacctaaaatatgcatcattctttctccgagcaaccgaagacgtgcttttctgcacactgtgtagcaccaaagcaaatacgtagaagaatctttccacgttgttattgatattgtttcaatgtgtattcaatctaaaaaagaaggaaaccgaaagatccgaacgggagatgaaaagatgctaggttcaatgagtgcttttaaagctgactgtcatgcgcccctcaccattgccggtcttagttcagcaacgaatttgcaccagctgaaatccacagttgaaaacggccgacaacgacccatccggtaaaaaacatggaaaacacgggtttcttcgccgcagaaaagcaggcggtttatgggaaccagagccgagcttttcaatgaatagcttggcattctgaacaggaaacagcgaaatgaggctagaaccatttggaacgtgcgaaacacctgaagcaagaaaatgtgtttgtttgcagagcattaagcaagagctaaacactaggaaaagacaagccgcccatccgaaggacagatctattccgaatgaaaggaacatgtcaggagaagtacatgacgcggaaacaatgaaacattgcacgaataggagactaacctgtagcgtttagtcgtttagtcgtcgcgggctgtcatcatccggtgtccagtgaacgtcacggctcgctcaaccgcttgatagtcagtctatgaagcgtggtgaatcacaatgaaagtgtgcacttctaaaaaaagacacggcaggattccagtcttgtgttgtgactcgagcggagatgaaccgaaagagctgatcaggagagacaatgcatgtgttcgtaggctcgcaccgttcccggaggaagccgagactcagttggcgaaagagattagaccagtcgtgacgggaggcacctcaaaaagatgacggggagctaaagataacgtctaggaggaacggatatctctttgctgacaagcggaggaaaaacggagaatttaccacaggtaagcacacaggcaactgaacacagcgggagcctcgctgtctcttgggcatgtgcgacaagcctcagcatagagttcgtgtgaaaaaaaactgttgtcactcgtcctttttcatgactcgtcactcgggagaatatgttgtcgtagatctgagataaaatcctttcattcagggataattagaggtgttgtttcacttcgattcgggaaacgtcaccgcggtctccgacaggaacagagccgccgctgcaagacgcctccctgattttgcgcgggccttccaggcggcagactgtgcattctgatggcctcgtgttccagcttcaactcgaccacaaaacgagagggttgattacacgaagtgacgaagaggaaacgaagcgaatgtagagtgcctcgaactgtggggtgtctaaattctccacattttacctgcagacttataaaacggggttatgccttcccaccgctggggacaaccggaaacgcaatgtttgttgctgaacagacaaatacgagatagtgtacacgcatccgtttgcttcagtgttgaaacgagaaacgatttggaagcggtcggtccagctacaatttcccacgtgcttccatatgttagtgttgcctgaaatggcatgcttcacgcactgcaccgaggctctcttgtcggagaacatcgaagtcggctgaacgcattcgtccaatagattaggggttcaacgagggcaagaacagatagcagagcaatgttgttctgttgatgctagtaaagagacatgtgtattcttcaaaacactgttgccttcttgggcagtttacagcatcgcttaatttgggggagggttgcttgtgagaagtagagtaaccactgaaatttcaagagctcatgtgtaagacagcgaacaaatgtacctgatcaaattttattcgatgttcagaaagtgtctaggggctgcccgcttccccaaacgaaaacagacgtgtacgggtccattacgcgagacgtcgcggacatgacacaaccggcccgtttgcgaaatgcgtggaagtattctctcctgtatcgtgatttaccataaagacgacatagtggccaaaattccctcccagagaaaaaaaggcggccacctcaaaagggtagttcaaatggtttcaattcaagcaagactacatccatctggggacgacaacttgcgatctggaaaatttgatggattctaaatggtttagggaccttggtgaaccagagtggcacggaaaggatgcaagtttcgaggcatgtcatacagcggcctcaagtccacaatggaaaagcgatctacagaagcgtttatgtataccaaaaaggaagttcaaattcgtcgatgacgcctaccgcagttcaattgcgttgaatcaactgcatatattgccggaaataatggaaccggaactcatgtctagtgacttacgacacaagttataaacgggtgtttcatctacacgtgtgcatgccccgggcaagcgtgaaagaccagttgattgtcggatagacatcgaagatgcacggcaatgggaaatcttcgagcacagagagcggctgttctgcgcagctggggcgagcgtctcgaaagatatacggaccacagcagggttttacttcgtttgtcttgtcttgccgtaggacttaatattgtgtgtgtgaaacttcaaattgcaaagtagaagcttgctccgtagtaaagaaagcctgaacagagagctgcgccaaagcctgcgccatctctgatgacaggctcgcacgacctcctctgccacatactttttaccgacgctctaccttttagctgccgcgaaaa

SEQ ID NO: 2941 - DNA, 1572 bp, Toxoplasma gondii
ttacaaaacactcaataaactatcaaacggctgcgtgcgtcgagaaagctaaaatttcccaggcaggcaaacctcccagcccctaaatgttgtgccagtaagagaaacaagaaaccaaagactcccacacagggctttctggttctgctccctctgctctctgagagaagcgaccgcaacctggcaagagtatcgcgagcacacgaaggacttttcgggaaaatttccgagtttcttggaatccccgcatgcaaacaaagaaaatctcgaggtcgtcacagtttaaacaccacatacacagttactgaatcaaccttagcagaccgtctgaagtccgttttccccggtacaccgacgtgcagttagttacacctctggaccatgagaacttagccgcacgaacccacgaaccacgcctcattcaagtgtctcaacaccaaataaaaaagagaaaatagtggccgtctcggtttctgtgctgggaagtctgaccgtgtccactacgactcgccagatcgctgcggcagcgctcgcggatttcctgtgggcgtggaactcgaactgaaagttcgactcccgaggaagagcctttttctcagaacctactgccaacttgtcgctgaagcgtcaccatcatgttgttgtcgctttcggcgacactccacccggaggtttgcaggaacttcttgaggtcggcgtcctgttcgtaggtggactgttcgtgctggatctcgctctgaatcgttttcaggaggtccttggaagcagcttctaccgagctgtcggcttcggaagagaaagctcttttttcagccgcaaaagcggagctctgggtgcccgtgagcggggagaagaagcgactgtttgtggctgccgccgcgagacccgcgggggctttgaaagggaccgctccgagtctcccctcgcgcagcaccgcagagcagaaggaagaagagaggaacatgcgctcgcgggagctcgaaagaaccccaggaaggcccagtggggttttggaagaaaagagacgaaaaacagaggcagaagtcgccatggtgatgaggcggggagacagcaaaaacgcacgggaaaggcgggaaggcgagaagcagacgacaggcaagaagaacaaaactcgagcggaaaaaacgacggcgcgagaagaaagggactcctgcgactcggcgaccggagagatttctcccgcacaagcagctctatgaagaaagcgcgaaacaggggcggtgaaacgctgagagagaccccgcaactttacgacgagaaaagtggaagcacaggcggcgtgtgcgtgcaagaagacttccggaattacgggaaaaagagcgagggaaagaggagacaaacacgatgtcggccaggcaccaacaagaaaaattcctattgcccgttaacagtggtgtcgtagcgaaccccacagtcgtgtctctcgagagacacgccaaaggcacactcgagacctgccaacttgttgtcccccagactccagccccgtttcgacggaagctggattgcagatgtctttaaatgtgcacagaaaaggagacgacaccaaca

SEQ ID NO: 2942 - DNA, 2782 bp, Toxoplasma gondii
gaaggaaaggaagcgatgtcaaacgaagcagcgaacgccgctgagggcaacccggcgggtgaagagaagaaggagaacgaagaaaatagcgaacaagacacttcgggaggagaaaaaaaggcggactagacgtcgaagtttccactgacattcaacaccttctggtctgtccacttggacggttttctctctccgtcgaaaaaacgaagagctctgctttcgtcgtgctggtagtcttctgtctctgctttcgtctgtatcactggctcttgccgattctgcgcagagaagaaacagcgagttgcaactccacaggaaggacgacgaattcgaggaacctgcgcgcgtcccctgtccctcaactctctcttctcgctctttgtgtcttttcccgagcttccttctcgggtgtctgcgggcagcactgacagagagcctcaagcgacgcctcggtctttcagtttcaggggaacgcatgcaagtgaccgagtcgcaaaacccccgctcaatacgtagcgatgagacatcgcgacctcatagcggttgatagagagcagccagcctcgattttcctcacgctcacacattcgctgagtttcctgaaaagggcgtgccgtcaagtccggtctcacttggaagagagctttcttcgcagacagactcgaagcgattgcaggtctcactcgagcgtttcgacgtacgttgagaaaaaagaacgtgtgtgaatcttcacttctaacaaagagacaagggtcggtgacgcgacctacttgcttgctgtttcattcaaaaaatgaaagtctacaatccgcgcttctgctgggctatcgtgcgccgggaaatcgtacagaggaagctggagaaagaaacaggttgccgctgcgtttctgcagtgcacagaaaaaatgcttgagtgtgtctgtgtgaggcctccacgttgcattatctaaatcgcgtaatagtggtaaggtggaattgcgagtttttcattcgggtcaacttctacagttctgggtcgcggcaatcgcttgctcacagacagtctccacttcacccagtgctatccttttccagttcgcggcccagctgtgtgagtcttcaacagtccctaacgccggctgtttgcagaggatgcgcggcatctcgttttcacctgttgatagggatcggcgctggtttctcacacacctggaaaactgttgaaaacaatttgaaaaagcaccatttgtacacccgctgcagaagcatcacgacgcttcggcaaccgcctacgtactgctagtctgtacggaatttacggatcggggattcttgctggcctatcccccgttgagtaactggatgaaaaggcgctgtgatgttaagcaacagagagagtgctacacaccataattggtgttgcattgccagaagtctcgttcaaaaagctccccttgttattgaaaaacattcacgagcccaaaaccgtaacttgaggaatctcagaagtttgtgatacgctcatgcatccggtgtccaggactacctgacgctaccgtcttccagcttccaaacagtcgagcgcaagtaaaactgttttaaacacaccatttgtcacgtaacgaaaaggcatcgcgatttgagatcggctggtacagaaagtcaaacctcgtactaattaactgagttggcttaacagggcggaacgagaattcgcgtgtcttggtccttgcaagggagcctcgctggaaactgcctcttgaaacctgaaaaaaccacacaaaaataaaaggatgagatgtgtgagagcggccttttgctttgcggcttccccaggcctgaaaaatccacttttttcctgtgttttctcgatgccgagacgagacagcctctcgacacagacttctcgctgtttcgcgcgctgcgctagccagtgcttttttctcccgcttttctctcgagaagagccgggcaaaagtccgaatctcctcatagttgattgacggagtctgtcgctgaaagattccccagtttccgtcggcgtgcatgcctcaccgaaaaaagtgactttcttggaaaactccgcgtgtgctctcccgcgggagcttccccttctcgactttctcctgaagcccccttctttctccattttcgtctgtttccagtttacttgcttccctccattcccttgctcgatttggagaagttctccgcttcctgtgcgcattcctccagcgcctgtcctccgctcccagatgcccccttcgcgaaattctttctcccctttgaggcgtctctcactggcgcgcgtgaacgccattcgcttttgcttgcaaaagatacttttgcggaagttttctcctctgcaagcgatctcccagctctttccaacgccctcacaacgcgcgtctctgcagctgccgacacagcggcttccagagcctgtctcaacctaacagaggttgccctgggttctccgagcgtgctctctctccttttctttactcgagggaaacaaagttgacttttacacctggctttcgcaactgttctctcttactcggcgcgccaccgcaatcagccgtctaagcagcgaagtcgctgaggagaaattcgttttccctctcttgtgcaaggccctcatctctgaactccgacagtcttctcccgtttcttcttctgctctttcttcaacctttgccttccctcgtcttccctttcttctcttgaatttcttttttctgtctcttctcgctctctgctgctctatccgtcgtttgctggccgtgcatctcgaacggta

SEQ ID NO: 2943 - DNA, 1801 bp, Toxoplasma gondii
cttcttgtcgagttcctcctccaacgctgtgatccagttcggcatccccgagttccgcgggctgccctctccactgtcacctgcaggcgaaggcaagactgcatgcggaggcgagttcgtctccgggaggccctcgccgttgaaggcaggagacacgccgttgggcgcctcgcgagttgcctctgaaagagtcatttccgccttggtgcatgcgaactcttcagctgttatttccagtccagaagaacattttcagcagcgactcctgacaggagttcgccgaggccttcgaacgtagcggcggaatcactggtcagggaaaaggcgctgatccgtgagcagaggacagcgaacgggtcctcggagcgagaagacgcgccttacgaggtgagcttcagagagactctcagacaaaaaaaaacaacttgttgcagacaccatgctcagacagcggaacatggatggccgcagagggacagagacagcaaagagcagggccggattcacccgtcgggtggagatagagaaaagaagacgaaagagaagagagagaacaagagagcgaggagagggagaatggatttgtcagggaggagccagcgagcaccaattgaaaggacgcacacagataggtgaagacgcgacagaagtaggtcgagaagagcccaggaggcagagaagaaaatctacaggccagttgcaaggtaatacggaagaaaggtcaagataggaggtgctccctcccgagcgactcgcaaagaccatgcagacacaggtgatgaaactactcccttctcgaagaaaggcgtttccgcctacatccctctcctggtcgggttgagacttctcgacctcagtgctccgaaagcctggctttcgcggcgccctctccgacttttcggctttcttctctaccgagagacgccagcggaacgcccccgtgaacggcgaagcaacgactggtcttctggagttgagaaacgggagtagacgcagcgtgtgtagagtaccgataccgcgagcaggagcgatcctgagctgtctgtacaccgaccgtggagaagcgggagtgatggcggcggggcttccgagttggaggccgaagaagcgttttcctgaagaaagacgagagacttgaggccggaagaagaaagacgaaaaaaaccgggatacgcgacagactcggttgacagacgacgggcggaatcgcggagcaaggacgacccctacgagatttcctctcttgtgtgtcaggaaagctaaagagaagaaagagaaaaagatttctccgaccgaaaaccgtcgaggtggaccaacgtgcgagagcaaaggtcggtcccgaaacgaaaaaaaatctctgcatgcgccagccattgtcacttctgcgccaggggagtttccaggggatcccaacgttgtgtgtctcttctgttacctctttccgtttccgaggctgttccacttttcttggttgaagaacaggggttccgaaaaaaatataaaagtacacatttgtcggatgcgtgatatctctgttcaccctctttcttcttcatcgtccttcctttcctcgtccttctttctcggatcccctttattccgttcctcttcctcttctttctcttcttctgggtctcctttcttcctcgttgtcatcttcttggccatctttcttcttcactctttttctgggtctctcctcgctcactcttcgtccggcagctcatcttccctttcgagccgcgtctcccgttcgacctctcttctcttggtgtctcgcaactcgccctgccgtctgcga

SEQ ID NO: 2944 - DNA, 1865 bp, Toxoplasma gondii
cctcctcttccgccgttccaccttacttcctctcctcttgttctcttttctcttaccgctgtatgtcctcggggctgaggaagaggctgctcagaccggagctccgcggtccagagaacggcgagaagcaggaggcggtgcgggggagaggaacggagtctgaggcggaggacgcggtggccgcctcgggatgcgactctccctgcgctgcagaggctgaggaggacagtccccgaaagcgagaggtgcgagcgaagagcgacagcggacgcctccctctcatcttgtctccggcagaatctcgagagagagatgcgcaggcgacctgtccgaaacagcgagaacgccgcgaagagacaagaaggagaacaagagaaactggggaaacgagagacagaaaagggaagaggagaacatgaggaagaagagttgagaacaagagagaacgagaacaggagtccgttcgtgaggttgaggaagcggtttgtgacgaggaggcctgaaggcgggtgtcggagcgacgcgagagaggccctcaagcgacctgcgtgaggctccaatcagagagaattcgcgactactctctcggcctcgagaaaatatcggagacgaaaggggagctccgagcagctgaagaaggttctcgctcgcgccaggcctccagagactggcgcaaaaaaaggcgcgaaaaagcgagagcgaccttcgttttgagaagagagaacgaaggcgagggcagtctgccagagcagaccgccctctcaggcgtttgcggcgtgtatatccactacacactcacaaacgcccgagaccggccaggcgagaaggatctccggagacttctctgcggtgccttcggagtctttctgcagaaggaacgacgcgccgcgcgcaggaagaaaagaacatgctcttgctgtttcgcgagaaggaaaacgcacctctcctccctctgggacttgctggccagtgtccgcgctccaccctctcgccgggacggcagggcgacgaaggcgctctctccatccgtccagagaagtccaggaaaatctcttcggagtcgaaagtcctgagcggcgccgcttcccgaggaaaggaagctcccgcgcttctgcggcgactcgcgaggcctcatatcactgctggccgccagcggcgaaaagtcgcctctgcatgcgcgaacagcgcggcctgctgcggagaaaacgtcttcgagaatgcagacacaccaaaaagaacgccgacgaacggagagaagaaagagagagagggtggaaaaggaagagagggagcggggaaaaggaagagacaaactggagaccgcgaaagcgaaagagttcgagaatgagacagtgaaacatgtttgtgtgtggaggagcgaaaagccggggcggctcagggcgaggcaatttcctcgcgagttttcgctgttcccctctcttttttagttccctttctccctttcttctttctccgcgttggactggacttcagccgacagcagctgctcttctcagattctcttgagcttctcttcccttggtccggtccctctctctctctcgcgtctacgcaggtccactactactcgagtcgaccgtccatcgcatccgttctcttctgtttcgacgcgcttcaagtcaacgaccttcttctctgtttcgcgccgcttgtctttcctgttcgtcgtccttctgctgttcgtcctttcctgtgcttcctgtcctcgctggtagagcaggcgtcgagcggaagacgtctttttcttccgttatttgtatttttccttctccccgcttctctgtctcctttctttgcctctcctgtctctgtttttagttccttctcggatgcttttcgcagca

SEQ ID NO: 2945 - DNA, 1748 bp, Toxoplasma gondii
agaccgacacacacgttcaacagaactacaggcacttccgcatgcatacagatacatacatacatatatatatatatatatatattataaatatatatatgtatgtatatatatatgtatgtatatgcatggaggtggcacttgactgggtggaggagaggagcggatttcctggcagatcgacagacctcccgaacgagccggctctccccacctgataaagacgagtcgccctggcgagggagcgagctgagagaagtctgcatgcgtagatcggcgccaggtggagacgcggcgccagcagagcgcgggggcaaaaccgcaaagttgttgacgaagtcgcttccgaaaaggacaacgtggttcattcccgaggaagaggggacattgacaacagcagagacaacgtgttctctgctcgcaggcgagttctgtctctctcccccgaggctctcggctctcggcttttttccagcgccggcgtgagacgagagacctgcacccatggcgaagaaggaggagagagtcgcgaaaagagaaaaagacggcgaacagagaggagaacggagagtggaggaacgcgagaagacaggggacccgcgtcgagaggggagaacggacaggagaagggagagtagcggcgatggaaggagagcacgacgcgaggggagaaacagggggaacctggaatgaggacaacgacgagagacaggggagaagagacagcgtcagaacgacgaggagacgaagacgcgaaaggagacaggaaggagggaatgagaaaccggatgaactggcacgaaggcaagcataagagaaggacgacctgtcaggagagcaggacgacgaaacgttgagaaaagaacgtgtagaggaaataaagagatgttcgtcctgtgataatggaggcagagggacgtcgcgaatgctgtttgccttgcatttctttgatgctgacaggagggaagggatttgacgaaaaaacgaattcgcaggtttctgctgtattcgtgacggccaaaagtgacgaacgaagaagcaccagaaaatcgttcacaggttgcactggagacgataggccttcgagtgaagagcgatttcctgcctctatttctctttacctccgcgcgcaccgaggaacggcagaacggcactcgtcgaggcgcgattttccacgcacagtcaccgtctgcgtcttgagttttctcgacaaagagagtttctcggactcttcgctcctgtgttcgcgaccgtcacacaacgctttctgtctctctgcatgcacacactgcgtgtatgagaggcctcctcgactttcacctgacggccgacagaaagactctcgtcctctcccgtgctcgccacgctgtttttcatgtccggagctggggagacagctgtcggcgagacaagcgacgaaagggcgtttcccggagcttttctgcggctctttcgcctcagagagcatctccacgctctctacacaaagaggaaaagaaccacagagagagagaacgcgctcgcgtagtgtcgcaggcttcagaggcctcagagaaacagttgcggccgcgcacaacggtgttccacggaggtctctcagcgccagcggacgaggctgagttctctgtcttttacgcggagtgggtttgcggctttttatccgcagaaagacacaagggctgcggcgagaaaagggggcattttcgtcaggaaaaatggaaaacgggtgaagcgcttcgctgttttca

SEQ ID NO: 2946 - DNA, 2337 bp, Toxoplasma gondii
acacctggtacgttgttcagttgattccagtgctaaaaagatttccgtctctcaaagagtattgcccctcctgtggcagcgaccttccgaggcaagcagaccgcacagcacgagcctccgttgctgggttgaaccgagggaactacgcctacaacaatcaactgctgagacaagaccatgtcacaccctcttgtgcagactttatcattttcagattggtattttaccgttttttccccgtcgcctcctccgtccccctcattcgagtctcttcagtgcccgcggggagtgaaaaggaccccccagatcggtggacttggacatcctcaaaaagaacgacgcccgagatcggcgatgccaccgccgcttcgacccattttttcaaggtcccccgccgccccccaaacgtcacgtggaaggacagagctgcaagacctcaatgatttccgcgtccggagttgcgcgacgagaacaaagcatctgagcctcaagtgagcaagacatttcttcctcacgcactccggcgattgcggtactcacggtgccatcgtagaaacggagaagcctcggcttcccgtgattgttcaccacgataaccgccttgatcatctcgggtatcttttctggtcgaaagagacaaggaaccgtggttgtttttgcgcgataactcgcgtccttcccaccagcgagacgtcgtgctttcacgcctttctctccttcctagtgaaccgcaagtagcaatggcagtgcgaaccgtacgaaggatcgaagatgagctgacagaagatgcacgcggtggacttattcctggacgcttacggaagaaatgcccttgccaccggcggcgattggcgtttggctcacgactccggagtcttccacgacctggaactggagatgtcttaccacacggaaagggatgagacaccgactctcccttcaaggcgcatgcatcgccggcgtcatgacaaggaaaacggaaccgtcaaccgtgttacggggacgaaaatgcgtgtcagcttgtacacggtgaactcgccgtacgcgaggacccccaaactcgaaagccgacacactggagtctcgacgaagatagactttgaagcgctccccaacataaatgggaagacaggtgtgtctgttgaccattgaaaagaaaaaaaacggcggggtggaggctccgaaaacgtacaatgacgagacacaagtggtcaccagacacgcatgcgcggttctagaatacacagaaagtggatgtcgacgtctgtcacgtcttcctgggactcacgagcttgtcagcgaataggttgtgtaccaagtgaaccaatcccgcgagtagatactcgcattgtcccccgatcttttgcgtgagctcgacacgccgttacgggcagttaaaaggcgcagaccagggaaaggagataaaggaggtatctgcctcgacgacggaaaaagcgacatatcattgaccactgccagaatggattaggatagaaacacacacttgtacatcattcgcactgctatctgtgctcgagccgtccatggtgacctagacccaactttcatcgggtagatacgggttgcatgcaaaggagcatcctctatccttcgctgttgcggctcaggcggaaaaactcgaattaataacttggtacacgaaacgttttcaagtcactctggaaaggggagcctctaaaccctgagaatgttttttcgtggcaatggaggctatccgcttatgtcggctcatatacgaactgctatcacgcctgcttagcttagttggtagagcatccgcctagtaagcggaaggtcgtcggttcgactccggcagtaggctttattttaagatgtactgcttttccgctggtactggtttgagatgattcgctgtatttccttcttctcggtgcagtacaggacgggaaagctgctcgacgacaaaagaaactagcgagattagtgggagtcttataggcccgctcagtgtagaggtaaacatttatccagatcgccgcggctgatgacgtctgctgttcagtgctgcgcaaagaaaagaatgctttcagcctcactccccatctccccgtacaggtgttaatgtcttctgcatttattgtacctcataacttgcgggagcacacgtccgcggcgaaggtgcctgtctcacattcgcagtaagttgtaaacccaaagacggtgccacgctattcgaaggggcgaaacagcaactaaaactgattgaattaaacgtgcctgcaagtttgtgaatcgggtgtttacgttcattggtggagcctcgcaagagacagagtctcacaaggcatctgaacg

SEQ ID NO: 2947 - DNA, 2559 bp, Toxoplasma gondii
tccttcatctgcgtacacaggaaaatctgtggatgccttcacttttcacatgcatccgaatactgacacattcatgcaacctgcgagctatggaagcggtcggaaagtccagtgttttgcggggtggatttacatgaaagaaagattgacacgagagagttttagttcattgcgtctgaaaaaagcggtctgttcgtcttcgacgatgtttctgtgggagacgtgcatgtcttctctgtctacatcggagacgttgtttctgtcatgttgtgtgttggaggtgtttgtcttttaaaagaatcgcaaatctccctatacaaacccctcctgccaaaccaaggcttttgacgcaccgtcgcattatcgcctcttgataaaatagtctctgccacagtctgatgtttgacaagcacaagatttcgtagatgttttcagcgttttcggacccacctcctgcattcaaacacatgtgcttgtagaagtcgcgtgaatttataaatataggcaaatgtgtatttaggaaaccacgaggaagatgaccctggcgtttccgtggtgcatggtgcctgcttccctggggtcgtaacgtttttaggtgacgagaaagacgaggatctacccgtctgcaaattcatcgttacaccgaggttttgagacaggacatctatatttgtgcaccgttgagccttactttgaattatttaactcaatcaggattaggttttatataccaccagatctataatcgggatgcctgtcgcttatataaatcgagtattgcttgccgagttccatgtgtctattatatagatcactatgtacttaggatcagaccgaaagagtccatagatggtactaggaaatacgagatcgtgaaagagggaatcactcgtcacaagcttggatacacttcagcaaccattgctgtccgccctcataaatgccattcaattacaaaccgatttcggttccctcgccagtgcctcggcataagtccgtttccacatttcccgatcgcctttgtttctcgagttggcgttcacaagactggccgaaataactggcagctgctgaacgcagaacttcatgtgacaacgaacgacgctatccttgagtgcgtatgtctttatacatgttcatgtgcacttgcacatcgatatgtcatctctgcgaagacactaggcatttttcgaaaaaactagacaagcctcttccttcagtggaacaaaacgcctcatccggtgcctacaaacgtggaaagacctgtctgcgcgtaagacatgggtccaccgttgcatttcacactccggatgcttgctcggaaatttgattgggttcttacacgatcttgaaaaagcaaagccacaaacccaacagccccaacacattgctggtttcacgtggctaaaaccgattccccttttccccctacaatgagctcgtgcgtcgtgcatcgaagacacgcgggacccgctttctttcgcctagacgcagtcgaaagcacttgcgtcgttcttcgcttcccactgggcgaacaactccacctttccccagaagatgccacgtttgtgctttttcttgcatcctgttttcgcacgggtacgggcaactcaagccgagaacggcagctttatttcatggatcccggtgcggtacctgcggactgcgcacaagcgtgctagctgcctgcactgagctgcagcgctcttgcgtcttagcgttatggagtgagtttcgcgacttgttcatgtcttgctgcattcatcttcagctgcttctgtctctttctaggtgtaaacggcctcggcttttcttaatctcttcctggaaatctttgccacgaagcgagaccggctcgctctttcggggtcctgggcagcggactaggtccacgatttcagccttcgcgttttggttgaattctgggctttctctgcagcagctctttgcttttgcttcggatgcggttcccggttttccgggtgcgatagtttttttgactttctcctaaaacacaattcttccgaggttctcgcgcgacgtgcgcgtgcaaggactcaaaagacgtcaccgcaaattcacatgaagaagacctctcagattctttgtgctttagcaagaaagactccgcgaggctcttcgcgcttcggtttgtgtttttttccagaaacctggcgcaggtttcgcaaaattatatgtccaaaggcgaccgtaaaacgcatttcttgcgtgttggtctgcgtctcgctcacgttgtccctcccgcttttctgatttttacaactcgagcttcccttctctcctctgggcttccttcttcgttcggctcgctggagacattctctcaaaagatttgtattttctttgtccgagcaaaacggctgttcgccgtcagcgagctactttggattccccgtcttcgataggctgctgtgccctggtcttgaagaccgaagttctagagacattcctacaatttttttttcgtctctgacttctgtcagaagagtgttttttgtcttctctcttggtccttttgttttactcggccgtctaaaa

SEQ ID NO: 2948 - DNA, 1712 bp, Toxoplasma gondii
ccgcccatggcgaggatttgctgagaaatttggaggcaaagttctctcgtgggggcgagaatgagcgcgtagaatcgctgcgtccgctgaagcagccgctgaagaataggcaggccgaatgcagcagtcttcccgcttccggtctccgccagcgcaataatatctcgaccctgtagggcgtacggcaggacctcggactggatggctgttggcgacttccaccccagagttgaaacggaggcgcatagctccgagcacagaccgagagaggcgaaagtgggcgacacggcagaagcagagattgtgggacaagcagacgcgtccggggctggactcttgacgtcctcttctcggcttttcttcttcttgacgaccgtctccggatcggataggccggcggcctttgttttcgagttcagtgcggtgtccatcgtggacaggggaaaaccgaggtcaacacaggctgaaccacgcgtcaggacaccggaggcatcagaggacgacgagcagaagagttatgcaggttggagattagcaatgagaaaaagaaagaagaaattgattgcctcctcgacgcgaaggtgaaaagagtctcgcctcttccttcttcttagaccaggccttgtttgtcagagttctcaaatgaaaacaggtttttgcggaaaccccgttctcccgagcttccccggcgcgcttggtctcgagctctgtatacagccctagtgctgcaaccacgcgaacagacagttttttcagagattttttttattagttgaatatataacataaatatttaaaagtctatttatttctaaatttttagttaaattatagaatgtataacaatatatagtccgcccgtggcacggtgagcgacctgtcaccacggagaacgctctggatgtgcgaatgttgcaggacggaatcaactctcctccgggagacgacagaaacaggatcccccgttgagagtgcaacagtggagtccaaagaagcgtgggcgccagatgttgccgcagagaggggcaagaatcagcaagaaactgagatgaatggaagcccccacaacgccgcgcgcgaagcttcggaagacaaaaacaaagatcctgcagagggaaacttttggcagtcgaggtgggagatacgatgaggcaaatggttctttttctgctgttttttgaaagccgccggtcagcaaattttgcatgcagtctcaaacctcaagggccgcgacattgcatgcacagaaaagagaggatcagctgtcgcagcagtcgcctcggatcctgaacctgtgtcttcacagactgtttacggtgaaacacatttaaacgaacgtttgctgatatcttgacgacgcggtgacaaaagaccaaggggaaagtgtttctctgcataggcagaagtgtttggctgagttttgaaggcggttacgggcgtgtgtcgaatagctggtttccgctgtctcggtaataaaacagggtttgagacgccttcagtagaggactggaaaccgtctgccggcacttgtaaagtgtcgcactgtctccttcccctcaaacactcacttctattgcaccttcgtgcccagtctagtgttaggtacaagtgacggggaactggagacagtgaatgtggttgctagctcgctcttctgataaacctcttattttattgtgtgtgcccaaatccttcccgtctccttagcacaa

SEQ ID NO: 2949 - DNA, 2617 bp, Toxoplasma gondii
taaacagacagctgtgatgctccaaaatgcattgttacatacatgacgtgtattcgcctttattcagaagacgaagacacatcaatctacatatttatatgtatacgtatgtggatgtatgtagatggatatgaatatatatatatatatatatatatatacaattatatatgtatatatatatatatatatatatacaattatacatttatacataaaattatacatttatatatacatttatatatatacagttatatatatatatatatatatatatacacacaattatatatgtatatatatatatatatatatacaattatacatttatatatataattatacatttatatatacatttatatatatacaattatacatttatatatataattatacatttatatatacatttatatatatacaattatacatctatatataaaattatacatttatatatacatttatatatatacagttatatatatatatatatatatacaattatatatgtatatatatatatatatacaattatacatttatatatataattatacatttatatatacatttatatatatacaattatacatctatatataaaattgtacatttatatatacatttatatatatacaattatacatttatatataaaattatacatttatatatacatttatatatatacaattatacatttatatataaaattatacatttatatatatatttatatatatacagttatatatatatatatatatacaattatatatatatatatatatacaattatatatatatatatatatatgaatatgtgggcgcatgtgcatagctcgacgtggcatggagcgtaaagtttggacgccctcacagtttctcctcgtggtgcaggctttgcacagcagataaacggcgccagctctgttttttctctgtagaaacgaaagtattttactgtgttttatgcatttctaggcgcgcaaaaatgcatgtgtaggtttgtagtaggagatgcgcgtgagtcgatagaatggggaacgttgttcctttctctgaatcaatgaaattgtcgagcattgctcctcgtcgaagaccaggagattctttcgcgtttgagtgagcaggccgcgcgcgctccctctgtctcctccctccattcgcttttcgttttacattaatttcaatggcctcgcgagttcgcacccatctacagaggaggtcagcgttgcatttgaatcgaggctgagctttgcttgtccagttcgctgctctggaacagaaaaatctccgaaaggtggaacagaacgaagacttccactgctcgagagaaaacgcgaagttctcttttcaacggaagagccccctccggtggctgcggtgtctcaactctttccacacccgcgcagtagctcgtagaacccctgctgagttaggacgccatgcgctgaaaggaaagtacctccccccggcgaggcgacgcagaagagaagatgtctctcttctttctctttctctgaaaagttcctcccctcgactcgcttcgctagagtttcggcgcgctcctcaaactccagctagtcagggcacacaggagcaaaagtctgacgggggcgggaggccgcggaggagagaacctcttcttagaggccgttccgccggaggtttttctcatttttctttttctccctccttcttcaacaattggaattctcgcctcctcacagaaaacagtgtgtcgtcctctttcctttctttttgacgcccgccgggccgagcgcgattttaccgacttttctcgcgacgagaggtcctgcagcgaacaaggacgtccgtcgcgaacgccgttctctctttttggaggctgctttcgttctctgcttttctctctctctccgcttcagggatcaggtacatagacagctcgagcgagagagagacaaacttcgcgcggtgcgcgtcgagtctgaggtcctcgcggccttccccagcggcgttgctcctctggttctgctgtctaccgagagaggcgcttttttctcggctgcgcttcagcttctcgctctgctcgctttttctatcccgtttttctgcgcaggcagctttgccaggtccttctcatatcggtatgtttcgcctctcagcctcgctgcccagagtccggcttcttgtttgcgggtcgtcctctctcctcggcgccggagttattattgtttctcctcgactttccgcgtcctcatcgctctgccagtctgcgcgccgcgagagccaccgagaatgacaggtctagagacatagaggagaaggaacttccctgcatgtcgcgctgcaagctgcgcacgaaaagtccagcgcagctccaactgcggagacgcaacggaggcaaatccggtagacgaatcttcatgatggtgacctgtgcgtcttcttgttctctctgccgcgtggtgcgttaaaaaaaacagacagagacaaactttccaagggcgcggccctcctctctcgttctctttccttctgctcctctcctctctctcactcctctcgcggtcctgccgacctgcactctcccctgcgccggaccttctgcgtttcgctgcca

SEQ ID NO: 2950 - DNA, 1726 bp, Toxoplasma gondii
tagatgagaggcattgactctgtcgtcctttttctcactccttgtgttgaagcgagtgcgtggatctatctgggtgtgtacaagcatctaagtgacttctttataaaccgagagcgccgtgtacgccaaatgcaccacaacgcaaatggggcgaggcatgaacatcaaggatttgtggctttctgttcatgtctgaaaaggacatgacaaaatgcgtgacgagactcgtgacgttcctcactagatcctaagaatgagggacactgaaccaaactggattggtttttttctgcacagttctgtgcaagatcccttcccctctttattcgctccttctggagctctccgggaattcagaagcatgccgaaggtcttgtgtggatgcaaacgttcttttctttaaatacaaaacatacagggtggctttcgcgggcaaggctaggtagcgaactggacaaacttttctcctctgcttcgtatgtcttctccttccaactctctctctcctttctctctgcgaagactgtttgggcaccgatgtccctttgatccaggtgtattacttggtgaagacgcttttctgtctaacgccaatatcgtcgaccctcctctagccacttgagagactccccacaaagcgtatctcccgtgcatgcacatgaattcttatctctgaagcctcgcctgtcttctttcggaagcggagagacctgttcgccactgaaatgggatgcccggccctctgttttgaccagaaaagcggaaaagcgtggactggaacacctgtggcggtttggagagaatgtctttcttgaggcctctgcatgcagatggcccccgacgatgctggaggtcgccgcaagttgctcccgttcagcttttgaggcacctggtccctctgagaaaagaagagttgcttcttagcaccctgaattttcaaaagccagtctgagttaatcacttccgttctgtgagccgtcactagtctctacgcgtggaccgcatgtctccttcttcccctttcgcgtcggggcttcgatgcatgcaaacagccagcgaagcgacttttcttgcctctcggttcgccgtttccccattgattttctgtttgcttcacggctttcttcgccacttttccttttcaattctttctaacatgttgctcgattcattctggattctgttttctccaggcttgccccccttctgcccttcggtaactggaagccgttgatgtgggcgctcgacactcaacgcgagacggtcgcaagagaaaacttttttgcatgctttgacaagagtcttttgttccatctcacattttcttctgccctgtttgcctaggccttctactgtctctgatgatctatttttttctcctgttccctcccttccctctccttttgtggcatcctacttcatattgcgacttccgttggcggcaaacgtgatgtccgcgctctcctctacctgacccctctcagagacccctgccttcatttctgtcttttctttcgaccaatccagtcttctcttctttcctcacgtatctgctgtctctctaccccaccttgcatgtcgcgatagcacattctcaaggctcactgtcgctgaagtagattttgccagactaagacgcagtgagaacaaatcaccgaacctgctggaagcgtttttcccagcctttccactcacccgtcgagctgtgcagtgtctacacacccga

SEQ ID NO: 2951 - DNA, 2992 bp, Toxoplasma gondii
gaggcggaacatgcaccaaggagcgtcgaacagcatgtgccgaagcggaggaaggaaggagacgctctgggacttcctgcaagtgtcgcgatggcgagaacggactggagacaaagaggagcgcagggagcactctggcaggaaggcgagacagcttgtgcggagacagtgtgggggtcgggaagacgaggtcctcctcgagaatcaggtagacgcagagcagagagaggcaaaacaacaaattcagcagacacaccgcactcgcagccaagggcatccgcgcaggccccgttgccgtccctgcgcccaatcccgccggcggcgcaggcggcatcttgccgctccacctgtctcctggggagacagcgagcgatcgggagatttcaggtcacggatctggacaaacgcaaacaagcgggaggccggctggcgaacaaggaacgcgcgacagaatgcgaggccgaaggcgatcgcgcgaggaagcgaaaaccacgacgaagggtaaacggaggagtgaagaatcgagcgatgaaagcgaagcagggggtggccagagaagagaggcgaaaggaacgaaggacgaggaagcgaagaagcgaagaaacaaaggtagggggaacaaacagagagcggaaacaaagggaaaggaagtcaatgaagagatggaggagaatgggagggtcgagcgggtcggaggccaccaacggctgcgcgtttgacagcagaaaagagtggacgactgaaaaagcaggggaaggatacaagatggagacacccgacggagacggcaaggaagcaaaacaggaggctaccagagacggcgcgcataattctcctctgcaacaaatccaagatttaatggcactttcggcaaagaaaagttcttccctgcgggtgtatgtacagcggacgccagagaagaggcacttcaccgacccgagcgaagttgggaagacaacggaggggagagaagcgaaggcggcggaagtcgccgggatttttcgcctcttgaatgtcgacaggattgatttgccaccatcccccgtcgttctacctcttttcgtctcccaactggtggcacaatccgtcctcgtgcgccgtttttcgagtgcccttcttgtccgctgtcccgaaaagggtgttgttgacagaacgattttgccaccgggtgaccttagcgttcttaccgacttttcgtgtcgcgcagtgagttgtgtgtgtgctgttcaccaagcgtcgtgcgccgcgagacttctccgccacgcatgcagcgaaatttcgaccattaaaaagaggtttgcaccgtgtcccccttgatgagcgacccaccacaactcctccgcttcactgtgttgtgtgtatccagtctgcatgtagacaggaggtggacgtaaacatgttgcaagacttctgttcgatttcttgcatgtaaaccgaaactacgacggcaaggacttacctgtagtacagtacatatatatatatatatatatatatatatagacataaatatatatatatatatatataaaggatgagcagacagtctaagagaatgataggtgcgggaggaaacagtcactttccctgtgtatgcacgagtaccgacgtgtccacgtaggctgaacccattagtgcgaccgttgttccagtgtaattttggcttagttttcacggtagtatatactccgagttgcactgttggcttagactttgaaggtgcttgaaattgaaatacaactcattcagcaggcgtaaaaagcggtaatccctcatcagcctaggttgctatgataaaagagccgcagaacaaagacacttgaccccacctgctcaccagggcactgacactaccggttcgccattaggagagagctgaagcttctaaactactcacatcataggctcctgcaagacctagagagcattcaacgctaaacgagctcgagtggccgcgtcgctggtcgcggcaagccacaattcgccagttctgtttcctccgtcgggtatattccactgaacgttcgaccccagccgcacttgcaaggagccgatcgcacttgtgtgcagtgcgtctccacaccagagcgtggcctgacgaccaggcaaatgacacagagctttcgaggcacacagatccaaaaaattcttattgttcgccttcggctggcgtagtcgccgttcaagagagtcagctcgggcgcatttttttcaccgccctgcgtctcgacgagaaacttccctcgcttttccacgttcggcactgaagtttcgctgcccacgtgcgtatcgcgcaggcccctgaggtaaacagaaaatttggtcggtgtcgatcaatacactgcagcttctctgtgaatctgcgcataccatttgcatgtgtgcccacgaaacagggcaactggactgtcacgggccgatgctatgcgcgaaggtgaccatgagaggtgctttcggtgtagtgagattctcgctgcattgacccagactttccacaagtgtgattttcagtttagattaaacttgttgacggtgcccctgccctgcacttcgagttttgctgctcatttccgttgaccccgtctccgctttccgattgtctgttctgcgtcgctgaagcgcagtctagatcctcgcgggcgtcgcgaacggggaggaggcggactttatgacaggagtgtatctcgcatgggtgaagtcagcgtctgaaagtatgaagtaaaacttgtgcttctggtggatttcattctcgtcactgatgcacggaataatttaaacgttcgtcgtgctgttggagatccgaagcaacgacctgtggtcgacacaggaagggtcgcttcccagtcgtcgtcttgtttatctcccacaagaattgtttttaagcgtccacgcgcgttctctaactgcttccgtcgaaaggtggctctcctggtcttcgtcggttatcctggttttatcccaaaagaagaatgcgcgcgaggccggagcacaa

SEQ ID NO: 2952 - DNA, 3879 bp, Toxoplasma gondii
gacagaaacatcagtcagaaaagcgatttgaaggacgcgtcgaggtgagagacactttagagtggaaacaaatggagacgtaacacttggacagaaaacaacttccaatccgcggcgagttttgataaaagagcactttagagaggcgtcgattttaggtgacagtcggtttcgattggtttgtgcagaacattagacttgtctgtttttccttcactcgattcgatagcggtacgagactacaggggacgaaaaaaaggtaataaaggacgaaagggtgagaaaaaagtgagagggagaaacgaccgcgggcggttcgttccgacaccaagaatcgagcacgtgaaagggtggctacagaaaggcacgcacgcgtctgttcgagccacaaacacaaagtgccatgtggtgtcaacgattaagaagagagccagtcttttctatgaagcgttcgtcccactaagaagatatgccacacacaaacacacgcagttacaagccccgcagatgctgacgcacgcacacgtgtgtagcattggaaacgtggagcttcgaggcacacggatctctactgtagatagggatagaggtcaccagcgttgcacgaagaacgctgcgttcagtcagtcagacctcgaacagcagatcgctgttagggtgtggaggaaggagaacgtctggagtgcatcgccccgagacactgctgatgaggaggcacgtctgtcagtcccgtctgcggtaggtgtcgcattttctgcaacacatttttagattcacctcttgaacagtggcggtcggatgtcccatgggattcagagtggccggcgagggcataggcggcatggtttccggtagaagcaaccagaattggcaggacgtggacgacgcgcaattggaaacgcgcgaaaactgcgcacggagctacaggaaagaaaaaggagaaagggctgcaagacggagacatccccagccccagcccctgagggagatccttccccgtgcacacaacggcagactgtcaccgcctgcaaagaaagcggcttccggacagacgattccccggaggaaaaacgaatactcgaaaccaacgcgttcccagaaaccttacacgtttgaaaagggcagaaaagggggcattcgacggtcgattttttcggaggcagttgttccgtccgaaaagcgcgaggtgggccggtggtgacacgggaagggagagaccgtaaaaattgaggctctttgcagaaagcggtaaagcagagatgaaccgaattcacacacgaagggagcgtcacaaaaaatacgacaaaggaaaaccacggaagacacgcgatcgcgacagagagaggggggagaagggaggaccaggcgacggtgactgcagtcagaaattaaacacaaacgaagatcttcggatgggagaaaggtaaaaagaaaaggtgaaagcaaatgcatgcaagccaagatctgttcacgcaagaccgatttcgagagttttacggcgcttcctgctcgctgtgtgccccagtgtctgcgcctgcttttcggaagtagttgagaagacagcgagacaccaccactagagagagacaccaagagaaggagaaaaacaacaacaacaacgttttgcttggagaacggaacgaccaagccaattgttgccgtttcctctcttcctctttaaagggttttatagggtcttttctacgtatttgcctcggcagaaaactgccttagacaaaaagactgacgagacgaggcaggggggatgggccgtgggcctctaaacaaggtcaacggcactataccactcgaaactttctccgacgtttgcgtcttccgcctcacctgagtgaacaggaactcacaactcacgcttgcacattcgtatctatacaaaaatctctatgtacggatttcaaactggtatcagtcaacacgcaaaagacatctgcggtcaccgaaatctaggtcgttcattgcgccagacgcgaagaacatgaagaaaatggatgggaggaataggttctcctcgatgcatacagccagttcagttcttcatcatgttcctaatctaaaggttctgcagaactcttgcgccgccacccgcggaacagcgtcttctcgctgtcgtcggacacagacggagtgcacttcaacgtgtgttggtacctcaacaacatacatcgaacagatctcagtctgcgtgcgttgcctcttctgttgtttggattattcactttcggtaaatagaacactcctcatctcctacaccagcgagtgtgctgccttgtctgcccgcctcattccttgtaagcgcaaaacagattgacagaagctcgaaagcgagagaaccggtccctggtgactagatccgcgcctcacaggagcggcggtagcaatgaagtggttctaaacgtgcgtgtctgccgaagcgggaaacaacgcaacgtcagcgcaccttcgactctcgtgcagatctgcggtcacttgtcacctatcactcgcgccaggcaaagcagacagtacacaagagataccgtcattggatttatcggtgaaaccctgcaaaacacactttccttcagattgcttaggtctttcacggttcactgacgagacgtacatgcggtggaaaggaacgtttcctctgaagacacctacaggatttgcagggttctgtttcttagttggtatcagagggagggatggtggtcatccgagggcgtcttacgaaagactcaagtagtatcatgtcacttcacccgttgccaggtgccagcctaaaataaggtccgcaatttccacgggtgtttattagcgctgactcagaagaaaccagcagcgtttttctgctagtcagcacgagagagtaggtaacgagctggttctcgacacgggaccaacgctttgctaagttgcgaccgtttccttcatagatatgtcagtatatgcacattcctaagcaatgctttcccggtgtttacaccagtgcatgtttcacgtggccggatccatcagaacaacttggaatcttaaattttgccgcaggacacacacgtcgtagtgccgtttccccatcacgctgttctcgtctctatccagtgtgtgaaacttacacaggcaatttttgtacgcctcgcttccgtatatctctctagtgcagatgtcttttcacacacgtagcaagtttctctacttgcttcaggacagtaaccaagataaagtagaagccgtatttaagggtttccgtggttgtcaaataatacggcgcagagtcacaccgacattctgagtactcttactagagtgtggcagacacaacattcaccttagcgtttgctatgcgtgccgattcaaacttttgtatttgtgcgccagtttttctattttttggtaagtcgcaaaaactggaagagctgtgttctgtgtgatgcgttggcaagagtagaaagtccttccgtgtgagcttgtttggctttccaccggcgaatcctgccgcatcgctgttgcctagccacgcatgctttgccaccaggaggaacttctaatcctgttcagctcgctttctcataaatggtgttcgagagtctgtgtaaggaagtcggatgcctgtttcgcctttgcggttcgtcgtaactgcgagattcattcaagtggagatcttgtgagtgtttggtccatccctactctgttatttttcgcgacacggaagattgcccagccacttttgcacgctaaattcgcctccaggttgcgagcttgtgaggcggcacttcggtcgcctacgtttgtgagtgatttcgtcttcgtttttcccagagttttgtttctgcaggttgaggtgctttttggtcaacgctgtttgccgtttcgccaaca

SEQ ID NO: 2953 - DNA, 2651 bp, Toxoplasma gondii
gaatgcatgctgcattgttgcagccttcggcgggtgacagttctttttggaaacgatttccttctgtcccggcagcagtgaagcactgagggccgctggcaggtcgagaggcggcctccatttgcccagtcgactcatgatcccgcgagggtggacacactcgacccgctccgaggcacgcagttgccatggggagctgcagagcagctttggctttttccaagcggagatcggacccgcagagaagacttgtcttgtccgagaagcagtgaagtgcaagctttcttttatctgacgtcgccgcaccagcacaagtgtgtggatgggcgcagttcgtttcggttccaagttcgtagcaatcgctgttcacggcaggttggttgccttctttttgaaacaaatcgaggaaagctaccgatggaatgggagacagctgagacgacgcgaggagattcaaggcactgaagtccgcctctacggtagcgagctcttggtgcggtggtagcttacgaatgcacacctggttttcgaaagtttcttcagctgtcaagtcagttaaatcgccatcgatcgagcgccgcgttctgcccccgtcacaaggtgttgaccgaagaaatccctcctccggcgcgccaccttctggcggagcctggtcgcaagttgtggataaagtcatctgctgtggagagacctccgtggagacatccggcgggtttgcacggaggtcaaagggttcacagctttccacctgacctgagttgtcagtcgagggtgtcggattggtttctgaggcgcctagcggctgagtcgtgcgtcgtccgttagagttttgagcggccgctttcctggtctcttcagcatgcttcgaaatgcttctgctggggagatttccgagcatcgagcttgccaggtatttagacactagcatgcgtgaagaagagtgggacggacagacagggtgatgacgatttgtatggggcgctcgtcggcacgcgttcaggacgacccgctggatcagaggaaggacgcgaagaaatcggagaaaggcacggagtcattgaggaggactccgccagttggcaaaaaagcagtgcacacagacagcagccgcggcgaggagcggctgctccaaaggacccggttccgcgatgctgccaatgagacgctgcccagcaataatcgcggaccctctctcgcaggcctggaacgaagcgcaacaaaaacttagccgccgccagtaacagagcaaaaatacagaaaaaggctacacgatttgaacgtacagatcgtcgcacacacgatgggtccactttccacactcaagaaaaaccgtcgagtacgaggcaccgaccggccacgagctgccagaccgatcaagctgccagctgtctggcagctcacaaacgcacgcagaacacatggtcttaacggtaggtcgcgaaaaaatatggatagcgaaaaggccacatcaaaacggtgagaagccgagtccttttgcgcgaaaacttttctcgaatgcgtgttcaacaccgtgtccgtttagcacccgcgacgctttcacccccctaggacccgcagcaccccccctcaccgtagcagctgctgattctccccttgcaccacagaggagcacaccgcgcgacctgactgccactgtatcgttcattcacaggagttacacagcttccacagaaacgttttggcttgtttgctgcgtgatattttgggccgcttcacaatacatacatagctggctcccacctgattcaggcagtgctggaatcgagaatcctccattgtctgtgccagcttatggtgctggaccgaagctgccagctgcagacccagctgttccagggtatgtcgcttagcgacgtgtcggcatgttcacggagcaacaagggagagccaattcccgaagttccaattcaccaattggcgcattcagctgagactgattgcctgaaggctgaaacgcgctcagcggagttatttagcattcgcagtaattagcaagaggtcattcgcttgtttacgctgggtcggatacgttggctggcactttctcgcgccatgacaggtaaccaagggtcacgtggtggacggagcaaccgcggggcgcggagccatacgtggcaacgtgccggttactattccgcggttataaaattttcggtccaacggggtaaagttgcactccttggctcagccacccagaccatgtagttttcaaccatcagatttccacagcttacgtagaccaggttgcgcgccggtatcgcgatagtgagtcacgtgtgatttgaatttccggtaccgcggcacaatctggcggtgagcgctgacacatgggttcagtactacgttctccacacaaaggctctgtcgagagtccgtttcggcaaggtatgcaaccttcccggaggtcatacgaaacagaagcaagattggcaacggtgctagccaccacctgacattcttgactgtacatgaagaagccagctgtagttacacttcgcgccgcattcggaagtcggccgcagagggatgaccattccttttctccgacgcacggaggacccttttcgccgcctggttaatgtggtctagtcaacacttcgaggtagaaatctaggacgggacaggaacaa

SEQ ID NO: 2954 - DNA, 2185 bp, Toxoplasma gondii
agcttgcacaaacgtcatcgtggcacagcatcgggtggatctttctcgatgcccagtggggtttatatgcccacctggaaactccttcaatgcacaaacagagaggaagctaccttcatgcacagtgtcgctgtttctgtaaacgtttttgatgttgcctgtacagctttcgagattgacggaagcactcgtggtttcagaggacgacgaggacgaggagtgatatgttgtggcgtccactctaaaacataggtgtttcgtcactacccgaaataccgctagtctatgacgctcgattcatcaatgcattgttaaaagtcctcagtttcgactaacatcctgttttcgtcacagtcaagttattgacggtactctgttgccaataataagcatggttcttgatacaaatgcatttcccctgtcaaaattgatcggcatgcagtttgcgacccctgttcaagtaaactgtcaattactcttgggaatcgataagtgggccgagagggaagtcagggctatgatcataggaaaaacttgaaatgaagtaagcttatatgtggtcagtcaggatagtctcatcacacagtttctgaacagtgtaatattcgactcgtaggtatttgtaccgtatataataatattgttatgagatcacgcaaaaaagtttagcagcctacacttcttgtagccgcggcggaaacggcttttaagtggcctgtcatactgcggacaacatcgaaacgagcgaacttatcatagaccctatcatcggataagaatgtgaatccgaaaccggcgaagtgctgtatctaagatgaatgttccagcttttcaaccagccagcatggttcgcgtgtccggagaaatctctgaaagcctcacaacgctgaagaacaccaggatgatgcgctgctgaatacttcagtcgactgttaacaagaagtccatactgctggtgacagatagttcttccgggcaacgtacgcttcgtatgtgaccgcagtggccacgcgtgccggtgacttaaacaagagacttactcacaaattagggcatcacggatgtcccctggttcaatgccgcacggaaaaaagaatcctctgtcgattcgatggcacgtgctctatactccagaatccctatgcagtggagaaaaacggattcttttcttgagacactcccataccctgtctctttggaaggagtggaactgtgtcaattttgtataaagtggaatttgtcgggtagggggagcccaccgtcctgaaaatttgccgggaatcaaacgatgcaggaagcattctatagctttgaacgcacatgccttgagtgacagagcaaatcaaattcctttcgttgacagaagtgactttaaagttttctgctagccgtaactagcttcgtttctcatagcatgcggagggaccagagacaatgtcttgaagtcgcgagcaaaaacagaagtgtctacgaaacatccagccttttctctgtcaagagaaatcgcatcggaaagcgaaatgatttgaaagtgcagaggagttgcttgtgaggaaccctcgcgtgtcacgttctgctcgcgctcacaagtgtcatgcaactgtgcttggccgcggccggggagcgcgcgataggtagttctgcgattgcagcgccggatgagtgctctgtcatatcggagctcttctttggttgcggaagcttcagaaacgcgggaaaagtccagagtcgttcgaatgttttttgtgccagtgccgcggatgccacttcgtgtggtgagaaaagttgccgtcgagttatgtacggtgagatcgtccgagtgactgcaggtgacagctgggctgtcgattcgtggtcacagcgagtaggaatgcagtcagaaacacacttgggatatagtcgtcgatgcagctctttgtatcagcctttaatcactgaggaagggaccgtgcggaggcagcgctggagctgtactgcgcaaaaggagttatcacctacggccgctaccacggcggtgaccaagagctcgtttttctccgcagcccttaggcaggcgggatcggactgcccgtgtatgaggtccggtctaaatttcactgaagtacatggtgcttgcgaattgtcactgacacgacggattgaaaggtaccctgccaggacttcaaccagtaaatctcttccagaa

SEQ ID NO: 2955 - DNA, 4148 bp, Toxoplasma gondii
tttcgtgcgtatcgttctttcacccgtccattcgtcatgtttctcaaagtgtgcagatcctccaaaaggtgcttccactataccaaaactacaaggaactggcgccagagtgaagacgacactgggaaaagccgtgtgcagaatgccgcgccactctccagcccgttatgtggcttgtgtcttgcgttaagcagcgatcggtctcgctatcccctaaatacgacgttcccttctctgcctttcgcgtgctcagaatggatcgcctccagtgctcagaagcatgcgcatgcgtgtgtctctacaggcgtcttctctggaaggaagagacgctgtcgcccaacccccgttcggtcaaacgcatgtgcttagcccctaccagctgcacccatttctggacagtcatgtagccgttgaaagagtagttgctgaaggcgcgaagaaggtgttgatccatttgcgcagagacgtagagaaagactgcgccgtccttctgtcggcgcatgtagacccggttgagaggtccattctgcctgccttcgagggggtctctgggcgtgaactcgtcgtcgtcgagaggttggggagtgagatgggtacccgcaggcgggcctcgccgcagtgtcgtccgcaaagagaccaagtcctctctggcgggcagctgcagcgtgcgcgaggcatcccagtcactgcctgggaacggacgctccgcaccgaaacgcgaatcgaactcgcctgtctcgccggcctgcagggaattctgcagagccgcgcccacgggacgaggcgaagcaagcatctcgcctcttctagaaacgttgggggcgcgcgaggatgcgtggtaagaccgagacggggatgcacacggggatgcaggcgcagacggggaagcggctgcagacggggaacccggcgcagaaggcgctgaagtcgaccgagaagaggtggaagacgtcgaagcagcggatcgcgtggagtgcccggcgtcggacgagggggacgcaagcgactcttccgcagtcgtctgacggcgggaagaagccgggaggccaggaccccgtccagtcccgccacggaccagcggccgcattttcaggacgcgagaagcaagggcgcggccggaggagttcggtggagtttgcgggactcaaagacacgaaaaaagcgagcggacggagagaaacgaaaaaacgccgacaaaatccaaaatgtcgcaaaagtgacactcatgcactggcctgtcgccacgcgcgcgcctggtcgcgaggtgtccatacacccgaacggcgcgcgacgctcccgtgggttctgagtcaaatctgcgacctcgcacgggccaacacaaaaaacaagcctctttccactcaaagaaacgctttttcgcgcagacggggcgcaaattcacgagtccagccgcgaaacgcgcgaacgtgccgggcaccttcgcgcaactagcgcaatggtcgtgtctggtcacactggactgcgcgcacaggccacagtgttcttcagggaacaacggtttgcagaaaacgcacatgagttgggcgacgagccgcggaaattacaaatccagaaaagaggaaagactcatttcgctggtgaagagaagcggagaaaaaggcctgaagcgcagtgcgttccaggtcgcttgcctctagcccgccacttgagtagtttgccatagtctccacgccaagacacgttgtccagctcctgggggtgcaagcagttttcgtgaaagtctctttccctggaacagacacacactttcaaaagcacgctcggcattcgcgttcccataactcggatttgacacaaaacgttcccggaaaggacatgaggagaccaagggcgtagaccactgaaagtgtttacagtctagcagcgctttttcgcaatacgcgtctctgccccacgcagagttgcatttccgggtcgcatctttagagaagggaaaagcaagtctgtatgtggcatttatcgaccagcgaaaatggcatccgcatggggcttcgcgagcggcgtatgcggaggagcttgaaagcacgttctgcacgtcacttcaaatccaaacaagagttcacctcaaaatgcgcgtctgtgtaggtctccgtactttcacagaaatatacagcctctgctcggagccacaccagatatggatccgctctgactacaggctgggtgagaatttagatggaaaacggaggaactagccacgctgacccatccagcgtcatcggtgaacaggggaagtggggcacagagatgaccacagattcacgtcgcatacatgtgtctgcgcagaattatgttcacatacagtaattagatctacatcgaaatgtgtgcgtcttcgtgtctgaactcgtatacgtaaggacagtgaatcggagctgggacatgcaaagaagcaacggcgtttcgtatggcgtgtctacgacgaagagactcgggaggaaaagcctcttgcaggcactatacctcttaatcgacaaaagaaagcgttcgacgacatttaacgccagcaatcgaagcagccaagcacctaaaggtgcgcttccatactccaaacctgctggcaatactgacacctccccacataaagccgttagcgtcgtagatacatacgagcagctatacatcgacatatagacatacatatatgtgcatgaatttgtctttgtgcatgtttttcacagatcgtgctacctatgtttgtgtgtgtgcctttctgttctacccacataactgcatctgcgttctgtctgtagatacgcgcgtgctcactgtgcatggctctagatgcaggtgtgctacgcttgcgtccatagtttaaattttgaaagagtccttcagcgaaacgaactgagaccgattctacgtgctcgtccactccagaaagacgacttcgcttcctcgacgaaatccgttttcggcgttcatcgctggatgtctgcgtctcggcaaaaatgcaagcaccttttttccgcttcgaatctccttcgggtgtctccacgggtaaacgtttcttctgttattttttctgcgcgtgtgaactcgcccaccttccctccatgaggaagcagcggatctcgtcctctgtcctgtagtctgtgggggaccttgccaatcgtcagatccaaacagatggatgtttgcatatatatatatatacatatatatatatatatatatgcatctttaggtttcgttgttattggagtattgttatctgtatctgtatcttgttttgtgcgtgtctattttatatgttacatttcttgattatctcataagtgacacaaatcagtatggtctaagcgctgcgaggatacctactttaaagtacagctctagataacggtgtgcgtctggttcgcggcttgtgcgttccacgcatgcattgacttttgagggagcttaaaaaagcaccctttaattccaaaaagtgaacgactggattttttctttagttttcatctgtcttcctcccttcttttttgcctgccttgcctttgtgtctctgaggcggagagacacgcagacgcctccggggtgtatcgacagctggtagctgccggtcgcagcttccagcgggctggggcattgaaagcgttttttctgctggtccgatcgcgcggctctttctttcttctttctcgacttcttctgttctgtcttcacccattctccgcgaagttcgcgttctgcatcctttttccaccccccggaagtcctcctttccggaacgaatccccctcgagtgtgtcgcgttcgtccaggcaacagacaccgcagccgttgcttcgagtgtttgagtgttgtcggctggtttttcgctcgagcctcgcgggtcttcttcagcgtcgtgctgcttcctcgtgaagcattatccctccgtccttccgcttgcttttctcttttcctttccctccccgcggtttctcacagcttcgactcaccccggcgtccacccgcgactcgttctgccagtctcgcctcctacccaaagcggcctgcgcccccgtctccggatctcttcccgccgtcatcattctctcgtttctctctcttccttcgcccctcctccacgcgtcaacggcgttctctctgtctccgccctgtctcctttgcggctgcagtca

SEQ ID NO: 2956 - DNA, 2075 bp, Toxoplasma gondii
gacgcagttaaaactctaccggcacaaccttgacaaagcctttaggcgaggacagcatccattacggatttcccccccatttttctggtcgtgctgcgagttatagaatcttcccgaagataattggtcggttcgtcactcttttgaaaaagctttgattgtagttttggtgtcaaatccctgaaaaatctgagacagtttgcgcgcaatggtgcctgctagatgcggcacaacggaagctgcttttgttgtggaacagaagaaatggtgacaaaatagtctctttcgtgaagtgccacccagggcgatagatctccacttgaaggaacggcgtaacgttccggtagtaaagatctagatgttaccaagcgattcgcgttccagttacagcagccgcacctcagcacacatgcacttgtcataccccaataacgaatagaaagcgtgaacaagttggaggtgagtccgatcccttctcaacatgcgtagagtcatgcagtggagcaacagtatatgccacatgatgatggcgagaaacagtgctgcagtgaaatatgcgcgttcttctgccgtcgaacagactctgaccgataatgcagcctctctctttttttcaatgcccgctaagcaaaattcttcttcgcgaatgcctgttaagacgacgcaacaatactgcagagacagatgttaaagatcttgttcatgctttggactggatacgtttaagtgttctggatttgcggtttaatgttgttagcttacgccataccacacggttgacctgtgtacgtaacgttgtatgataattcgtaacttcgcaatttcaacaaattgcgatagaactgtggttcgggtgtgatggctgtaccagtcagatacccatgaaagccttccggtgacacacttcaaagtgggtgaacattgtttcatgcgaccattcaagctcaacctcatacacagtaccagaaactattggataagagtccagagttgaaagatacactgtgcggtatccctgattattggaggtagtgttattcgtaaatccctacctcctcacggcttcggcatttcggtgtttcccggtcgcctgcttggaggcacatcattcctgttccatgcggaaatgagtttatccttcttccacgcaaatgagatagaacgggcgggaaacgactccaggggaaactcttgttagcgtcgtaggaaagtcacattgaaaaactggtaggccgtacctttcagttacccaacacacgcatcctgcgtcgagtcacgagttcttcggtgcatgcacgctgggtctttcgtgtaaggcgattctcggtggactactactgaagatttggcagcatctgtctctttgtataacgttcctaggaattaaggacttctctgtgattgcatacggtgagagactcaatcgcggagagcgtttcgatcgttgagagtcttgactcttttctggatccttcaccgcacgcgcgaattcgcgggtgctcacttacgcgaggtagggggaaatctcgctgagtgtttgcgtgttgcggtctttcacgactgtatctgcaagattcacgaatcaatggttttcggagtggcgtttagtatcgtatctccggaaaggcgcagaatggtacgcacacgcgtgcaatgcttaacaaactctgtcgatggaagaaaacctgaagcctttggccgcggggaactcttggaaacatcctgctgacggtttcctctctttgtctaatccattttctccgccacagccaaatcatttcgcttcctgtctggctttccacaccccatcctttcaggcaagcgcatgtgtgtcattgctgcctgctgcgttgtcttttccgtttagccccaccagcatggagaatcgtgagggaaagtagccagtctcttttgctgcagtttctgaaagtgtttctgatcgttatttgtcttctcccgcactacggtttgttttgtcgagtggcagacacgtaggtgctacggactcgaggtgcctctccgaaaggcaggcgtcaccatgaactgctaggttctcgcctctgcatgcggcaaca

SEQ ID NO: 2957 - DNA, 2050 bp, Toxoplasma gondii
gttcatgtcgaattcaggaggtagcaactggtgtctgagggagcaggatcggctgagtgtttgcgttttctgtagccgagacgcgtgcaagtttcttggttttgtgaagcgacccatatttcaatcttcttcgtctgtccgctatcaaatcaaactgaaggttgcttcagtagcgtcggggaaatatgaccgtaggtggactgctagacaggcatacctttctgcatgcgtcccgcgtcgctgagaatgtcattggttgcttcgctcgttttgcttgcctctgatcgtgtcccaggagtctggtgacacgacacaacaacctggcggtcctgacgatgccgctgaactcgacagacctttagagttttttgtaaaagaaggaaacagctctggcagtcgacgcccttatgagagagcgccagcttcaagaaagtgaagccgctacgcagagtatctaccatctaccctctatgatccccccgcatgcaaactagccttaaacacaccgctcgtcagtacaaaccgtgcaagcactacaagcattaattatgtctatttgtgcatctaaggtggtacttggttatatatgttgaacgctaactccccgactagactttgagctattaaacctgcctgggatcattcgagaagactctgatgacgtcgtcctaaaagtatctccagggcccaccggtggtttgtgagtctctatgtcatcaacatgtcaatgaagtattgatagcgatgaaggtttttgatcatcatagcagcataaaaaggctaagctgcaccttcagcatgttaacaaggcggcggcgataattgtatcccaagctcggttttaggttcgaatgcaccactgccgccacacggttttccatgtcagtacaatctccgcgaaagttggtgtaccataggtgaatattaaccctgcctggtcacgcaactgtcccaaaacttcgacttccgttgaaaggccatccaccgtaactctcggtgctcttgctgctggctgcagccacactcgtcgtgggggaagaaagttcactacaagcaaacagttttctttccgtaacgcgctcaccacaccctgaaaggtcttgatcgaagtggtgatgtgttcgacggcaacagtacgttccacacggctgcggtgatcgtctgtcctccatctagtggttctaccgccccagcagaggccgtctgttttctcgatttcggttttcgggcgctctgcttccttcttagatgcatgtcgaaacgctttcacaaacgaacctagtgacatgcgccctgtccggcaaatgcaagagaaaaacaaggcaggatttcgtgctatcagtcaagtcctccgtggccgtacgttagtatcacaagcgacgccgtcgtaaaactggtggatctaaagctctgctgcaccataagtctcacacccacggtttctaattccagcgcccaactcgcatttgtgaagacatgttgacttcttcgttatacacgcctctgagctgtcggcagtatgttaccgacttctgtatcggggtgtggcgcagcatagaagcccctacgatgttcgggacatgttcttcccaaagacttcggccggcgggcatacaagaagtattttatttactaaggccgcgaaacaactccaaaactgccgacagagtcggactcctgatcagttgccgttgctacaattcatgtctgcattcctccgacgctccgtaaaaagcacgggtgcatgcgatttccgcccggccgcgggttgcggtcttttggtgtcgatttttcgctggcgcgtttgggcaagaactgagaaattgattcaccggaattgtggctgcttatgactgagtgaacacttgataaaatttccacagtctcaaagtgacttttccgctgcggttcaccgccgaattctccgccagcgtctgcacgcaggaacgaactcggtactgcgcacccagtggtgccgttcttgctactctttgtgtttcctagtggctggtgcgccacgagcgttgtgtttttcttttctccggaaaga

SEQ ID NO: 2958 - DNA, 4714 bp, Toxoplasma gondii
tctgtataccgtttccggtatgtgttccatcacaacgttgaggaaccggttgtggtcgttgctatcgcgttcgcccatttccgtgtagaagtagtcaatgagtttaacaacattggggtgtttgagttccttcataatatcaagttcgcgatttttgtaacgcgggtcctgtagaacaagcacacattcgtaggcggtcggatctctccgcgagttcagcgaagacacggggatcgggctgtctgtcgagagctgaaaacccctgcttttttccacgtacactacagcgcatccccttacctgaaggactttcttgatagctacgacttcccccgtatcaacgcatcttgcctctgtgacgacgccgaatgatccattgccgaggaccctcccaatatcgtaagtcagagtcgggtgagggttgcctgtgtgaacgcggctctgccgttcccccttcacggctgttgtccgttgacttcctcctccgcgagcgttgctactcttctgagcagctgcgggatcgtactgcgggtccggcatcttcgcaagaagaggacgaaggaaagaaggggtcggctgagacttctgccttctcgacaaaggccaggaaaagatgagtggagtttcaccgcgtcctcagcaaggcgaggaggagcatgtctcgtacattgccacactcgctgtggctccaagtgcgttctcacacaatttcagaactaaggctactcttgaagcaaaaactcgcacgactgtcggtcggagcgagagccgagcaccagagacagcgacttttgttcacagctggtgagcaggccggccaaatggatggccgaaatggttcccttgattttcagcagctgttttgatcggaaaaaggacaggacacaggtttttcaagcgtagactgaaggctggtgccggaagaggaggcgaaaaaggaggtgaagacagttgccagccaacacgggacccaatgagacgctcgggtgctgacacgcaacaaggcacatagggacttttactggttaggaacgtgacaaaacaagccaattttttgatatctctggaaatggagcaacgagccgagccgctgtagaagaaacgagttacggctgccgcgcaacagcaccgtgggaccaaatagcccgaagaccacccatttctcaccacgctctctctgcagacaggctgttcaagaaatacccggaaacgattgcgaaaaataaggttgatggaactcaaccgtttctactgccttgcaacaaagaggttgcgttggcgacagagggtgtcaaagaaaacctgtgtgaagggggttggcaaattgcttttctcccaacggatgggcgctgggttgcccagccagctaaaactacgagttttttatccctttgtggtgaagaaaaacgttttcaagacatgccaagataattttgggctcgcaacaaaaagtgaaagagagagctgtgcacgctgttttttcactctcgtttttcaccgccaatttttcgagggtttttcatgccccgtgcaacaacgtcagctgttgttgcagcaaccctctcagccacacagccggaaaaaagccgccgtccctacatagcatctctctcacgggaagaacagagagaccagaaaagcccagacattccagactactggtctgccacaagtttaataaattgttttcacaggggaagctcgaaaccaagagagacaattaaagtgtagcaggttccagtacggttgtcctcagccctgcagacagatgtgcgtgtgtcgccaattggaagcccggactcacatacacatacattcacgagaacacgcgaggacgccctgcatgtgcaagcgtccctcaaaggcatacacaaaatacgccgttgcctgcgaagcggcacttttctgtggatgaggacgtaagacaagcggaagaaaaacaattatgaaagtcgcttagagaaccacgcgggaaaataacatgacaaccacctcacctctttctatggttctggacactctcccttcacactggaaataacgcccaagtactcaaccacaatctattaccaatctctccacggagtgaaatattgttttcaacgcaagttctatcctaaaaagggagtctcgaaaagttccttcgaggcgccgcgttgttggtttcacagcgcgagtggagtatcaacaagaccacaggaggcaatgcagaacattgtgaggcaatgattcagagcagggacaaccgttttcggttcctcaaaacagacgaaacaatgtgagttttggctgtttccttatgcaggtcacccttgtgcagtgttgggatcctcgtcagatgcgaggaaattactgaagcgggggggctgtttcagctggctctcagatgctgtgtgaagaaacttgccgcgagtacgtgcacgtgaacgcgttcagttgcccctcaaacaatgtttctttgagttgatatcggtggaagattatatggctatccagtctcactcaaccacactttattcctttccgttcctgaagagggtaaagtggcatttggaaactggagggaaaggatgaccggtgtgaagttcgaccgaatcaccttgtaaaacaagagcagcgtaatcacaatagtcagcgaaggcacgaacatacgtctcttctgccctattcaatttaaacaaatgccatttctccggggaacacggtgacgtcagttgctccgatgcaccgacgcaggtgccatatgggttaaaagaaggaaaccgcagacaagtaagcgctgcatcttcgcttgcaacattctttaggaggactggtgttgatagacaacgggggatgcataaccgcacttttcgcctgaaaacttcccacgttggctgctaccctggcacgcgatgtcgtgcagagcgtgctgcccgtgcctaaatcccagtggcatcaagcagcttgattttgcatatcgagatctgctacgaagtgtttgtgtctctacttcacaaaatatgtgtgagagaatctactatcacaagacgagggggtggagattttgcttccagaccatgggtccctcccttaccgacggtctcagttacacgctcacatcacatcacgatgggccccggggcctattgagtgtgttatgaatcgaaaggatatggtgacctcatgcgagtcagtataaatgaaatcacatccggattaacagacttggccaatttacaacagacggcagactgcacggtcctctggaggagactgggctcgatttccctgtgtttgctagatgaccggatcaggcgtgcttcctcagaactagttagacgattgctcctattaaaggacgaacgttacatgagaggacagcacactgttgcacgtaagaggatttctcttgtgggagtgaatcaggagggtgtctagatccaccatggagatcgcaaagcagagccacgtatggctactgtcgcagagggactgaaatggtcttaacactgcttgaaacttgctccgcacccttaaacgacagtcctcgtctaccatagtgacattcggttgccagatcttcaaagggatttttcccaggagggaataccgcgacttgggagcagcctcattcttctctttacctctgaagctccccgcgcatgtatatatttgccaatgaaacctcgtttcccttgttccatttgtcttctggaacacagggttcttgtgggcataaaatgcttgcagccgtcttagcaggttccacctgccgacaacagactgtatcactgaaactgttcagtagttacacgccacgcccccattatcccagcagcctaaggtgtggaagtccaaatgtgtccggggcttagcaactgttttcaacgcttttttggtagcactgtctcggttcagatgtgagtcgctcaccctcgtccagactgactttaaacacattcccgcgcgcttttcccatccaccagaatgcctctctgtgacgtggacacagcttttgtgtgggagacagcagtctgccgccttttgggcatttcgttttggctggaggattagactctcgcccttggcgaaaacccgctggagaccggtgattatgctgattacatatgaacagatgacctctgtcttcgtaactcgctggaatgcgttcgtgtcagtgatttgtttacgtgtttcctgcgtcacatctatgttaaggatcaaattgggatgaatgtagttgtgttttggcggaagtcctacatgaaattgcttaggtctctgcattgtagagaacggtacatcagcgcatgaaacgtcgtgcttccaacaatcagacgtaaatgcgttcagatttctccctagttgttcacgagtacgactccctgtgggttgaaagtggcgaatcaaatatgttatcttcgtcttgtatctcacctcaaacctttcgagttctttactgccgaaaaatccggcgaacatctttgaacgcggtcatacagacacacatcagccaatgacgtgcgttatgtttcttacggaagggtacaccatcgtcttctgacagcgtctacgaatcatgtcatacacgtctgagatgtctgttttcgagaggtcgggagggagcccctgaatgagggggaaaaggctatggtaaatatcttgactagttcgccaacagaataacgctgcttttcaggttcgcattccattcgggggctccaccacgaaa

SEQ ID NO: 2959 - DNA, 4426 bp, Toxoplasma gondii
tcaaagcatgcagttcaaaggcatcttttctggatataggaactggaatcggactggggaagcgaggcctgcctcggagagccttcgaggtgaagaaaaaaatgaaaagattcacagcgctgtccctagggcgccttcctttgctcttcagaagccacacatacgagggctctcaacggtttttcatgtctggagcgattctcttcaagcacacaaggacggtctgcttcctttttagaatctgttctcgctcctcgatctcccccttttattcacccgcactccagttcacacaaaacgcctatttctctccgtcgtcttatcaaaccctgtctcttttctactcccaaaggggattctttttgttctcacattcccaaacacaacgtggagacgacggaaatcttgcaggcgtcggacatcgtttctccacagccgcgcgcttcctgcctctctctcacatcagacgcagcgtctccctcgctcttcgccgttggcgcggtgtctccggagtctctccaggtgcatgtcagcttgtgttcttgtttcctgcttcctcctcgacctcgttgctggcctggggcgcccagaagtcgaaatcttctactctgggaaagccacctcagattctttcctcttgtctctccgcgtctcccgtggctttccttcttgctgtggaatgtcgctgtcataaattggatcttccttatccacttcttgctccacactctctgcgtcttcgactcggtcggggacgtgacctagaaaaagaagagagacgcagaaagtcgatgggaagtgagtgggggcgcgagaagagaggaaaatcgtttgcaactcgacacagacttctctgtgacgaatcacagacactgttgtctcgtctggcgcttcctctcatcttgatcggtgcacaacgaaaggctccttgtttaacggcacacatgcatgcggagatatatgttcacacatgtttacgtagctatctatatgtatctgtattatgtagaggtgtatgtatattaaggacaaagaaactgagtgattcctgaagcaaccgatcaggcagggcgctctgtcgcaggccgcaccgctgcttccagataccagcaaaaagacacggagacacccagatttcatcgtctcaaacaggtcgcaccgcgacagagagaagaccaccgagaatgccctttttccctgttctgctgtcgcttcttaacactagcgagaagggaacgctgagacacacacactcatccgcagtagggcttgttcccgcgaaaacgcggtggcctttggcatgtcgttgaacttgaacggcacacaaccgttccgccaccacaggcactggatgtctgtggatctacaaatgaatgtcgccgatgaattcgggacttcttcggacacaccccaattaaatttcccgcttccttgtttgtgcgagcgttcgccgagagctctcgatttcgagccggcgtggtgttccagttttgaggcatctttatcgcggacggttgccatggtgtcgagaaacatacggtcacattattgaaagaaaccgcaaagagatttggtgttcgacgcgtggctttccatcccccgtcgcgtttcctagctttctcgcgttcactggcggcacaggcgagacgacgccgggggttgagtctctccatctagctgaaaaacggagacgagagcacgaaaaggtggacgtcgtgaacggtgtgtgttcacatgtcgcctagatacggaaggagttgggagagcgtcgacagcacaatgcgtttctccagctccttatcaaaaacaacgggatagaaagcctctccatgactcaagtccgcgtactctcgttgaagagaaccgagaaacgaagacgctttcgggtgtcgatggtgtcgattcggcaaacatatgcgggtgggggtctcggtgaccgtagagaagcaaacattgtgtagaagccctgcagagaattgcgctttgctaacacgatgagatgctttccagggtctctgcttctgttcacctttcggcaactctagacgtattcaatgggaaggaaagctgccctatgggcagtgtgcacattacctcgtgcttggcgtcgccgtctcaaagttcccctgtcccgcgcgcagaagcgggagagttcctcatggggctttgtctttggccgagtgttttggagtggacgcaaacaaagggtaacgtcgacaagaggtttcaccaattcacacacaagaagcagttttcctgagtagccatcaactgacgaacatgggcacataaaccaaagtgaaggttagcgtgtgcgacagcgaacttcgcgcttccacgctggcgttttgtgcaggtgaagggtgcaagacagcgaacattttcacggcagtgaactgccttgttttcaatgctgagctcgtggtcgcgacctgtgctttggaatctcctgcctgtcgccactgttgcaaacggcgagaaaaacaaacgactcttcagatacgactacggtcagtcccatcgtactgagagcactcgttcagcgtgaggcaaggtgatgaactttttctttttccaacgaattcctttccttcctcgccaggaacagagtgcctttcgttcctccaacagtggcgcctcccttgcttgcacacagaggcggcagttgcgccgcctgtgttttggccgtcttttccgacaagacccattcaagacgagtttcactgattcagctggagagcgtctcaagacctctgacacatgcatgtcgagctagtgcgtgcgtacctgctccaaacgccatcatgcgttgaggaaaaaaaactcaatagcgacacacactgccctgtgcgtgactcggtaactaggccagcgagcattcgctttctctttcttttcagaaagcaagaaccaccgaagaatgtgccggcgtccgcagccaaatggacagcgcttcacaactcaggattcaaaaagcgaaatggcctcggcagagtagtgaccgggtcgccacactggactccctttagaacacacgggcaactcgccttcctgaaggcagttttgcggacttggttcaactcggggtgtcttgctcgctttctcgtggcgctttgtcgacgccgttcactcctgacactcgaacaggacagaaatggaagcggcaagctgaaatcatgcgatctgcgcttccgcaggttcttccctgccgtcaggctttacgagatacatgcgtcgaattgtctctgacgacctggcgcagctgtgaaatacctggacgagcaacagcaccgtagaggcggaggtcttgagaccccgagctcttgcctgtttcaagccgtccaacagcgtcgcattttaaagctttttcgtagattcgaaaaacgacgggactctgatagaagcaactccatcctaccagagtcgggatgtcaccctgtttctaccgcgtttacgcatgccttagtttatcccgcatctacgaccaggaaccgtgtgtcgggctccagctggtcctcgacatcgcggcgacctctttgcaccgaacgttaatggcagtttccagcatgctttgcggtgtaaatataaggccatccacctgggaggtacggatgggtgtcagcttgttcctcgtcggttgtctttcgttcgcggattgacccgttacaatcaatcagtgtgttcttaatgtccgctttggatgtgctgtgtcacacgtaggaaagtggaatttctccttccactctgcaagtcgagtttccgagcctgacgtaaacctcaacaggaaacgaacaatttccagacatggaaggctgtcttttccgcggcagagagacaaacatccaagctgttgttattctcgttgcgaagcgaatgaagaaaacgcgctgtgaatgcattaccggagacactctctgcgcaaccgtggtactactcgagttctcagaagacatcacagcggtcgaacggttgagtgcatgcggtgagtgaatcgcggtttccgtgaagggatccggacttcagagcgactctcctcctccgtttcttttgttttccttgaagtccctccctcaggtttttttaattctttcccccgaacaagaaattcccttcctcgttcgctctttcgcccagaaaaaaaggagtgaccctgcagctaggttttcgcatgcagttcgcctcaggtcgcgctgtttctcttgtcagcgcagacttgtttctcgcgtctgcttgtctgccgaggaatgtatgtgaggaaaaagaagaattcaggatcccccccgaagctttggacgcactctctcctcttctgtcaaagctggagagacagcaaagggaagaaaggatgcatgccctcttgtcttcaggcagaaggtcaaagatgtgtgaagatggatcttgatttctctttcgtaggcgaggaaga

SEQ ID NO: 2960 - DNA, 3625 bp, Toxoplasma gondii
tccacacagtcgtacgctgcgtcgaggaattctgccgtttcttctcagagggcgatcgtctacctgggccttgtttctccacaggagacccaggtgagtctgctgtccagccacacatgtgtatatggatgtgtcctaagatacataaacagcctgccccaaacatggcttctgtctcttgtcagattcggctgaggggaaccagtatacctttttacttggggatggtctactgcagtgaggttctcttgagtttctaggagggccgcaatgggtacgcattcgctggactccacacactcacagacatatacagatgcttttgcaaagtgcaatgaccaagcgaactgttcgaagcatgagctcacacatcaagaccaaaattcagcccgtcggtattttcttcttactgttcagaatttctttcgcgagcttggtaaactcgtcgagcgttaggtgcgacttctgcggtggtggggtggcaccggaaaagcaactggttttgttcagtgcttgccggtattcatcagcggcgacatcaatgaccgtatacaagcagtcttcatcctgtaagggaacaaacaacgtgcagaaccaaaatgcaaatctaaagtcgggagaaactctccatctgttctgagtaccacggtatttctcaaaacccagaaatgaaatgcactgctgtagaatcacggagattccacgaggcatcatgctaactgacactggataaacctgtacatcaatatgcgtacatgcggcaaaatcggtacactgcttactttacccgcgtcggactgtctgcaagtacacaagtgcggtatcaccatacaaatgattcgcgatgcaggacgacttaagtcataccgaaaaaaccgagacattacagtgcctaggacaatctctgtgactcctgttatgagacaccgacatggctttcaccactgcaagtcagctgcatatgtcagggtagcagaggaaaacttccggcgttgtaaaacaccagctaaccttgggaacgtgggaaaaaatcggtgcgcggcaaaggtaactgaaaacgctctagcattcgaggtcggtagtcagacagtcactgcgtgcttgtttcttgaatgaaacactaagaacataactacaggaaacgagcgttacctcggattcggagtcgaagatcgggtcatacgtgtccatcaccttgacaggtcctcgcagctcctcttccaagagagacattttcttcccaagcgctttgttcgacgccatcttgtctcgtaaaaacgaatggtttcctgtttcacacgactgacgttagccacgacacacacgaatcccccagaactttgttccgatgtctttgtcttgtcttcgagcgaaacgtccacccgggatccggggtttcaaaacgaacctattttttctcaaaagaagtacggccgcattacatggagctccaggaggaagtcacataaagccagttagccgttacactagcaacgaggcatcagtcacggcgtttcttgtcaggaaatgaagggtgacaatgtccctgtgccgacatatgcaacgaaaagcttttcatttatggcgaagccaccgagacaacgcgaaccgtcaatccagagacagcgggtcgcgctgaaggcgcgtcttctccaaaaacgcttttggctacttgacctgcgcgagcctcacactggcgacctccggaataaagtttcaacggactactgccacagcttcgaggtgtagcacagccagtagacaaaagctcactctgcggaaaaaagagcaaaaagcagacgccggaacggttacactgtagcacagaccgacgtgctcatcaagaggcacaggaagtactggtgctgcgagacccaaaacagatactcttcttaacccggatatccgcgcatgagcccccgctatttctgattttccctggagcggcgcgaaagcttttgttagaggcgcccgccgaggaatgagagagacaaagccagcaaagccctgtccaagcgcgctgtgcctgagaaaggctctcgaacaaaaaacaaaggcttctagcgaaagctcggtagccgcaaaacggaaaaacgtgttattcgccttcttgctcggtttgaatgcttctgtttcaacacacctgcgagacgaggaacggtccgagggtcgcagtgccacgagcccactagcggcggggattgccgcgcgacagagcatgtaactccatcagaaccccccaacagtcggagcgctgctcttgctcgtgggaaggtttttcatgccgtggtgaattcgtgacgaagcgtgtgtaggaaataaataaaaatctctcgaaaaaactgctaccacccgaatcgacttatcagtgccagtctgtggctactctttctgcttcagaggtatggcagaacgcctagctaccgttaagagccgctacacgcttccttattcagacgcgccggcagtgctttgaactgagacggaaggcgcgttgaggtaagtttgccagacgtttgcctaccgcaaaagacacatacacacgcaacagtcaggcttctgggtagttggcgaacctcgcacgctgcgccctgttgccaacgctctcgattgagcagccgttttaaggcgaagtggcaagagggcgttgttccggacttgctgaccctcgagaagactaaagtttcactttcgcatactgggaaggttttaaatgtagctgcgcatttgcgcggacggaactccgacgcagtcgcagagactctgagagaagggaaccggctcgctggaggtggcactttccagaaaggtgtctgtacgcgaatgcaggaccgcttatgcaagacgtgcaccgcacgcgcccaagagacagatggatgtgtgtgcatggcagcacatctgcatgcagaggggcgacatgaagtggcacggtttgaagacatcggaaacccgagaaggcgcaatgcgtttcggtcttttctcttgtcttgcattttcatgatagtttccgaaacaagcacaagctggcgcccagactacacccggttgagtacgacagtccggccgcggatgtcacaggctgattcttgagacgctttttattgctcgtttactcctgcggatactcccgaaattaaatcggactgtagtgtatcattcgacagctgacggttcaagtcgtatttttcttgtgtgtagtatctcctgccccctgtacatgttcttacaggcactgtacatgtctcatttgacggagactgcctcgatctgtcgtcttttctccgtgaacagcacccgtcttcacacatcgcgtgtcacccggaggatatcgtaggttgcggtgagtgtccccctctgcgtaccactttttgacgttgtggaacaaatgatcgagtagcctcttcagcaaacactctccacaggctgtatctcccgccaagccttcagatccccggcaacggaaccacacccagcctgactcagcaccagggacaaataaatggaccagagccaggaaggagattcattctgattcgctccattcttggaaaggcggtcggccgtcgtactttttttcgccgggaaaataagttcctaactccctcagcagcagaccctgcgagca

SEQ ID NO: 2961 - DNA, 4264 bp, Toxoplasma gondii
ttcttcgacagaggttctctcgcactctctgctctctccgcatcagacgcagccaacgaccttcccggcgagcccgcggcaggcgacgaagccgagtcgttctctctgatcttccgcctcgcacactccatggtacgcagcagcgaggagagtgccaggcaactctctcggacctccgccaccgtcaaatccgtcacgagttcctcgggcagcgcggcggcagaggtcgggagccacggcaccgcgcgcgagcctccggcagagagagacggcgagcgctcgggcgcgaggagaagcggcggagggaagggagcgagcaggcgtaagcgtgacgcagaggcttcacatgcgccgcgagggtcctggggcagggaggaggaaggccgggtgggcgcagaggacgagaggaaggaagcgggagacggcggcagagatgtgacagcgggccagcgaggaaagacaaagggccgagctctcggtacttctgggagatgcgcagaagcgggaggggaggcttcgtcatggaactccgagggacgaagccgctgcgtcgctgtgcgctcgcaggcgtcgtgcctctcactgccccactcactcgtctcacgcagatacgcttggtagagcagaaaggacagaaggcgctcgaggacgccgatatgggtcttgaaggggctgatggctgccgagcagaactggagctcgagctggcgtctgaagaaggcgctgctgccgggaaagagcatcgcggttgtaatgttgtagagcacagcgagggcgaagaaggaggcgaagaggcccccgatgagcacagaacagaaaaaagaaaagaggaacaggaacaaaagaaaaaccgcaaagaaaccgcaacagagcacgagcggaaacgcgttcgctgcggcgaaccggacgctcgacgcgactgccggcttgagcgctctgcagactggagcgaggacccacttgctgcaggagagaaaacacgcccgaagacgggcaaaaaaaaggggaccgaaacgcacgctcatcttgtagacaatgcctcggaacagcggcgaaaggagaaacaaagagagctagcaaaaaggatggcggagcatgcgggagcgcttcctcgcgacacccgcagcctccgctctacctaagaccctccgagaaaagtgtgaagttgtctctcaagcgaatttcagaaacatccgtcatcagtggagaggaaatgcaagccgacacgcgagaaaatccaaacagcgcagacagagacacaaacgctggagggttggcgcgagtgccacgccggccgcgggaacgagcgcatttttcgtggtgaacggtcgttatcgaaggaacgccgacatgaatcaagaaactgtcgaggcaaagagggacagagtaactttccgaaattgataaaccaaggttctttccagtacgcactctcgctacaagacatgcaaagcacagacccgcaaaggtggaccgggtgacctaccacccgacgtgaagctcacggagaccgtctactccgggaactaagaatggagcagcggaacacgggaccgcagcgtgagtggtggtggccatttccacattcaggaataagttttctgtaccggtttccaccctgaaaggacaaggcttccggataggtcacgcatgccgccgctcaactggttctcctctcgtttctgctgcttgtagattcattgttaggagtcgagcgatcgcgtctgtattttaagcagatcaaagaacgagatggccacacgaatcgccatcttttttcctgctaccaagtcgccacccgtcagcgcgtgatttacaaagtggtaagtcgttgcttcgccctcaaacgtttcccccattttcctcatatgccagtattggaccctcgaggggccgcctgaagaaggcaggaagtttctcgtccagctgtatctgtgctgaacgcttcgatcttgagaattcctcgaaagactggcgagttcgagacagagagaagcgatcagatacattactgtatgcaagcagctggctggccactagcgtaacaccgactcacagatccagacttccctgtgagccagagctgttggctaacagtcacgagcgccgtcgcacccggctgtccaagagccacccatcataagttgttatagaagaacaatgaaggccgactggtgcgtgcggttacccgaggattaatgaattgctcaccgaaaatgccgcaagggatccctgccagcagtggtgtgcaccggggttcacggggggctcaagtcgcgatattcgcctgggctggtttgggaacgtgacctcagtacggctcagctgcctcggagcagaagtttccccacgcacatgtaacttacagtgcagacggggtcacacggtgtcctcacaaaccaactgctgcatttggcaggcacctccagcgcaaaatctcgttagcgccgtgtgttatacgtgcaatgttctgcagttcttgagacagatatcagcgtgaggggcatccaatgcggacggacgatgggcgctattggttttttcgcatggtgcgacttgtcatagagcgcgagttgtgcagatcgccggaaatgccgaagagcgagagaaggtggcccagtctccaatctatcccttgtgtctgttcacccttcgctctttaaccttatgacttcttttgtgtctgccatcatctgaagctgctcgcgcgtgaaaatgccagcatatccgaacacgctcacccccgaatacatacctcacagacggaagcctccctttgtcaactctagctacaaaggagaatgctttttgagtgcttttcctacagtgactgaagaaccccgtgttttgattgaaacggtcctcgcgtttctacaggaaccagctggattattcgctcgtggcttcacctggcttgagtgttctggagagcagctgctctcggtcttaccacactaacccgaggccaacacatctcctttccgaaacggattcgctggtgggaatcgtatccttgctcggtatgttcgagcttcgctgtttccgtgccggctgcatctgctgtccctgctgagcggggaccggcagaccaccatcctcaccagattgtgttgctttaccacttactctgccaagcaacaaatcagcaaagtgctccgcaaggatatgcacctagaacggtaccgcacacccgcgcattctgctttcggggcaaatttgtatggcggtgacgcccacacaggaataaagtagacagaacgcgagagcacacacagatctgtaggcaatcctcaacagctttcgagcccccctttcgtgcaaaaggtgtgttcttcatcccccacaaccatggtacacaacgagtgtcgtgcagtggaacagtcggctcgcgtttgcctggttgccgcatcattctgtttctcccgagcgatgagagtgcgtccctaacaagcggggaagggaacctccgtcaaggggggacagcaaacgaagccctggccacgcttttctgcaggacctcaccgctccacaattccggttatgttccggtggacgcacttttttgggcgtactttttctgcacacgccggcggaaaaacgagtccccgctgtgggcacggcgcgctgtccgttactgcggctggacagccttgcggttgcgcgggttcgtccacatagccgtcagacaccccggttcgtccgaaaatacatccgctggtggcaggaagtagagatcatggcatcggatgtcgggtggggaaatggttcatatcggtcttctggtatcgccgtttgctgtcttgcgacctgaaactgcgaagtgcgtctgccggtgtccgcgaaccccgaagttgtcgacccacgcgaagaggaaacggctggcatcggtcgtgagaacgacgagcagaagcgcgtgggtcacatctgtgacacccgactgttcgtgcgccaccgctgggggacgctggtggtagggcacgaagtgaggagccgctctgttgtcgggggaaaacgtctccaatatctcactttttcttgttgtcaaacgtctgttcttgtattcccaagtgcggccgtgctccagatcaacccgggtgtagctcccgtgaagcttggccgattccgttccccaggatttaacgagatcccctcacggctccccccgaggctgttgcaagcgtggtcgggagccctgctggtgagccagttgcgtttggtcacttctcgcaattcgcctttcccatcttcccaaaactaagcacaa

SEQ ID NO: 2962 - DNA, 4234 bp, Toxoplasma gondii
tacattactgacttcaacccttctattcgcttggtctctggtagcccagcctgtgtaaactcggatatagcatagacgcaggggcgggtggagctgtcggttgtactcgataacctccatgagacgttccgtacgtaccagcccatctgtgttcaggttcggcgaacggatacatgggcggaacgtacggcggcggcggctctctgggcatatcatcagaagttgacacgtctccttttgagcgcccctcttctccaaagtctccactgtccccacctccgcctcggcgcatccgccttctctcgagaaaagcgcgcacacgaggcgtaccatatttcagcagtgccatcgttaagacggcgagagcagccactttaaataacctccaccacgtcctccgcagcttcgtggtttcggaggtcccagattgtagcattcttatgccccctctcactaccgccctgtgcgacgtttccgttccctgtggttgactgtttataacattttcctcctgtgcctcaccagcaacaacagaggcgacatggtcctccatgatcttgaactctcccacggcatcttgcagataaagaaggaaaggagagaaaggatcccgttgtttcggcggtacgacactcactagatgtaagtacagcatgaccactgcttttgtcacggggagactagcgtcaaccgcctcatggagaccattgatgtccaaaagagcaagtgcagacgcaacagaaccaaggaaacggctcagaacttcttgaacctcaggagcggacttcaacagatctgttataaatccttcttcatttttggctgcatcgagacgcattagaatcttcttcacgccgttcgccgtgctctgaagggatcgagatagctgggccgccagcacatatttttgaacaaaacctgccacagttggtatttcccgagcactagttaaacgttccaatgcaacatcgaggggtaaacgcctaagaactccagagaagtatgacaaaccatctcctagatagcttacgggcacaatgagctgctgaggagttggggcagtctggggtttctgtgtgccgaggatgccttcctgctgcggttgatgttggacagaataggaaattgtctgctccaaactggcagctgcagccactgcttcactcgttagaagcagaaacgaaaaatagaaaagccagctacaactcgaccaccccgacgagcggtccccccgcgctatcgcctgcattttgtgcttagcagtgggaacctccggcacctgcgacctagcacgagagcaaaaaggtatttctttatcaaaaagaaattgccattacattcacctctgctagcactgtacacgtatgctgctacagaatagcatatgtctgagtgacgctttctcaggcacctgaccaggaaaagagacgcggcatctcgctcgttagcgcgtctcatggcgaaaccgacccagacttgctaattaccgaacttgagtctgcttccctactcgttttttttcctggttgtgctggcagaatctaatgcagtatcagaatggagcccaggagacacatctgaacgcggcatcaaagaacaagacttccgtaataattaactgggtacacatgacgtaatggtgctgcccttccttgtcccacctacatgtcgtctggtgtccttgtcttgcacgccacagcagagatgctgtcgctgcattatgctcagtttcttctgacaacttcccaatgcgttcacccgcagcatatttgtgcacgtgtgagagagaaaaaataaaaggtctcgtggaatgatatagtcgatgctccttgcatcttcggtggacatttgcatgattagccattgtgcgtgagtgtcaaccttcaaggaacaagttccagaagagaggtacatgaacaatgattgcgccaagcaagcacattgacaagacagagaagcttacgtacacgctgcgagcggcacgtgtgttcagtgtgcgctataaacagctcttgtggtatcacgcacatggtggctcgttcagccggtattccctgtgacagtgctggtgtccgagagcgtctagtttcatccggactccctcgcgtcattccccttccagtacttcgggggttgcctccttgctgaacaactagctttgccggcctcgtacagtataggaacgggttgtgtgcgcacattatttccgtgtataactccggaaaccagggctagaaagtggactgaagttacagatgacctgaaattgtaattgatctcagcaagcgcgtacgctgatgcagtattgtggatgtgtcaaaaaagcttatttactccaaatgacagtattgtaggtatttccgttctatttgtatctctgtacgactggcggtcctgtgcgattcaacacacctgctgtcactaaaataagttgtgctgtttgcgtcttggccacctctgtataacctttggaatgcacaaaccattcgtgcccacttcgaaaaatggagcggccatgaagctgaggctaccacgtgttcgctagaagccgtgtgtcttggacgtctatcccacgtgccagtggacgtgtcatcctcattcgtcactgaagctttagaaagttggagattaccttttcaaaacgtgccactcggtcccatcgcccagccacagtgaaaggttcaaaggagactgagagcgtgagtgcacactctggcgatagtcgtaacagtaattcctgttctgtcaacgctggctgaatcgcagaatgaaagtgataatgctccaggaagtgaacagcagagtgtttgaccttttgtcgctgtaattccttaatcttggcgacccggtcttgttctatttcagtgcggactcgcccaagcaagcttcacctgagtaaatatttctctgaaaattatcatcactagatacaggctacgagtgtctaccagcatttgctacttctattcactcacattcccaccgccagcaactgttgatgtagaacctctcatatgccgcggttctgaacgtcaggtagacaaacttcgtcgccacaggctgtggaattcgctgaagcgaaggactctcttgtgtcgccccgaaagcactcagcgagtcccgtagttcgctgatgtctgcctgaaacatcgcgaccgagcagcttgactggtctcaatgggaatagccctggttgatcggctgtagtctacggtcgttttccggtgtcagcggaacgaaaagctagtcttcatgaagctgcctgcctcttctgcagatgacagaccgtgtgtcgaagtcattggtcctgtaggtatttatattaaaatttctgtgcatgttatgttgatgtcgctttgtaagggcgagattcctgggccttctcccgttcgttgacggctgcattgttatcagacgaccctactcgtaacgtaagaagcctcttgggtgtcctccaccattctaagttcacgtgttgtttctcatggacaagtggcactgaaccgaacagcggaagcgcttcgcaaccgcggcacgcagggtgccaaagggtgtcgcgtccaacgcacaaatggactacggccaaccaggagactcgaacgcggccgtcctacaaatgatctgtttccccagtagatgtgtccgaattgatgtcaaagctttttctgcgggttgcgatattttctcccgcacacataatgccccctttgcatgcgtgcagcgaagtctcacgtaattcctggcatgccagtggccgcatttgtcccccaagtctccccgtatttatatcggcatgtgtaatctatgtaggcgtcccatctttttttggtttccacgggacgcaggaaactggttttaatttttcgatcgccgtttttttccgccaccaaacaaaagatcaaccattgcctgagcgtcacagtgtgtttcatgttaaccgcgttgccgtggtttcagtcgacttagaccaacttgcgacgtctctcgtgtttgtatacgaaactcagacgtcgaaagagtgctttactctatactaccactatatgaaatgtaaaacatatcgatgtcgccccagcttgacgtcttccgggtgcccagagtgtcttgattttcctcaggtcaccggagacccggcaggactcgcgatgttcgattgtcagagacatcgacgctgcttgcccaaccagagaaaaaaacgactaccccattatcgatttccgttcttcatttcaca

SEQ ID NO: 2963 - DNA, 4186 bp, Toxoplasma gondii
gatatagacaggtatcagacaacatagcgtggagacagcgaccatggtgatcgctgagaggagttgggccgcccacaagtgcagggactcgcctccgtcatcatggcgctcttcggcatgatggctggaatcgtggacgtgggcgtgaacggactccgttcccgtccccccttccgtcatttttctccgcgttcctcggcgtcaaaaatggaaacgaaccgcgagctgggtcatgcgaaacgcgggtgtccactagacaccctgcaagaaaattgacagttaccgcggaaacttatgactcgacaactagaagccgggtccacattcctaagaagtgcgcgcggtgtgcttacaccttaaaagcacgtgaaggtgtctcgtcggcgaatgacagccacccacggcgcaacaaccagcttcactacagagaaagtggttgttgatgctgcattcaacagaggcgcctcgcctcttattcagcacccaatgaaaaaaaaacgaatcgctcttccgcagcgtcaaatgagtgcctggctccagcttcacatttcagctgctggtgccccaattgaaatccccgaccagcgacgcaaatcagtcgttctttcgcgtgagaacagacgacgtgcaactctttccgtttcggagcaactaaatcaagggacagacaacatgcactcctggcgttgcgtttgcgcgatactttgggggggtctgaaaaagattgacaggaagacgaccttctaacacatagattgtgtttaccgttaccgtctagggatctctcgactcgggtgaagcattcaatgcccatgtgcagaacacctgaagcgaaacgcaaacgccctgccttctttccactgccttgaaacgctgtcatccgacacgattagaaagtcaaaactgacggtcgactggtgggaactgtaatcctttgtttccccgccaaccgtcccagtgtatatttacccatgaggggcgcctggttactgtccctagatctttggaacgaatgaattgcgtttttgcgccgtttctgtagaaagagcaggcgggtgcaagtgacgcaatcaatctgccgcagcccctccccggccccgccaacagtgacgaacgcttgccagaggcagcgtgtcaaacgcgatttcgttccagtggaaaccaatgacggttcttcccagtactcgagcgatttaccacgtgaggaaatcctactcgggtacgcaaatctccccgcactacatataaacaaacaagtatgtaaggaaccgcgaggggacctatgttacgcgtcccggagagaagatggagaaccaccggcatttgtttttctgcagacgcggcaggaaaacacacgcgccccttcacagcagaggacagcataaatccctggaaagaccagcacgccgaggcccgccgctgcaacaaagaaaggagttacgtcaggggaaaggccctgccagtagctggcagcagttaagcgcgaaagtcgcgcagaactgaggttttgctgaacgcggacaagactggcgtgctacgccaaggatagaggaaaggcagaacgaccactacgacacacttttaagcgaatggtcatcattctcccaagtttccacagcggaagaaaccacggagaaagagtaacgggaaattgggtcgtgctcgaccaacctttctcaactcgcgtacatgagggacaagaaaagacgctcctcctcaatcgactgtgaggggctggcgctccttttagcgcgaccccacaagggcggcgtacgagacactgctgcccaaggtgcacgttgttttcttcgagtaaatcagtgagtcatcggttaaaatcgtagcacgagcaaagggcacggttcgacctatattttcagggagatgtctcaaaatttctccgacagtatcacctgtgaagacaagaagggtctcatgaagctgcctagtgcaagaccttacggaacctcttacaggattcgtctgaggcagcagaaatagcctttctttgtcaagctgagtgtctggcatttgaaatttgtcaaagaaaacagtggaacctgtttaagaaaagagaagacgtattacgacgacacaacaaaaaaccagatgacagccttttctgctgccaggaaaaaccggatggcatgtctaacagaaagggacatcatcaatgaacgttcctctgtggatttgccgtaattcggtcctccgctcttctttttctccccgtacacttcctctgtcttcctttgcgtccttccacgcttcttcgccttcatccaactgctgtccctttttgtgttgaacgatgatgacactccatcattggtttgcctgttgcagcgccacggtcagtcgtgaccagtccgctattttgtgactaaagggatgacggcatgctacattcaataacatacaagtcagaacgaaattctttgctggaagcagccgggaggaacggttagcgtggattcagtataaagtaggaagggtcaggaacgcaagaataacatcccaccaatcggtgccatggaaaactgtatgttcaatatcacgtgacacactccacaaaaaacaaaaaacgacaggacaaccgtagcgaaaaagaaagtaggtgatggagatattctggagctgaatgtttatccgcactcacatgccacccgtcgactgccagcaagaaggcggtgttacacgactgcatttacgtgcccaccacctgatgggagctttcggagtgagctgcattccagatggtagctttgtttatgtgttttttcataatagagttatggtgatggcggtgtacttgttgacggtatgcctacattgtttaacgaagagcctacgtacccatttacggaggataagcgggagataaaagggcatcgaaggaagataatgaaacagcaaatcacttgttgagtctttgatttttagtaagtctattggggattctggtacaccactgttctaaaactgaaccactgactcgtagttcggtactcgggatcactcacgtgtggagccgcgttgtttgttgttctaaacgaacacgttgtgctgtttatttgcagcttcaatacactcaattaagacaagagggcaattgccatggctcgaatacgtaaccttgcaaaaagcgtttcgttttcccgtcaggtcgcccgtttaggttgtgctgcaaacattccgaaccgtgtacgaaggttgttccgtactgatatatgaacaaaggcgtccttgtggcgcgtcgacgcctaaaatccaacgctatcttacacctgactcgcggactgtgtttaagctattactacgccagcaaggttaatggccacagcttcgttgcaagcatgggactcaattcgtttctggatttgccccctctgttttcgttctacaacgactaattgaggcaagacgcagcgctgttgctttaacacggagaaagagaagtggaatactgctttatacggacgtagcaatataggtacacatgaatgcagcatgctatgaattatggtccatttgtgaacttttgcctggtacacaaagttctagatcaatgatgcatgcttttcgccgcaatcgtactacaggtacttccttgatcttttacccagttacatttgcaagcaaaggacggtgacaccacttcgacagctttcattggcgcattggtatataattctttgaggttatttcacctgcggcatctttatatctcagccagactgacaacgacacctgtgagagcacccggcacccaaggcactcgcatatattctcggagacgttcacgcctcttgccctcaggaaaccctgtttattcggtcgccattggatttcttacatttcctcctctcgactacgtctgttcgccgtcaggacattttcacctagcttcactcacacgcctcttgtacctgctccgccaacacatacgctgccgggcagtttctgttttcttctataaagtgatggcctatataccacgatgccgcatgagaaccaccaacaaaagagaaggcattttgtactttgtgtgatgcattctttgcttcgtcgttttaagtttgtcacgtagctagcctccatcgcggtggtaagaacacgaaaaatggtacttgagcgagaggcacctcaccacgagcgtcacggaatgtgggtaacgacaaggcca

SEQ ID NO: 2964 - DNA, 2308 bp, Toxoplasma gondii
caacgcggatttaggcaatgtcttggccagacggcggacgacatacacgccgcgagtacggctcccccgccggcgccataaaaaggccgagaggagactgcactgtgtatccagggcggatgggagagaccccgcagtgtgaagtcctcgagtctggcaactgcggtccaattggcacttccggcccccatgtggagcggactggattcgttgcatgaagcgatttgcattggcgcgtagggaggaagagaaagtatgtcggaatccccgggcgaagaaaaagtttccagaggtgcagccgcagaagcgaaagaaaagcagggactctgaccttcagaacggcggctctcgcctctgaaatcagcaagagtcttccttccaggagagatggaggcgcgttctcgggaacaggtgtgatgtctacgacggagacactgagtagaacatccttctcggcggctcgctgagtgtatccgtctagaggaaaacaaagacgagtacggcgtctcgattcgggcaggaaacaacggcatgttcctccgaaaggaaaaagcatcccagccagcggtgctggcgtggcgaagccgagatccgagcatggtagctgtcgcctgtgtctcgccttggctgagtgtcagtgaaacaaggtgctcgaacgcgcgtcggagcctcgcgcatgccctttacctccaactatgcggcatgcaacaggtcttccggcaaaaaacttggcgccgctcttctactcagctggtcagaaagaacgaaaacaactttacacgagttggcacagaacatcgaagtctttacgcctgggatgtatgggaaatactcaaacgttcttaatcctagttgactaacttgaatgatgctgggttgaactgtcagtaagcttcaatgcccaaggcagaacttctgcggatgttcttgaattaaaaactcacacagattggagccgggaaacacagggggagtcacgggcgccgacgggcgacattcagtatgcacactcctggctgtttctgccaggtcgttgtcgaaggtaaataaaagcggctgatacacttgagagaagcgaatagcaacggcacgtcccagaaaacagacgccgtgccgcactctcccaattccagatggcgaagagtccgttttgcgctacatcccggttcagacagttcaccccagccccatatatgcgaggctgagggtggttgactcgcacgcagaccgaattcaggcaagaagcacccttgaagtagccaccattttaccgatttttgcgaatgttctttcaagagggaaaacgaagcgacggaaaagatgtgtttgcttcggagaatgggcaccccgaacccagcgacaggcttttcgtgctgcaagtatacgctgctgcatgcgttttcaaagcgtgcatggtcacttgagtctgccgcagaaaaaggagacccgccaacgtacgcgtcaatggtccctaagcagcggttccctccgcagaggaaaagatcttgaccattcaaaacggcatgctgcttctcggtatgtctgtggtgcaaacggttccggcagcattcggcaaagcgctgcatcattcaatcggcaatcgtgcggaggacaacaggtgtgtttcacctggagttcgccaatcgatttgttctccactctccgtttggactcagagagcatcactcggagtgctactgtttcgcactctctcaagtcgtgtcagaaggaaccctgcagcccactaaactactctcggcgtgtgcagcagggacgctgcattcctttcccgtcttccagattcgccttttcgcttcgaaacgtctgtcaaagttctttccgtagcacattcgtttgcgctgcctcaccagtcgagtctagcccgtcgaagctgtgttcgttccgcttgtcagaatacacaggcgcgtctcgcgtttcggtggcctttttatgtgtacggtgggaaggcactccatgtttttttttcaaagtttttccccattaggaccttgttcaagccaatcacgtgtcacgtccgttccatatgcgctgcttttccatccacagttccaagaaacactcgacataggttttaacgtgtggccatttcaaaaatagctcgtcaagctctcgtccactcgaacactcgtgttggggttcgaagacgactttttggctcggtgagtttagtgagaaaagtccccccggtctcgttccgaagacgaattcaagtttgtcgaagtcggagcaggaacatagacaagcgggaccggcctgtccggctcttttcggcgatgtgaccccggaa

SEQ ID NO: 2965 - DNA, 1602 bp, Toxoplasma gondii
gcctatcactcgctgtgcttgcctgtggaagccgtcgaacgaaaattgtaaaaacaagaaagttgccgctgtcagacacaccgaaagagtgctgagttacactggtggcagctgtgaggatgccttgtttgagtttaccgccaccgtataaacctgagagaaagctgctttgatgacgatgtagacgagccgctattgttgaggcacagccaccataaccccgatagaaacctctaacttcgtgacactagtgtttaatcaaggtggtcgtggaaaacaatggagaaaaggaacagacaacacatacttgtaaacggaaggtcgcggcgttcacatctaaggaatgtccggcagtttaactgagaaaacgtacgcttgacgtcgctccgaggccttttctctgctttgcattttacgtcttgctttttgttccggttgtaagtatgtagcctttggatgggccgaacactctgtttttcaaagagaagacgaacgaaattatcttgcccgcaaatcaagaagaaactgagaatcgctcgacggcagggaggcgcctttgatgcacaagtgaaatttggtagtctccgccgaagctgaaatgttcagcaacggatgtcacacgttatgcgccgatgtttgtgctcaaggagctgacagacactagtaacttcattaaaataggttttgtttgtaaactcgatgatagacacacactccgcaaaaacatccaagtatcttcatatatatatatatatatatatagtgtttatatatatgtaggctaatgcttgtagagatacatttatatatcaaccggttttcgggaacaaaggtgtccactattgtatagagcagcggctaatgcgcagctatctcctatgcgttccgcaagcaaaagacgctggctgtcttttttctttcaagcgttttgtttcacgacatgtacaaggagctcggatctttaaacacaatcgcatctccaggtgtttttccttctttgccatgggagatgatgcagctaactctgagtgtgcgagactgcgcgacctgcagttagattcccatttgcccagaaattttgtaggggaattttcgcagttttctcccatggtttttggaaattctatgccgccgtaaagttgtggtctttgtcagagcctcaaccgtcgcggttgtctctctttttttcaaggtgttagtgagttttttctgcagagtcttgtcgtgtgcctttctagtcacgtgtcaaccgggaacacgcccttagtgaagttatcgggctccggttttgtactcgttttggcgatcgttcgcttgttggtttcccagtaccacagtcttcctttcgttggcctatcggtattacacgtggttcgctgtactttcgcgttcatatcgatataacccatgatacagatccgggttacgtgtgtcttcgtagcagacagaactcacggcagcgtttttgtgtgtttagggaccgatacaaagacctacttgtgagtgccttgtccggcaacaacagaaagctgccctctcatcttgaattccatgcagccttcctcatccttccctcttttttggtacacctttttgcaacca

SEQ ID NO: 2966 - DNA, 1974 bp, Toxoplasma gondii
gaaagttcagccgacaatacaggtcgaagaaaccgtccttttccacgccacccttctcgccagaatccccaggcatgtagaacgtgtcgagattcattggtggctgacgcctctgcgttggcttcacagcagcggctgtctgctcagacgctaacgggtcttcaacagcatctgcgtcatcgtcggaccctgagaacaaacagaaaggtgcgtaacttgcaacagaaaacgagtgacgcaaagaatacgatcctgcaacgataaacatgaagaggggtcatgagcatatctttctcgcgagctttttacgaggggcggtaacaaacaagcatcgagggcggttcgtgtaaagccgcggttgagagaagctgtgactgaagggaaaccagatatctcttcaaggaaatctgtagtatcttcgagttgtaaaaaaatgcaaagcaatagaaactgcgttctgatggtcagctctttccattgttaacaccacagaacgaggcgctgcggcggtgaagcttcgagtcgcacagacagtgtgtcggccaggctactcgggtgttcacaggaagaagaaaggatcattaaatcatgccgttacgcatgtgcactattccactcctcataaagcttctttcgagaacccctcgaaaacgaaaaccaccaattttttcctcgtttctgaaacgctggtcactgtgtgagcttgagcaatcacggtctgtgttgccgagagtctggcattatgtagcgggaccggtgctaaacgttcagacggcgaaacgcatagcgcctcctcttgttttggtgaccgaagttctgtcacatatctgggcagaacagcttgaaagcaaccggcttacagcgccttcgagcactctcttcatccccggtgggtgaggcgtctgtagcacgcagagtctgacggtcaacttcttcattttcgttttggtcttggggcggcggagaggttggctcttctgtttcgcgaaaaaaaaggcggcttgattgcgacggacttgagcccggtgagtctggaagccgcttgcgccggtcggcggacgaagcgggtgacgaatccatggcagaccacaagaagcagctcctgtacgacttggcacgctgggtgagaatgtggtgaggaagaaacaacgagaaaagggagatttgcagctgcgaggaaaccgtgtacaagacaagaagcgagtatttggaaactgccagcgtggtggggggcactttgaacacgcatgcagacaaaagcgggccgtgcatgtggtttacaagataagacctggccgctgcagattgccgaaacagaaggttggtcgagaagactctcgtggtaagcaaggactttctgaatttgagagagtctcggccgtcagcgctcaagtctcctgcacatccagacaagacagtgagcaggtttcgtcgcgcggcacgggatagacaccacccatcccaaccccactttttgcgaggtaatttgagcatcgagttgcacatgcgcatctactttacgcatctagaaatccaggtatcgatactttatcactgtgtgtttcagatgtcagcctgtctgcggcaagatcttttttgtgccatgcttaggaagagagaacgacaacaggtgagaagcagcacctctaaaaccagggtgtttgtatgagtcacgtccgaacgttgttttttctcggcgatgccgttggtatgtccggagtgcaatgagatattgtggttctgtgtttcgtgggcaagattccttttcttgcagcgtgaccctcgtgcttgttcgtatccgtcggatttaacggcggcagcggcacttaactggatacgctagccccgcacagcagtctgttgactcaagtctcccttgggtagagacgcagctgcctgaaacccacgcttttttggatttacaaagccagaaccgccgactccacggctcgcactgcaactgggccaaaaaaa

SEQ ID NO: 2967 - DNA, 2118 bp, Toxoplasma gondii
ctaatctcgcagcaacatggatagaacgttcgatacatagtctcgtgacactgttgcgggcacttttactctgttttgtcgctctgtaggcttctccccgcaatcgcagagtagcaaccgtctgaattttcagaccagattggtgcacagagcggcatactgtactgagcttatctgcctatctacaaacgtagatgctaaccaggggccgccgttgtgcacgggtgaattaagcccgaatcggtggtctctgcttctctaattttttttgtttccacgctgagatggcaaacaccgggcttaccctgttctgtcggggaatcatctgtattcctttgtcttctggatgaatcgcattctggctgcatcccatgttcgggtgctttttcggggttcagtctagagggggtagcgagacgaactcgaaagatgtaggtttggtttctcgtttgttcatccgtccggctagcagacctgttttacgaacataaccgagtgttttgttgttgtaaacaatgtccgtcgataactttgtttgggcgggtcccaccttctgcagagatcgcattggcacgtcagtttcgcagtttctccgagcgtcgagagccgaggtgtttgtacagcccacgtgtggtcagaactttcgccatgggtgctttttttatacacggattctgcacaaataaatatgttttacaacgctttaccgcatacgcaatgtccatctgccatctagatagtatcacccctctcagtttttcagtgtctggcggatttgcagccaacctgctgcaggacggtcacgttacgtccccgttctcgcaggattctttcgacaacgggattccggctccccccaatcacacccgtctgttcgccccgggaaacgctgcgccttgctgcgaactcgtccgcttttcgcgaaaccgaaacgcctcgtgaactgtgtattttttgcgttgaactcacggaatatggctctcctgctggccgtcaccagtgttttgacggtgtcagtgcgataacagtcattcaatgttctgaattgagatgctggcctcgtggcttgtagtacttcgagaacgttgagtcgtaacttgggtgtgcataccacaacttgagttcccatgtcatgtctctcgagcgcccacacttctccaaagaactgaatatcccttgcccgttgttctatgccctgagcgtgtggcctggagtggcgaaggacgagaaaagcgtttgtgtgtggatatagataccgaatcgataggtagatctgtatagagaacaaacacagaataagggtttacctctttgcagtcctacgagtgcttgaagtaaagaggagaaccgcgtcttagcatacctacacaggggcataaagtgcgtcagccaaatgagaaaagaaaattcaagagaagttcctgttctaagggtgatcgttgttcttgtttcatgacgtacccgacacagcacatcatcaacgaacaaaattttcttggttcacaggccaccgtcacaagccttcggacatctcgtgtttagtagtttgttcgttttttatgccaggtgacatttgtgagctcttgcctgagagaaatcgtgtacgaaaaaaagtatgaacgcgaatatccagatcacgtgttgcttgttaatgcaatacgtgcaacggtcggtgtcctcgttgtgcagatgaatgggaaaaagtggagttgtctggttgtggaccccggctcgagaacctcagcgagtgattctgcttgcaagtcggtctatgttttattatatttaagctattactagtttaaatcgattgaatgctagcagtgtcatatctgaagcacgccgaatcggcaaccaccacggtccaccagcttgcggtcagaagagacgggacgcagagagagttcgagatcgccggcccatactcgaacaggagatctggagcacccgtgtctccgcaagcgtagcgtaaggaaagccgttctctttctctcagccagagctaagaaaagccgccaattttctttcttgtgtgcacaccagccagtggagtggatgcgagcctgtgatttctgcccctaccgcagcccgtcgcaacacgcttggattttcctttca

SEQ ID NO: 2968 - DNA, 1138 bp, Toxoplasma gondii
ctcgaggagacacctgccagagagaagagcaactcgatggaaagcaagaagaaacggacgcagaagagagagaagagcgagaacgaacgtggaaggaagaccgagaagaagaaaggtaccgcagcctttctgagacccgatcgacaacagacagtggaaggagacgcgggaagcggcggaaacgaagatgagaaaggttacaagaagagagaaaagaggaggaagacgaacaagaggaagatggagaggatgaagacgacgaatgggaggaagaggcagacaaaggagaaggggaagaagagaaagaggagctacgacagagggtctcctccgcagggaggtggagttttcgagctggactttccattgtgtctgaatgtccttctgcagtcaactctccccgcattcgcagagggcggctctgcctctcttgctccgtctctttgtctttttcttattctctctcgccggttattcatctgggtctctctctctggttttctctcctgtcctcagtcggtttctctccctcatgaggcagcgtcctgccctgttttttgtgtccttcgccgtcgtcgtccttttactgtgccattccttgtcgttttgtcttgctctcttgtttcctctgtttctcacttctccctcttcgccttttctctccttcgaagcactcacgccggcaaggtcacctgccagctggggagccgggagccgcagaagaggaattgaaaaagggcagaaatggcgggagaagacggccaggaagagagctcagacacacaggaaaggaaagagatcgaagaagatctggtcgagaggaaagatgatttcttccttgaatccatcgaaaaaaacgcgtgcatgcggcacggatgcatgcaggcatttcgactccagaagcagagacagcatctggcgttaccttctcgtcttgggagtttttccttttctcccccttttggagacatccaaggcacctcgcgagcagcaagttttccggagcttctctgctttcgcgcgaagaagcttgagaagtcgaaggagttctgcctgagagcctccccgccgttgcatctgaggctctcgagaaaaataggagagacgtcctcgacatgagcttctcgtcctttccaca

SEQ ID NO: 2969 - DNA, 3403 bp, Toxoplasma gondii
cctctactaaacctctctcgtgtaatgtgttctttttacgcttcctgtctctctcggagaagcaaaagcgtgaccgtgccgcggtgatctgtcgtctccaacgtacctcatgagttgctcacttttaaaaatcactcaacgcttcattccattattactctgcagaaacgaggaataagggactccgtgcacgcagtaccctgagacctcaaaacggggtgcgtagtgtgaagaaactgttgaaagtagctttgcgagccatgtggacggatggccgccggaatgtagaggcacaccgatggacgatcctaacgtagaagtttcctttcgagggaacatctgtagagctcttggatttttgcagacgttctgtctggagttccagcaatgagaccgcccactcttgcgggtggcattcgcataactgccactgcttcgcagacaggggactttaccatattgaggcagccgctcattttatttcagtaccagtttctgatcccccttgcgctagacgtaacagaaaagattttcatcaaatggagagtcacttacaagtccgtttttcaccgatgaatgaaagcagcgcatgcagtattacgaggcaacactcaaaagtatgcgtatgcatctatatataaatatgtcgcttcatttaatcaaagaaagagatggagcactcgaactattatctcccttcaactgtcctacgtgttgaagattccggtattttcacacatgagccaaaacctccgttaatcagtgacaagtttccatctacatatgtcgcttcaacctgaaaaacggtggttttttatgggaacaccatggaactgctgccacattacattttgtattcatgatggaatctctggttccgcaatcacagcgcgcaaacgggatacggaggccactggtccccaataagtacggaccacgcaccggcgttttgtgttgcgaagggaccgtcaattcccattctgtgggaatgtgttcggtgtcttcacgcttcctacgtcacagcgaaataatgtcttcgatgaagataggcaacaacgaacggaagaagacaactattttcgtgctagctaggtatgtgcatggtgacgaagcgttgcgcatgtcaacaactttcttgtaatcgtttgtgaaaatgttgcaaatgcaacccagaatcatcgcgctctagttcgatacgtgatcaaagaatgtttcaagtcacaaattcaagtgaggaaaaggtaacagtcggaatgaagaggagtgaactatcgatgactatcggcgctctcgtgtaaacagaggtttgagtaacatgaaagtgggtactaaataaaggcagctgtggtgtaatcgtgcatgccttagtccctctatacgccattcggtgcagactcaaaattgtcaaccatgaaagaggaggtatcaacgatgcattaggggggtatcaccacagactaattgaactctgaatacaatgcgccgtctggaacggtctgtagagattaacagtgttcgtgtagtgaaacttcagtagtctgccttgtcgtaattcaaccattttaactgtctaaagcagtccggttggatagtggtgtagagcaatcttgaacttggttgcctatatctcacaactgcagtcgtaatccgtatcccagtttctatagtgtctaccaccacatatgatatttccccagtttaaaataaaacgctgctgcactattcgcgagcttggagaagtatacagtgcgacaagctcctgctagctgttgcatgaacagcccgacatgacaaagacagggttgagataaacagagtggatatctaacaccagatttttctttcgcgaataggcatggctgttcggtcgccgtagcattcctaacaaaggcgggtcgcagcttccccagccccaattgcgaggacaagaagggagaaacagtgttcaaaaacgagaatgtgtttccgctgtacgagaaaagagggaacacgagcagaggctccacatttttctcttgctgttggatgggatgaaccaagacatgggaatgcccctggtttgcaattcggttctttggttcaaatcgttttgcgccagaacgtggctgagacacttggtcgttcgcgtatcttgctttcaatggagctccaaagcatcactgctctggtgtgcgtaacagtctgccttttttgattattcagaaccttacggaaaacgtattccgtcaaaacgttttcgtatattgcagagagattttttaaatgtgttgtgacaccccctggttatcaagcaactcgctcctcgggtctaaccagttcagcgctggacgtctcatcctcctttctttcttgtgtgagtacttacgaacttcaagagcgctgggggtccgttttcacacatcttttaccgctttgccggctgccggggaactgcttgtcacgagcagaaagtatcagaagacaacaacatgtctgcttgttgtggagtttgaccgtcttcccgacgagccaatgccacaacatgcgcgaactcccagatgtccccggcacttttcagtgtgtgttgcggctgtgtttgttgaacgccaacagtgggaaacaaattttgtggggtattagaacatgcatggcattcaatcatgcttggttgaacgcccttaatttagactgccgctggcgaactcgccaagggcaccttgcggagtcgacgcgttgctggtatgctgttgaaggaccttgttcatagtttttgcctaaagctttattcatcttcctttcgcttttcatatacaaaacggtgtggcttcgcatcgtctcagcacacatacggtgtacccattcgtactgctcaagaaagggaatacgagacagtatgtcaccgtatcacaaactatatgcgtccgttgccacctgtcgggtgtcaagagtacagtcagagggtggatgtttgcagtgaccgtgtttcgtgctatgattgatagatccgaaactccgatactttggtcaccacactttataaaagaacctcggcttcttcctgtcctctcaaagtagcatacttgtgcgcaaaatattcgggagcgcctctaggctgccacgcttgatacgtttgtctgcgactgcggatagagtagcgtgcagagaagtccacaacagtatgtccattgttccaagacaggcaaccaccaggcgtcgaaatggcccgtgttttgacgccccttccactgcagtcgggcgaagcgtttgtgttcggttggttttcgtctgttcttcataccaaagaagcagcgtgacctgtctctattcgctccacttttcctttcctccattttcaatatcttgccattcaaggggagaattatctgagcctttatttcgactctgcgttgtttttttacgacta

SEQ ID NO: 2970 - DNA, 1967 bp, Toxoplasma gondii
tagcgggttgacggcgacggcgagagagcgtgatagaaaataacaaatacgaatcaaagaacagatggttaatgccaggataatgcggacgtcacgattttctacactgcacacgtgcatgatgaagtcactacggggtttcccctttgactcactagacacgtccattgggcgacgtcgcagcaaccgggggaagagcgaaagctgaacaggaccagggaaaacaaagagagcgaccgcactacggacggaacagcgtaactgcttgaaccatgcggtgcgagaacagctggagactttgaatggttccgctttgaaattcgccggatagaaacgcaggaaagctcacgccgcggagacagtgtggtgtggcttgacgcgtcgcgaggatccgttatttcacaagtaccaatgcatgtataccagattccatcaggggaacgacatcgtgtcagcatttcactaattagttgaaaagaggtgacgcaccgccggaaacgcagccctaatgcagacttgctgagacaggggagacacgcggaaacacggaagagaggacttgtgcagccaaaagctgacacgctaagtgcatagacgattatgagcttctgagtactgcgacacaattgggtacatcgacagatacagggattcaaacagcatcaacgaagccgggggaagtgtgtttcaacaaacacatactacaaagatagggaaagatatcgcttccacggaaaaagacatacgttaacatgagtctggcggtatgccttttcccaggctcattatcgaatgaatgagaatctgcggggcggggggtagagcgaagtcctcgtgtagccagtgaaactgcttccaatgtgttcaaaccccggcccggtcctccaggttcaaggccgcttgagctcctctcaatacagaaaaaaattgcaaagataattaaggaatatgctaaatgtggtgggtggaaatgaaggccaattctgccggtttccgccgtgccagcgccctctgtctagatatccatgcagttccttagatacaggaacggaaactcgacgcgggagatctagtgcataaacaacaagcatacatgcgatgctagccactggaaaaacctctgcattcctgatatgtgcactgaagaaagagtgtggcgaatcaggaactccagaagcaccgtctccagcgcgaaagcgacgtcacatacggggtctcgagtgcatgcactgcggccggctttcatgcctcatcacggctagcttcgaggtgcttcatttttccccttagttaagggctgaccgtgaccgtccgctccgcagtcttgagcaacatgacataagcaatgttgaaaaagctctggcgggtccagaagtcgaattgcgcctttgcgtgtctcgtgaaaaccgacgaacttgtgtcagcctgcatacactcagtgtggtcactcacttttacgtggcattccgctgcacatggtaaacacacaaaccgggtgctcctgcatgcgaaacaacgagtttgccaagcacccgttcattgggacaaatagcgtttcgtgtagcttcaccgtataagcttgagggaacgggaactgacaattttcaatcctccgagggctgagatacggcatcgcacgcgtctcgtctcaattcaaaagttgggtgggcagtctcgcagcagcaaaactgcagtctgtgcccactgagaacaaaagataagggttgtcgaagacttatcgagataatggaaaagccccgttagaggagtccgtcttgccgtgtgagttgcaaactgtccgagtggctggaaggggtagtcgggattaaaacagatgtatagaagcacgtcccatgataatgcagtttggaagcctcagctggatccgaagtttgcatatttttcgtttggcgacatacccgagtcggggtcggttttcgtcgcttgaagaaccctgccactcataa

SEQ ID NO: 2971 - DNA, 3863 bp, Toxoplasma gondii
ttcaactctcttggaggcctcagtgcccgtctatgggaatgtttatggtagatgggtttcggtgtggtgttgtgtccctttgcagaggatgaattcatgatcatcgcatgcgacggtgtgttcgacgtgatcagttgccaagaggctgtgaattgcgtacgtaagcatctgagaggaggcgggacggcagagacggcagcgcaagccctgtgcaagtttgcgttcgagcggcggtctctcgacaacctttctgccgttatcgctgtcttccagccccccgagcgtcttcaacataaagacaaaagacctgcggactggactcctaccacccccggactcggcgaagaaaaggctgccacagcagaggccagaccttcgagctcgtcacggtctcctttggccgccacccaaagtggagcctcagctggagaccgcactggagtctccggtggagggtcaggcgctgcaggcagcggcggggacaggacagccgcgggcgaaggaccaccccgaaggcggatcaacttcgccgcgctaaagggtctgttgtagaaacacgagctgctaaagagcggaacaacttgttgatgctaatggcgccgactagtgctttctcggggggcctgtgctgtcagtcttgccttgtcgccgagtcccgccaacagtggcgaggttgaacatcacgacgggcaggcagtttgtatatatatccacacttcgttgacgtaccggaaaaaacgaggtcgagagacggactctcccggcgccacagttacgcagcaatgcgctaaaaggaccagacacactataccagtagtgaagtgtaggataacagtcacggctcgaaagaactgtgttgaggtcgagccgccggtagccacaggttcgtgtagtggaaggctcgcggcttgttcagtgttggcactcaatacggcaagattttttcgtacgattttcggtggttccggcgctgaatttggagacacagttttgtgtcaacctagtctccgctctgtccccctagttacgcacgaagcgtattgttttgcactctttgaaattctccatcgcgcccccagaagccagcaggcggagaggtcctagaacggcaagttgccgaggtggtgatccgagttgcagagggtagaaacattgtctcttgatgcatgtgtcgaggcataaatagcttgcgcaaccgtttcacgcgaagaggctggagtagcttacaacccgcgagtgtcctgaggcatctgtacacctcttcttcctgttggtcataacaatgaacacgtagggcagtagctgccggagcgggcggtgacgcagacagccaagacgaggcggctttgtacaaacatcgagactacacgccagcttccgcgtttcaaggctgtggccaattgacttctcgtgtgcacacgtgcatgttctgtatgtatgaaaatggctgttgtgtcgctcacacgacagggaggaacctgtcaaaaaggtatcctcttacgcctgtgtcccggatacccagtgtcgtacgattccttttgggcacgtgtgcttgcgacatctgctgaactcttgggggctcccccttcaaacatgtactgctataaggcaacgggatcattccgggaactcagaaagccttagacatagttgaaagccgtcatcacccgctgaggcgacggccgaaacttaaaatgctgtttgatccgtgatgcgctcgcatttccttaagctgcatgaggcctccggaaggcaacaaaaatggaaacactgttcagctccctgctgatacacaagggatgaacagtacacttacgcctctatccatcctcgagcagtcacatcatgagtgacacgaacgagacagtgccagatccactcttcgagatacatagtgaaccgagaagaaagtcgtttgtgatcgatctgcgtcttgggattgttcacaactctgtggtgggtgagccggaagtgacagcgaatcgaagacacggtgacaagtagctcatgttcagaaggggacaacgaaggttgaaagagttgttttaacataacctcttcgtcggctgtgcgtaccgcagaagagaagcagggagcaggactaggatagatcaatttgacggatgcagagggtaacaacgtcggctgacagggtgccaccttttgtgaagcgttcggggcttgcgtcaagtcgtctcgagcttctggagagagaacgcagtcctgacgtggccatttggattctttgtgtcgtattttcgcacggttttagtgggtagcgaatacaatgttgatcatggttgtcgacgggcacttggcttcaaaaggcagcatatgcatcaattcattttatgtgtgccatgctacacttacctcttacatagcagaagcctggattgcatgcgtctgtcatttgtgcgtttggtccagctgcagggttgccttactgatgccattcgccgttgtttgaagcctgcacacaaaatgggcagaaaatggaccccgatccctgcgcttagtcaaggcgagtagcgacggtgcgacacagaaacagaaagacaagcgaccaggctgtacaccaaggacgatgtgggtaatttatctggggaaaaaacggagagaaccgcgtcactgtaccgatagttttgcttgagtgttgcattgcttaaagatttgttcctcgccgattgtgacggcgtgaccgatactcagcggctgtcgacaccactgacaacaagcattatttctgctggggatcacagaccaccgatcagagatgcaaatcctagacccagacgattctgcatctaaggcatgtacagcccttgcagcggtgtgtgctgtacgccaagcgtcaggctgcaaagagtcgaaagaaaaaccacccaaacgttagaagacactttgagcctcgagctcaggactgtcaatttcgtttcccttttcttcaatcaagcaactcagcagctaagtgcgagattggaatgaattgcactgtcactagtcaggctgcacactggggagaagtgactctcgcaaccctcggataacggtcgttctttcagagttgatatcacactaaacagcccctttcctgggtaaagactcaacgtttctcgcctggaaaagtatttagaagtgcatttgaagttccggcgggcatgatcaaacgtttcatgcattttgctgagcccatgtctgcggaagcgcagggtggcaaaaccgggagacagatgtgacgcgtggcctaccataaatgcggcagtatctatgtgcatctaatggcaaggtacctcgctttgttccctctctaaacgccacactttatcttcattcgaagttactgtccagcgactttccgagtcaggtgtgtagaaatctcattcgaactgaaggcatgtgtctcgtctgtgcggagcgttggcctgccacacagaaactccatagcttttcgcaggtctcgcgtccggtcattatcttgctccgatatgaagagaataaaccactcgtgtacttttgcgcttgaaacagcactggtctccttcatttccgcattctcaatccagaaactgccaatgtcggtgttcctttctcaacagcggtcgacgcgggacccgagcatatcgcagaaagcgccgagtcccgcgtacaactgaaatgaggaaacagcggatggcgaaagcgcggcacagaaacgtactggattcgctacgttagagcgtactgtcttctgtccaagcaactggaggatggtaatgacttaccactcgagaaaccagcagaggtgcgggcgttccgcgggagggatccctacgacacgcgcttcgtcttctaagacattccacctttctgccttgacagaa

SEQ ID NO: 2972 - DNA, 2376 bp, Toxoplasma gondii
acaaaaggagaacaattttgcacaaaaacgcacaggcggcaccagcagacgccgagtgtttaatgtggtaaacagtgaacctgaaaatgcgactacttgctcaacagttggtgacagtgaagaaacacggcacacctctctctcatatgtttttaatcttgccaggcagttggcacgcgcacgggcttccacatcgccgtgaacacagcaccaggaccaagtgcatcaaccagtggcacaccatgctaattcatttctggcaacgacgtgtttgcttcgcgctagtgcctaatctcatcgctggcattgaacgcagtggtctatcaccgtggcttacgatacctttgccaatactctggaatagcttccgcgacccattaaaccaaagcaaatcatttttacattcttacgacacgtacctggtgcttgactacccgtttgcaacgggttgagaaaaaagactggctgatgtcctgggctgacacaagctaatatgccaaccgcatcaactgttagctccacgttcttggggatggccaaagacgttggagggacggaaattagaatgggctgaaatttccagctaggataatggagcggtgcgaaatggtacgcagtaggaccttcatcatcttcatccacagacaacagctggacaaagctgtacacagcttctaaaaaacgaccagacaaaacagaagacccaagtagtaacggttagtggtgaacggcagcttctgatcacagcgaaagaaacgtgcacctatcctttgtacacagaaaccaagatgtgtcgaaacatccaattgctcctctattggcactgtaaaaacaaaataatattacagactcgtcttactactaaagtccgtatgctccactaaaacgaaggcccccacagtcctgacgaatgtagaaactcgacaacagagatagcgcgaactctggactcaaccacgcatacgcgtagttggtgagagaatcaaagccttatcccagtcctcaggcacctttaccctgtcccaaataagcactgctgatctctcatctctcagacgagttctctgcgtgatttgaacaacgcagacggcaccgccgtccacccgtaaacagcacgctgtcgcacgaacctatcagtcacatcacttaccggcagcacaaatcccgcaatcgataaaggtcccctgcgcgctcgtcaggacaacctgctccgctgtttgaagaacgtagccttgagcattcagataatgctcataagcttcgacagtcttggtatcaaacatatcgtacaccgacgggatacgcgcctgatttctgaacgccgtgtcaacactcccgtgatgcctgtctatacccatttgtgaaagagcctctctggttgtgaaaacaatttcatatgctgctgagggcgcaatgccgtgccacgtgggatcgcaccgcacgtcgtctgtagaggtggtaacaatgccattgtcgttctcccccttgatgactgttgatccttcctttttttctacatgctcgcgcagccttgcctgcccacgttccgctcctggtgagatggaatctacaccatatacaacggcttcgtggaaaagaattacagacagaacagcgtaaattgctcgatgtttcagcgatttgagaggtttcattatgagtggcagggttcttcaagcgacgaaaaccgaccccgactcgggtatgtcgccaaacgaaaaatatgcaaacttcggatccagctgaggcttccaaactgcattatcatgggacgtgcttctatacatctgttttaatcccgactaccccttccagccactcggacagtttgcaactcacacggcaagacggactcctctaacggggcttttccattatctcgataagtcttcgacaacccttatcttttgttctcagtgggcacagactgcagttttgctgctgcgagactgcccacccaacttttgaattgagacgagacgcgtgcgatgccgtatctcagccctcggaggattgaaaattgtcagttcccgttccctcaagcttatacggtgaagctacacgaaacgctatttgtcccaatgaacgggtgcttggcaaactcgttgtttcgcatgcaggagcacccggtttgtgtgtttaccatgtgcagcggaatgccacgtaaaagtgagtgaccacactgagtgtatgcaggctgacacaagttcgtcggttttcacgagacacgcaaaggcgcaattcgacttctggacccgccagagctttttcaacattgcttatgtcatgttgctcaagactgcggagcggacggtcacggtcagcccttaactaaggggaaaaatgaagcacctcgaagctagccgtgatgaggca

SEQ ID NO: 2973 - DNA, 4335 bp, Toxoplasma gondii
ccgattaaacgccgttgctcctcgagtgctctctctttgtctctttttccgtccccttcggcctctcttctctggtcagagcgtgaaggaatttcgtggagggtgttcccttgcaaattgaaagttgcgcttttgccttccttgtgccttgccgcggctgcgggtcgctcgcgctcttcatccccgagtttccccagcttcgcgccgtgtcggaaacgcgaagtagcaggaggtttcgcgacgccttttccatcacctggctggtgagaaagaacagggaaatgccggatctcttgagagctgcctctcgagtttggcgcagcctcctgttcttgcgactccgggaggggatgcgaaatgacagacgcagaagagaaactctccggatccaagtgaatcacgtctctcgaagtctgccactcgcgagaaacagcctcttttctgccctccatttggcgccaagcgagcgttggatggaccttctaggaaaaacgcaacggacgacacccgaagcaagagccgctgcgccgacaacactcagaaattcatgctgcccctgtctgtgcactgactgcctacagtttcacaccgaatttagatacgcgaacgaaagagacggatgtaaagaccattcgcaatggaaaagcggttgctgcttttggagacgaacgcaacgcactagatctcgaaatgtcagaagcaagaataccaacgcggtcggggcattctgcgatccctgcacaggcctgctgcgtggcctccagtcacgcaaggggcaaagctgaaacgagaaatccaactccgtgactgatgaacttttccgccaaggcacttttcactaaggcacaaaattcggctttcaaaggtttcaccaataaaggcgcgatcgagtaaggcgggggaagccattgaccgagaatgtctgacgtgcgtcacgcggggaaaaatgccaatgaatccgcatggagtacactgcagcaccttttgctgtggaaatctgttgtcagaaagctcgaaaacgggaaaaaggaacgaaacaatctgttcttaacctgggccttctggcgcctttgagtggcatggagcaagcgagagctacaacgaaaaacgcgtttgaaagcgagacttcttgacggatggtcctttgactcttggaaactcgagaccttctgggcaaaatcataatcgaagatcgcgactcatcaggcggtttcatgaatcggaaaccgggagaaaaactttaacggggctgtggtaagctagaaccgaacgcacgcgatatgtccatgaggagcttcagatggaaagctggttatcacagcagcggatcgcatgcgagacaaaggcattaaaagaggcgtagggctgcggaaaagccgtccagtgattcggtcgtctcttgctgtcgaaaactggctgagctcgcgacggcactctgcatgtttgtcgtgcatgcgacttcgaagtcagcatgcttgattttttcctaggccccggatggctggcggcaactgtctcgaataatgtctactgtcactctagaaaaagcgggtattgaagttagtgccgaagtgttttttccctccaagtctctctatgtactgcgacagcgtccggaaggctgcttctgtgaagcttccggataaatttgaacgctctcacacagcaccgacatgaccacaagctgctgggtacgtaattaacaagccaacggagcaaagggtacgcgtagaggaaacgtgaaacgtatcggccggcatcgaagaggaaagaaatgaatcagtaggcacagtttgacgagcaatcgttgtcctcactgctacacagttgcaacaggtatttgatgcccggagacagcacgttgtcgaggaattggaatgcacgtagatacagcgcaaattccgaatgcacatgtctgccattgcatcacgcatctgctcgaaacctaaagtagggtgcatagataatcttcagctgtgtctattctcttgtatgtggttgaggacggatgaatgctctgccggacgttattaacaccgttcatcgagtgctagaggcatgtatggatgctgccagatgtctgagagaaacactcctttccgctgcgtacatcggaactctggaagtatgaaaagagccgcacaccttccaacaggggcacgaagtcctctcaccgcaatgaaacacgacaactgaaccaccccggtccttgacaaccgttcggtttggttcagtgaatgatgctcccgcttgtggctgctggatgtttcccgattaccccttgataaatgaagcaaacttatctcattgttcaagaaatcactccagttccctttgttccagacacagttgtagctagtgtcacaatgccgctgtcgtactaggtgaatattttcagtccgcaaaagcagtaccgcgttcgtcacccacagtttcagtatgtggctttgcacggcattgaccccattctagcggcaaacaaggcattagctcatgtagcccgcggcccgtttgtttttcgtatttcgtgcggcccagcggcccaggtatcgggtaagaacagatctaatctacatgatctacagatcctcggcagacaggtgtcagcaacacgaaacaagtaacgcttgaaaagatgtctctcaaagcctcccttagctgacagaaagtcgcgaagacgcatgagtgggtggagcaaaaatattggagaactcgtacctgttctacacattacaacgggacggggttcgaaccccgttgtcagctaaccacctgtcgccatttttcccatagcaggtccgtacctccgggaaggctttctggtggaagatgtattgttgcaagggtgggagacatcccttcagctctagaaaagccacttttccgtttttcgccttttcctgagcgctacggacacacaattgctaggcagtgacgtggctgcagatcctctgcggacaagcagccaagcgcttcccagagttaccagccactaatggtgagcttttcatagttgcggaagtgcagaacaagaaatcagtttccaccatgtcgtagaaagcctttctatttctccttgaggggccccgataaatgcgcatgcagccaatgcgaaaagcctctgtgccgccaaacaccagtctccgtctccaggcgccccatctcccaaccaatatttgtcttggtcgccctttagacattcagcactaactgcaacagccgctacttggttttgctgtaacctaatcttgcttcgccagtttacactgcctgggctcttgctagtggcagccgtaagctcgttacacatgtcctgcacgttgatttcctcgctcatccatccttgttttgtgactgattgcctacccatcgccaacagcagactgtgggctgagagttatattatgccgaggcgatatgtttctggatagtgggtgtgcacacacttggttatcattcaagatgcatcccttgtgtgtttttccaccaagcaggaatctcagtgctcttggagtgttgtaggtgttcttcatgatacttgcatcacttgtgagccgtgcctatgtacgaaatagacatagctgcctgtcaatgcaaaaacccctcttcatgtgtcttggcagaagttaattacctcatttacagctgcggacagagctggggcatatgctcggcacctgcagttccttcttgattgggtgtagaaatttttctccctagtgtctggttgaggcaaccacgtattagggccacttatctggctggtaactgctagccttgtcccctcgcttgctcggggggccgagtaccgatgacttttgtgaagctggaagcctctctcggtagtacaatcttccggaccgctccacgtattttgggtttgttaacgtaggtgccatgccaccgacaaagcccctttcaagcaaaagtcagtcaccatgggagacccttctcccgtcgggcaggccgtcagacgcagctccgccgatttgcgctcttcgggtcatcctttgcaagaaacgaccgaaggagaaacaagagaagcaactgctaagcagcggtctcccacctctaggccgacagcgtcttttactggccgaggacggaatacatcaagcattaaatgggccggagagcagggatgcgcagcccgagtcaggaaggctcgggtgaagagatccgcggcatcttccggtagaagcgacccgggaactcgtggaaagttcctttctcctgctgccagagacaggcacgtttattccaatctctcattctctctcggtaatcaaaccgagtctcttattagcggtggtactgcaaccgtggtcaaaagca

SEQ ID NO: 2974 - DNA, 1886 bp, Toxoplasma gondii
ctgtcttgagcagtcctgttttagctcactcctcgactcgaaattcatatatatagatatatagatatatacatacatatatatgcactgtctacgtatgaattgatagagatacacatgaagtatacgggggaaattttgcccaagtattcatagatagagaaaagcgaaggaaaatatagctagatatatatacgtatatacatatatatatatatatatatggaaatgccaatgtgtgtttgtggcgcattttctctcttgccgtttgatagatttccaaagtgtttaaggtggaaatcagtttctgttgtgaagagaaatgtctttctttctcgagtgcctcaaggtttttaaggcgctactttcagcttccggacggttcgacaacgatgccggctgccggcgaaatcgagacgcagaagtccagttcgccgaccagaagcagtgcgaagaaatgcgaatgtgaaggagcgacagacgaggcagattcgctccagtcactcgcgacacagggagctcgcatctcctcgactgtctgtccagcttggagaaagcgcagaagagacgcgacgtcaatccagagagaaagagagcgcaggagagagggagacgcagcggagaagaagaagaggagagagtcgaagaacagagaggaagagacacttgcaggtcggggaggaacagagagagagacagaagaacggagagagacagaagaacggagagagacagaagaacggagagagacagaagaacggagagagacagaagaacggagagagacagaagaacggagagagacagaagaacggagagagacagaagaacggagagagacagaagaacggagagagacagaagaacggagacaaggaagagggagagagtagagaagaagcggtggcactcagtacctttgcaagcttggttctcgaagacatgctttcgtcgtttcttgactctcacctgaaaactggtcgtcaaccttctttttctcgtcaaaaaatgcgttcgtgtttgggccggagttaaaaatatgtgcatgcgagcgcatgcatgtttcgcggaccgcaaacgagcgacgcgccagagtggttttctgggcctctggacgactgaaaaatggcgccgaagagctctgagtccgcaaatgaaatcttttgtccagtccagaaaggcattcgcgaaaaacgcgacttttcgctccacggaactgtgtcatccacgagtccccggagcacgagcgctgccagctgcgattccaagttgagtgaaccgcgttgaactgcagctccagctctgcctcagagactcccgcagatcctttctatacccagtcctccagtttttgtaaacggaactgtctcttcgcctgcctctatcccccatctctgctgcatgtgcatatggactagcgcgctcaggtacacctacatgcgtctgtactcaactatctatgcttgtgcatctgtaaatctttttttttatcaatttgtacatctgttgtgaccgaattgctttgtgacatgggtgtgtctcggtagcggcttgtatttgtgcgatgaaggagacaggcttgctttgtctgttccctcttttttccgtttttcaactcacaaccgttcttttcttctctgaacttcacctctctcgctctcctcttttcttttttattcgtcgcgtctgttcttcgccgcctctctcgcgccgagcttctgttggcttttgcatgcagcgacaagtaggaaaaaaatctggagggcgagacgtttccggagacgcgcttcagaaagaaacgctctcgaaaaagaaggcgtctgcacatcttaaacaatgacttgacaagcatttttccgaaaggtggaacagacgctccccgagga

SEQ ID NO: 2975 - DNA, 1040 bp, Toxoplasma gondii
cacatgccacgatctggacctcccttccactacaccggaaagagccaatgctcctcgacaaatacgcatatacatatatacatatatataaatatatatatatatacctaaatgcatgaatagcgatacctaaatgcatgaatttattcatataaatgaataaatatgtgaatatgcatgtggctacatacaggcatacgtatatatatatatatatatatatatatatttgtatgcaagtggaaagatgtgactgcagatatgtataagaattagtatacatgcgcataaatgactgcatatagatgcattatgcatatgtttgatgcatgcaaatgttcggttgaaaacggcctcctgccagcgaaatgttgcccgttgggcttttcgctttccacctgtgaagattcacgaaggactgttctgagcatttgcaagtacagaggccttcagacgcttggtggaaagcctttctcgcgagagaaacaaacagagtcgaaggagctgctcgagagacttcatcgatgtttaacggagacaagacgaatttccaaggctcagcggaagacacaccgttaggggagagggtcggagtcgccattgctgcgatttctctcgagaagagggggggaatcggagaggaaacggcgagaagaaggagaaagaggagtgagcaacgtctgccagagtggagagggtcctcttggaaggtccgcgagattcgctcgtagagaagccgcgcgaagcgactgaagaagaggagagccaaaggctctcgtgagagggttgtgttctgaagaagacgaagaccggcaaggaatctttctgtcctttaccatggcacagtgtcttcacggcgaaacggcagagtggacgagggagcgcttttcgagtctcttcgcggttcgctcttgcgcgccttcgagactcgctgcaaaacgaaggaacactgaggaacaaagaagagcaggagacgaaagagaagatacggagacgaagccggaaagaaagacgacgcagcaggagaagacggtcacgca

SEQ ID NO: 2976 - DNA, 4320 bp, Toxoplasma gondii
gtgctagatgttctgtcgttctcggcccagttggccaacgtttttctcctcgcgtgtgacttaggttgccaggtctgcttgccttttgggattagagaagtgccaagaaaaacatattttgtctggaggcctcgatgctcaatcgaggcgaacaggttccattccaggagtctcgctcgtggtttcaggtatcacttgcgtcttgcttttcagccttcccgttgcttgcgcctcagtacacgtcggcgagagcttgctagccaccagtcaacctttttgaaacaaataccaaatctttggatatttatgcgacactgaatgcattggattttcccgtataatccaatgttaacttcaccgtaaacaatcctgattcagttagactcgagtttgacggaaaacagccgtatcccagttgtgtttgcatcgtgtttgccaggctgtgaggtacaaaagccatcttttcgagcgcctgtacccatggagtcgtttcgctggggtcagcaaaacctttggctgccctgcggccttcgctgcggccgccaggcaagcggcgggaagttccgcagcagaacaggctgctgaggcaggcgttgaggaactcgcgtccatggagaagtttgcgcagggaggggacaacgtgtccgtcccagccgagtgggaaagcgagagttctacagagccggcagaggctgcgagaaaagtgtatgtgacagaagctgctgaacgtcagactcctcagctggagcttatctacgctttcgacgaggacttggtaagtcttgagtgactatgcttcgatagaatgcaaggtttcaaaggtccactacactggagtgcttgaccacggcgttatctaaaatgtcccgcttacgggaaatcaaatcttctcgtaccactaggaagtgttgtatgtaatgcgtgactgatatctgaatttcaaacgggggcaatttgagtgttcgatcacccctaatttgcgctttgagttgggttctgagtttccaaactggtgatcattaactgaatcgtgagggttccgcgaacaggaagaatgacggctgctttgggcgtcttgatgcatgctgcagattcgtattcatccttgctttggctacctcgccgtgggtgtggacgacgttccgagagcagtggcgacctttcaggtcaatgcaccgaagcgtaaaccgaagaaattacggaaaaacaacggtgatgatgatgacgatgacgatgacgaagttgatgacgatgacgaagtggatgccacaggggagacaacaacagcgggatgcagcgctggctctggaggcagctgtgatagggcaaccagtcagagttcgacagagaccgaatgttccgcaagccatcaagcagaggcgattgccgcagctttcaggggaaagttggaagaaaccgggctgtcgctggatcgagccatggtcgaagatagagacgggtatcccattttgctgatgagcatgcgccgtgctcagcagtattacgccgacctccacagtagtcttcgtcaacaccgcgccgctttgacggagggcacaggccagcatgagtaggcgcgtttgtggtcgtgaattcgattccagcgtaactactattgtgtaaatgcaaatccaggtcgagctgacagcaaaacgcacactgcacagcgacaaactgtgtggcatttttagctcccgtgcagcatgaggtccactttcatacatcttaattagttttgaggacactcgtgctctggaactaagaaacgtgcagagccccacgctcggtctgaattatgcatgacaggaacggcagtatctttgaaactgcttacctaggtgacgcgagcgggcctccatgcagcctccggcataaaactggaatcccacggtgttccgccttcattttggggccttaaagttgtcgttcgaattggaaatcacccggaggaacagggatgagcaaagaggtcgcatgaaattgtttgacctctgtagtttctacgtgctgtggcgttgccctggtcactggcaggtattttcggttatcagtggggaaatcgagcggtgcttcgaatgaatttgcgctcctggactgccatccgaatttttgtggatgagacactacaggtgaaattctgtgcatgaggcaatacacattgtaaaatactgatggcaatcgggaatccacagcaggcagtgcccctttttaagggatattttgagttgatgatgtgggctttgaaaatggaagcctgaaaacagaggcaatcagcaagttcggagctatcctgcgaacctcgaagtggtggaggctacagttgtacgattgcgctatagcgccgtgaggaactgcacgaatgcttgttcctcttgatttgtgcaaaaatgcactgagcctcgaaacatgaatcattgttttgaccggtacagaagaaaactttctggaaataactctgtcacggcaacacctcggctgagcaccgtaagcaggctgtttatcttctctcaactacgatgaggccgtattgcttgcagctttcagcatggttggagaatgctacaagcctaatctagacaatgccatgccgctcacgaagcaaccggataagacaaaatcatttctcaaacgcttttttgatgtaacgctataacagttcacctggcttgcaccgacgaatgccaataggcgtctcgtgacggtgactaggaacggtttcggcatttaagtccatgtaaacagaaagataacgtgggggccaagcggaaccaaatattgctaatttgatccgtttaataaagcaacttcttttgttgactagtggctcaaattgcgttagaagacggacgcggcgtgcgtgcgtggtcctgacggaaacactgtgtggcactccaccttcgctaatcctcttgaggggggttatgccgcagacgagcgaaaagccacatttcttctttacaacgaaagataccaaattagtgtcagccttatagaataaggtaatctactctgctcgtcggtgaatctggttccccatcacgtcaaccaccagtggcgaccttgtacccagtaccatcaccgacggctaggggggggttgggagggggtggacatctacttgcactccaaaaagccgggacaccatcttggtaataactcttgaagatgttaccatctgaacaccgacacgcgaacactcttggaagttgaagcttttttccttggcgcgtaaagttgacagcttctgccagagctgttcttgtgtgcagtgggctcgttgtcgcctcgcaggtcgttagcagctgactgagcggctggctgctgcagtggcttgattcttttaggcctcactggccagccccacaacagatatttcctttctaaacgtaaaccacgtcactctcgtgtatatcaaatctatgtttcaaaggtattctgcagttttaatctgtcagccttctggatgacatgacctcccctggaagcctgtcttctgggagaatactcatcaaggactgttgtcaggcgtctggtaaatctgctcccttttcagcgttctagtaataaagaatttaaagtcttttattatgcattttgggcgctaaccatgtcagtgtgcgctggcctaagcgacacagaaaagaccggcgctttgcatgcagccgacacacacagtccacaggtggctgcgtgaagagccgcgctagcctaagttacggccggcgtgaagccgggagctttactgcctccttttggagacgagtcttttctcgccctttctcgacgttccggcgacttgcaggcatgacttatcgcagtgtttaaggtcgtccgccgtggtcctcttcgcgctagctactgtatcccctggaattgaaccctagtgcactgtttcctcgctttctttgagcctacgaaagatgtctcgtatacccttgtaacgatcgccgctatcaagatactgatctcgactactccacctattttaaggattaacccgtgggagcttctgtgtcgccggcccttcgggacggtctttgcacatcggtggcccatgtccgtggtatagtatcgtgaatttcggtcttagaaggggaagcggaatgcgtcctgctcgaaattcgatccgtctctggtgtcgaatcctgtgagatttccttactacaacatagttgtgaggcggaaacacacggcgggacgtatatgcagtgagcgtacactcgaggtaacgctgtggctctatctcgactgcatagccctgccactcgcattgagaatgcttcatgcaatagaagcatttggacgcactcgtgggaacga

SEQ ID NO: 2977 - DNA, 2284 bp, Toxoplasma gondii
atccacatggtttgcttcagtggaagaatggtcaccgatttctgccggaggcacagtaccccaatcgactgaaagcatggacgagctttgagacctgatttcggctggggaaacgaacttcttttctagaggggaaccttaagagacctacggctgctacctcgcatttctactctgttgtatgcgcatagacagccttcttttccgacagagaactcttcgccattgtgactggagaagaagctcggagacaagggcaacggcgtgtgtctccctcgaagtcggtctcgtccccaacgggtcaccacacaggctgtttcagtgcatctcatggacctgtgcatctttctgtctcctgtctatttcttttctgctttcttcctgcacctctggtctcactttgtcggtttctcggttctctgtgtacagtcgaggagttctgtttctcagaaaccgtgtgacgaagtgtagcctcggatttcctttcttttgccttccttttctttgtcccaatcacccggatacgaaggcgctcttcactgagagaaccattcgcgaaacgagtcagcaaactcagctcggcaaagaagctcggaggccttcaaagacgcgggaagacttggcggcgcagtgtgtgtgtcagaggcaaggccttctacgcttcaggattggtctgcgatggcggggcgccaggaatcaaagggtcgtgaatgccctcgctctttttctttcttctcaatggtttatctcgctgacctctctgtttctttcctcttttcttctttgtctttattttcttctcttctgccttgtgtgccttccaattccctctcttttcctttcctttctttctcttgccttgtccttccttctctttctttctcttccctttccgcattcgcttccccagaactaaggcttccctttggcggagttctctctcagtcgctgacgactgcagccccgcacgagcctctcccttctctcttgcggcctgacagccaatcgcgttctcacagtctctctctctgtctggcgaagaacagaaacaggagcttgctctctggaactgccaggcatcccgcttgaagacagagaaagcgaggaagaagacgacacacgggggacagaggagcgtacaagcagagaagaaagagaaaagaaggagaaaagaagaagccaagagagatgaaacagagaagaaaaagcagagagagatgaagcagagaagaaagggagaagaaaaagaagagagatgagaaggagagatgagaaggagagatgaaaaagaaaagagatatgagaaagaaaagagatatgagaaagagagaagaaatggagaagaaggagagatgaacaagacatgaaaacgagaagaaagagaagatcttttttctcgttttggggtaacgaccttgagagtgcaggcgccagtgtctcgcagttcaccgtgcatttgtctggcgagaggagagcatcacacgcaccgagcacagattttcttgtgcgttctttcatgatttctcctgtttttttttggagagtctggaacagcgtcgtcaccggcaaagaaagatttctcgccttctttctgctcgcggcgaaaccgcttctccctgccggccgtggtgttcctcctcgccagccagcgaaaacgcgcaagagctgcggtgacgaaccgatgacatcacatgcaacttgcaggcagacaagaacggcgaagcggccggctcagcatcggacagggaaatgtcttctccttttttttcgccgcttttttgaccgccgccttccacgctgtcgcacactctggaaaaggtctccgcgatcgccagttcgggatctactgtcggcgctttcttttttctcctgcgtgtagacacctcgacagactattcaaacagccatgcgcaaagctctccctttttagcatccagcttcttcctctttctccgttccgcctcctgcaaaacaacgccggagcgcctcgccttcgtctttctgcgcgacgaccgctgaagtcgctctctgaacgcgtcaaaatctcgacagcctcggtggacttcggcgccgccccgtgccaacgtttctctcgcatgacaagtccgtgcgtcaaagaagtcacgaactcgacggtgaggagccgcgctcgcctgccaagcctctccctcttctgcagtccactccacagggaatagacagcaaacgccttcttcgaggctatctgcagacaagcttcttcttctgcttgtctgatttcttctcccctccttcttcgccacaa

SEQ ID NO: 2978 - DNA, 3084 bp, Toxoplasma gondii
gtgtgacactctcgcgactttttagggccatggaatgcatagctgtctagccacacattcactagtcaattgcaggtatttgagcaaaggcagagatattctatgcaggatctgctgcgaggcaccgactccaccgtgctggtttttctgggtcaaatcgccgcggcagagatcggaagatacaacggcgtctctctctctctgagagttgaactaaaagcagttctgtacagcggcagacttggtcgagaaaaacacggttgtcacggatgctgtttgtgcagcacgcactccctgggcagctgtccagatgactagtcacgtgtcagtgcctccgcggtggtccagcacctggtgaggcaggaaacaaaaggcgagatctgcgcagagcttcttgcattcacaaagcgttcacttgtctaatcagtctgcgaactgcaagacgaaactccagaaagtctcgaaacatgacctgtgccgggcgcgcctctacactcgcagaaatcggcgattcgcggcaaaggctcacgcccagaagtcacacgtttttgcagccgagtgagatggcgaggaaagcacgtggagattcaatcaagagtgatgggcctgtacgcgagcactgagatgggggatcacgtcgtccacagagagatggtcacaacaaaagcgcttgttggcttccactcagcgtttgctcccggatgaaacagcatccccgccgcggaacttttagaaaaacccaggtcagacctctcagttgtttgcagaactctagctccacgtgtacagtctccgcctcatgtggtgtgaaagtctgaatagggaaccagctgtctccagatgttcttctccgggaccggagagcagttttgagtctggcaacacgaacgacagaagagtttccaagaagacaacttctctttagctaagtggaaacggtttctcattccctgagagaatccccagggtttccaacttcaacacgaatttttctcccaacacgagaacgtctcctgtagttcctcacgcgtttgtatgtgataggaggggcgcaagacactgaggcggatgcgctatgaaagcaagtgcagagatcggtggaccccgtcctttactttccggtttgagcatccatttgtctgcactcacttcccctccctcgccgtcaggatgacctcaaaggcccgagaagccatgtggtcggagcggagaacgggacaccagactgattttggctgaagagtatatacaagttgattctatagaaattaccgctgccgaactggaaactccagtcgaggatacacgccctacacctgccgtatccagtgaccattcgcgtaagtggttccattcaagtaaatggtaccgggggtgttgtctgcggtaaaccgcgttgttacgagagtgacgtttgccagtgaaccgagcctctgtttgatgccttctgtatgggacccgtgaacaggaaacggtggtgttcgttgtcgcagaaacaacggtgtttcgtggttaaactacagtggtcgtaaacggataaaagcgaatatcggtggctgccaacaacatactgcaggagtcacacactttgtgtttgcatgcactttgacgaaaccgcaacgcatccatcagccgaaaagcaggggaaggtaagcggcgactctacttctagcagcgaaaacgctttgactcaatcccgtcgaacaggtgtttcgtttcacgcacggggactggagaagatctgctcgcgtgtatcaaacagggagttccgcgcctggagggcgaagatatgctccggggaacgtgcaagcgaagcattcgaggaaaaaagagacggctacaagtctttacagaaatctgacccggaaactgatgtttctgcatcacgcctgcgccaaaagtgacctgccagcccggcgccggggtgtaggtacactgccgcgacagccgactagcgagcaactcgcagcttccacttttcagacaacgtgagttccccgtcaaatcacgacaagcttttcgtgtagacgatcggcagacagcgatgtctttctacgcagagtctcagcgggaattaagcagaccggacgccgtcgaccggcagcgttctgtgaaagctgcggtggtaatactttttccacgtcaacaaaaatgtgggtctgggcggcttaagttgtgtgcagctcccttctctcaggaagccagaggaaaagcgttgggtcaagcacagaacgacgtggaaaggcgtttcaaaagtgtcttgactgagtgggcatcgaggcttcagccgacagccggtagaagcacgcgttgtgcatgcatgctcctggccgcctaagagcaacgttcacgggaagttcccaagtctgggagcaaacagtttcgctatttcttgtgatttcctcctcaccttttcagcgcttgtgttgtggagcatccctctgtcgggagctctgcctgaaacgcccagcttctgttcgccaagcgctgcggtaccgactcaccgaccgacttctcctccggtggacgtcgtctccctcttttcttttgaacgtttttgtctttagagaacctggcaaaaactctctggagacttgcgaggacaaaagctctttcgactcttgcgctgacacgccacaagatacttgtggctctcgacatggatcgtcactacgagcgagtctggtcccttgttttcagttctgtgtcttttgcgacaaagatttcctcatcccctctgtctgaactctcccgcaacacccgaaaatttctccgcagaagacacattgcctgactgtgcacgtgggggctgaaagccgacagccgccgtgtgttggcggaaagaagaaagggcgagagacacatcgccgggaccattgcagaaagccgccactctcgggaaactgtttcatctttgatggatttccagaagggtgtcttacgcagagaagagaactttttatcagcagccaccatggggacacggagcgtcctgtgtcttctgcaaagctgaaaagtcgagcccgttttaagttcctgtccaaagctccttcaaggtgtctgctacttctctcgaggccacga

SEQ ID NO: 2979 - DNA, 1847 bp, Toxoplasma gondii
accggcagaagtgacgcgtgccacatttttcgtttgattacataagctttttctgggggcacctccgtccgcgccggcatttccgatcaattcctggcgggccgctgagggttcgagaattagtgggtagaaaagcaacggaacgaagagctacctttccctggcttgcgcttcgagttgaaataaatagtattggctttcgtatgtgaggatttaatgcgtttggcacactggttacacggattcctagagtttttcgtctcctgactccggtggacgttctatttggattagcacgagctaagtgaagcgcgaacattcacacgcttcgacaacttggtgatgcaccttctgtggcgtcttgctgcgctaactatctgtccaggaacgaaccgtttctctactctttcagttccattctgagtttacgtttctgtttaagctgcacctggtagacttcaagagttgactgaatgcggcgtagggctaccggggttgatatagtgaccaggcggcacccatgacagaggttctttctttctaggaagcagccgcttcgaaaaagactctccgtggatttccaggggtttcttgtgagacttttactgtagattttttacttgaggcgccgtgcaacattcaaaaccactcccgcgcgaggcacaggcaagatacatacatctcgcggagtttcacgatccacgccacaacacgatgctcagttccactacagaagtgtcgccttcttccgttctgtcttctgtcatttcggccagtagatgtttttcagtccgtgaagcctccggggagggaagggcattcgagacgaagtgtgaggagagccgtataggacgctcggtgaaaggtggtgcgctcaagaactgagattttgatgtacagtgattaattgtttccacctgttcctcaaagttgttactcgctatgctctgacgtataacaaacataacggaaaattgtaaacgtatagagatgtaaatatatatatcaacatatgtacacgtataaagatatacatatgcgtgcagttcacatgcatgtgcatgtagtcattcgcaggcgcgatggggacacacacaactgcaaataacaacctttagttcagttcatgaaagccacgactgcaaccaacaataacggttttttggtgagtgacgcaggttcatcaccttttattagggctacaggcgtgaacccattcgaaaacgaccctgtgacagagcgcccgaagagcggctatcttttcctcggcagaatctatctgtcgttgtacgtgcagagcggacacgaggtttagcggttcttgtggtcttgcatgaatccactttcaagtgtttcgtctcttgtcttttcttctttcgccagacatgcacattctagcggaatttcgtggtttcatagtctctgacctgcatcggcgagacattcaaatgtgcatgcccccaattgcatcgccggccgttctcaaaacgcatcgaaatttccatctgtctacatcgtttttctcctcttttgtcattttcctagtcttcacactcgccgttttctccttttctacttatcttctgtagaaagttctctacgcccgtcttccccgtgcttctcaacgtctgcaaatcgacatcctgcgcgtgtgtcgacgttttccgcgcagcagatcgccgcacttttttccttctccgtcagtgccgctattccactcttacattgtcccccatatcaaccatctttatttgattccctttgctcgtttcgtttttgttggttcccttttttcacccgcactgtcccatgttctctgtcccgtttgtcgcgctttgacgccgcga

SEQ ID NO: 2980 - DNA, 4003 bp, Toxoplasma gondii
aagttattcctttctgggagtgtagaactgcttccaccgcactcgcgtgcggagtgctggtgctcgcggtacctctggttccgaggcgatgggtcactaatgggcttgctctgttcaggagccgaagcagagtcctctgaagctcctaagttcgtattatgagcgaaaatgttgacaagagctttttctgaccccccggcgctatctgggaacgatacgttcgcagatgggacgttctcatcggggcgtcgaggggaagacaccgacgaagcagcttcgagcagcgttcgaggtggagagcatccggaaagaggagagttctccgagggagaaaggctttctgtttcagcgcggtcatcaaacagtcgacaatcgacggctgattcagaatgtgcttttctgtgagcaggcgatggtgacgcagacgggtacggtgagctagagggtgaggaggaaggtgtaggagggaggaagcatggggaggggaacagatcctcgatcattgtgtcaacaaggaaatgaaggtgaggcgtgacgaaccaaagaagcagcccgcgtagacggctcactgtgcttctccctctcaggttgtccctctcttcgcctgggagccagcaagaatgcgccccgtgatatgaaaggaaaaaagtccgacacctttctctacagaaaaaacgagcttctttctgacgcaacgtgcctacgctgggtattggacagcgggagaacgtgaggagccacgaaagtgaagtggagacaaaacagcaccaagtcaggcctactcgttgatgcaggctcaccgtgggagttttacagaaagaaggatgcaatgtatcgcagtaggaagttcatgtctaggatagaagccgcgacaacggcccgtcacactgatggctcggacacagccgagcaccagcgtataaggatactcatactcacccgaaagcagtggccttccagttcactaccacggaaacggttccaaaacaaggatggaataccttcatatcgaatccagtttgcataaacaacagggaaaaatcacaaagaagaatgacaaacagaggggggaggtcgtgcgatatggtgtcgccgactgccctctacgtcgcgtgctgacgtggcgacttggtgtgccgtgcactaaaattgggagcgaagcgatcctaaggtttcttccatgttgtttgtcatcgataaaatagagaaaaggggactcgccacggtcaagacaagggagacggtccattctttccgcgagtgagcgtttctttgcgcggtgtctcggtggtaccaccacggtctacaccctcccattgaggttcccctcctgcgaatattctcaagacattcgggggtatctgtccgttaaacaacgggtactaaaaaaacagggaagctttggctcccagcgattattccatgcgagatgcagatgtttgcacgcgaactaagtcaggaaaatgcgcatattcctatgaacacacataatttcttctgatacttttcagcaaccccacctcctccccgccccctctcacgggtgactctttgcgccgtgggtggctttttacatggtgaaatcagttggctatatttgccagcggaatggaaggccccacgatgaccatgcttatctgtggtgattgggaaaacagtcgcgaagatgtgcccaagagctcgttccgtattgatggtgtgagtttgggcgtttttcagacagtcttcgcgaaggtggttgttcacgtcagagaaataccagtacgtgaatgagtaactatcataattcgacagtggtatcgcaacaagacgctgggcagcgaacgaccaggaagacctgtacaggacttgcttgaggtggttgacgaagaagcgagagacagcacaaatgctgtttcacagacaagcggccgcgtagaatctctagggaactgttcggtccgctatatcaacactaaaaggcgcctgctgtgtcttcaccagcggagaggaaaacacttgccagactgtagaggaaagcctacgactacactacttaaatgcaaagccgtcactacatgcatgcgcctcctgactctacggttgcttatataagtggaggcaatggccaacggattctcttcggaacattactactaggaagtaaatttcattccacgttctccagacaggcgtcataagcacagtttaatgcccagagcaccaaagcacatggtacgtgatactcgacacctcggcagttcatttgaccaaaccaatcaagtgtgcaaaacctggtcccaataaacgtgtataacgcccccccccccatgtgagctatgagaggtgttaaaacaaaatccatatacaaccagaaggaaggagcgacacgccattcgtgatacgtacaaggtaagcgcattctcgcgaatgcaaattcctttacattttgcgccgctgaggtgggctcatgcttatgcaggacagttgcacgcccctcgagggtcgaagaacatctgcgtgtaggcttcagtaagaaggcacaagcagtgtcacaggcgcatgcacgaaaaacagttgcggcacgatccaaggtaccagaccatgccacagcaagcgtcagggtttgcttcccatgacaggccgtgccttatgctttcggtaaaagcgttctccacaggggatgggggggactggaagcaaagtacagtccccggcttcctcgaagagagtggcgccatataactcggcagaaagaatgctgaaggcgtctggcacaatgttgtgtattactgtttaccaacctggaaaaaatccggatgtcttattgctgctgttgaacgtgcaaagccagacacgggtgcgctggtgcactacccacaggagacaggtacacgtacagctacacctacaagccacgtttcaacgaaccaccttctctgtgcacagtatgagctctcattatcagctaactaacaacgttatggcgtcgcaggctgcaggtagcactaaaataaagtggaacaagtagtggcattttttctacatcgctacatacctgccacttattgaacgtagcatgtctcgcagctgaatgaagctgtccggtttttgtctgtcccactgtaaaaagaccaagactagctcattcgaaacgaccgtatgtcgttttttactccaaatgcagttggcacagttgtaattgattacacaaacataaaactggactttcaggaattcgaacccacctttcttcgatcaaaactcacagcgaaacgcaagtgcgggtcgggatggctttgagcatgaagtgagtgtgcagatcacgaggggaaaaactcgtgcgccactcgtcgtctgatcgaattcagttccacctcttctgcatgctccaagggcgtcgaaagtgaggaactacggaaagacaaggaagcatgtcaatgattgtagcgacgttaactgtttgccatcagcagaatggcgaatcaaagcaacttcacacccagcaaaaaaaaacggcctttacagaacgagaatagtgacgccggagcaggaggcgactgcatctgattgctgtgttgctgacgttagttagacaacgagccgtcgcattgcaatatcgctactgtgcgcgtagagcaattcgaacgaggcacacttctgccggatagtgtgtctgctgactgatttttcttttttttcgacgtatggatgcgagctgagaagtcgctgatgcttgttcatattcgtgttcgactatcaagtaacgaacttcgtgggcatcgaactgacgctcaattgttaacaaacaccgtgtatttctgcggctcataagggtgtcacacaaacgcgcgaaggcataagtggaatgcatcgacctcccacttttccgtagctgaatgattatcgcttcttccagttcaggtttaagcggtacgggagcgagttgagggaggcggcagacaggagtggggcctcagatgttccagttattcctactccagtagttgattgcgctccacga

SEQ ID NO: 2981 - DNA, 2235 bp, Toxoplasma gondii
gaccactgtcacgttttcgacagttgagtccaacgtgtttacctttccgctccgttgcaatctcaaaatacagtgaactggcagccaccccggaaaaactcagtcacgcaagggagacgagaaacgtggggactgaaagctcgaaatgtcagtggcatttcccccccaactcagcgctctcgctctgctgcacaaagcaagcaggttccttatattgttctagacagtatcacagcggagaagcaccagcgcattttccttggcagttctttccgtcaacttcttttcctcttgcgaaggcgaaagcacccccaagagccaactccagtgagatcgcagagcaagtgttcgtttatcttacgtggttgcgcacaaaagcggcaagcatatcagcctgctaacaacaatatcgtggagctgctgtgcctatgccatatagtgtcacaaaggaagcagacatcatctacagaagatcgactacagcgacaggccgaacgccgatccgtccgtcgccgtcatcgagcaagtcgccagagatccgagggacctacacggactgcacctgatacagtagcaggtgtccaaggaaatgtacccgtggggtgaattctgcgcgttgatgctgagaggtgagaccttgaaaaactgcacgagcgataatgggttatctaaaatcaacagaaccatgtcaatcgctgcaagggcccaaagagaagccgtacggtgccactgaattgagcacattactagatatgagtaaaatgcgagaacgggtctgcgatatctggagtgagcacgtgactctatgtcctctgttctgtgtgaaaaaagcaagaaatcaagtatacgaagcacgcttccgacgtcttgtagagagagttaagacaaacaggttatcgatgagcggtgacagtcgagtgcacttcccactggaagacccaacgaccaggagagaaagacaagaaaattatttcttgtgagccacctggagcacaggctgacgcccctcccagtggacgctgagggcatcgtagttgtatctcgtgggcgtgcgtaacttcatataaaagttgagacaaggcaacccacatccaaaacctcctacgcatgaacgactcaggttgactgataaagccaaacacaaatgaaaggagtgactgaggtaggcggtggcctcggaggtttaatctcatccgcgccctcccagctgatgcacacgtattgctagacagaatagatgttgtatcatttcctctgcccccctcgtacctagagccgtcagcaaaaatccaactccaccgattgcattttgcatatttgagaggcctgcttatatgtgaaatccccaccataagcccttcttgcataaacacaagttcgtttctcgcgaagaaaaggaatacgccccgtctctctgcggtagtgtcgcgcttatcctgacccgctttgcaagtgtgtcagcgtgtgcggcttttgtccaaacgtgttcaccggcaatctgagtgcgctgcgggatcgccgcggcatgcaaaaaggcgggcagcctagcaacatggtctgcagtccgggcagggacagaaaaggaccgatttgtggaaggttgataacgtttcttctgcgttagcgagatcaatccagcgtaggatcgttttttctcgcagatttgtcccccctcacgctgccactggaaatcgtgacgtactgctaccagaaacgggaccgcaattttcgtcaacgcgagtgtcgaacccggcgcctgcagtgcaccacagtgtcaagtaacaaacttttcctcattcgctttaatttcgcctctgtctgtacgtttttcctgtagcgtctctgtgagttccttttccttctcgtctcggcaccttcgctggctgcgctttcctttccgctccctgttgcgtgcacatgcaaccactgggctcgcaaggagatcctccgtaccgttcttcaagtctctcgccgtcttcgtctccgtgctgcactctcttgacaagttcgacttgcttatcaacaggacgcctagtgcatgtgcctgcgtcgcagacgaggctgatctcccaggcgttgctcgagcacctgtttttctcgttaccctgcagaagcacagccggcaccaccccgtggaacgttgctttttatccggttactgagacgcttttagtttgggtggggaaccagtagagcgtcgattgttcttctctgagtctctgtctcttgccagaa

SEQ ID NO: 2982 - DNA, 2694 bp, Toxoplasma gondii
tctgtgtagtgccgcgcttttcatgcttactacttgtcattctgttaagggcgataagtcctcttctccgtttacaacaggggttgcctgttttttagtccgtcatgtgatcacatctgtgaatgacgatttttgaactcgtgaccggtgttgtttcaagttaacgcggtgtgagatcgcccaggatgtgcaccgaaagacgagcagcgtcttgcttgaagtaaaagcgaaagttgcgttgtgaagctttcacccaagcaacaatcacgcttttcggaacagtggtttgatatcttcgcatacattcacatgttgtctgctttccgcggagagcgttctagcgacgcagacagtgtcttgcgatgccgacaagtgtgtccaccttaacctgtatcaaatcacaggtatcctggtttattggcgtactgtgtgtgtaggagtatggccatgcatcatgtacatgcacttgagtacgcgcaaatttgtaccgccagtagcggtggagcggtcgatatcgggacggcgttaggggtgagtctctgtggggcacagctggctttttcctcctgctggctttcatcggaagcagagatcgagtttactaggtgacatcgagaaaagaattttgccgattcacgacaccgtgtctgagtctttttttgtagaaaaaccctagtcggaaaacagttgaaagatcgccctccaatgacgtaaacggaggcgttctccgttcctcagcaccgaatagtcactctgttgtctgtacagatccaatttttccgtcgatgcggcagaataaaacgataagatccacatgcatatatttcagtctgtagttacatgtctaactatttattcgtaacgaatataatatatatacgtgcagatgcacacatttatgttgacaaaacttcagcactggaaagtgtaacatgtgcaactggccagcctctacttccagaactgtgcgggagcttcggaacaggcagttttattacttttgacctcatggcatcaattcttgtgtgtctgctgtacgtctttgaagcgtttgtgctgaatatgactcaaaatcttcaactctgtctcaacattccttgaccttggttacgctctttccgctgcttgacaccgcatctatcgctcgatcctcgtcttcagcctgccgttgctgcaggcgtgcgattgtttccgcaattccactttttgcaacacgtcttgtgtctctctcgtcctttgacgcttctctgatttgcatccttccacgccgccctactcattgttgtttttgtcgggacctctgcactggtcgtttggcgtgcactggtcttatcaggaaaccatctctgcatgtttctcattagagtacagaaaagacacgctcctatcactctgatgccgtctgaagaaccacaacggtctcacgtgtgcgggacttccgggacttggcccttcctcgtcagttccggtgactttatcaacccagcattacacgaaagaatggtgcctttcgctttagagcacacatttagcttttcgcgaagcctttccctcttcctcgttttttgactctttcattgcgccaccgctgtccgaatatcccctttcctcaacgaggattgctggccatttttcctacgcggacaatcaacgacccagagtaaccgaagtagtagtcgaggctgctcaatagttgactcattccccgaggatgtatccagtttttgttctgtcgaaacggtaaaggcaccaaaaatggaaaaattgaaaaatgataacagactcgcatgtcgacgaggatctcagcagcggataagccgtcctttcaagtagctgcgttctgctttttctcacgtcagctacgcacgcgcatgcgtggcgtctctctgacttgggaggtcagtacggtccttgtttgcattttctctgagtttccttttggcttttcttttgaacaagtcgtgagcatgcgtctgctcactccttgcttgactctcgtcgctccacgcttctaccgccgtgttacgagttttcacgattgcgtcgtccgcgtgctgtccgcgctgctctagcgtgtgaaagcgagaacccgagccgccattttttgaaactggagaagccaactgctcattttttcgcggcctcgagaactccccgaactcttcaattcgagggttgacagtttcccccgtcctttcgtctttttgctgccgtgcggactcccgcgtcgccatccgtaccttggcgtcttgtgtctttgtccgttacccccctgactctctcgttccctattccttttctgtccgcatacttgcattttctccgcactgaaagtagcttatccctgagctgtttcgaactttcctctcttcgtcgcccctcaactgttcgtttccctgctcaccgcaattcgtccgtgtacacaaaagtcagcccgtaatcccgacgcttatgtccacgctcctgaatgcctacctacagaatgcacatctaaggacaatgcgcgaccctttcctgtaggaagagtttggccgcagcctggctagagtgtgcctgtacccttttactatcgctgttagcatcttcagagtcttacccctcagttagagttaaggagccctttgtttacaacggtttgtttgagggtccctggcgtcgctctttgtgtctttcctcactttccagacgcgatca

SEQ ID NO: 2983 - DNA, 4468 bp, Toxoplasma gondii
aactgtctccacactttgtggatcgctgcctcctcctgggtactcaacggcgtcaccgccaaccgctgtacgtacaccttggcatacagcggcagcccgtcgtgcgagacagactgcagttctcgttctcctggatctgcggacacggggaacagtatcccttgcatgcgtcccctaatcgtgtcccctgtgtgttcagaggaaaagcatcgaccgcgttctgccgccgtaaaactttgtggcgcttccccttgtgaggctgcctctccagacgggtgtcgcgaaccctgtgccgcgggcgcatgttgatttcggtgccccgaaaataccagtctctccctctgcctacctgtatttcgagggagtgatgcgagatctctctgtatagaggtgttcgagactgccgggagttcttcttcgcaggacgggaaaccaggcaagttcgctggagactgcagcagagaagaaccccctctataaggtgcgtcggaaggtgagacgcacgctggcgaagctgtaggagacgaaggtgagaacggtgtcgaagaaacgtctgcccttttaagcggagcgcccaagggacgggcggagtctgccaggaggggggacgagccacgatttgaggaggacgcagacggaggatctgaaacaactggacacggaatcactctgacgggtttcgcctgaccgcctccaagccacgtccgagaagtgaacgcgtgagagtccagactcgacgaaaaggtggcttcctcctcgtcgtgctcgagcggcgacagtttgcaggggaactgtctggaggtttccagcctctcagaacacgacgattttgaagtccactgctccaccgattcctgctctcctcgctgacgccgtccgactctgtggccagccgaaaaagcaagtccgtggtttgagcacaacagagaccagagacgtccggtaatacgcacggcgttgtgaagagattgtgatttcatttcgacagacgcaaaccagcgaagttgtgcgcgatcctacccatcattgcctttctataggtgacctgcaaaagaaaaaagggcgcggagggaaaatttgcggcaaattcccacgttctagcagagggaatttcgccgtcacagctcgacagtgccccctcggggacgggataaccgcgaactgtgcatctgaaagccttctggacagaaagaccaagtcctacaaatcggtccctctgtatttagtgacaatggaagatgctgacaaaaagtaagcgtggtacaagcggacgactctgtattgaaatgggtgagaaaacaatgtgcgcagcttgacaacgacgagacggatacacacagtctaggtttctattgaactgaaaacgttttcacgctcccagattagaaacgcgcttcggaggaaaaacatgaaagcgtgttccctccgaaaaagattcacacattggccgcaacggtacgcaaatgagttggagaaaggctctcaaccggcggcggagacagctggtggactctagacagcagagacggcgttgccacgtatttgtgttgatccgcaagtggacgtgaatcctttgaagagatttctgaacctgcctctcgcacttaccctcttctgaaaaggaaagaaatcaaggacttcaacccgagggacgaatcattccttcctgtgacagttgcggtagcatcgggatagctcgagaagtcgagcttttcgcaaatcgcatacaggacgctcctctccggctcaagttctatgtagtgtcacggcgaaagcattaacgttttatctctagaggcaagcagctggccttctccagttaatggaaaaggtgccaggcgtgtacttgagaaaatccactgaacaaacccgcctggcgttacggaacagttagcgaactgcaatagcaccggagtggcgcattgggagggctgaccaggctccgccggactacacctgagaatcctctcgagaaaaaagtggtttcgcgaaacggaggaatctccaacgtagcctactctgtcagggtgtttgggaccgcacccttttgtgaactcgaagctatgccgttcactggcaagtgtgaaaccaacgaacaggaactaccgtgattaaggtttcccaagatagcaccggctaaaacatgactgaactgtacagtcataaatatataaagactgctgccaaatccactaccgtaacaaaagtagacggacctaaggacaccgtactgattccgaactgtcgatttatgggctgcacttcgtaaactctgtacaaagctggcactgagaaacttatggcgtactggatccatagtcgcattactttagggcctgccatccctggtatgagacactgaaaccagcgacctgttgcagaactctgtttctcagaagggtggcgtcagtgtcttcgttttctcgcatcacggagttgcgaaataaccgtcaatgtgcatttggtgattccggaatgaggcgcagatatacataaagatccacacgcttctacgtataggcaagaaacaggaaacttgcatgtgtgttatagagacaacagtctccagaacgggaagggtgctggaagtcaacgcgttgcacgggcagcaggagaaacggtgagatagtgttaaagccgttgtgttagtatggttccgaagactctatttagttgtgatagtctataccgggcacatgctgtcttttctcggagagcgatagatctaaatgcatcttatgattttggttcttaaccgtgtgccctggctacgttttgccaaccggggtttgtgaagcaaaaacagcgcagttctgaatcagcagaatgaagtatgggacagagctcttggtgcgcatcactgagaagcctccatctaactctagcgctaacgtatgtttctgtgtaatgaaattgaaagagtgcccccctgggtgtaatcaccacgagcgaaggactgtatattggtacgcctactctgcaggggtaacttctacggagaaggaatgcccgatgatctttggatcagtttgaagcagcccatgccgacgctctgtatagtggccgaaatctcagtttacagctgttttattggaaacgctacgtgatgtgatgcaatgcactgtcaatcgttccagtggaaagtgtttcagagagtagatcagatgtcatgaacctcgagaataccccccggaattaagcttctgctacgagcattcttctgatgggctaacgcgttgttgagacacgaagcaaaatctatcacatacatcgttcccgtacagtgtttctaccgagcacagaacgaaaggaatttaccagacaagatgccagattattcatctcaacagaaggacaacggcacgagttgcaggaatgtacagagcgcagcgccttccttgtggtgttgttcagtacgtctcggttctggtgagcgtgttcgagaacagtgaatacctcactaactgcgttgcgcgctcgtcctcagtaaaactacagtacttattccttgatacgtcgaatctatttacactccttgctaccatgattgtaacacctaccgctttttatccagttgcccttctttcggaagaagctgcattttctccacacgtcctcgaaccaactcacaaacgaattccatgctgaaaactgctcagcgcattcatctacagagacggttgttttgtgcttcaatagcgttttacccttcgtttgttttgcgttctcaaggcagccgaggtactcgatagggtactggagaaaagaagtctataatgcgtgcagccctcacaaactcctttgtccgtatgctggacgtatacgagtcaagcattggctatggtaaatagatttagagtaaagcaaacatcccggcggtagctaaatgactagcacaccagctatgcaatcaacgagtcacgtgaactgaaagggaggtctctctttattaaccgttgcactagtcccccgagagacttactctcacctcagcgggtcacagagtcgattttacgagcgctgctatctcgacccttagtcccccgtttatttcccaacattttcgctagcagtccccgttgttttcaactgaagcccaagaacagcaggttttttgtactgttgcagttttgtccggaggcaaaacattgtgagagacagcgagaggcaggtgctgggcatgcaaacggcccccgcggccgcaggcaattttctgtttcgcgaagtcagcaaggctgccccacagaaggcgattctcggaaggagactagcagtatccgaaatttctcgtgttgtattgtccatttctccttttttcagtcaaacggagtgtcagcgaacgtggcagattctggaggtacgcacatgtctgcagtatcacacgttttcgagtgacgacggcggggctcgcccccataacgaacgctgtgtatcgcagagggtcaagaacaggactttttgtgagata

SEQ ID NO: 2984 - DNA, 4862 bp, Toxoplasma gondii
gtaacaaacgagttgctcatccgcttagcggccatgtcttcaatggccgctttttgtctccgcagtgcctccggagctgggcggtaagatactaaaatgatcaaactgactagtgagaccagcgcagctgtctcgattgatatcaagtgaggcgttcgctgcgttgcctggtgttgcgaacggcgtctgcgcactgcagtccactgtgaagactggtttttctttcctgtcgaaggcttgctctgaatcgcgtttctaagcgccgtgggcacatcactttgtgattgcgaaaactggtcttccttgtttgtcgcaggcttgctgtgattcgagttgagaagtgccagggacagatcgttttgtgcttggatttctgactcgtggagtggctcagggagggcctccgtcactccctgccatgctccgctattttcttcctcggcgcgatcgggctccgtcgcgaccttggcgtcaccgcctctagacgactctgagttgacttttggaacgtcagacagaccgtcagctacagtccacgcgggcaacggtatgctgaaagcagcgccatcataactaaaggtcaacgactgctgagctgaccctggaggagcactatttcctgtccaggatgggggaaagacgaagacagccccaaataggaagccgagcgggatggcaccaatgccgcgcattgtcgaaaagggcagtgacactcagggttggagatgcaagtaagcagaccaagtcgacacgaacagggatctgagggcaagtgctctacggtgctatggagcactgcgagttttgcgtcatttcacggggccgacgctgatctcgaaaaaaggacacagagcatatacgacacgcgaggaaaatgcagatcctggaaagcgacgtcttctggtttcggggactccggaaagtcacagcgagttcaattcacgtggcaccgcaaccgtcctcgattcacgagcccccacaatagcgacaaacatgtcgctgatactctaagaagcttgaacaacgaaggcgtttcgttttcttttgacaactcttgaggagaatgaggccgctatatgggcgtggtgaaacagaacctagaagcttctgtttcacttgacatgtccaacgactggagtcgtgtgttcaactctgaacactcccttgccatcaacaaaggagatcttcaaacataaaacggcagcacagatccctttctcatcgaagactctgtccgccagccgggaagggagactctctttgaaatatcgtcgtaatcgtgactacctcaggcactgtgtcataggggcgccccccgaatggtacttactaacgtaaaccactcacaatttcactgctgccgacccgtccaagacaatttaggcgagaaaattgtagccagcatgcacaccatgcaaagcgcacagcctgctcgagagcgttccgttgcgcacagtggacgggtggagggccaaggaagactagctacgaaactcacccggcaggtgacgaaaaagagattttggactggacggcttgacctgattgctcggaagtcgtgacgtcctggaacgttttcccttttcttgaccttttcagtctttttctgcttgcagtttatcagcttggagagacgtcacccggtgcatgcacgtgaaaagcctacacgtccccgatctaggtgtgcatcttcgtagcctttgccgtagggcaccttgcaagaacaaaaggacagaaagtagctgcagcgttcccaagaaggcaaaacataagtcgttatccaggaacggagaacttttgcatgtttcggaaccgtaccaattgagggatagccattttttgagtattcgtttgatgattataaattttcagcctaccgattggttagctggacgtcttacatgccctactgtttctggctatgctagtatccgcagaaacggtaactttctttgtacatatatctctatgggagccttttggccaacaagaattcgatctatgcattccgtgtagaccaacatcgggcaggactctaccaaagctgcaggccaccataacattagatgaaggcttgcgcttcataaagtggtcgacgttggtgctttgtgcaggtggccgcatctgttgacgttcaaccagctggatgcggcatgcttgtcagagttttcaacaagcgaatagtgcaacccagtcactgagatctgtcgctatctcagacaaagcagcaagaagttgtgcacacgatttcgctggtcacgcggtattggtggctggacaaagagctcgtctgtgcaaaccattcgagacgcagaacaaacaaactgctgtctaatgactgcagcacactatgctgggagtaggctgcaagggccgtacaagtcagaagctcaaggcatggagcaataccgagaacaatcaatgttcacccgacgaggtcactaccgcaggcgcctactgtgacaatgcatttgcttaccattgcctgaccgccgatgacttactcgtgtaaacagggttggcagtgccgtgagggcactcagcaaatccactgctgcacgaagacaaatctagcgtgacagtccgtatctccactacgactgagtgattggtgactgtgggcctgcaggacttctatggaactctcaagtgtcctgcccctgatggcacgtgagtttgacaaaactgaactgtcgagacgcatgttcctttctgcgcattttcgggagcttgttggttgtcgactgaaggaacctcttactcgcaattcctgatgtacttgagttactcaaactagtcgtttcagatatgtagagcttagattccatttcatcatgcttgcctgtttattatgcactgcctcgcaatagccgacgtcgtcagcaatgcggttcatgcggaaagtgacgcgcccgcatttctagactttagtgtttgcaggtttctttgctggagagatttaatcgaaatatgcgggggcacccttgatggggaaacacgccatcacaggcacacactgttaagtgacctgatgtgcacatcccgtatccgtctgacgaccatccgaaaaggtcttcaatgacgctggcagccggttttatggtggatggtcgagtgaagtttcactcgcgggtgttaatcactattctttagcgacagcagcaacagtgaatgctgtcgtagaaaacgggaagccagcatgtgaggatgcagtgtatccgttgagttagcacgcttccgtcccgcaagtcgccagctctgtcagctgagggcaaagagtgctcttgaccaaagtagagcaactgcattcgcgcttcaggatgcctgatgcttatgtcgctggatctgaaatgacaaaaacgtttcagaaccaaaagaactgtccagcggctcgtacctcctgtccctgcttgtgtaccttcaccgctgctgctccaagcacactcagcaaatctttggcctccgaagaagtcagaaatcgacgatcatatgcatgcccaccgcccgacacccccacttcccttttggaaaaaccgttttttcccaactgcgccgtctctcggtgaatctggtaaagtcgcaggctgcttgtttcgtctcgagccgaagtaccttcgtctcaatgtgggtgttcctggcgggaggctgtcggttaaaagattgtcgcagcaaaagaagttaatatgctgtctagaattaagcaactccttcaatacttgaacaggccaggcaaacggctatctgcaccactgcggttgtcgcaaaaaccagcgagacaaaatcgtagacatctagtgcgtattgacgaatccccttcgacggacaagttgctccgccactgcacattgccggcagtgcatcatttctatttctcgctaaatattttgagaagtcttgaaacggagtgcaatgccacgtagccttgaaaattactcggaaggctacatagttagcgtttgcgactgttcgtgcactccaagagaaacagatagcgacaactacgcttgatcgggggggaggggggggtcggaggttcgtggaaagagaggtgacgagaaagtggaggtcgactttgtctcatacaagaaaaggggggagaaatgacataggggccagctgtgcattttctcgcactcagtaccaagctccacgactcgacgaggcagcaaagtcctgaggaaagggcagaaccgaaacctggttactgttccttttcttctgcctagtttcagctcgtctcttccgctctgccacctaccagtcctccactcctcaaagaaggaccccggcggtctccgcgctggctgagttttccggtggatggtctcttttgattaaaccctttcactgtgtatctccaggactgtcttttcccgtcagccgcagtccgttgtcgtttcgtgaccctgcctcgccttctctctgtccccccgtcatttcctgctcggttcgatattcttgtcgccgcgtgtctttccctgtttagtcgctgtttcgcaccgctctcttcgttccatttggctcctcctccttgtctctgtcctctgtttcccgctgtttctcccgaccttccctacaactcgtcttcgtctgccgagcgccccgaccttttccgaagcctctcccggtctctagtctccggacgtcgtcactccgcttcggctcttctttcctctgtcggcgctggtgtctggcaaacgacaagtttctcgctaggtttttcagcaaaggcacccgcgggtattcgggttcccttttcttctggcctctcacagctgtgacagtgaccgtctcgctttttccagtttccaggagctgttttctctcgtttgaagggattgtgcattagacgtagataaaaa

SEQ ID NO: 2985 - DNA, 1649 bp, Toxoplasma gondii
tctccgtcttccttctcgtcgacgcattctggttgtcgcgaagaaaccggcgcgagcccagtcccctctgagtctgcgtcgcacatgcggtctccatctatcttccgccgcttcctcgaattgaggttctcttcgacggtgtccaactgccgaggcaggcaatgcccgcaggcctcgtcccagttccgtgctgtctcctggagaggctgctctccctccgcgatccccggcatcgcgcttgacagaaaaaatcgccttcagaggcagacgactctccccttcctcttcgaggcgacctcgttccgggtgtcctgaaggagcgcgacaaatgtacaggcgacgggggaggaagcagcaacgacagaacgtttttctgcatgcgatgggagtggaaagtcttggaaaacgagggggggattaacaaggaaggaatgaagttgccacgaagcaggcggcgctcgcgaggtcgatagcggagcagacaaaatcagcttaatgtgatggatgccaccggagagagaggcagactcaaacaccctgaatcctgtatgaacaagtgcatggaactgaagaaacgatcaacagcgaatgagaaagagaggcacaagtcggcgctaacgagaggaaggacaaagcgctaacgagagcaggcgaagtcggggctttaaaaggcagaaggctcctgcgctgggcactctcggaaaggagagaaacaggctctgttgaacagcgcgaagcggctagaattccgctgagagaaaagcggaaacgcattggagggtccgagaaatttggacccagaattttcgagtttccctctgggcacagcttggtcgaccgcgtcgtgtcagagggctgcgtggagacactcgaaccgagatggcagagggagctgagactcggggacagatgcagttgaggaggttttgggttgaaggactttgtcaaaggcgaatgagacgggaaaatgcaggaggacgaggctctgggctcctcttgcatttccgttaccctgtgaagagtgtgcatgcatctcgcgcgcatgcagaagtcacatcgacaggcacagcggaccccgtcttgcgagcgtgtacgcggttgtcttcacagtttgaccgtcgggatgtttgtccctacgtctctgtttcagagaaattcgttttgcagctttcctcgcgcttctgttcggcggcgtccccccttctctcacgcctttccaccgcgtacctcacagccgtgcttccgtgtgtatcgcaggtttctgcgccacgtgaaagaacgcgagagcggtttcctactccatctcgaggtgaaatgaagatgcgtttttgcccgttgtctgttcgtttcccatgaagacggctcgtgcgttttttccaaccgtcctcgcggcccggccagttggcttagacgaggctcttcgtcacgatcccaggcgttcgggggttttctcgcgcgtcgtctgcttcgtctccaagaccctcccctttttgtagtgcgaatgcactagcgttctcctcttcttcacctctaccgtttttttcgcctgtccgacccccctcttctcttttgtcttggttcctccgccgtatctgccctctttctgagcgaggcgcctgtccgcgtccagcacccgtccagcgcgacaa

SEQ ID NO: 2986 - DNA, 2066 bp, Toxoplasma gondii
cttggacacaaaaaccttctttttccgcgacgccttctccctctcccgtgctctctccgcttcccttcgcttgctctgtctctcccttgtccccttctctcactcaagcctcgccaccggtcgcctttctctctcctctgctggggaaatcggtggagtttctgtcctcgcctcgaccgccgtctgcatgcacgcgcatgcatgcggagccgcgggcacggacagagaggaacgtctccctgcgctctcccgagacgaggagccgcgagacgagcggagagtgcagaaagcactggcctagccaaagaggagctcgaagatgatgacgacgaggttcgccactacgagggggagtttgaggtaagttctgacggagaagagaaagagcgaaatctgcgaccggaagccagggtcccccacctgcggcttgtccagccccagaggacggaggagacgaggagcgctgaggacagccgcggcgttcaggagaagaagaaagctctcgaggagatggaggagagtaaacgccatggtgagaatgcgagacggcgactcgacgaggcgctgcgagagcaagcagaggagaagagaaagacggagaggaaaagaaaccgaggaagcacgggggagaagaggcgaagacgagggagaagacaagacgaaaggaccggagaagaagagaagaaagaaaggcggaagaagagagaccagaggcgaaagactcgagaggcagagactcgcgaaaggaagagaaagggaacaacgagagacggcaaagcgcagaggcgggaggaaagaaactgaggcacaagagagagcgcgagagaagtaaaaagcttctcgcgtcagttcgcgatggagtcgcttttattctgtctccgttccttctctcgttgtgacgcctctctttcctggaggcgcgcgagacaccaaggaactcctcgtctggcgaaggcagggagttccccagcggctgaatggcgcacctctcgcaagaactcggaaactgccgagtgtaaaagttcagaaaatgcgatagtaacggcgtcaaaccaaaggccttcacacattcgctctttctccgacgaaagaacgttcgagcgtcggagacgctcttgccggtgagtcgttggagaagagacctcctcctctgtcggggacatcgaccgccggagaacgtttgcgaagaggccagcagaaagacgcgctggaggccaaaggaaacgcaggaaaagaaggaaagttatccaaacgagaaaggatcaagaggcttcggagaaacaaccgggccttgtgtgccgcttgtgtaagccgccagaggaagtgcgaggaaagaaggtggagggagagcgacgttaacgttttcttctcggatggaatgcatggacacaaaacaagcagcacaagtatggccacatccggagacaaggaagccagaaaaattgcgagacagagaaagacatcagaacttccgtaaaaggcaagaaactcgctgttccggggggtgtccgtgaggtgtatgtacagcgtagcgacccccgtgaaaagagacccccgccctcgcatatatgctggagatatgatttttttctcgatttcaggtttttcttgaactttcaggcacatcttttcgcgtatctctggagatttaaccgacccggagcagacccttgcttctgttgctctttttcaacgtttacatcccctccgtttcccttcgtcgttgcacaccgtatacacgagagcctcgtcgtagaacgcattctcggaagtcgcatgcacacccgcgacagtcgacatcgacggctgtccaattgcaagacacgagtttcttctttctttcctttcgacctcacttctatctgtgcctgtcgcctttccctcgtgcttcttctgcaaggcacagcggtgaaaccccctcatcccgccttcgcgacgtcgtttctcgggcaattccctgtcctctttcggcggccttcgtctttcgctttctacgtattttttcgcgcgacgacttcttctggctcccccatatttctcttgttttcgcttccactctcccacga

SEQ ID NO: 2987 - DNA, 3179 bp, Toxoplasma gondii
gcaagcggttccgtattgccttatttccgatggcaacactctgaatcgcctgaatttcctcggaaaatcaagctgtgttaagtgagtaccattactgtgatagtacagcccctcactcttcgcgaataagcgtgtgtttagaggcagcccgcatcttttcggtgaagcctcgtatgtgcagatgcactagaaaaattgtttccagtttaagggatctctaaagaacatggttgccagggataggtcgaggtggccacaatacgatctgctgtttgcgtggctgtcgagacacgaaattttctccagccatagtctgtctacgctatcctgcctccatcacggcatcaagttcccgtgtttgaagcttatcgaaatattgcatcatacgtgtccctcatgaaactctcgctcaaaagttttgctgataacagcgcataaaactgcgggcgtaccatgttgcccttacagcgacgcggtttgtcagtttgcggttgtctgtggagctatccttggcgctactcgtcgatggcactacgcaaaagatttcatgtgtaatacacagtgcagtcgttcactacagcaaacgggactgtaaacagtcacacttccactgggaccgcaactgacgtttgctactgataactcttcttccacacgtcgaggcggaacagggcgaaacacacgaaagctttcgccgccaaagtcaaggtccggtcgcaccattcattcgttgtagctcgcccacttattccgggtgacactgaataaagaagttcagccagctgtcgcgagaagaaaggcctctgagacggtcatgaccgtgttgcgtttcctgacgttatactgcacagaagttttgatcccagaaaataaaggtaattataccacgaatttggaagcggtggcagagccccgcttataggaaatcgaggtcagcaatgttcatattatcatccagaagtgggtgcttcataacggtaactccaaaaaggagctgtgcatggctgcctgtgtgagtccgcacgaggcgaatcagaactgcagcaacagcgaagcatggcaactaaggcaaatacttagtgcgaattcgtagcagagagaaacattagtttcagcagttaacctcaccttcgttcgagttgctactgtttgacttgtcgaatggtcaacctcacccaagagttctaggacacgaggcttctatgcaggcaaacaacagaaagtatttcctttttacttggactggggcttatgtaagtccatagcatcaggcagccagcggcgcttactatctctatactgctgtctttctgttcagattcactgcttgcccaaccgaatcactacacaaaaacactggaacaccggctgccatcggtaaccgtcaagtgaaagctaagtataaagaagcggatcacgcacggggcggatcccaccccgatgtaaacgctgctaatgtttgatgagtaaaagggcttacactggcagagaggacggatactcgttgaaagggtatccccttgttagtcaaactgaggctctaccataccaacttcaacagctcgaacccacgaggctcaactcggtgtgcggactacgaaggggccccgccttggttcccgacacctcagacttcctgttgttggctatcttgtctgcaaatatcttggtacatacctatgtataggtgccctcccttttgcctcgcccgagagacactcagagaaggtttgtggacgacatttaccagccgactgcacataacacctctcactcactatttcatagtggacaactgggcatggaaaagtactaggccaacctagaacggcaggctcaaagatatatagataagggctgtcgtccctgagtggacgctgcgccgcagaaggctgcaaacgccacatctcagctgccaacgattcccttaagaagtcctgcttagtcatgcattcacgaggacaggctgtctggaaacgggttgtgtcctgtctgagtcagttgagagcacgtcctcttatcatctgtgttccacgttggttcgtggactgtgatcacccttcttgtacggctcagtggcggggcaggtccacgtgtcgtaacgtcatccgatactcagactggcatctacatcaccaggtaacgccttttaatactggcggccaatcagtcactacagatcacctccatttagctgtctacgtgtttacccagacgaacagtcacatgtggattttgtggcagggaaacgccgatgaacgacagcttgcagccgtgggcgtcacgacaaagccaagagttttttcagtgcatgcaagggcccgacataattgataaatgagtgattactctcacaggaacttgccacatctatttcatgtctccttgatttctccttttcttttctgatcggcgttcacagttgttgcttgaaggtgcagctcttttgttgcctcaagtcatctaacgagtgattgcatgcattgttctttgtcttcattcctgttgtccctattgctcttccaatgtgaaagaccagtttttgtttcttggatttctttgattgaacttctgagagaaagagcggatctgttcaatttcggctttttggtgtatatgcgtgagagaagatttcacttgtgaatgatgagttcgggtttatcccagaattctcgtttgccacggcccagccggtagcccagaagcctggacccagcaaacagtgtgtattcttcagtaactgtgacccttctctccaaaaaaacgcactccagctttttttcacctattatggtgacaacgtttaccgtttggcgacctctgtaatgtaccatggtgtcccctgcgttttgccccaacaagcgtcgagcagccgaaagtgccggaactcagcgacctgagaaattgcggtgttgtctgctgtttgttggctcaaggtgatcatacattcttacagatacgtagtcaaggatcaagtggttgctgtggttacatgatctgtctcttctcgtactgattgtctgcgctgcgctaagcatctcacgccaccgttgccacgcacagttgctgcgtcgtttctgtgattacagttttccttctccatctgagagcgtttctgttgtctgttgtccactagaataaaaccccctgttgtgtgaatcacgagactgttgacaaaa

SEQ ID NO: 2988 - DNA, 2311 bp, Toxoplasma gondii
tgttggctgttcctgcgcccacggccttaacagggaaaatctacctctgcagcccgtctccagtcgattctgtctgctcttttctagcaacatttaccaatgtactgttctcttgcaccgattccgtggcgaacgcgtccgttgtgaccctcgggggtaaccacaagatttcccgtcttaggctgtcagttaccacgcctcttcaatttgctaggctcgctgtctccagtcctttttcagccttcctgtcgcttgcgtcgccctgttccgctctgtcgctcctccccaattccctgaagaagcagtggttcttagcggcgctgccggacaaggccatgaggccgaccagcgaagatatggatcagcaaaatgtcttgaagaaaggaggcggggcaattcagagacactggagttctcattttcgctggagacaaaaacggcgaacctggcggttcgttttgtccatgtggattagagtttcacagcaaagcgggtcgagttcgtcgcgttccgctcgagtatgccggggtgtacgtacaccgcaggagccagtcgtccgacaaggcgtggtctgctgacaaagaaagtacgacacaatcattccttttgttggttttgacaaggcgagaaggaagaagcatttgagcaatgttttgaaggtggcgtagcgctgcccacctgtggacgaacgaagacgagttggtacggctgccgttttctgcgacatggaacatttccgcgctttgtttggttgggaagaggagggccaaaacgtgtctgtctggtctggggaaggacagatgcgcggagttggctcttcgtcgccgtcgtgccctcgttacaccttggctggacgccgcggaaatgaatgaaatgactttggaagagggatttacagccagaaaacatgatattgtcgcgcccgactgtcttgatgctaagccgacatagtacatttgccgacaggacgccacggaaatgagtaactttaggagaggaattcgcagacagaagacgagttatcatcacgcccgaccgtcttgcagctaacgccggacgtcgccatcttgcggcacaacaaagcccacgacgttcgttcggcagccctcccttaaaagactagaagagccgtgttaaccggcacacatgagtgtctgtttctttcgtcttggagtttgtgcgtgagttagctccatcttcgctagctgcggacaatggagtacacacaggcacggtgttttcggtaagaaagcttcccatcgacttttcgcgcagcgcacgcctggcgcgcgatttgtactagactagaggtactctgttgacgaggctttcatagtagacagaaatggagtaggcgtctgctgccttggttgcacaagcagaaagcagagcccatcgttcattctccaatttccttctctcactgccaaaattgccttcttttctcacgagaggaaccgttttcgaccgtcaagcttgagagtagaagccgcgctagcccccaaggggggagcggcattctccttacatgcgcttgcggctttggggtcagcgtgatttgcagagtggggccctcgcacgaggcgagttcttcgttcttttcatccgcttttgtcttgctataactttttgtacggctctttcttcaggcggaaggcagtggatgcccttgcagattcctaggtagaccacaggagtcgctcttccacttcgcttgcatgcgcgcatgtacgccgccgaaacaatcgagacaccgcggctctcattccttaaaaaaaccctgttatctccgatgaatgtttcctcggtgtttttctcgaaaggcgatttgaagaagtgaacgcgctgtcgccgacttccctgcctgaaaaacaaaggggacacgaaacgtgcagaccgcaggtcaggggccgttccgtggttgagtcagcccgctggggaagaggagaaaaagatgggagtggagacaccgtttttccaccaaagttctctgtgctttcagaaacgctgatttgaccaactgtgcgggtcccgttgctccgagatccccagagcaacgtggagctccaactgcgttttgtaaaaccgtatctgtcgtccttcttcctcattttctttgacgtcccggcatccggctgtcacttcctccagccgtctctcactgattttcttgatttttgtggcgcacggcctctgcctttcgtatcccaaagagcggggctgatctgcttctctcgctttgcgtccttcttcgcttctcagttcggtagaccccacatcgattctctccataaaactgggccccccagaa

SEQ ID NO: 2989 - DNA, 1180 bp, Toxoplasma gondii
gacgtctgcagcggtcccgtgcacagacgtctacaaacttatccttgaagccgtaggccaatgctagctagcagtaggggttttaggggttggcttcgcctttaaccttcgcggcggtgcctcagtcactctccctcttcttttacggctgcgacagcgtctgcttgccgaggaatcttcttgtcgctctccgccggcagcacgaccagtggtacaagggaaaccccgtgaaatggcagtaacggaaagtaaacgagggtttaaaaggtttgttgctgtactatgcgtccggcgaaaaggatgtcactgtttcttcgtggcctggtagaataactgagcgagatgcagaacagtaaccgaaacggggatgccttcagtacagtatacaaatatttctgataagctgtgcacaaaaaaagattctgcttgggcttgcggcacctcagacagtcactcaggtgttccggctgccaccgtcccagttgccagaaaaccatgagttggcagcaacgaagctgcttcaatatatacgaaacgcacaaggaatccatgacacagaggatcggtggtgtatcccaccgaaaagccgctttctgacgaagatcacagaacagggagtcgccttggcgttaacagcatgcgaaccattctggattagttagctaattcgcacctagtctgatacctcggtgaggcaccaataccgagaacccttaatcattctaatcgccaacataagaggcagctaggcacagcagtctccctggcatatgggagggagaactgatccttacgggccagaaaccctttgcaaatggaacagtttaactcgaaacaacggtaggggagcggggggggggcttccacacacgatcacaaaacgcctgacaaaccgccgttattagcctctttgcaaagcccggtgacatgtgcttcatgccttatcgtgagaaggtcgttgccctggattcaacattgaaatactgctaactgtttggtccacgtttttaaaaagaacagtcacgggataaaaaaacataccaagctaagcaatgtcacggatactgctgaagcaggagacggtgtacttacagtaagcgtaaggcagcctgcgtcttccatccatcaaaagatcaaatttgtgttccgtccagaagtaaacgcatcctactcttcgaaa

SEQ ID NO: 2990 - DNA, 1896 bp, Toxoplasma gondii
tgcgattatctctcttccgaccatttcccgtacacagctaaacacgtatatgcatgcacttgtatctctcggtatccactatacatatacatacatacatgtgcatatgcatgtatacagatatatatatatatatatatatatatgtatgtatgcatatcacatccacggtggcaacatgccttgaagcgtccatatgcagagaaagtgtattcactgtacgcctggccgtctctacacctgcttcactatattggatcaggatatgcatccgtggatctctccttcaattcacaactatgagtagatattttgacggagcagcgagcatttttttgcggaagaagtcttcaacgacatgattcttcgtttgtacctggtcatccatgattttccacgagaacttctgggtgagagaggcccagaaaggaaggtaagtccggtgactggtttcccagtaaatcgagctgtactgcatgccgtgatccatcgaagtcgccttcaagctgtgacccacgaggtcgaggtacccgggtgtacgcacacccgaagccgaggcggttcggcctgcttgctgcggagcagctgcggcggcgggagcgtctccagccatcttgtctttgaagagcgcgaggaggacagaaagaagaaagcgaggaggacagaaagagggaagcgaggaggacagaaagagggaagcgaggaggacagaaagaaggaaggcagagtttgcactgacgaggacttccacctgacgggcctcgaagcctcgactcgctggaatcagagcgaagctgtggcgtggagcttcagacacgtcaccaccgaggcccccgctcttccgctttttgaaccgagagaacacccagaagccgcgtccttcctctcagacgaaacgcctgcgttcgttcagcaaaaccgtccgccacgctctcgtcgatgcacactagagtcgccgtcgcactccagagacgtcggagaaaagcgcaaagcgactcttcgaggaagaagataaaaaaccagaaaaataaggtctgcaaacgcgccagtctcgcacgtgtctcgggaacgtttctgtctcctcggatatcccaactgttgaactgcttgcatgcacatgcctgccgcccgcgggtccccaggcctgctgccctttttcggcgctaataaaaactctcgcatgtctcgactcacatgctgcggtggacttggtttccgtggaggaactcttgaagccgacgtggttgcgttttttccagttgaaaagacttcgaggggaagcccaggaaaaaggctccttggtgttttgccctcggctcaccgtttctcgactgcaggagcaacggggggctcttgagtgtcgggagatccgctgaaaggttggagggcaacagagagcgctggcgaggaaagagagcagggggggcagaaggaacatcgggcggggggaaggaggaaaacagaggaggagaaaagagcagagaagaaggaagaggacgaaagccgtcacccagtcgtccacgtttctgcgtgcgagagttcttggcctcgacggggactcaaaggccggattctttgcgcgaggaaaggccacctcaaagtcgatgctcgcgactcacaaagacgcggggtaaaggagaccgaaaccgaagggatctacgtacatctctgggctgagaaaggaagagcgatttttgtctctggagcttcatctgtttcttcgtgacactctctttcttcgacgattcgcaaccagctgacaacgggagcggaaccgtcttcgtcctcttcttctcgtcctccttctcctcctccttctccttttccttccttttcttcttctccttcttcctcctgcttctcccccatgtgcgcgctccacagtcacaggaacaa

SEQ ID NO: 2991 - DNA, 4284 bp, Toxoplasma gondii
gagaaatgtagcaggagtatctgtctatgtctcgctcgtagctaagaaacatttcatacgtcttctcttgatgcgttgtcctaaccgcaagcgcggactgcctcgactcactcgaagtcagattgaaagacttagatcgtatccccttatccaacacagctgttggccgggatgtataacccgctgcaaatcgccctttccccgtgactggggacggtttcacgtgagttactgccatgtttgcgattttggctagtttgtccttagagccaaaataagcctctagattgaacgtttctccccaacaagcttattcttgcatcttgggcccttatctttcaatgcctctttgtaaaccccgggacgtgctaccagcagatcaacgcacaccaaacctgcatttgaaaaagtgtttgagcggtctttgttttccacagggcacaagggcatagtagaaaattgggcttgtttctgctgagtgtttcatattcaatttatgaattgccacaacaacagctacattttagctaagacgtggaacgagtaaaattcctgcccccgtacgcttgtccaggttttgaatgcatctgcattagcctcagctcgtggttgccataatggtatctaacggcaactatcacaaccattttaaaaactccacctgtttgcttaaaaatactgccatcagaagagcgttgaacaatgcaatgtaaccatgttgaatcgtgtctgaatcatgcaatgactacaaaatacaccaatggaagagaaggcctagatgcgatcggacaggggaagccggtgctaaggaggcaaacaatgtccacggacgaacaagcggagatgtctcacgatatcatggcacgtcaggcagctggcactttgaccaaataatcaatctgtatcaaatagatatcttgtcagtctacagcgaggtgaattttataaaactccttgccgactccgcgaaaatgcggatcacacgtgcggactttcatgggcggcttctgcccactgtggccgttgttgagcccttctagagacacagagagtaaccagcagactaacgggggtgattccatttcagttttgtgaatggcaagacaagatggtgtaactcgctgccgcatttatctgcatgcaccaggatggctcccacatgtgaccccatagcagcttgtcgttttgacagtttcctgttggcgccagtgctcaacatatgagcgacaaccacagtagaattaaattaaggtgaaaatagatagcagttggtgcgacctgcagaaggttcaggaaaccttgtaacacgatggggttcaatttcactctatacgacccctacggtcctacagaggcgtgcatgcagccacttacggtcggatttggcaaataggcaaagtgggactattgcgttggtgtagaaacgctccacatcatgctcaaaaagtaactggtgcgtctgtgtcgggattgcttacgagtgtcacaaacaacgcttttaaggataatttactgtaaccgcggttagcagcctcttttcgtccgcaaaacagtaacaaaggtagttccgggatcctacaaggatacaaaactgagctgtcagagacctaaatacagggaagccgcccgctgccgaactcctaaagaatcctaccaatgtcaggtccgcttcttttccaagcaatcagagacagtaatcgagagcaactcgtgcttctgctagaacaggcccacgcaaacgtgaaccataccaacgccaatgggacgacaccactgatcttagctgcgcaacttgacagggcgtctctcgttgaaattctgcttgccaatggtgccgattcaaatgctcaagagaggcttgaactgggagggaatacagcactacactacgcagctaaaaacggcaacaggtaaattccatgagacgatattgcaagtggacaatatctctgcagatgttgccactgtcactgttagcttaacatttctacaagaacgttcagtgcctcgcgttaggtccagctgtgggtcaagcaaagcgacagcaatcatttctatcgcttcacgaagacatccatgtttacatccattccacgaagcattagatgggaacaatcgatacgaccgaagttccaagtagctcacacttctttctacaatgtagttccgtgctcgaaactaccggagtaacagaagaatgagaacaaaggtggtgcgtgtgtttcttctgtgcacactacctttcctcaccaaataaaccctcggaaaacaaagagaggtggcagtgcttttgttgagtcatggagcacaagcaaatgtgcaagacaagctgggacggacaccgctccataccgcctgccggtatggtagcccgaccgtagtgcaagcgcttttatcaaagggcgctgacccctccagcagagattactcaggtgagccggtgttctgcaaaagcgcaggtgttacatattctacctatagcgcttgaatacctcaggcttggacataataaaagctggagaaaattctcttctgattttttgaattgtacgtgactagtcagtctccagagcgagcagtaagaagacgatgatgatgatgtttgattggtgtcttcactgcaggtttcacaccatcgtactgggccaaagtcaaaacacacgaggagtgtgcgagtttgcttccgccacctcaattttacggcagcaagcaaatatctgactttcagctagtaacgatggatgccttggagctgactttaaacattccttccaagaaaaccatggggggcaggggcaaaggaaagaaaacaaagtaggactcacctgtaaccatccctttaaaattgtctgtcagcaaagagcaaataacaaaacaaacaggacagaatcaacaatccttttcaactggagagccaccgaagagcaagggtctctgccgttgtattggaaacgttcaccaccagcggttgacttcctccacgtggagcggtcagcgtgtgtgtaatcatgctgccctcacacacaaacacccttccacatcaagatcagcacggttcgagcattgccgcttaggactacccttcactgctattcggtgtcaaaacggagttacggcaacacgacgtacactaaggttctttcatatctacgttgattcagcagtcctgtccgaaacaagctaggcttttgttgctacagagtgcgtgctggacagaaaccaggggataccaggaggcgtccattgcagttccttgactgttgtttgtgtatcattccggaaggatacttgtcctaatcacattcgttattgaaagtggcgttctgctttgtgtcggggaaaactgtttccacagttaaaaactgctgaaaatccaaatagcacaaaaggtcccaagttgcctcgtttactcagcgtgtagctatcggttcattgacaccggcaggcatcaattttgtggccattctgcaaacgcacaattggttctccacctacgcgataggttggcttgctcagtccacttcttggaacggcctgcaccttagatggcaaacagagaggtcgaatgactatgcttaaaccccagaacagacagtcgctggcctttgatgtttgcgtcatagttgctgacatggaaaaacttcccgctgttttataacctcttccatcctcccttgtctgtcggtatacactggcggcgagccaggaagattttcgcgggaaatgagacacacacacacattcaacgtatctgctctcttcccgaaaaggcatcatgcgtgcaaaagttggtagaagctggtccttgtcagacaggaatggagttctattgcattcttcccaccggcttcaacgtgaatcagaaaccatgggaaacatatcaacacaaatcgggaaatgccctctagaagtgtcccctctctgaggcaggagtcgacgacgtttctcactcgtgacaccgactcgtgtcccactcggacactccttcgaaggaagaatacagccccgatggatcgaagttagaccatttctcattctggttgcaaccacagcatgcagagggttccttgttccgtgaggaaccacgtgtaattttcccgttctttacctgctacacacgctgcggtattgggggtcttggtgtgttgcacccaatgtacctacactgctcaggtcattcgaaatcactatgagcagttattgttttcttgcgttggtagccgtttagcaagcatctcttcgaaagaaccgagacaaatctagtcaaagcacacttgcgaataa

SEQ ID NO: 2992 - DNA, 2034 bp, Toxoplasma gondii
gctgcgccaaaccggcaatgacatcctccatagaattgtgtagatcaccttcgttctctgacacgtcagagacgctcgcgtttacgccgtctctagtgactggacagcaaggctctccgccttctgtttcccagaaagaacctatcgccctccagagaagggaactccacgcgaggcaggcgtcgtccaaatctctttcggactgcgcggcaggcggagcggtgctgcaactgtcgaaatgactgctcatatgggcgagaaacgtcggagataagacggcacgtctcagtttcgctcggcatatgcgtgtttccttgtcaccgttgttgtctaacgaggcactgccagaaggtaccgaagtacgggagaagcgtgttgccccaacgggggctttaccctcagtgtcctcatcctttctgtcctgcgcagagaccgctgttgtttcttcattgctaggaaatccaagcgttttggacaagtgctgaatgtgagactttaaaaaacttcccgaacaaatgggtactgacttgccgagcagccgaacaaagacaccaggtgtggtcagcacacatgtgcgagctcctatattttcaccagccatttcttctcattatacgtgattcattcgggtgtctgcttattcccgcctttcaacgaaagcgttgatatacgacttggatattcggtcttggtatgaccccacagaaatgcagcacacatcttccaaggcattcaagaaccaatgcgtagtgtgctccacgacaaagcgaggtatagaggttgaaagtgccctcaacttccagaaggaaacctagaaacttctgcacatgcagcagctaccggccgacatcggtctgcaccgcggaaactcacacgtcaaaaaaacccgccatcgtggacagaagacacaggaaagcgcaagtgcaactgactggcctgtgaaaaaaagttctttcgtgtccttttgaggaaaggagcagcacggggattttcagcgccaaacgcaaggacgggttcggccgggtcctctgtacgtcgattctctgtgggtgcatgcaaacgcatgtgccagtcgtcgcagcagaaattgcaaacaggccactggttgagatattctgcctcattttttacgtgctgtgacagagaagaactccgtatatcattcctaaagagacaatatgacttgcataaatacctgtgggtcctcggttctgcataaacggcactacggaggagcgcatgcaggctcgcttcaactcgagatccaatatattcaatgatgttagggtgtgaatttttccagatcagctcatctggtctcgccttcgtttgagtcagtctgtagcacatttgagtcatcacttttgttcgcgtctaataatgccgttttcttacactacgctcctcttcctttgcgccatttcgtgagagaaacgacgcagcagaccgtgaccccggtttcctcatctggcgctgcttcgtcacatgttctgcaactcgacttcgactgagatattggtttgaatagaaagaaacgcaacagtgcttagcatactctcgagcggcgtttcctggagggagtctatcgtagaccccacttgctttgcttgtcaatcgactttgcgtctctagtcgccgttccagataccctctgtcaactgtgctcctccagttaggggtcttccgccaaaagacataacaaccccgcagtgactgcctttatttctgccgtcgtacttaccttgttcgtttgcttctttggtcgtctactctcccctgtccgttacaaggcctgtgacgcgaaattaattgacgtgacaccttggctgaactgtcaagaaagatgtcgccagtcacccgcttattctggcagctttagtatgtggagactagtcagatactatcttacgtgcatgaaagggcgccttgtagcggaggtgtctcatatcatgtagcgccgagacttttcagccgcctacttgcctagttcgagagtctcgtctcagctgtacgtacacctgattttgtcaaaga

SEQ ID NO: 2993 - DNA, 2675 bp, Toxoplasma gondii
cccactgttgggcggaagacgtattacaccgtcctctgtgcgtggcagcagctgattgactttgctcccttgacggttcttcctggggagaaattccctcattgcttacagtaaaacgagggaaacacgggcctccgaaatcaaagctttcgccggaaccgcctttgtccaagaactgtggctgtgcggaatgtgtctcgagcccctcggagggtgctgaaagatgaagactctcccggccaaggaccggcgtgttcactagcgttgagctaaacgcgacatgtgtgaagggagacacaaaaaaggaagaggagaacaggagaaaccccgggaacagaaaacgtgacagtgacggcgttgccttcatggtgaagggggggggacgacgaaccgactagagaggagacacaaaagcggtgagatttcagcgtcgcaggaatgacagttactgtgaacggcagagctacacaggagcaattacagccacatttccggtgacgtctgactgagggagacaaactgtgggtgaagcttggcggaggaaggaagcacgtggttaaagcagatatatgaaagccactcaacagaaccggttagagcgcgtacaaaggagctcacatcactagagacagagcttgccttacgtctgaagcatccatatgattatattgatgatgacatgcttccggaaaagtaactcgtgcaaaatagggagactgaatgaactggtcgatgggatatccaactgcaacggtgtgtacatacactcacacactcgcttacacagcctacaacctgctgcgcgcggggctcgaggacacacataagtatgtcgtcgctgctgatgaatgcagactttggcctctgcgaggcaggaacggtacttcttttgaacacgatcctagctgtttttgatttctcgactcagctactttttcggtcaggcgggcaccgcactcctgcggagcgctggacggggttccagcgtacactcgcctctgggccaaccaaatagtactggaaccaccgtcgcgacaaattggcgtgattgggattccaccactagcaatcgacgccggcgggctttcgcagtcgacggacgggcagcggtaatcgacggaccgatgccgtttaaaggcaccgcttcgcgaccagccaatggctggtttgagcacccctctggagtcgagtctgcagcggcgagtgaaacgtgtacgcgagatcggaggtgtcacttctcgatgaaaaaactcaggtgagtagaaaatgggaaaacacggggtcgccgaaaacacacctttgtgtgctcctgcatacagctgcacgttatgcctcgcgccacacgcgcacacgagttaggagggagcatccgccactgagaggaaattgactgaactcgacttgggtttccacgacaagggctatacggtagaaattttcgggagctgacgtttcaagtgaaaacatgtcacaccacaaaaactgaaagttctctgaacccggaggaaatgactatctcaatcgcagttgccattccgcagtacccttggacggtcctgccagtatgagacgaagatcctacgacggcggaccccgtgtgctggcgtgcaactgttcttgatcgagagcagtgtgtgaaacgctgtcgatggcgttgggcaagcgctcagctagcggcgtggcgcattcagcctcagtgcaagaagcagctatggttagccggctgaggaaacatcgtggggggagaagcactggcgagtctcgagaaaagagcggaagagaggcccgctgaaaagccttctgactgccggtgcacccttttgctcaaacgagcattctgcggcctacacaaggtgaggtggtatttgtcgctctctacggaataccgtgtggtctctgctttgttctggacccttacgtgacttccttgacggaccgtctgcccgtcctttccacttaacttttttttgcgcggttttgcattctgtcgatgcatggatacgaccggtcaccggggttacgttactctgttttgttgactccgtcaccacaggtcttcgtttctccgcttctatgcttcaccgtatttatgtcaggtgtacaatgtgatttcacgtgaccgtacagtgtccctgggcggccgtagaggtggagtatttcctgtttctgtgctactcttgcctcctgtggtggctgcctgtgcatgcattgttcacggacccccttgtcgttggcttagttcagaaataaagtctttccgtttacggcaacagttattgcttgtggtaaatcgtcgacacaggtagtttcacccacccttggacgcgggcgtcaccgcccggatcggtcgtctctgatctgtgacccgactgcgagacttgtgccgcggtcggaattcttcagtcccgttaccttatgtcttgcactgcgcagaacacccctgacagttcacgttccggccgatttcgcagctcacgacgaaagctcacctgtccctttgctgattcctgtgttttcgaatccgctcactcgcagaacaggccttccgcggaactggcaattttccaccgatgctatttttcttgctagatcctctcggcattttctctatcttcaattttgatatctactcaatctcaccagctcacctgcagattctccgttctccagcgcaa

SEQ ID NO: 2994 - DNA, 1872 bp, Toxoplasma gondii
aactgctgctggtgctcatctgtgctgtctgtctagtcaagtgaaagaccttctctccggagtcgtctctcctcgcgcctctcggaattccgattaatcgcaatcgaattccacgtctttcgcacgtcaaccgaagcaccatcgaaaatatctgaatactcatatgcacatatacatatatctatatatctatatatatgtatatgcatatatatatatatatatatggatatatatatatatatatatatatatatatatggatatctgttcgcgtgttcgcacggttgaccttcaaaagtattcaggtcgactgcgtctccggaaacgcatggcagatttgaaggagtcgcgctgtctttgaaaagggtgcagggcggagagcaagaacctctcttgaacgtcggactgttcgttcatgaaggcagagtctggagcgcgtactttttttctccctcgaagtgaatgcgggaggaccttggaaagtcacatgctgctttcttgcctacgcaaaaggaggcgtctgtgtgtgtgaagcaaagtcgctgggtttccgcctgagaaagcgcgaggatttttcggagtgaaacagagagctcactgaagaggagacccccgcggctgagagagactgctgtcgggccagcagtgcacccaaaaaggcacaagttgcagcgactttcctctccaagaagagcagaagagaggcgaagagagaaaagagagaggagagaagggcagaagaacaacagagagaaaagcggagagagagaaggggagagagagagtaggcgaaggagagagagagagaagagggaacaccgaggaggaggagaggaagggaaaaaggaaaaagagaagagagaagaaaacaacaaaatcagagagaggagaaggaagagatcgaggaacgtggaagagaggaagatttggaaagggagagacgagaaagcgagagcgggagagagacagcgagctgcgagagatgcgtcactggaagacagcagaatcgagacagcctcgttttttctctcccttgtgtctcctctttctctcgtttcctatgtttctccttccgctttctttccgagactaccaaaggaaagcaaaagaagaagaaaggaaagaaaagtcgaccctctcacatccgagaggccatggacgcactcggagaccgagagaagacacaccagcacaaatacgcagagaagcagcaacgttcgagcagccgacgctagcgaaacacaaagcattgccagaaagagacaactgtggctaaaaaatggagaagaatctcgaagagacatagacgggagagtgagcacaaacgttccccactgcctcagctcccgcgctctgtcttctctgtggagttctgtctctcctctttttcttcgctttctgcttttcttcctgtgctgcttcttcctgtgcggcttcttcctttccttcttcgtttttttcttggtttttttcttggtttttttcttgttttttttcccgtccggagcttacctttttcttcggtgtcctctctttgagctgcgctagcggcggcttcagagcgcactgccctcgcctggaggggggtgtgtggagctccgtcgttactttttttctcgaaattaattttgtccacacactgggctcgcgctctccatattttcatcaagacacagtagcagcagcggccgcaggtcctccttctccgtcctctcttcgttccttgtctttctgtctactccttactttcgctctactcttctctctccgttcccctctcctgctttcttctcttccctctctcagtccctgctctccgttcgtccttctcttctctctcggctgcgacgtctctctggggtatcaaaa

SEQ ID NO: 2995 - DNA, 1802 bp, Toxoplasma gondii
tgtagatatatttaggcacctatacatctctctgtctctgtgtatccatcgatctatctatatctctatatgttatagatgcacaccagcacctccctatgcctaccgtgtctgaagtatattacctctaggaacatctgtatacctttgcgtttatatatgtccatatgcgtgtatatgtatatacatatatatatacatatatatacatatatatatatatatatatatatgcatgtatagacctgttttcgcgcattgtgtgttgattcatgtctgtgttgatgtaaatttgttttatttttgtggcggttttctctttatttgaatgtgagatactctgcgaccacagtggtgggcgacagccaggcaccgacctggcgcgcagaagttgacgaaaaggacggacttgacgtccacggaaagtcgctttccttttttcgtttttcagctttgtagagcaaaaacgagaacactggctttctgtcacctgcgcaaaggaaggggaagccgagacttccgtgttgtagccggtggtgtaggcaaaggaactctgcgttttttttttcgctacctctttggggatctctccactgttcgcacgagtcttctttgcatgtttcttgctggcattttcgtttctcttcccctctcgtcaacaagtcgaggcgaacgaaaggcgaatgcatttgtcctctccagtgaagaaccagaaagctcaaaggccgacaccgacgctccttcaccgcaaaagaaagatcgaccgcgtctccccgcttgtccccggacgccatctttctccagaggcgtctcgcgttttgaattgcagagaaacagtctgaagagaacagcttcactcttttcttgtggcgtccttcgctgtcgcgcaaaccgcgcgtataccggcgagagtgtgatgcatgcaaccgcctgcgcgtgtgtccaggccgccgttttctctgggtttctcgggatttcctgtttcttttctccccttctcctcttttgtcttccatctttgctgctcttgcttccgaaaaaacgcgtggtggacagaattcatgcgcacacaatgtcgaagccggcactgcccaggccgtcactcgagagattccccgtgagtttgtgctcgctcctttctcctctttttcctctctcttctgtccttctctcgcctgtgactctctgtctgtctcctgtttgtcttttatgcttctgaaacgacgcttttcgcgttgctccggcctctctgggtcgtcggcaaacagagagacggacgactggcgccaagaggggccgccctctcgagactcgcgcgggatattgtattcctgatcgatttccgcctcgccttttcgagatttgcctctgtgggagaaggcgaagctctcagaggagacggctcttctcggaggcggcgaaaaccaacaggttctgcggtgactcgcttgtctctccgacaagcgaggaaacgtctttcttcggtgtcgacgactctgcttctcggacttgtgcttttctccactggcctccagaactttccggttctcaagagccgttcttctcgcgtcggaggaagattttttcaccggactttcagtctcctgggagcttgttctgggtctctcttcgcctcttcttgatctcttctttctctcctttcgcctatcctttgttctttcgtctgcgcagaagagcgccctcaagaacgaacttttctccggttttcgcgctcttctttgagaaggttggctacagaaaacttgctgatctgcgtagcgccactatctctctcttcaaca

SEQ ID NO: 2996 - DNA, 1809 bp, Toxoplasma gondii
tatatatcaattgttccaaaagaaacaagaggaaggagaggtgaatcagaggtgaggaggaagggagaaggatgataggggaacaggagacgagagaaaaggcgagggaggaaagaaggagcgaaaaaaagcagatggcttaacgcgccacagcgtcgtttcctgttgttcgaagttgccgtccatgttcccccgatttctgcatgaattgtggagacaattgaatctatagtttttgttgcccttgatacacttgagaaatgcatcagtcacaagagcgcgtgagaaggatcgcagatgaggacgaaagcatttgctgttgatcgatcagcagagaagcagcaactctctttttgaaacctgggcgcaccgtcaagacggaggaggtcgtcgaaaaattcatcttcgccttcgctctctgagccttcaaagaggaaacgcgctgcctgtgaggcgtcgaagtccatcttggagaccggccgcgaaaagcaaagaaacgggcatcgaagaaaggagaacgagaacagacggaaccataagagagagaagaaacagaagaggtttacaagtggacaaagggagagaagcaaacggagagacagaggaaaaggaacggagagacagaggaaaaggaacgtagagacagaggaaaagaaacgaagagaggagagaagagggagaaagagaggagaagacagagaagagaaggcagtgaggagaagaaagaagaggaaggccagagaatgacaaaaaaaaggacaagaagacagacaagagagaggaaaagggagacgcggtgcgagactccagagacaagacgaaacagggaagagacaagcgacaggacaggcagaaaggaaaagtccgatgaacgcatatgcccgaaagcgcagacgctgttctctccgcgatgagtgagcaggtttgcgaatggagataaatgaaagagaaaaagggagaaggacagacagagaccctcggctagattttatcgcgcggtgtcgtcggtaaaagagctgtggtggagggtcgatgaagaagacgacagagagagtaaggaaaggcaaccttggtcggcgaatccgcattcggaaacttcttgtgcctccaacgttcactgaagatcgaaaaagaagagtggtggactttgttctcttgtgtggagaagaagaagcaactgcatgcgcgtcgagtttcatcgccgacacagcttgctgagctggcggcggaaagcggctcccttgtgcgttactttcattgcgtttccccctttttcgtcgcccttcgtcctggccttcattctccttgcatgtcgctctcaggaaaaagctcctttttgtggaaaggaactttctcatcccagtctagagtcgctgtcttcatgctgccggcagccctgtgcatgtgagagttcctgcttgcgagaagaagacacacactttttcgtcggattctttcattttttctgtcctttcaagatgtgatgcaaagtcctactttcgcgacttctctctcttgctcttttccatcgtcaacaatggaggcggctaactttcttttttttcgcttccgcgccttcgagcgacaaggcgaaaaactcagcttccccagcctcaaggcaaagtgacctcaggtctctctcgtctatactttgttctctcttcgcttctcttccttgctcctttctcttccctctcctattccttctcccctttttccatcccctcgttctgttcttctctcttcctccgtcttttgtgccttccttccctgctcctgccttcctctggcgcccaaactcctccccca

SEQ ID NO: 2997 - DNA, 3350 bp, Toxoplasma gondii
tgtgagcacaggctgtctactctttctgagaacttggcttacctggcatgaggcgcatcgcttcattttcccggtcgcctcgcttgatcggggtgaggcaagcgaggcagttctttccgtcgacgttcatcgcgcaagagccgcaaatgccttctcgacagctgcggcggaagacgaggctcgggtccttgaaagcagacatagacacagagagactgcttttgaggaacgtacatttcagaggtcttctggggcgtgggaaactctccagcgcaggtgcaacggccccgtcgtcccaaccttcctctggacgccacaaaaaagaagagcaacagcgaacgcctgcaatatgtttacgtcaagttggaatcgctatttatcgccgatcagcaccacggcggcgaataagtcttcgagtcttgcacacaccgcccgatcggagcatctgcttttccagaaaggctgcacgagacatgcgaatcctcacttgtctgtctttgatggcgatgagggcatccaaaatcatggggccgcaggtggagacatcgagctcgaacttttgcatgtacgggcgtttgtctgtctcagggttgtaccggtagatcgcaaaggtgcgaaagtccggcaccttggtggcagcctcagcctcggaggcagctgtctgtgcatgcgcgacggaggcgaaacggcgagaggcagccgaggcggcgggcctcacggagcgaagcgcagacgacaacattgcggcgaaagagaacgacgacaggagcggcaaagcgcggaagctcgctcgagggaacgtacaccacagggcgaaggcgggggaggggaagggtggagagaaggctggggagagcacagagatgactttcggctacagggggaaaggagaaggggagaaggaaaacaatggcgagaccggcgttgactgacgctggaaggcgtgaaggaaaaggtcaggcggggcggcagaaaccgagagagacgcggtcacgcgggaaaactgggggacagaaggtcgcgatgatgcgacagaggccttcgacattcgagaattcaacacgttctgctaagcaacagaaggcgcaaaagggctgcatgcagctgaagctcctgtctgcaaaagctcgatacgtgacttgaccggcaccggatgcgacgggagggaggaaatccccgaattcgcagaaaccccagtttcgccgcgtcgtcctgaggaggcagtggcggttcgccaggcagttcgctgttcgggaaagcgttggacgtccagcgaagcacaggcgaagacggacgagaaaacccggtgaaattcgtcaaggagccgagaaatcgcgatcaacgcgacaggccccgaaagcgcctcttgttggcgaactggaaaagaaacagggtctgtctgcccgcgcggcggagctgttctttttgccgtggacactcatgcgtggacgcgaaaactcgagaaaaatcgagaactcgtcgagaaaactctttttgcgtagaattccggcctgctctgtcgcgataaactctgtcgaatccgctcgttcaaaagatagtcgcttgcgctaaaaatgcagttgcccagctgccgtgagaacagcgtggagaaaagaagactcggcttagatccggaaaccgccgtctctcccttcccgcccgggcggactgccgttgaggggtgtcggcttcctcacacgcccgagcgcggtaggcggcgactcgaggcgcgcttcgcacaaagacttcgtcacctccgcgagggtccaaaaatgtgctttcggacagactgtggaaagctgggctctccggcactgttgtaaaaaatcccccgattccgagctgcacactgtgcgcccaaccgcggcacatacgacgcgtcaagcgtggcgtttctccctcgtcggatgtctctcctgctgaggaaatagcgagggaaaccgatcttgtggaaggtagaagatctgcaggaaacttttgctgagtatgcacgctatcgtcacctcgtgaggaggtggtgataatttctctgggaaactggtgacccgcctctctagccggctggatggccagctggcaagcctgagagctgtatctgcctcgttgcggtgtctctttacacgaccgtcaaactcgcaggtgtgggtgtggcgtcgaaacacaatttatttccaaatgaaagaacgctatcgccacatttgacgcttttcgaaaaggctccggcgcgaagcgcttcgctttccggggggtgggagacgagagtctgccctctcttgctcgggtgtctatacacctcgattgtctacgggaggccggagcggttccagcacgtccttgtttttagttgttcgctattcgcttttaacgcaggtagtaggcgctccttactctatttggagtgaatctcccgtttttcctgagaattgaggtccttaaattggtggcccgccgttcctcccagagacccccctctcgcgcttgccgcgtttcgcgctgcggtgtgtctgcccgtttcgcgaatcgctgtctcgcttcgcggcgagagtctcgccgcccctgtgtgactgagcctccacgcacgcgacatctgccgtgtgaaatgaatttttctgcttttttcctgttttcgtctccagagctgtttcaaatcaaagacgtccgcaggtcccgtcggttgtccctcggaagtacccctccccgtgcatgcgttttgcgcgcatcgacgagcccgcagcacagagtcatgcggtctgcggcgaagacctttggggaaaccgtcgctcagcgctaatcggtttgtccgttgatctgtcagagaaaactcccacctttttctccttttttgtttctgcttcacggcaccccccacactcgtcgatggttgcgtctgtgtctccgtctttgagcaagccgtgatttgctggccctcccccgcgccggttctcgcttcgcatttcttctctgcagcgcttcggccctgaaaccttcgtcgttccccacttcgagtgtcgtttacagttcctctttccgcctctcattcggcgaaccacgccccaactgctttcccccatatcggcggcgcctgtgcgacctccggtctccacgcccgcgcgacttctccgcctgctgtccgctcccgtgctgtccttctgcaccggatcttcctctggctgaaccttctgcccgtcttgtctctcgaattctcctctaccctcttcttgtcttcctgtctgcatcgtcgtgtctctcttgcgtggggcagcgggtgctgttgagtccggcgctacgtggctaagttcgcggacgccgcagagaaataccttggagcgttttttgacggcgaaggataa

SEQ ID NO: 2998 - DNA, 3287 bp, Toxoplasma gondii
tctttctcctcgctcgaggtaggcgcagatgtgcttgtcgaagaggaaggggcagtttgcggccgttcggtcaccacgtacacctcttcgccgcccttctctcgacggctcgggttcgcatgttcgactctgcgggtatccaccctctctgacccccacggcagaagcacatcagcagcctccagtggagcttttccggagacagcggccgcctgccagtacggagaatgaaacagtgggttgtctgcgtctccctctccatcgtctgagcgggaatcgaccgccctttccccgcttcctcccttcgcagaaccgcggaaaggattggcctgcgccacagatacctgcgctcctcttgcatgtcctggtccggcgtcgcctgcatgtttgcgtctgtgctctcgctccgtcccttcgtttcgtgtctctgtcaataaagcgcctgtctccaggccgtggccaaacaggctgtttgtagcgggtgttgcagtggcggcgagtgcatgaggctccggagaggggcgccccgaagagccccctgtgagggtcactcgctcgttacctaagaacgagggcaagaccccgagacggaagaaaggggaagaaagagagacaacgaaaaacagagtgaacaaaacagacggcgcagaacgcagaggactgcgcaagtaacgcgctgccctacgcagagccccacaagagagctgcggcgccttacgggaaagcggttcgctttcgatgccgcagggaggagcggaaagaaagcacgagaaagcaaaagacggagaaggtaaagaagctgtactggaaagggcaacaccagccgagttcctagcatatggacggacaggggaatctactttccctagaaaggattgtcctgtgcaggacctatgaaatttcgcggatgggaaactgctgagacaaagacacttcctgggtctttgcctctgacgtcggcccctcatcacgctcaacttatgacgctactttgcgagaaatgcaacgcgagaaactggtgaggttgccagaaagtgtgtttgtatcgtgggtgatcaggaaaaccgtggggataccggccccttaactgtgcaaaggtgtcattcacaagaaccttgtaacaatcttgtaaaaaagggaaaccgttgagtttctcaagaggaaaaaacgctgcgtttcgtccgcgcgcgaacgatatgccctgaactgcgttgcattggggaacggggcccgacagacggcgcgaaatactttcggctccgagtctcaaaccatattgtagggaccaccaggaaaatgtcaagcaggggccaacattgccactacctagcgacgaacacacgatagcggagagtcacgctcaacggaggcagatttactgcgatgtccccctcgctcttgctgaatgaactgttgctcggtccacaagaaaattggcagctttacaaaatcgtcttaagcacacatgagaacaatcaatcgaatataagaataatctgccctcgggccttgtaccagcagtgcgtaaaatacagctgttccgtgtcgagtcatgcgacgttgcgctgtgaacccccttccccctccccccccctgagtttccctcgcgcaccgtttcccgaaagagagactgtcgaaccctcatctgctcatgctcaccttctaatctccatgttacttggcggctagtctatccttcatctcctccaatatctgcctcctcgttcgaggcgctctcaaggatagtagtcagtggaacgagctcaagtgaaattgcagcattgaaatgtgaatgcagcaaccagcgagagtagacactggatttgacgaatggaaacctgaggaacagccgagcgcagctgttgggcagagaggaattctggagacatcaggagcgtttctgtgttcctgagtctttatgacggatttagttgttttgcttcgctcccctgtccagcgcacggacttacctggtacctggagtgtacgcagacaaactaatgctttgctaacatgtggtacgtaagctgcgctaactcgcgtcagccgcgaggccacatagtgcagtctaccgtggcgggcttttgttttgggtctccggaagaacctaagggatttcctcatttttgatccacatggtaaagagttcagcagagcaacgctaggtaggaccgggaaggaaaacatcgactgaaataccagttacatcaaggattcttcgtacgttttgtgcctctgagcatcacagattatgggccgcagcaggcaacgtaccgctgtcttccggctcgcgttctctctggacggccagggggggaggaaccgaggtgagcatcaacacatccggcgacgcgcgcgccagggacgagacagcatttgccgatggagcaaccggaggagacagacgggtcatgactatcgccagtgctacatggatatccagttcactgcttgaaaatttgacatcttcttcctgcttcggtaccttccgaggagtccttctctcttggcgtttcattcttcacgggccacgacacgtggccggggagaggcgcggtcgcacaaatccttttctgacagagagcaattctgaagaaccaccgcgtttctgcattcgtagctctccgtatcggattttgtagggttgatttctccgtgttccatgtcccgttcatgtgttcaggacgcggtagacgcatcatttctcccgcagcacccgtccccggagacgtccaaaacctgcacgacccgccgcatcttcagcgcgacggggtggtctctataccgcctgcctttgttcgtgcgcgtgatgagtccctcgccgcctacggtggagtcgaaatgcggtcatttcatcatctcgcgttccttcgaaaacgtatcatttatataggaaggaatctctccatcttcacgtaccggcgttccctggtcgggtgcatcttccctccctcgttcgcgactcgtcagtccagcgtctctcggaccaccacggttgacacagttcttgctcattagatcccgtggaacatagatacaaaactaataggctttttaaaaattcattcgtctgtggtcccgccgtccattcgtttccctaaagtctctacaaaaccagatcctggcaccgccgtcccatcgcgggggtcgagcttcggaaaacggaacgaccctcgcacactagaagaacgcggagctcacgccacctagcgagggtgcttcttttccgttcacccgttggaaaccccggccggttttctcacgggtccactttcgcacacccgaga

SEQ ID NO: 2999 - DNA, 1913 bp, Toxoplasma gondii
agttgtgaagcgacttcgccgccacaagtgtagccgcttattctggccggacattcagatgcatttgcagaccggaatcgcgaaggcaagtcgttcagcatgcaaagaaattgcatactacagtgagcgcatgcaaaccggtcttcgatcaccaccctgcgatgtataaatagtccttagatgattgtatgtcagccggtaagtaattgtcgaccgtgcaagtttcaagtttaccatgaaatttattggcagcagagctaattgagaaacaaacagttccgaattgggaacgcgaagaggcagccgctatcttccacaagcacatccggtaataacacattccacttctcgtcaccatttcatgattgcttcgaagacaacctccaccgcagcgaccaaactcagaaacttcacttgaaaagtgatgcgaagatacgacttaagactcgcaggaaaactctatgttgcatcgtgacacctttgaagttgcgctgtaggtgtccggatagagcttttgcattcgctgggaagtcagcttttttcctgcagggaggaacacaggggtatgcaaacgcttgctgcgagagcgaagagaccgtgtcttgagtttagtctgtttcaatacggggagcacagccacgtccttttctcgtagcctacctcttcaagaagttgtgtattcgcgtatcacggtccttgcggacacgcggagtctgcacttctggctccccttcaaaattttgcatagtctgccgtcccaaaggagtatactggttttccagcctcgtgaagaaagcattagagttgtcaccgacatcagtcaggatggagtaccctttagattacagtattgctaaacactggtacgctccgacgacacacgcgagcgtacaatgaacacacagagagttgttttcgtaagcaaaccgtaggtcgcgcgtgacgatgcagtgtgaaccagatcactggtaaagtttagaaccgctgttcctttgaggggcttgcgttctgcgacattccaaagcctgcgtttataagccttccgttgacaaagagtcctgccactcacatggaccgagcgcgacaagctacttcagctctcttcttagtggcaagaacaggtatcttctagcatattaggcgggattgaaagcaactgcatccaaaactggtggatgtcagcatctatgccatcccttattaatctaggaatgccatcggagactcgacctttaaatacccaaatgttaattccccatcatttcatgactggcgttgtattcactggatgagttgttagttgggtgttcagcgtgatcttcttggctgaccccctcaacccgtagggaatcctcgggcaaaagtttgtggcctcccaatctatattgcatacggaagctcccaccatgcaaactcttcgaaaggggcgtttctgttttaaatgtcttattcctcagttcatgacctatgtcctgcgggcctacattgtctctgtttcgaatgatcacagcgagagcgttagccgttacacaaaccgggcttctctttcggaccatgtgcagccgttgcatgcgttcccgcacaaactcttttccagcttcgcttgtgttttcacctgtcttttgttcgctcctgagagaagaaaactgcccccataattcctccataagggcaatttcgcttgtgtccacctcacaactctttgcacgcgtccgtcgccttcccttgttggtggtctgtccacctttttgactggaaacctgcgagttgaccggacccgtcgctctattcaggcgcaagttgcggcgtttcgtctcttgcctttcgtttttcgtgctttcttcgtcttctgtatagggtctttccttcttttcttcgcgtttccggcctttcgcttcctccgcaccacacca

SEQ ID NO: 3000 - DNA, 2836 bp, Toxoplasma gondii
cctgtctccgtgctgcggatttggcacactgcgttcctctttcgcagactctggtgaacattcttcgccgttctcgacgcctccggtcgtccacgcttcgccggggctgattgtgagactggtggcgtcggttctcgagaaaacgttctctttgtcggatcgaagagctcctctagctccgtagctgccggcctctccgctgcacgttccggtgtctccaggttctgcctttgcgggcgtctggctgccgcgcggtctccacagatccgagaaacgcgaggcggcgactcgcgtcaggtcgaaggcatttttctccggagacaggagctcgatcgcctgagacgcgccggtgtctccatccgagagaacctgcgttggcaggaaacccagttgggcgtcagaggtttctccctgctcgccgtctctttctctgcgttcctggatacactgttccgcggcttcttcagagacagacagacagctgcgggctcgagcgccgaggctgaagacgccctgctcgcgacgtctcttcttcagcgaagcgagcgacgggcgttgcgactgcatgttggcgacgagaaagtctggagacacacagcccacaggtcctgactgcgtcctggggtgtacgtagactccgggggatccagggagcgcagagacgggagcgatcgagaagatacgacgcgcgctgtaagctccgccaggagttgcggcaaggcgcatatctctgtgctctgcactttccctgtttctcgtcaggatccacctccgactgtgttcgtttcttgctgccccgctggtgtacgctcgccgtttccccactcagaactcctctgtcgtcacgcccctttctgcgtctggacatgtctacatctgcggtcagaaagagatctgtcttctctgctcagaggcggagaatcccgcgaccctgtttctcaccccacaaccgatgtccacaaccctctacgacttttcctctcctttctttcactctcttggttcttcactttctttctttctttgtcttgttcctttccccctcttggttcttcactttctccacgggcgtgagtcgcggccgttcttgagaaggaagttgctgcacaccttccggcctcgagaagagttcaatgcagacatgtccagttgtcaacttgctgtttgaagcagttcgtgacggggcagcgacctgttcgcgcccgagcttgcgcggagacgagcgaaaaaaacgaaggggagaagatggaagaagctgaaggcaagacgatgagacaaaacgcatcaacagcaaaaggcgggatgcagagcttttcccacgaacaagggaagagagctggaaatgacgagcgcggcgccaggggggcggcaagacagcgacgcgctgctctcagccgccggtttatgtacactgcacacactgtcgccagatgagagagggcgcgtgcttgcgttcgtggacatgcaagcggaagaattttcggcagttttctggatccaaaaaaggggaacaggcagtgtttgcaaccgggcaccgaaccagctccggactctactgggagcgcaaaatcggtagtcgctcgagaaagacagaactccttggaaaaactcacgccttcttggaggatacaacccggttcgcagtgactcatgagttctgcgtttgaaacgaagagaatatacgcgaaaaaagtccggcgaacaagcgagaaaagaagccacacacacggttcgaccaccgacggatttctggggtgtccgtacacaccttgtcttgtcccagatgagcgcggctttccagccgcggggttctgttggacctagcggtattgtttatctggaaaaaagctttggttcgttttctttcactgtgtctcattcttgttgcgtctgtcaccccgttctccagccttcgaatcgctcaggtctcggcgacacagccgcggagcccgcacggagacgagagacgtctcatgcgccctttcgcgtttttttcgcgcatgcgcgctgtttcagtctcccgcaaaggacgaccgctgccgtttccgagtcgttgcggccgcagcctttttgaggacattcctcgacccttctgtggaggtgtctctgcttttcctctttgcttcggccttctctcgctttgtcttgcctccggatcctccccacaacgtctctcccgctaaacagtcccgacctgcgccgtatgtacaccccgccgtgtctccgagcgcggccggctcttcgtgtggagccctttgagcgtcaagaagcgaattcggagtttctcgctttttccttttgccaaggtagaagttcttcttggaggaaacggggaatcttgtgaggcgagcaaggacgcgaccgcaaacgacgcacctctcttgcgcgtgtgtggccaatgtagtcgagagatttgtcgtcttcctgacgttctgcttcccgaaaggaatttttttctggagacacgaacaccatctaggccgcgggaaactcctttttcgccgcatcgtcttcttttcggtgtctctgttcgtctgtctcgtccctcagttcttgccgcaattcgttcctagtcgccactgtccctcgttgtcttgtcgttcgtctcccccattctttccgactttcggactttgcgttcttcgtctgtcgccttcgatcacggctgtctccttcattccgttactcttcccggttcttctgcgaggcaccccagagtctccctcctgcgaccctttctctccttccctctccctctgaagtcttcctcgacgatttttttttcattcttcgcgtcccgctgctgagtcgcttctccgttctcggcccgccgcca

SEQ ID NO: 3001 - DNA, 2773 bp, Toxoplasma gondii
ttctagcgaattttgtcgagaaaacagactccgctgttttcgactagtgtctttcattgtcgagacactgcaggaaatacagcgaaaaggaacgaatggtttttggcggcgatgtgtaggaaccttcctggtcattgtctgcgaaattgctcgttgcacgccgcccaaaactttctgtgatttttttgttcactcaaaagttgcgacctctgtaagcggcctctttctaggaaccggcaggttgaaaaacttgaatggatttgttcacatcaataagaagataccttccttgtttttggcgtcgaaacaaaaagaacatctgatgccctttcttttagtcgctgtcggtggtgcggagtcaacgcacgacccgttaccaccgtacaactgcagcaaatgcgccccgaggttgttggcgtcaatgcgtctccccggttctttctagaggcaattttatccattccctctatcaatccttctagctgtacatcgctctcctccgtatctatcgctatatatacctcgctgcgtcccgacttgtctcttgggctaggaatgtgtcgtaccggcctccgagctgacacctctcaccaacaatgtcatcacacacgccctcctgatagatctccttgcgcattgtcctggggaggtcgccaagtacgtatgtggtaaaagcgtcactcagccagcatgaagcttccgagtacctcagaccactctgttggcagctcgatcgtgcttctacttctttaatactcgctcccagtggggagttccacgggggagcgactgtgagccaacctagcggtacgccttgcgcttgcgactcagtcaacacacaagcagcatcatggacgaccgccgcgcgctacactgtgttctcgtcattcagtttcgggtccaaacgtcaatgcagagaccatgagccgtcgatccagcgacgaaccgttagatatcaaaaaccaccgacggcgactcaggttgaattctcacccaatccagaatctcgggacaactcacattcccgccgaacctggcatgtgatgtgacaatcacaagaaaatcccgtgcactctcagacctcgcatagaccccttctgatcttgactcgccgctacagtcccttaacccttggaactcgaacctggaaatgttcgtttgcctcaactggaaaaatgtgtcagtgactgtgtgccgaagctggctgccgccgcgtactggaaagccaccgaacagcgggcgtgtcgccgtgcaccactctctgtggtcgagatggtggaagttttggtgccagtttacggttgttagcctggccggtgatttggagactacgacgacagctgtggcctcgcagcgcctcctgagcagacaatcggatcgactgtgtgtgtcgtgtacccacttcagaagggacgacgctgggagtgtgatgcgactggtcgttgcctctattccgatgtgacttcggggagtgatgcggactgcgttccgatttgtttccggttctatcaacggcggcacataggaccccgccacgtgcttcaaccagattctggaggtcaccactctcccatacaaaccaaagctggaacgttttactgcgacagactatcccacaggcactgttccctggcagaaaacacacatgtgttgaagaaaatacaacgcacaactgtctggctctcagtcgtaggaagaaacgaaaaatcagaggagtacgccctcgaccacagcgaacgggtaagcgtacacctgattaatgaaagacgacttctttgttcattcgaacgcgctttaaagttacataaactacctttttctgggcagtataaactaggagttaaactattggtgtacgtctacggtggggacaaataagtttctggtgtgctatagtccttacaaacttcctttgtgtcatattggtaccttggctacttggaacatacttcgtatccgatgcaacattaaaacatttctctgttttaactctcgagcatctcgtaccgtcgtttgtccgagacattcggacacaagcacctgagatttcctcagattcgcgttgacatctgtaccaagcaaaaaaaagtatattgttcgacagggattcacaaaatgcagcgggaagctgaaactagggaagcactagtgaggaacatgcaacagacttttctccaatgaagaccagggctgtctccagtcagccgttgcatgcacaggcttgcgatccgtctgtctctcactgtgaagaaagggagagaacaaatgcaaaaaagagacagaacgtggaagccgctaccataaaagcaatgacacgtttcaaaacaacagttcctttacaaaaatccatttttcttcctgggtagtcctctttcgcttgctcactctttagtcctattttcgcgttgaccgacaacagcgctgtctgcgggctttgaaaacagatggataaaagagagcgaaactcgatccctcttgtgaagatttccgccactgttccccgccgtgtacagacagtttttttgaaagccgtttcgaggcctgtgaagctaatccgggggacaccgaacataaggagacccctcaaatttcaacatgcctcgtttcctctcactatcaaagattgggctgaaactcgaggaatctggttaaacaaacttcatcgccctctcgaactcctggaaactgggtaaacgaatttccccccatttcctcaacactctggaaactggtgaaacctatttactcgcttttctgaaaaggttgtgttcga

SEQ ID NO: 3002 - DNA, 4552 bp, Toxoplasma gondii
attgtcttccctctgtgaaacgaactccgaaggaagaattctctagcttcccagcttgccaagacacagaagaggacgacaagaaagcgcgactcgtgtcccttgtccgacgagcgcgttgcagggatgtgtgtgtgtcatcgtgtttcttcaaggtcgtacaaagcaggacacagtccctaggtctatctgtccgtgtttgtctttcccctccacaaaagtccttcggtacggtgcatccctcttgaagagcagaaatgggggcatcaaggctctgcgggcgattcgaggccacggcatccggggaactccggcacctcaaggaaggtcgtgcgtcggagagaacgaagggaggagagtctcgggaaggaacagacacagaaagagacagtggtactgctttcgtagacgtaaaagaaaggtcgtgacctgcagccgagaaagacgcgagaattccccaaatgatcaagggcagcagcagtcgccctggcctaggtcgctgggagcgtcgcagcggaacgttggaagaaaaatgacgagaatcggaagccgacaaaaaagggaatcccatggcggggtaagggacagacgttcgagggggggtattacccagaccgacaatttctcttgttctcccttccagaagctggtcatttcatcccgtcttcttggcttcgcacgaaccacagaaggccaccaggagaagggagaaaaaacacgttcgtttccttcaccagagtagagcaggggaaaggaagaagccagtgcagaagcaagatctatctcgtgcaacgctatggccgtgttggacagcacaggccctgggatgaaagaaagaacgaaacgactgcacggtgacattcggaaaccttcaagaagtgaaaggtgattagaaagcggcacggcgacggaagacaagaaaagcacggagttcgtgttgcagatctgtcttcaaacccctgagaaggagacgggtaatcgctgtccctcactcattgtcttcttggggagggacggatcacctagattgtaccgttgacagtcgagctgtctcccatcgcaccccccaaaacagactccatatgtctggcacagaaacttccagttgcgggggtgtatgacatgtctgtgccgttttcctggcaaggctatctaggcgagtctttgacgcgataagagtccagaatcgacaggaaagtcaatagaaattgacactccaaggggaagacaggagggcaggagggagtaagtgctctctttccgtgctgcgagtatcgttgctagatctgaaaaggaaaagggattcttcgtggaacagaatgtcgcggaaatggatagagttgcgaacgaaaagcgcataacccaaatcccgtttacacttcatgcggctgtgtcgaaaagtcggcagagctgttgttttgtctccacagtctcgacatagcatggcttttcgcagtgacaattcgtcgtcatgtctcttcggtttccttcttgctgctccctgaacattctgtcttcagttgttttatgctagtgctggctgtgcgacaccgtcatcctctgtgtgctcatcggagtcggacacatctcgcacatgcctcctattcgctgaagctgatgtagcacgaaattggcgtgtctcgtcgttcccattcccgaattgctgcctctattttttgctcccaaatcctgaaatgcctgttctctgttaaatagagaaccaacccctccgcatgtttgccttctccaccaacaagcgcagcaagggctgttggtgtcttcggtgataatattcgcacaggtgtctcatcgtttttttagaagcaaatgcgtgaagagcgtgaaaatgtcttgcctgtagatatgtaggcagatgatgcctccagatatcaaaatatctgatctgttgggtccggtaactcaaaagaaagcgtgcctctggaatctggggatatcaaagaggttggccggttgtggcatccgtgtgttctgtcattctgtccgacgtctcacttctgaccacagattcaacgtttccctgttcgctaacgccacgcaaaccagagacgtctcggtggaagtagcagtctatgagttcggagcgcacacgctgcttagctctatcctacacttaattcacatttctttatgttgattcggcagctttatttttcggatagtgctcagtggtatgcacctggtggtggtcattgtctttagaaacaatacgacgaacgaagtgaatggtaaacacaagcgctgcttttctgttttacctgaagagacggaccgcgaaagctgtgccagaaagttgagtggactcttcctcacctggaatcagccatttgcgtctacgtttctgggtcgcagttaatcctgcaaagaaggcgactttattttaaagaatgtagacaatatggctgtggtcggcagggaacggggctgctgtgatacagcgtcttcggaggagaaaccaaaagtctcgggatggcgtgtaggcttgttttcggtgacaccgaataaacgtgcatgccacctggctgaagaccatgacagacattagggattataatagttgtctgatcgcgccacgcggtaggcggacagccaacagactggaaaaagtagagaggaacagtctagtcgctaacgtcacctgaagaagatcgtgtctttccttgaacacccggagggtttttcgaagccagtggcgtttgcggctgctgccgcgtcgcagttgaccacctcataaagaaagaagtttaaggctcctttcaaaaaatggactgcatgcttgaggaaatgttcactagctaagctgtggctgcttgtgtgtagatcaatacctccatatgggcgcgtgacagttcgaccgaggaacgtggactataaaacatgttgcgtcagaactcaagacatttgattgtcagtgtaccggcgcgcagcgcatttgattgtcagtgtaccggcacgcagcgcaattagtctaataatcgtggtgatcctgtctcattcggaagaaagcaccgcgaaacaaatgattaagttgtggtgcagtcagcgcttgcgattccttaccccatcctgcaccgtgcaagttatccacagataagcaacagagcgtactagagaagaaagtctttgttatggcacacaggaacaaaaatattatctgggcgatggtgctggctttggctgactcatggcgggtgctggaacgagcgtttgtggaggaggaagtacattacgtacaatttgcacactaaaacaaatgatgaaggaacgacgatattccgtcggtcactaccggtgtgtttgtccacttcaccggcatggtgagagaaacatccaggggtctcccccggtacttcccacgtttaaaacgcgactaagcggaggccgtgcgagttcgacgctatggaccagttgattatcaagcttacctcaagcctgatacgacaccagaattcgctggcctgcagcacagcgaaatgtcacacaaatattgttttaccattacgactgtatcgtgaccaaaacaacggcaatttggaaagcgagaacaaattcagtgcgccttgaccacctcgtcctaccgtgttgcgttccaccacaatacatcacgcagatgccgtgcacactgtaagtgctgccactgtcgttgtcaatcacactgtacgtgctgccgctgtctttgcaaattggaacaagtcaaagcacgaggagggcatgacagtatgactgagaaacgtcacttttcgttcgtcatatcaagcagcatgaggaaggatgctgtctgtgttacgtgatctcatagaaccccttgcggcgaccgttatctcatgaggcagtcgccctcagagtacgaggatggaaggtcagaatagtagacatgaaggggtgtatagtttttgttgtactgagtccagtgatgacgccgcacccgccatggcccggtctcaggaccattcaggtagtgctacgatcgtgtagcatttccggaaaaaagcccaaagctcggagtaggaagccacgcttcacgccctcaccagcgacaaagaagtgcccatagcaaccgctgctgttagctttttctgactaattcattacgaggaagcctagcagcgtatgctgcgatgactatttgaaaactttctgcccagtggtcttgactgaagaaacacaggcgagacatgcaaccgagacgcatgcgcgtgacccgtctcagtcttcaatgcatgtcactcgttccattgtactagcgtcagcgtgagttttggcttgctgaactgccatccactcactggcggctgcttttcctggcctgccttggcgtttgtctcctacagctttccatttacgttgccgtgtcgtccagttccaattgtttttccgcgttgttctccttacactggtcatgttgcggagcaagtaaaagaacaagtcaatcatccggattttcctggcgggtgcaactgttctcttgtttttcgtcttttttcagttgagtgtagaggacggtctgaggtggttctttgaaccagagcaaaca

SEQ ID NO: 3003 - DNA, 2675 bp, Toxoplasma gondii
acaacttcaaagtctacttgcgcacccggttcaagaaagtctcctctgcaaagcccaggtgagaaaggaagttgctcctgcacctgcaccccgcaaagccggagaaggccagcggactagacctgaaagagtgtgttcgagtctgttggatctggccaagttttagcctcgacaacaatcgagagtgaaaaacgtcgaggaagcgtcatttagttctctcgaggtctgttccgcttgtatcgacgccggacgccacgtcgcccaacgtcgactgcggggacagccttcgtgctgctaagcctcgtgggcggagtgacctcctctgccgagcgcgcggaaagaaaaggccgacagagcaaaacacagagtgctaccaccacggtcggggttcacgaagaaaaaactaccggacgcgattgtctccttggaagacgttcaaaggtgtggagttccctgtgcgggaacgctaagcagaaaggaattcgactcttttgagacagtctgtaggagctacggacaacgcagttttctgtcgcggctcccggggtcttctccgacgtggggaatgccaagaacagcgatgcaagaggcaaacagagtctgcggtggatgcacccgtggtaactgaaggagctcagtattccgtttgtgcctgtcgaccctgttgtgattcattcgcagagcctgtcgacaggaatcgcgggaaatgtatttcgtctgccaacacttcgtagggcgcgaccgtctcgccgaagaagtccaactcaagggctgcttcaccggaaaagaaggctttctgtgacctctcgcgagacagagagcagtgccaagtggaacggacagagggggggatgtatatgtggtagtggcagttcattgtctaggtacgacatttcgttcctaatgccggctttccacggagggtatgggaacttcgtcgtagcagtctatactgggtcgtttctgtgaaagcgtacacacaagaaaacagcccggtgcggcctttcttgtctccttcgcgaaacgttattcacgtgttcactgtcttgtcgcgtgtgccgaagacgcagaccgtgaacgatgtgggggcagccttgctgaagatggtggaactacgcaggtggactgctggtttttttccgctgtgaagcgtcctggttcgcttttgtccataatcctcgttttttgcgggaaaaagctgaagagggaagaaaggcgacacgcgcttgtccgggtacaagacacaggctgagagcgctgcccacgttagagttcgacgtctttccagtcgcagacatggctatccgaggcgcctgtgtgcctctgcatgcagcctcttactttccctcgagcgaaaacaggtcctctgggagttcagtagcaaagaagcgagggaccacgacggctgcgttttggcatggccagatgtatacagtgtactcttctggtggcactgtggtcaaacaccccctatgtcgtgtagagcttccgtgtacccgacgaaagtaaaaaacagaatgctgtttggcgttatcgcatttctgaactccccttttgctagccagtaaactcactgcagccgttggcggggcgctgagatgacaggcacttttgattcatcagaaaaaaaaattgagccgagtccctgcgacgtgatcgtggcaaaacggtgccagggtagcccgcgtttcaacaagatagaaacgacaccttaggtccgctattggctagcgtctttttcccagtctctctttgagtggagtctgggtcggagaacattctgctggtttaggctgtaagcagaggccgcagacactgtcacacagccacacgaatctgagcgtgttccgggttaaacatataagcaagcgctctaccgtgttgctttctaccccgtggacaaatggagtgctcccagatgaagggatacgaacaactcgcttattaagtcatttatcccaagggaaatcatgtggaaaaggcctctcataatccgctcccacattcaccagtggagccacatcccaccagacaggaatttccaagagcatggcgcgagactgcttttgttcagtacgggaatcgcgtccgtcagccagccgatacgtgcgagaaggactgtggcttctgcaccgaaggaactctgttcgatgcttttttctgcggtcgctgttttggggttcagaacagtataccggaactcatgtcgccgcatgggctgtcgcgaggtctcgaccactcacaaactgactccacactgacagaaaagaggaagcattccagaatgtgttgtatatattccgtagtgtacataaacctagatgacgggaattgcgaagcctgtgcgtcttgattcgagcggcgctagcgtccttgtgggaccagacgatttcagtgctttgacttgagaacattttacccaaactacgacaagcaacgagctggccagctttgctgcctcagaaggcacccagtatggtccaataacggcggctgttaatagaggatcgtcctccttgaatgcgaaccaacgcaaagctgtgatctgacgtgtgcgtcgcgaactgtgtctgctactgggttgccgccagaggcgtggacatgggggcgccgaaggccccccgacgttgtttgtccatgtttgtttcactactagttttgtcttgcgagtttca

SEQ ID NO: 3004 - DNA, 4728 bp, Toxoplasma gondii
  misc_feature (4256)..(4275): n is a, c, g, or t
cgccgatggatactctgacggacactgaaatgaggttcaaacacaagtctcccccttcacaactcgctgttccattttctcgttttttccgttcaacgtgtactgtgccgactggacggcatcgacaccatttgtcctcgattgtgtattgtccttcttccaaaacgccctttccctactcacgtcgcaacgcgagtctaaatttgatgcctcgcttttctgtcgcgttctagccagtgtgtgcgttgatttctggtggttcctcggccacccctaaattctctgcttcctcttcatactgcactcgtgtctagtgttccagtttcctctttcattggccccgttctcgtcagcgtctggctgctggagtgccgatacgtttgtaattcttctatgcttgttcacacaatgtcgccattcccgatttgcatgtataccttcaagaatccagtgcggatttcgggtcccttggtgtccaggagaatcgccaagcgcgcttcaggtctttgcttcatggcttcctggatgttctggacagtgcgtgcgtgtgtttcgtggtcgccgtgcgagaagttcaagcggcagacgttcatgccagcgtcgatcattttgacgagggtgtctacgttccagcatgcggggcccatggtgcagacaatgcgagtgcggtgggcagtccagtcttcttcggagcgcggctccagaatctgggacatgcggatgttcgtgctttttcccagctgctgagtcatcacagaactggcggacacgaggcgggcaacgcggccgctctcgacggcgccggcgctcagtgtctgcggttgtttagatgccattgtgataagagaggagagcaggtaaaaagtcaaaaagcccaagcaaacagttgtggcaggaacagaaaaaacgcagaaagcgtcacacacacgaaccgacacggagaggtgaacaaacctcagtgacgacagacgctcgcattcgaaagtgttcgttacgggtaaaagcaccagattccgcacacaggcgagaaacggaaaaaagggtagcacacgggcaaagtgttgtgtggaactgcaatgcactggagtcacgtattcgacgcaaaccggttgctgggagacagcgtgtcgacgcgcgggaaacgcacacagcgggcgggcggatgccgcggaaccgaaaaaaaacccacgcgacgcaagatctccccgcgattctctcccaccgtaccccgttctcgcgtatcgtggcttatgcgtccaccccacgctgtctcggctgggcacagttggactgctttctagaaggagccgtcgaccgggttatcgcaagtttgcaccaagctgtcaattagtatggcatttttccacgtccattcgggtagagtgaaaagcagggcgaagaggcagcactcgttggagccctttctaaccgggtggttctgtgtatcgtgggcgtgtcagctgtagaagtcagttgaaaactagctacacgaacaaccgtccagtttctggtgaacaaaaaatgatgtgctcgacagctacccgcaatgaagtaggcaatgagcaccgcactacggcggaaaaggtccgcgtctgatcggcaggagctcaacaagagagaacatatttcttcacgtgtcggttggcagtataattctgtcctgaaaacggataactggcggcatttctgtttatttgtgaacggccggtccgcggggtcacgcgtgtctgttctgtctcttaataggaaactgcactaccggaactggactgtaactcaatcggttacagtgtcggggcaaaaattcctaccacaataggagcctaccagggagtgtggctaaattgacagccaagagagctcagcaaaacacgtatcttctgatgagacgcaattgtgcggcataaggaggcaccgtgttggttgaagttcttatgtgggtaccgtgcccattcgtctctctaggttgcagttaccactatcacacaacggttggcgattcttccgacagctgctgctaccacgtgagggagtcaaaattgcctagtgcggctgagatcacacccctcaaggacacgttgtgagaggcaagtgtgcagtggcatagtctcaatatggcggtgtcagacggacattctggtggcgaagtaggtcgttggttgaagcgaccgctacgccattccctactctttgtttttactgtgtcgttcacatggttgcactataaggctcaagctgtcagcatttaggaacagaaatctacctgaaagaggcgcagaggactccgccgccacgttggtcagcacgcgcagtttcgggtcatccgcttgtttccgagtcaccagtattcattcagatggcaccgaaggttctatgcgcaactcacagtggtccatgtcacaacttcacacacgagcggcgacacgttccactctcgtgcctctggatacatgcaagagatgatatcgacaagcttgccgacggactgcctaccttattgaatccacaagctctttctcctgagtgagccgccgtggaggcacgagtcgttttacctgactctacagggtatcagtcggagactcagaagaggcgatggctttgcagaagagatttaacaggttgtgagtacgacacctgacagaaggctggccttgcttggtggtgtcgtgcacggaggttcttgtcattcgctctccattctatgttggcattcttttatgacacccgctacggcacaaacgactgtacatcaacggttaaaacactgtgatcgggcgtatgtgtttctttccgccagtgatgccacacacgtaatatttctgaagtcgtgagggagactcggcatgcaagtgaggcctctccgactagtcagatactcttccatatgaggggtcgcccaaggctacattcacgtccacgaagatgcccataacgaacatttggtatcgatgtgacgatttacgctctgacacaacagcttctctctagtgtccgagcttacaggggtggctttttttggccggtccgatggacgcagtcaacttggtggatggatgacggactcgacactcacgcggtcgcatagtataagtgcgcttggcaggacctagttgcgatgtgtcagagaaaatagcgagtttctgaggatttaaagagttctcttaatcttctgcttgatcactagtggtggtcgaacagttgactgaagtcaggataccatctctgggtatcgagccatcacctcactccgagcgttcgagaaccgacatcatcgcccaatttgcacgaccatagacaccatgtcgacttgtatgtttcgtgttcttcctgaggtaatgtagcgttggctgttgttggccagctagaaacgagcgcacggggaaaagccctggtgagtaattccggttctaaggcccggcgaatagccggaccttgcaggcatacgtggcatttatccacgtgactgtggcttgttgccagtcgtttcaagttgagacggcgatattcgcaagaacgcgcgtgtagccccgggtgttgcccctgaggggttagaccgagcctgtgggttgacttccaaaacgtggacggggtttgtaggtcactctagactgtcactctttgagagtggttgcatttacggggaatcgtcgtcggactgtatttacacgttttcgcaacacggcagctatttagtatacagtctcgtacggatgcatccgattaaattccgtgcgtgtctcttacccagcaaaccctttttcgtgcgggaaggatcagaggtccccacgttgtcggcaggcactgatactagaaggagagtgccgtttgtaagtgtatcgtccactgtgcatgcaaacaaagatcaaattcacaagttgcctaactatgagaaaaaaatatccgcgatcctgacaatgtctcgttccctggagctccggcaatctcctggctcagaggacggcgaagtccccgctaacatcgaagaggacgtcctacgtgagatgaagtggttttattcccggtgatgctcatctgcctttctagacaatgaatacaacaaaagctgccgcatttgatcggttaaaaaacgggctctgccgcgtccctgaagtgatgagttctccatccagacttttccaaaccgcaagctctgcaacgattcatgttgacggttcttcttgtcaatcaaggaagccaacacgctatatgaattcacgcggacttctgctgcaatgccgggtccccccaaaaannnnnnnnnnnnnnnnnnnnttgttgtgcgctcggctgtttctagtgttgttgcagtctgtgattgcccggaggacgtggttcgaacaaaccttttcaacgctcaaaaaacccgggggcgctcgccatgcattatactctgatgtgcgttacccccattgattaaaaaccctcgggccattgattcatagagaagcttgagatgccgttaagtcggtgacgttgcgcttcagtcacagccacagtccccttctcactggaatcgatcaccagggttggcgcatttacatgcagatgaaattaggtgcgcgacataatcatctgggcaaatatatgcacctctgtgcgacagcaatacggcgtcgagcaggcgccggccagtctgtccacctggccgacagaacagtgagccagacagtgagttccggcatgtgagttgcctcagcggcagggggtggcttcaatttagcctga

SEQ ID NO: 3005 - DNA, 2401 bp, Toxoplasma gondii
gagcaacgaaaggtgcctgagcgtgcacaacgtacatgcaaagaaaagcattccgtgttgcggctcgaagggaggtggctgttttcctgagttttgcatgcactcgatcagccatcctgatactaggcaagagacacactgctacggacgccgggatgaccccccttttctgtatggtacagacaatcctgaacaaccctcggtccaggtttccacatacaatgaaaaatcgaatgcccttttcgttacacatcaaagcaaagaacgactccctcttctagaagtctggttgttcactaccttttttatcgcgtttcgtataaatgtgtgacttgatcagcatggcgacaagaatagtccattctgcactgcatccgatcccactctacactaaaaaaagccaacatatttcttcttgaatcggttctctgtctcccacattgtttcttatggctgtttcgtaccctcttcttcacatgtaagtttcggaaacgatcgccttgtcggctccctaaatacgaacaacagctatacgaaattacaacatacaaactgtcaaccaatccttcagcgcctgctccgtgaaacgaaattcagaacaatctgcccgggtttgcgctcgagggaatgatttccgcaatacggtgaaaggctcaatatgcagacatccattttccaccgaaggcccaactactgcagatctaaattcagcgggggtttgcttgggagttatgacgcaccgaaaaaacagcgatgaaaactggatcgcgccactgattgtactgtcctgatgagaacttatcccctgcaattttcgacgcagcatccaatgaatgctggcttgcaatgctaaacaacgtccaggtccaaagaccagcaaggacgagagcgatcgccacgaacttcttcccgcgcgacatttcctaggtcttcgcaacagccactcaacatggaaaagtcagaggagcggtctcgcttctcttacagcggaatgtcaactgtccttgctcgtgagtttggccttttgtgggtttctctcccgaagcaatcaatccacgacacggcgagaattgcgagcgatcaaaaggcaacttgacaatagaaaagccttcagtggcacgcgatacaacaaaggagttttagtgtcaccgaatatgtcgagtaacgcatcggaaaaagacaaaaatcaccacaggaagggaagcacacgcactgggtagtgattagtcgtccgtggtgtgtttcctgcatgcgcgacagatacgtaagggagattcttgcgttctgttaaacggaaatgacgaagacgcgtctccaaaaaactcaagctccgtaatggggaattcttcgaacaaaaaaaacggcaagtgccgttggatctctgtgtgcattcggcggcagaagtcccacgagaagcggcagagagaccagcgactggtaggacactcccgaagaccacagccccagaggcctctgaaaaaatgtagataaggactatattaaatacttcgctactttgcttcccaagaaggaagaccgcaattccctcgttattgccggaaagatggcgggggtaatgactgtgaagacgacgcggatgcctaacatccccccgtgtattttcccaaagacttcatgctacacgaagctcaatgttcgcgaaacgccagtagatgagaaaaggtttcaaacgaggtgggaacggtacgctagaaagcgtggcggtgtgttcgccagcacccaagcagacaaagtgcatgtgtgagtagatgtctcaattggtagcctgccatgcggggcagtcgtttccggcaccgctttatagaacaacatggcaccgagaaagccccttttttctaggatctgagatgtgctggagttttcgttccttcccacatgaccgagaagattgctaccacttgatatccgagaagtttagccgcggaagaggccaatgttcaccgtaaacgaagatcagtagggtggctagccggttaagagcgattcactgtctatactggctgggtgaacacgaggttactttttcgcggccatttgagacaagaggctacatcacaggtagaaactatttctctgtggaagtgaccacagtctgttgccgctctcgctgcaaagggacacccaaggcatctagccttctcttcttgtctcactatctgcttcgcttccagtgtcttctaccccgttaggttcgcggcactggcagcagccgaatagtgctgcctggtctttgcagtcctccagtttcccatgggagagtgtcattatcattttccttctgtattttgcggaggctgcgagacacagcttcacaaagccctgtagtgcgcggcatctgcactgttcctggggcttctgttgcgtccgtcacctatcccga

SEQ ID NO: 3006 - DNA, 1717 bp, Toxoplasma gondii
ggcagcagaggaagtccgcgaactcgtgagagtagaaggatggagcaagcttgagaactcgattgaagacggcgacgtagaggccgcggggcctcacgcccgcggcttcatagacggtcaagagttgaacgagatgtcgcggctccaaggccgacagcgagcgaaggaagcaaggtacgaaggagaggaagagctcgcggtcggtgagacccagcgaagagacagcgcccaagaagccgagagcctcgaagaagcgaaacggcgcgacactcacgtcggccgcaccagactccggcgaccggttgacctcgattgcgcgctgaatcatcgaactccagagaacgacgtcggtgcagcctcgagccgcgaggttcgacgccaactggtgcagctgacgcggagactgacgcttgaagtgcctacgcgaatagtgcggaaaagaagaaggagacggagacggagaagaagaagcaggagaagaagaggagggagaagaagaagaagcaggagacggagactgagaggagggagaaggagaaggagacggagaggagggagaaggagaagaagaagagaggagagaagagtagcgaagggaggaagaggagaaggcggtcaggagaccccagcgagggagcaaaggcggctgagagacgcgtgagaagggtgtctgagagagagcaacagcagatgacagagcagagaaggaagaaactgcactggacggtggcaagagatgagaagcgtcgcccaggtgcgtatctgtcgaggagagaagaggactggacgtctctgaagaagtcgcggccgaacgtgagagagagaggctggggagaagatctgtgccggttttctgttgagagaagccacagacagcgaccagaccccgagagaagcagcggccagcatgtcgtgttccgcttttcctcactcgctgagcgaagctggagagagaagacggcttcattgtgtgcaaaaagaagagcagatttccaaagaaagctcgccgtccaacggatcagagacccgagcgcgagagcgaaaaaaggcgcgagcgcggcttcgactcagaagaaaacggcagcgcggtctcgagagaggcgggaaaagtcgaattccctggaaagagcagatcgggagaaaggatgtttgtgtgtggatggcggcgaaaacacaaggcggggatgcagcgcgactcccgaggcttcggcggctgtttttcgcgctttcacggggcgggtctgtcgatttttgcgagacaggaaaagcggcaggcacagatcgacacagatcgactgagacgcaaagtcgtcgctcttctctgctcttcatctgcccgctcagcgcagcaaagggacaaagcgcgcaagagcgagtgcgacagtgtctttctttcgcggaggcaacactgtcagaaacgtttttaacttttctgaaaaccatgctaaagtgccgtctctgtccggtgcagcgactttcttttcttactcgaaagcgcaaaccagccgctgtctctcccacagcgtcaatttgagtggagaagcgcgaggcgagtgcgtgggcgggaatcgtcgcggcgccgcggatatttcgaggaggaagatgaagtccaagaactatttttaaattcgacagaccgacagcttggctactctcgtggtgcctttttcgtccgaaaaactcgcctttctctcgacgctctgcgctctgcgctgca

SEQ ID NO: 3007 - DNA, 2492 bp, Toxoplasma gondii
gggtaagccacaggtaaacagcgcgtgagtgcagacagggacccacggcccacaagatttttttcggtggtgagaggcaagtttaccgtttttttcttaaccagtttctcaactgggtatcctggctgtgaccaccacaaagaacagtgctgctaacgcgattagactgagaagagttctcctccttggcttcgttctatgcatgcagccacgaaaaaacagttgcaaaacaaagtgggcaaaaggtatccacgaagacgttaagactgttttgggagaggtcggtgagggacagaaactcctccttgcacggcagagagagaagcgaccgtgcggcgatggatcttgcgcacctctcgaggattctttggagaaaaaacagcgaaggttcccgtcagtaaagttcagaagagacagagaaacagctctccttgctcttgagaagtttaaacggttcttgctcttgatgagagagcgacagccggacgttctcaaaactgcatattctggggaaagtgaggaaacgtgagaagaaaggcgccgcagaaaagagtccggtgacacgcgcgcccttccgactcttttacgaccctcagaaggtgaaaaacagaaaccgtggacgtcttcagccgcgccaaagcgccaggcacacactcccacgaagaaacgcggcacaattcaaaaatctctcgagagacagatgcgcctagatgcggaagccgagggaaaacgagtgactgaagtctgtggtcgtcgtccgagcggcccgcgctctctctgtcgagcgtgcagtgtgagaccaggtgacccgcctcttttcgagagagtgcgtacacaacgacgaggggagtcctgacagaaacggtggagaactgtcaggaagaaggcacgagggaattcgtccgcaagaacgtcaacaggaaaggcggtctttcgcggccgttccccgtatcggtgtggaacgaaaactgaggggacggacgcgcctaaagccgactgtgctgagagttcgcgaaacccaggggaatagtggaagaaaaatcgttgtctgagtggttactttccgctagacaaagagggcaagtgccgagacgaactggacaccggaaaaggcaactctacacctggcggacggatacgctggtagcaatcccagctccctgtacattccggaacaaaaagcaacgacgacggggaaggaaaaatgtgcacatgtcgactagtgaaggaccccgcaagcgggcgaaaaggaaaggtttcattttcgcgcctcttggctctgctcagcttgtcgaaaatcgaaacaaaaagctcctgcctcctttgcatgtggcgtacttccccgtataaggcgcctgattttctggacgatgagtcgttggtcggcgaaatcctcacggaaacaagtgacacatgcggcaagagaagtcaaaaacgacaagagcaggtcgtccttcagctcgtttatccacgattgccaccttttcgcgctctctcactgcaagggtcacccgtcctgatgcaggacccttctcgtcgctggcgtgtgttgccgcccgcgactttcacgtttttcgctgcacgacacgcgcgcgaactacgatgcctccgagaacgaccgtgtccgacgcctctttaaaacacactttagtcccccagcgaaacacagacgccgcaaatgtcctggctctgtcgagcggtctccacggacgaagttctccaacttgcttcgcggcaactcacgaagtgcatgccgtttcagctcgacgagaaagccattgcgtggccggtagaagcgcggcagcgcgcgaattggaaccgctgaaacgggcagtgcacacgttcacgtacactcggcaaatacatctccacgcacgcatatacagatttcttctcgtcagaacatgtacgtgttccacgcatgtacacaacgcttctctagcagagcacgcgtccgacagagagcgacagcgaaagaaagatacttatctgatacatggtcgtctgggaagacgcgacaaagtctgttggaccggcatgtgacgagcagatgtcttttcgctgtgatgccaagagggaaaaactcccaagcgagtcccggcaagcgtcacgtggcgggttcgccgacccagaccttgagggcaatacagtgtgtgctgctgagccttcactttggtttccgcaccagaaacagctttctgttcaaggaagtgcgtaaaagaccccacggatgaagcgaccggagggaaaccgtactcaggaggataacccaccctgcagatttctctgtctgaggccacacacgcgtcaccccgggaacagccttcacccgtccaaggcgtaaacacagaacgtggagggaagagtttcgacgtttcgaatctgttgaggccggaggaaaagcgcccattaggtgcgcctcttcgtctctctccctgaatcactcgagagacggccgccacgcgaagaaaagccacgggcaacaaaaaaaa

SEQ ID NO: 3008 - DNA, 2429 bp, Toxoplasma gondii
cggtggactggtccgcccggctgatttgagatggttttgcgtcctggcgagtcacatggtgatacacgccgtccacaacgacgggggaagcctcagcttcttgctcatgctttgcgatacgcactgacgaggccacatgatttcgggaaatagatctccgcttggaaacttgaaccccatccaccaccttgagcactgcaccatggacagggacctctccccgacctcgcttcaacccccacaagtgaggagggcagatctcgattggcatttcgacttgtctgttttccagggcctcgccttgggcagtcgatctgctgtcgcagccgcggtggctgtcttcgtttggcggtggaaggcgggttagactgctaagtttgctaccatcttcgaccgagcatgcgctcacagccagtgcctagaaaaagcaccacacacaccgacattctcattccataggtggctctacaataccgcgctgcaggatgcgaacaagcggaagaagcctctcccgcgacacagcggtttccccccgtgtgcacggcccatggcaaatagtgtagaaacagtcacataaccctccttcgtatacagcttcgtttgtgagagggaaaaggcgttgcggcagcgtaccgaccagagaaacgtactgccgagaaaaactgaaacgaacaaaaacttacggccgcagtttttggtcgccgaggcatcgatgatgttaagccttggacttcctggacagcgacgactacaggcttcttcagagcgacaaagtgattttcgagtttgcagttatcaagggaaaaacatcagcggtctagttaactgcaactcgttgtctcaaaacaagcatcagcgttggcttgcgatccagaggggttgtcctgctaacggaaaaccagacaagagccgaaaacaggcatgtatcgaacagcaagagccagccgcgaaactgcataccaggaaaggctcttggtcacttgaaggtgcggtctgcctttcttcctgatcagaggggcaaaacggcatccgctagttgattcgtccatcggaagcacgctggacacgaacacgggagtgtgcggacaaccggtgatgcagccatgtgggtgcctttgcatctgtcggagcatggaaagagaaactaccttcaacaggtgcaagagaccttaccttcgtgtccttcggcgacacatttgcgaaatcggggtgaagatatgccagcgaccaccacgatcgccacatgaagacaccaacacactgcaagcgagggcggtttctgccacctgtgtagccgtacgtcgcagaaagtccaatccttttccgaatctcaaaccgtgagtgcttgtccgagatgctgcatttaaaaggaggcaacttcaaatgaaacggcaccatggcgtgcccgaaggattgcacagcgctcgctgtatagacgggtcgtggtcttagaaacaccggagctatcacttcaccattaggcaaattcgatcgcaagtttcatattttgggtggaatttgcagtacaaatagaattctactgaaagtatgaactgcttggtcctggatggtcatgcacccgtccggacgcaatcctggcagcatccgggcaaatgcctcttcctggggaaaatgcggcgccccgtgctgtgcgttaccacagctaatacatgcagaaaggagctagttaaacaaaggggtagaacagaagcggcactcgaatggtggtttccttttgctgccattttcttacaggaagcgagcatcgacggcggacacccgtcaaccttgcgacacacgggattggtcaacgctctttgcctcaggcggatgtcttgtccgcgcgtgtggcggtcaccttggctggttccagccggcccaacgtagagaagcatgcgacgcgaacctctttcagtaccgctctagcttacgctgccagctaataaggtagtgttcgcggggacgattgcctctctcgccagggttcagggtcgtttcgtgaagagaagcgtaattgtaccgtgtctgttgctgctcccaggaaattcgtgaactgagccggattcatgtcggcacgcttgtctcgcctctcagattcggcatattctagtttgccacattgagttgagggttggtgtcttgtccagacacatactggggctgaaggcactattttgaggaggcttagaaaataattaagcggcttcgcgtttgggggaagtggtgacttgaactgcggcgaaactcggccagtggaagttaaagatggttagagtcgctcctgtggcaaccaagggccgagccctgacagctgtgcgtgtttgctgaagaagctgggcgtcatgtagtgaagaaaacttacggtgcctttgatgtattagcgtcaagtgcggagtttctcattttcaactgtgctagcacaggccaca

SEQ ID NO: 3009 - DNA, 2436 bp, Toxoplasma gondii
tttttcggtagcatgcgccctcacgcggtccacgacgaaaatacggtcagcacgacgctccttagcggccgaatgggggggggggttgggtaattgagcaatggcggcggctaccagctctagtactgaactgctctgattgtgatgcccaagtgttgcatgatgggagtcatctgatccgtttgtttgacgagcatccggtgaagcaaccacacagcaaatctcagtgtatatttgtggagcggaagaagctgtgtcccatgcatgttactttaagtcgtaagactctagcaacataaagtgaccacattcgcgtttacgattctgatgttgtacgagcacagtcgtgcattccctgcagaaagacacagcataaaactgggcgcaacagtcagcgtttactgaggcaaacggttgcattctgagccaactactttccattgccgagtcatagtgtctgtgtgtttcctcacgtggactagtagcagcagaaatgcgaacagtagtggaaatgacctttacggcaacattagtcaattctcttttacccaaatgactcgggacgtgtgatgtgggaccgtaacggggccatggtgccccggttcatccatgcacctgctgtaggtgaacgctggcgtagcacgcttgttgcacccaaaaatctccgggacaggcaatcgcaaacgtacaccgttagtaggttgagttgcatagaaacacccgtaggtgggggtgctagaacccggtaaatgtaagtagaaaatgtcaaactagtataatacaacctagcaatccttttaaatggagactagtaggattaacattctgtcctgtgtacacgacagagttcgacctgtttactatcgcggagaacttcgtggttttgttggcttatcccgccagcgtcgagtgtcgatcagtgacaagatcggtgggtactaacagcgtcgcctttcccaacatacaaatccgtagcatgtgcggaaaacttatgacggttttatacgttgatacatgcttctgaaacgccgttcgtcaaaagctgcaaccttggtcaaagttgtgcacctacgaagtcctttttgcttttatgcgagccggttcgaacgcaccgatcgattctgatcagcgtcacctaggcatcggacgatctacgaagagccgctatctgttcattccttactcacgtgcacttccatggaggatattaaatttgccttggcggcacctggctgattttaggatttcaccaccgacacgtgacgtttatgtgtcgggggtcaaggtgggttcacgagtcgcggtgtcagtagcgcgatagccacccgcttccttactgagggttagagcttcggcaaggcacacgcgttgtaggttggacacaaactgatttgctttagtgagaatcgagccaaatggcaaacggcagtcccctccgcgttttgcgctgagaccgctcgcatgcaagactggtttttggacctcctctgtggagaaggttttgagctccaccggcgtgctggcgacagagacagaactggcacgcgaagagagcgcgaagcttcggtgtaatctctgttttctcgcgcaaacatctctttttctccggtcacctacagagataatcttttcctagagcatgtagcgacgccaggacaaccgtctacgccgtccgtgtggtgtgggggttcatgccccaatgtcgtgtgcgggttatcttccacgtctcttagtgcccgtcgcttcgcttcgcgagcttctctttccgctttcactaaatcggttgctgcactcaagcaattcaatgtagaggcgtctttggacgaatggtggcggtgtctgaatttgtctgctcttcacgaaaggtgtggctctttccatgatgcctgtcgaagccatctgtggccgacagtttgggctgatatccttttccggcaggttcgcttgacttgcagtttccgcttttttgtgaagcgtgaatcgaaccaaatccttctcgtttctgccttcttgctctgtaagtgcatacaccgaacgggacgcgcctgtgacacgtgctgcggtggattgcgatacttcctgaatcacggcattgcgttgtccccgtgtgtttgctgtcgtgtctacgcgagcaaggggaaggaaagagattcgttgtgacctcccaagagaagccgctgtctttcctgctccaggcgaccgaaactctgccgttaagtgtctgtgtcgtctttttgggcaaccgttccgtcgcgtttctatgggatttcgcaaatgaatccgcactaggtggagtacgggtctcaaagcgccaagccagatggtgatgcatgcacttaccatacggcaaaggaaatcgttgcctttctgactgttctgtgataccctgaggcagcggcagtggaccgggtgaaaaaaaccggcgacctcaggaaa

SEQ ID NO: 3010 - DNA, 3951 bp, Toxoplasma gondii
actccgttagtaaggagcatcctgtatacgccaccagacaggcaacagcgtaggagggcgcactggaacgtcgagtttaccgtcgagtttaccgtcgagtttacggactccaccctccggcgttcttttgactcactccgttgatgttcggacctgtcgcgaaagacgccagcctgtcggggactgagtcctccagaggctcttcctgcttttgctccacagcttgtcgcaggtgcgccgtcgcgattgccttcatcgacacctgcggatgaggcacagagtcgaggaagtatttggactcctggcgtctggggaaactcttgtatctggagtctaggcgctcgggggctcctcgagcattgtcgggactcagtgggtcctctgtcgacgacgacgcactgttctgcacttcgggagctccttcgacgcagcgacccgaaggggcagagaacagggaggacggagactcggaggcagcagagacagagagagacggcgaagacgacagaagtccttgctccggcgaagcctccagcgcggagacagggccgacgagtggggactcggcttccgccatctggtcctcgcaagcccgtgagaccagcaaccgcgaagctgggtgagaaggaggcggctggagggcgcgcctcggccgtgtctacctacggaggcagacgcggcaggggaggcagcgagagcgcaggcgaggaacgaagctggggcaacttccgcggcaacgcgaggctcaggaacggcgaagaggcgcgcgtgcttagcgagcaaaggtgcaaagtaaccttaatgtggtaaacaaactgtgggagatctaaaccgggaggtgaactcgtgactctctgagagaggaggcgacaccgtgggcgacgggttgcttaagactcgtagagtcttgaatacgggcagcagagtctcctgtaagtaccaccgatttgaaggtgtttctacgagaccacgaagaactactgcgaaacgacagagaaacatgccgcagaaacgagaaacacggcagggaaaaagcccaccgagaatggggaaccgaacgcacaattcgaagcaggggagacgacgatacagcagggtcaccaaagtatccagtgaagcattgcaagaattcggatacctggagagaggcttaccgaagaaacacgcagccaaaaagagtggtgcccgcgagcgctgttggcgtgaagataccgcggtaagcgaggcgccaaatgggctcagcaccgggcaaggaatggatcacgcaataaagacgctgaagaggactgaagataccggagaaaagaggagcaacggcggttacagggaggctgcagagtagacgcaggcagagcccaggaaatttttgcacagagtctgctgcgagcaatgcggaaacaagacgctgagactacagtcgctggcgccgaagagcgacagctgcagacttcgcggcagaggattcgctcgccgcatctgaatgccggcgcctacgttagcgaggttacaagaagcgtcgacagcaattccagtgtacagaagtctcttgtttctgtccggaatttgtgtcgggcaacagtcggggcctgtgagcagtcgccaacactgtgtgagcgttatgctttgaggcagctcaagattccacactagttcccgctgtagctaagagaaggccactgttgattatcattgcgtgcgcgagctgggagtgtttccctgtcgcgttcgtgagctccgtctgtcgcatctaagtgggcaacgaccgcggcgagtagatcgcagcaacagacccggctacgaggagccgccggcacacttgaagaagtgtctatccgtgaaaagcccagagacgcccttctttcgaccgaggcacgagaaaaaaagaccttgcgtgagatgttgcccgcgggaaaattccacgcaactcccgcgtatttcgacatgtgaacggattctgatccccgagagtcgagtattatccatacataccaggcgtaaaaagcgttcatccagttactcaacaggtgccaggccaacaagaatccggttagtgcagaaactttcgagacggtaactgcgttcgacacgaccgtgcggaaacgctgacaatgcctggagaggcgaaaacacgaagcgactcggaaagccgaaaaacttgtgcagtccaattttgcaatgacctgtcgcccagctcaccgagctgctcattgtccggcgattgttgaccaattctcgcggcgttcgatggtactgcccgtgcctgcatgcgcctgcaagtgcgaaggaaaagggaagagtccgcaactttcagcgagtgattttgcttcgtgtatagctccagaaccaattcgggcagcgctctcgaaaacctgccttctctttgaggttcaggaggattccctcacagttgcatacgaggtcgtcctgagttgtggctagcctttccgcggagccccctcagacaatagtgtgctgctaagccgccaacaagagtgaggcccaaaacttgccgcgtacaagacatccaattgctatcgagacggagcagccttgttcctctgcacaaagtggagacaaaactttggaaagggacatgatcttgacggcaggcgctaaaggggcaccgatacggctgccacccacagctgccgattgttgtggtgccctcagtttcactttcatatgttctttcgaagttgctgtggtccacgagatccgaactgtagttgtttcagagattatgagacagactccgcgtgctcggcctctcttttccccggacgtctgctggaaccaagtaggtggcctgcgaaagactggctctgcgtatcatttcagtagaccatgttgatgcactctgcagctacatggttacaacaaatcgacaaatggccacgtactgcagatttagcggcttcagtacacacagtcaaccctgcctcagggattttgagatggggatcggtgaggacatccaggcttcacaacagattcagtggacaaagctacagatgatatgtgtttctttcccctccctgcgacagcactacgcctgtggagctcttcctgcagagctcttgacgcgaaaagcactctccaaggatctcaagagactagcgtgcttaaaagcagtacggaatgcagaggactgaggacggaaaataaatcagtgccacactgcaggatgctgcaggtagggcagatccgacattctcctatcaaacgccatcttcggtaactgttcccgaaaaaacgtggtccaaagttgttagctttcttggaaggccggatgttagtaaggacacagcgcctgccgacggtctggctggcgttccatccacacacttgccgaagcgccgacggactgggcagcaggctgacacgatgccagtgaagtttctttcagaaggcacacatcctgcagccagcagagcagcccccattcgctcttttcgtcgatacatagcaaaagtgaaggggcgtttcttgatctccggtggcttgcggatcaagtgtgaaaatgatgacaacgcacaagccaacgaggcagacgggtgcggaaggcatctctcctttgcctcggtaattattgccttcggcgtcgtgtgatcactatgaattactgagtgccaaatcatcttcgtgagcttctagttgactcttcactgcagaggtcaaagggctccgctttctttcgctcaatagtggtatcccatcgtttcaatcccgttccaccaatgaaagtttacttgatgggtttctcgtgaagtaccaaacactgtgtcccattgccgaaatcgttacaggcttgagactctgtcacaagatgcgtgtgtctcacattcagatgaacacaactatttggtcgagaatccgccgtgatctgggaggttctaacagttcaccatcccatggactccttaacgttccttgcctcgtaaactttacata

SEQ ID NO: 3011 - DNA, 2187 bp, Toxoplasma gondii
tgaagatccacgcgatgtcgaggaagaaaaacagagcgtgagaagagaaggcaggaagacacggctctccccaggagggagagtttaagaaaaaagattctgagcgcgttcccccctcagtcactttccaaagagacttacggcgtttgcagatggccttaaatgacatcctggaaagaattcgacgaagaaacgcgccagcaagggaaaacgaaaacgaggaacaagaaagcaagaggagaaagaaacaagaaagaaacaagaaagcgagaggagaaagaaacaagaaagcgagaggagaaagaaacaagatagcgagaggagaaagaaacaagaaagcgagaggagaaagaaacaagaaagcgagaggagaaagaaacaagaaagcgagaggaagaagaaagagaagcaaatgaattgaggtgaggggcgttctttttctcgcggtcacgacagtgtcgggagatcgagagcgcgacggacgtccgcggtcctgtccatggttttagaacagggagcgcaagaggagagtctagtgaaaggggagcgcaagcgttctggaaaaacactgcgagaaaagcagtgaaggcgactacacacgaagaagaagatgaaaacacaagagcgaaggaagcagaaggcgtcggcaagaaaccggtatgccgagaaggcgttggggagaaaaggagacatgatgcgctttcctttgaaacggtgtttaaatgaatgctcctctttcgaggttttctcgctcacgaacgcctccaggatttcctccttttcctctttgtctttctctctttgtttcgtggtgttcatgtcgagcggcccggacatgagcagagaggaccgaccgacgccttatcttttccacgaggcgctccggccgtcactctcagcaactgacaaacgaaaacgagggaagagagaaagagaaacgcgagagtgaagagcttcgctggctctccgggcgcaagcgaatgctcaccttcgcctctccttctttgacctcagtccctgtgcacaacaggcgcctccagacagttatctgcgtatgtgtcaatctgtctgcatgcgcagaactgcggtcttttatccctcgaaggaagagagcaaacgcgcctgaaaaccacgaggcggctcggtcttgcttcgtccgtgtcttcggctctccacagtctcggcgagaaagagagagaggagggtcgagacaggcaggcatgcgcctttacgcgccttgtctcgattgtcggcttatattcggagtcaaccgcccagctcgccgcagggaggattcccggcaggcgcgagaggaacgcgagagtcagaaagagagagagagggccgcactgccatgcttttttctttttcctcgcaaagagaggctggggacgtcgccaccggctcttccggtttctcgaaaggagaagaagcacagccgcagaggcgtggaccctcttgacggtctgctcgcgcagcagtcgctttcgagctgcgagaggagaaaaaggagacacatttggagctgaggagttccttcacttctgggagaaattcccttttcaaaagagtttcctttaagtcgtctttctcgcctcctcttcttctgtgatgtctttcccccgtcctctctgaacagtcacacaggacgcgagagctctcgctgtgcaagacaccgctccagcagacagttgagcgaagacggcgagagtcctttagaaaaggtctttgctcttttcggattttctttccccttggcgaacctcacgcagaagcagcagcagactcgcctgaagacttctctccgtctctcgcgagaggccgtcaaacctccgcgccgtagctcgcttgtcttcgcggcttgccttctttctctccgcgtctgaattgttttatagttttcgttgtcgcagttgacttctgcccttccctgccctcgtcagtgcaccactagagtcgtcttcttttccctggctgcttcctcatttcttgtcttgaaccttttcttctccctctcgttatctcttcttatccctctctgcatcaccctgccgtatctcgtcaagagtctctcacatgcggtctctctcttttctcccgccgcctctggcacttcacctgcatctcctgccttctctccttcgtcttttgcgtctctcttcgcgttcgaatgagccggaaaaaaga

SEQ ID NO: 3012 - DNA, 1553 bp, Toxoplasma gondii
cggacgagacgctgcttttcatatttgttgcgtgatgtcctgttggagagagagacgaagaagagagagaagcagcagaagcagaagagagagaagcaggagaagcagaagagagagaggaaggcttggagggagagcgggagatatgggggcgcagcgcagaagcgaaggcggtcaaggggaggagactagcgagacaaggttttctcggggaggagcgcctcgaaatcctttgcacactgcgcgctgagaagaactccgcgagaaggcagttccgtttgctcgcctgcatttgccagagaggccggaagccgcgaggcaaaggcaagccatctcgcgcagcagagaggtacgacgaagagagagacaggtttgtgaagcgggcagacgaagaggcagggaaggagaggacatgaaaggcaggaagcaagcgagaagatgggtggaagagaggttgcgagatacgagccattttggagagactgcgttcgagcagaaagtgacagaaggctttttcgcatctccgctgctttgcccgttagcgccttccgcctcctctcttctctcttgtttcgcgtctgtacgctcaaagggttgatgcttgttcgaaacctattggatttgtcttttttgggagaaaacagcatgtgatggagtgacgactccttcctcttcttttcctctctttttgttctcgaacgtcgctgtcgcagcagcatctgagcagtcgtttcgtttcgctctcagcaggagcgtcggcggtggtcatttgaaagacttgcagagcagaatcgacgcgaaaactcttcctgtcgtagaacgaggccgcgtgagtccgtttttcgcggggctgttgtcagggcaggcgagagaggaagcttgcctttcgcggaagacagaagaagagaaacgcctgctccgccttgtgagtgcatgcgtctgtgaagcgcctctccttcgacgtttgtcgagaacttccgtgtgaggcgagaagaaagagaggcggtctctggaagaagcacagcagagcgaagaggcaaccgagagaggcgcctggcgccttcctttttcctctgttgtgtctccggtcttgcgtcgaaaaacgcgagggagaagactctctcgcatgttcccttcagagagggaggaagcgaaaaagagaaaatggtgacctccggcctcgcctcgatgcaagcctctcgaacgctttttttctttggagaaagttacacgctgcgaggcagagacgcgcgcgcgcaacaagaatcgggagaacggagacaactcctaccagaattgatgcgtgtgtctcgcgctctggtgtgtatgacggtcggacttgttccttttctgaatcccttttcttggaagcctcccctcgtctgcgtttttcttggacgcaaagcgaaaaaactccacggttcgagctctctttttcctcttgtctgtgtctctgcgacctttctccaagaacgcatttccgcagaaaagcaccagaacatgcaaaactatcgaaaaatctcgcggaaaatcaccgcagctcgccctcaaaa

SEQ ID NO: 3013 - DNA, 2033 bp, Toxoplasma gondii
cttgcagggcaaatgttcctgcgcgatgttgtgcgagagagtagacgcgccgatgcggtgccgtccgcaagtctctgttcagtttgcgcaaacgtggatatgtgtgtgtatgtggctttggaggcggatccccgcccctggcatctccgtagactctctgaagacactgtcctgtgaatttttcgtctctccccaggactgtcgtccgtggtctcagacagaggcctcacttgagttgcaaacaaaagaaaccctctgtgtgatcaggcagtcagcggtgtttcgcccgtcgccctatattccggtctcccacaccgaagccggcaggttcaagagtgtcctgggtgcagccaggagcgtattcgaaacaataaaggcacaccgcaaagacggcgccggtgcgcaacagcgaagccgagagacatgcactcctactaataggaatcttaggacaagctgttgtgcaagcaacgcccatcagatgacagcaactgaagctagtctccctcgtacacattactcaaggggatttgtacgtcttgctcccgttaggagctgcacgatcagtcagagaccaactgaagctcgacttcgtgtaacacagtacgggtgcgcgttgaaggcttctctgggttccttacgctttttcacagtcatcgcctgtttttctttagtccacaagtcttgccagacagatacgtatactttctacggatgtgcttcgcccgcacaaatcttttccctttgttaaccgtctgatggagacctctgcacagatgctaagtctccggcctgcgagtctgtcgtggctttttgccgtgaaaccaagagggtaaggtagcaagtgcactggtcgcccctggagcaattctccagttctcagctttgcgctacttcgcgctctcacaggcgccaggacggagcctcagggtcgctttttttacactggaacgcatttcaggctctccacaggtgatgaatttctggaggtgtctccacccttcgaccgaaatctccccattgtgcgacaaggtcgcagacaaaagtacagagttttgccatctgtcaccctcgtttttgtctgtatatgggcgaagtcgactcctgggccagggggtgcggcacttggcttcaggtgaacaaactcgtacctcatcggttaagccccgtcgcaccagcgcgccccctctcgagttaaagtgaacaaagaccgaacactgggaagtgcagacacgcacacattttttccggtggaccgcccacgaagttctcctccgagagaagtcccgcgttttcttttttgcgcctgcctttgccagttcttccgagtgtttcgcctcagacccctccgcagcagcatgtgccattcatttcgcggcggacccttattcttgtcctgaaaacgcggtcggaaggtggggggggcagtcgagcggtggcggcctgaagacgcgcaagaattcgagaaggtacgagactgccgtcgtgctgttttggggaagtcgccgtcgttttttccgttctcctcccctgtcggtcgtttgatttctggggcaaacggcgcccgtcgcttcgtcccttgtcgacttgtgttgttcgtcttgcgtctttcgctctgcttttctgcctctcgcggtctacggcccagagacgcccccgcgcccgctgttcgcgctcgcggcgtgcaaacccacgcgggcagacaatggtcagaggctcgtcaagtgactccgcgtttcggcgaacacgagaaagaccatgttttcttcgggaatacctgtttttgacgcgctgaacagggaggggacgaagtgtacagacagccgcggatcgagtgctgcgcagctgcgcgacaaagacgcgtagccgcggacaaaaaagaggaagaaccggtgaccccggggaaacggcgtcttggtctccttttcgtctcggtcctatcggtgtttctgtttctctccttccctttcacagagtagcctcggcgattcctgttcctcgacgccgtcctgccccgtcgaacgccttccaca

SEQ ID NO: 3014 - DNA, 2668 bp, Toxoplasma gondii
acacttgactgcatgcgcagactgtccttcaagtccctcgcaaaaaatctcttcttcctctcctcgttttcgatctgtcttctgtgtcgaccctctcttgttgcctcccctctcccagctgcggtcctgcaccatctctcgaaggtggttgacgaaactcaactcttgacctttctcgcgttctcctcctgtctctcctctctctctgtctgctttgtctcctttgtctcctttgccctcttcggctgtttcccctccgtctcctcccgcttcgcaggctccgtctctgcttgccggtcgaggcgacgaggacgctcgggcgtctggccgctctgccgggaccctgttgctcggggagacaaacgcggagtcgacgacgacgttgcatgcggagaccgcgcgatactggaagaggaacttctcgtgtctgaaagacgacgcagggaaagcggattcactcatggcagcctccaaaaaaagacgcaaagggcagcgccggagcactccgctccgcgcgacacagagcgtctcccccgcgttggttgtggaccgtacgaagagaagaaaacgcaagttgctcggaaacaaaagaatcctctgccgtcaaaagacagccagtctcttacctttgacactggtagcagacaggtgtgaagcaaccgggacagcagagaatggcgtctgtcgttctgtctccgacgcgcaggtgtttcgcgacccatttctcgtcttcttcgtctgcagatgagtcgtagaaatctcctccttcctcgagttccttctccagacgctgtcgcagctcgcggtcgagagcgtcctcctcgtcctctgcttcctcctcgtctgcgcgcatctcctctgcgtctccgccggcctgcgcggctgcacactctggctgcaacgttgggcggagcttgaccttcgtctccgaagcggagcaggaaggcctcaactgctggttttttttctcctcccgctcccccagctcgcgcttctcggccgctgtgtcgcccagcaccactcggactccgtcgtcatcgtccccgaattgacggtggcacacacgcgactgcgctgcgtcctcggtggaatcttctcgcttcggattctctccagaaaagccgccgcacagcgtcggttcccagtaggcgtcgatgtcgcgcttctctccatgcttccctcgcaaagcagaagaagaagaagaagaagaagaagaaaagggagaagaagagggcggagaggaagaagaggagagaggagaggaagaagagggattgccgtctgaagagcggcgttgttgctcgagaatatacgcagcaagctgccggaagaccgtgtttgagcgaagcttccctgcactagaagaaagggaagaagagagagaagaatgagaagacgagggaggagaagaggaagaaccagatgaagaacacagtggagaagaagaggcagcaggatcgccttctcttccaagaagcgagttgctcgctgccttttgtgggagagaagtggagaggagattcgcgagagggttgagctccatggtcaagctggggggcgttcaggaggaccgacaagaaaagaaaggcaaggagagacacaagaaggaggagagagaaaaaaacgcgaggccagaagcgcagaggaggaaattagagacggcctgtgatatttttcaaagaaaaacggacgactctttcttttccggcgcgtgcgtctctccggccgaaaacagacctgcagtcctcgcagagagacacggcatcgtcgttctcgttctcactttctcctgtctttcgagttgcatgcatccgcgatcgctacaggaagttttctttccacgatttgccttctctctcgcgcccaattgttttttccctctcacgagaaacactcgaaacagctgctgcgcttctcgtcgctgcgcaccgttttcgcgggtgctgagcttgcgccttcctggaggtgactccagtcgcagtgtgagtttcgaagagaaaaatttcgtttaacttcctttctgctccaacgtaagaaaccaagcgagcgagaaaaaacgacgacgagccttcacgccgcatctgagaaaagtcggacttccaggcctcccgtctcgctgccagacaaaagagctccgcatatttgtttcgtcttttccatctttcttctctgaaaaacacagatttctctgccgcgcctctacacggccgcgacgatggtggagaaaagcgatccaagagcgccttccagctctcggccacccgcttctcctcccgagtagcttccacgagtcgccgtgctctcctcattcccttgtgtcttttcctttctctcctgtccgtcttcctcctattcttctgcttggtctttccggttttctacctttctctgctgtctgctcattccacctcttcttcgtctcacagtaatctgtcctcgactcatctgccctcgactcatctgccctcgactcatctggcggctctattctccttctctgtcttgcccttcctcgcgtttcgagtctccttcgtcgccttcttctctgtcttatcctctgtcttctcgtttctcttctctctcctctctgtcttcctctctgtcttcctctctgtcttcctctctgtcttgttctccctttttcgcgtgtctgtcagtcttctcgcca

SEQ ID NO: 3015 - DNA, 2726 bp, Toxoplasma gondii
taggaggtttcggtcagcaggactgtgcagaatgacggttgttttttcgactggaagcgctgtctacttaagcattttgtgttgcagacggaccctaacttggttgcatgggcaatggaggggtactgagaaaacagtgttttcaagattccttccgggattcttgtttctagagaggaagttcagttgctctcctgagcatggagggtgccgactgagaagtcgaaggtgtacaggagcgaaagccgcttttctgtggcttcaaaaaaacactcgcttcttctgtagcgaggcgactgatcctccatgagtcgtcggaaacctctgctcggcgcacagaaggaatgtttctgtgcagagcgcccgactggagaggcggttcgccgatacgcgaaaccctccagctttctctgcttcagatcttgtctctctcactggatgtgtgtacaatagcggctatctgtcggtcaatgtgcgaagctcggcagcactgcgaataggacgaaacaactccacagcacaaaaatgcctgcggacccgcactgcgcagagtcctccagagagtctctttcgacagcgcaagacaacgactcctcatgtctgctccgtttcgttgcacagcgtcgtggacacatccttcgctctggtgtccctacggagtcgtgacatttttccggaagtcgcgtgcgttcttccgaatcgacttcgcagctaccactgtttcctggtgcaacggttttgcaggagacccccccccgaagtgaagactgcattcctgctgcttgtaggttgacggcagctttccaagtcttcgccggccgcctacaccactccagacgccgagggcgatgcacacaacaatacatcgcaatggacgccctcgcacgccgagaagggtcgccgggatgaatccccgttgtgcatgtaaactacggacttttgtttcgatagaaacaccaactgtcgctgtctgcatgcttgtgagccatgtaacagagcacctgtttctccgcgactgaatcgggacggttgcggccccaacatgcgttgtggagaaacagcaggcgcgaccgccacacagccgagacgcttttttcccttcggctgtgcgtttgaaaactcgatgctgcagagctgtaggaactatgcaggaacttcgctacatctccttgtgtcacaggttttcgttttcttcgatttccccgtcgtgcgcacatgcgaatgctttgctccgtcacggaagggaaaccttccgcattcgacccagcgactctcgcggcttctacctcacgccccgccttctgtttcgtcaactgagccgttttccatcttcagcgatgctttcaccaccggttcacaagattcaaaagacacacgaacctgcggacctaactgagaactggtgactggggtgcgagttctaccgtttcgctactggcccgcgcccctgcatagcggtgaacgctcttcccagaaccagactgctcgccgcctttgcttgtctgagcaaagccgtgggtttcgagcccagcactggcgtaactagagtcgaggatcatccacgcacacacacccacccgaaaaagcaaattcgtaacaagttcgtcgacagtggaaggccccgaagaagatgccgtgtgtcggcctgtggacgtcgcgcaggtgccaaaatgaagcgcgacccagagcgcgagaaaccccgggagttcaactcacaaagtaatgagtaggaaacgcttttaggtctcgtctttctgttggctccagtgcgcgcattcgaagaggcctctgcacacggctgccgacaatgcgagatgccgggacccgacgaacgcgagaaagcagcggccgcatgcgtttcagcttcaaggtttggcagagaagcgggcgaagaccgcgccagacacccaccggaggagagtcaaaactgaccgttttcagtgcctcctcagagacgggcaactcgtgcctctcagctgcgcgaccgcgaagtgtctgtacacctcagccgtcgccacacgcgtccgtaggcgttgcgcaaagtcgcgcctgtcaggtgtgcctcggaaaatgcgtttttgcggctctgctcgatttttttttgtgaagagcatcgctacgtcgtcccgcccgttcgctttctacttcttttcgtctttcacgaacttcctgtcagtgtcagtgcgctcaactgcgtcttcgagctgtgtggagcgactgcggtccacggggcgacatcgaaagatccagaatctccgtcgtttccgcttctctttcttgctggggctacgcgccactcttttctctccaccacattcgctccttggcgtttccgtaggtcatcaggggcgcagtgaactcgaggattctgtcggaaacgctgcgttgggttccccgtgcgaggcagagaccccgcgttcttctctgccgctttgcctcttcacactctccacttcatacccggcgtctgcacgctggtgttctctggaaactgccgggtagttccgacactgctcaaccttcgtgacgcgaactttcgccgccgtttgccgcaggacgccttctctctgcgtctcggcccctgctgtgtctcccgtctcgccgttccttttcttctggctctcttctttttccgctctttctcactctgccctcactcgttcttctcgctttccagctcttccgcgcgtcacctctctccgccgtgcacacccagcctgcgaaga

SEQ ID NO: 3016 - DNA, 2525 bp, Toxoplasma gondii
ttctctgttcgcaatctccctgtcgtccgttttgcgtacgattgtttctgcttccaacaacccatcctcctgaaggaccaattccccccaagaaggtttgaggtcgtcgcatccctgtttccgattttcgtggcggatgacaatgccgccaattcaaggaaacccccccagaacaatccgagagtgactcccggctaaccgtgtcgaacagcagaaaaaccaatttccgatcccttgaccacaccgggcactgaccccctgtcgcacacatccaaaaccacctctgactacaatcgtgtgtgacccaaattttgcgttttcgtctccgctgtctctcgaatttcgttcccttccgcgactgctgtacccactttctcctcttttcctgaagacagcttaaccaaataagtacgatagacatttcgcgttctccatttacacagatttccatgcaaacaatctcaaatactaatgtaagcaaaggcaccttgaagtgcggagctgattcttaaaaagagcaggttcatgtcgggtcttcacgctggataattcggggctgattcatagtttcttgcgtatcacagcgatagtttagtttgtccttgcggtcaggagttttgaatcaagccggtcgtggatgtaatataaggagtggtctcagggaagttggtatcgtacatttatagcctagtagttgagtatcaacttagatggacagatgccttgaaccacctaaagaaaaggaaacgttaaccgctctttagaaacaacaacagttaccgtcactgtatatgaatgctaaatctaaatatggatgcttgttgcaacgcatacaaccagcgagagaaaacagaggcacacacaggttattactggcagcttttctttcgccgagaagacgctccggagcaccgcctacaaatgaaactcgttgtctatcaatgaaatataattatctcatatcatcgactagacctgatactgaaggtggaagaaagactccattcttcagcaacataggtttgtcgtttgatgataaggacctaaacgttcccgttttttccagtcattttggaaaccaagacataaccgtccaagtgaacgggtgggagtctcgctatttgcttcttttaatttttctgcgtggaacccgtccgtcggttccaccagttctgcctctttcgcattttccggataaaaaagtgagtttttaaaaatatctttcaggctctcctcttgctcggtttgtcatttgcaattggcttcgttctcaacgaagcggttgcctggtatatcgcatcacaatctgggttcccactatggaaatcgaacgacctaccacacatgaaatttggatccatgagttaccagtaaaggtgtgtttaaacaaaacattttctacactgatgcgcatcgcagctggttgttttatgacgtggttgcaaagatgtggaaagcatgcatgtatatagcctaggtgctcgctgttaataaattccacttcggtgagttgtcccttcgatagaatagttcccggtgcgggcggtgtttttcagggttccatgcacgcagaaaccttttcgatttctctccgttccggtgctacggagcgaagccgcgtcttccgtactttctcggagtccagtgacgttcttgtgaagggcccctccaccgcatccgcaagactgtcgtgtctcctccacccccctttgtctcacgagcagtgcgtgctgctgcttgcagttaccttcgactggagtggcaggaatagtacagactgaaaggaaagaacgacgttctcgatcgtctgttttcatttgaggcggcgcacaggctttctggaaaagaagcgacgcaaaacggcgaagacagagggcctgctgcctttttttgcagggacaacgaaattcacacggttgagagcgcgaaaaagctacgacaggggtttaatagacccttttccactttgttcgagtcgcatgctcgtgaacaagctacgcgttttgagtttctctctccttgtttgccaccaaagtcccgtggtgtctccctcttgtctcgcttgccccaaaactggctgctgtcttgagctgtcgaatctcacacctttgtgaatgtttgccggaagaacgtttcctcaatcgcgcttccgagtgtttttcccttcgcacatccttatttttctctcatgttagtttgtgtgcctctagaaagttcacagcatctctcgcttgacagcatagtgtacatacacctcaatttttaactgtcgctgtttgtagtggttctttgcccagctcatccgttccgccatttcacttgtatttctcgccgcgcgttcagttcgtctaacttcatttcccccctctttcaccgctctcgatcttccctctttcggttcggtcgtcttcttcctgctggcttttcggagttcaagccgcctccaccgcaggtccgccgccctccactgccagggtccggcctgtttcccctctctctacgcgagtttctttcagtgttgaaaa

SEQ ID NO: 3017 - DNA, 2198 bp, Toxoplasma gondii
ctggcgcgcattttgcatctgtgtatgccgccttatttatgtacttaatgacgcctatctagcgggttcgagtaaagccgagaacggcttcttggagatgttgatccccgacatttccgtggacaatgaagacgtcgttcgcctccgattctcgactggcgtccaggatccgtttgcctgctttgctgcgattgcttacgaccgcgtagagaaggacgaagaggccagcacgagcgacctgcgcgcttccggggtctgcatgcgcgagcgctgcgcggccgccttctccctcgccgcggggacgactggggtccgtgaggaagtctttgaacagctggagaaaagaaacatgtcgtgccagacagaaggcgccgccgagtgcgagaaccagaaccagcagcctcgccagcgcggccgcctcgccgcgctgcagcaaaccctgcgaggcgcgagaatacgagggagaacaaaggggagaagaggagggagagcaacggggagaagaggagggagaaccaaggagggaacaagggcaaggagacgcaggcgaggaggaagacggcggagagggggaaaatggagaagaagagggaggcgagggagaggaggacgagtcgagtttcctcttggagaggcgagaagcgcgagacctctcgccgtcctcccgaggggcgcaagaagccgagcggccagagccgccgtcggcgcaagaagaacctgccatgggagaaggaggaggagtctcccagtgtctccttcctcagtgtgaaggcctgagaggctgggagcagccgaggagagagagagagaaaaaaaagggggacaggcgaggaactcagggacggaaagtcactcgaggaggagctcttcggaggtagaagaagaagtcgaaaaaagaggaacgcttggccgtccggcaaaactctccgcgtcgttcttgagcggcctctttgccctcccaaaagcgacgccttttctctcgtccgacgttgtcagattgacatgaccgtatgacgaggctcccgcgttttttcccatccacaccttcttggccggcgcttcgttctctccaagatctttcgccagattctttcgcagcctttcctgcgtggagaggcgaagctcgccaccctccggaagacaaaacgcaagacagcgcggcgtcgcacggacgggccagagctggagtttgcggagactcgcgccgaagaacgaatttctcgcgtctcgagaagagcgaagaggacgtgtgaacgaatgccgaggaagagaaggaaagcctcacagaggagagcggggagagcgaccgaacggggaaacgaggaaaaacgccatgcgaaaaagcgctcgcggcgtcgggagaacgcgagagacgcgcgcgcgcaaccccctctcgtctgcgtatatgtacatgtattatataaacttgtatacacattcgcagcgagagaagccgggagaggcgcgttcttctttcgcgttttggatggcctttcttcaaactcaagtgaacgccgacgaaactgcgtctgcgctgaggacgcggaggagcatctgcggctgtcgcagcgactgaaagatgcagcgcgcgggtggcggacgagacagagagattgaaggattgagagagaaaagcctctttcacagaaacgatatttatttcttcctggataggctttatgatcaattgtacagctaacagggttcctccttcctgagaatccgcggagggtctcggatttgctcgctcatctcgttgatgcatcttgaaactctcgcggtgtctcgacacctcaaaaaactcatttttcctctccattctcgtgctgcatcaaaaattcgctttctctctttcgcccgcctctcagtctctcctccacgcctccaaagatagtgtccattctccctcctcttcttcctctgtgcttcttcctcttcgtcttctccctcctcttcttcctctgtgcttcttcctcttcgtcttctccccttcttcttcctcgctcttccccctctttgtcctcttcccttcttcttgctcatggttttccctctttgcgtcgcctcgccgtccaggctctcctttcgacgcgagggtctccgtttcagcttcgagtccgtcgcgcgttcctccctgggaagtacagagagaacagagcaacaggagaaaacgtagtcagtgtcggagaggtctttga

SEQ ID NO: 3018 - DNA, 2832 bp, Toxoplasma gondii
accaaaagaagccggagggactagggatacaaagagtcggtttctgctgaggcttgatggccaggcggggctggtaaaccagcgtctgtcgccacataggacggaaactaactccacgggcgaggcagattgcgaggagaaactacggggcaagcagagacagacgaaaagcgtacgtgagcagacggttcttccttcggttcactcaaaatcaagaagtcgagaagaaatgggggacatgtttctgtggcgtgagacaggtgaacggcgaaagtgaactaactaagaatgagagagagggagaggaaagaaacacagaaactcgtgaatcatccagagcgagaaacagggaaagaaaacgacagacgggtgttgccctgctgacagtgcctggctggcagcgtcaccgctggcatccctttaggagacgaaacccaaaaacgagtagcacctgtcaagatgaatcacgaaaaacacagaaccaagttctctagtagatatggtattgtcgtaccaagcatgcaatacagggctccaattgtgaggtagcgacaacccagttctctacgatggctggcgctatgatttctaagatagtgcaaacgacttcagctacgagatacagacactccagttctgtatgacagctgcacgccaccatccctgtggactgcttaaggctgctaaaaggggtcaagttcagcctcctatgttgttaatcgtattcatcagaacagcagaaggatctagcagctccgaaacaaatgcaatgtatccccgcggtcgcgtgtttttcaatcaggttcttcacatgaacggcattttactaacttgctcgacaggctctttagctcaccccgccagagccgtgattcattcttaaagaaggcagaggggcaagacgagacagacgcacggagactgccgtaatctatgcctggcgcatctccacaagcagaatgtcaaaaaaagtgtaggaaacgagcagaggttctcccatgtttgcgacgcctcttcagatcgccgccgactggtgaaagaaaaggaagaagagagtagggcacccccgagaagtagtccaaatgtcgtattgaatgccgagtaaccacaaaggaaaagagtttttcgcacagaagtttcaagacttgtcccattggcagactcatcgctctccaaccttgatcccggctgaggtcgctcccagaaaaaaaaagcaggcgagttgacaacctaagcaacggctttcttccccggttgctgttaaacagacagaaaaactgccccgccacaccctgtttgaacgctggtcctttctccaaacaggcaagccacaacacaccagctgtcgattctcaggatccgaaaacgaccggagtttttccggatctggaaactcggcgccacgggtgaaagacccgatgatacgcgacggcgtctcctgcctggatctgcgctgcaccatgacagccgacggcgaacgggaggactttgccaacgtccaagttgctgaaatcgaccgaacagcaatgtgaacgacaaaacagtgaggtctacgagcagaagcaccgtgtcagacgtctacgaagcaaataaagccaaaagagatgtctctgctttctcgaaacgaaccgatagtcactggcacacccggttcctcgaatataagcctactcgttcctgtctgctgtaaggcctgtggaaggcccccccgctgcaagctcggactcgtggcttggccagcagacagaaatggccggtatctgtagacagcaaggaagagtagtccatgataaagctgattccggtgctcctatccacttcccgtcaaacggctaacaggagaagcttttaaaaacatggtcgcacgtgaagaagcgcttctcacgaactcgagtctttcggttcgctgttgcgggattgcaggggcagagggaggagacacatacctacttgaagagaacgacagaatagaacgaagaacttgagagtctcgactgcggtattagcgaagcgaactgaaagaaacagagaggcctgagacagagtcgtcggaaactagcgtagttgccgttagttctggaggaaaaaataactcgcttttgtgtatctgtagcggggaaagtagttccacgttagccttcaaggcctactacgcaacgcatgtcttccgacctgtcgcgcctctactcgagttcgacacttctaggggtctttgcacgaaaaataaaacgcacagtccatttctgaaaagagaaacccgtttgacagtatgaattctgaaacgctgaattctctccctcacattcacaccatactgtctgagttttcctcctcccttcgacaactttaactcgccctgccattctacgcgactccgacgccagcgcttctgcagggctgctttcttctgtctgttacgtttacttcgtttccacgttttctggccacaagagtaggaggcgctcgacgcagttctgtgttcccaagcactgtttccttttttcctggcgctccttttagccacgtttcttttgtccgttgctttgctgtcctcgtctcccagtgagtggggggctttcccccagttgtctgcgtcgcctctcccccaaaatcttctttgttcctggtctgtctccctcgccctcctgccgcatggttcttctctagtttgccgtgtccttcacctacaactgtttgcaacgtagccaacatctaggctgttggtactatgttcgaattcccgtagctcaggttgcagctaagcaggtctgcgccccctctgtctgttctttggattttctttctcggagacttcactccattttttcccaa

SEQ ID NO: 3019 - DNA, 1359 bp, Toxoplasma gondii
aagaaacttgggaagccgccgtccgcgagtctgtcttccttccttccatcttcgcctcttcgttttcgcttcgccttctccctgtcctctctgctcgcagggccgccgtcttcgccggagggtgcatggcaggcaggcaggtaggagacaactggggagacgtcgaggtgatcgcgtttctctaggggattcagaggcgcgagagcgcagcggtccgagcccgtttttctcgagggggacgcagagtcgtcgagccagaagccgaacgcagcggaggaagacagcgcctcgtgcggcagtcccacaacgctgggcgcgacccagcgaggcagggcgtcgccggagactcccgcgcggagtgtgtgcgttccccagtcaaacacaagaggcgcagccgggagcggagaagaagaaaacatcgtggacagcgcgcagaaggcgaacgaaacggagagagagagacagagaggtcgacggagaaccgatgaagggagagacgaagcgaggaacccagagagagaacaggaatgcgcggctcccccttcgccttctgcagctcagcgggaccgaagacgaggcatctgaagctgcgcaacttccacggctgacgcgcgcgagcagagcagaagcgacggcgaggagatttaaagaaagaccggcgaacgcgctccccacagaaaacaaaagaagagagaagaagattttatggccaagaagacaatggaggaagagaagagaggtacagacggagaagagaagaagaaagacgagaggcaaagaaggagaagacgagtcgcgggggaggtcgtagagggggagacggatcttgcagacaaaaggagcgacgaaggcaggagagagcggcgagacagttcctacttccacacgacaggcacaacggagagacagcgaaacgcacttgagaaaaccagggtgcctcgaaaaaatgaagaaagctctaaaggcgaaaggtgaattgtgcaataaccgccgaggcgctttctttccaagactgattcggctctgtcgaggcgacagatggagacgggggaaggaagggagaagagaggctcctgtgacataaaggacagagacaaagacagtccgcgttcgctctcccttcagagcatatacaagggaggagagggaggagaacagcgagaacaaaagagcgagaacacaagagcgagaacaaaagagcgagaaaagaagaggcgaggggaaggaagtggagagaggaaagaagcagagagaataagcgaggagacggttagaggcgagaagaggatgcgagaccagacgccgcctcgcgcgttttttcgcgaagaccgctttgctctcgcagagattctcggcaaa

SEQ ID NO: 3020 - DNA, 1858 bp, Toxoplasma gondii
ctgcacgctcgtccgaaatcaaaggagcaggacaggacgaagaaggggagacagctccattgctgagagaagcaggtggagctgacggggcatacgcatgcgacgatgggccagaaacggcctcactcgtggcgacagaagaagactgctggtggctctggcgctcgcgaacaaagccggagtacaacgaacttccttgacggtggccacggcctcgatcgtcccctccatttacctcctgagattccaaggaggacgatgggcgtgcggggacggtcggtgccatggtggacttgaaaaggtaaggagacgagaggaggaagaaaagcggacagacgcaggtcaaggaggattacatgcaccaggatagtcctcgcaaagagtagacatcatccctgaatggcttcatccctcaccaggttcagtggtgtcctgatctcaaaacagattcgtttgaagacacacatctccttgtcgaaaaacagttccagaccatgccgacgctggttccatcgaagagtatggacaccaaaaaaactccttctgacgagtgctcgcgcggcgttgcagcctgaggaaaaacagccgccataacgtggggctgttagtgtcgaatcttcacattatactccttgcagttcctggagggcatcatgtccagcccgccagccgaagtagtgactgtttcgtaccctgtttgctaaggacccctgtttggaaggtgcaagacgaccgaacgagtgcaaatagcgaaaatcatacaaaaattgccgaaatgtagaaccgttggcacgcgatagaggacaggaagcgagccaatgacagtgctgagacaactgaatggccttaggaaacgagcggcgaaaggaacatccccgtgaaaccacgaaggaggcgcacttgaatcgggaagcgctgggagcacagaagcaaaaaaaacgaactaactgttttgcaatacagcggagagacggaaaggccgtccctgagaaaagaaacaaaaggaaacgcggaaaagtgatcgcaagttaccccttgaaggctacaacaaacggcaacaaagcaagcacacgctttttcatcgatatcttcctcatctgaagagagtcctctgcagttttccaaaaaacagttaaacgaaatgtcccacatgtcttatttgtgtgcgctgttctcagaaagaagatctctgtgatgactagggaaccgacaactgcaactgcttcgacagcatgcgtgaaaaatcgcaaggtaacaagtggacagccaagatacttcgcgttcatctatgttttctttcgggtgaaagaaagccacgagaagtttgtgacgttcatctgcacaactgtctttttccaagaaatcagcgaaaagttttgagtgttgcatcgtgtttgcctggggcaccaaaagacaaggagttccgccagttgacggctgcgcatatcgcggtgtgctccaacctgaatgcatcacgtagttttggttttctaattccaatcacatttgcattccaaacgaaacaagcatcactctagcggaccgatggaccctgagataataacgcgcattcctttgatttgcagtccggaatgaagacgcattttctaatagcaattcgtgttaggttttttcatcgtccgccgcatcctgtgacgcacaacgggtcaccggtgtttgtttggcaaagaagtggataaaccaatcgacgctgaacaaaacagcgtacgatttattcatgcagaggctcactaagatttacaaaagtgattccttcaccagatgcggcgtctctgactgaagggagttccggactctagcatgctgtggcgtaacatagtctgaatcaaacgaacaa

SEQ ID NO: 3021 - DNA, 3105 bp, Toxoplasma gondii
cagttttcttgtcatgcatgctgtgtacaacgtggtagatactcgctggtacgtcgatctttggggggtctggagggacaaacatgggaggggaaagtgcctctctctcttctgtcgttcacagatcagagaacgtctcaggggtcaggtgcgtgttttttcccatgctcttacccaagcatgttggcgttggatgtaaaaagtcgggaacctggcaactcttggtattgtcgggggcggggacctacgaaagccaccggtgtgtcgaacagtaaagagggtttacatcgtcttctcgagcttctgtggtcttgcattgccttttcagtagtgctaaagccatgtcggagggaaatatctatgcgctgcaactctgttggcctcacacaatttagcccgcttgtgggcgtttgtctactgtggtctcacacagacacactgttcgcgttggcgtgactgcagtaagaacgagattcttacgttgcacacggctgggtataacagctgttctttcaaacctagtctggtccctaccagccacgctggacattccttgcttcctctgttctgggctgtcctcggtactgcctgtcaccgcgtatcagcttaggtgggcacaatcagctgtttttcggtttgtgtctatggctggcagcagtaaccaataagtttagctgatgcactgaaaggtagtcatttgagagaaaccaaggggaaacggacagacggaccttgcaaatctaccaagagaatggaaattgtagcgcggtccattccagtagcggccgtgttcgactgagagacttttgtcataacaacgcattttgttcccggtattgacagggaaaagtgaccatcgccagaatgagctctctggtccacaaggtcctacacataaaacagtactgctggaaccccgaaacagctgccaagtgaatgtctctttccgttgagccacacacgttctgggctttgaggcacaaaacgtctagtgtgccgttgctagtccttttaaggtggacaccccataaacgacttcaagaacaatcacgcatcatgttgtttcggacatgtagtggaccgcgtgtgtgatctgtggtccccagtcttttgacttttgcggtgactttgttttcgctgatttccaaacctgctcaccagagttccgcttgaaaccggtctgtggcctcgccaagtggacaagtcgtgagagacaggtgcagcagtcttgacgtcctccattttgagcagaaacgcgttttccccatggtggaagtcacccctattgtgtgtcatgacagggacgtcgggacagctccgctgcatgactggcgacccctttaggaacgccactgaacttcctgccagcatcgtagtggggcaggtttcttcattcgacagtcgacacgcaccctgctcaatctagaatcagacttgtgttgacatggaggttttgggcaaggaaactgttctgtgtagtgccttgcaggaggcttgggagccaggcttcagacacaaagtgttcctgtccggctgtgccttcgagtccacgttcttttgaagactcaaaggggcttggaggtgttgagaggggctgcagtctggctttttcgcgaaatggccagccatgttggtgcgccaccctaggcaagcggttgcatcgaatgttcaattcatttgcgaatttcgtagagctggtgacggttattaccaagccgtgcccaacatccttgcatattgtgcatactgcctggtacttctccattcctgtccataaaaatacaaaatctacaacgtcgcctcaggcacccgtagtcgatctgtgttgcgtgcttccagcaacgatctggtgtcctttggcttgctccaagccagcaagcagcacctttttcacatggagacggattgctgatgacaggaactcgtatgagggagtccacaaagcaaagtagtgaaaagagacgaactggcagtgacactaatggctttctacgtagccccacatgccaatggtaggggttcaagatggtacatggagtatttgcctacccatgtcacagggccaccaactcgtcgcaacgccgtcatcctctgcagtacaccggcactcgtgtctgagacccgccagagacacgagcaaattttttagtggaatagggtgtcaaaaacatgttgcagcaatacgccaccatgcaccagcgtattccacggtttttcttgtcgtccctattaagcaaacaacgtgatttcacagaaataaaacgtggatggttgtgtctaaatcatcctgaaatcttgaaaaggccggttcgcctttgaacgcggagtaggttgccataatatgacgttctgtgtacgatgattttcccaagagagacctagtatgtgtcgaattcgtggaagtgatacagcgacgtactccagcaaaggccacattgtacagtactaaatagaagccctaatacccagttctgatgcatgctcgtggtcgtttcgcgccctgcagggcgcatgtgcgatgcgcctgtcttccgcgagcgctttgcgagagcatcacggtgaagtccattggtggcctgacgaggccagtggtgctcggaccgtcggagagcactgtgaagcttgactcactagcgttctcattgacagaagaaatgagaatgtgttattttcctttccaaggataaacgcggcgaagactgcgtcatcaacctatgctttcatgaaggaaagtggcgcgcttacggcgagttctccaaaagtctcaagaccgcctgcgtcactcaccatgctttgtatctccatgttgaactccggggcgataggacgttgtcttcattggtattatggattgcattgtgtctctacttgtttctttcttttaaggtttagtccgtgaagtggtggggacagttttaacggcgggtgagagacgcctgagtgactgatgtctagctggggtgtcgctttgtcgctcctcagctcggaaaacaagtagccataactcgttggcaaaccagcgaaaaggactcgcgaagagttgcttttgtctggtgccgaaggccgggccaccaaagtcactcggacgacggtgtgcattcctca

SEQ ID NO: 3022 - DNA, 3144 bp, Toxoplasma gondii
ccccacattcttgttttaggacattcccaaacgtagaaggacatctttcacgtcaaacgcttcgctcggaatgcgtcatgcgttgttttttcttgcttttctgacctctatgttgccgtactccgcgaaacaaaaagggcggcctggtggaacgtttcctcaaaagcaacagtgttcaatggttcattccgcaagtccgttttcacttcgttgctacagaaacaaacctgctgaagggaacgccatcatgggcatgcctttcccctgagttctttttgtttcttgcgcggtcactctgtacacacgggacgagctcggcagacaccatcccagcagacagtctgctgccgttcctgctttttggatttttgtgtttgtcagttcccgcgaccaaacccaaaggcaaacgctctgttgtgcagatattctgccagtcaccaagtcatcgcttgtacaatgcaacgatctttccgctttcgccgggtcttccacctagcgtttttaaagtagaacagaaagtgttttgccgagcgaacatcgatggaaactctagtggccgtgcccagtttgaacacagtttcccttgccttctttcgcggggacaactccacaatcaggagcgacaaattagcacgggcggagaaatcactcacgttacttcgactcttctcacgtgggatggcggcagcgcacgcagacggcatcagacattctgcagaaaagtaaacggcactgttatgctgagaatcatggatcacgaacgatggacgggcgaagggaaatgcctgtgagtgtgttctttcgagaccaactcgacagcaagatttgcaacgttttacgtttcagtttgtgtccgaagatgatgtcttttgggcgccacaatattcagtgaaacgcaagcgaaacagcagaaacccggagagcactgcttttcaagtgggatacagggcaagtgcctcatggccaaacgcagcagagactgccttttagtggagagaaagctgaggcaagatcactcctgcatctgagaaggggtcagaggttcgagacagcacgcgatattcacggcagaaggggaacggaaacaacggcagtctgtgatcacttcttgaggcagaaacgatagtactatatttcacacgcattcattcctactcagatatcggtggcatctacttcactcttttagctttttcgcctgtccagcagttagctgtgaaacggtggcggagaagtgacctgagagggtactcggaagagacgcttaattactggggagttggtcctctgcagacactttcagagctcgtgtccagagagacttttgaatttgctgtagttagttacgatggtagatacgcagctgcaccaccgttgaaactggtttccttactgttttctggcgtacaacggaagcgtcacaaggacaaagagctacagcaatttctagtttgtgtcctggagtaattgctccgactcttgtagacgtacagcgtaggacctctgcctagtgcagcagcatgcaaacagcggctgtagcgactctcccgaggttgtgaaatcccagtctagtattaatcatcgtgcatgaaagttggtccaattcctcgcatgtcctttatcaaagttgagagctacttaagaaaggctacacgacatacggggaacattcctgtctggaacgacggcaggagaaaacagaaaatatattatcaaagaggccgatgttttatctccatgcgcctttaaactcatgtgccattgttcacacacacacacttcacaggctgtaaacagttaaggtgcaggctcgccagccctcgcttcatcaagcattgcgtgcggttgaactgcattgatgttttcatcacctttcaagattaccgggttaccgttttgggctcctgactccctcaacaaggagctgactgctcgtacagtagttctaccagtggatcaccgataaaggtgcgtagcacttcctgtgcttcttaacacctgagctctctatttgcaacacaccggagtgttattttccagcacattgagtggtgttaagagtgactgttgggcaggcatcgtccagtcctcttacgcgtccgctctgataatactcccatatttttcgtccccatgaagcacctagagagacaaaacgtagaaatccacgttggcaagttcctcctacaatccgcgcgaacacatttgacgtctgcttcgtctctgcttcgatctgctcgcgtgtttgtaactcggccaaggtgctttcggaattttctgcagcaaggccggcggcagtgcggagttccacatcggttctgcaagaaatggactgctgttgcctgtatccatagtttttattcgcgtgactgagcgttttcatagcaagtcctgtggtaggaaataatgccttctcagctagctgtcgtctccttcccctctcgttgctgaagggatagcgatcgtgtattgcggtaactgtgtcgatgtctgctcttgctagctttctgccaggcggcaagtgtcagaccacggaaggtgggtttcagcgtccagtccaggacgatttctgaggcagactcaacgtttttctcatcatttacctgggaaagactctcgcgaaccccgcagtccaacactttttcttttcgacacacatttacccggacaaatcgtgctcactcaagtcgcgcgagccagctgctactggcaacgcgatcggagaaccctcggtgttgccttgcgcttggcgccgctgcgattagcaaggcacactttcaggcttctttccacatgtgcggattcttgtcactaatgctttgctccttctttctcaagcaaaccgatcgcaacgcgtattaacgtagaaacgcctctcctggcccgctgtcttgccggtctgtcgacctttgtcttgccgtgcttccacacctagcggcaggccctgaccattctgccagcttccggatagttggaacgccggtctttttcgaaaccgtcggttctttggcgcttcaaggcgcgttctttgcggctttttcccaactcactttgcccaacttgctcgaacgaaacgcgcgctgtcgacccaccttggcgcatcctgagggcattgtagcttttcgagtttcaccttcctcaaaa

SEQ ID NO: 3023 - DNA, 1959 bp, Toxoplasma gondii
tatccatacacagacaactacaagtagatctctgcttttctggccgcaggcaccaagaacaggcgagttgaatctgatttcctcatacgaagattcttggtcttaccggccatgtactcgagagtgccgtcatcgactttcccgcaagtcaccgtgcggagcgcgtcgatgatgctttcgctgtcttgccccatgttcgcagcttgagccttcgaagaaatctaggagacagctggcatccagcgcgtccatgcaggagtggccggagtcaaagccagagaatcgagacgatcccaggctacgcggcctcaattccccagcgaagtcgaccgaggacctctcactcgcggaggagagggtggggaggagagcgaaggaaaaaggagactgagggggaagggaggaagaaggagaataaagaagagaagagagagaaagagaaggagaggcaaaggggaagaagcaagtggagctgcgcgataaggacagggacaggtgaggggcgaggcgaagaggcgtgacgtcgacgggagtttcgcgagcagagagggcgggagaggagggaaggagaggaaagagaaagaaaggcagctgcggagctaaggaaggggaagaagagcagaaaggagaagcagagacgagagagaacaagacagacagcgcgctcgcttgaggcgcgctccgccctccacttgcacgacgagaggctccgggcaggtgtgcgagaccttggacgacaggggggagagaagggagagaaaaaatgagtgaacgagagggagaaaatacgaaggaggcagctgtggaaaactggaaagagttccgagaaatgacagagacctgcgaagaaatggcggagatgaaagggcaaaaacctgagtcgagaacgtgtccacaagaagggcctcgccgagcagagacaaggagccgcgacggcacctgaaatcgttctgggaagcaaatgaggacaagactcgtttctcgtcctgcgtcattcaccatacacgaaccgccttctcatcgaatctcggagttttgttcttcaaacaccggcgcctctgcatgctgtgtgggtggcgacagacgcacagaagtgccaagagtttgcgcgacttttctcagaatcagcaagaaaaccgagacagcgacagcagcctcttgtctctcgcggctacactgtaaggcacatactgcctggctaaaagaagaggcggaaaacgaaaatgaagactttccggggagccacaaagaatctttaaagtgtaaaaaatggccagaagcgaacggggcttgcgtccaaaacagtggccaactcgttgtatatacaccccggaggaaggtaatttcacgaaacgtagcagcccccttatatataatgtgtatgaaagtgaatgtcgtcctcatgaggtcaactattttggtggaaatggggcctttgtagacagataacagttttcctcgtctttccagtggtgaggttcccttcttttccggttgtctatccagaaacctcaagacagaccaccgcggggctactgggaaactatgctttgatgaaagcgactgtcatcaactaaacatggctgaatgcgggaaccaacagtacagaacggagcatgctgtcgggcggttcgagagaatttcgaggtgccgcgagaatccaagaaacagataatggagtcaagaagcaaacggctctattcgatgatgggaggtcctgctcgcagctccgtctagtccgctttctccagagtctctacaccggaaacgccttgccggagcgactcttttctggtctccaaagttcgtgaatcgcacacttgtggaagtgtttaatttgtgtctgtcgctcgcaagtctcgctctcggttgttgttctccgtcgcattcttgttctgtacgtgtgtagcgttccgctctcgtagtcagccgatggaaaaggcaaagcatgctcgaaaa

SEQ ID NO: 3024 - DNA, 4795 bp, Toxoplasma gondii
agagcagtccgcagtgttacgtttagacagcgagaagacgaaaaaaaagcgtttgacacattgaccagctcgatgcctttgtttctttctctttgctttcgatgaggctccatcttcgctcacagtcgtctccaggagaaggaggcgaaggaaggacgtcgcagcgccaagaaagagcagcgctccgcagatcagcgcgccgttgtcgacagcagagatcgatccgaggaggagagcctgttgaggcgaagccggtctgggagccacagaagaaggcgttgttttcttcgcctcttccgcgtcccctcctgctcgcgtttctgtaccgcattgtcctctttcctctgcatcttcgcccacattcggatgcgcagcggcctctctctgggcaggcggatgaggagaggaggcacccgaagaagaggaggaagaggaggagggggacggagcaggagacaagtcgccacaagacgaagcagcgagcatcgacgaaggagacggagcggagacaggagactgtttcgagaagcgatcgactacgcgtccgaggtagagggggaacagcatctgcgctgcactgctcaacagaatcgcaagcagaaccaagaagagacgaagctgctcgtgctccatcagcctccacaaaacacgcagagagccttcagacgaatccgagttggaggaagaagacgcagaagaggaggacggagatggggacgaagaggacggagagggggatgaagacggatgaagagaagcagcgggatgaggagaagaagagggaggcgcgctggcatggactggagacgcgggaggagaaaaggaagaacgtacagacggggcagccttagaggaaggagacaagagaaaggcagtcgaatgacacaaagtggagagcgggaaacgagagagacggacgatcgaaggagatggtgcaagcaggcgaacagcctcaggccccgtcgccagtggcgaagaagagaaactgaagccgagactctgaagagccagcggagactgacacaactgcgtcagtgggaaagttcgaggtaaacagaaggacggaagaacacctgatggagctgagaggaaaccaggagaaacaggcgaaaagcggtctcgctgaccaagcgcaggggaagcctcaaactgacaagagaggagcgttgacaacgtcctccgcctgtctctcgcgagacagaaaccgtctgccgtatgtcttcttggcacagaccacatggcaagcgcctcaggtgaagcgaaactggctttctgcgctctgtttgggttctcaaaactgacacgagacatgacgcgccttcctggccaggggtacatacacctcacgcaggttggcgcgtctacgcgtgggccgcgccgccgaagcggcactggcgacaagcgcattgtttctcagggcaaagaacttgggagaggatggaaatgaacggagagaacgaagggagggacgcgggagaaaggggaggaaagaaaagagtcgagaaaaatggaaagacggcaggtcgaaaagtcgacgggaacagcacgaacagggggtgacattgagtggtgtgacagctgagagacgacgagcgggggcggcaggagagattgttgtgaactacgggacttgtttatggcacaattctttggatgtgtcacacggaaaagagtgagaagcaatttgtccgtctgaaaacgagaaacacctcacgtaactgtgcgggggggaggggggcttcctatctcgaaaactcagttagaagcgacagctggttctgaggtgaacacaaaagtacggctttttccgcagccagggaaacggacagaacgcagcaatgacgattgccaccaccgtggcgcatccccattcctggagaagtccgagagaaagcaagacctgcgtgtgctttgagttcttttgtctccgtcgcgggagacacgggcgaccgcacgacctgcttgctcctcgatgctcgttctgcgctgcatcgacgtccctaactcgattcgtcactcctttagtatccactgtttttcttcttgtgcgaaggcctagcagctgccttgccagagctatatcccgtctcctccttcaagagacaggagacgctacacaaacgtagaagagcagggaagacagcgtcttcgtgcaccacgcgcagagccggcgttcttcgttttcaagtggttcgtctgcaccaagtccagaagtggattttcagaaaagaacctggttgctctgtactgctcacagattcaggtgaattgcctcgatgctggcacatcggggcttatcttttcacaggaaccttctgagtttttgcggtactcgattcttctcaggatttacggtaccgagaccgacattctcgcttctactttactcacaagctttaagcgctttgctttattctaatgtagaacgctcggtagagtgcttctgctgaaacaaaggacaggactgttgttacacagggcgtacaagcgatgatcgaaaaaagtgcgagaaaaaacagagaagggctttacctgtgaatgacaagcatagaagctgctttctctgacagtgaggaatcctgcaaccaagtatcaacttcgacacgttcagagtttccaacacagcggggaagtgagcttctaattatgtaacagagtgtgagcacagatgcacgctttggcataatcacaccgaggacggttggtaattacttgcaatccttcttaagctgtaggtatcagtggataattcgcgggtctcgggggggaaccgtgtcttttcttagatctgaaagagtcaagatcttttctgtctgtgagaattcgtcacggttatgctcctagcagtgccatcactcgataaccgccatctgcttgcgcgtgtacacgtttcaacgtcacagttgcgggacgatcttcatgttccacaatggaaacaacctttctggagctgcctgcgctgcctcgttccaattcgcccacacggacagttgcgccttcgactctacagaagacatctgctacgttggttcactcggtcgcagatcgatcctttcctgtgcagcgtaagaggcacaagcgtgcgtgttgtactaaattgtttagtgttaggttcgatcttctacactaacggatctccgaaccttcgcagcacgactactcttgccaaaaaagtcgttccttctttcctggctcctcatccgtaaagattcgttggtggagttcgtcgaaaccttttttgtctcgcactgccatttccacagtgtcgacttggaaaaatcagatccagaagatcaagcgcgatccccgcaacgacactgttgtgacgtgtcaaagacaaagtaccttaagtggagttcgacagccgtcattcgggtgcgggtatcacaggcgaaaccggttgtcactgttttctgtttcgacggagtcctcattcagcgaaagacccagttttgtcacttttctgtacccgcaccgcaagaatgggggtgctgttgctacaaacagctgatgcccaccacaaaaagagactcggaagtcagcgcttgcccgatccaagtttcagtgtgctagcctgtatttgtgaacacaccctatatgtgtcagtctactcggggcacacctggtgttttatggtgtactcggaatcgaaattcactcttagcttttgattcagttgcagtgacccgtgaacgattaatcgtaacagatgtcaccagcgttttgcgacatttcgttgcaaacaaacgtcgtgaaaggaattatcaggtcgtcactgtgttttttgaacacagtctgcaaaacgtcaatcgtcactgtgtaccgttggaccaccggacaggaccgctgctcgaagtggttcgctgatcgagtgccactaagaaaagcgggtaagctgcaccatatttctttcaaattagtcttcgttttctcacttattctagataaagctgctgaacagattgttgcgtcttactatctgtgtgctcgagcgactcgtcgctttccagcgaacccagctaacttcctcgttgatttgctggtaggaggtcgctgaagtttttgaggtggtgatgattgcatgtctaccgtgcatcctttcccatctgttggtttttctgagattgtgtgcgttttgaacatttgccttcgacctatggatctcgtcgccgctcccgtgtgtcgacattttgcgttattcacttttggaaatcgactgtctgtgtcagacagccagtgcagtgtgcgttttcgagagagatgcggacgctccggagttcgacaggattgttataaggtaaagaaagactgtcttactgtgaaggcgggcgtcagcgtcgtctgttagcgtctgcagcgttccaatgtgcagtggaactttcgctacagtggcttccgtaaacgatgacggcgcattgctcagcttctgtcgtgcgttctcaagcggctgcctcgcgtttccactttggtttagctccttgggctcttcgaagggacagaaacaactgaatcttccacggcgtgtcgttactgctgtggcttcgttctccggcacaagttctgcttttaggctttgtgtctgactctcgtagccgcaatgcctcccgcactcagttccccgttgtgtgccttccggagccaccgtggactgtttacagacttctctgacgtccctgcgtctgacggcattagtctgacgggtgcgcttgtgcagcgccgaatgaacagttcgttctcgtttgtgtggcgccttcgagacagtatgaaagcaagtcacgggagcgcgaaaaagaaa

SEQ ID NO: 3025 - DNA, 2884 bp, Toxoplasma gondii
cagcagagaaacagcaacgtcgaagaggatgcagtggaaggaaggaggaatccgagttgagagcatacccccaggggcttcaggggatccaggggatgaagaaactgagggaaggtagctgtgcagcgaaaggaaatagtaaaagacagtgtcaaagtgtagacatgttcgagggtttgcctacatgcctgttgacgcccgaaagcctctgcttcagcgcacaggaaattatttttgcgatgttgaccgaagttacggagcgcgctatggctctccactacgctgaccaagttttggtaaggaaagacgacgaaaatcgaaactaagtgaaggatgcatgcaaggggatgtagcaggcctcgaagcaggagttcgctgcagtgagactcattgtttttgcttcataaaggatgatgtgatagtgtctggagcagtttcaagattcctaacacactctttcactgacggggcacaaccgtatggatggtacaaaccgcagctgcccacaaatctcagttgctaacttttcttttatcgatctttttgccgtatcacctagggtgaggggtatttcttctcttcccaagagtggctgcctgtctccctgttgggctttccgccaaagcgtcattgcaagccactccagttctcgcagttttaaagacgcaccaaacgcttccatcttgattgccttgtatcacttcaggttgtcggcggcgtcggctgcaatttgcgcctgcaagaaatgctaaaagagatggcgatgagacgcggtgcttcgatgggcggcatggatgaccgttactgcatcgacaacggagcaatggtcgcgtatcttggctgcctgatggcctctaagggtcagtttgtcgatgtcagcaaagcgcactaccgccagcgcttccgtactgacgaagtgcccgttttgtggcgggagaacgataactcgcacgagcttgccgagatgcaaggttaacgcgcaagagcgtaacagacccgatcactttttctgaccggtgatgacatgatggtgctgaaatgccaaactggatcaagctccgtctgaggaggctctctacttctctccgttagcttcgcgtctataaatgtgcgcagttacacgggtattcatgacactacatcgcaatgttttattggttgcgagtaactagtatgacgagtacgactttgcttgctagggtcccaactcggttttcgtggagcatgaacacgatttttaaaaatgaaggttattgtcgcttcaaggacgaccggacaccgctggtgccggaacctgaagcaacaataaggcgcctggcctgcgatgggcaagaagcgaacgattgaatgattctgggttttcagtaatgaacgcgacagctaacaagggcgtgtggccttccgtgtttgacccccaaaatgtaactatagagaaaacagatgactccaaaactgcacttcagacatacatttcatgccctgaggcagtacatccgacaaactggatgatttagttgggacattgagttctttcgcggctcttataggggttatagaagttcgtctgaagttttttccatttctaggctgtgcttttgttgccgcaagcatcgaatgcattgaggtggctgatgcaacattaaacaaagggctctctttgctctgtactcgggtcccattcaagggaagacgaggaacttgaaggattggtccgactagccggatctctttgggtgggatagcaaagatggtatcttcgaaaaacaacagcgaaatggcttcttgtatagtgtgtatactcgcaaattcttcaaaaaagcatcttctgactcaccgaaagtctttttccgtgatgcggtacaatgcctcctcctgcggcgacccccttccgctgttgtctcatttgtttcttagttggaaatacatgagcattcactttgtatgaactagaatgcaaaagtccgagaaaaacaatatccggccaccggtagttatacccgtttttcggcggtcctttggtatatctacaagcgacttgaagcataacacagaactgaagtcacaccaccactgtaaagtggcttacagcctgtagtcagtggcgcgatatgtaatgactgtgcaagtgttgtgccataaacagtgctgtattttttaagctttgaagaaacgtaagtttccattgtcctgacgaggcgagcgcacaacggaccgccagtcccggtgccaccctgcaacgcatgcataaaaggaattgagtgcatcgacgatgattacagcgatacggggacttcctgtggtgtgacacggtcgtccccgttttagtagcgtaacaaataagcttaatgcagtgacgggtaccaaagcagcagtgaaaagagctcgaaatatgccggcaacgtctcacacaaggcggacattgacagcctgattcgccagcgcgtgatgtctgtcgactgctacagtcgcagaagtcaatgagcaagctttcattgctccaccattgtgcaactgctgaataaaaatagttgtctacgcgttttgagtttttgtacaaatgataacttttggagtgtgtgctgttcagcggactgcgcagatactgaaacatttgcgtgagtgtgcttctcccaaagagaccacgaagcagggtcgttgtcaatagaaaaacggcagctcaccggtttgctgtttctttcgttcgctggctaagcgtttacgagaacaagctttcatgtctgcacttctggaccgcaccaagtttctttccctgtgttgcttgtgaatacatgtccagctggtttggccgcggcccctttccctctggccagcatttgtgtggaccaacaagcgtgtttttcctcatcccgctctgtctacgtga

SEQ ID NO: 3026 - DNA, 2065 bp, Toxoplasma gondii
tgaacacagcgatctacgatgcgactcacaacctcacactggagagagaaagagcaacctgtgaagagacagctaacgaatttctcacctgaagagacacacagagcaccgctgctggctatgagagagcctgcctctttcttgagggcttgctcgtacaaaacggaaggggccgtgttgtggaagagctgggcgcatgtaattccgacctgagacggcatgaggaaagtaaaaggtctttcgcataacgttgacatacgtgcgtttccacagggacagcccggggacaatgatagtgtgacgctgccattgatggccagacgactatagggagacaggttggccacgaacatgaactgtctctggtgttgttctcgagggagctgaaaagaggaacttcagccgatgcaggaaaaaggtcgaattcctcgggaatctacttcattcaacttttctgtgctcaacacgtaaacaagaaaccacggaagcttgagcatgcgtgcgcctctcctaccgcttggacattctcttggaagtcgatttctttctgcagctggccaagatcgagaatatccttctttgtcagaggacaatcgcctggtttgtggtgttgcaggttcgcgtcgatttgcttcttgagcatctctaagaagctgatggagtccttgagactccccgacgactgtgttctattcatttttctgaccgagcgagagaattggacgacgaattgcctctgagcatcggaagattttcggttcactcccgaacttccacggagctgacgaaagaatgtatgcctcacttcagcgatatgtaagccacaggtttcagagcgggaacagcaagggaactccttgtctgcaagagagtgacggacacgtgaggcagttgaaccttgtgcgggcaagaaaccccttcctgggaggaatctgtacacctctcttaagacgttgcgagacaagtgcattgtataattcattttatgtagacaaccaccccgtgcgaactgcgcagcgcaggtcgcgtgcgtctccgatttaggcccgaccccccactccccaaacgaccggtctaacacatgcgcgggttttttggtgagacaatcacagactgatttattcttggcggtgcggaattggaaacactggtttcaacgccactcagcaaggtacgcgacacgagacgtgcttttttctttaaatgaggtcgaaatgcgcactgccactccgtaaaacagaaacacgatgtgtacccgtggagacttcgctttccacatgcatgcgcttcgctcgagatgtcctatattcgaaagatcgtgaagcgtttccttcactttttaaaataaagtgtgctgaaatcgagcgttgccactcatctgtagaaaagcatgtctaggcgaatacatccatctggaggagctattcggttgagagaagcggttgaaaaaaattgttttcacttccggtgacccaacacctgcctgcattattttgaaaattctgtttcttctgtcaccctgacagcgcaatctcgtaaatgtcgccgtcaacaccgagaactccttggagaactccttggagttctcgttgatgcgaaggtagcttgcagaagcgtgatcagcgagttaccttcattggccgcgagtgacggaagtgcgagcgaaagatgtttttcttcaccaacacggataatacgaggtccttcttttcccagtcaaacagcataggcatcatcccgtgcgggaacagaagctccttccagacagctgcagctatggcagtacatccaggctgatctgcacaattgaaggcccctctcgcacttttcggaagtttaccatcttctcgtcacaacagctcagaggtattctgggcagagaaactgcctctgaggaaaggtcgaagaacccctcgtttgccgtctctgccaccacgtctgatccgagtcatgattctgtcacttttgtatcattccttgccacatgcgctttcgcgtgtattcgcctgtcagcggcacagaatatgcgaatgaactgtcttcgatttccgtctttgcttcagca

SEQ ID NO: 3027 - DNA, 1392 bp, Toxoplasma gondii
gtagtgttggtcaaccgggtatttcgagttcgaagtggcactctctcggtgcgttgcgccctgaggcctaaaacactggatgctgcagtgtgtagtttctggcatgatggaggagaaaacgctggcagatttatagggtatctgggcgaaagtcagctccagaaaggcaacccgatggcggccttggcctacaagtctgtcggatggcctctgttcacaggggtgaagccccggtacacggacacgtcttcatatacgattgcaatcggagcggcggtatggctatgaaatcgcagatgagacactgcttgttatcctcgcctccctgcaacactgagagcccgctatttgtaacaatccggcatggtgtgcgggataaaagagttttacgtcttggctcaagaaattctgacgtatcttctgtgaagatccatgcatacaacgaaaacactcagtattgaagatgcagtagcctttcaggcctcgtaacaataaaatatacaagcaaatgagaacactgcatgttttgatctcgtggtgagttcagttcagtgcaggtttcgcgatttaaacgaggtcaaaatgaactagcccgcagaagatgtgtatgcagcccaggtgagtctaaatgaccatggttagacgattgggaggaaatcaatgaagggagaaacatgtatagtttcgctgattctgaaaataagcaagaacgaagcattgttcttctttagttaaatcagcaatcctcaccagactcaatacggatagcttcgtggaggagttcgttcctgtttactgcaggtccaggtgacgtgtgtgctcagactcaggcaatttctaacggtggagtttattcgaatgcacacacgaaaaacactggacagaagcccttcaactgggacagatataaggagaaaaatgaagggagtattttctccctaagttaaagaatgtcgaagtaccaaacgggcgcatgcttatgcgctggcactcatgtgcatgcgctttgattttcttgccattaaaaaatggtggctcacaactgcagagttctttgttcagaaaagacacacgctatgcagtttactgttgcgtgtgtgtcgaatacattcatcgcgcatttccttcgtgtgtcaactgtttttcttgtttttctctgggaggttgcatgcctagaggcgtgccgcagcctcaatctcaatagacgcgggaaattgtatcatttgtgtttgaatccctgttcatgtgagtccgtatgtatatgataaatccacataagttatcttgtttttgtctctctgataagctttcatgcgtgacttgtgaagtgcatttcttagccgactttaataaacaccctccgtcggtggtttacctaaacactccacaaaa

SEQ ID NO: 3028 - DNA, 2649 bp, Toxoplasma gondii
gtgcttgcagtcacttttattggcacttggcgttctttggcaggaagcgagagtctcaagagactgtcggtgggaactgtggctaaccggatgtcactgccctcgctctcttttacaggggtcctttttgcctctgttccgcggcgagccgcattgaacgtcttgcagacattcctatgtgtatcgaggtgtattgagcgaggtattgggcagttacatacagtattgtgcactgcgattgcatgctgagaattgtatccacggagtgcgattttttcgtcagagctctttccacaaaacactaaccttgtgtccataggcaaatgaatttggggtgtgccgcgtaattatgcagtatccagaaagccgagaaatagagtcgccaagctcgagatcactttttgcgtgatcccactggtcgtcctgtgtggcctctagaaacgaaactgagtagtgaggaaccggctgggagagttgcatcctgtagagatctctgctttctcacggaacgcgtcatgtctcatcgagaagacccgcacgttttccggtgttttccaccaacttcgcactgcggttttcgacgaagacaacgacgctgacaaaccaacaatgcccgcttcactaatcaaattcgacctgaagccgcgatgcacctgctcatcggggcctcaaaacgtccacgtagacgcgtaaagatgtatctgcatatctaagtgaccggttgaatactcagaaaaattttgtgttgcggaacagccaccgaacgaatttgcggtgagggagtttgcaacgagcagaaagtacagttgcacaaaagagatgatcctgttgcctcaaagtttctgtctcagccacactggaaagcagttccgccactgcgtgaggaatagcggaaagtgcaagttcggccttcgcttcccatagtgttggcttcgcacggacagggcaaaaatgttccacgtctaccccgaaaacaatttgtgctgcgtctgcatacgcccgtgtttttgtctcggcttgctgtagccaaaactgccaccctctagcggcttgaaagtcaaaccgaggcgagaccatttaggacctctcattaaaacatgaggaaaaaggaaaaaaagggaactctaagcgctgcatctgtacctgcagggctgctagagtcattcagatgtgttctcgaaatcatggtaacacaatagaagatctcgttcggatgcggggactctgccctgccacaccgaacagagaaatccagttatcatttgccgtgtacaggcagctctgcagacccctgaaaacgccaagcagcaggcactctcgctggcgtgcattgggagcgtgtgtcgttgtcttgctgctgattcgttttgatttttccagcgccgtcagctctgcaggaagcccgcagtccgctgcaactgcatccctgcttcgcatgagcattctagtttctcttttcgagaacacatccagaaatacggtgcaaatgcgatgatgctactgtgtggcgagggaagggtttgcgtgtcgggacacccgtgaaaacggtttttcctgcttttcacacggcgcctggtgttttgttcaacgaccttctggacttctccaggggagttcgaaactgtcattgtagttgtcttctccggtgcctccttgtgcccggcgtgcgacacttgaagagatcgacgcatctgtgtgagtacggagcgatgggacacctgagtatgccaaagatctgaaagacctgtgctaccgcgacgtgtgtatagcggtgaagtcgaaagctggccacgagccacggaatggagaggccggtgcgggagcacaaacaaagtttgtccaccgacagcgatgggctagcgcgtctcctgagtattctgcgcctttgcatgcaacccccagttttttcggtcgtttgctggtgtgtatgtacaccgaagtcttcacctcgagaagtccttctttccatacgaagcgatttcctttctttgtcttccacatcgtcggaataccgtggtggacgctctctgcactcactcgctttttccacctctgtcggcggtcgccttccgagtcctcggagagcaaatacttttcccgttctcttctacctcttcggttcgcttttttctggacatgtccttcggagtcgaatcaaggggacagacacagagaactccgttttctatcatttctctgtgacgcgttctgccctttgctgctcgtctttgccttcctgtctccacgcgcctacacacagcaagccacgtacaaacagaagtgaatcggcactcggtttccccgtttctgtcattatcccctttgtcgttgaaaacgtgagacgattcgttctcgcgtcctcttggttttcgttctccgcaactcttctcgacgcaccaaaaaccggtgtacgtacacttcggcagacagatccgacgtccggtattcgatactgtttgcatcctttccctcgttttcgggtttgttgctcttgaatctcctttctcttcgtggaagttccgctcttctgtcgtccgtggcaacgctgacgaggacatctttccccctctgcgacatctcgattatccactctcattcgtctcagtcgagagagttcgacctcaggtttttgacagaccttcgcaaaaa

SEQ ID NO: 3029 - DNA, 3728 bp, Toxoplasma gondii
gcgtctgctctcgcctcactgtgcattctgtctcctcaccttctgaggcagcaggagctgaagagacggcggccatgcggcctgcgacagctgcggtcacctcgccgaggttcctccagttcgcgttttccgctgcctcttctcttccgcgagacaggtgctctgtcactgcagctgttacgctgttcaaccgcgtccacgcgctctgagagttctctcgctcgccttcagaatacctctctgcatgcgcaccgagccatctgccagcccccgccgcgagacgcccgaatcgaaatccgccgtccgcgaatggggaagcagaggaaggagaatcagaagcaggagaagaagagggagggagatgagaagaaggcagagaatgacatgtgagttgagccggggaactcggagcatttttcatctgagggaaagggggaagggggtcatcgccgtcgtcgtcctccatgaggaattcatcgacttcgttaaagatgtccgtcatggtcgagagtggaaacaactcgaatctggaaaccgagaaacgtggaagctctgctctggagacagatcggtcagacactacgacgtggtgaccctcagagtgggcaaagggcgttctttccacgcacaggagagaatcgcgacagcaaacgttcgtctgtcacacaacaggatgcagccgagttgaacctcgacaagaaggagtgaaaaacgaacccaatcctctgcaacagagaaacacgagcgtcgaaaacgacttgcacccgcgaaggcagttcggttttttcgggactgcatgcgttagcggaccaaagtcgcctcgcgaagtcctttctaaggcgactggcctctctcccgtaagtgtcggttctctttgtgatttacttttgcttctgcgccgtctgggtcagttctccgcagtacccagcttctgtctcctcggtctgtattcaccaccggggccgctcggaaagtcgtcgagtttgagtccccccgttttccagaaagcgtaggatgtagtcacaaatatgtcgcgggacttctcgtctgctgcctcctgctctgtgtgagcgtacatgtaccacctcgaatgggggaagggaggaagccggtaaacgaggacgcagaggatcgtcctcagataagaagcgcccggcgctgcagcgacgttaacgcagagcgcgggaaaaacacctcagagtccagaatggggaagcccaactgctggtttctcgagcgcaaaaagaatcgcgaattcgagtagctgaggtccacacacgtccacacgctatcgacggaggggggtactacttgtctgggagggcggctggccgcggtgaacgcaaaacgcgccgcttcgtgacaaacaaaaccctcgtttagagaaaaacacgcacagaaaaaatgcctctgaggcaaatcagaaaaaaagatgcacgacatgctcgttctggccgccctactcctccgccgaaaatccacagccgatcacgcatactgtctcaggagcgggaaaacgacatcgtttctaggcagcagcaccagtgcgacatcgcggcaacaatgttctgaaaaggtaccgtgcccgtacgtcttgcttgcgaaaaaaccttcgcagaattcacaactttgaaggcgcaacggtttttttaagggcgaaaattcgctgactcgaaacgcagcttctgccgagggagtcgggtaagcaaacccagaagtggtcggccaggggaaaagttgcagggggtttcgcgctgtgttccgcaagacgtgtgctcactgcattccctgcttcctctctttcctccgtcgtttttgatgtccgaattctcctccagtgtcagagaaaaaacagagaaggttgtgtgtcgagtgtcgcagaaaaagacgcttgtctgtgcccggcgtagacgatctcttcggcctctcggacgaaccgagttttcacggtgaaccttttgtgcttacttttcgtctcagactgtgttgttgttccctgcttctcaaaagccgcccttctctcacttcttgttcgccgattgccttcaagaagtgtggagttcccttccttttttctgggttctccggaagcctcctgtagcaaaatgcgctgaaattttggacacttctcgacggtgtctcgctttaggacggacctcatggtctttagggcaccgttttctttcactttttctgggaacatcacagttttctccatttcagggaacgaacaatctgcaagcgtccacttgtcctgtggctgctgggctcggatgccgcctctgtttagcaagtgtagcagggaccggatggcaagctaggtccacttcactgcagtttcaagttccaaaccaaggcatctcaatttgtatcgtgttctctgtcaacaagctgttgaacctgtcgacggagtgtcgtcccggctcctatcccgcgttcgcaagccgcaccgttttcagaacagtgttccccgtggtgttgaaagcgggctgcgaagcgcgagcgtttcgttttgtggttttttctgggaaacgatggggatctcttcgtgtggcgagacgcttgcctcctgtttcaaggcggtgaagtccggaaccgttgacttcaaggggcaggagcgagtatactcgtggttgatatactttgcgtgggcgggtggcctcagcgggtttttcgtcggagggattctggaagacttcacggtcacagtgtacacgattttgatgtgcatggccattgcggcgattctctgttttccgtcgtggccatgtttccacagacaccctgtcgagtggacgccgcacgaccccgccaggctggctgctctcttcacgcagcatcaaacccaggaagaaactcctcagaaaggtgcggggaaaaaacgagggaagaagagcgctgaagtgaaacggaaaaactgagtgtgtgtgcgtatgtagacaagtgagtcttcccagagttcgtccggattgttgcgtggatcgtgtcaactggacttctcgttcgtcaaagacctggtcgtctgacccaactgctctccataaaaaagcttgttaacgctccctcgaaaaatgcgacgtggagagaaacgtttgctttttcggctttcaactgtccgctgcagcgacatgttcctacacatctaaagagcccggaagttctcgattggcgcggggtgttaaccttacgtaaaatgcggttgctagcgaaagaccaggccgcagaaacacttcagagaacccccagtcgccacacacagttcaacacgttttcagcggatgtagacctcacaagttcaggttgcttgtttgttgaacagggtgtcctttctgggaacgttccgacgcgtatttcgccggtgtcgcggaaaaaagtcgatgtcagagaaacagaacacatccctatctcgaggtgtcttcagagttgataggaaagaagagcggaaattgcactggattcggactggtcatcgacgctcggcctgagttcacacttgctcatacgcgtataacgccctgttgatggctagttgtcgacaggctccccgcgaacgcgcttcatttatgttttttcttctgtagagttcctgtctcattggcgtcttatttctctaaattgtcttgctcatcgccacgtgcatatcgttctgcgcgaattgcgactctgtctcgagaggtgtcgctgcgtacctcgccaccggcgatttgtttctccacacacgcttagta

SEQ ID NO: 3030 - DNA, 2820 bp, Toxoplasma gondii
aaagtccctgcatatccagcagtcctttttctggtgaacgttcattttctctcggactctcgcagtgaactcttcgtgagcgtctgcgtagaaatcaatggctttctccacacacacccatctaggtcgcattctgcagcgtgttcgtcgcttttggcggtagtaggtgacctcagcgagcgtctgcagcgtctccagttctgcgagtttcgcctgaagtcttcgagccatgtcatcgtctgaaaatcgtcccctaggcgtatgcggagcggtcggcaggctgtcgctgacactgccttctcgcgcattttccagcttttcaaacgcagacatttgcggctgatcgccggcgggaggcggcgcgaagactggcacttcgtgcgcgggttctctctctggcagttggacagaagccgccgagggggaacgcgccgtcgactcggacggctccggtgtcggttccctaggctctggaattggcacgcgctccggggaaggtgtcttgagttgtccaggtgctttcggaggtggagaaacaggcaccgggtcccggttgaccaactgaacttcctgactggcttctcgggaaggctgctcactccccggcggtgtcggaagcttctctccttctgcatgaggggcaggccgcggcggcacctcgacttcctcccgttcctgaggaggtgcctctacttcttcccgttcctcaggaggttcctccacttcctcacgttcctgatgaggttcctcaacttctttcattggaggtgtggcgggtgcctcttcctcacggggagaaggcgcttcgatttcatctggagcttctttttccgaaacttcttcctcaggttcctcttcaccttcaaaaccgttttcttcttcgtcttcggggagttcgatgtggtcccgagttgtcatttccacggggatgctggccggtctcgagagcggcgcctcgccgaggtcttcggcgcgggttttgactgctctggggtcgaagagaggatagcgaagaggaatctgtgtctcttcttcttcctcctcttcaggctgtttcgcaggaatttcctgagccgccttccggctgtcgctgcgcctccccttctttcccccgccgaagcagaaaccgaacggattcttcatgcgtcccatagtgccggcagagatggatgacgggaatccccgcgtttttgagaaagtcttaacggacgctaattaaacgtacaacagtgcgcccaggactgttactttgtctccagagttttcaatacgcgaaaccagccgggaaggaacgttgaaatgcaccactcaacctagctcgcctcgggtcggcaggtgcaggcatttagtagaggttttccactgctcttctgaccaagagaaagcccacgttatattcacatgaaagcccacttcgaaccgccgaacaaagacaaaaagcggtgggactgcggcacttttcctctggagttaccgactcccccccatccagagtcaggaatgcaactgtcacgcaggagacacagaatacccgagagaagttgaaatagtccaccacagaactctcaaaaaggcacagcgattcaagacactctaacgaaatcggctgcagtctttgctttcgttttctcgccccagagcactggaaaacaccacaacgcgcattgaaggagacgccgcagcctatgcagccgtcgggctgctccgttggcttttgtcactggactgtggtcgacgcagaagtctcagaaaaatttactgtagatcttgacttcgtttgagaatcagatggcggactccttcacagagacggccgccttgcttgcccagaatgttgagcctgtcgcagaattggcaaaacgcgtcgcctgtacctccggcagcagcgactgctgactctacctgtccgtaacctggttgttcggctgatgatcgccgagttttaagggagtgagagttgaaagtcttgctttgtttcgacttaaggaagctacaacgtgaaatctggactcagacgtgggccacgagatatgatacccccgtcgtcgaacacagcgcctctcttgcgttctcacacctcctcatgttctcgcgtttccaccagcgaggactcacgggggagcagctagctgagcggcacgattttagcatcgaaaacggagtctcttttctcgtgagaaagagagaacttggaaaacgagtcggcgatcgactggggtgctttccatctcaatgaaagatgtatacacaagatatatacagagtttaccaaagggaaaacgctcaaagatttcataaagaacttccttgtctctccacactcggcgtgccttgttcctctcgctcgcaccacgacgaccaagacatgtaaaccctaaacgcgaatgtgtcgcgactgtgattcttcttttcgccgtgactttcttcctagaacgaaaactttcttttgtcacgcaggtctaccagttccaagctgacggcgtctgtccctgttacacagaagtcggcagtatctgtgcgtggtttagacaactcacgtggaactctatgcttattcctggcttttgtttctcctcatcgaaagtcctctggcattttcttcgtctcgtccttccttctgcttctgtggcggaaactgtcgcttctgtatggtctccacccgcgtttccgtttagcgtagtgttggccgaaaatcccgtagtgagctctgcgttccacctcaatttcctgctttcccgcgggcaaccgaaagatcccttctctgcgctgtttttagcgggagtcctttctgccttacgtgttttccccttatttgcacaa

SEQ ID NO: 3031 - DNA, 2132 bp, Toxoplasma gondii
acaaagcgcgcgttcttcgcgacgaagtctgtctccgagttcagttcgaggagacagaccgtcttccctcctccgctgttggacgcctgtccctccgtctctccagaggccgcgcctgactgccgagccgccgggagacacacagccgcgatcacgccctcagctgccacccggtcggctctcctggaggcacgagcaatgcctcgctttcggagattcaccgctgcttcttctagatcctgaagacaaccagacacaaacgaggggaaacacgcgaaaggaaactcctaatcgctctcgtgtgaatcaaaaaactccctttctgtgcaaatacacacttgcccacccacctgcgcacacatatacttacatgcatacatccgtacatacccacaggcacacacaacatatgtatacatatatacatatatatatatatatataaatgtatacattatttgggcgccctgatatggacaagacatgcgtttcatatgaatagatttccggaagacacatatcaactttttatgtgggaatgtggacgacgcggtgtgtggacctaagtgtcgcttgggatgtctaacaagagtgagctggaaaaaatgtttccctcaccatattggattcttcgagagctttgcggcactctccaatgctgaccccgccggtacgcgctcgcagttttttgacgagagcgagaatgtcgccttccttcgctttgggctcctcgcttctcgtcgagctctctgcgaccctcgaggccgccgctgcatgcgcaaatcctctgaagcaagtgaagcccgcagcgggggccagcgagggagaccgggaagaagagagagaagtagaataagatggagagacatgctcacgaggagggtgagaacggagaaaacaagaagaaaggactcccagtcgatgtgtaggttgcaggacagaccgggtcatgcccgcgagggaggagcagctccaccgagccatttggtgagagtggaaagagagaaacaagcgaaaataggaggaggctttcgagacatgccaggaaacgccacgcgtgcggctgcgctgggtctttgagaccagagagtgtccagctgaaaaggaggacggccgaggggaacgaggagacttcagtgtgcttcagaccaagagttcatttcccacggctcaatacacttgccttgctcaagaatgaccttgaaaaatcagggacaaaacacaggcgtcgtcgaacggagaacgccgcgaatccgacggtcaggaaaggtggacctaagactgagggtggaaaccgaagttcgagctggtctactgaggagaatcagaggaaaaattcgcgagttgcacgattacaagtgacgggggagggggggggggggaagtggagacgaaagaaaacgaagtgacagccgagaaacaattcgcctcgaagagacacatgcaagtgtgtgtgccgtcagagaaaagtcaccgcgcagagaaaaggttcccttctctcaatctctgggtagacgaggcgaggagagacatcaggatcgggatcgactccatggaaaagtgtgaggagaagaacgatattctttttttcgtgaagatatcggcccttctttttaggaaaagcaagcgagagatgcatacgcgatagatgtacttggctcaggcgccggggggttctcgttcgcgaatgatgtagcattagcttttgtgttaggcaaacatttgggctgaaaggacgaaaaacaaacaggtctggtggcgccattgccttgcatatacaagaaagggaacaaatgcaacaccctgaaggaaagtgagctccgctgaaagacgccagagaacatggggcctacaggaagacaaacgaatatgttttgcccgtctgattccatcgttgttctctcccttccgtattcacaatccattcctctctccatcctcctgtctctttactctccctgcatctctgtgcttcgttctctgtcgctttgcagtcgctgttctagccttctgcctcggtaccatctgcgtctctctcgacctccgtccgtctttgtgtttccgtgcgctactctttgactgctcgggagttgagatctttttacagatcttgacggtctttttttccagaa

SEQ ID NO: 3032 - DNA, 4539 bp, Toxoplasma gondii
ggcgacggcttcgaaaaggacaaacgagaaagtgttttctttaacggagaagaccgtaaaagttctgaagttgcgttgcccgtgtctggcgatgatgctcatgcgttgctgagccaattttgcggcggggatcgcttcgcgaacaccaacgatcttgccagcgtgaatactgtgaatgcgcccgctggcagaaccgcctcagctggcaagagcggtggagatgcaaaccatacgcaagagtcttgtgagactgggtccagccgtcctagctctcaaagtaaagatacacccttgctgccggcgtttttcattgaagtggatgaagagcccatggaggaatcaactgcgcaaaaacgactaggtcagttgcgacgagagacttgcctagacacctcggcacttcctccagtgtctctttgcttcttcgactgcccgagtgaacaacgacagcgaggaatcatggggtgatgattacaatcactcgtaggcgacatgtcacctggtttctctcatttgtgtcgttcgcttgctgcagacgaacgcgcccgcgagttgtggagtgactatcagcgcaggtatgaaaggaccacagggtgtagccgaaggcgttgaaaattttacggccgtcggcggtacacgcggtttcgcatgtcgtgttttttggcagggacgacgacaatagtttggcgcaagaggacgaagcagatcgagcctttttcgggtgagtgaggtggtttcggttatttcgtatcaactatgtctggcaaaggagcagcgcgaagaggtaggcttagatagtggatcacttttttcactggaattggtagtcaggtgcttttacaagatcgttgcacttccaaatatttctgtgtcagcatggtttcgtggcataaagcacagatgtagtggaataggtgaccgctctctaccacaggaccttccgttcatgtgtttgcgtggtatgtttcctgactactgcagcggcggagcatttcaaaatgaggagtacgaggccgccgaggacaaggtaggaacaacatgttttccgatttctcctgcagctacaacgaatgttcgtttctccccatccagatttgacatcctggttttgcctgttgcacgcaggtcctccaggcctttcaacggcggctaagcagaaacccccagcagatcatccgctacagcttcggcggcaagccgttgtggatccggacagatggcattgctgcgggatctcaggagccgtccagatgcgaacgatgtggagcaagaagggtatttgaaatgcaactcatgcctaccctcatccacacagtcaaacaaaagttagtaattagtttcccgtgatagttctgcgtcgaaaaggaccagcctgagaaaaatgcagtttccgtctgtctttctcttcgacgctgcaggtgcccgggaattgacagtacgctgctcaagaacggtgttagcccgaactggggtactgtcgttatttttacatgtaagtttaatggcacttatagcttgtaacgctgtgagcaatcagcagtgaagtggctgacgggttttcgctcgaaaaattgttatgctatctgcaggctcggaagactgtgtacgagattgtccttatcagcgagagtttctggtagtccaagaaggaatgtgagattcgggcaaaaagtaaggaaatctacacatacttttacgattgatgggtgttgttcgatttgacaggacgggaacccctctttctacagcgatccggcggcagatatagtgactgcctttgtatgtagctactgcgtattcttcaggctccgatcaaattccagtgctgctcttgtttcacatgagttcatgccaaagcagtggacacagtgaggaatacacgtggcaactaatgttttgctgccattgctttcgtttacgtttccttgtcttgaaagcaaaaagttgtcctggcaataacacgttctcttgccaccctcagcattacgtctgcttgttgaactaaagtagcggtagcttgcaactgtaggtagtaaagtatcagacatatttccacggcgccgacatacacagtggtacacaagagtactaggaatgaccatcgttgtggttccactaagttcacctcagcctgcccatacggaaaagatgtagcctcaaaaaaatagtaacgtattgtcggtttgcgagcgaccttcgccaaaaatgattttggcctgaaccgcacacccacctaggaatgcattacaacaatgaatacgcaggataagccacttactgttctgcgcgggtccatggttttgacaccactggtctggcatggccggtaaactctttaaccacgaaatggccagcgctcctacccctcagccattggggtgcactgagcgtttctgggaaagaagtgaaatagtgaggatggagggcggcaggaacagcccacacctccgtgctcggacattcgactgatacatagtaggcggtggatgtccccactcctgtgttaaaacagagagggttacgtaccctttcagatcgcaatgatgaataatctgcttacctcgcaaaatattgataccctggtgcacaggttgtccccaagaacagccgaaccgacacggttcgtcaggagagttgctctctgtccagtaaaggaggtgacactgggcaagcgtatcttgggagacaccttgggcttccagggtgaagaaaacaaaattcgcgggtgcgcgtgactcttttggtcgacgtgcccaagcgaaggctccacatcgatttatgcctgatcgcagatacacgattgccgcgaaacacatgagaaacgaggcatggagggccgccatgagccactatgcgaaaattgtgtggactacgtcatagtggtgctgatttgtaaggcagagactagattggtatagcgggaaggtgggctgattgggttgagtggcgagtagcaccggtgtgtcatggcagtatttgccgtgtatgtacacgcaagctaagttggctgttcaagcaagttatgcttcgtgctggcatgtgtcttgtctttcggtgcctatgcccagggagacagtagaagaaatttgttttgttttccgtggtccgccactttgtttcatgcgtcgtatggcactgtttggcaagtcggaaaacatcctctgtccagcctgtgaacgtacccaaagatccgctttgatggagaccttcgacagcgtagctcacagaatcatccatctagcttgttagaacctcgccacggaacaatctctactgataaaatcaagtactctcacattgggtacaattggggcgacgccaattgtgtgttccgtgcatacagcgcacgaataaactattcatttcggcctggtcccagtggtggtattcgggtattcgactacactctcacgagcaggcgaacaaactccgtgttctacccagccttcttcggttgatatcgtgaggaaccgacccatgattcagcagtgcctctaacacggtttctaattttccctgatatctcacgtttccactttgaacacaatgacagagcagaccttgtcagatgcatgtgctgtgggtgtcattgacgtacaaagtacaatttttgcccggtaccagctgttacgttgcatgctagtagactggtcattcaactgctggacttttcgtaggagcacagtcgcagggtgtgtagctcaatggtagagcggccgactgcagatcggcaggttcatggttcaattccgtgcgcgcccttgactttaaacaacgctgccacctttggcatttttgcatccagggtgatattttgtcaatcctttcttcagctgagtattcatatggcatgttacaggtttgtgtgtgatgaacaagttccatcggcgcgctggctgacgcgtttgttgtgtggaagcttgacggcaggcctccaagtctcatgcgcagtcggcgtgtcaaggggtggcacggagcggtggtggttcaactgagtgctttagtcgccaccgcagtagggatgactttctttaagaagacgttcgcgtgccactattttcactcgtttgtttggtgtctttgttgtgtctcttccccgtgaccttccggggagccaggtcaccgctaggcagccgactcgcaaggcaggcagcaccgctgtgtgttagagaacaggaactgtcttgctcggtgctcccgctgtgaactcatgcaaaccatttgtcgtggcgttctcttctacggtctttcttcccatgagacataaatatgcgtcatgggttatctgtattcagcaaacgtgtggcctttcaaattccgtagtctcaaagcaatacgctgcgtcacctctcgacctgcgacacggacttcgatctgtacacggcgcgctcggtctctcgtgggggctagcaggagtcgttaaacttctaactgcgctaaaaggggattgagttatttgacgaaaagtaacttcccaggaagaagggcctccgtttcggcctctcgttcatatttgacgtttcagcaccgttctcgaga

SEQ ID NO: 3033 - DNA, 1747 bp, Toxoplasma gondii
cgtttggctggttgtcttcggttttgaggaaacaggcagaaaggggggcgatcttaaaatcctcgttgcgggtcggaagagcagagactccagtctcgctgccttcttcgcgagccttggctgctgcctcttgcgccttcttcgccagcgccttgtgcagagctgcgaggcccatgccgacgatgttctctgtccgctctgcgtccttctgcgtcggtggcgagctcgccgcgggaagcgaaggaaacaaaggatctccagaacctgcaaagccgaggcggtccagccgcggtccgccacccggcgcagcagttgaaacagaagagtcttctgcaaatgcagacccaatagagcggcccgcgcgcaggccgccacccagcggtgtggtaccgccagaggagttgggtgcaggtgcagcgggggagctgcctgcctgggtgccggagtcggagggactggcgccttcctcgctcccgtcgagggggaaagcatttccgtcacgaggcgactggcgctgagaagacaagggtggcgaggaggatggcgcagagggggcgagaccggagacggcgactgaagaactactggaggcgaaagaagcggtgaaaaactccgtggaaaccgacgaactggcgcctgacaaggaagacggaccgcctagactcgggtccatgagaagccccatagaggaggagacgcacgttgcggcgttctccgtcgaggcggagtcctcatcgtcttgcagcgcaaaatgcattttgcggaggaggtcgtcgtcctcctcctccacggtgaaagatgcatcgtacaaatcagacgagacagatcgactcagaaaggcgccaggaagcgaggaagccgaagactcgaaggaggaggaagtcgagagcggaggtgcgccgccgacagcagcggacggaacgtccgctgaaggcctggcctcagactctgccgggggatcagcggggaggtgagaaacgtcattttgttcgagacctacgtggagttcagacgaagacggaagatgcgactcgggggaggccgaagcgtcctcgctcgagggctctgccatcctggtcccgaaagggggagaagatgcgctgatcagactgccacgttccccagagccaggccatttaatggatggggaaacggggcgctcaagatacaaaaatccggttcgtaccacagaaaaagacggcggtcaaaatctgcggacgcaacccgtcgccacgagacgctgaaatcacttttccacgcggagaaagggtgagacgtttctgcagagaactgattatagaataaccgtctcgcaagaatcgcgtaccaagatgcatgcaacccctgcgaaaaacagaaccctccgtccggccgccgccaacagtcggcaactcgcagcgtgtcctgtttcctctcggtcgccgcagaactctctctggaagttccagacgtttattttcggattcttcaaaaagtgaaaacctaaaactctggttgccgcagtacatgagtgaaccgctggagtgctgtctactcccggtataagtacagaccgtgtgacgcatactggcagctggcgagtcgggtcgagagtccagctgctgggcgtgccaggctgcaaactcggagacgcgtggattcaagcctgtcccgaaaagcaaatgagaaccagaaacggcgctagacactaaaagtgtttcttagtacgggataaagtgcagagatacttcgacagagctcgtctaga

SEQ ID NO: 3034 - DNA, 2341 bp, Toxoplasma gondii
gtctcgtcctcggagtttttggaggattttctgctgcagtgaaaggccaaaatccttttctgtcggtgacaaagtgcctgaagtagcagttaagtgtaggagactcgcacaggatccgcacatcccaacggtaaacagcgttcacccagttccctggtggagcaccatgcaaaggatgtactcattgtgttaatcagaccgagggaggctctgaggggtaaaagccgcgcgtgaatcttagtcacccacacgactgtggagctggttttttgcgcgctgacgccgagtttggaagaaagagttgccatgagtctcgctgtctcttctgcagcggaaactgttggcgcgacaccgtgtgcggagaccagggatgccctaatgcaccttgtttcctagtacctagcttaccactcatgtaaaccgttgtggttttttgagcatgcaccagtattcattttggtgttacgactttcggcactaagacaccctagaactcacacaccgaaggtttcgaagccgtaccgatctggatcgcagatcgtgtgcacaattcaatgctgtctcagtgatgatcgtcgccagtattaccatccgttttcaagacgctgtccgttatacacaagcaactaggattaagtcggacttgacggtgaatggaaaacaaaacagatgctgatacgggactaggattaattctcctttgtccgttgataggcagcagttgtcctcacgcgacgatgcttaacaatagatagacggtggatataagcatgccgttgttgaaacatgactaggatcaactgtggtttgaaattgggggattgagtaatttgcctttacatttcccgtcggtcttcgttattctacacacgcacgggcggttatggggctttcgcacgcggaccggcgacgaggctccggagacaattgcagccgcaacaatataaagaaagaatgtggatgggcattctgaggttattcatactaaaggtggcacatagaagcgcgagaaccagcggcggcgttacctttatcacggagcgcagcgcggatatgcacaacaccactgtggaaactactgttaaggtgcccactgttctctcctaccgccatgtgtatagtggaggcagtagccacatttgcaaattgagtgctgactgcgggctcacgctacagcctcggctgtttcttatgggaagttacaaggccaatctcacacgcgttctgttggttcagcagttctcaggcgagcccaagcaaaggaacagatcgcactaaacaaatgatgccacagtgtcttgactgatcgatttttgttgcatcgtgcacggcaaggtgcccgtgcagataggggagttctgcggcttctttctaacagcgggggaaaagtaggtttctctgaaggcgatatcgtgccttatcccccgcagagacacgtagacatgtgatcacagcattcgtcttttttgacgtgaaatgttcggctacagagtaccgcgttagcatagcttcagacatgtgcgttccccgccatgcgcatttctacgtccccggaaggagtactctttatgaaacataaggctgaactactctatggggaagcgctgcagttattgttcgcgagacagatagagctcacaaaaacttgttcaggcgcgagtctcgcgaggcatgacatagaaaacaccatgaaaacagcaggggagcgccgtgacgggcgtcggcttctcgtgacgaggccacgtcgctggtggcggctcaacatcgaatccactgccgccctttctcccgattccctgtcgtctgattaacgtcgggctctggcgatctcactccccttgtttctgtgtggcatagtcaccttggtgggacattcaaggcttgactggtgtgagtagttgttacgatttatcactcaccagtatgagcagtactgtggagttgtttcgtcgcacgctagcattcgcggtcgacgtggtgtttgtgccttgtggcaacgcttcgtctgagtagacgctcgatgtttttacgagagggtgccaagagccagtgtgcgtaaagttgtccaatgcagtttaatgcgtggcttcccgctgttgcaggaatgaatccaggcgtgaactccaactaatagtgtgcgtttcagcgtgactgaagtgtgctagattgtctattcagaaggcatgctccctcggtctgcagactcatctcaactcgcgtcacccgccccccttcccttcaacacgagacggggccttcaaattgagtgggtaagcaaatcttcgcatatcactgtaaaatccttccaagcgtccttgctagttcgttgccttcgcagcaa

SEQ ID NO: 3035 - DNA, 4586 bp, Toxoplasma gondii
gccgcacattcccacactgttgcctgaagacttgtcgaacagtaacgcgggagttttatccagcggagttttgcaaggattcgccccaatgacggagtgggtttctgtacgatctaacagtgaaggaagcgcaccaacctcgtctctaaagaggtgcagaagactacctgctctagggcgcgcgcggcaccgaacgcatcttgttgcttatcgcgaatgtcagcgaccttttgccagcagtgtagcgcctgaggaaaagcttgctcgctaccatcttcttggaaacactcggcagcggccttgtactcgagtgccgcgatatcgtagtctggagagaatttgaacaaaaatacggaggtcttgagtgccttttcggcccgttgacgatgctcgacgccgtcttcgaatttgcgcgaaccaggcaagccgtggtcgctgaaacctccccggccgaacaaccccgacatctcgagaacaagaccctacgaaagtctgtggtattgaacgctcttggcgcaaagagcgcttcgacgacggagctccccactgcactccacacgtcactaccctgctcggcactcccgcagattcttcactgcagctatcgcctcggctcgtttaatgtgcgactcaagtgaacaattcagaaaaacgatttcgacgctgccggaggaactccgaaacgagttgctagccgaagagcgagcgccgtcaacacattaaaagtagaggccagcaaggggtggacagaacggacatctgtgcactcgtccagcatacatgaaagcagactaggcaagagaacacccctgtcgctgctatagaagctggtgaggataatcgggggaagaaaacaagccacaaagagctgttgtagtgaggtgcagttaccgctcccgcaaacttcgcacaacaaccatagacgcacatgggctctgcatcatccgtagattcacaaatggaaattttgtttcagtggccaggcgaacgggagattaacggcctggaaatcggaatcgtgtgtaatcacgcatgctaggcacaaatcgcagcgccgggtgccgggctctgagtgacacggaaaagtacgaagtcagccgtcgaaacagactcactaatcaccagtgtggattgaagccgctggagagagcggcacatttctgtggtcaatattacgtgcattctgatgcatcttttaatgccatcgaccggggtcccgctgtcttgttcacaaaaatgcatgccgcgggagacacggtcgttgcctgagagctggttgatccacccttagtcgcagttcactcaaactcggttgggcacaagttttcagctgcgatacaacacagaaaccgcaggaactccagttcgagttgaaaaacatgcactgaaaagaagcgcatcctatagccgcgccaactattgttttaaaatcggaatctgcacacccacctgttgccttcgcaggtgacactgccactaagaggtttgtctgagtccagctttcaccatcagacatctggcatgtttccttaataattctttcttaactgcgccctgcgtatccccaatcctcatgcaaacgacggtgaaagtgccggtgactctagatgtgtaagaggacgcagccgtttagagaaaatatgttgtccgacgtgccacaccgctttctgggcaccagtacccagactacctgtgttccattgaatcggaatccaccagatttttccagagtttctccagggaaaacgccatgatctttattttcgagtggagcacataacccttttgtgtacacggtgtcctcaaacctttggctgctgccagaatccctgtttaaacagtacaatggtgaaaattggctctcgaggagggttaggctctcgctgccgcaccgtttggcaagccatttcttccacttctttaagacgtgcgcccgtgaaggacgcaaaaagaatttcttcacggtggaatagttgtggagtttcgtcagggcgacatctatttgagagggaatttttgccgctggagcgcagtcccagcggagtggtggcacaccagcaacgcagacccggtcaggccttcccgccgatgagaggctgcagaggcacttggagcttttggtagtatctggaatttcgtgttttctttgttgtgtgaagcttcccgtgttccgttttttgtgttaacagcctttctgttgtgtatacttcgggcacagtttcagcgctcgatcgtggcatcagtctcggcgctctcgcagctcacgcctgggcgccgtgccctttcctatattcgactgttgttttatggtggaaagatatccctccgtttttgtcgggaacttttgcccagcagatgtcttcatttctccgtggcgcgcctaattttgaaaagagaatggctgacaaacgatccttcaggaattcaaagctcgaaactgcgtagtcctcaacgcgaatgcctctcgcaggagctgcccacccacctgctccgacaggtttctgtgctgcgccacttcaagatgatagacacttggcatccgtcattaacatagggggctgaaaggcagttttaagtgcagtatctatgcttgcggtcgtattcactttctcaaaaggtgcctggccagcaggagccagatccgtgcacatacgataccgactgctggagagcggtccgggttcgccctgttgtcatttttccggaacgacggcgagctacaactctctagcagccccacacggttgagccttctcgctgggctggggatccagcggacttcagcggtcaggcgctccgaacggctgtcgccttatttgcggctatgaatcgatacgttggttcgatttgcctggttctttaggcccgtcagttccgccgagcaattcgttgcgaagaggctcttcggcgccagaggagagaacgtctacgttttaattgtggaaatctgtctcattttcgcactgcgaagacccggggactgtcaaaaggtatatggaaccgtcgttcctgggattttttcgtttcctctcgctgagaggagcggcctcgtcgtttaagcttacctccgaaaaaaaacgacgtaccgctggatcgggggccgtgactccaacagcatgactcaaactacatgtatggtgattccatttgagttgtcaatttccctgcactgtcaagtgagcaagaaggccaacaacgtgctcgggaaaaccgagcaggtatccaccgcagactcgggcagagacgccccactctagggggtcgcgtggaaactgaatcgcctgagcttgcccggttttaatttttttacccctaaatgccgtgcagtcagatagacaggcttttggttcactctcctgcgccagagttggcctcgcccctcgggacccgccgggcgccgtgtccctcccggaggtccggatcggccgttcgtcggccattcgttttgtttcaaagtttgtcaagtctacccttcccgcgacttcattcgtctttgaatttttttccgtcaagccgtgggcgtgaagtcctccaagccacggtttttcctttcccctcggttcgtgcacgcaggaggccgttcaaagacgagtggcaccctgcggatactgggtcctattcttccttgtgaaacactgcgttttaagtgaagaagagcgcgttctgtaggaatgcgtgtggtttcgtatcgggtcatctttttatgtcgacatgcatgtaaaatcacccctgccaccagtgagtccgcttgtgggtgtgtgtgcagaaacgagaacccatttgagctgtcatgtatgctgatcggttcttgcttgttgtcaagatatcgctgtcgcggctaggcggaacccttcctcaagaggtcccgcagcagagttcttttttgcggactgaacggatgtgtggtgctgtgagtatcgattgaagctcgtctctttcccgtaagcggtccgattgttccccgtttttttcagatcgacgccttgacaccttttaggccgttgggagtcgcactgttgtgtggcgttcgacgcgccgtcacttgtgacggacctctggacaacatttccatgtatatattaggtataggtaaaacagacttcctcggctttcccgctacaactttgtttccagtattcttttcaccgtttctcctcgaaaccgagttttctcttcaggttctaggttgcgcgccactttgcaatctgttgtgtccacccaagaaatcgtccgttctcgtccccgttactgctcccggctcgccctgcgtgtggcgtgcgatcgtgtgccctttctggcctcacgtgttgcccgtatatacggcggataaaaagaggcgtgactagcagcgaaaacgtcaattgtcctgcctgcgcggctcctctcggtggaggcaggcccgtctttctcatgtttcggaccctgtcggcaccttccggtccctgcacactgtgagtcgttcgccggcgccgagaaggcttggcgcacatgagcctcaagaagagagaggaaggtgaacttggttcggcatgcgccttggatcctagactgcgtcgcttcggttgcttgccttgtcccgctcaaca

SEQ ID NO: 3036 - DNA, 2417 bp, Toxoplasma gondii
gaaggacatgaatgaatgagggattgcctgatgacttatatcaactggccacacgtgggaacgggacgtctgcacaattagctgttaacctgcaatagcggggccatccgttgccttcctcgggagattggcctggttcatcccatattcggagcaccgcccgcggttgcttactgacaaacgtgaatcagaatacgatatctctgcctaaagggagagcgactttgggccaccttccccttgtcgttattaaaagcagctgtgttgtggcgtctgaaagtatcgtgccgcgtcgcttgggctcctttggggaaacgaaagccgttgctagcataaacgaagactctgagaagaggttcagcggtgcagatcttgtgccctttttcacgacaaacagggatttcttcggtttggatgctgggtacagcagagggagtttttcgtgtgtatggcatgagttagatggcaaaagggcagcgaagactgatgccaggccagttccagcggcgaaatagaagaaaatcccctcaagctctacgttttgcctcgatattcgatttgtggacaacttaacgccagcctagaactgcctcctgataatgttttttcccgacttgggtgtcgtacgagtacagcaattggtaagtgaagaagcgctccagtgaggagagaagcgaaaacctaccaccacagctggaaacgctccatgatagcgagtgtttcctgtcgaaagctaactcaaaacttccccctgtcctgaaactctgttcgataccttagtatgcatatacttaaccggcacctccagattcagctcttccgcgcttggggcaggaacgggcacccaccacacgttctagcgcaacgtcccccggtattccagtaagtgttccagctacggtttcttgtggcataggaaaagcagacagacacaccctgaaaaatacatatgtgggctgaatagcgcccctcccactgtatcgttcacacacacttacagggcacggcacgccctttaaagcatagacggcagtttttcgcggtgcaacaaaaagcacaatcaacacgggagactttcgggttgctacaaacagattcatagctgtgaagcgactcacgaaaacgggtttatgctaagcaccgagggaaaaagggcggcggtcgtcactttgaatcagcagcaacgcacagggaaagtatcttccagacacacacatttcaagacagcaagatgagaccctcctgaccacgaattgttacgaagaacggtgttccgatctaaacaaacctttaagtggatagtcaaaacgtggttcagcctgctgcagtgaatttcagagcccctttcatatgcaacacgaaccccctgtttctgttgcacgatatctgcggtcacccgtaacgaggcgcattcggaaatagctgcgggaaactattttcgaacaacaaatgaaacagaactgcactcatttgggcaacaaggagcttaagaaaaggtacgattcagtggactgatcgggaattgaacccgagacctttcgcatgcgaagcgaacgtgatacccctacaccatcagcccttgaacctcgtttcggtcggcatcgcgtcacaaactagttccaaaagaaacagcacccgccacggactctttagtgtgtatccatattacgaaacttcccttccgtggcgattctgtcgcgaagcagccatgtctacatgtgtttccaatggggatgctccaccgcactttgtgtcccgaactgttggccaatcaagagagtcgttgacaacgtcaaaattctttcgaggagcatgaaatacagtcctgggttctgtactgcatctttgtttttagagtgattcttgactgggaacgccactacgattacacggttgtgtgtgaaagacaaaacgtggggttccgttggtacccgcggcgtgtcacatgatcagacggtcgcagaggaagctttctggttgctacgcacccgcccactagtttttactgagttcctctcctcaggtgatcagtgaatacacagagtaaaacaccaactcgcagcgtttccttcttctgagagttgcattctccgctgtgtcgcggctaccgagtctgtccgcctgtgttttcgctccgacatcattcccgtctccttttgctgcagccctcagaagttgactgctattccacatccggcttcttccttcacgaaactgtgacaaaaacgcgcgcccagtttggtgtgtgtgtgtgactcaagcacttccgattcctgtttcgccgtctcttttgtttgctctcgagttcttttcttcgtcgtctgaccccaatcccagcaatggagacgtcgcgaatcgacccccggtgagagggcggctttcagtgcgccgtgtacagacgtccgatatattttgca

SEQ ID NO: 3037 - DNA, 2170 bp, Toxoplasma gondii
acaaagttctctgtctcgcatggcgcgcgtctttctgtctatctacacaaaggctgcttctcaacgcctctacactctgcttgctgaaacatcgatcgcgcgcgcctcggcaggaggttccatctgctttgtggccgagaacgcaggaagcatctggagatgttgaacgcggaaaacgcagcgcgtgagaaggcgaagaagcgtactcttgaaggaacgaaagagtgaaaacgagattgagaacgcttacaaaaggtcccaagaaaaagaagaaaacagaggcttttccttgctcacttgaacgtgtggtttcacaattcgcagacgtcgtcctgctccagcagatcttctgcagaaaagcgaggagagaagccgccctgctctcccgcgagacgacctcccgtctcccgcagcttcgtccgtcggagcgtctcccctcaaccacaccaccgaaggccaggcaacgcaccgcctctgtgcgggtgacgaaagacgcaaagaaaaagaaggagaaggagcagaaccgacagacggagaagccggtgacgccgcgcggcgttcgctaccaagtttcagtttccatattggatatgcgttatacacgtccatgaggccgacgagagggtgtttcgctcctgcgcagtcttcctccgaactttccttctctcctcggagctcgctgcgctctccaggcgcttctgtccactccaatacggagacgaccgtttctccgtcctcgtcggaagcgctgagtcgcgaggtacgccgagctgagagaaacgctagggaaggccgcgaagcgcgaaaaactggggaagagacaggagaaggagaagcagcacaaagggaagaagagagagaagaggaaggcgccgcaggaggagagggagacagggaggacggttgaggcgaaggaggtccgctgtgaggccgtccaggagactgtgagaggtcagcgagagagaagcgatggctggacgaccgctggaggactttcgtttctgcaaagagaagtggaaagagagagaggaagacgatggaggcccacagtgtggctgcactgttttcgcaggtttttcttctcttcattttgagggcgagctgcggtgattttccgcgagatttttcgatagttttgcatgttctggtgcttttctgcggaaatgcgttcttggagaaaggtcgcagagacacagacaagaggaaaaagagagctcgaaccgtggagttttttcgctttgcgtccaagaaaaacgcagacgaggggaggcttccaagaaaagggattcagaaaaggaacaagtccgaccgtcatacacaccagagcgcgagacacacgcatcaattctggtaggagttgtctccgttctcccgattcttgttgcgcgcgcgcgtctctgcctcgcagcgtgtaactttctccaaagaaaaaaagcgttcgagaggcttgcatcgaggcgaggccggaggtcaccattttctctttttcgcttcctccctctctgaagggaacatgcgagagagtcttctccctcgcgtttttcgacgcaagaccggagacacaacagaggaaaaaggaaggcgccaggcgcctctctcggttgcctcttcgctctgctgtgcttcttccagagaccgcctctctttcttctcgcctcacacggaagttctcgacaaacgtcgaaggagaggcgcttcacagacgcatgcactcacaaggcggagcaggcgtttctcttcttctgtcttccgcgaaaggcaagcttcctctctcgcctgccctgacaacagccccgcgaaaaacggactcacgcggcctcgttctacgacaggaagagttttcgcgtcgattctgctctgcaagtctttcaaatgaccaccgccgacgctcctgctgagagcgaaacgaaacgactgctcagatgctgctgcgacagcgacgttcgagaacaaaaagagaggaaaagaagaggaaggagtcgtcactccatcacatgctgttttctcccaaaaaagacaaatccaataggtttcgaacaagcatcaaccctttgagcgtacagacgcgaaacaagagagaagagaggaggcggaaggcgctaacgggcaaagcagcggagatgcgaaaaagccttctgtcactttctgctcgaacgcagtctctccaaaa

SEQ ID NO: 3038 - DNA, 1794 bp, Toxoplasma gondii
atattctgaatgtagggcgcgtcacaccgcccgcggtgtgcagagcagcgcatgcatgtctcgaaaagacctttccaggatgtagacagcctcagcctcggcgggattcgtagagaaggagaagcgtctgttggagaaaaggattttctcgctggagaccatcgtggcgaggctgtcaagcgaaagttttattcttcatatttttgtttctccttgccagcttcggcgaccctgtgcctctcttccacttcaagagaggacaggaatccagcctacagcagttcagtgatctttccggattcggctgcgtagcagtgttgcatcaacattattgagagctgatggaggcgacaacgcagagacagagccttgctgcatgcagtctacgccgtccccaagtcaacgaagaacatctacacatctcagcgccttttgttgcgagcaggagcgtgagatctcgtctagtgatgccgtattgtgtacaaacagatccactgcacggaagataaatgcgacctttgtccaggcctgcaggtacacagacaccgcggaggccagacgacttgcccatctgactctctgcagatgcaattttgaatcctcgaaaagggagaagagtcgaggcgttggctcagctggccccaagagaaaaattgccatctctcagttgttctgtttcttgtcgggaggagacgtcgcacacccgttcggcaggcttgttcaaacaaagcgagacaggcgggaggcgcgtatacgcaggaaggaggatggccgaggcgctctgctctccttcttgcattttctcttagcgtcatacttttattatgctccttaaacgcttgtcttggcctctgcgcttcgtgtatacggcttacaatctaaaaaactgagctctgctctccttcttgcattttctcctagcgtcatacttttattatgctccttaaacgcttgtcttggcctctgcgcttcgtgtatacggcttacaatctaaaaaagtgagtctctgccgcagagtcggcgctgtccaatacaccccccgcgactctcgcgccggctgctgcgcatgcacactgtcgctttcctgcaaacgaacggcggtgaacatttccgaggcaggcagacttttgactgaggaaaaaggacggtgcttttcaaggaaagggagacgagaacagtgaagagaagtcaaaaggaattcccgtccaaaacagcagagtcctcccccagcgccatcttcactcgagtgtcttgccgaagcaggtcaccgcgtttgggtccttcgtgtcttctttctctttctctcttcatctgtttctctttcttgtggacttttctagtctccctccccaatgcttcactctatctcgtccaaagagcctccgctgatgtcgtttccccactgctttgctgcggcggcatgcgtcttgaggcttgacatgcggacgaccgtcgagccagtctgcacacgcgtttttcgactgcctcgctgctggaggggtactttgttttttcttcctttcctcaaactttctcttccccgtcggcgagagagaaggcctcgaaaagagagagttttatcgcttctctttttttgtctcggccggattcttcgcacgcgacctccaagcctgtgacccccgtcttttctcttctgtcctcgttgttttcctcgctcatgagacgtcttcctccaacagctccttcttctgtccccggtcgcgctctggtctttcagtcctccttttggctcctttcttcctcttctctcagtgtgtgtctctttcctaaaaa

SEQ ID NO: 3039 - DNA, 2265 bp, Toxoplasma gondii
aggcaagcaaagaccagcagcgttttccagaatctccttgcgacgtcgatcgctgcatgcagaagaaaggcagaagcggcgtcgccgcggttctcccaggcgtccgatagcacgcgactcaaaactccgagcgcgaggggcaccgcgcggccttccagctggacgagacgagcaatgaactgcatgcaaaagtgacggaagaccggaagcgcgtggcttccgagggcgaggaaccgcgggactgcacggtggatgtacactcggagccggtcgcgctctatcgcgtcctcgccgcctcgcgagcctgcgttgggatctccaccgttctgagggatcctgcagttcccactgggtcgctcgcctcgagaaaaagcaggagcgaagtcacttctgacgaacaagaggccgtgttcctccctcacgagagtcaggagttcgcgggcggctttctgcagtcggaccagacagttttggacgtctggagaatcggctgctgtgagagcggcgacctgagcgaagacgcattccagtgacgctggggacgctccgccctggactccaggcgcgctgccgactctcggagcacttgggggagctgcgctcgccaacgctggactgggagctcgcggcgagtttcgacatcgtagtggcgaattggaacaagaaagagaggggagggtgggtgcgaagggggggtcctcggagctggcgttgcgagggcgcttctgaggaagactggactcaggctcctctcgacgccgttgagagggcaaaggcgagtgcatggcgcgagttggatctagggagttcttcttcgagcaagggaacggtcgagacacagagacgcagaagccggccgagacggaccgagaaaagaaggaggacggccacagagcaactgcccagacgcgacgcgttgaagtagaagaggaatgcgcgagggagaaagttttccaaaagagctgcccagacagaaaatgttaaacgcgtcgtaaaaggaagaaaggaacgtctgcaggttgtgcaggacgcgggagatgggcgggcaagcagcggcaagcggctgtggaggttgcagtgcttcacggctctctggaggtgcctgcgtcgcgagagaactgcggtggagaaggagagggacatcgttggaggaaagttcccttctagaacggcgagttcgagcatgcagcagtagaggggaaaagacaggcaattctcgtcgcgcgggaacaagagaccaagaaaagaaccctcgaagcactggaaccggtttcgaggcttctccaccgggggacagacagaccgccgaagttacgggatggttttgccgggctccctgaagaaattcatatcgttttcttcaacaggggaaagagaagcgtgtgtggagaagaagggaacgcaagcacgcggagcatgcagtcgtcacgaaatttatgacctgtgcagcgacacactgttttaacggggccgaacgtccgtgaagggaaggatgaagtctctccaagtcgtgaggcagaaatcagcgaagagtacagagtccgcaaggaaggaagaaaaaagccaagacagaacacaggcctgccctgcaggtcaatcatcgaaatgcataaactatgaaaaaagttgcgctgccacatgcgggaaaaaaagaactctctgccgccggtgcatgtgtgctgtttcctcctgctcctagatgctgcggccgcagtgcgcctggaaagtgcattcttcggaagtggaattcgttgcttctttgacgaagcgtttgtgtgatttctttaactcgtcaggaactaaaagcgcacggcgggtgaaaaagcttactggcatctgatgtgcctttcgacgaagcagtcagtgaccctgaatgccggccggcttctgtgtggtcgcatgtttgtgttgagcagaacgctcgcttctctcgctcgtgaaaagctgttaaacgcatcgttctgtatctgatcctgcttgaaagactgccgctgacctcgtcgtttactcgcacggtgcctcacccgaaaaaaactgtttttagtgagttgcgtggtgaagactacacacgaaaacgcgcgcgaggtctgtcagaaagcgtttgtgaagtcttgagaggcacagggtgcaacctaactgtctctgtcctcagcacgaacgctctgccactggcgactttatgagtcgatctaggttgcacgcattacaccactcctgcctgaacaaagcctgacaaaaatcccgaaaagagacccgaaacagaga

SEQ ID NO: 3040 - DNA, 4027 bp, Toxoplasma gondii
tctcgcgacttgcaggcgaagccgctcctcagaagaaacttttgcctgggtgaggtcgtcgtcgccttcttcgtttgtgcgccctgctctctgcgactctgctctcggttccacggaagactggagagactcggcaacttcgtcgacaggagtgacgctcagcaagagagggatgaggagagaagccgagtagacgtgaggggcggcgtttaacgcaaagcccgacagccagctgcagacggaagcgccgtcgtacgagctcaggatttcggatgtcatgacacctgcgggttgctgcggcgcgccttgcgacgaatggcgcggaggactcgcttcccgagagtcaggagggacgggtttcagcttcgcgaacagcaggggaggagcagaggcaaatacgtcgacgcggaggagaaacgaaacaggcacagacgaagaggcgtggttcgaagagtctccttgccaaaaagcgtctccaaatgccgctggctcttgcgcagctcgaagcgccttcgcagccgccagcgcccccaacccgctcaggtatacagacacctcgagggtctgcgccggcgcagagtcgctggttcccggcgtcagagttccttctagaacgacagagtctctgctttttttgaacgcattcgccacttcttccagagagagatacgcttgtgtggaagtcacgactcctgcgggcagcggcgcgggcgcagccgaggcagacacagataaggacaaaatgccggaagcgactcctcgaggccaaccccagcaatcgacagacgccggaggaccagtagcactgcacacagacaacaggagaagagaccacaccagcggaccgcaccgccacaggcgagaagcctcaagggaacccatcgtagaaaaaatgaaaaccctagcgaattcgatagaatgaaaaatgtgggtcaaaagaaagtgctatgcaagagaagtggtttacgtgagcagcagattagaaaaaggttcgagaataaatccttaaggggaaagtttgccggagaactactctggaaaggttgacgcgaacgaggtggcggtgacggcgtatagagtcacacaagttcaggcgtctgtggtgtcaagtccgagaatcccggaaaaagggggctaacacgagaaggccggcgtcaggcggaagcacgcggaaatctctgagttcgtaagaaaagactcttttaagatgtaaacgtcattccacgagtgtctagagagcaggaagaagcaccggagactgatgccgactagcaaggaacgacgacacgcactggctgtttctatcagaccaccactcagattatacaggtagaaaaatcaaggaaatgaggaaaagacgaagtggaacagcacttgccactaagcaatacaccgtagacaaggggaagaacgcggaacgcacgccgagaacagacagctcgccagcacacacgaggtgggccggaaagtgtgaaatgcactgcttctcacaagctgaatgtgaaaaacgtagtcctgggaggaacgcggagaaagttgccaagggaaaagaacaaaaacgacggtacaaagaaagattaacggtggaacgctttaaacgcccgctgtcactcatgaaactccagccagccagtttgccaaggagcaacctcgaagcatcgcggaaaccggaaagccttgcgaaagtgaaatcttcggagtccgtttcatagttgcgactaagaagccgaatcaggaaaaaaagagcaaaagagaacagagatacaactctttggcatgatgaaagactgcgcagtgtcttgttgaggtttacccggcacactttcggcaaaaagcgccgtgtcgatggcgcttgcacactcaaattcgtgacattctcggcgctggttgcagccgcgccggaagacacaacacaaagattgtctgaggaaaaaactaagcgaatctgcggcaggattcggctttgaaaacgaagaagatccgggagaaaatcgtacacgtgctaacagggtcccggcgggttgcgtacaccaggtgcgcgactctagcgtagacatgcagcaggctgctcgacactggaggtaatttggaatctgttttgtcgctagtttttcaacaatccaataaaacgactcgcgagtgtcagaaaggagcgaaactccacacctgcggtgggctttcttcgagcacagtctcgagcttcgagtgtgccacgccccgagcggggaatgcctgtggttcttatcgttcttggggggccagcaaagtcacaggaaaggctcgctgaccgttgacagttttctgttcctctgtcatgtcacctcctcacagatgccaactgcgcgcggtcgtcagaaagatatccggcccttcaaatcctgaaactgaagagccgccgtgtacccagcaaccaaaacgaattcggcgaacagacaaccaagaaaccccccggattcagtgcagctcgacttctgctggctggccaaagggtggaagaccttatgcggccggtggtacctataattgaaatcctttccgatcggatcccatctaatagttgcggtttacattggaacagggtgtcttttctcgatgaaaacgcgggaaatggaacatcgcgataatctaggttccagaatggaagtggtggtgtacaattgcagaagctttctgtattagaaatgatcgaggtgaatgattgcactcaggagcgactgcgtcgacgcctcgagctaggcccggctcacatcagggtgactagtcgattggaagttacgactagatgaatcgaccacggtatatcacaggagactctccgttgtgctagcaagtacaggcagatgcagctgaagagtttgcgtttcagatatcgtgattacgttgtcaaatcccttcctaaaacatcaaatttcgacatttgcgagagttcgcaattcctgatgaacgagtctacaagcaacactcaatggcaactgcaagtcgacccttcagccacaatctgctgatgcagaccggaaagggagccgggggtggtattcgatgtccttctacgagaaacagacccgcttgtccggtttctgtcaaaacacagctcaaaaacccacccagtctgacccttctggcgcgcgactttttcttttagactgctgcaacgatccgaagccgaacctgctcatatcctgcgaagatagtggaaagtatacgagcatctctgctggttctttggacgtccaggtgaacatgacactcggatacgttttaattttaacttactaaagcccacgggagcgaagcaaacagctgcttgtaagcaaatttcctggttagatgcgtaacaactccacatcctttagaaatttcgtcgcggtgccgagttccttgtgtacagccgaaagaaatgtgcttcacattactcgtgaatgagtgcgcgagagcgatgagtctacggatttgtctggcccacaccttctcgacatgagtgcgagaggggccgggcgacccgtccgattccatgaagcatgcttggcgtcttttctgatacagcaggcatcccggtgacccagaccgaatgtgtgccgactcaccgggatttctgcggtgttttactgagtgtgagtcaaaaaagcgtttggtttttcctttcacagcatacgtgatcattgtatccggcgatatgaagttttgaaacccatagatgcgcacgttcgttccgttcgtgtccctgcatctgcttaaagtacgtgcggacgataattatatcaatgaattaccaatttaagctgaagatgcacttcgcgtggctaactcgttagctcgtcgacagggtgtgtagctcaatggtagagcggccgactgcagatcggcaggttcatggttcaattccgtgcgcgcccttctcagacgtttgagaatgggggttctgcgggttaatttgttgtccggtttgccagttacaggatgagcggatgccatacctctgtctcgatcttctggaaagaagcaagctaactcgttagctggtcgacag

SEQ ID NO: 3041 - DNA, 1886 bp, Toxoplasma gondii
aaaaacggaaagaaatgaacacttgcagagcatcaccgcaccatgtgggctaaatggaagtatacagcccgacacggcgaaagtccagcagggcatttacccaggtaaaaataacacattcatctgctgttacgccagtaaaaaaaagcgcctgttcaggagaaatcgtacctgcgacacgtatctcgggaacggaatgagagaagaaatgtgcgtgcaacttagttgcctcgcaatgcaggacacgcaaaccaacaacaggcaagaaaaatggacgcctacgagaggaatgcgtcgccaacagatgtaaacaatactacaaacggcctagaaatctgtgacccttccgttgtgcgaccagtcaccatgggccgttggttcggggccttcgtatttgaagccatactcgggttccttcaacacgccaccggattcttttgattgtggtccaaccgttttgctctcttgcttgagatgagcttcgtggcgagcagtgccttcagccttttcatttgcatgtgcagaacactcacccgacgccgcacctgaccttggtgcagaaccgttccggttaacgcggaaaatttttttcacaaaaggcgactctggagcgccttcattcagctgcgtagatgataggtcgatgcctccacttctcaaattgttatcgttagacgcttcaggggatggcgggagttccttgtctctagccatactgtcatggtggacgctgccactcgatgtaggttgaaccagggtagaagcaaagtttttctgtagtccttcgaaataagggaaagcagcttcctgtgggtgaaacaggcgctcacctgaaaagaagagtaacaccagaggatacccagtgggtttggaagaagagccgctgagtgctaagcggtgggcgcggccggtcgcagatccagtattttagtgaaagcaccggcatttttgcgatttttgcaccttgagcgacaaaaatcaaagacgtactggctttgcagaagcaacttgtccttgataaacgctgcaactcgtgggcgacgcgcgtggatcgcaggactgcttggaaagctgctgcaccgggggtttcccgcccgtgcgaagcgagtttcagaagaaactttccgcttttcagcgatgtcatttccggtgaaaaacgaacaagaagacttcggaccttctgttgaccacgtatcctgtctctcaaaagtgacctggaaacgttgctttcaagtgccagcgatcgtttcgcatgccgcgacgttcagcggtaggtccagaagcacaaggcaacagcgagttgtacaagtttctgaggtaaagcggcacgacccttacacacagacgcgccataagaaagccaaagatgatcagccactgctgctgtgccgacacggcgtttttttcgggtttttgcttgagtgtcccgacgggatgcatgcgtcgatgagaacagggccgcagcgcatgcacgactaggcgtgatacactatgttcttctggtatccgcctcgtttccgttgtatctgggaacagtcttgccgcatttccttgcctgtctccttgagcgctgtcggatttcttcaggcaaatggtggttgcatattttgtgctggcaccgcctttttctacgtcacgagcgagagccgctcttcagtttgactagccggttgcctcgcaaccccctccctctgttccgctaccgggggaattgtgaagagaaaaggcgtttttcctggcttaaaagcagagattcgttcttccagctgctcgtgggacctcggggcttgcctcagcacccccggcgtcgcctctctgccgctttccgcccccagaatgattttcgggcatcctgtgcctgtcgtctgcgcaagtgttaagcgcca

SEQ ID NO: 3042 - DNA, 2625 bp, Toxoplasma gondii
agatcgctcactctttgttttgtctacagcagcgccggcaagcgaatgggtcgcatcctgccgaactctttcctcttttgacattctctccgcgctttggattccatttggagatccctcgatcccagaggctctcttccgacaccacgacgcctttcttctaacgcgcgcaatgggagagaagatgtcgtgaagagacaaaccgagacacgaatctgccagacaaagatgagagagactcgttttttctgtccttctgggcgccttccgaaacccccgttctctccctgactcacctggatcgccttcgcccgggagacaacaatgtcttctccatcgtgctcttcttctttgtctctgtcgacttctcgcagcgctttcagtgtctcagatgcgacgtctggtgccttcgtcgacgacggaggcagaggggtctgggaggcgcattccgccgaagtttcgagcgcgtaggaagcggctgcatgtgcgagacggcaagcctctgccaagaagcaacgcacatctttcgccgcttgcgtgcatgcggaagcttcgctggagtctgacggtccgaagccaccgtcccgctcggagtctgcggctccgcgtgagacagaaaaacgaagagaggagagaggtggagaaggtcctgcggaagcggcgggagaaacaggcaccgaggtgcgagcagatcgcctctcaggcgcgcgagggggaggaggcgagggagccagagtgtctgccatgtttccacaacgcgaaggtggaagacttcacgaaaactggaggaagtcctggtcaacggagccgagggcctcgccactctcaggaaaggccttctctggtaaacgctgcccgccgaaatgcagcaagagaaaccgacgcagaacgaagaaaggaacaagaagaagtcgagagagaagaacaaaagaaagaaggagtgaaagcagaagaagaaagagagtggaagggagcaagccgggagaaaggagacattgcgggcaaaggagatgcttctgaatatggcagaagacttgaggaacgcgaggcatggacgagagaagaaagaaagagcctctcctctccgttcgaatcctgacgcttcccccccgtcgcgcgtctgcttcttcgatttaaacgaattttcggaactttctagacatcctccacagcctctgaggcactgctctttttggtgaccgagaccgtcctggagcgagacgctcaccgccgtgagaacagtctttcagagactctttcacaggtggaaaaaaacttctcaactcttcgacaaatgctgctgctcaagggatacacacatagacacacagagaagcgcagctactctataaacatgcggaagaccgagttctttttctgccttttttcctgacagaagccggttccgcgtcctttgtcgcggcaggaggcagcgaagcgtcaaagaagacagaaaggaaaggacgcttttgaaggacgcgccgcaaaaggaaagaaaaaatggcgacttgcaggttcttggccgtccaggcagccgcgagaaaacgagacgcgtccccgacttcaaacgaggtctatacgggaagccatacacgccagaggatggtggaagaggatatctttcaaatcgaaacggacgaactcttctctcgtctcgctctcaagcgcttccccgacaagcaacgcagtcgcgctctttttctgcacgatgaaaaggttttctcctttccgcttgagagtagaaagtcctcccttttcgctgaagacagcaaaacaagaaagaggtgtctgtctctacacacacggggcttcttcccttttctttttccttttctttttcctttttctttcttctttctccttctctttttccttttccttttcgcctgtgtgtccacgcgagtctctggcgtgctcggcggctcgcgagaggcgctgaggagactctccacggaggagtgagagaagagcgcatgcagcttttcgcgcaaagaatcctgcgttcttccttgcaggaggaaatcttcggatttggctggagaagcgaacttctgcttcagtttctctcttttccttctccgccgaggccttccttctcaacggaggtcaaagaggtcgtctctctccttgcctgtctcctttcgaataccccacacgacggcagagcatcgagagggtcaagtttcgcagaaagcaggcagatttttttttaattttcaatcttgtcctcttttctgtcgaaaacaaactgcatggaggcgtacaacttcattctcgcggcactgttaggggaggtcctcgtttttctgatctgagatttgcctgtcgtcaccgtccttgttcaagaaaccgcattctcttctctctcacctgctctccacttctcttcctcgagtcgcgctactgtctcgcacctccaacgctgtccgtcttcagtgtctttcctgttggcttctcttttctctcttctcttctccttttctcctttccgtctcctcctccgcttcccgtctcgcgttctgccctgttttctcgattctctcttttttctttcctttctttcctttctttcctttctttcctttcttttcttcctttcttttcttcctttctcttcttccacga

SEQ ID NO: 3043 - DNA, 4963 bp, Toxoplasma gondii
ccccttgtaacgatgtcgcagggtgtcgcctaacggaggaaaaatcgagggagctgcgggcttgcgtgcttccgtgtccattcgttctcgactttgggggggcaatcggggagatttttccacagcaactgcatctcgttcattgaaactcgcacactcatctaggaaacaaatcacgtgttcgttagttttgtgtggaactcgaagagcgggtaagtgaaggggctggcgaagactaggtattcaggggggctggtgcctgtaattatatatgcttgacagtgttttagctggtaattacaagaactcgcttctgtgcggtacgtttgctgctctcacatgtatgtactgccaagttctgtgtatacgtacgtctagggaagaaagcgtgcacgtccttgaacacaagtgcctgtgtcagtctgttttcgttgaggtcgagcacactaaacatgtttcagacacacgtaaatatctcactaaaaggttgccggaaatgaagacgtggcgcatttcgtcgtcgttgacttgtctcttccccacacctcgaacagagcagacgatgttcgagcatgcacaaggatgaccacgctttgcacgactcggaaacgacacttccgcgtagtgttgcatccgacagcctatagaaggctgaatgctacagccgctcctgtcattgccatcagaagcgtagaaagagtagacggccgccggctcatggatcgcatttgccgccacaggcgtttggtttttggaaagtctgttggtggctatgtgccagagaagagccaacccatcaacactggcatttttacgctgttcggattgaacaatctattcagaatggccacgattggttcagattatctaagacataagattagtgttggtgcaaaacgttcgagcaaacctagtgactgccggttttaccagaaagaatgactagtggaagccaagtgagctatcggcaacaaggaaagaaagcaaccggcaacagaaaaagcagctcgctgaggcgcaccggggagagtaaagtttagacgcagtgcagtttaatctcatgctgttaggataatcaaattgatttcatctgttctttttctgtttgcttcaaaacaattcatcggaagtcaatggagtaatcgaggggaagtgacaacgatttacgtactgctcgtagaggcttgccgttttggcttggggaatgactgtactgcgtgcgaatttgtgtaaatacagacccgttgtggactatctgacatggctacagccagatgtatttcagtgcacagctaatctttatgcatgccgttatggccaatctcagatacaaatacaaacgacagtgttgcactgttttttgctgcactgtacctgcacactgaagagcagcagctgagaatttgtaattcccatgccttgcatgcagggtgatgtcgttggaatgtcagtctctcatatccatctactacccttcttagaagacggatcttgatgttcgacgccattgttgtacgaatgcaattaggtttgcccaaactgcaatctactgccccatgcctgtctagtattcagtcgactcgtggaaaagcatgagaaggaaccctcagaaccaatttgtgatcggtcggaaaagtgcttatatgctcgaaacgagttttgtctctttatgtctcgtctacatgaagctggaatgcacctgttatctttgataataaagaacgctgtgaaccaactgaacccctcgaagtcgtctagcctggtgaaggcatttctgcaagttgatggggccgtgggattaattgggcctcccccgtgaagttccaaacaaagcactaagcgcgacaagtacatttaccgcatccataataagttattcatacaagactgaggtgcagaacaagctgcttcactagatatgcgggtacttgatgggcggtcttcggcgctgcatctgttttcatccgacaaattccctgtgttttgttagatggacgacgccgctgggaccatccagagacaaacgatctatccaaaagtaccgaaactgaaaagccactacaaggcttgtggctatatcatggtgaggcggtacctctgggtatggctttctgttccggtttttagcaaccgccctgagtcgataacgaacctgtctcgcgaacgcaaaaatgctgttgtgacacggatgagatacagagctcaaatcctatcctcatataggtggaatcgcggcatgcgctatcacctgcaaaacagcgaatgcggcatttgacgttggctgtgatttatgttgtctcgtgccactcgagacggatggagtccatggacagctgccgtcctaaagggtcccgcccagaactgtataactcaaatcgaataaaccgctattttgtctcatccatagcatgtaacaattgtgtcgattcgtgtgtttcttgttcggtggtggcgcacgtaaaactacaaagcgtggggaagtcagagagtccgttggtgcaaggtcaagctgttcccatttcggcgtgctcttccaaacaggggccccacggaacgcaccatccggaactcgtggtgcccgagtcagctaggcataaagcgcagcatgcatccggttaagcacagcactaaagagagtcggtggtaagtgcgtttttgcggttattgaagccgctctcggttttcgtgcagctgcacgaccctttgttggggatctacgggacggttggcggggagacagcgtagagcacagagctcggctggtgaggatagcatgctcgacgtgcaaccggccgcgggcttgagcgcagtaagtggattcaagttcgtggccttgccggggggtaccgcttccaaaggggaagcgacaggtgctgctgagaaccaggcaccaaacaaacagaaaatttctttcttcgctcttgggtctgcttcttcacctctgtttatgtctcgtcaatccctgtgccgtcttgacttgtttttatatatacctttttaacaccgccccgccgttcactacttgcactttcgctcgagcgtcgcccagcaggccgcatccgaggcgcgctccctacgcagcaaacgcacttatagcagtcaaggggggcgctgcatactgatcgtcccaccaatcaaaacactttacttgcaaacgtagcaggcttaacaaacctgttgagccgcggaaaggattgcatcggtttatgcgtgttgttaagtggtgcctaatgctttgttttcgtgcttttcctgtcacagaggctgcggtccaagcgacttgcagtctggcaccgcgaccttctgtggggcgcggcgatcgtctgtagtgtacagacagttgatctgcgctgacgtgtccttagcgttccattctcatcgcatgtcacttccctcgtttccgttactttgtgatatgttctgtatcagcgaatcaggtgtttttttacgatccgtaaagtggatcggaccgttttcaccatcgcgtccacagcaaggggctcaccaaagttttggggacggacctgctcataattcactgttcagaaagacttactcttgaaaaccgaaagcgaccaaagaaagaagcgcggaagaagcggaacagaaaaacgagctcaagtctccttttatatgtgtgggctgccgtggtacgctcttccacttgcgttgcacagtccgtgcatttaagtgcaagtgtgggcatgacagcatcctgttgccaaagacgagcacaacgtatttgcgagtcgtgaacgagtctcaacgaccgtctagagtgtctcagtgttgagacagcgactcgttgccagctttttaaatttggatcacggttgttggaaaatcgggagcccgatcaaaaaaagatgccgtgtccgcctttgtttaacgaaattgaaacctgtacatttcttatgccactgtacaattgattttcttgtccgtatgtatttgcacgcgacagaaggagcaagtattattggtacgttgttcacgttctgtattctgcgctcacgggactagttggattgggtggattcgtctcatccgaccgtccccccaccctgctgccctagcttgtctcgaagtatttctttcgtgtcttctcacttcttttaccgggaatcatccttctgtctggtttcgccgcggcgcatctcgataccttccgccctctgtatcatcgacctttttcgtgctgaagactcagggagcctaacaggccgagcgccgtaaggaaatacatttgcatttaatcgtccgcgcgtgacactgctcctgtgccagaagactgaccagttcgctcgaatgtggactgaggagcacgtagcttggcgaaagtgacatcgtgtagcacccgaacagtctgaaaaccaggcgggcactcactgtgttgtgtccttcagttgtagttacactgtcttccattatctggtgcttggatcctctcataacactgaagaccgatttgccttttctctgtcgcaaccacaagtcgtgtaatccgtatcatcgtagccttggttaatcaggccacccattcaactcaagaaactcattctttcgcgatgttgctggacttctgttgatctacaagcgttgcggcggcttattcagtcatatatatgagtaggggtaattattttttgcaaccgtagttagcgtcgccactaagggaggggaaattcgaaccttgccgtagcttggattttgctgttgctgtgtcttttcgtctttgcagggtttcagctttttttcgaacgcggtgctctctgcccaaagcattttgctcacaaagttttcggctgtgcctggtcgcggtgatctaccgggacgccgtttttttctcccttctggagacccgttctcgccagcctccggctggttgcgaccgagtagcaggcggggagtcttttctaaggaaaaaagggaaagcattcttctgccgctgtccgtgtaccga

SEQ ID NO: 3044 - DNA, 2075 bp, Toxoplasma gondii
ttatgctacgcgtttcgcgtctctaccacgaatgttgacctttcgttctcgtgcacttgtgtcctcatttccagtgtctgttttgtatcgttctgtgatcgtccagcggggaagaggaagcgatgaacggtttttgctatcctaaggcaggatagccacatgtcaattatgtgggcaggctcttttgttccgtcccccattgtattttgtctccttctgtagttgcaccatgttttcggccgtggcggtgtccccagtttcttttgaaatggtgcaggcggttctctaggctaggtgtatctcgtgtgtcgggaaaaaacaaggaccgtgacggttccttcttgataacgtgcatccacacacacacatgcattcgtgttgtcgtggacatatctactgtcggtattctcaggcctggttttgccccgtacttcaacgattaaaataaaacatataccaaaacgcctttaccgcaggtgtatgtaccctaacatagtagggatagggcaattttggaggaaaagggccccgacggtacatactgtttgaggattaaagtggcagagttcccatatgatttactcacctgctgatacgcctcgcgttaacacgaatgcttttgttgctcattattcagcgaccacgtagtctgtttctctaagccaaaccgaccccacattcgaatcgcgttgtcgtttgcggtagcgaacctctctccaacactgtcccctacagcagaccactctgctgcgtggattctggcgttagtacgactccggcgattagtccaatgtggaaatccactcgtcatttttgatggcgccactcggggtcgtggcacactcacggttaattactagaggagtagcaagtcagctgaaggatagtaaccgccctgaaaaacggtatcatatccaccacagattacgacagttcctgaccacagaggtggcgataggcagtctccgacgatacagacagctgcagccagaagcaagacaacagggtgtctaacttagattattgcagccttttttgtacttgggatgacactgacatgccaagacaagaatggtggggttaaccaacaaattgcacgagtatttattaatcgtcgtgcagtgcttcgtgctaaagggacatcgtcacagaattaagtttgcctcaaacagtagctgccaggcaaacacagcagccgtttcttgggaagttttttgtgggtagcttactttagagttgcgattgttggtacgcatctgtcttgcggattgttgtggcgtgtatctcgacagcaagacaaccatgcgaacgagttcattgtacggggttccctactcggacaagtatcttttttccccatgttcgcacagaaaatctcggaaaacaaatatcagagcaggactgacatggaagacgaatccgatacctcaactgcaacacatgcagcggctctcttcatctgggacttgcagtagcgcttgttgtgtctcgctgtcgcttgcttggtatcatgtagcatgcaacactttttagatggaccggcagcgcatgcgacatcgacaacctccaacgaaggatctcctttaatgtccaccatacttagatgccaataaaaaccacaacatctgcaagtgtgctactccatggggtacatttctttatgcctcgccatatttagggtcttcgtcatgcctgtgccaggaagtatgtacaccagatgcgaaaaagttcaccgcaagtcagcactcccacttgttattcgtgtcttttgaaattcggtacaaagtgtccatggtttcccttcgttctgtctgtgtccagggttggccatctttcgtccccgtcgaactaacgaaagaccgggcagtatgcaaagctggggtacgcctcgtgaacccctatcggcgcaaggcagttccctggctttttgtgcgaaaacgggtcacaactgtgaaagccgtaggcggaagcctttttgtcttgaaaaaattagttccgaaccaggcgtctctcctcttgaagtagttgtccggcttcgacagcgggccactaactagaaactgttgtcgacgcga

SEQ ID NO: 3045 - DNA, 1984 bp, Toxoplasma gondii
gcacgagaagtcgcagttcgacgaaggaagaatcacaaaaatttgagaagaagaaatttgaccaggaactccacggcacatgtcttgctatcgttcagtgtctctctctctctcctttgcgtcgattcgtctactccggcgtcttcttccttcagtcgtcacaccgaaggaagaaagttcgtcctcaagagactgttcttcgctctcatcagcgtgtggttttcttctccagcctcttctttctgctgcgcatgtgcagtctctcaccctcaggacgacaggaaatggcggcgacctcctcgccaggcttggtcgagctacgcgcggcgcctctgccgttcgtcctcgcctccgacaacttgctccagagcctcattgcgctgtcgcaagacgaagagaaactgctgtttgcgccttttaccgcagcaaccaggcgtccgggcagcagcggttaaactggaggaacgccgaggttgatcaaaccatttcctgcgcacagagtctccgccttcttcctgcgctgaggtcgcctggactctcctcagcctgtctgttgactgctgcaggttcctcctaaattctctccctctcgtttctctcggaactttgcacgctcgcgtcgcgccgcagactaggggggagaagaacgtcgaaaaaagggagcaaagagcgcgcgagagcgagaaagagagaacaacagaagaggaaaggaggacgagccggtgtcaggcagaagaaggaagccaggacaagccgcagaaacggaaacaacgcagaaatccggtttttttattctttgccgctcgacagacacgactggacagagaacagcgcaaacgcaagcgggaaagcaaatggtgaagtgaagagagcggatcgcaaagcagttgtcaaacaaagaagaacgacaagcgatcaaaggcgtcgagactcatctggactggccagagagaaaaaacaggacggcccaggcgatgctgcccccaacactcgccgtgacctcgtccgtctgtctcgggtgactcacaaatttgtcttggccatcttcatctgttcctcgttcctcgttcttcctgtctctcccgcgagcagcgaacgcgttttttcgtcgactccgacatgcgcgaaccgcgcctgtttgcgcctctgtctctcgcttcgtcgagagttgcttcttcctgtgcatgcagcggccgccgcagccgctccgagcggtgtgtctccaggagaacaagaggaactccgtgaggagaactcgcgttttttcgagaactccccgaaaggtctgcgagcgcggtcgtcgcgacagccgagcgcgtcgagccagcggactcgcagccgttgccctgctgcatgcagtttgctcccgaaaaggggaatcacgaaaagaagagggtgaggggagacggtggttcgtggacggcgcgcgcggcgggcgtagtgcacgcgtgtataaagtgagagaggcagcagtgaaaaactgggaggggggaagacgggtgtatctgtccaagcagaaaacgacgcatcttctctctttcgccgaaacgcgtcttctccctcgtaccctctctctctctgtctctctctctctgtctctctttctgtctgtctgtctgtcgcgtgaggtgtcctcgtctgtctagccagtctctgggtcgaccgactccggcggagcgcgcgcgtgtgtgtgcacaagcagtgcaaatcgcctgaagcgtttcagctgttttctcgacctatcgtttcggctgctttcctccttcgacgctgccgaggcacacacggagttcggcgtctcgacgccctgcttcttctcggcaacttctcccctcttttttggatgcttctctcgctgcgcgctccagggactcaccgtcttcgcgcctcctcttccgattcctccatgtctcttcttctctcccgccgctcgaccctgcgctttctctccgagttctgctgctcctctacaccgcgagaaaga

SEQ ID NO: 3046 - DNA, 1751 bp, Toxoplasma gondii
gaatgatgagccgccgcaagaaacacattggaaccgatggcatttcccttcctctttctctgcgtgtctgtggctctgtgccttctcagctgacgctcgggcaagcaagcacgactggcgcattagtgtgatgaactgctggggtttcactcgtcgctccctgcttgtgctggaaacagaccgggcaaaaaggggggcattcgtacctctggaggatacacaccggtcgcggcaatgaattttccatctggcgagactcggatgcactgggaggagacattgaactcgaattcctgcagaagctcgacatcttgtgcatccggtccagcggcttcttttccgcccgcctctcttctgcggcgccgcttcctgcgaggaagaaagtctgcagcgcggctgcgacctcctgagaggttgtagattttgttgttgtcggcgttgctcgtcaccaaaaccattgtgaatcaagaagctgtggacgtgaaagaggcgttcttgcgctcgcctgtgcacgaagttattgcggtgcagggtccaacaagaaattgcagaacacactcttatcagtttgacgccgatgagtacccactctttggttggagggagctgtccctgagacaaaacgactggggtatagaaaacttcccttcactgagagactcagacgcacagcgcatccgaatttgttcgatggaggagaaatgggctcaacatgcaaagaagctggagactcgacgcagagcgacacgcagacgagctctcatttggtcgacgtcccctgccggcggactcgaaggcagtgtgggcagaaagtgtggcagagtgcatgcgtttctcgccgacgcgtcccggtcagaaagttcttacgattaaacaggacttagatagatgcaacagacacgatgctggagtgagacagatgccacgttctcactcggtatgtatagaatctagcgcgagttgcggcgcagcgaaaggcaaagaagtacccgttgagtgcgacgggtaatttgaatgccagggctggaaagcgagagtttcacacgaaatccgggccgacatcgacgttgaaaaagccctctggtagcctcgagaagcatacagagtgacaacttgagagatgtggtctgaggacaagtactttggtatctggatcggctgtactgaaacgatatggaatcgagtgtggttttaacgcattcgagagtgcatgcatgcgcgggcgggttgtcctgcccgaaaggcaacgagccaggacacggtgctcccgacacgcgaagttattacacaaaaggtgcagtgcaaagcaaatctcttcttccaactgagcacttgtgacaccctcatatgtcgaccatcttaccgaggcttaccagaggggagaaaggtctcccaagttttggttccaagtgcgcgattgtaaacttgcggaatgggtcgtttggctgccaagctcatgatcaacaccggagaaagtctgttcccgctttttcacggctagagacgcggcactctctgtcctccgtgtcttgggacgaaatatccaggtgtgcacatcgtgttggggcacaattctgcttgttgcagctgtctgaaccccgaccaggtgtcttgcggttcctgctcgctctgcggcgttgtttgagcacagttgaggaaaatacaccaaaacttcaccgttcggccggtggaacagcactcgtaccgttcggccggtggaacagcactcgtctttagcttcagcgacacaa

SEQ ID NO: 3047 - DNA, 5007 bp, Toxoplasma gondii
cgtctgaagattaccttgtccatacacttgactttcggcgggtcatgagggtagtttgcaggaatggcaatgaaaaagaggaacttgccgcctcgccagaatccatcgtcgggagatattttcaactgcatgttcagcaggctgttccccagcagctgaggagaagaagcctccgcggcaccgcgtttctccaaagacgagaaagtaagaacacactgatgaggaagatctaagtcctccagctctttctgcaggcgaatctctccgggaaaccgacgcctttcttgaggatctgcagacgctgaagaagcgccagagacacccgaactgctgccagtgtctcctgagagaggagcagctgaagaactcggggaggcagaagatgacgcctctgcgttgttctgcgacgtcgaggaagagacctgcttaggccgcccacggcctacgccgtacaacttcagcatttcgacaaagtgaaagagaacgaagagcgcgcttcctcacgacagagccgagagggagaacagacgcagcagaagagagattcgagaaaggatagagacggggaaggggatttcgcagagaacggcgcggctccagagaagagcagatctaaacgcaggcttgggggaaaaacgggactttacacgacaacagaaaccgagaatgagaacacgaggtaagaaacaagcgtgcgaggccacaacatgcgaacttaagaggagaaaaaacaacagcgagaagcgataaacgaaagagttgtggcgggaaaaaagagaagcgagatcgcgacagcgaagaagctgcgagcccggtcgctcaaaggaggccgcctctctcgtgctcagacaggacgctcgcaaagagaatttaacgcatatgaaaaacagacatagagagaattgaatcgaggagaaactagacggcgagaaacaaaagacagaaaacaggggaggctgactccgagaggaattctgctgagaggggaggctgactccgagaggaattctgctgagactccagagtccttcaaggaagcgacgaaagaggacgctctttcagagggtgtgtctgggaacggccctctgctgccttgcttcgtctgtgcataaactaaatgaggtcggaaaatcgaaagaggaaatggcggagacagacagacaaaaggaaacgagggcctcccttctcagttcgggcgctgagacctcgatgtgccgagtgagaagagaagcaaggaggagaaaagaagaagaggactaaggatggaagaaggaagactagggaaaactacgggcaggagggacggaaagacatgacaagcccagaatggtaagaaagcagcgggtaaatacgagaaaggacggcgatgatgaaagaagaagttgagacctgagtcggagtcaaaaaaaaaggaaaaacagtggcctgactaggtttgaattcgagagaaaaatgcagtgtacaagaagcgcgcgagttgcgtcaacgtggaaaagtttggtgtgtagaccgaggcgcaagagagaaaaaggggaactccacctgcgtgtgacgtggctgaaatagaggtaaaagtagaaaatcgagcgtcgtttgtttgccgggtcttttcaaaagtctcatttggcgtgatgaacagaagaaacagcgagagcagacatgcaagggtcaatgaaaacgatttcagaacagcatgtcacaccctgattaacgaatccaaaaagatagcagcgacgtttcctcgatgaaaaccattctcttttgtgtcacttgcttcttggagaagagtgtttctcttgtagcttagtccagcaaatgcagtgcgattttctccacgcgatttttgccactgagttctgccttctgaccgcacgggtagcaaataaggcacgaaataggcggtcgggccgcacgtgacaaagacgaaataccttttctatggaaagggcacttcgtgaaatgtagaaggatcgctttatacgttttattttagcggaaaaacagatacattcgtctacacactcccgaaatagctcctttctctgtgagggattctccgtccgggcttcttcgtgtgttaacagtccgcacccgtcttccgcttttcttctttttacgaattagctgtcgtactttttacagcgcccagcttgcacagcagcgccctcgtctggaacaagttgcacacgcttcttgttctcctcgggttcaacacgcagagggcgagaaaagctgaagagtttgcggcgagaacccccgcaagcttcttttctgaggaatcaaggagggaacagcagcgacatttttgtcgttctccgtcattatctgagatgatgaatacagtccagtagtttcccgtcgaagaaactcgacctcgagagagacacagaatgccgattcagctctaccgcgccgcgaacccgttcgtttttctcggttctacgggagcgaaaccttctaacgcaaggaaaggtggaaaagacctttcaaaaaacaaccctgtgcttctcacgattgcagcaagctgccaacacctgaacagtaggcttgttccgtaggcagggaacagaagcgaaaagagggaacagggcgcacgattcaacgatggcaatgtccaagaggatttcaagacatcgagtgccgcaactctcttagaaagtaacatccgtatcgcattcctatcttgtgatgtggtctccccttatagtgaggggacgcgaatcggcttctcaacaaaccagtgtggaatttccttcttcgtcgtgcaggggaagcgttgaagacacactgtgcgtaaatggaaagcttctgtttgagagaagatttcagccccttccgtatcggtgaggcatatacgtgaatgagttactggattggcgagaaaaaacaagaaccgaaggtgagaactgaagcgtgttttgtgcataacaatgccacttcttgtgtaaacagagtgcgcctcggcaaagtatgttggtttcttcttgattcttgaccctgcaacagagctgttggtgtaaaaggctttttcgcgtcagacgttggatactgcgtacccgtggacctctactcgccttctgtttgctacttggcaagtggtgtgttttagacgggttcacttgctttccgttgtttatctatttaacttttatactgacacccggaacggatgtgcacttggaaaactaaatgggcacaccgttgctccatctcctcaattatgcgatccagatatccctccgcagtccgtgctttcggatgctccttgaaagtactgccgtttgcattctctttgcaagcgtgccacgcccagttagagaaggagcagcaggctggagagctagaacgttgcatgccccagcagcctctaaatagccacacagaccctctcgcgattgtgagtccgcgcttgccgagccgttttacttggctgtcgacagagcaaaacagaggacgctgcatgtaaaggaaaaactatcgagtctgacgtaggcattaaggagcagatgctttcagtgtctcacgagaacatcagataccaccttctccttgcccgcgattcgtgcttgcttctaaccgatttgtagttgacttccatcactctctgtgacaactgcgctacccggtgaggtggatccgttcctgcattctccacctcgactgaaaatgtggatgagcgaaagcagtgaagagacgcacgagagaggcgcaagtgtgcgtggtagcgatgaacgctcagtggcgacgtcttggactcttcacgtcccctggtatgttgtcgaactagaaggacactacagggtatcaaaggacgcatttctcaggtccccataggcgtccgtttgatgtgtgtgagggtctcactctgtgtcagctgtggatcgaaaagaaggaaccgagtttgagaaaacttagacaacaggaccaagtgaattaccacgggagactacgtcgacgagaggttccctgtggctgaggtggaaccagaccagccgcctcttttccctgtttgtgttgcttaaagtgaagctcctccatcaccaagcatttttctcctctcccaatatacgggggcattagaaactccttatgccgccgtgcctttccgcctccttcgacgcttccgtgcttcactggctcttacaaacgcgtggcgcacaagccagtacaaagacaccgtgagaactgcactgctaaaaacattcttttgaatgttcctggaaacgaacgagctgaagtccgaaaccgacaaagtcccgtcagaccgctctttctagacgaccaaaggtccccttgagattgcaatttagaaacaggacccgtatttccgtgttgtcttactctgttttgtggaggggcgctgtttctggagtttcctcgttcggtctcttccggtgtttgcatgcgttcaaactgtcgaggacggccactgcaaagagagcttcccatgggacacgcgggagagggtcggctgccactgggagcttttctcgggattggtgaaaagcgacgttctttgcgtctctctgttttttctgttccctcctgacgctccagttgacagggtgaccttttgccgaaagaaccgaccgtctggtgttgtgcgattcgctgctgtctctctgccgcgctgttctcgggtgcagcacaccggaaaacaggaaagttttcttttccaaaagaagcaggagatgactttgtctttgtagacagcaaaatatcgtctttcgagactcaggacgtagcttactgcttgcgtcctttccgttccgctctgaaattgatgttagcggttcttgctgaggtgtgccggtggctgagcgactgcggaatacccggtcgttttctggaggcaacgtgaggtttcgtttcagttttcccgcttcatttcgtcgttacagctgagaaccccttgcgcgtgtcccccttcggctcgcaagctcctcccttccccttctccggtctcttcttcgtctttttctgcaccttttccactctgtggcaaca

SEQ ID NO: 3048 - DNA, 1345 bp, Toxoplasma gondii
gggcgtcatccgatcgccgttgcagatgagctttagtgaagaaacgccgagaaggaaagagaggaaatgaaaacgtcaaagaggagagagaagaagaagaagaagaagaagaaagagaagaagaagatgaagaaagagaagaggatgaagaggaacaggaagaaacagaggaagacggtggatgactacgtcgaggagagggaatgtcgggaatgaaagaacgtcgagagaatggagaagaacatgacgaaacgaaaagagaatccttccaccggcccagagaagaagacgaagaagataaagaagacgccgaacagaaataacagaaagaaggtggaggaccgcggagagaagaaaagcgacatgcggtggttgtcaacgcggaaggagggaggtgaagctgacgaggcgagaaggaaggcgagggcggagaaagatgagcggagaagcagaaaggagaaagaagagaagaacgcacaggaaaggaaggaggagagaaggacgaaaacgatctccgagccattttctggagagcaggaaaatgaccagaaactcaactagaaaaacggaacagcatgtttctattctaaaaaaatggaattctcgaggaaaacaagagaatgagagagaaaaaacttcgcagttccgccagaaacgcctcttatgaactctttgttctgtctcactcctccactcacagcagcctcgacgaccctctgttttccatctttgttcttgctccttctcttttcgtctttcgtctcttgccttcgctttgctttttctttcttttctcttctctcttcgcctttctcctgctgtcttcggctgtgcgtctttgtttctccagcatctcaaatcgctgtctccgttgactcgcggcttctctccaggtattgtacgcggttcccgcggttttccctggccaggtttccgcggtttctttcgcgaggaaggcaccggcctctcgccatgtgtctgcaggagacagcgaagagaagacgagaacggagacgagcgaggcaactgcaggaaacgcgtttctttgtcgcgttttcgtcgtataattcttcgcgcatgcgcatgcactccagctagggcagtagagcgacatgcacagaagcgcgcgtgagaagttccgcttcttctttgccgttttcctgcgcgttcttctctccgtttttatttctcctcaacgcgccctctctctgctgccttcgttctcagccttgcgtcgctccttttccgcgtccttccgcgcgtcgcctctctcctctttcttgttctcgcctcgaggcgctcggcgaatttctttccttcgtttccggactttctccatggacaa

SEQ ID NO: 3049 - DNA, 1704 bp, Toxoplasma gondii
tcaatgagaatgtggcagaactcgcatgacgatcgtgtttcttagggaagccagagctgcaatctgatttggactttcctccgtcctggacccgcttaccattaacacgttgagttctattcgaatcagacaaacgcactcaaagtgtctagcggcgcttgaggggaacttcgactgaatcataatttccctgcttttccaaatcctctcgcgtttcattgtcacatctgagccagtgccgcattttggcggcatcatacaggcttcatcagacgtagtcagtaccttgactctcccagcagtaagaacttcaatagtgcattttacagaacccggacaagtagaaaggtagcagtttcggctatatacgagaaaactcctctgtgtcgaaatcttccgtatgcattgtctccaacagttaaaagcctatcacctcctacagcggggaaagccgtgtttttcgaccctcgtttgagcagactgcatatcccagactaaggcctccaggattcgttcatcgcagaaactgtaaaacagcgaaggtcgtggattttatatcctacgacagagaaccttcttcacactggtcgtattctaggcgtaagatgtatatggctgttgtcactcttaggcaggttttggcgcgtctgtagagagctcaaagaaacacactaattgcagtgtgtagatcactataaaggaagtcttgcacttaacatggtggccgtagaaaccataatagaacttggatccggtaaaacaaagaccttcaagatctaaaccgggagtccgactcgtagcatttgatccctgccctgctcagcaacaaataatcagcggcagcattctcttttagaatagtttcttagctacaatattttactctgctcctggattggttctgtgcatatgctaaacgaacgctgctgacggacagctccccagcacacccgaatgccggtaggatacagaaatccaccgccttgagcattttcaagaagtctagtagattggtggagtatagcaatcatgaaaaacttttcccagaaacaagaaagattgattgttgcctggggacggttgactagacacgggattgaggtgccgccacgccgtttttgtgtggtcttttctcatggtttcgttcagttaattctgcatgtgcatgcgcgggtttttcccggcactatttcctctgtttcgaatttcctttgcgttccgttcttttctgttcttcgtagcccgttttcgttccaactcctcgaccatccgcgattgcgagagatcgttgtcagcatacagagttctttttgggtaccgctctagtctcagcgttgctccggctgtctcgaactctccaacctctcgagttcacagcgtccgttctctttcttttcctcgcctagccgtcgtcaaaatctactctttggaacttgtcggtttcacactgttttgccgacctgccacttatttcgtcctttgacctttctccgcctctccagtttctttctcccgcggaacgtcgagttctccccgtttatcttgccacctcaaggtcgcctgcatttcgcttcccgtgctttctccgtctctctgtcttctagttttggtccttcccttctctgcccttcaagtggacccttggtctccggagctgtctgtttctcctccccctccttctgcttgtcttcccgctatcgatta

SEQ ID NO: 3050 - DNA, 2297 bp, Toxoplasma gondii
ttgtaaataaaggatgtctttctaaggaggatgcgttggtacagtgcctcttggagaatgacacacaatgaagtatcagcacaggcaagcatatcagcgtttgctctgccaaacaccgatcggcatgtgctgtgcatggaagtacgcatgtcccaatgattcggacaccgttgcagaacgaatcgaaagaccgccaaagcccaagattgcactgagcttcttctcgactggcccaagtgtgacacaccacttccctggaacctgaataaagaacaaacaaccatcaaatttcatcgcccccacggagaggcaactggaaacgagcacgtgtgctaaaagtcgacgacatatcttctatcgaatatccgacgcaaagaagagacaccttctcacacgatggtgtaaccgtacaaaacccgagattaacgcgttggaggcaacgtcagaaagaccagaaatctcttcgggtccaacaaaatacaaagctccaattcttcacagggaactcggatccttcagcacgagtacccgcatgcctccgttcgcataagacacaaccctcggcggcagtacaaggagcaaacaagaaacagtgcttgctgagtggctgtttgccggcaatagcgttcagaataggctggtccaacagcagtggtgtcttttacaaaatgaagcacctcttgagtgctactgttaacggtggcacgtgcaccttgcagcaacgactcttttcttcaaatggcactatccctcaacccgaatttcagtggccgaaagcaactagtggaattcaaccctcctcatgtattccgtataacataaagccgctgtgaaaaatgatacgccaggtaaccttccagatgacactgtctgggccgacactttcctcataggagttgtttgttggcgcgtacgagatacactctcgctatttgcacgtgtcaggcagatgctcgtgtccagacaggcgttgagggagcattctcgagaatcgagtagtttccctctactgcctacagaatcattctctacaccacatttcatcacgacgccgggagattagttcgtttcgtgtctttttaccactctaaacacactttttttgaagcaggggcgatacctgactgcgacaaaacgacgaacagtacctcccccttcgcctgtacacactcttggcaaaattgcgcccacttaccgctgagcgccgaatgtggcatagtagtgctgaacaaattgcttgccaatggcgtcaaactgagggttaagctgcagcatgatgaatggagatatcgcaaaggctcaccaagatgcggggactgaaacgaaagaaaggacaaacaacaggaaacgagcttcaaacggcaacctttaaactgccgacggctgaggcagaatgaacttttggtaaagagaagggaaaaacaccaagaaagttctgaaaagttcaagagccactctcagtacgcactgaaaaccggtatccacttctggcttcgctgtctccccgtttcaggtctttccatccccacccccccccccagtttgagaaaaagggtcagagtgcaacaacaggagtcagtttcttgaacacttcgcgccggagacatcgcaccccccatcacctcaccgtcgtgtctcgtgtttttctttgagtgaatcggtgtttgaaaattgttccattgcgtttaatagaggggttcgtgtgtttgttgctggactggcttagtgaacgaatcgacgtactgcacagttcggacaccagcgactacacgcatgtcgtcttccacagaggcttcgctcagcacacttcgtgttctttcagtcaacacatcaattttctgagtctgtagtgttcccgatccctttcacaaccttctaccacgttctaagttttgcgtcaggatctctgcgaacggatttgtgcatttaactattttcgtcaaaattgactgggaccggagacaggcctccatccgccagccccgtccgcgaaatagcaagccgctttttccaaggtgaaaaatacatcacaatcgatcgcgaatgaaccgaacgggaagccaggagacggacgaagagtcaaagacgtgaatgacgtcgtactttcgagcctcctcatcttctataaggaatggttgtttgccacactcaccacccgcctcgtttgagtgccagtagtgttctgtttcagcaagaaatccatcacgcgagcaatcgcttttgcagtgtgttctgcttactctaatcttcaatccgtagcgatttcagaagtcaatcgtgtcactaactcgtaacga

SEQ ID NO: 3051 - DNA, 3388 bp, Toxoplasma gondii
taccaggtgatctaaaatcgcaatgtcggtttcttgtgcctatgaatctcattgattaatgtgtcacaggcagtccatcttcagtcgccgtctcactgatatttccagatacgccaaggaacagccacaacctttcaagtggtcgaaatacccaggcttcgtacaaacaacacggaaaaaagagatgcagagagacacgtgcgtctcggtgaacgcggctcaaaggcacccgagtgtgtgtggcgagtatatacgttaatgacagagtgtacgcagaaatctggaaaacgcagtcgttcccatggtgtgtgggggcactgaccgcaaatgtcgttgctcttacacacagagacagacacgtttcccttggagactgctgtcgctcgtctttgcagcgacataaacgactcggcagaccctcgtatactctgtaacatcatcctggagttttagcatctcggagacatgactatttgtcagcgccttgtgctcagtagaggagagcgacgaaaccttctgctcctggatgcacactcaacagcatgcatgcggtccggttgaatccctaaaaattttttttcttactgcattgtattgttccctgagctgctgagtctcggcttggagactgaagttggagtcttccattctcgtacagtgctcacaaaaaacgcgtctttctttctggacacgtgaccgtcaccctgtgacgcgagccgcagaagcttggcgtcttcggtggctgaggtgtgtacaagaggttagtccgatcgctgagtcgaatgtgatgagagggacttgcagttggatctcagaagactgcgctgttcttggtatcttttctcgaatttgcagccatggacacggctaacaacgactgcgtcggctggagggacggcggagttcgtgcgaggaaatttcggaaaagaaactccacggctctctacgacagcgctcgatgcaggggaagtggtgggaattctggccggatgaaagcagacgaaaacaacagaagggctgttgcgagttaagaagcagcgtctcggtcgaggttccccgtttcgcgaggcgagctccgtgcaggggaaagcgggaaaaagacgagaaatatgaaagcgaacgaccttccagacaattcgagagactcacggacagggaagcccgatcggcagaaactaaaaattcacaccgtggctgctgtcgctggcgttgacgactgtgcacaagacacaaaccgcggtgaggggaaaagggtggctcgagggagacttcactttaagaacgactgagaaacacacagaaacagaagaccggcgcttgagtggcgttcagattcatccgtcaggcgcagaaatatcgtcttttttcccaacataagtatccagcatgcaagaaaagaagcgccgcacgctgcctctccgtctgcttgagagtagatggacacgaagtcggacaaacaggtgttttccacttttctttccaatccggatggcataactgttctcagcggacgtgagggccgagtggaaaagcttcctctgcaactaggtggaaataaataacaagtgccgccctgtttgtcgtttgttttttgcaaaccatagtggttcgtcctttccccggtgcacgtcttcaaaagagacaaagcggatatgattcaacgaaaacgtgagaaaagcggttcgattatccaccactgcctaaccatctgagacatatacaacaacatgaaagccagttctgacaaccgcggtcagtgagttgtatcgtctgaagaccagcatatatgcacagcagtttaccagcaaattaacgcacggacaaggcacgtttgacgatgcattctcctacctacaaaaaagacgagaataccgcaattccgttgtcagttgtgttccacagcgaaccactgcagatctgaaaaaactatatatatatatatatatatatatatatatatatatatatatgcgtgagacgcggagaatgaagcagacgctctccatgaaggaattgcacaaggcggtggcggcgaaaaggcgcgacagatgaggggaagaaacactggaatttcttgaaaattatctgtttcgatcgttgctgacaaatccttttcttaagctgtttgtagttcgggcgcctcctcacctgtttctgcgtgcgtgggaagacagcacatggacgcatgttgaagtatgcaagcctgttgtaacagaagccgttttcttcagaattgcaccgggcgtctcttcagcccacgtgcagcatgaaggaaggaagtctgttattccctcagggcaatcgttgtttactcatgctaagtggaacgccactccttgcgcatgttgcagaatatagcaaacagaatgctgcaggtgcccattcaagttctccagagagacagagactaaattgagacagatgtcacgtaatgccatgaaacaaaccatcttcgtagaccgcgaaaactagtcgcaacgttgacgtgttttttaccactgctggcggacagccatcgctacgaaataaaacgttctgactgtcattatctgagttgtgcaagaagcgaaagaaggatgaacgctaccatctgcagctggtgaaagtctgctacttccattgaaaggaattctctgtccggttctactgtagcgcctcaatgccaacacaatctcacatgtagaacacgggaatccaataaccgacgcaaggggagtttaccctcgaggatgccttactttagtgcacgtaatgtttgacctattcagtcgtgtcgaagtgcttcagatttctgtcgtttctttcataccgatcctaagaaaggagaaacgccctccccaaagtggttaactcgttgtgaactcttcctacggacacgaggcagcttgcaccgtcgttagtttcacgctagaaagaggcttcctctctttgttttccactgaatcgtcgacccgagacgatctaaaactttgtccgcaacttacatccacaaagggacataatgaatcttggaacggtctatagtggtcttcctcctcaatccaagctgaactgtggttgatcaggactgaagtcctcagaactaactccgagctgatatctgccggagcgcattcagctggaggtgcaaatgcgcaggaaatgtgcacgtctatttgcgtttgtagacactcgtttatatccacgtgcacgttcatacgaaatgttctatgtccccgtacgtgaaagttggcaactgccacggcagcggaaaaaacaaagagatttctgctcaagagcgagtgctagcctctctccggagaatggaaatcgtctctttcttctgtggtcaacgtatccttcgcatcgagattgtttgcaaggaagattcccaacggtcttcagcgca

SEQ ID NO: 3052 - DNA, 3802 bp, Toxoplasma gondii
cgcttggttaatcaaaatgtttgcatctgccgtgaggccggcaacggcgcacatgacgtggtcgtcgacctgtacagacagtgaagagagattcgcagcactgaaagggagagtctggagaagaacgctggcgaaacgagcaagcgagcaagtcggcggcggcacagagcgcagagagaagataccgagacgtacaacggacgaagactgagagaaagtcaacgggagagcggcactcactcacctggcgacagagaaaacacgagacacgacaaggggaggagagacggcaggaaatggattcaagatcctgtacgaaaacaggagtataccgaagggtggagaggaggagagagcacacacatgcaacgctcaagggaaggagtaaggaagagcgagaaaacggagacgggagcagctgcgcaggaagcgacagacggggagagagaacgcgaaacaccgcgacgggagagagcagagtgtgaaaagaaagctcgaactcccctgctccgggaggagcaaaagaaaccactttgtaccttgtagatcttttccttcgttctgccctgatccagcagcttggaagtgaccattttgtctgctgcgaggacgactccgtcggtcgcgagaattccgagagttgaagacgcattgttaattgcctctaacgcgtactccacttggtagagacgcccctccggcgagaaggttgtggttctggaatcgtagcgcctggccatgttgatttccgtctaaacgcacgcggtcgaaactgaaaggttgctggctgctcgagcttaaacaaaggcgcgacgaacaacacaagacacgccgttgccacgcccagaccgaacgggcgctctctgcgatgtgaaacagagacaaagaagaatgagaaacgcgaacaacaggcagagaagaaggagcacgggagaaaaacgagagagcaacaggacagaaaacgaaaaggcgaagaacggaagacagaaggcgacgctggcaaggggttccaggacgtagattggggtatttaggtctcagggttccacggaggtcgtttttctggaacaaaactggagacaagaagagagaaaacgaggaaagaaactgcacacgccttcacattcaaggagcgattaagacacacggactgtactccggtgcctgcacatctctgcataaaaagactgagaggaagaaacactcccgcacctggaggagagcacttgcacagaaaaaacagtgcgttgagtgaaccacgaggcacaagaacccagagaaaagtgccaagcagccggctgaaaaaagtaaaggccccctcgcttttcagaaagacttccccgggtgtcttccgtctccctgcatgcgcgcacaaactgcagtgtgcacccggcaacggcttctgcaagtgacaaagggcacgaaaggcaaacgctaacacatccgcgaatccgatctctttcaaagcgaacttctacacgggaaaccacggtgtgcagtcgtttgcatgcctttctcaatgcgtctgcaacacgcatgaacatgttcgtgtgtgtcaaaacacgaggaggaggccgcaggttcctgacaggcgaaacaggctgcttgtgcacgattcaagcgaaacacgaattttggcttttgtcgctcttttaaggaaatttcaaacaacgttggacagagactggggcagagcagcgaacgccggcttacactgaagcccccgcctcttgtagcagctctcccaatgtggccagcactacccttgactacacctctctctgtacctcctggagtagtaaaacaggtaaatgttagcaaacgaaccgtaaagataattgaacaaatatataagatatatttaaatcagtagatgtatgtaacatgtatgaaaatatgtactcatgggtatgtatatgtatctatatataatatggatattaatgatgcgtgtatgcatgtatctgtaaataagcctggaatagaaggcacgcttctctaccagaaaaggtacaaagaaagaaggtctgagtgcgaatgtgcaggaagacggcgaagggaaaaaaatgagcaaagaggggaaaataattgaatctttctgaccacgccgagacagcctcactgctttgccaccctctctgcgaggttcacctggaggcgcatttgtttcttcatttgcaactttcactccagatgctctttaaaagacactggagtacctaggttactgaatagaaacccagtcatttcaagggactgacagccaagttatgtacgattgctcacgaccacgaccccctgtagtgcttaagacaacaaaagctggactgaggagtctcgacaaatctacgaaaatccctgccttggagggttgacactttcagaatggataacgttctttgcctccaagacactcgcgaccttttgcaggcttgaaacgccaagctaggacagagacaactggatactaccgcagagctgcaattccacttgccacgaacaacacgacggattcaactcagcaaccacttagcgacctgagaaaacagtttagtagccagggcgagacacagcctgaagtgggggtcttcccaaccctcgttgttcggcgaaactgcgaagacacccgcggaaatcgacaggtcacagttctgaataagtgggcactcttttctctctgatgcccgttgcatgtaagaagcaacttcaagaggctagttgttctgtctagtctgtacgaatggtgacggcaatgtaggactgagatcccctggagaaacgctttctcggggggctctccggttccctgactctctagaacaaggtccaagcgaagagcactctgagttacttcctctggggagacgttctcatgaatctgctcattccaccgaggcttctttagctccgctcgctcctgctgcatagctgtcacacggtccgaccgcgaacgcaaataacagctccgtttatatcggtacactggcgcacctggacacctttttgtgttgagctccagttctgccagcgggggttccctttcttcgaatttgcatttcgactatgtccacccgatgtgtgcgtcggcccgtgagtcctgaacacgatttttgtcacttgcgagtcgtctcggtgagacagtaacagttaaaagaggaattattcttcgggatgttcaaagaacgggaacagctgcggatagaaaaccgtgtctccagagtgtgagcatgtcgtttccccttttcctgggcacatgacaatgtgccaaggtctcaagacagcgctggagggaggaacggactcaagagcttcctacggtgaacttcagacgttccagcgcggtttggaggttgtcgcctcaggctgacatcaatggtttgtgagaaatgagcgcaagcgtacactttggggttccccgttactcgttcgctctctgcggtcgcgtagtaattcgtgagcgactttgactttcctcatggtgaatgcgttctctagtctagaaacgcaacgagagctgaggggtcaggtgaaagacagctcttggctgttgcggaagttgttgatacccgcctgaaaggcgcggagcagtgtgcggcaactgtcgtcggtttgtctgaggggtcggaaccggagacgtgcgggtttcgtgcttgtcatcgactgggaagaaattcggggacgcattcgcttggcatcttcgaagactttgcgttttttgctcgtctatcgccacacgctgttccgaagcactcgtcccaaccaaagcaggcgggcactccgggtgggtcatcccgctgtcaca

SEQ ID NO: 3053 - DNA, 5044 bp, Toxoplasma gondii
gggaaagcgatccgccttgccgttaggcctctctgtgccagataattattctgtcgggagcctcgcaaacaggaggacgcgtttggtcgatttgcgggaaaagacaggagatgaccatcaagcgcaggagaggctggtctcggtggagcgacgccctgcgacccaggtcccggagaagccgtgacacacatccctgttgagaatgactgcattccaatgtccgaggaactgagactgggccactgtcctacagcaggttgaggaggtttcatatgccccggaaaactcccctgtccggtgtatgttggttgaggtgcatgtgacagaacctgccgatttgtacccgaaggggaaaggaccggatgatcgtgtgggaccgccgagtacggctgccaggcgcggtcgccgtttgcagcgccgccaacctctcgatagtgacctttccacatgataagcgaagaatggagcgactgtatgacacctgaagtatctagaaagatggcgcgaggctgaaaacgttagagatgtttgctcgcgcgtctgttgagagaaacgagggaggcacaggtaacatggcttggcactggaacgcaaacgaaccaacgcctcaggccaaaatttgtgaaagcgaccaaagacaagggaaaacagtcgtgacacgcgaaatcaaacaataacgctgaggtcactgctatttccgggcgaagaaaaaatgttcaggtctgttgtccatggggtatttaccgatatttgacaagagaatctcggcagtaacccggcaagtgatactgaattgtgaaatgtgactgtgagagtaggcacttcaagagagatgaggagatggctctcacggacgtggcttgcttccagaatgaaacagctacttgccaagacatttgattgaagagagctttgacatgtcagactatgctggttcatagcacctcagaaaaaccagcccacggggtacgccaagaggacagacaagaaaacccaaaaattggtctacagatcgtcgtccacctaagtggagccacgtcaagtcccgtttgcctgatgccaatcttggtttaaaaggtctgatacctgagaaagaaggtcacgctatagccactgtttacgcgttgcatcctctccacggcagcaggtctgagaagaaggcagtgcgttcatgaaatcctccggtcgggcacggcctaggatttctttgatgagcaatccaatgcaccttgcaattttccgtgtccagctacactcggccacgtttcaatcctccaacgcaagtgtaaaatctacgattcgcaaggagcagagccataaaatgccaactgtagagaaaagcgttatatcaagggatgatcacccggggaatcaaaatgacgtttcgagcccaaaaacgttgtgttgcccttgctgcgatgtgatggcgggggtttaccgtcaccgcgcagtcgaggacagacggtgctctgctttctcccacgcactcttcctgaccaagaagctccaactatcaaagtggtgggcccaagattttctcacgcacaaacctcgacatcgaagaagtacacgcagcacaatggccatcgtaattctggagaacgcacggggaaaagcagcagtcgctgcttggccctcctcggctagcacgctgttgggcaattgaggtggcggtgtcttgagcaaccggtcacggtggctttggcttgctctgcgcctgcaatcaaggtcactcgcggtggaaactcgacataggccttcagtgaatgctgtacgaaaaaatagacacaatcttacggactacggtggaaagtgcgcactacaaagagaaatgtaggagtgtcagcctgttgctgagctaacgttcgcgttggcgtctgccacccagtggggatgcggtgttgacgctgccctgctttcagcgcgacttgatatgtagctaaatgtattgccgagagtcctgcaggatcaaactctcaactttttagatagaagcgcagaaggagcttcttggcattagatagcatatccgcattctcgggcggaacaccgctgagccgtccgtgtgagagggtgtgtcgcaaacaaactcgctagaacagtatctcgcggtacgccacctttgggggcccggttcaacagacatctgactcactggccgctgcgcctatgttgatttaattgaggggtaacttgataaggttaataatagtgcacccattttcttgggaaataggggggtattatgagttccctgcctctgcggtcggctctgcgtccctcgccagtacaaataatgtgcttcggatgtttccaatgccgcctcctggagctgcctaccacgcgcgtcgcctcatgcgtatcgacggccgtaaagatgcttacgccaaccactgcgtataattttcccccagctgatcgactactagcagttaaacaagaggcgaacgcgaatatcgtctaataaagggcaggagacatcaacatctaggccggccgtggcgattaccacagcttcatcgcaggtcgtgtggtacaaaggaaaaacgagagctggaagtgacttcacaatagtggaatgcttcaccgtgacaactgccggtgctgcggatttcccccgctatgaaactacaccactgtcaactagggaacaaacagtccagatggacctctaggcattcgtagccatatcataaggtatcgtgtcgggtatgaaatgccgccacacgtgcagtagatttctgaagcaaatagagacgtcgctttctaaccatgtgtggcctgtacatactgcttccaaaatactatgaaagcaagtttaagaagtgcagttttgagggctcttcttccgggaggtaccggtttgccaggccgcaggctcgcagcaaggcgttccgtggccgaaggcagcaattggtaggtagcggcgcacatgttacctccacagtcaccagcgacagtttttcacgtgcatgctgatgagagactgtatacgagtacagtacgtccacagttacaactctatgaaagagcgtctgtgcacagtattctgcagcacccgcgtttcccgaagcttctcttagcagttgagcggggagaactggtgtttgggtgagaacagcggaagccggatttgtttcttgggtatcacaatactggtaaaataatacgtgtaatgcgttgcctacgacagtcaggttatttctatttccatcccttcacgcaaaataccagaacagtaagccttgacctgctgcatactctagtgctagcaacacaactactatcgaaatcgctactgtcgtgccatactagtgttgttctgatttgtacccgcacgccaatgcaggaaggctgtcgcggcgcgcacgaactcagtgagagcctggagttttctacagaaaaaataaacctcgaagcatcccttccctcaaaacaatagcgtgcagcattacgaaaacatcggcaacttcgcacgtgtagaagcccgctttattgacagtcagaagcgtttcgttctccataagttttgcttgggcatgggcagcgtcaaggtagcctaagcgttttttaaccgccagccaccacgtcacacatgtgttcagcgaagacagtgacgagcgcttcccatcacatgtcagtgaccgtgttttttcagcagacgttcctcctcgacaaagtacaaggggacgtttgacttgaaagtttgaggctgttatcaggagaaactgttccagcttggcataacctttttcccaacaatgcttgcaacaagttcggtcaaaccaggacgccgcggtctctcgcgggctattgcacaagtgactcccgtgaacgactaaggggagcctattcctcaacggtcagactgattctcagaacgggcgttttctgaagtgtagatgccatccttattggccgtccacccccgacgccatcttgtcttgccgttcagctatcggaaacgtcgaggtgttcggactgttcggtgtcggcactttttcgtcaatacagagacttgtaatatattgtctgactgggcccccgtcaacttttcttactcctgtgtcagagtgtttgtcgaccaatactgttcgacactggaaagcacctagttaaaagtatcgagtttcctgttggcgtatcttcacgttacgttgagcaccaaatctcgattgctattttgccgccaaatggtggatatcttctattgagttgtgccaccaccttcgttggtgcaggtctctggaacgcgcctcagttgttctctagccgttttccagctgcgccgcgatgcgactttctttcctttggctgtgcgtgagtgtgtcgccttgtctctcaagtggcgcgggacggccactcttggcattgggggccgaaggagattctaccgagtctgactacttccgcacgttgatgattatcttccatgatgactgcgatgcagaggaagtcaaacatagggcccttcagagaagcttgcaagtccagctctcacgtttgtcacactccacggatatcagcggacaggcaagagccggcgacttcgagtaagcaagattgcctgttgagtgcttaccccccgaaacgtgtacgtaaaaccacccgaatagaaataggcagtcgtggtgcgcagaattatcaaccttgcaccatgcccctactttctttggttagatggtgaaagccgttaaatgcacggtatgcttttccactgtagcgacatgcacctcgagttggaatactggtctgaatctgggtagtcgttttttccgcatgcagatgctggacctagaaaagacactttacagtgcttttctgcttacactggatacggacttgtcctgtctcacgagttctgagacccgttcacgtacctctttaacgataggacagactagacatgtgcattcatcgtggctccatccttcaaatcaccaacggacgcagtaaaaaggctgaaatttcttttccaagaaggattgaaatccaacgccatggcgtgttctgatgtgtctgtggcgtcatttcagcgaagaga

SEQ ID NO: 3054 - DNA, 2649 bp, Toxoplasma gondii
gaaaaattacctgtggatgtaaagcagcggttcttgagagctgcagtattggaggggcaggaagatgggggcagtgggggtgcgggagacttctcgcaaagaaagaaaacatagaggtggagggaaatttgaattcatcggagaaaagaggtgcgtctgcggtctctgttacgagtgcaagggcgtcgagagtggctgtacaaaggcaacagagacagttgaaatgcgacaggtaaactgaactttttctccaggcttcgctgggaaatgaaaggggaagaggaatcttcgtggccgcttacattctcagaaagaacagcaatattttctttccactcttgcagccagtgcgtcgattcgtctcaggttaggtttggatgcagttttctgctggcatttgtaatttgagacatgctccgccgttgctgcatttgaatacccatcttcttcagaagcacaagagtctacaactgtctttgcccactttcttctcagtcctattcccctttctagcctgttctgtcgcagcgtctctcctctccttttctttgcttccgctctgcgctgttgcctgctctctgtttttggccgttctcggggccgctgctctgtcttcgcgggtctgtttcttgtttgtcaacctctgtgaacgttgctcgtttttttcgactcggaaacgctgttgtcgtctttttaaccagactagcgtctaccttggggaccttggtgcagacggaatgacaggaaacagtgttgaaactccagttcgcgacagccgccagctcaaccgcaccgcaggcggctgccttcccagaaaggagcgtcgccttgcggcaaaccgattcgagtgtgggctgtaaaaaaatgcaagtgccttttttctgagagtccctcgaacgtgacgagccttcttgtgcacgttcttgtttggaatcctccacaacgagtagaagcatgtctcactggcttccgcaatcgcgtaatacgtctttgatgagaccaccaggtgcactgtggcttgccagtgaagaagttgaataggttgaaggcggactgaactatggcttgcgaaggaaggaaataatctcacgtatcgagaaaaagcgagatgttcactttcagtggcggatcaaaaggccttgcaatacatttccgttgatttaggtcaaaacgtttaccctgcttcagcccagaaatcgtagacacactcggtcattttcgtagagtcgacagctacaaacgtcaaagcagacgctgaagaaggtcctttaccaaattagctactcttaccgcacgctcacctcttctgggactgccattcaagtctgtttcggtttttccaaggcacacctttgctctcagttcttgtctcattttgtaccagtttcttttgcttctaaagccaattgtatggatcctgtaatatttgtggatacaaagaaagacaaggacagtatcgcactcggatgctcacaaaggagtttcttgctgttctacctagctcgagcaagaaacagctcgacgcgcagtacccgagtcgtgtctctgtcttcgtgtaggtcgaagatcgcggtgaaacctctacaagaactacattctttgccaccccagtgacgaagatgacaacaggagcaactcgtctctgctgccggctttcggaaaaggcttggaaaagtcctctggtgtgcccccgggggggtcgatccgacgctcgacttgccactgtgcgtcttccatccgacggagggtggaaaacacaaggagatggcgtcttttcgttttttttaaccacagaaagcagtcccctcgggattcgcgaatggggggcggcagtcccaacgccgaaccgttttagcaaaccttcgtggtgtgccttttcttcaggtggaagagggtgggtgtgtacaacagttgagttgcaaagcccatctctcgaggacggtggtcagaactgctgttttttcggcggcgaaacagtttcttttgatcacgaattcccggagcatttctccgtcgacggctcaagaggtcaagaattctcagtctgtgccactttttctttggacactggctcagctcaccgcctttttcagaaaaagggcgttgtcccccccctccccccaaattctgttgatgcaccgcgatatccgacagcgtgtctccaaggagagttttgagctttttgcgcccattgacctgcgaaacacagttgtcagttggctctgtggaaagtgtcgcttttccccaccaaaagtctgtgttttgccgcgacgcgtttcgcgaacaaataccttttcctgcacagggagttgccgccgtctcgtccagacaacatcgtccctccccccttcgcacgacttagacgtgagatttctctttcccaacttctttccgtggcgaggaaacggcgactctgtcgacggcttgtttctctcgtgtttttccatcctttcccgccgtaaaaagcgccttgccctgccgtcgttttgcccccgtgagctgctgtctgcgttctcgtgttttttgccgcctctccacactgctgtgccgatagtcgccgtttctccacctggtttctgcgctctcttctcttcgccatttctgcgtccttgcgcgtttccccgtttcctttccataggctcgacacca

SEQ ID NO: 3055 - DNA, 2184 bp, Toxoplasma gondii
tgtctataatcgactcccgcagtcgctcaggctcatgaaatctgtctgcatttcggatgctggcttttgctgtagtgcctgagacggcagttgcccccctcccgccagacctctgtgtttttcgatcgagacaggagatcggacctgacacgaacggacggctcagcacccattataaataaataaacaaataaacaaatacatacatgcatacatacatacatatatacatatacgtacatgtatgtatttatgtatttatatatatatatatatgtatatatatatatatatatatgtagctgtagctgtcaatttgtgttggaaaataaatgtgtgtatatttgtttgcctatttgtgtctgacctcttcgacagctatttcgcagaagggattgatggagtgcttgagtccttccgtctgcatcgtcgttgcgcctgcctggacgcgaggcttcacggcgtagtcgagagtcctcttgacgcatacgacagcagtgtcgagaacgcctttcatcttgaagagttgaagaacgtcagggttgagtctctgcttcgaggcgccaggttcgcgtactcggggaggcgagaaaaggatcgctagctgggtgttggacgccggcgaacgctccgctgtctcctcctcgcctcaggataaaaaaagtcttgtttccaggaaggcgctcttcgcttcggagctcgtaggtagtcagggagaaaggatgcgcacttcgcgtggaagtcgtgagtcctccgtcgagtccccagcgacggttttcgcatccgtcacaatgatcaactcgtagaaaagtacaagggagcttgcgtgtgcgttgaggaaggacgtttcaatgacacccaagagaagcagaagagcaacgaagagagaagaagcgaaagaaaaaagaagagagagggatgcgcaacttcctgcgcctcaaccgcactcaaaagacgacaacctggttctgcgtgtcttgttctctctctcctctctcttctctcactgcctttggggtcgtctgcctctcatcgctcgacgaaaacagcatcgttttcctcgctggttttgaaagacttacacttcgcggtctttcacccgttgctcgtccattcttgtcgactttccctggcgctcaattgcgacagcctcttcgcgccttcacggtgtgcaaaaaagcggcctctctcgcttcgatccccgacctcgctgtgtgctctacgcgcgttttttctcggaactggcgtgaggccgcgccgcctttcttgtcttcttttttgtcgcgccttttcctcgttttctccctctccacgttcgttttcctctttcttcctcgtcgtaaagccaaacgccaaggaacgcctcccgcgaagtttttccccggcgacagtgtctgggcaacgcgaccggccgccgcgagtgtggaggctcggcgtgagtggtgaaaaagacaaaaacggaaaaagaaaaaaagtttttcgttggcggcttctttctgcaccgacccttctgccagtggaacggcggagagaaaagaggagaaacgcacgacggagaggcgacagaaaaaaaggggaaaccgacgccgagagaagaacagcagaagaatttctggaaccggtttcaagatgaacagtgtgtgaggagagactaggtccacaatcgaacagagagaggaggaaaaacgacgagaaaacgggagacgaccttaggcgtgtctctcctctctccggcaagacccagagaaaaacagctgaagtcgtcgtcgtttttcttctcttcttattttctcttcttctcctctcgttccctcttcttttctcctttcttcgtgtacttctcttctcttctccccgcctcgtttcttctctcctcgcctctttttcctcgcgtctccttctccatcttttttttcgtatctcgcagaacagcgagagacgaggctgtctcgcttgtccgcctttcttggttgccctctgccgcgtcttcccctcttcctgccctgcttgtttctgcgccgtcaccgagcgccaggtctcttcgttcaacgaagaagttttttctcgtcgccctgtgcgtattgacaattcgccgcggcaactctcttagggaagaaacaggcctagagagagacgcagatgcacagaacgaaggcaggaggggaagagaacatcaaacgaaga

SEQ ID NO: 3056 - DNA, 3721 bp, Toxoplasma gondii
tcttggcaacatcttcctttctcaaagcaggcagctggagaggaacgcgcgaaggtgtctgcgggggctttgccgttccgcgacgcaggccggcgacgtgcagtcgtttgcgcgagaggaaggccacgggatttacatcctcttgctctggagtgtatttggcagagcgtggttcccgtccaggacaagacaaagacggctcttcagtcgctcttttgatcgcaggagcagagactgaaaaagacgtgctcatctcgcggatggccgcgaccagctgctgaaggagacgttgctgcgggagggttttcaggccgagagtttccgagtacttcgaggtcggcaggtcgagaagacttttgcctgacagcttgtgaaaaaaacaaaagacgaacagaaacaggaaagaagggtatggggaaggtaagggacgaaacggacacagtggacgagaaacacatcagcagaggacactgcagtgagcggtgcacgagcaactacgtaattgacaaggggaccgatgtgagggcctccacacaagcagcgcacaagatgaaaatcaggggaaagcactttcaaaaaggggtgtcctggatgtaataatgggagtgaaggtgaaggaagcctttgctgtgttgacccgagaacagcaaatggcaatcgatgattctgtgagtcccttttctgctcgcccctgaaacaaaaactggaaatgtgttacgacaagccgttcttgctttacacaagactttgataactgttttacatcttgaaggtctttgtttcacgagtcccaatggtgcgagacagaaacgggtgaacgtcggcataccgactgttcagatgttcactagtggagacacagaaagaagttgctgtttcctcaaagaatgtatcagcggttgcgttacacaaatacagaaaagtgaaagctggtctcttccacggtctccctcgtacctcttgaagcttgacttcgcgaactgcaggcgccagagtctcacctccaaccttcaagaatttcgccaccgcagcatattccagctcaccaaaacctgaaacaaaccagcacgcatgtatggagagtcgacgcggacgtttccagtgctttgaaatctccagatatcgactgaacaaaaagcagctgatctcacgctataggtggtctcgtagggcaagtaactatgcgttttttcttgtatgcgcgagtgggacctctctttttgtttcgcattctgcaggtgtgcgttccctcatgatgaacccgacactcgctgttcacaggatgcgacggaggtgtaatttcagaggcccatctaaaaagcgacgaacttggcggaagcggagttgccgacgaacctctgaatcagagcttggacgaccccgctattgagaccggaaacttttcgccgtccctaggttttacctcagcatgacaatgacactttccaagaaagagtagacgcgtagacgcgctgtgcagacaccacatctttccgcgcactgcggattcccgggtagctgacaaaaaatgcgtggaatgtgtagcgaagaagagtgcatgccacacggagaagtgtacaaagtgtcttactggaaagttggtcggcgtcaatgagctgctgctcgatggctttcgccaatgacggagcggacatgctgtcgcgcatggcacgatttgcggcggttctcggagggatgttgcgccgaaggcaacactttcgggtaatgtcaagtaaaatttagctggtgtgctattaagacaagtacgatgattgcaggagaagagagggaaacgagagagttgctgaaagccgagtgaaaaagtcagccgcgaaggttctcagggaaatgcagcgagactgttttcgggagcaactgcgaaggctaagcagaagttatcacttgagcgaggatcttcgtcgcgaaagggtacccatgagagtcaacggggaaaaaatcaagatcgaatttcatcttacaagcaagaggaagaaggaaacatgggtaagctaacctgtgaccaaaactgccagcacacagaagcgatacactgcagagccggaatcctggggaggaatggacgaccacccatccaccacagctacgtgaaagacacactatgtgtgtcatgtgaaaaaagccaacggtaacccttagagaaatttaaaagatttcgccattacgtatgcatgatttgccagaaattgtcctcaactggcaagacatgcagcgggggtcggggggtagtgggactgcgtaggcgagcccctccaacctgattctgtggtttaccttcacgtgatcatcgtttggaggcttgcctaaactgcctcaagtgtacttctttgttcgatcaacaatccctcatcattgagtgtgttggcgagagagtgcaacggacgaatgttggcaaaactaacccgacgaacatgagggaaagatagaccaagaaatggaagaaaccctccactgcactagtcaccgcgagggctcggccaggaccccgtgtgtcaaaagttagattaccttcctttttacttaaatccaaaaatgtgtaatgaatgtgcccgatgcggtgaaggcagaaagccctacgagcttctgcagctgacgtgtgcccgtccccagcttttcttcaaccgagagaaatcttcgcctccctcgcacaccgccagggcatcggcacctgcccgtaggcgctgcatcactgaagcaactcaggaagagtgtagcgtagacgttggctttccatatagtgttgcagggttcctgacgtccttaactcggcggcccaacaggttcttttaagggaaagcgaaacgaaacgttccttggtgcgaatttggcgatttgcgttatctgccactcgcggcagtggcgtatcgttccgttggtgggtacgctcggaagggtacttacaaaactagcaaaataacggtgtctttgttttcctctatcacaaactcggcttggcgtgttttctccatcactcgttgtttcgcacaaatgcgcttttggagaggacgtgtgaatggcaggtccatgcgttggaggaaaacaactttcccgaaactgtgcagaaatgatccgtcaccggagacatccgtctctcggctgcgggccgaatcgctgagcttgagaggcggattgatcaatttcacacccgaatgagagagtctttccggtggtcaagaagggtgcaagagatgcgtagatgagctgttcccaatcccccgttatccgccgcgggacaatcggaattaattcgtggcggctagctggagacgcgcgagcgccatgcgtgggcagaaaggtacgctgaaacaccgagggaagcatcaatcaacggttcgcgcgggcaacggcgcgtgtgcgtgccacctcgagctcgatgccaccgtgggctgacttcagaataaaatcttccccggaaaagtttttcacgtggttatttcaccccgattatttccaggttataactcacttccaggtttaggcgtagggaatctgttgctaccgttgtgtgtaggtttcaagccgtcaccgagggaaatcgaattaaaggtgcacggtacagtgcggtgacatcgacgagccaggctttcgccgttgtgttaccttcgcgcagagattctccaaggaagagtaccagcgctaagacggaacaaaccaatagaaaaggcgttgtagcagcgtcactttgcgaagctgtgtttcagaa

SEQ ID NO: 3057 - DNA, 3237 bp, Toxoplasma gondii
tgtacatacacccggcgctccttccgttctcgcctaaaacgaattccctcggacgcgcttttcccccgttttttttcgtgcgtggtccttcttcccgcgctctctgtgtttctcccctgcacccctgcatgcttctttctcgctctccctttgtccttcgtctttctccgtcggtccatctttttcgccgcacctccgagcttcactctgaggttcttgcgcacgactttgttcaggcgaatctttccttcgtcgaggtcctggtcggccaggacgacgcagacggtgtcatgccgcatctttcccttcagaaggacggtgtctcctcggaagatctgcagctcctccatcttcgctgggttcagcgccacgacgctgttgtcgtcgttgatcgcctcctcgacgatcagccgattcggagaccgcttcttctgactctcctcctttttctccgccggaacggattgcggtctgcgaatgccgccggccatcttgtcttcgcagtcgaaagaagcagcgcgtctacgcaggccgagcgttgaagagcaggtcgcaaaaaagtcactggggagagaggcggcagcggagggggagaggcgggggcgcacagcgaaactctctcggctggtgagtcgtcgccaggtgtgaccagcagtacggagcaaggttagcggatggaagcagagagctccgaggatcccgcgggcgaagaaaagaggaaatcgcggggaacggtgtgaagaaaaaaggagagcgcggctgcaggagacaggggtcgtcgagagggaggcgcgaaaagagcgagaagtccgcagaggcaggacgcgcgaccgaggagaatgcaacggaaatgacgaggcgaacgccgcgtgcagaggagcgacaaggcagaaaaaaggcgagggaaacggaaacggtctctccagtgcaagaaaagaaaaaactggcaacgttttctgcagacaccgggaactgcagttcttgcgcgcacgctgcgccggtgtctcgacaccccaaaaaccgcgagcggagttctcaacgcgtccggcgcctcggcgcttgttcagacatttctcggcaagactgagaaccgcgatttcaacacagaaactctctggagacgcagaagaagcttccgacgcgccaagcctgcagctgcacttttcctgaaaaccgagtcgcggcgtccacggacaacaaacgcgcggtctctggggggtggtgttgcagtgtgcgcgagcgccgagcaagcgccgagcaagcgcgccggcgcctcttctcttccctcgtggacagccgcgctgcagatgtccggcttcggtggcaagtccttcttggctccagacgaaaaacgccagccctccagcgatctttcagttgcacttcagcctcatttcagttgcactccaggcgaggaggcatggcgaagagacggacttctctccgtctcggtgctctcggtgagagaggcaagaaggaagaggagaaggaggaggaggatttaggcgcgaaagagccaggaaggactcgcctgcctctgcgcgaggatacgccacacagacgacggaggaaacagaagatagacatttgcacagacacagagaaagagcgaactggaaggaagaaaaggcgcgccccagggacgcggcaatccggacaggagaaaacaggaagtaaacaacgaggagacgcgagagagagacaacctcggagaaccgcctcggcgctcagagggaacagacagaagattcgactgtacaagaacgcttgagaaagggacgaagtttagacaaaggagggaagcacgacgcgcagctggtttacgacagaggacacagaaaacgcgagagattacacacaaacggcagacgacctttgtcgcagccatgctcgtcttcgatgttgtccgcttgcttatatatgtgaatccttcgaggggagatgaagtagagagggaagagatctacagagccgttagtggttcaagacggtgaccttgtcgtttcaacaagcatatggacgacaatacaagcactgtactcccccgtagagttggaactgggacgaggcgtctcagctgccgaagtttctcctgtattacctgacagcaattcgcggtgtgtgtgtgtgtgtacagccggtacagttgtcgttcgaggaagttcgctgcatcgctgacatcagacgtttctcgttcgctgctctgtacgaaatgcgatgcatgttctgtcactacgggggtgtatttatagattcggaatggagaatgcggcatcatgtgagagagggggaactgtcttgtgtgtctccttctttccttcctgtgttctcgccgtcctgcatccttcatcgtcttttctccttctctctcttccagaatatcccttctctcctccgttattcgcctttgctcttgctcgttcctcctcaccttcttctctctttacctcttgtttcattcctccctctttcttccttctcacacgcgtatcgctttcttcctcgtctcattttcgctctgtctgccttttcgcgttctccttcctctcttctccacttggcagtctctctttctttctctctgtctttctctttcgttcttctttctttcgttccttcgcccgccgacctcttctttctgcgttgcagtatgctgcgtctttctcgcctccgtttgtccgttccaggacctgcgcgtctctcctcctcaggcagtgaaacgcgcctttctcgagtctcctgcttgcagtcttggcgggacttggggagacgacgtctggccacagaagccgcgaacgcttcttcgaatgccgagttgtctcgccttgtgcctctcgggcgcgcgttttttctccttcgctcgcttccgtggaaggaggcagtgacgctggaagcctccgcagagtccttcctttccacgcgacggctcttgctcctcgcgctaagaatccctcgcccagagaaggaggaaaaaaggacgcagagcgcgtacccctcggcgtcttccaggagaagaggagacagggaggggagggaaacacagagagagacgcgacacaaggacagaagagaagacagagaagagaaatagcaaaaaaagagaagaaagagagagaagaggaagaaagggggagggaagagaagcgaggaagatactcacgccgtacgtagctgagagacccgccacctgtcgtgttgaatttgatagagtgaaatgagaatagaaacttcgaagaa

SEQ ID NO: 3058 - DNA, 3929 bp, Toxoplasma gondii
agcgacgaggacgaagacagttactaagatcatttgcctagttgcttcgagacactcggccttctccccccctgatccgggaagtaaatgacaacgctggtcatcacgcgagtcaagcgcatccgatttagaggctacattcaaatttggaattctgtgaacgagcagtcgaacaccttggtctcctgaaacctgagttggctgacgatcgtccgcaggattcgtggcacctccggaggggtgtccatgttccccatggatctcgtgagaaaccgagttagctagtgcttccggggtatttgacggttctgccatagcgagtcgtcatacctattcgtcaaacggcatccgtcagtcggcctcccaacctgtttccgacagaatgttcgtaccgttcttcgtcataattcgcgagcggaaacagcgaaagcagaagtggtgtcacaagggacgacacgcctgtaattcacttttttgggccccaacggagatacgttagactgctgaaagaggcgaggggcacttgggactccttggaacggagaatcgacaaacgtgagtggcgtgccgtgacagtgagcgtggctgtcgatgaagaaaggagtcaaggtagctacactcttactgcatgggcgcccaacggaggttcagcacgggaagggaggaaatgccggaggagcggacagaggagcaaaatcaccaggccgcaacccgaagcaatactagtcgtcctgagggtgattaataagcaaattaccggtccccacctcttgcaagtgtatttttcccaagaaacataaagctgtcggagacagagagtactggtaccgtctgctttccatcctgcaccacaactatgcctgggtgctggtagaggggttcttccgcagctgcttgtgcgaggagagctagtcactgaagcagctgactgaagacagtgctcagctaataacatgaaacaaacagagaaaatggtggtggccggcacttgacgtcaagagtcctgcggtggaacggctctcagccgaggcatgtgtctgttattcttcataaggacatctcaggacaaagccgatcgtcgacattatgtaaggtgctgttttcagcagacatgtgcatggacgtagtgacatctgtcggtatacattcttgtgtgcaaggaccacggcaaccagtccacagaaaaatgattcgacctcctgtagaatgccagctggagctcgttggtggcattagaaaagaagacacaacccgactttggggaacagtggcattggatccggacgtggctcattttccatggcctcaacactaccgcgagcaaacatgcccagcttcgctcttttcacaacgccataagattcatccttatttatttaaccaaagcgaaaatcacgggacacttccgtcggatcactcctcatttgggggcctgaactgctgcggtcggccaagtgacggtgctagccagagccaccagggaccgctggtctgcaccctacaaggtgtcttgtaatctgactaggggtcgctcccatcgcgaagtgtaactttgctggggctgggaggagaacgttcgacgtggctgtctggtgcgtacagctgaacatgtgttacgcgtttttgatcgagaaaacatacacccccgaatgcacaggatcatttgtgcggaggcagtctaacttcttgtccgtgagacccgaaaccaacgccgatatcggggaaactgcccaagagaaaattgtcgcacgtccgaatagcatgctacaccggttgttcccctccagcgtcgctgtcactgctcggaagaagtgtttgcggtaggcggagaccggggtactttctgaagtacatgtgcccatttcagttcgctgaaggcaagggacacagatacatgagccttatgattaggatacgatgcataaatagacattactatttcgtagaactcacgaagaaacgagggctacagaaccgcgctacgtaccttgcggaacgacgtttgcagtgtatcttcctgtgcagtcaaacgcattaaaaataatcataacaaaagattactagcaactgcacttagattaacgtgtttgagtacgcgtcttgttaaggttcagttcgccagcgaatgagaacaaggttctgttgggtcaagaagctcagctgctgcggctactttactctgccaattcgcgtatgtgtgtgcgaccgcaagtcgtcgtggttcacgctgtacagtcaatttgaataaatcaaactcttgagaaagaactgcgtgttttttaacgtgtgcctaagctaccacagtcaattttgcccccttgactctctagtgctctggcttggaaatcgaaactaacaagcagctcaaccttatgttgctctactcagtcaataccaactgatctagcctcgtgatgcctatttgagtatacagcgtgatcttgactattttaggttgtgttaatccacaagcaacataaaccttacatggtaactcgctatcttatatgttactactggaccggttctgtacttatactcaaccaccactgttaatggcttcagcttccacccaccgagtgaaatccaacacttcctgcaatcataggcagtccattgaggtgttgttgtacagcagtatttctctctgtctcctaagtggagtcatattcggtatcctaggtacacaatcatcttacccatgtgtgtattaggatttaatgttatgcaaggacggatccgagtaccgtgattctctttattgtatacatgttgttcagttagttgtagtcataaaccggttgccaacttacctgtgttctgctaacacaaaaaagcttgaattccatatacaagacgctttgaactccaagctaaaccactagtgtagcccttggcacatgcttcccatagacagcttacaaataatgcaacttggagacgtggtggcgttccacgatggagctagatgctaagagccattaagacgaaaatgtgctcgtggcaattttccaacagaagtacgatgggctttcgagattgatcttggattgttagctggacaattcggggttgtgttcgctcctgcaattggagaagacatgcaggacgacgacacactgatacacagagcctgtcaatgtggcgggcagctcggcgccatttttcaggtttccagggactcgcctcgtcagacgaacatgagaaatcatcccgatccttctagaaagtggtctgagggggacataacgaaccttttagagggtgcctggcgactcgcgccgtgcctcgaaaagtatcatcgacaagctggctgcgcatgcgcggtattcgctgcaaaaatgcgcgcacagggcattctgtggtcatctcgagtacactacggtgttttctcatccgactccttgcgaacaaatacgggcaactctctttttctcgagggttctgccactgatgaccacagcagcgggtcttcatggtcctcctcgacggacagatcgagtgaccgctcattggggaaggcagctgctgatggagtccccatcatcgtcgattcgcctatagtttgtgttctaacatcctcccgactcacgtttcgtgtcgttcgaacatccttgtcgttgcgtgcgtcatacgacggcctcttgccgacaaggacttcggtgccaaacccgaggcttctctacgcgcggtcaacgctaagagctgaccaaacctgctgcgtaaggaggggcacaatcgatgtagtttctccggccaacatcagttgtaacgtgtatgacatgttgcgtggtcagttctcccatgtggagacgtctgatcactaacgccgtcggtggacagccaagcggcaactaggctgttgtcaacctgcgacagctgacatgccacacttccgtcccgcatttacgatcagtcagaagtaacga

SEQ ID NO: 3059 - DNA, 2643 bp, Toxoplasma gondii
ccaagaacagccgcgagtgggacattgttgtcacgttcaacgagttgtaagtggaggtaaatgtacacgtaggtgatccaggcaaagaggaaaagccccgtgactatgacaaggggaatcagcgacagccccctgacggcgcggctcgtcgcgtacatcgttttcaccgcaagcagacagacacgctctgcaaaagtgaggtggcaggctcaagctgcagttggtgcccagagaaaccctctggcatggtgcaaaaggcggacgcccgagaggaacgccgcacacagactccccgaaacagagacaagaaaaagaatcaatacggaggaagacgttacagtggggccgacagtacacacgatatgggaggtcgtgaaaaaggatctaaaggggaagcactttacccgcagtgcggcaagaactgaaacagccgcgcgagtcgtgggcacagcacacaccgggaaatgcagaccttcgtattacgttgatcatgaaacgtgcgtcgcaggactctgatccggtaacgaaaggccttcaaagtccgggccagtagtctaagtcgcagaagacactgtctagaacaacgtcataaatgctcctttgattcacgaccaacaaccgaacctccgtttaagcgtccagaaaatccatcgacagtgatatcgcaaaaaaactccagtgacggtttcacctgattcccgttggctcttcgaccgcagagtgctgaacgagccacacgccgacacgcgcggccaagggaaacgactgttagcagaagccttcccggatccaactgttgacgcttactagaaaggtcttttggcaatatggaaacgctgtctatatttctgtggactcttgagcgtctctcgtctgttcacaaaacagggggactcaaaccgcatagccggggggttcgctggaccgccaacagaaggcgaaaatcgttgttcagaaggaaacgagagagcgaaaacgagcgagaaaagcaacgcagatctaaaggtaacaacaaactcctccacacaaattacaaaaactccgtcgcggaagggttttggacttcgacgcgagatgacgagggagctgaacactctcacgagacgtggtgctggtaatggtgcgtcgagaccggagaagcaagcctaattacactggaatgtgtgtgagttcttattcagtggggtacttgggaacgatggacgctggcatcagcaactgataaacctgacacgaactatatttcatgttcccattaacagggtcgcgcgtcgactcagcggcgtgtggttcctaacttcatcacagggaaacggagacctgagacaaaaaacgccgccggaagcgcaccagaaaacccgcagaactggaaacttttcggaagtaccaaaacttgtgatagagacgagtcttgttgagcgaacgctcgatactagcgcctagcgaaaagagaccccaatggcagggccgagtcaagcattccttccattcagcgctttctgtgaaacagtctccagtaaggtcttgaaaatcggttaaaaggacataaatatctgcccctcgtttgcaatttcattctcattcagcaatttagcagatcgccggcatctcggccggccatgtgcctcgcagcttgcacggttcccatggctcagcaagctgacacatctgcgctatgtctctcgtgatttttccccatctgcatttccggtcaattctcaacccttcaaataagtaagtagatggcttccctggaaacactgcaagggcctgtcaacaaaagacaaaagggttcaagggttccgcagagagttccgcaggattcggcaaaagacacgggaaaaaccaagggtgcaaaagctcactatactgaggccggctaatagacgaaactacatggaaatgccaacgcttgcaccaggggaaagagtggcaagcccgtctcgaacatgtttttctcctgtttcgatcagcgatctgtttcaagctataaaaagcacacgtcgctctcagtccttgtgaagggagcgctcctgttcgttccagagaaacgctgcactgcagttcctgtaaacagtgtgtggcgatccgcgaaacggtactgcctgtacattttgaaaactagtgtatctggggttcttggggggaaatcagcctctcataccgttactagagaatctctatgtttaccgtcggtgacggaaatctccgtactagtgaacgtatctactcctgggtcatgccgctactgccacgaaagctggtaaaaccctagtacgaaagatagctatgtattcaaccacaccggtgccttttagagatctcggcttctctgtgcgatacgagagagcgtgccgatgtttcgtgagcgcagaagaacgggaacgtccgccgaagctgcggaaagcgatgcggacctaagtagaacactcagtggggggccggggtggcacgcgtgttggtggcgcgtttgttgcgcatttttgaaaatgctgaagggtgcccgtcaacgcggaggctttttcgtccctctatcgctcattactactctatcatgcattttttgtcacagctcgtgtcctcttcgcggctcctctatcccttgcagacacgtccttctgctctagtgttgacacttccaca

SEQ ID NO: 3060 - DNA, 1995 bp, Toxoplasma gondii
gatgttgcgttcagtctcgtcactgtcttgcaatgcgttcgtcaaagtgtgtgagttcgcgacggctggcaactgtccaactccttgctcggattcatcctcttgcaaaccgagtcggggattcgctgaacctggagttcgcagagacgagatgtggagtttctccccgccctgagtcgaagtttcactgcgtatcttctatcgagagatcctgagaaatctggagacacccggccgttcgcgcgaccgtgcggcagatgaaaagtcccggaagactgccgagcttcgcggcgacagacaccaaggaaaagcatgcagaacggctctcacctaggttgacggacgcccatcgcggatgtttggcgccgcagtctgcacacagtttattgcctgctcgactcaagacctcttgaagcgcttccgtgatcttcttctcatcgcctgagtgctccggattcatgcgccatccctggccggccttccccgagccttcctgaggccccgcagcgggcacccccgcggccgaacgcattggataagcagagagggaaaccgcgaaggtggacgaacgcagagagtgagagagagagaaaaacgttggagacaggaaacgaaacgaagaagagaggaggcagagtaagcgaagacgaagaaggagacaggaagaaggggaagcgacgaagaggagaagcagacgcagaaggagaaggaagtgagggtctgaaagaaacagactgagcagaagggatgggggagcaacgagttgcgggaggccagcagagcctgaaaatcgagaagggatggtctctctcggaagggaagaagcggtctgcggagagcaacgaggagacgcaaagaaagtagagatacgaaagagagggaggagaacgtggaaagagaggcaggtgagtcagccgaaagggcagacacgcgagggcgggataaacctgcggcagcgcagcagaaaacgaacgacggaggagagcgacgcgtggaaagatgccaaaagaactcaaaggggctcggggaaaataagagacggaggggaaaaaactggttaacaaatgtttgacatgagtggacgactccctgaaagtttgaaaaattgaccgccacaccctcccgtacggtgtcttgtagagtgggagcgcggaagtcgaattggggtttcctccaacgaaacaaaagtcaaatcttgcaaagaggaaccttcggcagcgagaaagagccacgggaaatccgagagaacgcactcagctgtttcttccaggattcgcgcggttttatcggagcaggtctgcgacccaggataaatgcagacccagagacgacggctgtagtcggtggtaaaaaagcaaatcggaaggggtctcgctctgtgttttgccttttcttttagacagtgtttgactggacagcgtttgcaggagaggtggtgagagcggcagaaggggcgcgatttcgagagtcacttgccgtgtctctgaggagctcgaactggccgacaacccgggcgcgcctcgacgagatcctcccttgactttttcgagcaggagtgctggagcgcgcgttcacaagaacaatgaaaatctcgcgttcgctattgcttttctgcgaaaagcagcgccgggcgcgtcgttgggtccccctgcgaggccgcggcctcgacacgcgcgagtcacgccaaaaagggagggagactcagacagaagagagagcatttgacacccgcggaaggtcctcgaccaaagaagcgtgaacaactcgacgagaaggcaaggaaacaaacgactcacgaaggagaaacacgcagccagaggctgtctgcgtctgcttacaacgcagccacctcccccgtgctggcggcaaccgaggagtcgcccccttgcgaagacggatgacgaaaaaaactcgagtttttttctcgtcgccgcgctcagtgtccggctgcgcttgagaggagactccttcgaattcgacacaaagactctcaca

SEQ ID NO: 3061 - DNA, 2211 bp, Toxoplasma gondii
agcgaacagaagtagacgtcgaagcatgagtttcacaagttctgaactttcaatatttgtaagcgactgttttttccatctcccgcgacagatgtttcaagcgcttcccctgttgaagacaaaatcataggttcacatcccgcgagtccgaagtcgagttattcactgaattcaaattcaaaagttctacaaaggcactttaaaaggaggcaatatacctaaacggatcaattaaatacgcttcgtcgagaaccagatgacaaatgtcctccgaaacacgcgcctcctgttcgacttcttgacaaatggtctacctgccgagacactgagggacattctctacgtagtcgtttgcggacaaagtttcgtctgcttgtttacttcagaaagagacgttaaataacaaggtctcgagcctaaacagaaacagtcctctggcgtgctgtgtttgccgtgtctccagcgccgccgtagattacggcaaccaatgctttcagctatctcgagaagccgtccagtcgagtggcggtgtgtacacagcagtcctgcagaacaaggtcggcggtgtctcagaactcgttccagatttatcatgttctaggtactcgagtgtgtctgtagaaaactttgaggagtgctagggtggaagcctccggtcagcgagtgcctcgtggactgctcctcacacatgcgtggttagaggaggagcaacggaccgcctttctcctttcaagttctgccccgtcaacatgcatagagatttccctttcgcatccccactctttgaattctttggcattctcatccgcttctctgtcggttcccagaaagcaagaaacgcgtagctgaacaaagaaaccgaggttctggagcaactccagtggaggcacgaaaacctgagtgtggaggagattccgcctctcttgaaggaatgcggtttactggctctagcacaaagcgtccttcgaataaacgaagaatgcgggttgcaaatcagcgggattggagcgctctggaaaaaacaaccgggcggaaggaactcagaaaagagaatgcctccctcgtctaggtgtgaaaggcgtgtgtgcgagatttatcaacgttaaaaaacacatctgtggcttcgccggagcgcctttcctttttctctttgttgaaacaacgcaggactctcaatcgaactcgaacttctgggttttttgacagggaagccgcgaacagttgttgcacgtacgtttgaaatttccgatgcatgcaattcagcagtgtgtttttcccgtcagctcgaagggaagcaggtccgaccagagagcagtattttttctaacttctgcgattattcgtgtccagaagcactcggggttcttcacgtgctttttcatctatgtctcagttttccctgtttcgccccgggcccgcgtgttcccggctcaagctctgaaaatcgctgtgcgactgttgcttgtcatccgcagattcaagagttgtcggactgttcaccgcgttttcctccttcgctttcttccagttcttctcgagtcctcctcccatggttctatcgcctcttcctcttcctttttgccggacttctccacctctccttccctctatatttctctctgggtccacatttgccacacagaggcagcgacctgtttcccttcccagcttatcttgttcacttttctccgtctcgtgaggccagttctgaactcttcttcgcgctgcctctgggacctcctgcctcggctgctctgcagtcgcgtcgagtcgccgctggcagccaccctgacagcttctgttacatcagcagttcacggggctcaacagtcccgcgagttgtagcatcataagtagctcgacgtcgcctctgtgcagtggtccgcgatccggaactgcacaccgtttcttttgttttccacggtctccgctgcctcccccctgcgagagagaagagagaatcttgtctctggccgcacgtagacgagcctcaggcgcagaagaccgctccggctctcgggcggtggtactagatgtcagttgtgatacgcaggaactcagcggagaatctttgttcgggaactgagggtgagtctgacgggatcccaggcagaccgcgcgcgtttgctggaaccgaggaagctacggcttgtcagctcggagtccgagtgttcccttgagcgtctcttcgttccgcagaaacccacaaaa

SEQ ID NO: 3062 - DNA, 1692 bp, Toxoplasma gondii
gccaaaacgcattcatcgttcaaaaatcttgacgcatccatccaaaattcttcatgcatgtggtatacacggcgtccgtggacgttttttaacactgcctaacagtggatttccgccccattatattttcgtcaacgggactttttcaatgccgccacgcgtgggggtgagaatgtgcagcatgcgtttcaagtatgatgtaatgtgtacctttggtcagacgtctagtccgccgtatggcaccctcctcttgagcgatatatgaggctcctcaaatcgttctaacgcagcccctcactcaggtgctgactcatgacgttttgcaagctatgcagggccatccttcattggtcatacctgacccccaaagtgccgccgttcttgcgtcgtctcgtgcttccaagaattgcaacctccgacaaagtgagcaactcacctctcaaggccgccagcagtcgaagaatctgcgctgttgaaaatgggacggtcatcagcctcttctttgatctggcttacgagatgacggggcagcttcaaaagcaggtcctcaagagccatttcgactggcaaggaaagccacaagattgctcctggactgtgctggcggtttcactccaccgagtagcaggggctcaaacctcgcaagtcgtccacaagcgggtcagacattcaaagccgagccaagggagggtcgctcaaacagagctcagtccccgtacactgcatcgagaacagttgtcccccactcacattcagatcacacactttcttcggaatggaactccatcttacagacagagtcttcaaactgtcgccggagccgcagattgccacaaaatcgttgtcaacactggcagtcgctgtgtgacgcaacctggtgcttttgaaagtgataatgagcagcaggatcactcgctgctcatttcagatcccttgcgacaagttacaatgatcacgatagcatccagctggacttggggaaacatccgtggttgggtaggcttcaaaatcacgaggtgtgcaaactgccgcaggtaaaccttccacttggatgggacggagcactccgttgacgaccatccactgtagcgtaattgcgttttctgttctcacaagttccctgcggcatacagcccccgctcatcgaaacgtagtgtggcgaatgcttgtggttatgcgcccagcctaaaattcctggctggcggctactcggcggagtatttagcgcgctgtgacacagtcgacggcagccggcaacaccagctaccctaactcagagaaatgtcaattgcaggtatgtggtccgcagaattcattctcaacaggcttactaaaacagtaaatgcacaaaagaacaacatctaataccccgagaaggcgtcacaagtccatgcatgtgggcaaaagcggggtttgtgcgctgcaagcgacactctgacttcataccgggaaatttgtatccccctctagcacatgagatgcaggaaaccgtcaccaggagacataaggggttgtcggttgtatatacataacataatttgtaataaaaaaaaacgcggtgtgaggagctcctccacctgccctgttcagccggggtgacactctgtgatccctgctctgcgccacagcggacacttttccctgctctgtttccagcctgaggcgttgcgcgtctcatcatcacccgagaga

SEQ ID NO: 3063 - DNA, 2122 bp, Toxoplasma gondii
caacatcacttggcgcctggaaacgcgcgacttctgcaggaactcttcgcagaacagatggaagcgaactgtgtgtgtgctgaacagagagatggtgggcatctcgttttctctgttggttcgagcgagcgttcagagacttgactgcaggtttccaaagtcacgacctttcggctgaaaggagggcgcaatccgcagacaatttcctgccgggagaacgggagtcgattccttcagccatgacatctgtacagctgacaggcaaacgctggattcgaaattttcgccgaagacaagctctgcactgatgcactgcagttcgcaattggagaggagtgtttaaacccaccgcccttgtacacaccactcgttgtgacgtatagaatgatcctctgaatctgttgacggtatgataacataactgtcgtaaaaaactgaggcgaagccttccccaatcgtgactcggagatctcctgtgaggggggaagttcacagaaatcgtgaagacgctccgttacagccgagaaaacggtttgcgagagtcttgtgcctcaaccagttagacatcagaaagtggagagcgagaccgatcaaacctcttgagacaacttacggagtacagcgagaaatcaaaacagttatggtgaacgaaacagagattctttcaagtaaacgtcggataactgaaaagaatccaagctccagatttataacgtctcagctagtcgactcagtaccgtggagacctgttgtcctcagtctcgatcctcggttgaaaaacgagcagctgaaatctcgaagaatcagaaactccaccttcttgctacgcgctgcaaattgcttttctaagtgtctacaggaaagcgtttcgttgctctgcggaggggggagttgcgccgacggagcgagggtatattattccatttgaatttctttcagtctctctcggcgtcggagaatcgcctttaaacaggagctcgtgaacggtcgcttcttgcaactgaaaaaaagataattttcttctaaacttgaacactgcaaaagaagcgccagtggagggaccgcggacttatctatttgtaccgcggaactcgacagctctgttgaacggtgttttaaacgacaagtggaacagtttccagtgaatttaccctacaatcactctgggagcttcatcgagagagagagaattggttcccgaagcgatagatctgtgctctctgaaatgttcaacgaggacgcttcaccgtcacaattgtctcgatctctccttttcgctcgaaaggcaactgggggctcacctcccgccgattttttagcctgtcgacgactcgacgacctttgagtctttgagaaattcgacattttagatcgacgtacaactttctggaaacccagatgttctctagatgcaggttccgacgagaagagtggggtgaagacaagccgactgcatgtctcttcttcctcgtatttctgatctctgcgcttctcagctcgacctgcttttcactccaattcgagaaaaacaacaagcagacagatacacagacatagagaaacacagagagacagagacagagagagagagagtgagagcaaggaaacaagaccgctgtttttcgtgaggtctctctctcggcaagccactgcatgcaatcgcgagacatccgcaccgcttgctcgccggttgagtaagcaatacgtcttttctctcgaacctctgtctgcgtctgtgttttcctttcccagtaccttttctttctttcgaaccttgtcgtccaacgcgttctgtctgctccttctttacaactgcaaaggattgcttttctgcgtcgtgtctcccgtctcggtctcccgctcttcttcgaggcgggtctgttcacctctcatcgactgtgttttctctctctctctctctgcgtttcctctctctcctcgcggctctgatctccctttatttcttgttgatccttcgtctcttctccgtacctccaccgggaactcggagctccgtgaggacgccgctgccgttttctttgttttcttttctctgtctcttggcgtcctttttctgcgccttttcgttccttgccatggccctccacgaccgcatttgaaa

SEQ ID NO: 3064 - DNA, 3214 bp, Toxoplasma gondii
tgccctagttttcgttccgaagctacatggcttccgcgctttcctcgctgctcactggtctgctgtccttttttttcttgttgtttgcttgttcttctgctgtgcatcatgcacctgttgtggggcccttggcttgacttactttgtactccccctcggaatcaacgaccttgacgacggcagcaacgcacacattcctcatggaggtgataatacaactacggaaaggaatcagaaccatgacaacagcccgcggtcgcgccacggaagcttgccctgctcgtgcagagcttgtgctcctcttggacagacccagtcgccggatggtatctcgcgacctaacgaagctgtccccctaggcggctgtgaacttgttcctcgccaagttacaaattctgtacaggatggcggcagagagcctcgtttgatggacgcatctaaagacctacctgctaacgatggaaaaaaccacccgtgcagcgaccaagaacaacatcgatttgctcccgccgtaaatcaggaagggactgcacgtgaagcgcgcgtggattttgagttgttgaaacaagaaaggcagatggaccacaaggaaggagagtcttcttccttagttgagaacgaactggatgcgactctccctccctctcttgctggagaagcgaaagcgagaggcctcgaactcagaaaaagaaggccttcagcgagagatgactgagttttggagtattggtacacagcgcttctttgctgtgagcgccacgttgaaaactcgtggcagttgacgatttttgtgcacatctgccgatcctaccagattctaccgctctcctgtgtatacccgtgatggactgaagagtgggccgtcggcaaaggagaacttgcagttgcggccaaccagtagagcgtgaagcatatggtacgactgtatgcgagtggctaccgcgtatttgagcgcccaatggggaaatgcgtataagaatgtggaaagcgaaagttacggggggctactaagttttacggtgttagaatacgcttgagcactgcagcgttcaaattgcattgtattttacgcgttcttcacataagacgcaacaggtagagcagaattccgtattcagatgatgaattcctcggggtggactaatcgctgtgcggatatgtcttcgctcacgacatcttagctctagagataataaggcagcctttccccccttaaaaaacagagaagaggttcaattgatttcgacattatttctcaactatcatgcaaaatatgaaaagagaaggtagtaacttcgggtagcgtctacgaaaaaaaaccgccatccaaagtgtcacagtgcccatgtaggatctgtttgaaacagtttccaatatagtggaaatattgccaggagctcgttcgccgtttgcgatgcactaagagaacccgcaagaagctccaacaaatgttttttaccatcgcctaccaaacctgatacccagatttcggagtggtcctatgcagtggagactactgtactacgctgtaattctacgcgcacatgctttcactggtagatgatcaggtctatttacgatttgacgtttctgggttagaagttttaattgactttgaatgtagcataccaaaaagctagagccccccaggacgccggcacaatgcgttctacgtcaaggactcagattgagataacgagcatacaggtgaactttcctactagacaataaaatgatttgcagatatggtcacacagcgttttcttgccagcttcaaaatatcaaccaccttgtgcaagacaaaatcgaattgtaccggtagttttttctgagtcagcccttccgtcggaggtgaaacagaaaataaaactcttatcaaaaagaaaaccagtgcatgaaagttcaagtatcaattagtgtggtcaaatcagaaatgctgcaccacaggactctctgtatcctgagagattctgttgttcatcaaagggccgaaacgatcttagtcggccgtcacctacgttttgggtcgtgactagtgaggaagcaatgtatctgaagcacgcgagacagcgcatgcagcgtaatagtcttcatgagctaccagctacgcaaatttctttccaggacgtgcctgacagataattttctcccctgcttcgaagtaggtatgctattgtgcgtaaccgtgacagttgacactggatcctgttgtgtgtgtgtgtgtgtgtgcttctcaagacaacgctttactctctagatccgccacggtgtgttacggatcgaaacctcccattcagatattactggaaatacctcgcgatttgtttttgtgctggtagaaggtttggtagtatgacgttcgtccagctgcgacagcttcagcattctttacagagacgcctcacataggcacgcgcgtgatttctctcgtcgatgagatatacaacgtcgctggaaggatacctctgctcattgcttcctctgggtgacagtcgaaacgcattatggattcgcttgcccattcttcaccagcggtgtgtgctctcggcatctcgagcttgttcacaccgcacaccgagtcacatcattacaatctgttgggccgtctgcgtgtcaacaacagacagcttgacatgggcgagagctctgtattggacgcgtctccgcgtggctaccgggtccggcaggtgagccgtaaaaagagacgcaggcttcttagcgctgtggtacttccgttttagcgcaaaaggctgaagctttcctgtcgttctgcttcgcagaatttttacgtaggttaaaaatgagtgtatatggttgtctcgtggtttgctagtagtcctgtcgcccttgtgccgaacgtcttggtggtggctgcggcttgacgagggcgttccgtgaagcgttcctgtccactggaaaacagtacgttttgcgttgcttaatagctaatagttgcgaaggattttgtggatcatcgttcgtatgctcgcgctgctggtgttgacgcccatgtcaacgtgaactagagttggccgggggtatccgttagttacttactctttccgtgcataggtggtttgtgtgttcgtcttttctcatttgagtatcgtaactattttacatcatcgagacaagcggaaccatgccgtgtggtcacacaagccgtgtagggactaccaagggtttgcactagttcacgttaagttttcaacca

SEQ ID NO: 3065 - DNA, 1642 bp, Toxoplasma gondii
aaacataagagttctacaaacttacggcagactcagcctgctggagatatttgccgcatctagcgattccccggcgtctttccgcgcctgctgcccacgaaaatagacagtaaataagaaaacatgcaccgctcgtgatgaagtgaaacaccatctttcgcaagaacgccacaacagtctttcaccgtgtaattctggagaagctcccatgtagttgttccttctctcggtacaaatctcgaacttcaatgggaattctagtgcggtggaaccagaaaggtgtaatcaagtgctgcaggtgttacgtcacgcttttgccagaacttcagcttatcgacatatcgtcatttacatacttctgtcctcggttcgaagcgttgcacagccggacttgaggagcgcgtatgagttgaggaactcttgctcgtagtccagaagcctgtgatccatcgtgtataacctgaaacattaaacaaacttgcagcctagtgaaaccgcacattcgccgttcccagctgtagctgaagttcttgccagaaacggtaagtcgagagttgcccgcaacgcgagtgtggcgaatcgcggaaggtgatgttgctcttgagctttccctgcaacaaactacctatctttaccatccctgttagtattgaaatatatccacattggcgtctttgtggctagcgaatacgctgcacgcgtcctccagtttcccccttccatcgaaacacttttgcagagagacactgtaatgagaaaacttcttcaagtgcttagcatgcgaaacatgatgggtaagcgcgttccatactctacagacgaaaccgacaggctatgcgccagtcatgattcttgtcgttgcgacttgggggtatctgttacggatgcgcagaaacgtgtgtatgcaactggcacacggcaaaatttcgctgtgttcaccgcggccacaggcgtacacctccccgagaccaggcggaaccgaaagaataccaacaacgaatttaactcggtcccgacattggggaaacacgggagtgtataccagtcaccggttattcgcgtaagccgtaacttgcgaatgacgacggaggaactcgtcgtccatggcttgtttgaaaattcgtcaaagcaatagctagcatgcaagcgggaaagggtgtgccgcaacaggagcaaggtggtacctgcatcaagacacattcgagaaaactgcatgcagccacgctgaggcgatcgggcttcgagacttccaaatgtcgctggctttcagcagtttccttatacaaaatggcgtagtgtccgacaaccaaatcagtgctcgtcccttttttcccactgaccgttaggccgggcgtgtagcgaagtcgttattatggttccccgtgcaccagatgatcctttgtaaaaatgcaactctggtatggtatctgtgcctctttgtgaacccaccagccattatgctttgtccatgagctttctgtcttttgtgcttccgtctgtgggtacgagtgcgtgtgcttcactacgcgactgctcgatgaagcttgctgctagagttcatggcaaacacaggaacgccggtagtctgcatgcttgaaccgtttctttttttcaaaatgaggacgccgcatcagtgaaagaa

SEQ ID NO: 3066 - DNA, 1585 bp, Toxoplasma gondii
ggcaagaccgtcgttcaacgtgcatgcgtatatgcgattgtaagaggaacggatctggagtctgtaaagacttatatggtgacgttatacgtgtaaagctttcagttacgtgtacatcttgtttagggtgggttatcaggatataaagcagacagcagttggtgggaaagtagtgtcgtcaaacgtcgtcccgttgcgaggaggaagttcttgtttcagggcttccaccgtagtcagcggtatctgagagatcgaacagcttgaagcaggttatgatttatggatgccactgacaagaggagctctgatgaaaaacagccgccgctctccagcgcacacccacttgtctgcattggacgcgttatgcacgggccagtgggggaccatcatgcagtgtctgctccaattgatagacagctagaacaattacactctcgatttttcagtgccaagaacaggtgtcaggactatggaaaccgtccaaggttccacagaggcctaagaggacgagatatgctttgttaataaatgcctgccgatgatggaccggataagcaccacttccgctagcatgctttctaggaaccacttcattactcacagattaacactaagcacacttcagcaatatcggaaagtgagccaaagcgcgtagaaagccagcgcccgttctacacagtcattcggaaaagcctgtatttgctcttagcttccagaaagaaacgtcgggagccatttcgccactgccgataatggggccattgtttgaatggagccatcgtttgacaaggaaacaatcttttcacctcagctttcgtcgtgattcgattcgggagcatattctcgcaattggtgttgtggaatttccatactagtggccatgggagtattttgtctcgcttcgtaagtgtattgaacctcggtcactgttggcgcatccgcgttcagttcacagattcttgtcgcactattgatctaaagctctcgcatttggtccacaagagaatcacaaaataggagctccctccctcagcaaaagtgatgtcacatcacgatttcccgtatagattctgcacaaactgccacggtaaaccgtttatagctcctgacctaacaatttgcacgcagcgaatcattcggctggaaaggagatggccatgtcagtaaagctgtgtgtactaaaggtccaacaacaggtgcacttcgatttccttccttcaatttcacaacccgaagccgtggatgacaccattggaaggaacccaagaccctgacatcgcgtgtgtctgtgtgcggcttaacccatgtcaccgtggttccttttttacacgccttgctgtggaagacccggcccttgccggcccgtctgtatccttgaagtgactaactcaaaacagatttttgttgaattccaacacaaaataccacagacttggccgcacgccccggacacggtacgcacgtagtttttccaacttgatgttcatcaagcagttgaccgtagtttgtcaaaataaagtcgcctcccgaaaacgttgactatttcctcgcttacacttgtgtgagtaccacgttcgctttttca

SEQ ID NO: 3067 - DNA, 2183 bp, Toxoplasma gondii
agtgaagaaccagggagtaactccacaagattcaacatgcaacagcgaccgacaagtatagcgccccaagaaacaggaacacagccataggaatagttccgtataagagtggagggaaatacaagccgacacatttgcctcgagaagagacatggcagaaaaaaggacctgtcgaaacgaacacacaccacaggataacacacaacgccgaacagcagacgcgggcttcaggcagaccaccgcagcttagcgacgaagcacatgacacaacaataggtatatgtacatacccgctagtacagagagcggaacacgactttctagctgtttgtcgctttgttgtctttgagaaaacgcaaacgtacctggccgacgttgatctggactgcgccgtgctccttggcagggatgagacgacccgtcgcagagcacttgcgcgggatgtacagatccacgattcttccttcgtcgttctgcattttgtgcagggaagcggaagtgcgctgcacagaaaatgccaggaacaggcgagaagccaacagaacatgcaaggacggaagggcaaccgtgtcagcaacgagttcggcacagcacagggaaacacggattaagcaagacgtcagcacagagaacagggaaagttcgccggcacaaacggaccacaagaaatggggagagatctactgaaacagagagaaaaacggggccccaaaaggggcaaagccttcgcccgcgtgttgctctgacagcaaattacggggctttgaaaagacaagcaggcaaagttgagtccggggaattcagcagaaaaagtctccacagagtcatttcagcgcagaaacgccgaagacatcggagtgtagcataagattcttctgtttcatcctggtccccgcgtcgcgagccacacaaagtccacttcgcacgaactccggtgctgccacaagcgcaaatgcgcactcgataacacccgacacgttcaggtgtacatacacccggattcaagacttgcgaagactaccgtctctctcgcagtagagttttggggcttctctgttgggaccccaagctcccgcggcagtcaaggaagtgggcggcccgcatttcagtgaacggccgacagctaaaacgcgagagacggagaaaaatagacacgaggacattcgagaagacaacccctcgtttacccgagaaaccgtccctctatttccgattcttcacggcacgacgcattgtcctccgcttctgccccgcgcctgtgtgggggacgattttctcgtttcctggccgtctcccccttctcttctcgcgaaagaagactcctagcgggatcggcagatttccgcttaccagcagagagcaggggaaagaagacaggacagcaaaatagacgaagaatggttttcagtgcttcagtctcgccttcgcatttctctccacacgctgtcgcagccgacgagcacctccctcttttcctgcccaggagtcccagcacctgtcgccgcctcgacgaggcgatcggcctgacccaatataagccgacgagctccgcgcatgcatcgagcttccgcccaggtcaccgcaattttcccagttgcttgtctcgcgctggagggtaaaagacagccacgaggaataaggaagcgaggaagggagaacacaccagctggtatgcagcaatcgatgtccagagtgtccagtcctctgcagtgttctggcaggaggctccagcaaaaagcatgcgcctcgcgaaaggtgaaacagccaaagcgctcagatcacgataaatcgaaccgacaaatcgcagtccaaccagctctctctggggtgtctttacactccaattatacaccgctatagataccactgttttcctgtcgtttcgagtcggattgttcgtcccttgtttctcagccgtggaggctcgtctgggtttcttttatcgtcgcgaccaagggatttccatgcttcgagtgtcttacggaggcgcttcacagctgtcggttgttgcccccagttctgctgctagaaaatcatcgacaagaaaaggcacacaggagttagctttcgatttccctccctcgttgctctcttcagttaacaaactgaggttttcgatctctcgtttttcgcgccttgtgtccacttcctctttgggttggtgtctcctcccaagggtccga

SEQ ID NO: 3068 - DNA, 3224 bp, Toxoplasma gondii
ggacagaagcttgtgtcgtcctctgttctggataccgttttcttttcgcgaaatctggcgcagctggacgagtaaggcattcccccttgttgttaccaggttgctgcgtagacgcgctgtggcaggggaacctattggcaccagcagctgtttgtgtgcagcagccagcggaacatttattgactggttttacttgtcattcgttattttcagcgcaagaattgcgaaagtacatcacgaaggagcaagaaccaataccgaactgtttggtgttcaactccgagacgtccactgcagcagtggccagtctgcccccaccaggtgtttccgtgtctgctctgaaaacggcagtctaacttcttttctgaaacgcaactgattcggtgtttaccttacattgtttcacttgtcgggcgaaactgttgaggaaacgacagtacgaaccacgactgcttcgtgcaattctcagtttcaggaccggacaacctctccgtggtactagagcaacacttggcgacaaaaccgaacatttcaagagtcccgcagctgccacgacaagaacggcacaaacggagttcgatcgtgtatttctgcttcagtacttacgctcacgtagaggtgtgttcttccccaactcgggtcgcacccagctctgtctggccgttcatcctgaacggtgtagaaatcccaaactcgtgacgtcatttccttgcctcgtcgctggtggagtcaggatgttccacattcatcaaacgattgaccccgcttttagcaaaccacagggaacccgctatcggacacggtcgtagaaccattgaggtagcactgatgctagactccccgtttgcaacttcagtgggatttcgagggttgcggtttggctgaaagcgtcaaagggacaccaagtagaacgtggctgagtttggtgtcgcgatattcacgagttcgcattcaatagagaccccgagcccctctgcggctgtcgaaaccttcgttagttgttcatctgtctggacgctgaaatcagttgttactgggcgacgggcagacagcgcacactcccgggtcaacaaacactcgggtgctttggcataggcgtagccacgccttatctcttgtggtcctgcacgggcatggcaataattctccggttagtaaactttttcgtggagcgtgtgctgcttggtcgggagtatctgcctactcaaaggttgcggattcacgctcgatggatcttcccacgagcgaacaacagctggaggctatagaagcgaacgcagtcgttcgaatggtttcaaagtaacagatttcacagcgaattaatgggtcaggtgaaacaattgcgagacgagtagcaattgtttcgactcagaagcgtggggcgctactggccagtccattccaactctttgagatgtcgcgtttattacacgagactgtagcctattgaaacacgcacggttctggttctggttttgcagtcgctgctgtgtgaagcaatttgtggttttacggacctgacactagggtacatcctcagcacctgggcaacctcccggaccccacagggccatcgctcgggggctgtgcctactcaatagtaggtgtcccagcactttggaaacgcacacaaattctgcggttttcttcctagttcgaaatatggctaacactgacgcggtttgtccccaggcgtggaatgaggaagaaacacacgcttcaatcggaaacgggaatctggcagacgtaaatcaagacgaaagtgtactgcccctcagtgaaagcagcccctcggaaaacggggtcaccaacggtgatgacgtggggttgtctcctggcgaatgtggtggaaacgcgagggaaggagaaagtgtgccctgtaactctggcgaagagcatcgttcttccgtcctacctgctcggggcatagatcccaaaccggcgaatggtggtgggacagaagaaccctttacttcacaagcatttgaagtttcctgtgacaaccagcagactgtcgatccgcgtgcagggcgagaccctgagttagcgcctcgaccacagttgacggacgttgcagacgctgtctgttcatctcccagacgaggacacaggcaggtgtcagagagtgtctccaaagtctcgccattgggtggcgccttgcatggtaatgaaaatgatgaagaacgcagtctggaacaaaggtttgaggaggctctgccctctttcactcaacctccatcgtcacatttcagcatggaaaacgctgacgattcagcaggaggcggtttttcaaccgtcacagagtcgccggatcttccacacagaccgtacgaagtcgaggaaaatcctgtagatgcctttgaagattactctgagcttctagttgaacaaggttgtaagaaccaacacaggacacgtgtcgtgctatcaaagtctgtccgctcttcgctagtggactcaatgcactggtcccggcacgagcggctccttacgcaattccagaaagagttggaaagcgtcggcctcaacacgttcgaagccactcgacatcgccaagctttccctcgcttcttgaaagcttgggctctgaaatggaagccaggtgatgagcttttccctttctggttattcatgaatgctgcaaaactcccaaccgcaattcgagtgaacgggagagactacagatactcggaaaaactctttcgctttcgagatgatctcctcaaagggtttattcaagcacaagagacaaatcatctagtcatctgcagaacgctccatcactcaacgagtcaaacacctgcgcagccattgccaactcgggctatgcaggcaagtggttgcgacgagagcacgtgacgaaaaactttacacctgattatcccacacaagcccacgctcagaagtgtttacgcatttaaatagactacttgttctatggtgatgcgcagttccaacgaatatctttaatatcttccaccgctgtatcacctctcctctccccacaattgacctcacgttaatgcttttggctcgtttacgcgaaccgccacgtagacagcagaagctgggaagacgagtgtttcgtacaaggaggaagagaatcctgagaaacgtcaaacaaatggcgaaaacgaactacttatgtcaatttctagtcgggaattgaatgacccggcgccagttattgaacgcctttctacatttgattggcccttctgtca

SEQ ID NO: 3069 - DNA, 2819 bp, Toxoplasma gondii
gcatgtctcggagagatgcctgcctgctatccaccatccgtgagcccacggtgtgcgccttaccagggagtaggttttcaggtggaggtgccgatacgtgaagcatgcaggcttgctggtttccgtcattgcgagtgtgcagttccacttcccttctgctctttcttttgtggatccctttctcgtttgacttttcttcccgatagcctcgtttgcccctgagtcctcaaacggcatgcatcgaagcttcgtcgctcctcttctctccctttccttctttgagttagaaaggcggcaacggttgctcgacaggattgtgctgacgtcccaaatgtatcgaaatatattcataactaggcatataggtgacccggtcaccacggacacatccgcagtcgccgagcgtattccacgggcaagtatttatatgtgaatatttaagcctcaccgtttacgcgctgtacgagaggagacctgcctcaccttggcgtatgaatgcttgcattccttaacgatagacgaacagatgttttcagcaagatatccatttgccacgcgactttctaccttttctatcctctgcctccatttgtttcgtccttctaggccgtaagacccgacatttcgatgcatatttacactctgctttcagacacaacaggttgcagcggcgaggaagattggagcttggaaacggatgtgtacagcgtgcctcaatctccaaatcacaatgacactttctaggacacactactttacagaaactctatgctgaacagtcttagccggtccttcgatttgatctcttcccagatgcgctgttctggattaaagaaagtagcactggcgacccgccgtctgcatcttggtgccggcaggagatcgaggagttcttcgaatcagttgtcatcatgcgctctatgcaagatttcctgcttttgcttccgctgcgcagttctcgcacatcgcgttgttgaggcgttcctttgcttgctgtcggccttctggctttacacttcaggaagtacgtcccccccccctcctgaggtgacttgcgttagggcatcgtttcagttgcttgctttgacctgtatgtcctgccgtggttctctgggggcgcctgcacgcgcagcttcttcgacggactgttctgcaccctcaatgttttttggggcatgcattactctctcactggtggcacgctggaggcaatccacgtgatcgctgaccgtgtgcgcttctctccagttagtgagtaccctcaacttctgtttgtctttgcaaagacgacgcaacacattgcttagaggtcttcgaagcgtctccagtcgccgacttctttgtgctttcggcactcacacacactatacgatcggagaacttacacttttgtcagaccctcgaatctactctcctgttcgctttatccgtacacagacactcctcaaggagcgactacctacgtgtgcatccaacaacatttctgagacacccgtcgaccacgtctgcttgtggcggcatttttgatcccgtcatcgaactatacacatatcttcgttttcaactgcttcggaagcacaagacggtggtcatttactcaaagggaggaaaggctagacggggatgaaatgtgcaagctgacgcatctgcactttctgttttttccgccggtgtggcgaccctgacacaaactgaccttgtgaatatgttgtggtccgtcgcctctccttccttccctggcgcagaaagtacggccgccgcatcgcaatcttctgaccatttccgcatatttcagcttcacacgcctgcaatcgcataaatctatgcacttattctctgggatgattacaatttatctggagagctatcttttctaggtcagtaatgcgtagttggagtgttacttgttctcaagagccgtgtctatacgaatgtggcagtgttaacgtttcgtcacgaactccgtacataataatcaccctcttgagctctctcgccaccgcgccatctgtcctgcacagtggaggcatgattctatcttcttgctctctcctacgtcatacacatgcgtttctgtgatacagagtatccggaacactgcgagtgttccacacatgcgttcattcaaaggtgtactgccccgaaggtcttttcgtcgttttgttcctatttgtcctgacatctctcccaccattcccacgttcggaagctgcgtttttcttgttcgtcttttttgaagtcttggattttcattgcagaggtgcttcccttcgtttgtctttgcgctcgctttctgtatccttcttgttaccttccccttgtactcgtcctttccgtcgcttctgcgttgccttggcctctctcggcaggcgcgtagcttggtgccagcgagaagtgaacgagcaggggaaaccgaagggcctcgtttggcttgttctttgcggtttcagggcaacgtaagaaactcgccttcagaaacagtgtttgggtttacccgtatggagctcgcaaaacaatcaagacatcaggactcgacgtggagacgcaggcagctctgggttttgcttcggcgtccttaggttgttgtgtgtaactgtacacaagactgagatctatttgtccatatgaacgacaatggattgggtgcgggtccggtttcgaattcgtttcggtggcagagagcgacacacgggaatgaaacgagtttgtacgcgaacctacaggaggaagtagggcctagatatcctacgtccaccacagtccccgaccatctgaattcgtgggctcagagacacactccatatgatacaggagacata

SEQ ID NO: 3070 - DNA, 2002 bp, Toxoplasma gondii
aaaaacgaatttgtatggtccctcctttgttgacagcttgttactctcacgatgggtttcaggggtatcccttctgtcgatgcttgtggaaacaacgctgagcaacagtgaggtcactgcctatgcatggagccaatgtgtactcaagattatgttttttcaacgaattcagtgccctcgacgccatcggccatgggttctcggtttttggcttggtggatatacagtcaggctagcaagtcataattgagaagatgtggatgttgaagcgcaacaaggcatagttggttttaggctcaccgttggacaaaatacgaatctcaaccccttctgtcgactactcggtcgcggttattctctgttgtccacaaaatatgagacagaatatcgacacgaccgtgccggttcattgaactctacagagctgaagttctttgtctgcagtggtgctgatgtcgccatgtcgctttcagaaagtactttagttagtatcccgtaaatgttctctacttccccaatacatagttacaccttcaaaaagggcaggcgagggtccactgcgcacccggtgtatgtagtacctcagtcactgcttctatggcggcagtaaaggaagaagttgattcctgctttcagtaagcacggcattggtaatgcaattccaaactgaccgtcgctattgcacatccggtaaagtttggttccatcgtaccctgaatggaagggcgacaatatcgataccagctaagacccccactggagtcacacccggtcgaacgtccgtcgtgttttgtgtcgtaaggtggtaagccatagacaaattctaccgtataccaagggagattccgatgccatggtaaacaagagaagcaggaagtctggccctccactgttgtggaggtgatgttcaggcagttagctcacctgaaattctttccgttgacgtcgcctcactcagcaccgttttcgtgtcctgattaccacattttctttttgtaaacgaagcgaccatcgatactgcattttttgtgccccctgcctccgagcatctctactgtagaaagtaaactatacctgctacacgagcttttgttgcaatggttattcaaagatccttagcatccgcttgcccctcttcgtctgtcaagcttaaactgtcgttccgtcagattaccctcgtgaaggcaacgtgatcaaacacggatctacacccctgttgcgaatctcggcagtgggagcgtgtgtgtgtgtgcgtgtgtgaagggtacaccgccaccttgatttactagtgaggcgtttgcacctcgttcgtgacacgtgtggtcgcacctgtttcggggtaagcctgtttagctgccttcgtattgtaaaaagggggttcggagcgaatcacctgatgtttgtctcaaaacctcgtggtacaccgtacttgtttattccttctttcttctccacctccaactgcactcccgttcttctctctacaaccgcgaacgaagtgtgcacgctttgcaaggagctagcttagctgcatcatcactggctgatgatggtgactctccagtcacctggtgcgggaggtactgcccggagcatgcgtccggttccagaaccagcgccggccggtgacaagcgtcgggctgaggcgtacaaataaccagaacttcttgcaacatgctctgcaggggagtgaaactgcggacagggcgtgacgcgatatctgtaccggacgtggtcgatgccggcagagttttgtgcagcgccttccgaaaagggcacagaagacaatctggtggatacaaggagaacgttgtagcgtattccagaaattatactcgtgtgtgtggaacttctgagtaatgaagagacctgaatgtttaacttaaagtcgtgaggagttaaacggcgtcgtgccaaaagttcaggcgtgtcggtggcttttcgtagcaacatacttacgactttctttgcgctgctcggcattcgtacttcacttccacca

SEQ ID NO: 3071 - DNA, 1884 bp, Toxoplasma gondii
tccaaaattcacctacactgagcacaaattcgttgaaccattccggcaatgtcaccggttccttgggtcccgcgcgctcgagcaactgaagtctgtactccagtggaagacgaccccgcggcgattcacactcgccccacgttatcaaaacagtcccgtaattcatattatctctgtccaggagactacattttccggttcctgcgctaaactgacaatcgaagggagaagatactgtagcggcctaacgctaacagtgagagggctgtgtgttggtgtacagttgctcatcgagttgtgagcactgatctgcattctgaatatcaagtcccttgactcaccaacgcttggaatttgtactgtgaaaatcttcaaccttagtcgttagtctgtccttcacagtaaggatatgccaaagcccatatcacccactcacgccatcgactcctgggctgatgtttggcggcacccatcgccagcttcgaaaacccttgatgttcaccagcagcgcttcagatgtatcctcgaacaccgattggccaaaaagaagggctcattaaaaacgaaaaaatcatttatatatgcaaggcgtccacctaccagtgatggcattcgttatggatagcatcatgagcgtagttcacctgatagcccaccggacagtggacttgtgtaaggtcatcgatgacggcaggcaagaaatgaggtgacgaccttgctaaactttttcgtcagctgagcttctagcgacaagaggaaatttttttgaggacgacggtaacctggggacatggggcctgttggtttggacaggttattttcttgggaagtgccggctcattactggacatcgaaaccctcgctccggaggcactggttatgagcatcaataaagttcttacatttctcctctccatttagcagaatgcactcgtcgcgagctgctttggtttctgtgcacacacagcagatccgcttgcccgcagcattgacacgtttgctgcaggacgaggtactgcccggctgctcggcaggtaaggttgttgaagcaggtgtagatgcctgcgagcccatggtggatgtagcgaaaaaacgtcacttgcaaatagtaatcttcggatacagtttgtttatgcaaaaagacagcctgcacgcatcggcgtcaacgtgcaggtatagaatgtcggctgcagttgtccgagatgcgaaggggggagcgttgacacctgtctacagtacaagaccgtatttgtaagggaaagtgacctcatacagaactcgcctcagtattcaaatatttgtgtgtcccttagatacctaggaaactgtattaattgccgcagagatgggttactgatgtttgggacggccggcgagttacgttgcatgctgcatgctgggaaatttctcagcgcagcctgatcagagcgacagagtgtgcatctgaaactgatgttgcctcaccgggttttggagaacgacggccttcgttgcgagcaccgtgaaatatacatatgttctcaactcactgcatcctctcaaggtattcgtaaacaactcgtcggtttgcgatacacagcgacggtttctaagccgcaggcagaatcgacgagacgtcgcttcttaatttgcaaagatacagtcgcctgtgtgtttcacactatgacactcagcgaactgtaatacaaattgttacacatgaccactcggaagaagaaataagttgctgttggaaatgtgaagaacggtggcatggtgtcgtctgttgcttcctgttgccacgattggtgacggtaagcttatcgcgcagcatgaactccaagagataatgacgcttttcgctctcaaagcaaggacatcgtctgatctccgcgtttttcatca

SEQ ID NO: 3072 - DNA, 1977 bp, Toxoplasma gondii
tgtgtctctatgtctgcatgtctccgtgtaaatacattcatgtctgggtgtggtgcgtcgaaatatttgaatgcctggcgagcagccgctgccaaagtacatgcggcatatgtactccttctatgtggatttttcgcaagtgtacgcactgtctatcactccagaaaaggcgaatcgcgtgacggccagtcggggactgcagtccaccgggcgcctgtctctcgtcaactctttgtaaccgaagttttagcgagtcgcttttccgctgtccacttctctggaactcgactcagtcaggaccgcaaaaggtcctgctgcttctctgcctctctgtggggagattgagttctgtctcacagagactgcgacgactcgtcggacctcggcgagcctgtctgctcggtgaagcctcgagtgatgcaaggcagtgaggagctgagcgacctcgcaacggtctgttgctcgtggagcgccgctcctctccctccgagagacgagaacatccgactcgcgagacttccccggccgctttttcgtcgggtgtgtcggaaagagggctaccgcatgctccattcgttttcacctttcgtattcaccccattctccgaagttcgatcgaagacaactggcatccacagagagaggacgaagacaggcgcctccgctttttttcgactggaaaggtgactcggggactctcaactgtgtcgcggcgcggccgctcgtccgttcgtttcctcaaaagctgtggggtgcgcagctcccctgtcggcggagaggcaaaagcttggcagcctcctgctcatgaacttggttcaaagaacgtacaaagacacggcacaagctggcaggcggaaagcgtccggatcgcgctgcggctccttcgtttatctcactcgcaacttgcgcgtttccgcgatcgagtcgaagccctgtgcacttgaacgaccttatgctggagctccggcgatgcggccgcagaaaaacttcaacagagaacggtctgtcgagatggcacacatgctcgagaagaaagagccagcttttgtcttggcagtgaatgtatgggaagcgcgcgcaccgggcgcgctgaaagaggcagaaaaacctgtgcaggagcgctgaaacgaagccactgtaaacgtcgtgatggcgcgcgcgcggcctctagaggacaaagagctccagcaacctgctgctccgagaaccctctgtgaagccgcggaactgacgagtcgctcctcacctctgcaagcgcgattggagagtccacatgcagcagctgcaactgcgtgtgaacagtcgaaccagacgcgcgtgacggccgctggctccgccgagagtctgcaagtttcgcgaaaaaaaggaaccacctcagtgtgcgcgctttggacttgcttcgctgcttttctcgagctccaaaaagaggaaaaaacctgcagtgcgcgaggaaagttgcccctcctgcgccagtgccgcgagccgcgccttttcctgcccgcctatatgctgagagaggcggtcggcgagggaaaaagaacgcgtcttcgagccattcgcttcgactgtcgctcgacgtctttcgcgccaatctccagttcgctcgcttgcgcagttcctcattctccctcgttttttccatccccgcagaaccgcccccgcggcatctcctcacgcggttccgttccctcgtcgcgccttttgagttaaaaggcctctcaaaatcgatcttttccagagttcgaaaagccatcctgtctcggttcttcttccgcgtctgcttgcctgcgctctccccagctcacgcgagctctgcagcacaacgaggcgacgccaaccttctgaggctgcttcctctctgtttctctccgacgctccacggcttcgtcagaacatctctgccgcagtctctcgttagactcgcgaaacatctcagccgtacttcgctctctggcttcgcttctgctcgagtatata

SEQ ID NO: 3073 - DNA, 2047 bp, Toxoplasma gondii
agcggccatggcaaaggtttctccggaaaacgcgttgcgagttccctcgccttctgtgtcggatttctctgtagacaaagagttcgtctcctcacgaagcggcaacttgcacaactgtgttcacgttccccaggttctttgtctcttcccggacttccgcctgataaacgaacatctgcgaattacctttatacgaatatcatcacagttttcgcttccgtagtcccccctgtcggattgccgtcagagcggaattcgtggtttccctcgaaggcttcaccctgcagaggcagtaaaacgcagttccctctcggtcgaaagagggaagaacttctacctgctacacggaaaaggattctaacagtacgcctttgactctgggttttctgccgctttcgcaaaaaagccatcggaagagaaatcctgttttcccgcaggtatctctagggccaccatcacctttgtgcactttcggagcgaaacacaaactctccacaagtccgcattacccgacgaaaatggtgtcaatccagagactcttttataggcaaacatacatttatccatatctatctatatacatatatatacatatatttacatatatatacatatatatatatatatatacatatatatatatatacatatatatatatatacatatatatgtatgtatgacaaaggagataaaagtgggaaaagcgagagtgatgtgtgaaggcattcgatgatgaggtgcatctggagttctttataaaaattaggaaagcgtgcctatgcgaaatttcgactttttttgagattggtcccttcggcgtcccagtgcccttcgcaaacaggacggcggattccttgcgtcttctttccctggagtgtcttcccaacttctctttgaggccagtcgtgttctcttcttcgcttccttctcgtctgtttgatggacttacgcattttatctggctttctacgagcttaaagactgaaagcgcgtctctctcgctctctccccgcgtgtcagcaccctccccccttttctccgcgtttctcgcgttcctgagggaagattcagtctaacatttgctaagagacttgtaagttctcttcctcctgcacaggagccgcgaaaagctctgctgttttcctcccaaagtcccttttccttcttgctccctcacccctcgccgcctctctgcgccgctcgacagcctccagtagtgtcttgacagctcgagagcgtgcttgccagaccggctgtctcacctgttccctcgtcttttctcttcctttttcgtcgcttttctcctcgccttcattcgatggtccagcctcgtcgctgcgtttccatctgcttttccaagcgaaaaaacgcttgtttcttcgagtgaaaaagtaggcttctgcagatgtgagaaaaaagactggggtccgctgcgagcacaattacccattcttctcagttgcacggggacgcccctgctttgagttcgttcgggaagatctcagcgtctgggagacgactccgtttctctcttggatgaattatgggatctgtggatctgagacacgcgcttctccccgatttctccggggcaatgtaaagcctttcccctcgtttcctgacttcgctcttgtcttgacctgcgacagctcgcgcgaacgctcgagctacagcgatcttcaggactagcgttggctgcccttccggtttttctcgtacgcgaataaattaaagttaaatatacgtataaaaataaagatatacatatatgtgtaggtgtatgtggatggagtttcgtttcctctctgagctagccgggcgagaagagctgggatttctcctttcctctgaaaaaaaggaacgcgaaggctcctctcgcgtctccatgcagctctttccttctcccatttttcacccgtctctcctcttcatcaccttcctattccacctgctgtctgtccttatccttcctgtccatctccctccagtccatctcctttcgtcgacttctcttttgaacatccgtttttcgctctgccaatgaaa

SEQ ID NO: 3074 - DNA, 2186 bp, Toxoplasma gondii
gactgcagggtctacatcgcatgtggtgaagacacctgaggtgaagatggcagcaggcgaggaacccaagggcgaaagtcgcgggcagagaggcgggcgcgccgacaaaaagcgctggcaccacagaggccgaggcggtgcgagcggcggtcgacgttgaggtggaaaacggagtttttgtggatgaaacaaacacacgaaagtctccaagaacccttgcccgacgaggaaggagggccagggcgaagggagaaacttgaaaaataatttttgcgtggtggagtgcgaactggacgtgtcgtcgtggtttgcgggggtggacatgtttaccattctcggggtgttgacagcagggaaaacgaaacgtatgttgttttttctacacgagaggggttctgttggcgcggtatttccttcagagggaggcttgtactttcttggcgttcacgtgcgatggtttgcgtctggcgccagtggcctagactcatcttttgccgctattccttgtcatctgaacttccttcgcttaattgttttccactcatacttggcagcgtggagggaacacaggcacgacggacgtcaggcacacggaaatcggctgtggtgtgcggctatagccgcttcgctgaaggtcggaatcgattagcacaactgcgcgcctagcgatcaccgtttactggcaacacgctctgtgtcctcactcgtcgctctagaatggtcgggtagcctacaactttgctaaatctttctcggaatggtaaagattctggacagaggcaaaatatttcagcatgccaactcgtctctcaacacggacatagactgcgggacgaggttaagcatccgttgtgcagagaatcgaaaaatgtacgttttttcttctgtgaaaggagcacagacatgtggtagggtagagggtgtcatcgttgcaaacattcaggaaatagcgtcgtcagtgatgtgtccaaaccagaaatcattcacaggcgttagacaccatgagccgaaagtgagactaaagttctggatgtctctgtgtctcagttgttgttccacgatgactgttgatgtcgacacagcgactaaaagtctttatgcctggaatgaagtatgacacacttaggtagtgtcaaaaagattattggtattcttttgtgaaagagaagaggtacacgttcacgacacgtggttttgggggggccctagtcgttacaccatcaggagtatgctggcatcgatgagcatggtgggtacattcgacaagtatgtagtgtgaacaaattctccgctttgtgaacccgaacgtgggcaggatccaggcggattggcgcctctgtcagaaagcagcgccacgcgctgcgccgaagatcgccaaactatactgtgctgaagtgtttcagtgtaaagcctttggttttcctcatctgccgttaacagtctctggtgttcatcaaattcaaacagtcacacaacggtgtaccgaccatactggcatgtattacaggccctgcctttttgaatgagcaaatttcagcacgatggacggtaaatggctgtgcgcgtctcgtgcatttcaccggacgtggttgttcacaagcacagtgcgatactgctgtagactaacagtactagcatcgtgatcatcagcgaagaccaaactagatgcgattctttggtagatatttattcctggagctttaacggagcatgactaatggaactgaagtcatttttggaacagtgcccagaagggagtttcgagaatgaatatcggagatcatttcctctaacgactcagcccaggccgctgctgagacgagcgtgactcgaggcgggcagcggtaactggctagcggaagatgaaggtgcaaccgcgccaatcggcggtcatcctcattagaatcgccattgtcgtccgaaccttaagtaaccgtgtgcattctcacttatcgcacatttgtacatcgttcggaacccgctgaagaaatttgacctaacactttgtttccaagattttctttcttttgtgtggggtcacgttcatcgaagagtcggtcgcgaaagcgttagcctttagttctcgtgtcgatttggtgtgtgtcctgttctcggctagaacgttgcatttacccgttgccccgtataacagaacccttggcgagaggtttgcctgccttgcaaga

SEQ ID NO: 3075 - DNA, 1771 bp, Toxoplasma gondii
cgttttctgtgcgtttgggttcttcactctctcagggcctccgagaccgggagaagtcgtctccatcccgtctctccattgaattctcggtttgcttccacttcgcctgtcctgctctctgttcccccgctctcaagagcagcgcaggcgggactgaacaaggatttttaaactttccagcggatttctgcagaggtcctgttttctgcgtgcggtggtggagagaggcgccggctgggcgcgctttcttctctcgcgtgactctgccgttttccgtctgtgggcatctctccgttttgaatggactcgaagagcaagagggaggagactcgagcgctcgtctccactttggaatgtcttccctcttcagagaggcgcaactgttgcgtccgagaaacgtccacgttctacctacatatatatatatatatatacagagagacacgtcggtttaaatatgtaaatgtgcatgcacaaatttgcagggaaggggaagaggcggtggtggctaggctttgctgtgcgagagggaaggcttttttaaggacatgcagaagctcgagcgcacgaggggtcgggcgaatgcacggggatgtataaggatcagagcgccagcgaagaagggaggctggctgcgcaaggtaagcggacggcggatcggtgcagaacgagttgtctgcctgttgatggtcaaaggaccgcagttgcgtcctcaaggaagcacagcttctgttgcttttccgtttacgaggctcctcggagttctcttgtttctcgccagacaactgattcctttctgaaggcgtttcattttcacatccctgccgcgcacaggaacgcctgcagctttttgccgcagtcttgcccggcagcaggatgctcgcgtctacacgctcgatccctagttcgttttcacatgcagagacggcataccgaaccgtagagaaaagaggctgacacttgaacgcgacgatctcacctagatcctgcagaggttgcgcactagtgcagatcttgaaagctggcactgcgaacgcgacggaaagtcgccagcgcatttcacctgcacatcggtagatgtttctgacggtggatagtaggtccccacttttcctcacgtggacactggcagttccgaggctcggcacaaacgaagaaaatcgtgttgtggcctggcggcgaacgcgtcggtgcccgatctcgcagcgtcggacctaaaaggaacttgcgacgaacgcgggatgcagaaagtccagcgggtttccggttgctggcgagtctgccgaacgaagtctgtcggaaacagcaacgcagtgaagaattcgccgccgcttactgtctaccggtgtggcctgtagaggacctgtgcggtagcgggacagtggagacatcagacgattctcccattctacggatagatccgcgaccaggcccttcgccgccagccgccgtcgcatgtgtgtttcctagcaagcgctagcgtaaggtgttggtggaatcgaaagaacggtccgtgaaactgcggcactctcgggcgtctcgacggtcagtcgttttccacgtggaatccgcgacatacggcggttagattcaaaacattggcagcgggtcgaaattgacgtgtgtctctcagacaccgcgcggtctttcccgcgtgtgtgaaagtacctaaaaatgccgggtacacacacgcgtgggttttgagtatcgctgaagcaaagagagcaattcttttagacgacggatcccgggtgatagatttttggacgca

SEQ ID NO: 3076 - DNA, 2375 bp, Toxoplasma gondii
gtcgggtggtagagagctctgcagagcgatattgaaatgaaagggggacaattttcgtgacatgaaaagaaaggatgcgcgccagttgctaggtctcttcaatgttgagcactagagaccgctcttgtcaagaggaaacgcgccgagtccgcattcctgtagcagtgtctgttgctgggatgcgcgctaggggaggtcttaccactaaacggaacggctgtgtctgtgcagtgttcttgcgttgggctcttgggcacctgtcggtcgtcgtagtcaagtcatgcttcgcacgaaagccccctcgaaatctcttacttgttcccttcctctcaactacattacgatgctgtggacaactgtgtctcctgtctgtcctttgcatgaatcgtcgcacttgcaattcctacaagcgaaagcatcgttgggagccttcctacagcggaaaaatgtgctgaaaccacgggaccacaaagtcgtggacgtagttttaccacggtatgctgcgtcctcacacgcagaactctacgcagtcagcagtggtgttttggattttgtttacctaaagtccaattatgatttgtattcagatgcgatccagagttctccgccgggacttcacactgcactgcaatacagtctgatcattcctcgcacttcaccacaagtagcacgattcccgtggctctaacggattcgcggggaaagctccgagttcggcaatcactgcacaactcaccactccccgtttgacagttttgcagcatgaatcagttcaatcgcggaacatcgactcagatacccgaaaagccattacgagttttgtccgcgcggcgttaaatagtggagtgctttccccgatatgtctgacgagaattgcaggtgacgttaacttcagtatagcagcatgtacatgtccagcgattgaacataaccatctaaacactccttcaagggtcagcaaaacaagtgtagagatgaggcgcatcactaaatggtgtcaagagcctcgaagggacgacccagtggttgctctgttgtcacggcgctgtgcacaggggcactattcattaccaaaattataaattcaccgataccaaagtggatttgcaactccggcgaaagtacgaattcatcgccaagattgcgtattcatcatcgcggcacatttcccgtgtgaaatacggtggaatccggcccaagctcaagcgataatggaagaggcacattcaaagcaaaggtaccgtggggactgtgtttcaaacacttctaccatccgaggttcctttttattattgtcagtctatgctccgacaactgctgctggtagctccgcacgcctgttacagaacagaacgctggtcgtaccgatctagaactggtctttactcgtcggcatggctcactatttcgattcccgctacactgaagtactcccagtgtttctgtactttcacttgcagcatcatttttttgcgcttgtgggttgccgctggtccacatggcaaaagcaagcgtaaacagtgtgcgcttatctttttctaggtctcgcatagcgacttccagcaatcccgattggccaagaataactcaacgcgtttgtaactgttttctactgttgttcgctgcctcaattgccctttgagtcttcaccgaggtccttgacggacttcggatatcgcgatttcgcactccgaaacatctcccagtttctttgttcattgactggaaagcaactatccgccggtgtggctcttgttcagtgcaagcccccagctacacacatctacgtctaaatgcctgtgtaaaagagcaataaagaagtgaaaggggtcaccgaaagcaaaagcagatgcgtaaactacagagcgagggtgataatgttttacttcatcgaagaataatatcatcgaagaagggtgttaatgacttatctcgtctacactaatcaggagagagcatatgcgcacgcacacgtatctcggcggccatcatccagcagtgatacaagagaacgggggtctttacgtccttgcactccagctctccctcttacacgcaagacggtcgcgttttcctattgggcttttgccgcttcaatgacgtttattgtcatgcgtttcctcaaatttggagagtttcggcgttcggatctctagatttcgagggtgcctgcgcacgcctgcgaagagtcgttctagttcgtctcgaaaaacagtcctggcgtctcgagttgaaacccttcaaatagcgactttttctcgtccgataaactccttgttcgcagttcaagactcgtctcaatttcttccacacccttatcacttttgtcggcatctgcttctgccttttctcgtctttttctgccataggaccta

SEQ ID NO: 3077 - DNA, 4809 bp, Toxoplasma gondii
atatatgctgccaaaggaggcctggaagcagaactcaccggctgaggtcgcgtctcggctggatgtttccaccaacacggaagcttctcggcgtcttagcgaagatcggagacttctggaccttcttgccagacttgccggccaagggcgccgctggcagcttcttcttccctccgctgctacccttggcggcagccgatcccttcttcatggacgcctgaagacgaaggtgcacagagacgtatcacgggtacatacagcgcgatcgccgcctgccacagttcgcatgcccagcgtgacacacacgcttcccgacttgtgtaaccctgcacgtcaccgtgaagctgaggtggacacaagccaaggactccgaagactacacagcccacgaaacagtgtatcatgcaccttccgcaaaacaaatcaggtttcccctcccagtctgcgagagcaccgcaccccgcattgccccacttgaacattttgggcggatgcagccgctacctgttgtaaacacgcacacggataacggtcactctactccctcctcagcagttctgagcacaacaaacatgtcacctaagtggagaaacaatacgatgatccagtgtcaagagagcacagatcccggggaaccggctgcatgtgtcaatgtgacgcatgctcttgaaactgcagagacgtgtgattctttgcgtataacatgcgcggcagttttgcggtaagtgcctaaacaagaaaacggatatcgtgaatccccagtatatctgcaagctccgctttcaccaagatctggccgtgtagccgcagcccacgacttcgggagactgtgccggccagtcgctgagggtctctccacctcgccccccacgccgacaaaaacaacggacatgcaaaatcaccaaacaagctttttaaagcatgttaaacgctcccataaccattggagtaggcccatcaaaacaagtgtttctcccttatcaaaaacggagcgaaacacgtgggggattccagtgttggagacaacatgcgcgaacccggaagccacaactgcagcaaaaaccggcccagaaaagagatatcaaggcaggcattgactgctccactgttgtcttaatttctctgccggcataactgccaatcaaacgggctttctccagcgcaacgacacagttacacagtcagcatgtgaggggaaaaacggcagaatgtggtgcccccggagcgcgtaccattttgatgaagtctctcttcctgcgttccctctctggtttgagtggagaaaaactggcggcctgcgaccgccggaacaagacgcacaagaagggaagggacctccagaaagggaaaggagaacgcgttaaatggggattttatcaacgcggctgaacagcgcagccgcaccagtccgatggtctccctgccgcagtctccccccccacagaacccccgcgttttcggcgcagcccctcagcggaaaatactctgttgcatgtgcagccgtcgagaattatttcgtccgagtagggcttaggcgcaaaggcgtctcgatttactttgcgtcacgattggctgcatgcgcctttcctctgagaattttcgggagcggggaaaccctcaggcgggctatttactgttctcttgaaatgatacagcagcggagagggcgcccctgtgtttaaaaatctcaactagcagggaaaccttataacgaggaaagaccggagatgttgaaagctcctgtctaaaaaactgaacagaaggacaccattctaggaaaaaagaccgaaaatattatatatgcagcgaaacacagacgctttgtgttaggtctctccactagggcagacaaaccaccgaggctcgacatgctggtatatgagctaactagaaacaaccatttagagtgttcggtagacttctgcgtcccatattccacaggagccgcccctcaagacccatttgtagagtagtgctgtctaaattattaactcctgattcgctacactcaacagtatgagagagagagggattagtgaggccagctgtcacccggatagagcatcctagaaggtggcatgtgcgggtgatgaagaaaggcttttctgcgtcacaagcatcgcttttaatccagttgttaccaactgcaaataccagtgggcgtgctatcttgatatcgacgttggtattgcagcgaacggctgaggagcatctgcgtgttcttcgctgtagtgaatacctcacattttccttcctctcagactgggaaaagtgggaacccggtccgatatatactcattgtgtcaaacaggctgttgcgtacaaccggacccgaggagaaacgtgccaccttgagtatgaagttggccgccattccaagagttcttcatgcgggtctataaggttgtccgtgcaaatttatcgatacttcgtatattttcacctgtttttcgtgcccgactcatgagcaaagcagcagcagagttctggggcagcgcctattctcataacggtcctcaaaatgacactgggaccgtttttggatatgtccaggcttcttgccaaagagcaccccaacttagtggagagccttatgattccgtgagcgttggtggcctgttgggcatcacataggtcatgcatgtggtggaacccattttctacatggtgacaaacgttgaaacggcttacgaacggcgtcgactctgttagggatatccacgaggtaggttatcgtttcctagctttgtaaccatgcgaagcatcacaatcagtgatgaagcgcacatcgcactatcaggggcgcgtgtgcctttgagcggaagtcgttctggaaccgcaccacacttcgttcgaactaaaggtgtacgatgtaacattgccccattattgccccttcctgccgccgatgtcccggctctaccgcatgggaagcttctgcgccagaacgcagcaacgtcgttcaagacaggcctgtctccttttttctgaaaagttggcacattgcggcactgtctccagtgggtaggtgggccgaagacaggaacacccacctttcagagatgacaaacagtgcagctttcttggctgatcgagttcggttgcacccgcctcacgagcagtcagctaccctgttcttgcttttaaaaaatatcgaaccgcaactccctttgcgttaaacatttgtacatttgccgtgtcatacttctcctttgctgtattatagtgttagagactcgccaccttcggcagccagcatgagcacattttagctttcctatcttcttacaggttggacctcgacttctaatcagtaaaccattctgaaactcctgcttcccatctggctgcgactccgagtcgacccagtagacgccagggaactaccagatgagtgcgacagatagccgatcagaggatcgaaagatacattgtgtgaactacacttctttctctgtccaaacaccatacgtgggtaggaacgagcagtatctgtggaactgaacgtcccgttttccaagctgggcgacgcccccgaagtggacacagagccgacctgaggaggatagcttgagccgacatttcgtttgagcaggagcacgattttccttcgtacagagtagctgaacgctttgaacaaggatagctttacggaatggcaaaagccgcgtacttgccttaacacttttctgtgtcatggcactcatccgggaattcttagggtgctgtagttcgaatgtcgtggcgttcgcgtcacaggttacgccatctctcatccagcgaagttgttgacctgcggtgcacatcggctggaatcatccggcaaatgctttccaacgaaacgaatgacgcacatgcagctgtcacagacgcgatgtgccctcactgcgtgacaatgaaacgaccctgttcctgatttagggaggacaacgtggcactcatcggattgccttcagtgtgtcttcaaaattcagagttctcgcgcatgcccacgggtgcaaatttgggttgcggcctctggctgtgcatacgatcaaacaagaactaagggtgaactgatgaaatcgagttggctaccgtcaaaccagtttgcattataactgtctgggaccctatagtgaagtatttctatgccccaactgcctgcacaacacaccttcgccaattttccccaggaaccactgtcaacccatcctcacatgacgcaaatgactgttggagtcaacgtcagatgatgactctcggcgaactcttcgccactctcaacgtttgccgcccaaaatcagcgacaattcaactgcacacaccgctcaacatttgcgattgctgtgccgtgcttcagtttcgtcggaagagaagcctcgggaacgggcatcctccctatgcacttcgtaagacagcggtatcgaaagacgcggaactcggtacaccggatttgtctctctttgctcaaaactgcagaaacgttgatagtttcgagggcacttgccgtacttatcaagcgacgcccacaagtgtgcattctggcgtaacacgcgggtcgcttcttttttcccacccctccaaaccagggtcgatttccagacacaaccaccggtggctccaccgccaggtcgcggccaacgttcccgatcgtgtagaaggcgaaatcagtgcagcttcaaatattctctttcagagctgagtccgagtgcgttctcgaattcgagatccaataccaccagagacgcgaatttttcgcacaactgcgagttttctcgtgtgtacactcaaatttcacccggtgtgtccagttccacgcaatcaaaa

SEQ ID NO: 3078 - DNA, 1707 bp, Toxoplasma gondii
aggcaaatgtgtgcagactcatctacatacgtagatctatctatcatgtggagtattgatatctgtttgtaaaatacgtctgtgacatggtttttacaaagatatcaggtccacatcttggtacatctcgttctagaaatgtaccagcctatctgcatatgtatacacacatatgtatatatatatatatatatgtatatatgtatatatgtatatatgtatataatatgtgacgacgaatgtagtatatacctctagatgtgagtgtcaattcgtttgatggcgggggccgtctcttgtgaaaaagagaagtcgtttttacatgttcgggcagccctgtgcgtctgcgttctgccatatcttcctcgccgcgttcgcttttcaagtcttgtgactgtcggaagggcagggggaggccgagcgccgttgactggcgaaaacaagacgcctgacagccggagctgcatttgtttctctcgtctgctgcagcgtttctctgttcggacaaggcctgtggcttcctccacctctctcgcttttttcccaagtgtgcatttatggaactttctgtaactctttgattcgaaagaaaaagagtttccttctcctcgccccgttcctcgtcgcctcctgcgccgctctgaggctgcgtccgaagtctctttctttttcttgcccgcgacgcttgaagaacaaatgcggccagacaatacacactggccttcatttctccgtcgcaaaagacaacggtaacgggtgatgcattggtataattatcgtccaagcactcagagctagttatcgagagatgctcacgagctgaaaaaaaggttttcatcaggtcctccctgaactcgttttcggatagccagaaagaaagtgacgatgggagggggacaggaagaaacgaaatgaagagactctttccctctcttgtggccttttttccagcttgcttggccgtgtctgctgcgtattttgtctcgaattttccttgcatgcgcacatgcagcgcgacgctcgacgcttttctctccgatgaggaaggccttcttctacgaaatggcgcctttttcagaagtacaggagccagtgactgctccgaaagattcatcgcatccagctgtgtcgaggggaaggagaccctaggccctttgctctcctgtctcctcgcgccgagactctttcatgtggggtccggaattctcgctttttttcgcgttgcatctcctttttcttgcctcttttgctgttctttctcttttcctcgctcatccttttctccagttctccgctgccaaggaaaggactcttttcgcctccaaagtccacgcgcttctgcctctccgtcggccatgctggcctcctctctcctcttgtgccttcctgcctctcgagttcctcaaagaaaagccatgtcgatctctcctctttttcctcttcctctgccgtacatcgtctcgtctctccacttcttctagagaagcggtcgtctcggcgcgcgccccggtgtctcttctctctcctcgccacacccagcgcgaagccgcctcctcgtcctttcttcctctcggaagagtcgcagattcttctcgcgctttcgctcgacgctctctaggctagctctgaagccttccgcggaaaaacgagcttccttcctggttttctccttcgcttttctgtgtgccaggcaagcatctcctaaaa

SEQ ID NO: 3079 - DNA, 1799 bp, Toxoplasma gondii
tggtgaacgcggttagtactaactaataacgaatcagttaggccgtgagtactttgtcagttgtaccgccgcgaatagagaaattgggtgacaggttaataaggtttgatggtccagcgaggtggtgtgtatggtaatgccaaccacgatattccgaggtttccgagttttgcatcatcgtgttgctccctcttctcacattcatttcacctacattcgtcctcgactttggtggagttgtactgaaatagattgtgacatcggagtacggaagggccctctctagacgcaaaacaagtagaacttcagggtcgtcatgttacggaggtgaacggatgaaccgtatgctgacacgacgtcagatgcgtttgagatttgtagacatatattcggagctgtcacacaagtacctcagttgaaacttattacgcggaagcatgttgtttcgtgcgtaagatcggcgaaggtatgaacgggtggcacagaccattcggatcccagtgcatcctcatcagcagggaattgagataccggcgttcgcacacaacatcctatacaatctcctgtcaggtgaagccaggaagaacgatcttgcaagtgaacagaaaggctgttgagcaaagcaagagcagaacatgggcgaaggccgtgaccacaccaagaacctacggttacccacagcattccttgcacgtcagtcgcgactgaaacgacgtgtagagtgtgtcgagccacgggatcggataatctaggagagagtgtttccatactctcgacgtgccgtctctcctcgtcttcactaatgttcctagtcgtaatttgattttcccacggggctgaatacaatccttttattgggaaattcacttgtttggtcaggtaatacccgtgactgaaacaaacaccgcgttgccagagatgtggtcactactcgtacctccccttatggaccgccagtacctcatagccataaggaaacggatagtccggaagggatattattgagaaaggtattacaggaatggcgatgctggaaatacggtactgttctacagtttgtgcaaatctcggtgtcgagccgctttgattcgggctgaagaatcaggacgagtgatctacttggaaaacgatgtatggtccagtattcgtgtccacttaaatatactgtctttctctttgacaccaccttctactcgtttaccctgttaggtcctgcggaaatggttgtaccatacttcggtcggcgcatgctgaacgcatgcacatgttggaaagagaaccaccttctgcgaaatatcggacgatcggcttttctctagttctttgctaaagtgtggcgtgagggtggccgaaacagccgttagacaaacgaacctgtttaatgatggctgctttcttatagtttcctcgtgtttgtgacggcccttctgctagcggcccgagtcatccctgaggcgggagtcactaacttacggatgaaagttggcaaatctcttcgacccagcagtgcttttccattttatcatccgattcagattctttgttgtgaaagggaaacttttttcggctgaccatatccgtgacatacattctgctggggttactggcgttctgcaggagtcgccgtcgccagagagggcgcagtctactcctaagcctcctgggaaaggtaactttcggttttccctcttattttgtgcatcttgctgtctgtctatcttcagttgcctgcctacagccacaccgtgggactcgtggcactctaaggaaaagtttttctctgttcgcaccgaggaaaa

SEQ ID NO: 3080 - DNA, 1469 bp, Toxoplasma gondii
tttacacacgagcttctgcgatgcttgaggcttcatgcgcctatgtcctcatgccggacctgcctacatcaccaagtccccttgcgggatcggctcctgccgaacaaatacctacgctggtcggctgtgtgctgccaggtaaatccaggatccctccacagcgccgggtcaacaggggtgcgtaacggatcgtcggggcacagcgttcgatacaacctggaaaaagagaacgcacatgtcacatcttcgaattgaaaatgccatcgacacctcacggaggtactggggttttctcatgtcctcgccgacaccacccatcccacctacccataaaggtcttggagtgtcgggttctcgcgaagaactttttcgtctatactttgaaaaaacgctcgaaccgcatcgcgcttcttccagcactgttccatcgtggcggacaacgttgtcagcgacacatgagcaggacgaggagcaaatcgcatggcctgcacagaggcaacaagttgagaccaggagcagaagcaaacttgacatgtctatatatgcttcgatcataggttggctgtgggaaagatgctagacatacatcgcaggccctttgcgtccgggagagaccgtcacgggttgtgttcctcggtgaacagaaagtgagctgactgcgtcgacaacatgcgcgactccatgtagaggactgcatgtgcatgatcagccttgcgctgatgtaccagcaaaatggattgagtggaaattgcgcgcatgagtgctgcgagactgcgagctcaacgatagatgcatgcaatcgactcacctgcatctgaaaatattgagccatctgcacatcctggagcatatacttggatggccagtaccacttcatcatttgacggccttgcagtggcctcacccactgctcttcccctggcataccgcacgcatatccaaaaatcttttttctggcatcagctacggcactttttcgcatcgagtgcggtgtctgcccctcttgtaggcgccggagggacggagatgccagcctcctcatcatagcaggcgaggttacgtgagattaacagaaaacgcctcacactgcatacacgaacacgccaaactcataaacccgtgcttctcctgctctacagtgaaattaaaaaaaaacagaacgcagcgtgcagacaaagcatgtaagatattaactaagagactcgggtcattgtagcaacctagcgggtttcttaagaaatatgggcagcacactctctcctttatcacagttgtggaaaaacagaaaaaggcgccattttagtggaatcgacgactcagacactgggaacgaacattctcaagtcaccatttggccaaaactgagaccaactaacagagccaggatttttgttcattcatgcatgcactggagggtctgcaaggagcgggtcagcgctttccccctacctgaaaaatcaaggcactcc

SEQ ID NO: 3081 - DNA, 1608 bp, Toxoplasma gondii
agaaagagacgaacgagaagaaagccgtaggcaggaggaaggagagaaacaaggggaagggagaccacgagagaaggacttctcaggagacgcaaaagaaggcaaatcgcgcgatgcgatgagagagagaagacggcagtggcgcggcacctccacatgtctctcgagtcttaacgccttcagtggggagttaacttcgcgtcctccccatctccatcgttttttcctctttcctcgttttctctcggcctgtctcggtcgaggcgccctcctctgcggagttctcctgtgcgcttccctcatagcggacggaccgtcggcgcgggaagcgaggcgagcaggcgagagaagaggagagcgaagagacagacgagagcgagggggaaggctgtccatgcccatgcggcgtaaaagcagaggagctgaacgtctctcttctgcctcttctctccttcaggtcgaagagaagcgtgagaagaagagaaccaagcggagacagagtgcaacggagactgaggagagggcaccggttcgcctctttctctccactcagtttcggtgcaagcaaagtctccggttcaagcgccgcttcagtgagagggatgcatacacgccgtcacgagcgagccggtccgacaagccgtcgggagaggcaaggaactcaagccacagcgcgaagctgatactgcgtttcgtcgcccgctccgtcgcatgctttcccctcgagcaaagaagaaaaaagggaaccgagaggagagcaggaagagaaaagagacaagtacaagaccgtgtgcatacccccttctgctgagtcgactcgcggggctttgtccggagcgtctgtatgtacgaaaatcggcgctggatcggccttctttttgcaggaggaaaggttcgtgttcaagaagactggccaccaacgaggaagcggagttctcggatttcgttccagttgtcttgtcccatttttcaattctcgacgcgtgactgtggagggcgcgcgacattgccccgagaatcttttctcagttttctgcatgcgcccggaggttcccaggcaacaaactggaaactgcctgtggcagactttcctgtcgcttctgcgtttgaaagcgacagaaaacaagaaacgagagcagcgcttcgtttcaggggagagacagccttctcaccttcctttcttcgtggggaagggagagccgcacggcgcggaagcaacgttttttttgtggctcgcgcttgcttcgctctcttctctaaaatgaaacaatagcagatacactccgacagcaggtggcgctctttcgcgcctttctctacgaagaagacggggagaggacagacgcgagaaccgcggagaagtcgacttcctccgggatcctctcgtaggcaattgtgtctctctcttcctgggaaggaggcacagcgtgcctagagagacggtctgcttttccttgtctgcttttcatcttcaacggccgctttctcttgccgcgtctgtttcttcctcttctgctcccccaccttctctacttcctgtgctatcttctctcccatgtacacaccttctcccttctttctttctcgtcttttctcggcgctccgcga

SEQ ID NO: 3082 - DNA, 3597 bp, Toxoplasma gondii
atatccatgggcaccaaaaatcgagattaagtccttcatgaatgcagccgagggatccttcatgccatgcttctggcatgctgcagcagcaccgcaggtgtacgcagcgccggatgatgagaacactctaccggttttcagacagcggacacgagagtgcacgcgtaaaggaagacgcaaacgtgctgaacccccaacatgtgtgcgaagaagctaccacatccgtgagaagttgggatcattatgcactaccagagatactggcagttggcagttatatgttgggctgctgcatacggtgcgaagaagaaacacgctaacacactgggaacagctgcattgaaaacaaacaacttccggtattgtgtgtaaacaaagagaagtacctccagcctaccgggaaagccgaggctgagacacgtcctcttcaaatgatgaatatccgatgtacgcagaagcatacccggctgtcaagccgccgacttacctagagtaatatcccgcgcgatggaacccacctcggcgttcatgtgatccactgaatattttgggtcgtattctggatggttcgccagcaggttgcgcaaaagagcctcatctgcactcaaagaggaggcaagagctaactgtatctggggcaagtctcgcctccgctcttcctttgaacagaagccactgtgccggcagaacaggatggggcataaaccaggaaaatgtgaacgctcatactcgagtgcattgtctttaagtatacatcacactgcaaggaagaacgccatcttgcagtcatcaactaggagaccgaccatgcatgaaccataaaagctgaaagttgactcattgaagtccggttagcacataccttcttttttgaagtacacagtctcttctcctgaacgcttctggtccatgaatttgacactgctgaagtttcgaattttcgtcaccatgccggctgacggtaggctcatttgctgtgtacccgtgaaaaagggagaaacatctgttgatttgctgtctacctggcgtcgcccactctccagtgtagttctggcgacacgccggatggcaacgcagcagggcgacgacattttctcagctttttctcttgtgagctttcctcaaaagctaatgcagttgtttggccgtagacacacacaaattttgcgcacggaaacgtgcggggaacgcactggcaacggggactctgtccggaaaaacagggaggcttaagacgcagaaacacgggcaactgacgacaaagaccgcctcaccagctgaatcatacggtcgaaatactgcttgatgtcaacaatgaacacgccgttatttgtggacacaacaccagcaattaggagggaatagaggtagtcctaacgacgacaaaaaagagtgcgcatgctgagcggtgctgtacatgcagtggaaggatgtatctgttaccgatgcatctcgaaattttgcaggaaaaaggttgtgttctactgttttggggggggatttttcatgtcggttagctacctcggccagtacctgaacgattttagcacggcaggccaggtgccaccggaagaaattctgcacgcgcgccggccaatctgcgagtatcagtttagaacacttctggcgtctcgcagtacaatcgtgcgagagcacgcacagccaacacactgtactggccacttagtcagaagtcaaagcctgcatggcgcatttcccaccgaatagaaaagaaatacttgtcagcgaatgttaggaagtttgtgactgccgccaaccatcctcggcaatagcattgttgagtctcacagaaagacggcaagggacgttcagccatcgttgctgtaacggtatgacttctcatagcaccagccggcaactgctcctcgtaatccctctgctccaactcagcctactcttttatgttacatttgcatgttcatgtgaaaatcagcaaggaggagtaagcgaatgcactgtgtattcaaagagactgctcggatagctgcagctactccctaagcgcaccgctacccaaattgtgctccgccgccgagggctgagttgtatgttttggcctgtgcaacgctcgtgtactgtgttagaccagccctaagagaacatttaccgtgttggcgatataagcgcagttctgtgagggaaaaatccgaggagggtagcacacgtctgaaaacttccgggatgctgcctagcactctactgcccacaaatgcagtattacagcgacgctcccaagtcacgtgcacacactagtctctgcggtaatgcaaagaaaaaatctgttttcacgaaggcgactctgtccttgcgcgcccagctaaacgaatccaatgccgaatgcctcagcgggtatccgtaatgtcaccggctgcgccacgctcaagccctgtagtctgtaccgaagttttttcggggccacacgattcggatactcttcctgtttaaaacttctgacatcgggggcatcgtcaggcctgggacaggattcgatagcagaagaggagaacagtccgaagaaaccaacaaatagtagacaatatcgctgggcgaaggcgaaacctctgctccactgcacgccgtcgagcatgtggcaacccgaaacagcgataaaaattgataactctatgccgaaatacggaattggcgagaatatgatggttgcttgtgcacgatggattcaactgcaaacccgacaatattttttgttctctatcccatgtacttgctccgtcaccagcctgccatacactttcctggcggctggtgtgttcagtagcactgcagggagcgttatagggcgtagctagccgaggtcccgttgtctgaaaaaatcacacagcgagacacttcttactgcctaacagtgaacgtctcgagctctgcgggagcttgcaagagaaagaatgagcacaacgcttaaatggacgcgcgcagtggacccctaattcaactacagaagcacttccatagtcgtttggatattaatgtatgccccacagagcagcggttgaggagcgacgtgcttaaccgcgaatgccacaatctgcaaatgctaaattgagggcagacaggacaacacgtcagccttcgtcgcatgcggatccagcggctatatggaaggcatcgtatagtccgacgggccttctacacggcactacagagataagagacgcggcgggcagtatgctcgaggaagaggcactaaaaatggctcagtttgcgaaaagttttacctccagtgcttcgtcgctgaccgattgttgactgcttagtccattgtttgtgtaattcatcttcgtgatgcagtctcgcaagtacactgtgaagagtctagtctgccactgacggcctgtttctgtttctgcgctgcgcgcattcaccgtagaactctgatccgagacggcaatcgcctccgatcaacatgaaaacctaaagcggatttcggtgctgtcgtctgcggggtaaaaccaactgggtagtatgaacgaccggatgataaatcgtgcggctccaagatacaccccgcctctcccagagtaacgatttcccatttctgttatccggtacgttcgacga

SEQ ID NO: 3083 - DNA, 4010 bp, Toxoplasma gondii
tagcaaaggagaacattacggcaccgcattctcgtggccaaagccgtggaaggcgacttgccgtacggcagagcagtctgcccttgtcgcaccgaaggggctgcatgcgtcgagggagcctcacctgcagcaggggtcctttctgcggtcctcggtgaagtcagttcctgctcaggggaaatgtccttggattccgccgcgcgttgttgcggcttctcgcggttctcaaaagccttagacggtccagaaaaagagctgttgtcgacatgtaccgccagacgaattttacccgagagatccacgtcggtctccgcacagggtggcttctcgcatctggagcgctcgcattcctctccgcttgattctccagccccagtcccgtcatgcgaaacgaaagaagctgccgggtcgaatttgaagctcggtcgtagaatcgggggacgcaccggctcttctctgagaacctgcttcgttgccaggtgtagagcgaggtcaggatggtagcctccatcgtgtgataaggggtaaaggggatttaatggcaaccgcacgtcgccggcagaagacaagccacttgaagtatttgagagtcggcacccgcccagtgacggtgttgacatctgtgctgctctgttcgagtcacctgcagtcctggagtcctcgggagaaaaccttttcgcggtgcgtgaggaaaacgaagagtgaggtccaccaggacctaaatgggaagagagaggcatttttcgcattgctggtcgccttatgggttcttggaaacaggtgagatgagtcacggaccgacgacggcgacacctcgctgtcgcgtgccgtgctcgcgaacgggggcaaaccgaggtgagtagacacgagtggttgcagcggcaaaaggcaagtgagtgaaagtaaagttgatccgacagcgaaacggtcgaagtctagctgcttggatgcaagtttaggtttcagtggtgagagtggagagagacgagtcagaaaaaagagtttgccatcgatcacaaaaaagggaggaaccaacatgtaaaaaccgggaagagcgacgcaggtccttcgtaactaatgcgagggccgggagtggaggccggaacgcgtaccccttagtataggtgaagacactgagtgactgagcgtttaatgaggaaagactgttttgctggtagatggtagcgaggacaccgcgtttactcctcaaaaagtaagcgtgcccacaagaggacccggttggttttcaccggacgtgaaggctaaatgttggtcaaaccagctcggcctctgaagagagctttcgggaaagtcagtgctggttcatgaagtccactttcactgtgcgctggaaagcagtggtctgcgaagaaccaccgcaggactgtttaagaaagactccgttcaccggttcaaatgcagaggaaggggcccaaccgacaggaagatagtagattggcccgaatcctttggtccacagaaaataacgccggagtacatggacagactcaaaaagcgaaaaataaccgagttgcgagacaaaagaaaaagccgtaatctgttcaatccggcactctctttgtcttgtcgcatccgcgtgcggttgccaactacccagcggcagctgaggcggtcccagccatacaaacggaataccgatacaagcgggattcgttttcagcccgtttttcgatggatgctattccgtagagccaaagaatggtgggaaagcatcgagctttcgggctatgcttgcgtcacgatctgatcccgtgggcttcatcggaaatcgagtggctgccagcgccctggacggttgacgcactgcgcaaaaagccagacacatgcagccgaaatctgcaagacaacttacctaggcagctagacctcgactggcgttcggggtacatcccactggagcacgacgcattatacaagggatcgctcgcagttgtcaagatgccctggagtcagtgccatttaaaaaagtcaaaatacccaattctaattcgtcaaccgtggaagcatggccaggtgcaacaatggggtcctgtcggcggcccctactgcgtcccggggaaagagtcggcgtcactcgttttgctaggctttctggggcagctgttgttttctgaaagccaactcttggctgtactggagaaggtaactatgctgttttattacgggtgtgtcggagatgaccaatgcatgaaagagatgtcagactgggagggtttgtcttccccacgttctacggatgtgcagcaggtcctgtcgacgggggagggtccgatcaaaacaggatgttgttgccgaaagcaggattcccatcgtcaatgtggcagaagctaggccacaaactaggagagcggaaccacagttgaaacacacgaccgtagggagatcggatgccgcacgccggtctcgtgaacgcacagatgtatgtatgattcgttgctccttcttctttgcagcttttgttcaactctcgcacctgttttggtggctgtcaactgatttaactggtcatgcaagtggggacgtaacactgtggctctggcacgaacgatgtggatgtcgttgccaacgtgagtatttattccggtttgttgctacctgtggtagtgaaacaacgacactaaacacatttagaacaaactgtgatgcttgattagtggtgatagcatacccatcttcaccaacaggaatatcactttttgtgtggcaacgtggcaagagttgactctgttaactcatatgatgtcatcggcatgagaccgtagcgaagcgcattcactcatgtggtgccattctgctgtgcacgaaagagatgtcacctggggtcctttagacgcagtctccttgctttatcgttgagacagaatgtcgtcaacgtgagatcgtagcgaaacgcattcattcatgtgatacgatacgtgcaaagtgtaccaatgatgtgccagctgtaattcaatgaatacagccatctttctttgtctgtttccaggtccccctgttaagcattccgttcgagtgtgttaccaccggaactggcgctcaattcctaaaaaaagaccctctgaagttttttccttgttctactaagaaagaaacgtatacatttataaggcagactctgttcgtggagcccgaggacagaaatgtgttcgacaggctagtttccggcgatgattcctgtggcaacatcgcgggcggtttttgtgagtgatctgcgtgttataaagtagagcgccctgcaacactgaagttcctgttacaggtacgggattcgtaggaacagaatgggaacgagggttgccgtcaccagaggtgaggattttatggctgacaagatttcttgacagagcgtatatcgcaactttgtggctacagtagctcagttccctgtgagaatttgattggaggattccgctttcaggtttgatgaaaaaacccaaacaactagacaggtggcctgaatttcgttggagcacacctcttgctctttcatcatcttagtcgggagagccaacgcccttcaggtttcccatccctcgcgactgttcacgctaagcctcgcgtgactagcgctgctgctacgcccgttgaagcagagcgtgagacttctttgccctctctgcttgataacattctgttcaatccgcctttccgcaatttctctctcttctctctcctcgtgccgacgtagtccgtcgctcatcatgagagaggaacgccttactcgcttgaaggctgtgacgcggttctgttgcatcgtagtggacgaagtcggagcccactggatcgccagtgggtttgcgcatgactttttgcgagtctgttgcgctcccgatataaaagttcccattttctcgttcttccagcctatgcacacatcgacgcagatgtatgagggtcttgcgacaaaaaaggcgcaactggaaacaaagcaatgacagtatagggcattaattctgtgtcacctgtcggcttgctcgtggctgcgggta

SEQ ID NO: 3084 - DNA, 2243 bp, Toxoplasma gondii
tactctacgccactgcgaacgatttccgtggcgtatgctttagaaatcagttccatggcctgtccgttgccgaacatgccggcgttgaagaagaaggggctagtacggccactttttagtttgaattcgccgaacttgagcgcgccatggttgtacgcaagacgaagcagcgccttttgcagctcgtccaactgacgcccctgatattcgtctgtttctccaggcgggccggccaggacttttctcaacgtgcgggatctggaaactgacaagtttccgctcgacattgtggcgttttgtccactgactccacaaaatttcgctgcagttcaagttaattctcgcgcgtctgcgagagtcgacctaaacacacacgaaccacatgcccatagaaacgagctgcacatacagaagggcgtacatcttgatgcatggtgagacagccgacgaggttgacacgcaaacacgaaacaacggctctctgtcccacaaaatcaagacgataaagtttaccagtgacacgcaggaactgctcttacagtgagctgttttcttcaaacagtcctccaagaaaataacggcagcgctgccgaacggaaaagtcgctgcactcggtaccgtaacgactactgcggaggccgccgagcaacccagaagatacggaaacaagagacgtttgcataaacgagaaaaacaatcgaagcaagattagaaggacggcgagacagacacaaaacaagaaaccagggagtccactatgggagcgacagtaacgtgggcccgcgaggcagacaacacgaagctgaagacacgggagaaccggacgaaaagacaaggcataattacgacatatgaacggatagagaggcagaagaaagggtacagaacgtgtggggaggtcggcgagaaagtgcagggaagggggggatagagagacgagttaaggggcacacagcctacgaaggaacaggtctcatagctttttatgcatttcctacatacccgccccgtcaaccgtgggttctgaaagagagaccagacttcctgctcttcaaaaaagcgtgaatttcggggaaaatctcgcctcgcatgatcttttgaatggaacaacaaacgtggctgatgccagctgctagagagtggcagacgcttgagtcgatgaaacgtctccttgattcgaacacctaagggtgaacgaaccctcgataagaagtcctctctactcaatttacagattccttctgagggtagaatcgcggagacttcgacgccgtttcacgcgttccggcagaatcaaagcatcgctcgctggatgcttgcctcgatgtgacttttcccatgccgcgaacggttcctacctcacgtatgagaaaaacagaggcgcagcatctatcgagcatgcaccagacaaaattgcctttgttcttttagttgctgtccattcatcactagcgacgatctttggttgttctcaagcgaagcacaccagctccgtgctcctttcccttgcgtgttccagccttgtcgcctgttcgtgtcttcttcctggcatgtttcgcgattcttcaccctgccctggcattggctgcagcgtgaaagggttatctcctgttggaaacacgacttgagagcgtttgcaggtgattcctgaagcgatacgtactcttcgctctcctcggattcgtcgctgtccctgcgggagacgagaaggtcgcagcgcctcgacttcctgtgtggggcagactgtggcaaaagagaaaccgtccctttacattcatttttgcctgttgatgaacagttctcagccttcttcaacgggacgcaaccgaattcaaggatccgacgaaagcctcgaactcagacctgactcggcagctaggatttccccagaagctacccactttcttccactcgcttgaatagccagcaggtccgcttgctttacaccactttccaggcctctcaaaaaacgtccatcatttcgctcagagcgaaaagccgttttcgagggttcatttacatgccgttctccagccagcgttgggtggttcccagacccgagctaatcctggtcaccttcgcatctttttctctgagccaacaagcggccggcaggtaaaaccgtctaatttgtgtgtctgtgcatgcttgtcccggttttttcctgcggcgctctaaaactctaggtcagcaggcgggcgcccttcattgcctatgcccctctccctactggtactctgaaa

SEQ ID NO: 3085 - DNA, 2971 bp, Toxoplasma gondii
aacagtgtcccacctgtctcgcactttctcgctcagcagatgattcctctgaaagggtcagctgacccccgttgtttgtcgtgagggcgccaagacgctctgcttccttcaagagccttcgcgtcgaccaccgtcgagtctccctctcctgtttcttcacccactggccaccgcaggggccctcgtgtccctgtgggggaggcggagttgaggcagaagcagaagacttcgaagacgaggatgtcggaagagaagaggggagactcgcagaagctgggcgtgcgtttccctccttgacacatctatccgtatcgccgtccgattcttcttcgtcgctaccctccgaagaaaatccagatgcccggatccagtcggggaccattggagcctcgcctcgttgcaggcaaatggccgcatgcgcaccaaggagttctggattcagcgcactgagcaaatggtcacagttgaaggaaacgaagggaggcagattcggtggcaagggaagagcggcggagtgcatgtcacttgcgtcagcactctctcgtctccttttgcccaccacgaagacgtagcctgccgtcgctctctgctgtgtctctgcatgcgcgacagcaggagcctcgctgacagacgaagagggcctctctcctgggaggccaatcgaggagcgacaagtcaacggagatcctgcaaggagagaagaaggcgaacacgaaggcggggacacggcgccagtactcaacgacgaagaggcgcgagaccacgcagagaccgtggaactcggagagggcgacttgagggcatcgcccgacttcacgtctgcgggctgcttctgacacccagcagaaggactctctggccccactcgacttgccattatccagacgaagaaaaggagatgcgcgagagaaacggcggactgggagaagcgctggtcaccgacggctgcacggagaaggaaaggatttgtgacgtactgagaacgaaaggggatcgagaaaacaaacgtatcttcgttttgcgccagagagagatagagagcctatctggagactgcaggactgaaaagcttttgttgccgcaatttgtcgttattcccgttgacggcaaacccttctccggctcgggggtcaaatgacgaaggaaacgttactcgtatcgtctgccgtgaatctgagaataccaccgtacctatttttgaaaccttccctctccctgtgcgtgcgaagaaagcacgatatctgtagaggcgttttccgttctgtttgccccgacttctacatcggtcagaggcggcaacgacctgggcggaccgggaccgcagctggaactcgacgcccctccgcgttttttttcggaggaactggaagcaaccgaaaaatcagaccgaggggaatttccttcggctcttgcttctctgctgtcgcttctcgccctttctccgtcacgttttcaaactcttccgctgcgaaatgagaaccacagctgttcctgctcggcgtcagaagcttagaaacaagatcccgacacagacgggcaacagagagtatccagagagcctgacagagaagaatgagtgatcattcaaacaaatcagaaggcgtgatggatgacagctgtcccaagccctgtaaactggcgtaaaagtgcgatgagagggttgaagtataacggacttgcggattgtgtcgaggcgctgtcgtcagctcgaggtgtacagacagctgaaaactccctccatttccagcacagatatgcaccgggacacacatttagctggatttgctggcgtcgggcgccactttcgcgtccttttctctgtcgtcgcggcttctcgactggtcgaccattggtcatcgtcgcggcggagttgcttctttgcgactttcgcgccggcgaaaggcttcctgcatctccgcaggccgccctcctccgttcgtccagtgttccgcaaaacctttctggcgtttttccgtggtttccgaaggcgtccaaggcaaaccggagttcgagcgtgacagcggcactacggtccagatgcatagactagttgttttttccgaaaatccagttcgtgcatgtgtgcccgccgtctcttcgcgtccgcgtttcgctggcattgacagcacaggcaagagctgtggcacacacatgtgaaacgagtcttgcgagctggcgatttgcgggactggctttggggcgccgccttcgaacgatcgcgttgattcacggaagaagactcgcggagaaaagggcgtccttcgatctcattttcgccgaattccctgcagcaaggtcaggcgactccgatttttttctcatgtctctgcaactcgccacttctcgcgcagcctcgccgcgaaaaagagtcagcgcgtttttttctcttgccggcccggttgtccccacgccgttctctgctctgtttccggcgttttcttgcggatcatggggcacgctttcggtggcgaccctctccggtttctttggcacatctttcctcgcttggttcgcggtcaatgctcgcttcctaactcatttctgtgtgattgagcgcctttcttttttttcgctttttgtggggtcgacaagccccgtatactgcatgccctttctctctctgcgcgtatttgattctctcgcgtttcctagggtcagcgcctttgtatcctgcgttttccttttttctacgtgttccttcctgctaaagtgaagttccggagttttttctcgtgcacgccgttagaaatcttcgtcccgttccaccctatttctccacgacacggccactcaagtagaggccgatttttcgcacttgcttttgcctgtcacacactgccgctcttcgagagggcgcgagagcgcctcctttcgctctcttccctctctcgttcgcccccgccgtttaccgcggcgtctgcaggcgagacgaaaagggggaccaactcttcctcttgcgcgtcgcccgcga

SEQ ID NO: 3086 - DNA, 2261 bp, Toxoplasma gondii
gtgtactgaacggcttctttgcgcgtttcatcgctgctcgacttctctcttttttctggattcgcgccccgaggacgcgcagcctctccatcgcctgcctctcgtcttctcttgggcggcgcgcaaggccaccgcgatttcgtctgtgtcgagtctcccgactgcttgccgccgccaaacgacgatgtatggcgcagcgcggctgcccttgtccgggcgcgcactgccgatctgatgagtccgacgcggagaaagatcgaattggaagcgcgatgcacaagacgaacaccgaacgccgatctcgctgtagaggtcagcgaaaacgcagacattttgagagcggggagtttccctggattcgacgcagaagcgcgacacacggaacagagctgcccgtcagaggaaagctcgccgattcctgagagcgcgagtcctcagcacatcagctggcggtgcagaggttgaatgcgttcccggccgcaggggggtccgaaaatgtgaccgagagatccctcgcgttttaggactgtgcccagagtcagttggacgaatcgtttcgttcggcagttcgagaacagtgtagaagaaagagagctctttctctgccgctttagcttgctacgttgtccccgcttctccgcgtcgtgtcgactcttgtcagccgctgccgggaagtagccgtggaggcaccgcggtgaattcttgtgtccggcaggggagctctgcagaggtgctcgttcattcgggctccgcgctcgtcgaagcatcttctttgtaaagaaagcggcgcgagtttgttgcttgttgactgccgtcgaaagacatccgttctctcgtcgctgcaattccgttgttcaccggcatacaaggtggacaggaggaaaggttttctccgtagtaaatggcgtgtgttcggtgatctggcgcgccagaagccggggactgtggcagatcgcggaaaaaaagacacccgactgtcctgtaggaaggggcttgcatcttactgtttgtgcctcctgcgcagaacactagaagctggtgggaaaaacggctttgtcgggtgtgaaaaaagccacgagttggaacgtctggggtatgcggccgaagtgttgagagagtgtgtgtgtggagtgtattggagaaggagagaaacctgttccccaaacgctttcaacatccatttggaaagcgcgtcgctgtgttaaggtgccgcttcagtgtctgtgtcaaacacacgtctcactttggaagcacgccgttctcccggctctggcgactccctagaaacttaccgttcggttttcgggcatttcttcgaaacgcgagtttacccgcaacatatgtcgggctcagaggccaagatgctaatcaggcagaggaaacgcggcttctgcccgcaaaccgagctgcttttcggcacgtatttccgttgttgagcacacacatggtcgccggcgggacacctagggtctcttcccagttctcacatgaggaagtcgtctcaccataactccaacgatcacgatgaaggcttcacagtgcctatcacgatgtgcagcttctaaatgtttaatcgtaccgcttcaccccgaacaggtggacgctcacaagccctgaaggaagcttacaggatcaatttcgactacggaagctgtctgtccgttagtaaagcatagagatcaagtaccattatggaaatggtctgtcggttagtaagtcattcggatcaatttcggttatggacttgattgtccgtcactgagagcacagaaccggatggtgcacaattttgactagttgctgtctgcaacggcctaagcttctctgagttttctcattttggcattcgtcttgggtcctgtagacaatcacttaatttgttccgccgccaattcgccattagcagccgtgttttcacgctgcgccatctccacggcgtccactccggagaacttcgatcccgagaggaaagctccgagaaacaagtagccaaccgactgcgctataggcccgtcacgccgctgtgaaattgacggcggccacgaaattacactgaaatacagttttcgcaattgctcttactagccctttgtagtttttttcaacgcgccgtaatccaagggaaccgcaagttgtggaggtcacttgcaggatccggctgcccttgctattcaggttgggaaacgctagattgtcacctgcggcggttcgcgcgtggccgcgcttaagagcggggttttctcttcatttctgcttgggaa

SEQ ID NO: 3087 - DNA, 1402 bp, Toxoplasma gondii
ctttcctgacaaacttcggagattgggaggctgaaatccaagttgaagaagacagagtcatcaaactctttcaagttccgctttgccagcagtcatatatatatatatatatatatatatatatatatatatatggagagaaagagagattttatttctgcatttacattgcgaatcttcagagaaacgcgtttcacattttgtttccaagatataaacatgtgcatgtacatatatatatatatagttgtacgcgtacatgtgctttcgttgatgggtagtcgaaagtgctggttaaaattggagagcgcgaggtacgaggacttcaacggcctccttcaacttttcgacacagatttacacttgaaaaaaggatagcttacgtaaatctgtgtacatctagacagaatgcagttttctgcaggacgtttcaaccttttccttgggcgaaagcatctacatccagctttcccccgacatttctccatagatagagacacaaggatgcgtgcttctcgtctgccgttgatttcaggcatccaaaggaattctttcgcgacgtcttcgcagatgtatacgaatctggctcttccgatcgcaggcagcctgtgtcccggaacaggcgcaccctgcgggcagagcagcgcatgggagaggagcgttttccctctcccgctgtttgtctatctctagttctttcttcgttgcccggcggaaaggggaagaaggcctagcaccctttggagaggcgcccacgaacgggagaaaaatcgtttgcttctcggatttgtgaaaaattaagatgtctagtaaaaacagacacgcccttcattcgaattgtattgcgggtgtgaagaatccggtaagacaggtcactaagctgtgcctgtgtctcatctttcaataaaggcgtttcctccaccaattctcgggctttctcccttctcagaacgataggtggcctgggtagagagtgcagcttctcacaaactgtacaacggtcaattatgtccatctgtgcatctacgactttgatactcggtgtcttccagacaattccgttgttctgtacacgacgacgccaggaatgactgcccacaatcattcaggacagcggcaacgcctggacaacttcctagaccgccagagatccccggcaaactgcaccttttcgagagagacgggaaaattccgcctcaccacctcgccgttttgacaaaagtgtgcatgcacaaaacctgctggaccgtgagcattgcacagaaaacctgcgacaaactgcccgcctgttctccagcctcgtctatcgcgtcgcagtagggaatcgccttatattcggagactcagccggggaccttcccgtcctgcgtggcgggcgcatgcaggtgctgactgttcggca

SEQ ID NO: 3088 - DNA, 2598 bp, Toxoplasma gondii
ccaaagtcgacacaccagaggatcctcctccttctctcttggtttcttgcagtatcttccttgtcttctcctctgtcgtccagccttctcttctctgactcatcgttgccgcttctcttcattctcccttgctctgctctttgtagcgtccccagagttcctgactctttcttcctctctctgcgtttgcaaagcttgcctgcttaaatcgatcctcaacatgcgaagccgaagctctccaggcacctgcaagggcgtcggccctctctgcggaagtccgttcgtcggaaacagctgcggctccgtcaggcttgggaagcgcggctgcctttttccagggggagacacttgcgagcggcgccaaggtcgccagagacagctggcgagagaaagaccaggggaaaacgggagctgagaggcgggaggttggggaaaagcacagagaaggcggctgagctggcggaaggctcagagaaaaagaaggcggagtacgcataggagaagaggacgagagagacaaagaggaggaacgaggacagctgattccagagccggagtggagagcaggcgcgagatgccctgcagcctcgaggggcaagacgagaggagggagacacctgcgacgaggagagagagtgaagggtgaagaggagcgagagggagaaggtagagaggagggaaaagactttacgtaggagaaaaagcggtacttctggatgcacgagcgacgagacaaggaaaacgcgaagagcgagtgactgtgccgagctcggcaagacacgagagacaccgcatccaccattttgcgggattcggagcttgcctgtgcaccttcttcctccttcaacctcttagaagaaaaactcgagcagagggaaaagagagacctcccctcccagaagaaagccgcggtaaacctgcggcgaaaaggcttgtgtgcacacaaaaggacaacccctacacgttgctgctggtggttgccgtcgagaatcaaggtgcagagaaatggcagcagaagaagagagcttctctgtgcaagggaatgaaaaggatttcagaggagacggaaacacagccgctccatttttgcaattatggacggtggccgccgggtaaatcacgagaggcgcgcgctcgacggcgacgtacacgagagaatgagcgagttcttccgagtttctctctgcgacgcattggaagggagaagctcgagcgaaaacagcgaaaagccaccggaaaaaacggccagggcgaaggaaaactccaaaggacagccgtatccatgcatgcagtgccacaacaccttctgctgccgtggcaatccccggaaaaagttctccagaaacatgcagaggcggaggactgatgttttggcgaactgagtgtctcgaaaaacgaaagtttgatactctgggaggagacagaaagcgaggacgaagtgcgtcttcaattctggcagaaatgggacgtagactctccgagaggattcacgcaggtaaacataaggcttcaaaacacacagaagcggatcgtttttacaccagcgccgtccggttctctcctgtttttcctaccccggttcgctgcgaacttttccgctgcagactcggcaagaatcgcgagggttggtggaggcgccaacacggaagtcgagacccgttctattttggatttagagcgagaatcgcactcgtgacgatggatcgacaaatgcatcaagtgccacgcacacatgcaagtcaagtatacagaacttttctgcggggtactttatgcggaagaaaaacgtatggaggttctgtaaattgagttgcgtgagaagcgttggcacaggtagctccatctgaaaatcacttccgtgtgtccctgagagagtgcgatctgaaacacctagtgttccacgaggtcgagaagaaagctgtctcggttcttagtgcttcggaactgtcagggacatggcgaccgggcaatccaaaagcctcagcgagttcctctgaggattcactcgcgtcctgctatgatgggtgcagcaactctcccacgcagcatgctttatttgctgtacacagggtgtttgtacgctgtttcaagtacgacaggaagagtctagcttttttgggtgttttctgagcggtgttgcatatcccaggcgtaatggatgaattcctgttaccacacacgagggcttaggttcgcgccaacagggaactctttagggagggaaacacctcgcgggaatcacagatcgagaggtgggaacaagcgactggcccgcgaatcctcgggtaggaaaagagttttgacgccgcacgaatcggctgagatcaaaatccgtagctttttagaggtggggaacccagcgttctatggagcttcagccgaaaaacctgcaatccctctccattgatacagagggtgcgtttgctggcgaaaatacggagactcaggcgcctgtctcgttttcagaggtgcaggaaaggagtctgttaaacagggacgtagaaatactggaaaagtaacgttccctgacgcatattgagttctcttagcaggcgcctagggaagtgacactgtcaagagactgagagtgactcccag

SEQ ID NO: 3089 - DNA, 2392 bp, Toxoplasma gondii
tacacgtgcagatgggcgtgtaaattctgcgtttgtagtgtctgtatctcataactgaagtcatattcaatatcgtatctctgggtacacagtatatacatatatataagcgtacatggcatgactgtgtcctgtaaagcttcactcgactgtatggttgcacggggcacctgtgtgatcctgtggcgtttgttattcgcatccataagggttagcggatacagccctacggaggcatgctttttgatttttacttttccgttgcggcgagtgtctctcgcaagtacgtcaacgtttccttaggttacctcgaagcttgcaggatcccgttggcaacgttctgttgaatatgtgcatctcaaccatgaagtaatctttagcgtcctagcgaatcttctgagattgtgttgtacgactgtaagggagtgctgaagacatcaccaaaggttgcggtggaataaattgattgaaaaactcaccgtaaatcccttggggaaagcaggcaccacatccacgaataactaaaagggtgttcaatcctgacgcgtaactgagtcaggtagtcttagacagaggagatgtaggcgtgcacctagcgaccccagtgggcaagagcagagaacaggcgatacacacgcaaaaacatacgctaccgcaaacgggaaaatttacgaaaacgtttatttatgtatacataaacacatgcgtgtgtacacccgagacagtgtatgaccggaggtggcagcaggtaactacaggcaaatcctgaacatcacgcacggggcgacaggagacagcaaatcgagtaccatctggtgctgaatattctcaaagcaccagaccctgtcaacacttgagaatgagtcttccaagagtgtggccactactgactgccgctggattgtagaccgggggcatggctgtatgcacccttgtcggaaatacgagccccccacttccagcatcactatggaaactttggagggaacatatcgcttcgttacgcagccgtagcaaacatgcatcaagcgagacttcacaaacgctatgtgttgaatgctcagctacattaaagagacagcacgtcaatgaaggaaaatcgagtaaaacagagcccaaaaataccacattgttggcttcattaccactgtcgcaccacattaaaagagggtcccgagagggacttgccgtaaaacacggcaagctgaaggtcacctgcaggggtaaaatggtatccgtgtgtgacctttccgatacacatgatagtaatcgcagttttgttcggcaggctttgttcttggatacacacacgaacatattttttgctggaacgagggaaaattttgcgactagtgtatgcggagtttgcgaacacaccattagagaagaagtgtccctcattttgaaactgctttgaagcgtattttgacaagcagacactcttaccgtgaccactgtccgccaatcatgggggaaggaaccagggtcacccgccctaatgctgacaaaagggtgaaggtttgtttacatttcaagacagttaaaaaactcagaggttttcttaattcaaactgctttcaggcaactcacaccgtgcataactgcagacaatgggggaaataaactagacatcgttgtattcatcgtccgtattagttaccacacggggctgctacattgcgcgatggaacataatgacgtgggggattaaatatttagcgattgtgttcggttagaggctttgacgttctccgatgttgtttcaccgaccagcaaacgagcgcctctgtcgcaaggcaacgaaaagagggtaaaagtatcacagtttctagtcgcctcaacgggtacccgatcgggatgcacaccctccaacagcttgcagcggggcctcccacaattgacaggtgtgagcggctcgacagacgcgcaacaacgcgcatgcggtcttcctggttcggtagtcaccgtacccttgtgtgtatcgggcagtggcacattcaagtatgacatattctcagactttccaaccttcgctctgaggaagactagctctctgacgaatatattaggggatcattctcctcatatttccgtattcctctgtttttccatcgaaccagaggagtgtcagaagggcctccgacggtactcttcttgttacagtgaacttctaacgtcagtaaccgcgtcttcacaaactgttaaataaaagcttttctggaacccgtctggtctttccctatcaacaggtactcatgagagtcacagtcgacctctgcgcggacgctgcacacaggtggtcactttgtggcacacacttcttcagatatcttatgcgaagtccagattccatcattgatctctccttcgtgctcttatccatctcaaacca

SEQ ID NO: 3090 - DNA, 3502 bp, Toxoplasma gondii
gaagcagggcttgcagtataaagacgcaaaaagtacctgtctttcggctctgtgccggtctttacggggtccaagttgccatgtagacttactctgtgaatgacagaaacacctttggtgagatgccgctccataaatgagcacggtgatctccccgcgcgaagacagcggcaaacccgcttgatcaggctgtctgtcgtttttttattctaactcacggaactgtgcctgccgtggtcagtcgaaaaggctgagatgcttctggagtcgtttttcctcgacttgcagtactcttttgcaccgtctgtcgtgaaaccgatacctgcaggttccgcgaaattgcgcagctggttgagtttttgtacctcgtaacccacattcatattccacccacggcatgtgaattttttctggaaattctttttttgcatgcatgagttcgaatctcatcattggattgttttgctgtactacatggtcgttttctgagtaactaaatctaaagcattgtttctgattcgaggttagggcggcccaaatggttgtaaataattcattctttgcaaatagattctggtgggtgctgctctgatggtctttatgagcaaagggtctcacttcgcagctgctgaactcccacgttttccagactgaactcgtccacctaggcagattttgctacccgttatgttgcgtatacccatagggaaacacaacagaccataaaccacgatacgagtctaacggaaacattaaaagatgtcgagttgttatgaacacaactagatggttagctcagaagcagccttctttagaaggcgccaaaagcttaccttttgtgttgaattagaactgggttcttttacgaatatagaataaatgaaagtgaagccatgaaacgtctagtggcacgaaggagccgaggctgggaggtaaggctgaagagtcaggaacgccaccagtttggatggaatgagttttaccactgcagctggtccaccgtgtaagttgtgtgtactttgtggaatggcactacctattataatcactgactgtaactccagttgttagaaacaggcaaacaaggctctcacagtagctcgaaccggcggcggagctggaagcagttttgatgtgtgcattacgcgcccctacctgtatccggtgcagaaattcacactcgtcgctcatcgacgtatgaaatgggaccgtgacagggtgcgtctcatatggggcgcaggcggtcaccacctttttctggtacaccaaaggatggtagcggagaaaaagaagtaacaggaggtacagttatgataaagagaaccaacgtttccagcgaaagtttcaaataatagccctgtattcctacgtatctaaaaagaactacaacatttctccttatcaagaaatgcggtcgaacagtgaacacagatcggtggagaaaacgttcccacatcaaaatgaaacgaggctataaacgcttgtgagaaaaccagaacggagagtgctagttgttttcatttgcatacacccagaagtggagattaagagggaaatttgattgttgttttaacgtgccttccagagatgggaacaatagactagcacggcgtagaagggtgacaacacagttctttccgctgatttctccgttcagctcgcctttgggtctgaagaggttgcaaaggaagatatgaaaataaaagtacgcctttttcagcagcgtgacttccctgtactcagtccgctgtgctgtgtgaatctcacctcacgggagcgggagggaggcttccagtcttgctacagcactcggaactcgaagttgagattctctgccctgttacaggttcctgacttctcttttctccgagtatgaggcgctacaccgaagcaagggaaactttgagtcctcgatgtccaaagaacgagagtacgtgttggtatcattcactaccaccagagtgcaagcagtcttgtatttccgtatcttcgtgtaaatctgaggaaaccataacttctacagttcttaataaacgtccaggctacacggaagagagccgtgggattcaatttagcagacaaacttctccttcgagcgtcgtgtgcttgctgctcatctaccacttctcgtttccttgttcgcgtcgttcgtttagaatatacacaaagaggccctgtttcccacttgccgctgcgcctccctctatcgaggtccttcaccgttccttggtgtcggaaaagtgtccgtttggtggccaggagagaacggttttgctcgtggtatgtgtggctctatgtgtggacagtgtgctggatgagagacttctacagctgagccgctactgctgggattgcgtatattctatgctcccactagtagaggattcctaacaagccccatttctcagaaataagcaagacgcaggacaaaataccgatatttctgtaaatgctggtcctcagaaaactgaattgcatgaggagcgagtcgcccggtcaaccgagcatgcacgcgaaaagctggggaccgggggctgcggcggagacccccaaagcgatgcaactgccgctgtggagtatgccgctttactttttcaagtccgacttgtgaacgtgagggatctgcttgtgttttgcaacatcgcaatacgccaagtctgagagcactacggatttgggtggccacacgtgcaatctgaaagtcaggagccggcacggcccccaggtcacccgagcccgaacaagttgacaggcttttttctgtttcccctttatttgcgttttgtcagcccggtaaactcttcctggtgttttagtggtttcgcgccttcaaatcaaaggtcttttccttcgatactgccatggctgccacgccgccacaccggtggggagtcgccgcccggcatctacagacattccttccatcgacaaaggcagcgatccgcctaaaagcagtctcagtgtgaacattgtgactgtttggcttcggttttcgtggcgatcgcggttttttgcctgactatgccactagaatatggctgagaagaggcggccctacggtgtgacggtccaagctctccgtcggggagacgcagcttcctcctgtatcaataaccaattcatctggcgagtcactaattgtttccttccgcgagtatcatcactggaacccgcagactggtgaatacctgcgccgcctcagggtttctctgcgtcgtgtcggcggtcgcaaacgtaagaggccgtggaacactgccgcggctgttaaggactacgggttcgttttctgttctgttaccccactttgtttgttgtggaagttcattttccttccctagacatctcggtctgttccgatccagtttgagtgcctctgtgcgcgagcgatgaactcctgaaaagttcgcctgcgctcccgctgcagtcgtctccgccccgttcactaaagagaggagaagcagcggctgttccaaaagacaagcgaccttttatggcggtgaaa

SEQ ID NO: 3091 - DNA, 2173 bp, Toxoplasma gondii
tttcgcgttgatgtcgtctctgggtaaacggaaagcagacgtctcgatcgcagccgtcgtcggccctgggaggaaaggaagcgcggaagcctttttgtttcgctcatgtcgagaaaacgacacactgctttaccaggactttccgtaaaagatgtgcggcaccgagttgcgtcgcacatctctagttagccagtgcttgcactgttgcgacaagaaagtgcagaaataaggttgtgtcttacccgatcttccatactgtttctttccatttacgaggaaattactttctcgcgttcttgtcctttgaggtcccgtggacggcgagaagagtgtcaaggagaaggagtgttcatctgagaagcgagcatctgcagaatgaaatcgagacgcacttcagttcacaaatacacaaaacggttccgaccagacatcccccagtacgcagaaacctggcgagacacaccaaacaggagaagcctttctcgagatcaacaaaggcgctaaggctgtagatcaagaggggaaacacactttcttcaagcagatcgaggccactgagaaaagctgacctcgcagaggcggaagtttccacgccagtcgcacgcatattggtcaaatatacaaaagagaggtttcccccctgccggcatgcgacctgaagatgcatgcccactgtctcctctcgtccctgttctctttcttccccagtgtgtctcctctctgcatcgacccaagcaaacattactcgcctccttccccttcttctcaccttccttcgtgggtgccgactgtcttccgagacattctctccactgagatgtgaaaaacagtttgctccctaatccaccactgaacgtgtgtcaccgtacaaagaggaactccactgtacacactggtagatgtactgtcctctctgactcttctctctggcgttggcatagcaaggttgagccgagcattgttcatcacttttaaacaaccttcttcggcgaaaagagggacagctgttccgcgtcaaaagagctcgcagggtctctgtgccctttcctccctgtcctaggtgtgtcggactgtctctgaaaagcggtaaacagactgggatgcgatgcaggttatctctgcgcaggcgcagcttgttccttcttcgtcacggaaatccaaagttccgtcgagtctttcttgttcggttcgccttttaacagctttttgcgtcgatacacaggaagagtgtgtatacacacaccgtggtaggactcttccgttttgactcctcgctttccgtcattgtgcgttcagccatttgagtcgctgtcacagtctctccccgcgtcgtcttcattttgtagagaaggaaggcgtcacgcttcgccgagaggagagttgtctctcgcctctctctcttctctccgctcctcgtctgcctcgcttctactctttccttccctgtggttcgtcttccccggcctgattccccgttctttccccctctcttccgaagacattttttctgccttcctcttttccttgtccgtctcgcgtccgtcgctgtgactcgctcggtcgttccttcgccgacaggacagagcaaaatagtttgagagcagacttctgttgaactgcgcgagaagagatttctcagaggtctctctcttccaaatcccaagcaaatactgaagccgactcaaggccgtgaaggtcgattcagtgcatgcatgcagtctgttctcgccgctcactagcagttttcttctccgcatttgtagggaaagagagagtgttctctctgccagagagttggcctccaggcgcgaaaatccgaggagcagttgttccactggctccctgtcccctgtgtctcctcgtctctcttctggctgcggccgtttttctcgcgctagctgtctctggccgcagccccacaaaggctaaaatcacacagatttgccggttcgccgcggagagacacaccttcgtctaccttccggagtcctcacaagtttgtcgatttctttctctcggcttctgcttccctcactctctcgtctgtccctggagagagcgacggcgctggtcggccgatcagagggcacagtctcttcttttttctcatccgttttcgtgacgttcttccgcgtttctgccggatcctctttcctttcgactgctctcccca

SEQ ID NO: 3092 - DNA, 4555 bp, Toxoplasma gondii
aatcccagatgtttacagggatttctccgtcggctacagaaacagcgacaaaggcgcaccgcaagcaaaaggcttgacttcccgtttccccccccaagtgcctctggagctggaacatccaagtcgcagagcctagagtaggagcacttttcgaatatactgtggttaccgctacgctcgatgcagtcaacatggtggtctcaagtgggcggcatacatgacgccagacaccttgatttctggatgactggacggtatgcgccacgcctattgaagtgtaaaggcaaggagaatctaaacgtttcaaacgacttacggcccgtgagtttgactctgtagtcgccgctttggttcgcaatagccactctttcttcgctagccatttcctccaggagatccacggccgctacagatttcgacgaaagagagtgtcttaggctttcagagcgaaacatctccgatggcatcgaggcgagagtcgcccgcctcacaggagtttctggtgtgacttctggtgccattacgaacgaaccttcaggggaaaataaacgcgctagcgaaagttgtggcaccccagtgctctctagagtctgagagcgctctaggcctgcagtgacctgttgctctgctccatcagcagattgtatgccagtttgcgaagacatttttgcagtttctgccctggaaaggctatgccggagatgagaactatcaacaagaacaacgggacctaccagagtagatcattacacacctttcgggagtaacaagcacaagctgcagagcttcttagtgtcgctgtcactgatcaaaacactggatattccgacggtcaacagaaagcggaactattgccaaacatcggtggtgaaatgccaacggaacaaagtgttgaaatcaggcctcacgttaggttcctcctgcagcaggtaagcgccggtgtccttctcacaaaaaagtcgcaacagtcagggcgttgttttcccagaaactgatgtggtttcacaaaacaaacgagagagtgtgaaaaaggcaggggtgtcacggcggggcaaaagttggcgagagccgctggaattttgtgacggcgaggagggccagcttaggagcggagtcaatcaattcgcgcactacaaagcacgagattcgcaaagagagcacgatatacgccactgtctgtatcgcagcagctctaacgcgaaaatgtggtcaaatacaactggaaaatttcggccggttctgtagagagtaatgccacgcgcgctgacgggagtaccggccgcgagtctctctcctggcgaggttctagacgaagaaaaggcaaatgaaaacgacggctagtgtgttccacatgtaccaccgatgtgaacacaggggaaaaaggaaatgaccttctaatggggtagcaaaaaactggaggcagaggcaaacactgtggagatgttctcgatttcgccacacggggattcatcactcaaaaccagagaccgcagttgtcgcagccgtaaaaaaccagccgtcccgatgctcggcgtccacggtgtgactcgacagccagcatcggcaagtcatcgcgcggtgagttcgcaacatcgaccagcgagcaagacataggacttcagttctgtgccttttttgtgtgtgcgcctgtttttctttttcggactgaagcagcggcaaagaaaatcataagctgtgggtaagcggcgtgtcataccactgggaagggcgcggtcgagaagaaagcctctatgcatttattcgacgtagaacagacacaattctggggcacgtacggcaactatgatgctgccggctggcactggggaccgatttttgacgtctctcttgtcgataagggggacgcaaagactcatacaggtgacattgttagatgattttgaacttctgagcctacagttgattcactgcaggtctcaaaggctggggcaacggattagttcactggatggtaaccgttggttttacaactatatgcaggatgcgagggctgagccgcacacagggaaccacattcatcatgcggtatagagaaatggaatgaaagaaaacttgcagttcgcatcagcaactggtgaagattacggaatctcacttagcacccgcatctgtaggtcgtgcgaaagaggactgctctcacgcagtttttttcgcgtcagagttggattgcctccttgtagttgcagtaaaatgcgaacagtggtgaccgtcctccaattcagacctcctgattcagccagcatggcatggaaaatcttgcaccaccattcgtgggtctttgctactagagttaacgtaacaactggctagcaacacacatcgacaacctggcacttcacgctgttccggcttgtagtgatgcaatcaccgattctaaatgcttctggcgcacatgtcagtagactgtggcaggatatctatccgactcctgtggacgagttctctgtaaaaagccgtgagtctgtcgtcatggcgttctgtacccacattcccttccgtaccacgcagtcgctcccttgtgttttctttctcagaacccctctgctgcactaggttttttcaagcttgatacgcacttaacacgtacgctaaagtggagaaaagactttaaactatgacttgccagccatggcggcggtgtatattggtgcgcgtcaagtgccgtaactcacagacctagtggataaatcgaattgcttttctaagtatgcaaattgagtagccttgagacgccccataggatggttaaaattaccctcgattgtggcgaaacgcacacaagccgattcgacgaacggttctaaaaacgactaactggcgtatttgcttccgtctgagaggtgacggtgaggagcgcgacacacctgacatttcgcttataataggcatcggtgcatcaccctctggtggactcgcagttttggcgagtaggaataaaggtaatgactcagtttattcgatctgagttctccgcgcccgtccagctcagctgtggcacaagagaagcaaacgcttacctttgtgaatttcttgccgcgagaaatctcatgccgcagagcgatttcccgtgttggcgcgctgtctcttgatgctcgagagagccacaagcctgtgtggatgagcgacggctgtgactttttgtgcgaatagtatcgtccaagctaccttcgacttcacttcacaccaaacctccgttttgccggttttatacgcatggctcgagcttctttctctggtagttgagttggcctttccaatgttgtatcacctttttcccgtaccctgtgcaggacgcgaactggcggaccattccggggactcgttcccttcgagtcgatactttgaaaccactggaggccagtctggaggagacacacgtggattgaaatgttaggcgtttttctcaatgacacttgggcgcctggatctatttttggagttcataagccgtgtcgttgtctgcgtcgatgccaacgcgttaaactcgacggcgaacccggggtgttcaacgctgcagcgacagaagccgttgactgcagttaagcacgctgggagcagacgacccaacagtttttgacaacacagagaaatcccacttgttgcttttttcgcacgccagtcctacctgagaacactgaaatcttctggcggatgtggctttgtgctaatccgacaccttcggtttcaccctgaattagtgtgctcggcactcgagtgagcttctaccaggtagccggcgtttgtgccctgttctttttgttcttttgcgttcgcaggtctgcgtctattcttcttttcaactctgtaactgttttgaagcaaacggttttcctttaggtcgccgaaactggagatccaggcttgtcatctgtcagtcgtacctcctctgggcacgcgctactgctcttcgccacaaatggcttgacttacggcgttctgtgttcatttctagttctgtgcggcttccggtgcttcttttctgatgcttgtaaccacatttaaagctgccgacgtgtctttttcgttgattgcccatagttcgcgccttcgttccctttttaatttccgtacctttagtcgtgtgcttcactgcccttcctttctcctcagctttcttgctcttcgttttgtgcctcactgccgttcctccttaatttccgcgctctgaatccttcgcttcgctgctatcttctcgatttttgtgggttcctctccttcgcttcactgcccgtttcttgtcaatttccgtgctctgagtcttgcgtttcccggtagcatattctcaactcgctcttcctggtaaaccgcgaccgcgcaaggcctcacttttcacgcgtgtttcgagacttgtctttcgcgctttcgcgcctcctcaacatacagcttttcgcgtccgcgcgggacagccgcggtgggcactgacagcactttccctggtttgtttcgcaggcgttcacggcggtatttcagcggatttccattcctctcagaaaggaagtccgttaaaagactctcaatggaggagctttgagaa

SEQ ID NO: 3093 - DNA, 4410 bp, Toxoplasma gondii
accacactttcccgcgactgcgcagatccacagtgataccacgacttggacatgtacgtatacagctgtttacatacacacatatacatatatacacatatgaatttatgtgtatatatacatatacatatatatacatatacatatatatacatatataagtatgtaagtatgtgcttatagacagatagatattcatacatttttcgacggaggcatgcgcactgagatgcgatgaggcgagcgcctggctgcgaaaaataaaaaattggagctgcggcgttccccagacgccttctttccttctgtgcgttttgcgtccgcttcacgtcgaggcgtggattcgagtgtcgtggaagaaagtggaagcctttctgttttccactgtctctacccagtcgcttacctcgcatttcatccatggttgctctcgtcgaaaatagaaaacagagcctaagagacaccgaaactctggcaaaccgcctgaatggtcctcgcctcgctttgcgcttcctcttgctctcgctcgtgtcttgtgcgtcctgttgttatcgctcgtgttcttcctctcgttctccgcgagccgcgtggaaaacaggcgaggcaagctgagagagtgaaacgctggcgagacgcccgatacttctgtacgtggggtgtatgtccactggagtgtgtgtaccccacagaaagggcagggaggaggaggcgactcggggaagacggagagttgcgcaagtcgaggaaaaacgaaaagttgggagacaaggctccaccagacgttgaaaatactcacggagaacagctgaccggaacagcgtgcgtacacgactgcagaaaggcgagtgcagggtcgcggagacaaacggtcctgcccttggcttccctcctgcagacagtcgtgctcgactcggagtgtggaagaaagcgacgacgaaatcgcgcatgcagatctttgcacgtagtgccccagctgtcacccttccgtgaactggccgaggcaaaggaagatcgccggcgacctgctctctgccgtggaaggccttcttctcggactgcaggcgtcaaaaagcaaaccgctcgaaagacaagcaagtcgtttctgaagagtggaggagcacgcagtgcaggggcggagaacgaaccgagagaagagaaggcgcgcagagacggaggaatcccagtctgcggtctgcgtcttttcgcgcaactctgcgtcttcaggcaatttctgggtgccttctcggcctccccaactctgcgcttgccaaggcaagaactgccgcggagaaaaaaaaagagacaacggagacgatggtgcgcgcgagtcgacgaaaaatcacgagtgtacagagccgtcgagatggaggtggaagcggcgaaatccggactctttccacgaaggaaaacggagaatctgtgaagtcaacgcggaaagaaaccgcaggtttccccggatgaaaggcggaaaagagccgcacagggagcaacgagaagtggaaccgtacctggccgcctgtgcttcttgccccctacatccacgcctgttcagtccagctgagttgggagagacaccgagtctctggagcagagtttgcgcagagaaatcgagcgtgaaaatcaattcaaagtcctgtttcgaaaaaagtttgccgcgacgtctgccgagaggatgtacactgcgctacgaccgctcgccccgcgactggcagctgtggcgacttcgcggggagagagagacgacagaaaaagcttctttctctgtataagcgcgcggccgccaggacagcggccgaggctgttcgtcggcgaggtgactctgccggaaaaacgtcggcacacaggcaaaactccgcagtttagtggaggagtggagggaagaaaacggtgtgctcgtcacgcgttctctgccgacccccctctctcggtttcgctggcgcttctctcgtccctcgtctgtttccaaattgcctcactcttgcgcaggacgcgttgtcgatcgcagcggagaaggaagcgcgaggcttcctcgagaaccggagaaaaatcgacagagaggctcttaaacctccgaacagcagcgggagaatcgcgcgcgaccgagagacagaaggacgcagaggggaccgcgaggctgctcaaagtctcaggagaaaaccgcgaaaagtgtatgcacaactggagagaagaggtagagcaagaagcgatggaagaaacgactgaatctgactgcgttctggaagagagagacgtgtggacgatggccctctaaaaagcgaagagaaagtgacccgggggaggaaatggagacagaacagagcacggggaggacaggtctggcagtacctttctgcgaatctcagtccactgtcgaaaacgtattctacgaagatcgaatgcagaggagacagagggaacgcgccttgaaaggtttctttttcatccgaggaaagcagtagctattgtcagtagatatgaaactaaggcagacgtacacgcggtagttaaaaatctgtaactccagttagataatcctcgagtcatgtgaattgaactacacaagaataccagagaggcttttgtgtagcatgcaacatcctaacttcctgacctgctgctacttctcgaacaaaatgttgaacgctaccaaatgcacaagatactcctgaggtatgtctaaacgctagagtgatacctgtaattatgtggagtacaaagttcattgcaactcagaagccaaaactgtaaaatgaatttcgatttagaacacaccggtaaaaggacaaggtgtgctcggagcatctgtcattaacatatgaggataaaaggcaaccttaagcgcggtatcaatgccgaatacctgcaggagtgctagaaccatttaaatgtagggaggagacctgtaaaactattacaagacaacgtataaaaggcaagataaaacctattacaaagaatcgccttcgtgttgcatcagatacgtagtatccttcaagtaccaaatatggtattagagaaaggaggtttgtggtgactgtatcaccccagaaactcatttgttcgccaagtttttatgacagctaccccactggactgttttagacagctaaaagctgttggatttcaacatcgtacgacattaggttattccatatcggtgatgctctacgcgtatcctgttttttatttacggtatgtaaatgcgctcaaggtttaaccgtcgggccatatcgatcgtcaaattcaaagataatcctatttttaaaagttcttgatctttcccggagcttctcgagtctctcatatcacgcgagacttgctacctcctcggagttttccggcgtctcgccctcagcgtctgcgccgtgtgtacggcccttcgcgttccgtcgcggggggacttttctctcgcgcattcgtttcgagttctcccctgcaaatctctgcattctcaaaggaaagatctcactttcggagagacaagcagcgacgaacgagaaggacttttttctcttgttctctcgcggtccgcccagcacaccacagcgcttgtccgcggctgcaggggcgctgtctctttcaccggttcttttcatatctgcattttttttctatttttctgctctttcgacgagtacgtatttcttggacttgtgtgtctgctgtctcgcccctttcctttttttgcgcgcctcttctccctggttcaagttctactcgatctcccggtgtgctcagtttcttgacttccgtatagttctagtccttcatgtttcttcctcgcgaaaaagaatttatttccgccatccacttgcgctgactctcgatttccggaatccgtcgctggtagaaaagtctccatcaaggccatctcaagttttttttcttctctctcgcaagcgccgtgagttctccctgttgggaatctcttgtctccgtctgtcccggtgtacatacaccgcagggaaggtccgtccctcctcacacaaagccccatacgcgttcagcgtctgatccgcgaggttcgctttttcactcgatgctccaaagaaagccagaacgctgcgttctcgcgcgacttgtgcctttctcctctcttctttctgtaggctcgaagcctcgcttttctgttcctgtgctcatcacaccccaacaactcgctcgcgctctccgtcgtcgactccctctctcatttcttcactcatccagaagccgactcccctctgtctgcgtcgccgtccccggttcgtctctcttcccccgaggctctctgcagcttcttactgtcctcttcttcttcttctcctttgccggcgacctcgcgcctttgcgtcgtgtgtctctgaagcaagagagagcattttttgttctccgtttcttcaaaagaagtcaccgacgcccgccacacaa

SEQ ID NO: 3094 - DNA, 1839 bp, Toxoplasma gondii
atccagttcaaaatagactgctccattcctggagagcttgcgtgatagtatgccctaagcaatatgatgtcacgatgcccttcttacacaaatagtacagtgctggccaagctccttgtatccacttaactcgcttcgtaattttcattagagcaaacgatctaaagcaagaaaacctcctcatgcaacaagatgaaagtcgaggactgtgtcttgtctttctttaacaccaactttcacgacacgattacacgcaattgggagggattacacactctacaaagagcgcccgttttcgaagcacaaatgccattgcaacaaaacggcaaaatacacatatatacacccgcagccaccccaagacagcaatcgcagcacctgtcgaattctaccaagccacacgtacttcagaagctttgaagaatgatttaaatgcattctgtggtgattcatcgggctttccacgagtcttgggacgagcaaaacgtgcatacgtcggcaaaaggtatgcgagacttccattctagcggtagaacacagcgcttcttccgagagtccacgctttctcggactcgactcgtctgtatgaaaacaaatgcgggcttctaggtcccctctttgtccactgacttttggaaggcgagatggtcaccttcacatctatcgctgctgcccacacaggcggcgacaggaatccacgtaacacataaacatacttagatacatatataaatatttatacatctattacgtgtagaagatcgccgctctcgagtgtgggatactacacacaactacctgtatgttgacctagtgcagtggggggcatgagcagttctttgaaagggaatagatggtgatttatttacacggggaaaactggaagtcgctcccgagcctaattaatctctgttttacttgtggtgttgaggaattcccgctctttccacggcagaaacatcacgttttgcatgccctggagagacgcgtcttcttcgccaggcggctgatgcgccattcagagttgtgtgactcctatcaaagaaaacagagctaattgccagccttccgagatgtatttatcgtcctgctggacagaaacctccaggtgaaagtgttcttagcagaccaccaggcgtaaaaacgcattcgctccgagcggagagcgcatgcacgcagcttgttttgcgtctggttgtctttacactgtcttgtctccggcaaagtgaagacccttcgactttcctccaaagccaagcggcatggcagcatgaagccgtctgctgcctggcaggcaatgtcgaggtaagtcggatttgcagttgttcttttgcctctctctttgtccgtcagcgtctccatctcacgcccgccgcctgcgtgtggaccttcgcttttcctgaggccggacttctcttcggtcctgaactgtcgactctttcctccttctttcagcttgttgtgcaagttgttcagctctttctccccgagagttgccctgcttcacgcaccctctctcgcagccacaccgaagccggaaacgatttctcagtttaccggggccgctccagactgagacgctttgcttgactgagcatggcaggcactttcgattgcgtagatttctttggggctcttcccgcacaaatttttcctctgaactccggctgcggcgtctcgagtctttacaaaaatgacaaggaaaatctcctctgagaaaagaatgcgtggatggtgcggaggtaaacccacatatgcgcgtgtgtctgagaggacaaggtttcgtttcatgaactgacagacgctgctctgaagccgggactcgccggactgtaaaga

SEQ ID NO: 3095 - DNA, 1794 bp, Toxoplasma gondii
aagaaagctctcgacagtacgaggccagggtcagcgtggttagcatccgcagtttcctcaaaaggaccggcggcagagcagggaaatggctggcaccatcttcgagagacgagctttctccgacggaggaagcatctgatctcagaccttgtcgccgcctatgtcgcccttctcggtagtcttcgacggtccccgtgctgaacagttgcagggtagccagaagttcagtgagggttagagagacagcggaggaaagagcgaaagatacagaaggcgcgtcggatgcctgccgaaggagtgctactttcgggtgattgagcaactctgcaaaaaaacagagtgaaggatgcaaaagagcttcaaccagaattgcccctacagctcgaggctcgtcgtcgacctcatcgagtcggcgacagaagatttccacgcagaagtcggaggaagaaccgaacgccgaagcagaggttgaacacggaagcggggggcacggtggcaatggcattttccacagctgcacgactacacagtcttcaacagtgcaaatggtcgctacgtttctctcttatccgcagcttccaccgcctcaccggcttctctccgacaagggagaacacagagttaattcttcaccaaggacaggggtacgtagtggatgtcaaaagacctaaaaaggtgggataagtgtgtcttcagcctaacactcacaacgagaaaatgatgacgcaacagaaggaagtatgtgtcaacagagggtatgtttagccgggaagttaacgtctaacaaatgcaaccgcgtatcagcttgagtcctccgtctcagcaggactttagagagtcataaatttaatgctcacacgcactttgtccacagaagaggtaacaccaacggcaaaggaactccggacgaagggtgaaaagcggagtagtggaattttggattccagagaagatttgggcatactgtgagcaacgactcacacactggggcacccgtcgacactagagtggcggaaatacagccttttcagctgtaggatcttccgtccgagagtgaagcgcttttctcttggaaaaagggaaagggcacatgatctaggatttcgtacgcggcactgaacagcagattcgatgatgccgacgactctgtgacgagacagcactgtatcaggcagtaccgcggggtcgcctgtgtcccaaggaaaatcaaaatctgccttaattacagatacgccgaagcacatgtagacgactggtaaacggttcatggggaaatgaaccccccccggaaaactcgcgacatcaccgaaacccgcgtagctcgcaaacggccggcacacggcaatgtgcatgcgagcttcgcaggctgccttttcattgaagtcgtttcctctgtacaaaaggcgccggacaaacagttgaatgtgttcccgaagaagaaacatttttcttcaaacgccgtttggcggcagtccgccgttacacggggaaaaagcgaatcttttcccgtgacgaacaagcgctggcggttgcaactgcatgtgtagaccaggacctcagtgttcggcagcagctttctacggaaaaaacaagcgttcctctcggctgccgattcgcctcagttgctgtcttccctcaacacggcaaaccaggctttatgccaccatacaaggctattaatgttgggtcttcacgtgtgggcttggcctcaagcgtgtgctcacgacctagcgaggaaagaacggtccttccccagtgtacgatagcaagcgaaattgcagaaaactgacaaga

SEQ ID NO: 3096 - DNA, 1902 bp, Toxoplasma gondii
tgtattacgctgtcaactcaagctatggtgggcagccggtgtgggttctcctcgcggcttgtctgtgccaagcaagggggtttcctttgcacaggtgtccgttctggaagtcaatccgacatacgcagcactccagtacgttgcccacaatctccagtggtgtgctgtagacatcgaagtgttagaaggatgcttttgttcgaccgtagaagccgttgggtacaggtggcacagtgctacggggaagcgccgcgggaaggtccacagctgttggggtgaacaaattcacaacctgagagaaaaaccggtctttcgtcagacctcagacgtgagtgctggttctagcatactttgatcgacgaaattgagttctggttagcggaagaacctcctgcgtcgctactctgcccgacatcatcgttctgttgctgtgccgttggcgccaagtggtccttgtcaatgggccctgaccatttatagatgattatctgtattatccatgggcactgacatttcctaccgttctgtgtttgtcgaaagcgcattcgaggagtacagtcgagaccgcctgctgcacctttggatttattcggaacggtcactgccactccaaatgcactggtggtcgggtgaaatgcttttttagcggcaattgttctggatgtcagggttgcctgatcgcagcagtaggtcgctccaagtaaaatatctacgaaagcatggcttacattgaggttggcaatttcgttgaggattgctttgtcttctggaacgcaaagtatgtgatttcagacgtacccagtacaaaactgctatcacacgcactgctttgttctaaagtgtgtcggcccatttcggttatttcgtcctgaaggtcccgtatgatcgcagtcttctttagatcctccccggagagagctcaccgaaactgcctccgccattttcgctgcctgcacctgaaacgaagaggctcaaacctcaactccgcacaacgttacacaacccaccgtctgtgctacttgtcttgcttcctcgagcatcgctgcctcgtgttcgccatccttcgaacatgggaagctggagcataaagaccgtggaatagagtggggaactgattactcacatatatgcgaagctttatcgggttcttgcggaacggttgtgttatgtacattcctcggctgcgagtgagctctcatagacagtgtcattctgtttcatcgcctggtaaaccgcttgccttagttcttggtcattcactggagtcctagccgctgactgtgcgccttgttcgacctgagtgaaacggctccctgccggccgccggggaccttgaagaacttcatcgaagactttctgtgactcatcgaatgcagccgtaaaattctatttcaccgcttttctatagctgatatctagcagttaatatcggatgtgttaccattctcgctctttcagcttccttcgtcgtttcccaaagctcgcgagcgacggtgacatcgccctccggtatttcccggaagtctgggaccagagtcgtaaagttgtctatattatccatattgagaccttccgcctgaagcaaggtggttataatcaatgctgaaatgaagcatagcgccatgatttttatggtcaataaaaaccgtcgagacgagccaatcgttgcgctattaagaaaaagtgggggtttcgtcgtccgtgcgaaatccatgcggatcaccggtgtagagacacagccaccgcaaagtcgcaatctaccaaactgtcgcgctttcctgcttacaagttcgtgagagcctcttcggatctcacgtgtgaaacaattagtcaaatttgtgattttccatggaaccgcgtacttgttgtatcgccgcctgtccgttcatgtcctgagcacca

SEQ ID NO: 3097 - DNA, 1893 bp, Toxoplasma gondii
agaacagccattgcgtcctccgtgagaatgagataccactctgcttccctctccttcaccgtgtcttctcctcccctcacctctgcttctcccggtgttttttcctctccttctttcacctctgcgtctccatcgttcgctttctccccgctttctctcatctctgcttcggcttctcccgtcgcctttgcttccacggcctgcgctccagacgcgtccggggcttgggtgggagggtcggaggcgaccgcggcagccgcttcgctcttcgaggacacagagggaatagacgaatttgaagaaacaacgaggctcgaaggttgttcactctgctccttaggagaagatctttgcagtgtcgaccgccttctccctctggaggagacgggagacgacggagagggcgaaggaggcgaagcgttctcggtctccggagtggcagaagtccgagcattctttgcggtccgcgcacttcttcgaaccatggtgaacttgctggaaaacaaagctccaaacaaatctagaaatccaagaaagtcctctccaccctcggcgaagccttcttcattccctctccttcgttccgatgttcggcactcctttctcggcttttgcttgtctcttctctccctttcctctgtctcgcttcccccttcagggccgccggcttctgtctccacgaatgccttctcttctctcgaaatacggggagaccaaccacaggataccgagtccagagagccgtgaaaaacgcagctgtggcttcacgcgtggattgacacgtgagagaggtcggcgacgaagggcaattccgacagaggcttctttcgggagacttcggggactttgttacgtttatcttctgacgtcgaacggaaaatccgagcagccgcgccggcggttgagaagacaccgaacggacggcgacgcagacccgccacacacggcctgcaggagagaagacgcattcgctggaggaaaaactttgtccagaagttgtgttttgatgtcgctgcttccgggcgccttcccgctgctcaccacgacggggtgcatggacaactgagacgcctcggagaagcttctgccgccgtggagagagtcgaagacactcgccggcggagaacgaaatgcggggaaacggagaaagggaacgagcgaacacctggtgaacgagggcgggacctcgagaaaaccgagtgagttttctcacgacaaaaaaccagagaaccacgcacaggttcccccgtgttcaccctttttctcttcgactcatgcgtcagcagacatctgcacagagagcatgccctgggcgcgccaacggcgagtcgacatggaaacgcgaatcgccttctcctgctcacgctgtttccaggaagatgttgacgcgtttgctcagaaggaaagaagaaggtgtcttccgtctagaaatttatcttttctcttcctgcgtctcgcaactgtctgcaatcgatagcgcgccgcacatgtacgcgctgcgaaaggtgtacatacacccggggacagctgtggcgtgtgacacgcggacaagaagcgcacaaacgcaaatgcgaagctgagaggtcaagtcgtacacagagaaagcagagccgagtctctttctctggagttcttttctgccttcctttcttctctctcgtctcctgtctctgtctccttgaattcgcctcgcgcctctcccgtcttttctccccgtgcttcgcttctgctcggctcgatgctcgctgcggttgaccctttcgctctcctcgttcccttttcctgcgcgacttccgctcccggttgcttcgcctctctgtccttcttctctgacattctcgctcgtcttcacctcgactccgctctctccaacttcctctccgcttctgtcca

SEQ ID NO: 3098 - DNA, 2758 bp, Toxoplasma gondii
aagaaagttcgaaggctgcgaacgggagttgggctttgtcatttgttggcgtcgtggagaatactgtttttccaaagattttttcgaacgaaaatgggacccttgtcgaccgaaagtctcacggatttcagattcccgtcaccagctggtactgaccctctggtggaaacacagccggtttctgtcgtttctactgtctgtcgaaaacctgtagggttcagagggttggtcgcaaaactgtggcacttctgagggctgcaccactgtcgcgcatgtgtcgccttttctgtggtaaggcggctgctgtcagtccaggggtagcacgccacttgtcttgtaccgaccttaacgaaatttcctttgttttccaaaacgctttccacgcttacatacacataattggagtcacactcagcatccaagaccagcattcttctgaatattcgacttgagttttacagctctaggtcgcgtaccattatttgcacagacaccgaaactacatcttccttggaaaattcaagtccacggttccgatcagctctatgtgttcgcgtaatgccgtctttgtacggaggacagcgtaacttgcgtgttccatcccgatggagagactgggtgtcgggctccccagaacgcacgcgctgtgtatttcctaggacaaacgtgtttgatgtcagttacctacaaaatctgttcagaattcactcgtactgatatgtagagcacctcggagacaccgcagttccgtgtgacattttttcttcctcaaacacgctgtgtaatccacaacttcagttgcgttgcgtagtttcttggacctcacgcaattcgccttaccacttgaacacaacatggaagatatgccgttctggtaccttcttcgaaggtgttcctgaaaaacgccttcttgtacggcggttcgtccatcggttgcgctttttcacaagccttttaatggattctgctgagtttttaagccctcatacctataggtctgcttgaactcaaaggtcaaccaggtgccaacgtacactaattcatgatgctgacttttgtgtgcagctaagatgattctcggttttgcttccggaagtttagactgctgaagttcgtgtagtggtagcgaggatcacctttccccgtttccgatgtttacccgtataaaacgcttccgtgttcctcgctgtcaccccagtggacggcttgatacagctaaatgtgttgaatttcaacatccgacggcattaaggttgctccagaacagtcgtgttccaggcgtaacttacgaatttctgtggcacagtagaacctggatccggcaaagaagacctgcaagaccaatgctcccactggtagtattaacacgtaccgatcggactgtgttcctcaccccctgccacatcgacgatttgaacgaaagtagcggaacttgggtccggaggtaaagacagtcaagacctaaacaaacggtccacttcgcagtaactactccttggttaacgttaacctgactgaagaattgtgagcctgtggaggccggtccgttccctaggcacgactgtcttgccccgagaaacaggggcgtctgcgcacttgaaaaacacgaggtgacacctgaaccctaaatcctaattgggcaccctgtggatctccttggtttgagttgaattatctccgcggagaaggaagtgatcgtcagttcccaatggtcgaggcctgcctcgcttgcagccatcgcgaaaacctgctactatgcgtgcatgcaccgcagtgcaaagagcgtgtcttctcaggcgccaaagccgatggattgaacgaatttcttcatatcgcttttctctccatgaaatcgacagtcactcactttcaggaaatgaaacatcatctcgctgagtcgttcgggagttcgcaaggcgtggcctctctgttgcatgctgcaattttctcgcgcgagatttaggcaatcccgatgatcgactgttgcattcctgtgtctggatctttctgaggcgcagtcagttcctattctcatgcatctctccaatctgtttccagattgtcttaaaaggcacgaactgaactgaagtcggacccataggcctgcgagaggagtgtcccgttcaaaagagcgccggaaaacaagtgactcgtatcctttttgctggtcgttttcacgcacaggaaaatgaatttttaacttggtagtagcttcttgtttcttcgacttgtctcgccacaacctgcgagtgctggatccagaggtgcagcgaggcagagcagctaccggttggacgtcgacggagtacaatgtgcgtggaggctcgcatgcttggacttctttcgcggtttccggttccttctttaatctattcgtccgtatactcggtgccttccgaccagttttccgaggaactctaaaatggcagtctgtgtagcacgtttgcacctcagttgttgacgtctctcggactttctccgcacccagcgctccggttcgagcgccgagttgcagctcccgtgtccgaagcagttccctcttcgctggaaaatcggcttcttggacaaggcaccttctgcagactggcgtcaccgtgaggaacaggcgcaagagcgggggttgcctgtggggttagaatctggaggcagcgcgtggaagcttcgtaccaagagaacgatgcgaagatagggtgtctgcagaagccggagacgcgaagacagaacgaacttcttcgctgccacacggcctttcacagga

SEQ ID NO: 3099 - DNA, 2452 bp, Toxoplasma gondii
cgttctcccgacttcttcgagagaagcactcggaagtccttctcaccctcagtcccggagacgaggcgcctgtacacgtccccccctcccgctgcgccgtctccggaggcctctgcagaaggcgccttctcagctgccttcgttccgtccgcagcgccgagagaagactccgacctcgagctcgcgaaaaaccggaaaaggtttctccgcggtcccccgcaactcggaagcagcggggagacgaccgagtccccagaagctgcgccgacagaagaagccagaggcgcagactgcatggagacagagcgagaagaaggagagaagagagcagaggaacagagagacgagagaggagagagaggagagactggaggagagagaggagagaccggaggagagagaggagagaccggaggagagcagaaagcgagaccggcgggagagggagacggggaggaagagcgcgagggagaagaacaaggtcgggggagaagagcagggcaagctgcaaggctcgacactgaggagagagaacgaagagaggaggtgaaaacagcgggtatagccgcacaggtgaacatggcgaagagcagagagcgacgagggagcacagcaagccgagaaaaacgagaaaacggaccagccatagtcgtctcgaagtcgcttcgaactcgacacggccggaaagcaaacagggagaaagaggagagacggcgaaaaaaaacgcggaggaggaagtttaaaaacgggcagacagagagagaacaaacggagaaagagagcagaaaagaatacgacggaaacaggaagaaagggagaaaggaaggaggagaaggagaagaaaagaaagatcagaaaactttctcgaagaagagtctccttgggcagcacctgcaagaggcacggcccctcggaggctggtgagagagatggaggaagtcttcttcgagagataattatttgtgaaatatatatatatatatatatatatatatacagatagagatgtttagatatagatattgtattatatatatgtatggagatagactttgcgtgcgtattttttgtgcacccgcctatggagagacacccacagtctggcagcaaagacagaaagagagaagagagacacagagggacatggcgatagacagagacagagagacagagagacagagagagacagagacagagagacagagagagacagagacagagacagagacagagacagatagacagagagagaagcgagaccgcaaggagagaagccccccgcacacagagaggctcaagaagcggtgacggagagaagggtgaggaaaagagagagcggcgaggcgttgaaaatggtccttcctgaattcttgagtagaaaggctctcggtttgccggaatccctgcggcgccgacgttctcgcggaaaacggaagggagacgagagagagttttcacgaaaagcgtaaaagagcttcgaaaagaaaggtcttttgggaggtagaagacgaggcaagacgcgaaaataccgcgaaggactgttctccgagaaagccaagcagccctgccgcggaaaaccatgagtgaagttgcagacgttgtttggtgagcttgtctcttcagaattgagtggagtttttcaacttaaagaaaaggcagcgtgtgactcttctctctcgacagacaacatccggcttcttccaggaaagtgacttctgacagttgcgcgcaaatctcccagcagaggcgctgtctccgcgtcccttataaagggagggggtggggctttctagacttgcgtttgaatttctcctcttctttccgtccttttcataaaaaacaaaacactgtagcatgagaactctgccggctatttgcgactttgggctggcgacagacacaacacagcctctggaggcggtcctctttttcctgtgttccgctgtcctctcgcctgtctcctttctctcgctttctcgcttctcttggtctttctcttttcctctttcttgtcatgtttgtcgggtgtaggcgagatgctttcgacggaaagatgcgcctgtctccgagtcgcaaaaccaacgcaacaaagggccagcaggagacagcgaagagactcagttgtggctctccgaagggaagaaagttcttcgtgaccgcagtttgcctcttctgactctttcattttttccaaggttttttgactcttcttgtctctttcgttcttcgccaagcatgtaaacctcctcgacaaacggacttctcgtcgacgacttgaaacgcgcttctcgcgtttccttctctcctgaactttcctcgcctccttcgtcttctccctcgtctcgcctcttctcttctctcaagtgtcttctttctctcctccctgtcctctcttttctctctttctttcctcgtctctcccttttttcgtcgcctcctcctgctcgcagga

SEQ ID NO: 3100 - DNA, 4770 bp, Toxoplasma gondii
tcttctcgcagcagcttcgtttctctctggcgcttctgtccctttgcgctctccgccctcgtcagcgtcgcctgccctctctccggttctcgctcgccttcgcctgtcggctgcgactcgccgcccccgcttccgtcgttgccttgcagagtagcagccctgcgaatcgacgcgctcgcagcgcgactgccggacggttcgccggctgcgtcgcaggctgcggagtttcgcagcatactcgcggtggcagagagccgcggagagtcgcagctgccaggcgaaggcgaggacgtcggaggcatcgacgcggcggccgcggccggacgggcaggtggactcccgtcaggagacgcgagtgtggggggcaagaccgaggaagagaaggcgcgtcggagccagcggccgagcgacgaggacgtcatgactggaggagccaagcctgcaaccgcagcagacgagcgagagagcgaagccgaagcggctgaaggcgaaacgagcgcggacaagggagcgaggggagaggggagagagaggagagagagaggcggagaagaagagtgaaagacgggcgatggaggggcgcaccgaggacgagaagagcagcgaagcgaggcagacgcgagagagcacgcgagagtggttgagagaacactagagggcggtggagggaagagaagtccagactcgcaaaagggagaaatgtccgaagcgagagaaaaagagtctctccgatactgcgccgccggactgctcagcggcgtcgcagcagagactcgcaaaagcggtggagcagcggggaagccgcggagcagcgcggaggctggccgacccacagctcgggtgtatcggcacgccgcgccagaccggacgaggggcggcggcgacgcagcggcgagcgagcagcctcgagaaaggcaagcgagcagtggcgccgcgaaggggaagcgaacgaaacacaaaagcggaggaagaaggaccttgctgcaactcgaacagcgcagaaaggctggccaccacgccatccttacgcgacactcagaagccgggtccgacgcccagacggagaggaaacgaaggccgccgggaagaaggaaaacgagaagcagagaagagagaagaagaggagacagaagccaagacgcatgcaacggactcggcgttcggtcgagagggaagaagcggcgagagaaaaaagagaaagaaaccgataaggttcatcggctctcgaataggcaagaacgccatcacgaggaagaatggtgaaggccaacgtcgcgtggtaatcttcaaagtgtggagacatcgactttttgtggactcggagatgacgaggggaagcgaaagggcgccgaatcgacagaaagaaggacgaaaaagacccggcagaggcaggtttccctggcaggtgtgccgacgcctctgaagacatctgagacgcgaacgcgcgcctaaaatattcgaactgcagaagagacttcgtggacgaagacgcggaagaaaggcgagacagagaattgccaactgctagagagcacatttgcttgctgacttcgagcgcggccgagtgaagaaagtctgtggtggaaccaataaaaaaaggaggggaacgaggggaccagcgcgttctcagccgagcgtgattccggtgttgcccgagacgtacacgaagctggcgagcggtgaacgagagagcagaaaaatcccttcggaaaacgcgttccagtgaacgcttggagagagtaaatcgtgctgaaaccggcagagtggagtgcaaactcctgcaaaaggagaaacgaagagaaaacctcggagaggctgcggccacgctctcgcttcccgtctccgctgtccatacgccggaaactcggagcgagctcgcgcgaaatccaggagttttcacaaggcaaacccgccagttttctgcactattcagcgaacctgcacgcgcatccacgtctgcaggccctgcgagcaaagaagcggctggaggtattgctcaggaactctgcaaagaaaaggccgggaactggagaggcggcccgcggtacgggaaacagctgttctttttttcggtgcagctggccagatggtcgaaaaaaacgcagaaaacgcaaggcaacggaacacagggaaccggtgaaacagcggcatgcgtttcagacagagagaggggaatggcgggacaccgaaaggcaatcaagagcttcagaacgtttttcgcctgcttggctctgaggactgcgagagctcgtcgccaccaaggtcacgcaagccatccagacggacatgcggaggggaagactgcggatgaaacgccggatgtttcgcaggatcgacgtcgcgggacaagcttcggtcgcttggagcttcttcagatcatttccgtggactctcgtcgccgcgaaacaccgcttttctgcatcgcgttcggccgagaagcaagccgccgaaaaactgtgggttcctgcgctcctcacgcagtgcaattccacagagtcgcgacgaggacgaacaaggaaaaggtttttgcggaactccaggcgtttttccactctttttctggaaaggttttcgcgagaagtcgcgagggagccggcaaagtcgcaggagctcgacgcgacggcggccgggacatgtgagcacggagaatgtgcaaaagtccggcataattctccttgtcgcaggctacatcagtcgtcccgagggagacacagggagagtggaccccgacaaagaaactcacgaagagagaaagatgccggggaaaatcggcgagggcgccgcgtcggcgaaggcaagacgccggacgagagttccttcgcctctccgtcggcctcacagcccccggacaggcaatcagctgctctcgcctcggacgcgaatctccaggtgctaaatgctagattcgtccttggcagaaacgcgccagccagtcaacacacccaggccgagaaccggatgacggcttctcgtagcccacggcgcccaggcgttcttgtccgtcgctcagtggcctcccttcaagacgtccaattttccactgaacactgtggaacctctgcttcagaatcgaaggagaaaggcaaaaagactcgcgcggatggcgagcgcgacagagagcagcatgtctgggtccgcttgccgttttccccatgcgctccctcgctgcggtatctccgagaggccgaccgcggatgaggctgagacacgcacacacccctctcactcagctttcgcgaatgcggatgccatttccgcgagaaagcgaagagcactgaaccgcgagcgcgaaacgaaacagccggtcctctcctcagacacgcagcatcgcaaatgcaaaaacacagaaaccgtagcttgacgatacgtaggtgtgacgatgtttcagctccaaatgcgcggagcccgcgcaggagaacaacgcgtaggaggcgcacagccactaggagagtcgccttcgcggaggaggcggtcgagctgatagcagactagaatagtcttgtgagagtcacagttctaggcaagcgaaaacgaaagagatgaggacaacaacttagaacggatctgtcgattgagaacgagcagcaatgagggtcggcacacactcatgcctaggcgggagacaacacagaggtccatccagattccgcacgaatgctcggaatctgtctggactcggctctccagttttcacggccaccgaagccgttacgcaggactgatctgtgaaacgtccctctgtggctttttcctttttcgagaactcaagtgtctgcaagaccttttcggcgacctgccttcgcccactgtgaggcgaggagggcgacgtactgtaattccacatgcggccgacgcctcgaacagactcggtgctctattttttctttctttagaaggaaaattcgttcccagaaagggcgaaagcccggcaactgcctgtcgaggagcttcgagtgcctgtggatagtccgaaggtgtttgaagttcgtcttccccctttcgatttgcttctctactcgtcctccacatctacacgcctgtttctttgccatctgtgcccttccgtcatttctttcgcctctctctttccccgctaatgtgcagagtacaaccgcgcgtccaggtccgttcctgcggtgcaggtacaccgcccgcggaggctggggcttgggcgcgggccgcgcgaggcgcgcgcggggagagttttcttttttttgccgacccagacgacttgagaaagagaaaactggtttttgcttttccgactgggcggtttccttctccttttccgcggtcgcagagtgtcagagaaccccaggccgcgagtcttccgaccgcgcgcagtgcgcgcaaagacgcactctccaggagacaccaggcggggacttgttttgtcttcgtccattaaccggcggggcgttttaggcaggctcagtcgggacttccactcgggggagaaaagagcgacgagcggcgggtttcctccctctttctccagagcgacgcatgtgcaggtgttccgtcggtcgtggtcggcgtttctgctcggcttttctccacttttcgtctccctttgtcttcttccttttctttcctccatcttcgccctctctccgcgtttgttcaggagagagacaggagacttttcccgtctgcttcgtggtgtgtggcacccctctctgcctccgtctctccggcgcctccgcccagaccggtggcacccgtttctgcatttcctgcgatttccctcgattttcctcggcttcacaa

SEQ ID NO: 3101 - DNA, 3613 bp, Toxoplasma gondii
ggggtaggaaacatttctgttttgcaccgtttctccggtacccttggctgctagaccgtcacgaattcagtgatcctatatcgaaatatgtttactggtgacagggatttcttttggcagcggtgacgattgcacttaattcaaattcgtgatgaaaatggttttctgtcaaaccagcatactgcaagccttcattggtgttgacttgctttttgagctgggaaggcggtcgcgaacagagggacagtttcatagtcccgaaactcgctcctttgcatgttgcaaccaacatccgggtagccctcatggtaggggtcatgcgctgcgggacctaaatcagggaaccggctgcagttatttttgtgtagctggacgataaaacgcccagaaaaaacgtgacgagtgaactgagaagcaaccctgataaaggagcgagaagatgcttctcttggagcaactacatcgtttcagttttatggatcttcaccgacacctctgcagctagaacatcgtggcgaatgccgacgagagggtgggagaaacgaagatcaaccttcgtgtcgctggctgtcactcaatttgtgtttttgagccgtgcgttacgataatcatctggaggccaccgaaagaaacgacactgccgaagctttcccgcacacttggagctggtactgaagacagtttcagcagagtcagaagtgaacctgtggattttgtacgccgggtcggggaggggtgcgataggaggggtccagactagtttagtgagggtatttttcttccttttaaatagcgggcttttgccgggtggcttaacgttcaagttgagaccttttggaagaaagcaactgcacagctgagacaagctatctttttatgcttgaataagaaatgtagttcttgctgcggggtgctgccggaccccttgttaaaagtagtgtgctggtgcatccagtttgttcgtatgtttgacccccttgaagtttttcctcctgcgaaacacgtgtcgtgcgtgtactggtttctagaaacctctgtgcgagtgcaacttcactgcgtgtcgcgcacaactggaatcccacgcattcgttccagtttctactcttctttatatcacgtttaacggcgtgagagcccactagcggggtagtagcatgctccgctgagtttgcggatccgatatcgatattcctaaataagattcgacatagtggagatggtgttagtgtcttccgttctcactgtgtagaacctgcagggtaaaattaactgtgtctttttgttaattgtccaaaagggggaagaggccgaacctctgccatgttcgggggcttacaagtttcatcggagtgtcatactgatcagaattgccatttatttctttagaaagttctcttttcgtcttgatcgtactggaatcaagtatgatgcagaatttatgcgtgcgctcttctctatctaatcgggttagatgcatatttacgccgttatattggtgttcgtttcaatttttcccgtggatcaggtaatgagaaagaagaaacgaagcataaggcatgcgaaggcacgggagcttgattttcttggtgccattaccggttgtcacttctgagtacatgtatccgtgtgcatctgaatggtttgcgtttaacgcttagatgctgtggcgagactgatgctcacacagggagcggaaatatgttccgaataacacttttgttgccatcgttcgaccacagcggacactacagaatcggctatgcagtcaagctgggccaatcggtggacgcagtttacctggcgtgggcaacgcacaccctctgtgtgcagttccactcaagttgcccgttcgatcgattaattcgtatcgtacacggtgcaatctgttcagtgctgcgtagaatatccaaaagttaacgcctgctagaaggcaaaagttacatcactcgtttccaatctccgcaggcccatcactctcagcagctacaaacattggggcgctgcaattagcagtcactcgatgcggaaccatgctgcctcaggtgggaagatcccttgtgtactgtatttaaaaacaacacacctagaaatctggcacctggccgagcagtttgaggatgaccaccagctttgccaccaaggacgaaacccccagcagaactgttggctcaacgcatgtggaactgtgtgaatcctgtcgcagggatgttagtcccagccttgtacctggacaagagtcgcgccagtggtgttatttagtgatttcctttctctctgattctatgcctgctccttctccgtggcatcaggtgcttcgcttggatgcacgttgctgcagcgctagcgattgctgagcatcagtctcaaaactcttacacaaaatctttcagtatagtgtctgctttcctcgtccagagactttgcagacgtaagggtgcgaagtattcggaagcagctgtgagtttcatcccagagcggtgccagaggtttcatggtcgttaacagatgtccttgcgatatctaggtggatacccggaacaatgtgcgaaagccaatgagtggacacgagtggcgttgttcttgccgacaacagggagtgtccaggcagttttgctgggtggcaaacacgtttacgaatcccaacgttaaattccttttcagaacttctaaacctcctggccgacgtcaactgcatctccccctgttgggagaataacagagacgggaacagacaagaagtggaacgtcagaccagtagtcgaagtcgcgtaatggcctttcgcaagcggaactgcatgctgaggggcccacaagtgaagctggattaaaggaatcatcatgaagattgtgttgtcagaacgccgatggatgcttttgaacaacactcgtcagacagaagggctggggccattgcagcatgtgagaaatactgacgcgcagaaagagatgatggactgtgtcttgccatcatatgtctccttccagcttcgcttctgtacaaaaagatgcgcaccctgggaaacaagaaacacaaaattaaacgacatcgacaatcggaaaggtcgaaaacgacctgcagtaccgctgatcgttggttttcatgcgtgctgtgtttgtttctgctttgacacgcgattttgtacatttggagattcaagccatgaaccacttcgcgaggacgatttcggtttctatctgtgatgcacacggaattctctgtcactttctgacacatttcatgcccatattaaaacaaagtgagacccaacaatcggtggatcttcatacaaagcttggatccgccgatctatcttttgtccggtgtacgggaattgcgcgacctgtggagcagtgcttcctcagtttccatgggaagagtctgtgcatgtctgaagacagatccgtattgcagtaatccgcagattcttctgcaaccaagaagacaaatcaagacactgacaaacacataagccagagggggaagaaatgtcggagtacctcaggaactacctggccaaagacggacacaggtaaagattctaagtgtgtatccacgcgacgctctcgagattgtgcgcacggtgccggggttgccggcgtggtttccttcgga

SEQ ID NO: 3102 - DNA, 3422 bp, Toxoplasma gondii
ataaggagttcgggaaacgagaaagacgaagagaggtagcgtgaaaaggaaaacgaaacggatgtctttaggcccatgtaaatatacagagcaaaaacgtgtcagataggacttgtaggcgctccggtggttgtcgtttctccatctcaaagacggacgcgacttcgttgcagcacaaaacgtctggcaggctgcctgtctcaggtgtctacatacgtggatatatatgtttggtgcatattatgtttcaagacgtaaatacaaatatatatgaatcacgggggtgtgacgatatcttatctgcgtatcaaagatagagatcgtgcgcaacgaggcggaaacggaaaaaacaaacgggtgccgggtgttatctcgaacattggttttgacagttttcaataattacgagacaacaaaaacaaacgcactgcctccatgatggagcatcagtcctttctggaaaaagatgatactcaaaggcatctccgtaccatcttgaatgcctctctttatcggaacgaagtccgggcacatgctttaattaccccgtgtgcccgaaatagactcggtgtccaattcaccgcctctgctagaacagagcaacgataccgtcgcgtattacgataggaaggcgtaagggtgggaggttgttcaggaaatcttcagtgtggagaatatgaactgaggagagatagcttcctcaggaagcgtcacggagtagtgagactttgcttcaccttcgtttcttcagaaccacttggtgagtggcgtctcttcgcaactgctgtagtgatcaatttcatattttcatctcaagaccacgaaggcctgtgtgtgtctagctgtgtgaagcaacttagactgaaacactgtttctatgttcactttcgcaaaagaattagtcgcatcacaggcattaacaaacgtacagttcaaatagcgatactggattgtgtacgggaaaatctgacactgtcatggttttatttgaatgagtcagatctggcgcgactcctttatcggatggaaagtggaacacagagcatttcacacatggaagcttcttacgagtgaatcctccggtatcaacgggtggcagcacttccggctgaagttgggtaagggggcaatatttgcggtgcgttaaatataaggcggaaataaacgaaattgtccttctagaagcagatctgaacgttgtttctatctccactttgactttatatcggagcttcatctcgtgaaccaggtcgcctacatgtggccttcaccgagacgatatttcttgtccgtcaacgatttcaccttgacaatcatgccgacaggtcggtcagttctggcggcaacacttttactgatcaaacgtggtctgtcgccagccagaggacaaggcagcttgtgaatttagaagcttccattctgaagtcaaaaggaaagcttggcttgactgcctgcgtgaatgctgagcatcccaatcggcgatgccgacgacactgccaaggaaggaggaagtctggccgagttcggtggcagtctaaatttccactctgtgtctgtgatgacgaggcagtgtggacagcgcaagccaataaagcaacgactcccaatcagctccggtcacgctagttttttttcacgtgcctgcctcggcctctaagtacgtcaggatgtgttgagtgtgcacagttgtggatggccggactttgcttctagtagctgagccagtccacggtatacgcacaagatggcatctttcatgtgacgaaagctagctttaaggcgattgtttccatcagaaatgtccagaaagggccgcatgtggagcggagaccaacaaattggtactgttcctctcactgacgttcacccttggacctgggaacaccacaggttttttgtgagatggttaaattcagttaaaactaaaaaactgagcaaccgatagtctcctcgagaatcacaggtaagcgcctaacaagttggtaatctctgaaggcagctaacgtcgagccgcagccagcctcaaccacacactcccgagttttcaactacgcttggatcaacagctgcattcccgatcgcagttcgactctagaaaagtgggcataaagttgcttcgcttaaccagttcaaaaacagagttcttgtctataacaaaagatctcagcctgtgcgccgcggtacgtggaaggttctttacgattgtaagcacatcggtcacgcagatgttctgggctgctgtggctagccctggttgtctttacgtgaataatagaaatttcgcagtgcttgtggacaggtgctcccgtctcagtgataattattaacataagtcacataggcagatcatgttttccttggtgttgacaccttccggtcgagaatcgtggaggcatgaccgcgaaattcgaactgcagccttgcggaggcaaaatagcctgcttttcaatacaagacctgtgttttccaggcaaataatgaaggaagggaacctctttcccagcactgattgcgaacagaaatttcgtgttggctcatcccgtagtttgggatccagcctgtaggtgtggcaactgccaacaacctaatgcaagatagcaccgtcaagaaaagtacatccactaactactactactcttactgctagtgtttctcttgctcttcctctcactgttactctgaatactattggtacctctgatagtagtagtcgggagctcgaccgaaaaaggaagctgatatcggatatggcacgaaaactgagtacacatcgacagagagacaccaatgaacggcatacctttgcgtgacctacccaatgcgtcgtgtcggagagttcactcggggttcccggtggaagaggtggttgtttgtcgttgatgccttccttggcaagctgctctgtttagtgtgtcgtgcagaccggagggcacgcggcgaacatccatttctcctctagaaaccgctgccctacgctgcaaaatccctcaacaatgtccaatcacagtgatttcacgaagtcaaccgaatcgcgggtttattttaggttcttctggtttcgctgatctcaagatggctcatgtcacactcgaatcagcacccaggtagccacccgcctctccgtccctcaacatccctgcccgccgcctgctgtcgggctcagtcgcacacgtgacgacgatgtcttgaggctgggtaagacttctgttttctgcatgtggcagaaaatgacgagcaacgttgggtcaacacaccgataagggccgatggattcacttttacaactcaacaaatctagggaagtgcctgtagcgtttgaaattacctcagtgcatgtcatcaaatagtccgatttatagacgccatggcggggtagatatttcgggtcgcgtgtctaaccctgttccacggcctcgtcctga

SEQ ID NO: 3103 - DNA, 3012 bp, Toxoplasma gondii
ttggccctcgtggagcactgctaaaaaggtttcaaaacacagactgcatgcgattctccctttttcttccaagggtagggtgctgtccaaagggcgtaggcaacgcgcgtggttcgaccgtcaagttgttgctccttctgtccccgcttctccttttcttggctgtccatgttctacctccgcgcaggcatactttttacacatttatatgcacttccacaaatacgtggatctctgtacagatttatgctcatacatacatataaatatatgcttatatatgtatatatatgtatatatatgtatattaattatgtccgtatgtaaatctgtgtattcctatgcacatgcacctctgtttagctctctttggagggcctcacgtaggtcctttcaactgcatctcgctgcggccgactatccctctacagccagcaatgcctgtggaggtgcctctgccctttggaaaataacactgtgggcgcgtcttctgtaagtttctgtatcaacctggagacgtatcgactctccgaacatcgtgaatcgatttaacagcaacagggcgactaaggaaacggctgctgtccatcctacaggacagagaagagcaaaacgaactgcagttcacacaaaaaccgacacaggcctctctcccgctcatgtagaacgatggctcgccattttctgggggacggagccactgaagtttccgagttggaggcggcagctgggtcgaccttttctctctctccactcttctttatcctttcctcctctcgtgccccttgcttctcttctcctttctctctcctggagacttctctcttaccgttaaactaaaaaaagtaactatgaaactccacatttcgttttcaaatcaaaggcactatatctcatttcatagacatactttcaaagtggatggaaaccataagtacatgtctcttctctgctacaactcgtccattaatctctcttgaaacaaaacttttctttcttctcctctcgttttcttctctttctctccgctcttgctccttatcgactctttttctctcctatattttctcgtcctctttctgtcctttcttccgctttctctcctttcttattcttcctatgctttcgatcttctcctttcgttcgccgctccttccttcttgctctctcctgttcgcctttcttttcgctcccctctttgctggcctcttccatcgatcgatccttggctgctgcgcttccatctccctttcggttcttcaagcaaagcaatgcggaacctcgaggaagacgcggcactggagagaagaagccgcccagcgaaagtcagagtggagagcgcgagcagcgaggcattttctctgtctgcaggacgagaaaagggtgccacgagaggagagagggaagaagagaaggcggagggggagtaaagaagaagggaaaccaaagaggagacgcgctggaaagaccgcgaggagcagaggaagaacggtcgaggcagagacagggagacagtgaagggagaggaggacagtggtacagagaaaaggcgcgagaagcttgagagcgagagagaagagaggaagctttgcaaagcaagccagaaggcgagagagctacacccaatccgcaggtctcggcggtgtctggtattatacctgggggaggggagcaagacacacggaggccgcgaggacgcagaaaagagcaagtggaagagaaaacggacaaggcgaggcgaaaagaagaaagaagaaagggggagaaagacacgaggagagataaagcggggagtggggggagctctcacgtttctcccagcctttgctgcggggccgtatacagccagctgcttcaccgacacacacctattcgtccgtttgagggatatcggggaagcgtttgctgtctctgcgggagttacttttgttgttttttggaactccgagctccaaactcgtctcggcctttctgggcctccgtggaggaaaactccgaaacaccacagaaaaccaacggaggctttcgagcgcttctgcccgctctcgcggcttccgaccagcgcgcgcctgcaccctctggagttctttctctctttcttgacttttcgcagacaaagaactcccctcgctgggattctgactcgttttctgctcttctcctcctctcttccccccagtctcttgccttcctcttcttctctggaggctctccgacgagctctgcgctctgaggtggatttgcacctgaccgctcgacggctatataaaagagtcgcgagctcggcgctctgaggggtgcggctttgagcgggaggagagacgccggcgacgtttctttaccgccagctttttgagttttctgcgaatttccatttccagggatcgaagcgagaaacgaaatccggtgcaaaaagaaaacgccgcaaaaaggttccccttcctccgccagtcggtcgtggttcccgtgaggacaccgcgtccttctcaaattctcgccgagtcaaactccgcgaaatagttttccttccttctctacacacgagaggacgcaacgcgctctctttgcctttctcgttttctgcttgtttccctcctgcgcctcctctttttttctcgatccgttcgcttccctcgttgcccccgccgaggcttctcctccgtgctccttgttttttcctccagcttcgtcgtttttttctcgtcttcctcacacacgggagaactgctctctctctctcccctcacgggtcaccctgttacctcgacccttttttctttcttttttgcctctctttcttctttcttctggcacgcctcctttgcgcctcgccttcctggataacactgccgccgagggatccgtcttcaccttttttctggtcctcggttcctcgttctgtttttctcgcctggctcgcgcgcatccttctctcgacgtcgttcctcgttttctctgtttcttttcatttctcctccctcgtctcttttctcctctccactgacgacacca

SEQ ID NO: 3104 - DNA, 3444 bp, Toxoplasma gondii
tgtgcaaccactcttcaaagtctttgggagtttctagacgcatcgggctcgctgtgacttgttcatccacaggaaacaggtgcggggtctcagtttccgggtgaacagaagcgataggggacgactccgacgagaccgcgaagccttcggtgaggtttgccgcgagccctgggctaggattcttgtcgaggcagtcgtcctccctctcagattcctcgtcgctggacgcaaagtcgattttgtgggcacccggcttatagtcggggttatggagctgttcgacgcgctccatgtcttccgcgcggatgtcccggcgcttcaccaggctcttcactttctcctgcaaagacttgcgggtctgctggcccgccgggcacgggagagggggttcgcgggagcgcgagcggagcgaaagtcgccgtcgcaaggaagagctctccttcttgtcttctccgtcgttggagcaaacgctgccctcgcggctagctcgggaggcgcgcgaagacagggagagacgacgcttcagcttcgcggcagtgctctcctgggcaccttctccatcttcttcgttagcagactttcgcgagctgacagacaggcgtctcagcaagcgacgaccgcggccctccttctccacctcggaggatgcgccttcttccgcttgctcatccgactccttctccttcttggatatcgacagtctgcgtctcagtcgggacaagcggccttccttgggttcgccctcgcgctccgagtcggagttgcgtttctcatcgcgggatgagatggacagacgacgcagaaagcgtttggtactgctttcttcatcggctgcggggctcttgggcatgttctctcccttctcgcttctttccacggagcagtcgcgcgagagcgagagacggcgtctccacttgtctctgcgggattccgacttctcgttcgtaggtgaaactgtctggctcttggcttcagacacttgcatcgtcggcgcgggttcgttctctgcttcttctttcaccgctgaaacatccgcaggcgtttcttgcgagttagccgcctcatcctgcttctcggactgttcgccttcgttcgcctttcccttttcggcctctgcgacgtgtgactggcgccggctccggtcaccgtccttcgacagcgagagtcttctcttcagacggcccaaacgagactcaggcgtgtcgttctgcggggacgcaggctccgaccctaggcccttgacgccggcagttccttcctcgttggcagtgagaccgcgctcgacagagcgatcgcgcgacagagacagacggcgtctccacttatctgtgcgcgactctgccttcggactcgtagcgagttcctcggtcttctcgcttgcctcagcagccgccgacgtgctgtcgacctcgtcgtcgttgacggacttggagtcgcccttcgtggcctttcccagcagcgccttggctttgtttgcgaagctgttgcggcgactctgtcggggctcctcggcgttgtccgcctcgttgccctgttcggtgcgcttttttttcagactcaagaaggacgggcgccggctgcctgcctttggactgtcttcggccttaggagcagtctcggtgcgtccagctgctgaagacggggaagcgggaaaggaagagccgcgagaaaccgccgcaaccggagaagctggaagggaatcttccctgggtttcccggccgcaggcgaggtcacagtgtcgctggccagcggcgacggcggagccgtgatgttgagcgccatgggtattttgcgaaagaaacggaacaaattgaagaaacgcgaaggaaatcacggagtcttgaggtgattccgacaaaaaatggtgaggagtggcgtacccttcgatggaacaaagaaatcgacgtacaagagcacagagcgcggtgccgcggccacaggacacgtcttgcgcaagacgagctgcaagaccgcgagcaagctagagcggtagaaaggagtgcccggcgtaggaaaagccgcgcgacagcgtcagtgttgatccgcaaatcgatctgaaaaaccacgatacgctgtggtgggtcaaggaatccttcaaagaggatgcataagaaaagttacgaaagtgtcaccccacggttgacccgtccacgccaggcagcctgcgagccagtcgccgcaagccaccctctctgctcgcggaagaaggcttcagcaacagtttcgacgttgacgctccgctctctgaaccgtggtcgcgagtcgatctcgggtgtggccctgagaagaagcacgcgacggcatggagtctgtaataaagcaagtttccaaaacgagaaatgacgcagccccgaacagtcgtgggaaaagaggaaaaatcgcgtggagtgcaaagtcccgtgagaatgagcttaatgaatggaccatgccttcttctgtggcgtctcagatcgaccgtggcgtttaaagaggaggaaagggtgtccggcgaaagtatcacaaaagcctgctgcgcgcgaacagctggttccactgctgcctaagctaacagtataccagcagtaaacaacggctgctttaaatatcttgttttccgggaacatcgtcccaattttcgtgtagcaagggacgtgtcaacggaagcaatggcgagccgcagaaatatcgcgtgctacaaactcgaaacagagggcgcaatcacagaacacatgaggtcagaggagtcttttttatgaaggcgaaccctaaaatggcgatgtctcgtcctgcagttccccttcagcttcgctattcccgagtcagccactgaagctctctacgaaagtcctgtcggcgtttttcaatgtagcgcgaggcagtttgccgagcggcgacgtcgagcctgtggacagccattgtcactgctgcagcaactgctgggggcgtattgccagcacatgctgcattataatgtaaatcactggttaaccaccaagcacggtgacacagagagctcgtttccacagactctgttgttcgacacgaaactcacatctgagtttcacgtagtaggggttacggtaaacgctctagcgacgaggttcctgtctagctgtgatacgtgaagaggggaccgtacagtggcctactcgacccaggaggtcactgaagcctgttttagaaggtgatgccataacgatattggtaggagtttccacacagtccggtgcacttcattctgttaatgcaaactggaggtcaaagaatctaacgattctttcgaaggcaaaacgcctaatgacagcatgaggaggtcccactaatactgcgcaacgttcgattagtaatgtagtcagcatgaccccttacacaacaggaccacgccatttgtttagagacgccacactactaaaagccacttcgatgcctttttggtttttatattcatcacagcaatatctgaa

SEQ ID NO: 3105 - DNA, 2031 bp, Toxoplasma gondii
gatacgcactgcggtacgtcgtgaccacgtgctacgttcaacacttcgtgtttggtgtctctaatcgctcctgcttacacatgccaccattatcagcaccaggattagctgtgaaacgaaacgcctcgaagatttgtaggggactcgctggcaacgaaaatggtgctacccgatgacttgaaatctgtctccgaaagtttgctttccactgctactcatactcaagcgaagcaacggccacagattgaacacgtccagctggagagatagagttgtcacacacttgccgggaggcgagattcacacaggaacggacccgttcacagttcaccacgggactcgagaggacgatgaatctgacgcttccaacactcgccaagttttttcagccttgtcttcagttgatgcgtaggcacgcacatgcgggcacacggaatgatgcattgataccgacatacgaatgcttggatacgcacagcactggacctgacggctggcgccgcaaaggtttgactgcctcaactcatttcttggcggaggtagatcctgtcttggttggggctgcgtcttgaagaagggggttctttgggagggcgtaggcatatcgggggtggccgaccattttaaagttggttgcaaagaggtgcttcatccgccagacagccccatggatttttccttcgtgcccaagcatggcgagatatgcaagacccaaggcaaacatgaagatgctctgaccgtactcgttctcgaagaagcgttccgtacagtagccgagcgcgttgcctgccataaaaatcaactcgctcttcggagacgcggtgttgtcgtagtctgtaaacaacattggagatgctgccagcatgcatcctgtcccggcgcccaccgcagcacggaaaccccgtcgccctccgctttctgtactttgttccttcttccccgattggcggccatgtgctttaacagacctcagcgtctgcgatttagcgagattgtgtgctctctctgccggacgctgtgacggaaaggggcgcaaggcaacccgatgctgaggaaacccactcgcgctacttcgagcaaaaaacgacacggccactcgtctggctgctgcagcagccggtgtcaagaagaaggtattcattttcgttgacacgtggacgatgaatatacagatttgccactttaacacacacggcggagacttttcggcccgatgggccgcgaatatctgaagctgagaaagagcacacgtcaccaacggaacactccttgagacgaaagttgcgagtcgtagttttcgagaaacttcaacaaaacgtttttccaccaggcgccgcttccgttgtcgtcgaaaaggaatcacacaggccctcaggtgctccccagcggccagaatcccctagacaaaagtccgagctagtcccccctcagcacacgaatctttcctcaactttgtagagatgtttcttgctgcctcgttgactcgttcccaacaaagcccatccacaggtacactgccgccctctgggcatgtgcttgtctctttgggcagagcgtgatggtcctgttttgcgtagtcacttcagcagtcttggcccgcctgactccggtcccttcttttcgcagggcgccaacgcaatttgcgccaagttgcacagcgcaccgtcagctgaatctattaccccgctccgttgcttgatccggcgcgggtcaaaggcctacaacaagggacgacaagcgctgctatgcaaacatgacctcctcgatttatccagcaggaagcgatgaagatcagctcttgtggagcctgtagcgtgaaactcgtgtccttacacattctacaggagttatttttcctcctcaaagacgtcgtggggttcttagaagcaaagcctctcgtcgagagcgtcacaagtccgcactcagccgaggtagcgcccgcccgggtaaatcccttttctacagtcttcggtgcaacttggctctatcctggaagaagacccttgtaaatttaaagcgacattgccaaca

SEQ ID NO: 3106 - DNA, 1644 bp, Toxoplasma gondii
cgattctttgtatcttctcgacacttcgtctgttgcagagggtctcacgtggacagagtcaggtaacgcactaagaacgcaggcgtggtgaaaggcagtacgatgttcctaaaacattcagttcagggggtcaattgttctttagcccaggttttttgtgacaacggtggtcaccccttcatttgatacgtttggcatcccctgaaacttctgacggtttcccatataggtcgctgtgtggagattgccggattttgatcggaataaccccggacatgttgatgtgctggatgaccatgtctctccagaattccagaatttcttccgtggcaaattcgacatccgacttcattctgagcctctggtgtgaacggaaaaacccgacgcggttgaccaaagatttagtaagggaagcttcggaccgacacgctaatccgctaacgattgccgtactacagggttaaccacgaatccgctgtcctgtctacgcagtttttacctacgacttcccaaaagtgctggggaagattgcaggaactttccgtgtgttctgtactctttcccttcaatggcctctccttcggggctgtttcccactgccagaagaagtgtgctgatcagtctcagttgcaactacataaaccgcttcgtaatgcctgccctcccttcccacacatactcaaaaaacaatggagaccactgaccaacgctcttgtcactcaatgacaatacagacgggcggcgcctgtagattggtggtaccgagcacatgctccccttcctctggctaggattcaaatacacactcggttagggaaactgcaagaaccatacactgctgccggatggaaagacagtcgatacgtaccaactgtttatcggggaaacattcacgatccaacaacaaaacaccctggactgcgggttcattcttcacacttgtactggtgtggcgcagtttgtgtctgaacgtggatgcgtgtgcacctggggggcatcgcatgcgttgtctcatgcgttgtctgaacaaccgactgagacagtaccaccctgctctattggcttcgcttgcctggacataataaacatgtccgatcctcttttgtaccacttacggacagagaaagaacacagctgcaggcacacggaacggagaaacggagtctgcaaaaagaaaggcgcgctgcgttttccgatcgtcgcttttgtgtacattggttctgcgagtttcgaccgttcttctgtgtgtatctcagtgtcccatgccatgttgaaatttcgcatttcgtctggaggaatcgactgtcccgggaggaatttttggaaagatacagttttgatgtttttacgtggtttctcaagtgcaaaattgcacccacaagggtgggacagcgtactgggaggagctagccaccttttagaggcttgctgacctacttgggaaacatttcgtgttgaatccgttgacacgccgatgtgcaacatcgccgtttgtgcacctggtgccgggacgaaagagtgggtgatggtcgcgtgcgggggtggtcactagaatcacattctagttttcgatcccgaaagcacgcatttgtgacctttttctccccaatcgtttacgtcgcattcctgcattttctacgaaaa

SEQ ID NO: 3107 - DNA, 2161 bp, Toxoplasma gondii
ccgtatgcgcgcatgtgagtctgagtcatgattcaggtcttttctcgcctctgaggttgttggcaagcttaccctttgcagacagtccgtccaggaggttcgagagttgctctttgattcctcggatgatctcgtgagtggtaggagtgaagacgacgtcgattccgaatttgtttcggatcgcggcgccgagcgccttgtcgctgacggcgagctgggcactcgcgtcggtctgcagcaaatgttttttcaggaatttcttcaaactcttgcccactttgctttcgcgcagcgcgaggacctcgtccagcgcatgcttggtgtccttgaacttcgcgaaggcctccaggtggacgctcttctgcgcgacttcggcagaggcgaagaacgaagtcaagtcgtttgcatcttccacctccaacagcttcttgttcttcacacggaagaggccgtagcccgcaggcgtctccacgagaaccagcatctcggggaaagagcagacaaagcggccggagaacggaagacaggcggcctctcagcctccacttctcagtgcagagtcgacctggaccgggagagtcgttccggcggacgcaccacgccgctgggcagcgcgaaggaggaagtcagagggacaagagcgaatcgattctcctttttagaaaggcaaaactcggcagagatctcgatccgtggactgacgaggtggaggagagactctgcgagaccagtcgtcaacaaagactgttcagacggaggactgcgcgaaaaaaagcggcgcatgctgttgcggacggcgatgtgttagagtccgcccaagaggcgagagcgctgccaaacgagaaaagaaagtggagagtgaggagatgcgcgcctgatttactgtgttaagacgcccccgcgctggctgggcagctctcgtcggcgaaacgcgacagcacagaacgcgggcagattcctgcgggagagagcccgcgacggccgtatatgcgcgggagcgagaaattcgctccgtcgagacccaaaatccacgaagtttcaacgcggtgaacctgcgcccgagcgcgtcgggaggaatgatccgcggaaaagaggatttctcttcgctggaaaacgctccctgttttcgaggttcgcgggcagcgcagactcgcggggctgcagcggacagggcgggtgaagtgctcggcaaagcaattgacgaagagatcgcttcggtcgaagaaaggacttttcctcgacaagaagaaattgggaactggggaagtcgccggcgcgaggcgaacagaaatcgaggccgcgcgaaaaaacctagacaacaaaagggtagaggctcgcgtactgcgccgtcgacagggccgagcgtgcgacaaggaaggcggaggctttctacgcgtgatgatggaagaaacttcctttcactttttctgtcaaaatgacgctgccaaaacaaagagtccatctgcatttgttccaccggcgcctctcccgcggcctcgcagagagagctcgcgcgaccggtcacatgcggcctctctgtggggtgcctggcgctcaggccgcggcgcctgcatgcgcggcgagcaagttgctgggaggtgatgtgtagagctaaaggttcttttcttttcgccgctttccgaggctctccggcctccgttgagtgcgtttctggcgattcgagacgcccagatctgctgcgcttcccgacgagaacgacgcgcggcgctcgacttcgcagaaggcgacagtgtctcgcaggcgaaaccggagacggactactgggtgtcgagcggccagcgagaaccaatgcgttttctgcggcgcaaacaggcttcactcactcgctgcttcgaagactgaaggtctctgcgtcggtatcgtatgcactctctggaggcgcgcaacgaacaaggatagaaggacgacaggtcgctgccaggcagcaactcctctctcgaggaaaaagagccaggggaacgccgttccttctccggagtctggactgcgagagaaaacgctctgcaggcgtcttttctccggcacccgcagctttcgctctctccctctgactccgtctcggcaccctctttcgacttctctgcgttccaggtttctctcgcgttctcgcccttccttacgcagatcctgctggcctcca

SEQ ID NO: 3108 - DNA, 2358 bp, Toxoplasma gondii
cctcttgctgaaatggtttagcacatcttcatacctaccgactttaagcgaggccgttgaaagagatggagagaaattttctacacatctggtgcaacttgcagccacagtctaccgaaaagtcccgactataagacttgaacgtaaaatggggctttacagatttcataacagaaagaacagctggctgctcgagtttgtgtgccctagcatcgccaccctggttttacggttgaagaaaagcatattgtgggcaagcggcagtcatgaatacctcttgtacagtccattcagttttgtagagtcctgttgtctaggttaaatcggtacatgcaactccgaaaggaaggattcagtacgaatatgacaaactcaaattgaagcacgagaagtgactgacatttactcattatatcagttgaagttttccttcgcggtatagcggcagtctcactcgaccacgggagatcagcggatgtggttttctaggttgcatgcttatatagtgaaatacagacgcaaaatgcagcggcaaaactctatcatatctatgaaggacgaaggggatgaaactccttcccgtgtccagagggctaatggtgcgttgttttttgtgacaacccccagaggtctatctaacaaggacgttgggcgatacacacagaacaacgcatcgagaacaggagccgagcaaggaaattcgtgacattttcacgcgaccgttaattggaaatgcagtcactggagttatgtgctaattctgttgcgaaggaaaaggcttttttatctggaataatgtgaccgcggggggcggagaaggggggggcgcgcggatgttaaactatgtcgggcatactgagctgactcacagagagcaacaatgaatagcaaactcgtaggcgaaagacatttatggatgcaaaagttgagagcttttaaaggacagaaaagcaagtgtcatttaaccccatgtgctacgtctagcaggtgcatggggacatcaaggatccaagggaggcagagcaccggtgtccctgtgcggacaccgaattgtaattttgcggaagaaaggacgtgagactttcactcttcctggtctccaacatggaggccatggcggttgcaggggaatagaacccgccaaggcgaacttttttttccctctctaacgccgttggccgaaacccgatgaggcctcttagctacagcgtcctcatacggaactcactagtcgcctcggctctccgctgattttaacctgttttgtgaatctctggggagaagaatctccaattgcattggacaggctccacggcctcctaatgacgaagagcgcaccttttctcgttagttaactgtggatggagctgctacgagctctcgagacacgcggacccgcctgcttttctcaaggagcgcgttgtcttgttccggctttccggaaccgcatcaagaagcccctaccttcgaaagtcaattgcagtagctgttttatttttccaaaggagctcttttttccaccctggatccccgttgttacacttccagttcccgtgccacaaacacgagtcccagtgggaatgactactagcccagtgtcgagtagacagggcaacatttccgaatccactgcattaccccggcagttttttcgctctttcagtcgacttctacgttcaagagaggtttaactcagtgccaatgacacagaggagtgtagacgaaaaagtgctgtccgtcacactgaggctacccatttgaacccgtgttcccggcgtcgtctggttataggtaaatcgggacagttgaaagtcgagcgatgacgtttttgcaagagccgttccctgttttcttcgatttgcttgcacagctcgcgaaacgttggcgaaaatgatttacatccacactaaaatagcagacgatctcagtttttttagtcgttcgagctttttaatcgtcggtgctgccccgagtgacagactgatgaatcagcgcgactctctttaggggaccgcgaagcatatgcctatacgtcttcacttttttcgcattatgttctgcgccttttactgtttaaggcgcgtgcttgtgtccgaatgcgtgctgtgcattgcgaaatctgcgggttctttacacttatcttttcccgcccgaatttgtgtctaaactttaaatcgacggagctcacgaggcagtcatgacacggtcgcggatggacgacaaacagatcacaactgagaagggaaataagagacagagcctgcaggcttctttggaagcaaactgtgagtcctctcgtcacatcaacttctgaaaattgtgttcgtggaatgcagaggagtgtaaaaatttgaaaaa

SEQ ID NO: 3109 - DNA, 2171 bp, Toxoplasma gondii
tacgtccactcagccacgcatatacacattccgaaagtaaacgtccatatatatatatatatatatatatatatattggacaatacgaaatgcagttacatatttgtatacgttcttcttgcgtatctatctatatcgtatatggcgtgctatggggtgtgtcagtggaaagcaaatgcagacgacatgtggttttagaggcatttttcgctgctcgtctccatcataggcgagaaggggatcgtctcggtgttcccgtctcacgctttgttctcttatagaaagttgcgtagaaggtctgacgtgtacggcgcgtatgagtcctccgattcaccactgagtggagttctttgtggctatttgagttaccttttaaaagtgcagttcctttcaggagttgcggtcgcgttttctgctttagacagtctgcgagcagagcaggtagactacatgggcgtgcgatttgaaggtaaggaaatgcattttttgacgcatcttgtgtcggcccggagaaaattttcaggctgcggttatcctcgacctcagcgcatgaaggaaacgctggagcttcgagcctcttccgcacagaacgaaacggctgctttactgaaacgacaggcgctgtgtagagtgccaagagcaaaacctggagcgggggaggagacagacgcgctcgagcatttgtcgcttttgtgcttttttgctcgagcaaggcccgggaagcacccgcacaggctgtgatggcatctcgctgaacaccagatccaagttggattgtgctagcacagttgagatgatacttatgggtaattgcagatatcgagcagattcatctcttccgtcatttcctgttggactcaaacgccgtgactctcgggagggagtctcgaaagacactttcactacgtcttttcagaaaactggcttcaactgcccccggcctacatgagtcgcctgtcctggccaggccttccttcggaagcctctcgcgtcagacaaagaacgagaggctgctccgaattccagaggagaagaagagaaagcaaatcgtggggacaccggagagagacgcgcagacaaagctggacatcgaaagagcagcaagaacagcccaccgcccatcgatgaagacgagacagcagacgcagagagaaaaagaaagaagagagaaagacacagagagaagaagagagagaaagagaatgtaaggaggcgtaagaaagcaaggatcatttgatttcctcactttgtcacgatgcgctagttacggggtagagcagtgtgacttgcagggaccttgctccacagagaaaaaaacctttttccaccgtagcaagaaatcctttttcttgaaagagaggtcgcgcttctctcgttcgacggcagcgagatgaaacagatctgcgtcctgctggtggcacccgcttcccgtcgattctcctcgcaaggtttttcgttggtctccttgccccacacatttcttcgcacagagttgagagacatgcgaaggcgagtgtcacttgaggagaaggcgaaacattcctgtcctcacctttccagcgtttcccctgcttttctgcttcttttctgaactcggcttgcctcactggacttgtggtctcctcctctcaacctcactccaggtgccgcgcctgtgaatcgtcaaacgaggcccaatccgcgttctgcaggaactgcatgcgcgccgtttccccaaagctcttttctgaggagctatcttaacgcggaaaagccagtctcttcgttggacattttttcttccagtttctttctgcttccagactccttccctccgccttccgcctttcctcaccagtctctgttgggcctgctgagacagctgtctcctcctgacgaggttgagcgacttgtttttctgaaggcttctgcgtttttcttcgtcgttcagaaggcgtttgactctgtctcttctctcgttttgcggtatcgcttctcgtctttctagtcccagtttaacctctctgcttctccccagtgttctgtccacgaccttttcagtatcgcggcaactgctttgtttcctgtctgcttgtcgtgagttgttctcccctgtctctctgccttttcctccttttccgccatccaacttgttcgtctcaattccttcttcccccaaattttctccaaaa

SEQ ID NO: 3110 - DNA, 2751 bp, Toxoplasma gondii
aaggcactggtatcctcttctggtatctgcaacctcttcactgtacatatatatatatatatatatatatatatatgtataaattcacaaatatatatgcgtaaatttatatatatatatatataatcagtttagatgtgccaagattcgtggattttgtgtccaagtactcgcagctgtaactgtccatttaaaaatgcatttattcactacaggtatttcgcacgatggttcgtctgtttattcggaggaacaggaggggggtgggcaagtttttcggtgaccggaactccgtcgaaggctactccggtcactcggcaaaggcgcagagacaagaccgactgtgtttcatagagatgtcctccttggtcgcgaatgcctcattgaaaacgcgtttcttcggaaagctcgcacagaactggtttctaagcttccctctgtccactctgctccaatcagcggaggttatccctccccagagagacgaagggcgccgatatcccgacgcaaaaaggcgaacaaacggaccgcaaagcgcatgcgcagcttcaggctgaaagaacgcgacactccctgtcgactcaaacatgcagtcacacagccttcgccttcaacaacaggcaatataggtgtatgtctatatgtatgaatatatatatatatatatatatatgtatgtatgtgtatataaatacatgtatatgcgcatatgtttgcatatggatagaagttgtatacatgtttttatatattgatatcgatatcgatcgatatgtatcggtataatatgtgtgcatttgtatttgaagggtggtgaaagagaggaggcctggagtgagggggcatcttgtttctgaacagttgtggggagagtggagagagtggagagagtcgagcagctcgaggacgggagagaagagacggagttccttcatgtagacgccccgtcaaaggatatcagaccgagctgcgtcgacggagagaaggaaaactcagctgcccttggcttccaactgtctgtggtctgcgcgcgcggcgcgaggtggacgaagactgtccagagagacaagcagagtcagatttttctgcagagatctcctcgcgagctgaggtcagccgaagcgtctgtcgcctgtttgcgcgacgcaggtgtgttgcgtcttctctctcgctgcgatggcttcacttccccagtcacctcgccgacgcagcgggcaggcaaccaaatagatccgactcacgcagagcagagtcgtcggccgtacaaatgcgttggccttgcagacacacagatacagacacagacgtcaggcgactctgcgaagcaccgacggacgcagaggaacagaagccttccgtcgctttcgctgtgtctctgctgttcccaggcgaaaacgcgaaaacgctgttgccttgatgccttgctgcctcgttgcgtcggtgtccctctctacttcctcgcgtcacagttcttcgtttccacggtgctttgccgacgaactccgcggagcgccagcctcgttcttcgcttcttttcggggatctctgctttctttttccttcgacggcgttttcgctcggggcgtcgtcgcccaccgccttctcactcgcctgcaactcgcgagctgttgtgtgtgcgatccaagcgcatgcagagcccatttccaactcgctgcttttcgcgcgaagagtccccgtcgacttttagcctttttaggagacgcaaagtcttttttccctgccgctttcctcgcctcaggttcgctgtgaaagcgacatgcagacgctgccttcctcgcgctccagcgcctgagatttccgctcacgcgtttccggtggatgcgcagctggcctggactcccgaacggttttccttcgctttctcgagaacccttttcttcttgtctccgctctcgcacttcctccctccgcgccgtcgaggcctggcgcagctgttcgcctttttccaagttttcacctccgcgtgagacacggccgaggttgagaagcgcagcggggcaaagccaaacgcgtcgaaagaaaggcctttttctcgaggcggcaccctgaaagattctgctcaaaaggcgagaggaaaacagacagacacgatacaaacagaggccgagaacagcggcggcggtggtggcgccgaagagagacagacaggagaagtttttcgtctttacaacctctgttcccgcgttcttcagagctctctttccacttggaatcaactggaaacagaaacgctcggtcgcgtcgactcccctcttctccgcgtctcgcaatctgaaaatcccccggaaaagaaaagcctgacgctcctgccttcggtcgccggcggcgctctcgccttgctcgcgtggatactccccttcccccctcctcggcgccttccacttcttcatcttctcccttgtcatctgtcgcatcttttcctcttcctcgctcctatcttccttctcgtcctctctgaagtcttcggagaggggaggacggcgaagctacgctgctctctgcgcgcctgtctcgtcttctctcgttctggcttctctgctccattccccagttctcctccctcttcctcctctgctccacgtcatccctctcgacgccactctcccgttttacatatatatatatatatatatttgtgcaggttctgtggttgtctctcgcgtttctttgtctccaacttatacaccgctgttttttttcctgcatattttctcttttctgcttccacca

SEQ ID NO: 3111 - DNA, 1775 bp, Toxoplasma gondii
gatatatcacttcaggttcactgacggagctgtgtatgtacacagggatctacggagagagaagaaggggtaagacctgcgtatgcagacgtgggtttcttcacaacctctgctgtctgtagaataactttattccctgaacctcgaaatatagtgaacctgctgttggagaggcaaaaacagtcatctgcacgcatgcatgtgaatgtaaccctacatcgatcgcagtcagtgtgtcctgtttgtttctgttttcgccagcttacaaggataatccatagcctcatccctcaaaattgttggtgcatttgttttgagcgctaacgcggatactccagagaggacgctgtccgtgtgaaacaaacgaactctctcgtagattttctcgctgacattatctccgtacctgaaggaaagacgtagcgaagcacacgcctcgggttacgtgtgtgtatgacatccaaagcacgcatatgtgtatttccagagagagctaggtgtacacaccccagcatggaaacattgccccgcttccttctccaggactcataattgaacctacacactaatacttatactgaaacgtacactcacgcagaaccatgcagcaggaaagcgttgtggcaaatatgaaccgttgataagggatcaaacataggagcctgaataatttaaaccgccggaaagatgtatgagaaagatgagcatgaatattttgatggcgtgccggaggggcaccccgtgaaatccgcaagaggcaaagaagctcactttccacctaggaagtcgatggcgtactgcccaatgccaagagcctggtttgagtctcgaggcaaaacaacggtgtcagctgaagtactttgagtcattttgaggactgtccggcaaaatgacggctgtaaaggcgcgggcagtgttcataagagcagttttccgaggcttgacagtcgggttttacggataaaacattccaggagctgtcggcgagagaaacctggcagcgtcggtggcaactctttggaccgcgattttgctgcagcatcagtccgtgtgtgcctcgttttatgtcttggtgcacgagcacaccgtcgtcttcgggacaagacgaatggacctttgaacagtcttcacaacactgtgcagaaatgtcttaatgcttgttcgtggggatagtcgccgtctgcagttcatctgccaagcctacacttcgttcacagggaaacgggatggtgagctggtcggctgtacgtacaggcggctctgtaggataggcgacttgtgtgggtgaaactcactctagtcaaatgagaaaaaaccgtgtcctccactactgcagatgccagggcacctcgtgggcttttgagtctccctgcttttcgagttttgaccttacccagcaaaacgcagattggctggcattcacgctggcgtgcatgcggcgcgagtcgcgaatcgcaaggaaggcattctttttgtgccgggcaagtcgtcaccagaagaacgtcttttccagcggtccatttctcctgcgctcttcaggggttgcctatttggagatgtttgtctggctgcccagcacacacatacacactcgtgttccggatctcttttttcgtctccgggatatcgaggcctgccgccgaactgaaccgtctgtcgagtagatattcagctccctggtgtgtcgggaagcgcggctttttcccacactatcccgtctgtaaagtgcgccctcgtcggggtattgtttctttgacaccaacgcgttgccacca

SEQ ID NO: 3112 - DNA, 3670 bp, Toxoplasma gondii
cctttagctttcttagggccattctgcgcgaaagacctttgttagaaaacatcgttgtttgtttcttatagcgtccaaataatcagccactctgaggttcacatgcagctgtggttagggctgggaatataggaactgagtcagcagcagatgctcaagaaattgttggatgtcgtgggctacacaggtccagagaatggcgtcgatagcgttgttccaaggactgttacaaggctcattcacaccggtgtcagcaccgagaaaaggtgtactctgaggaaaggcaacgccacagatttgggacgactgttcaacgtcacagccactatgccacaaaagtgttcatccgttctgcgccgtttcatcgttctctggcgaatgcctgtcaggggacctagacactcgaagcaggcttatagcttttctcttagtttgcgaaaacaacttgtagaagcgtgctgtgtggagcctggggaaagattatggcgcggaccgaagagatgtgagtagtctccaaagtcgccttgcggcaggcgctcttgaaacaacagaacggaaaaagtgcgcagtggagatgcagtgtcccggaggcgatgtggtcagcagaaggaatgactatatccgtaacaagcataatattagttaactagggttcagccagagtacgcaaaactgttgctcgagatgctgacttgagtattcgggggttcggtggagttgcttttacagacaaataggtgctttatcgcaagtctttcatgagggagacaacttgttggcaggggggaaaatgatgtttttaaaaagaaccgttgtttgcactttggcaagctgtaaagtatattgagactcactatggaatggttagagtcacggcagcgcgtttcccatgttaacaaatgttaagcgaccgcagtgcttttgtgagttctcgagttgttctttacagattggttaccaacgcatagccgctatcacagctagtggcaggtttgtgttaaaacccctcgtatgcctcctgtgtgccacattaggaccatgtactgcagcatgatcgagttgtgcgaggcaacccgtccagtagcacgaacggctggctgaaaagtgcttaagtaccttgcatgatgatgcagctccataggcgtctgagtcatgggatttataatactctcccagcaaaacgacccatgtcttttaacaaggtcttatacgtgcagccttccccgttccctgcagataggtcgggtagaatatgtagcgtcctcgatcaacacgtaatgcaaaaacgggtgacaagcagcacttccatttaggtgttcacttctatctttcattatcaggacctgcaaaaggaaacaagtggatggcagattctatctaacaaaaggatcctctatcgtcaaaaactaaaggggtgccttcgcagaggacagattttcccgctgctaagctggaaacccgaaatctttttcaagcccacctcgtattacatgttattttcgcggagatgttgtgggatattgagagacgctcacgaacccaaaaccgtaactttgtgctctcaatggtttgcgataattacaccgttgcccctgttaattcctttgagtttcacccttccgagcttccgttatattgtatagatcacatggcttttcatactttgagatcatactagtgacaagaagggaagcgtgtttccaagaaaaaggatatttagccaggaagtacattttttgccatcagatttattttttttaccattctgttttcactaatggagtagcccttggttttgtcattctatctactttaggcggtaaaacatgaccggctgtacgctagagactaaatccagggggaatgcaaagcgttgcattcccttcatacgcacatatatgtcgagattgctagcctatgaaacaaagaggacgaagaaaacgctctttcacttgctgtgccttgatggggcccctcaggaaaattgtctgcttggaatgaaagccaatgcatcaagccccaaaggtggcctgcacgctaactatcgatatgggtaagtgcaagaccgacatctatccccgaaaaaaaggcgaagacaaagcgtattagtatgcatgcgctgctgtaacagagtttgcgcatttcgttctcaaaggcctcattctggggctcgctgtctgctctctggctagcagtgattgcgatggaggcagcagtggtgacaccgcgggtccgtgagaccatcgatgcaagagtcccggcaccctccatgggagcagaggatcgcgattccattgttgggtatacgtggatctctgcttcgcacaacaaccaacatgatacagaggcacttgcagcatcttcagaacgaggttcgcctccagattttagccgtccgatgtcagctctctcaactgcctccgctttttcccggaaacctggcgctacagatgacggactggtgccgtcaactgtcgctcctcacgtacaagaagatgtcagttggcggcaaacatgttgctcaagcggaggtgcccgtgtcacggcagttccttcttcgaaacaaggaagcggaagcgacgaacccctctgtcacctgaacgggggtgagacagaacccgatccgagagcttccctccgacagacctgcaacgcagacgccgatattgctggtgcggattcggttagagactggcgagggccagtttaagtttcccaacacagctctgcagacgacgtattgtttccaaagcgaaatgggacagttctggcaagaaacctgcgctaaacatgcttagaagggaccgctgaagaaatgctcgagaagaggtctttggccggacactcgtagtagtacagcaaacaagtcgattctgagaatttattggagtatgcgctgaacaccacaacatcactatactgcatgtacttaccacgatagtgatgagcaccaagattgaatggctgtcgtgctacccacagtgcctgtcgagtggcacaaggataatctggtcacctgtggaaatgcaagatagtcacggaacctatccatcatcccgaagtgacatagaacttctgaaaatccaggcgacttgtgagaatcactacagatatgacagtaccagtagctgatcccttcatgacgttggtgcaatgtctgccagtgcatttggggaacaagacacaactgaaaatgcagaaatcattcagatcctcttggtatatagcaaccaggaggctggcgtgacaagcacttatatgggataaaattgtcgttggaacgcggcaccgagcaccagccttccacaaagtggggcggtctgaccctgctcgtgggcgatgctgactgtacttctcgcaggagcgaaagatgccggccgaaccgagatattttgtgttccctgcaagtcagctcccagacggcatcagccatacattgaatgcattgacgtacaggaaagtgaccctgacgagcctttggttttagcatatcggcgacgttgtgaagaaattggaatatcgccaaatcctattctcattgagacgttcgaggctatagacagaggcacgaacggttcgggacagttggatgctttagagcaacacatacacgtgcactgtcccggcaatgtgaagcctgtgttttgtcaccgactagacgatcgcggaa

SEQ ID NO: 3113 - DNA, 2393 bp, Toxoplasma gondii
cgagcagtgagaattactccttcggtcagataccgcgacagacgcatctgcctcacctgatcgtatctcagtttccttgcttggcgagcaaggagtacccgcatcacggccttcgcataaactgtcggctgatgcaggagacgaccctctctcacaagatgtgtgaggctgtcgtgccggtgacctgacaccttctcgatcttgttttctcgtggcaagcagagaaaagttgacctcttgtaaatgttgtgttgtctccttcactgcgcaatcattcggtagtccttcgggctgctcgtcgcattcttgtctcaagataccagtggctgccgaatctgcggacgcggcactagggcagctagttgacagcagaggaatagctcctaatccagccttcgacattttcggagaaaaggcgaaggtgggcttctcgtgtgcacatctctcttgggatgtggcagccaagcccatgtgcggccttccagatccgttgtcaagggcaacggctgtatctagaatctctcccgcattaccagatcccgagcgtgttcttgacgaagtcgactgcaaagcggggccctcacctgtcgaatggtggccattctcctctttccgtgcaccctcacggacaaggctgtccctggtctccatgactggaactgtacaatgaaaacggacgaccggttcacctcaacgggactccaacgccacattcgttgagaggaagacgtcttaggagcttctcaaagaacacatatggagcttcgatctttcagacctcctcgaaaatgctgacggcgaaagtgccgcgtttctactgatgccacgtataggacacctgcttgccgcttgccccgtgcatgcgcagatgcagaggaaaaaacatctgccgcagcaaactcaatgacataccgaaactgaccattcggcctgcgtgaaaaaaagcgtagtgctaaattttttaagatcacgctgctttgtcgcagtagcaagacgtttccgaaaaaacgtgcaaagctgtcatcttccagcgcacagctacatccaggagagggtggattgcgagaagaaaagagagaggtagaagcgtgcacaagtgaaagaaaaacatgtagagcatgtgtatcgtcacaaaattctagatatagagtgtatgagcattcgtgtaacgtagaaatgatccgagcaggaacccatcgagtcgcgccgccaatttgagcttgatgccactgcgatgacggcagcctttgacggaagagacgggtgtgcgaaccgcagcatgccgcgctgtgtcgcgcaaccccagcacgccgtccgctttcgaacgcctcaacactggtagatccttggttgtccccgtaccagtgtctacagcgcagtgaacacactgtgtcgccaaaaaaatactggtagatgagttccctgttatagtcatcgccttccaagttcggacgaatgtccactgagatggcgacaggagggacgatttttccgaggacaacgcccactggcacacataacgtgggaggacaaaccacatagcagttgtgtgcagctgcccgtcgtctgcagtcatctctctgtctgtggggcttcttggtttcctattggcagagacacttctaatgtactgtgacggcaggaaattgactggcacgaagcgattgcagtccgcgagtgcatcgcgacgccgcgaaactcatcgggtgaacttcttctgcggtgattctctgatagaagcagaatgtagcgatttgcattgcccctattgtcggttcttcgactgtcccagtaccagcatcacatttgaagagagatcgagagcgcaagaatggctgtgtcgcgcagggctgcgcggtaccgccggcgttcagtcttgtgcttgcttcgatttgaaactacacggggcatgagtgaagagaatggccctgcgccagtacacactattggggcacctcccggcaatgctttagggggactaggctgtccaggcctttcggctttgacagcacgggtctctatccatgcgcttgcattcctcaatccatgacagttcacttgaaagcgccccaaaacgccacatcgttgttatttgtcacgcataacgcaaggtaaaagcgccaagggggaaggacttcgagagaaaagaagcgagtaggtttttctgatgcagcgcattcaagggagtaaatgttttgtctcatgtggtgggcacctggccatatgcctgccgttgcagtgtgcatacatcagggcgcagccgactgttcttacacttctgtggatcactccaactgcaaagcttccttgtttatgatctgtatctctgttttgtgctactccctcgttttgataccgcgaggttgctttattgttttgctgatttccaaaga

SEQ ID NO: 3114 - DNA, 2547 bp, Toxoplasma gondii
aagcgatttgcactcgcgaagaacttctcctagatcggtttcaatgtcaagtgtcgtccctgttacgggactttttgttgccgtcattccctgttagcccacccttttgttgactgatctctacaccaacacttgatgcttgacagtttcacctatttgctgcgttgtgagggagtttcgctgtggtggcttgcgtgtactctttgccgcatttgagacagggtcagctttcgccgcatgcgtggtttcccgttgtgagtcgttcttaggaactaacttctcctgactctgggtttcgactctcgcttctgaaaatttctcactatcacgtgcccagaagtagactctagtatctgtcgattattgctctagagatggttctccaaccacagaacctgcatagggataatggaaccaacgctaccatgcctttaaattgaacccagcaaccagcaaagcatgctgttgtacacggcagtttcacgctcgatgtaaagttgacagtggaaatcctagggctttgaggaaccaccatggcaacatcacaagttctggcaaagactgtgttagagatggagctcctccgcttaatgcccttgggacaaattttgtctcgtacacatgcctgagcttcaaaggcgtattcttccgtaaacattaggtttctagctgcttttaaaaaatcccctaaagatacatgtgccaaggaggtcaacacaggctaacagacacattgattttcgccctttgaggatctccaacaaacatggggtaccttcccaaaaaatatatttgtcaagacgctttgccaccatctagtgtccttcgagagacagcggccaacaggttttaaacggtagttttatcaatctggaactagatttaagggaagtaatgcgtttcatggttttcactgatagaaatttgcgcgcatctgttcctgctcattctaatttggatccggtgtttccctgacccgatgccggcacacaacagcacaccagaattcggtcgcttccgacggaagcctttcggtctccgccacttgccttactcaaaaatgcaagctgtagctatgactccgtcggcatctgctttacagaggtcaaaagcatttcggtctcatcggcaatggcttccagcctcacaaaaaaccacgaagtttgtcaaacactggcactgtatctgtctatgcagattccagttcagccttctcttggtctcaaagatgacagaacagacagctccgtcccaactacgagtttccgatccttgacagacgttgcgaggcttcagttgtaaatgcgtgcgcgtctgccccgcacatctgggctgtgttccatgtgtatcccgcttgtacctgtgttgtgctctcagttcggtgaggaaaaagaggcgaatatcgctttaccaatgctgcactgtatatcccttgtggccgttacgaaagtctatgacccactttgctttgggtatgtccaagctgcgattttgcacatgctgcgtcgccccccgccccccccctcactctcgcgtcttgacccacagagctagcagaatgtgccatgagcgcgcttcgttgttcttctttccttaactgtggttttgaagagtaacgctgccccttttcatcacacagtccgcggccacacttttgtcgagacgatacacgtagcggagagttcgcaatattccagttggacggtagcgctggaggagagcaatgacaaggacactgttgctgcgcgccccccgtcccgcagatcagacaacttcgccgttgcgggattatcgaatctgtgaaacgactgcagaaaacatgtgtcaaaagatttgagtgaagccacagaatcggccttcccttactccctttactggatttgtttcaagcgcaatctcttactgcccttcttcacaccaactagaccaaaacaaccgtggcaagagcagtagcgagacacatcgacacttgtaagcttcccgcgtttcttgtgcgatcagctggcacaaacctcgttggaccgggtgacctgtgcgtttgactcgtttcggctgcattgtgatcgcttttttcaacagtgttccgatttaccccccatgagtctttatcacaagagtggtaaacaaaaagaggttccccgctccctcaacgcgggactgaaagtacctggccgcttcccgtacgaagacaaatgacacagaatgctcatgcgtcttgtaaaaaccatctgtattttggagtgcaactcttaaagtattttcttgggatcttcacgctcagaatgttccagcgttgttacaagaaaaccggtgagacatctagatgttcttcggcacctgaaaaactggcagccaagtggcagctgcatattccacagcccgttgttaaggagcaaagtctgcagaacacggcagcgttgtgcaagcaattcaccaagcgggttcccacctcttactagttcttttgccccccctttccccccatttcccgcagctaacctatttgtcggaagcgggtgatttgttggttgtcttttcttcccggaa

SEQ ID NO: 3115 - DNA, 4650 bp, Toxoplasma gondii
gacttactttgggctctctttgcgcctgtgattttcagttcgttggtggcaaaggcccgcctccagtcgtgggctcggagcgtgagagcgatttccttgtacgggacggcggggaacatgcgtttgacgtcatcgaccatgagagcgaggacgccttcaggatcttcttcgccaattgcatgcagagcggcctcggccgcaatcgttcgttcccagcgaggcaggagatccatgttgattagcttcacgcggagctggccgccgcacccgcgcacatcgtacaagccatcgatgaggacatggtcgtgcagaaccggagacaggtcgacgtcgcagaatcccttgacttctttgccgaggaatccgccaccccatatctcgatgcggaggataggcgactgtttgttcaccaagtgcgtgatggaaaaccactccttccactccgggttccggcgcgcgaccgccgtggacgtcttgtgtttgcagctgccgtggtagaacttgcaatacaacttcttcccgtccatattttggcccccgtaaatcaccaccttgatcttcaccacttcagttgcacctgtcgcagacgcgaggggcgcggcgtccgaggccacccccacggttcggtcgcgggtcaccgccccaaaggagcgcgggtctgctgggccagaagccgcttcatcgcgcaacagaccgatgtcggagacaccggacgctccgtttgagcccacgctcgcgccagcagtctgcgacatgcccagcgccggaacgcccgagttcgtgcgaatctggaacgccgacggaggcgattgcttctcttcctccttctccgcgaccgcagacgcgatgaacgacgccgggaccgccggcgttccgctgacgtctgccgacatggtggaccttgggcaaagaggcgcgggacgaacgacggggaggttgcggttgacgcggcccgaaagacaaacgggatttggggcgccaaaagccaggatcgggatgcaagttcaactcgtgagaagtgggggtcaaacgccaaaaagaaagagggggagtgtgagaaaaaactcgaggaaaagagacggcaggtacggggagtagcaagcgagagacgctggactacaaaaggagagtttcacctagaacgtggatggtgcgtgtctgcccttgtgcctgcacgccctgctaagaaaaggcaaacgccctagaaaacggtctcgaaatgtcgcgaaagtgcgcacaggcgatggctgcttaagtcaacgagggatggaactgccggtgcggcggagcgactgggccgcgatacggtttgcgcgcggagaaacgcaactcgacggaacgtgacagagagagagaagcgcaaatggcacaaatcttgccggtggatcggacagattgaaaggggatgacgacgtcgatggcggtacgcaggtgtcccgtttagccgtcgcgctttggacgatgtttctcgaaaagaagagtagggaaacgagaaagcatccggggtttccctgatccaggaaggtatacaccaagagcctaacgagatcagcctcagcatacgaagtttagtagtaagcggtatggaatgaccgacgagggtggaacgaatccgaagccaaaacgaaagcggtgtagagtcggagtgtatgtacacccaaagagtcgcagtcgcagtgtaaacggaagctgacacggaatgtgccactttcccgagttttcctcgggcttcgtgacaaaacagctcgaccgttctctctgcgggtgcgtccggaaaaagctggacgcaaggacggggggcaagaagtcgggtaaacgatgagaggcgaagcggcgatatcgctcgaaaaggagcgcaggaagtgtctgccactactagcgttgttgcctgtcctcgttcccagagtcgtcccgtctctctcgcatagtcgtcccgtccctctcgccgagacccgaaccagtagtggaagctttttgagcacgctttccctcgtctctcgtcgcggcctgcccgctaccccgtttcgccgacagcggaactggtgtttctgagtgagaggcgcgaaaatgtccaagcaggtacgcagaatgcatttcgagcgcgcgcgccgtcaagagtcttcccaaggaaatccactggaaagcagtctgacttcgtcttttctccccattttcgtggcagcgtttgtggcatgcgcgccgctggtgcgctttcgtccggtgagacgtcgtctttgccagcctgtaccggagggcaccgcaatgaacgagcctctctatatgcccaaggttgttttccatccagacaaaaagcgcgaaaagagtttggaagcgaagaaaagcgcaagaatcagaaaccttctcaaaacggggaggcggtatgtcgcctccgatggtgggattcgttccgtaccgttggtggacttcgtcgatgactccaacagtcggggatccccgttccatagtgtaccggcagcttttcagtacagaagaagcgcacacatgtatacacttttatatatagctattcgtatgtacggatttcggcacttactttagtgttgaccttctagtgtgctgtgaccgacccaaagaaggcaaagcgaatctttactagcgggaacgctttcggtgccacgtttgtcacacagtatccacctcagtgggcgccgaagaagaagagcctctcgattcagcctcgttcccctccctgctcacccacaggttcttacgaacagagatacacaaagacaagggtagctatctacgtatatatatatatatatacatacatacatatatacatacatacatatcgcccgtggtggacacagatggatatgcgtctaccgcgacactctaatttctgcgggtgaacatacaagcatgaaatgtctcgatgttctcactacacaggagaagtttcttctcgaggttccggtatgaaagacatacccgacgactctgagaaggacttaaatccatatacacctgggagcgtgctgaaaagggactcccctgcagctgtgtagcagcttgcacgctgaggcaccctgcttttgacccttgaagcgtcagtgacttgagcggcacaaagaatgaacagatacgcccagcatggtcgctgccggacaaaaatagcttttccaggagtacaacctggcctcttttacgatacagacactcctatagagcatgcctgcgcatttaccttatatagagatagtcgattcatttcacgagagttcctggggaagaagttccatatttatatggatatatggatatagaaagacagacataaatgtgtcatttaggtatatatagagtattgtatctatatgcagttccatatttatatggatatatggatacagaaagacagatataaatgtgtcatttaggtatatatagagcattgtatctatatgcatcaggtattcctacagcaaccgaaatgctctacggatcgagtgcggtttctgcttcttcaccatggtagccatccaccgtgtagtccgcgtgtgcttactagataccgcatgacgtattcccaccgacagacgtataactctatttcccctttgttcacttgtttgaaatattaaaatacatgtatttttccatgatgaacacgcggtggttgctcgatgtttgagaagagtttcccagctccgaaacgtcgggttttccatgcatgtcgcgcacagtcgagcacagcgctgacacgctgtctcttctcgctttccgtctgatgtttttttccgcgtcttaatgggaaaaaagaacgaccagatcgcttaactcgcctcactcagttctcagattgaaagatatagaggcacgaacaaagaggcagacagtctacgagcggcgaggggtcacgagagaagaacgagagcgacagcggctgtgtacagagcaggcaagcgcctgcttatggaatccttgagggaaaaaagaaagaggaagaaagaaaaaaatacgcatttttgtagcagatgtttgcaaagagcaacgccatcgctgctccctctaagagacacaaacgggcggggcggcgatcctcgacatttgggggtcctgatactttttccgggagtttgtgccaaggaaagatgtaaaggcctttgtttgcatttgcggccgcagtcttcctttctatttgcccgctcgtttttctgtctcttcggtctcggggtgtctcttttttccatgcgcctccgagtgctggtacatggagtgtgaattctctcgatcgatcttcgagactcccccgcgttttttccaatttcccggcgaagtttcttgtccatgcatccagttctcttctgctctcgccctctgcttccagcactcacacctcctcctacgctttctccgccgcctctgtcccttgctctttttctctatccatttgtgcctcacttttgctctctccgcgtttctctccctccttcgtttccgtctctctctgtctacgtctcctccacggtctcgcgtcgatctttgtgcctctcttcgtcctcatcaacgtatttccttcgtcgtccggtgtctctgtctcgccccgctccccggttcggcaaccctacgttttcgaccgcgttttgtttgtgcacctcactggcttctcgtctctcgtcaaga

SEQ ID NO: 3116 - DNA, 3443 bp, Toxoplasma gondii
tcgaagaagcgttggctctgaaaggatttggtgaccgccgtcgccgccttttccccacacccacacctctccatcgaacgttgctgcgaggctgatggaagctccacagcgaatgagttgcacacgcaagctgcttgctccatttctcgctctggcactgcatgcggaacagaccagggaggcagcagaaggctggacagaaggcttagacgaagggggagaggaaacacaggacgacaacgacggagaagatgagtgtggggccgaggacagcggatctgacggtcgtctttgactggacaactgtggacctctgctgcagaacaactcagaggtcgcctcatcatcgaacgagaagtggacgggccgtggaggatgcgttcgcttcccagatgcggaagagaacagaaggtgaccgagctggtgggaagatgccgctccccatgtacagagacatctgaaaagcgacacgtttgtagcccctgagaacgtcggagggaaaacagaattttcacccacagatttcacgagaaagcacctctccagataggggtcagcaaggttcttccggggcggcgaccggagaagagcacagagtcgtgaggccagttgcatcggcgaagggcgtgtctgatggtgggaaacgtgtccagccgaactcggacattcccagtcgaagtggtcgctaacgagtgctttcgggaggatattgaaaagggaccgcgctgcctcgtctgagtagagaagcggctggtgaaacggatctgctccatggtgaagaagaagatgcagacactctggcagttggagctgctggaggcaggcaaaaagcagttctgacggtcctacctcgggacggctttccccagaagcagacgtggtcgatcggaagccttggggtgaccggcgcgcaggacagacaaacggaaacgccaaacaaccgactgtgtcccttctgctggcccacccttgctcgttttcgccgattgatgaatttccacattttcgtgttgctcctcgctggctgtgtggcgcagtcgatccacgaagctcgggactccggccctgccgcccacgtcccggcatgagctcatgagcttcggcccaaataactctttggagatggagtgaaagatgtgatcccccagcagtatttgcgctggaagctagtcacagcgtttcatcggttttttctttacgaagagtaccgtcaccgggaagtgtgcgcaagcttctccctcgtcgaggcagattctccttcaggcccgtgtaaaagcagtgcgcatggaaaaacggtgagggaagtcacatgcgaaggacgagacacaagtgcacacatcgcatgccactcggctacccgcgatgctcggttatggagggaggtagcgccgcgatgtcgttgggaggcaaggccccaaatttatcaacctacttcgctgcatccttcagacaagcacgcacacaagatatgaaaaacagctgtatttagtgtgccgatgaagactctcgttgcttcggccttaagaaggcgtttctttctgcgaacctcgccgtgcctcctcaggagcgcgttctgtcgtgcctgtgtaacggcgggcgcgagcgcctcttcaaatgtcagttcacagttttttccagaggatggtgactttcaacatgtaaactcttgccaaacaatttgtaggcaagccttcttttctggcggcaaatttccattcgagacggaacgttaacacaaacaatcgctaaccgcccgccttgtcatgtaaaaccaagacttgacgggctccgcatgctctctcaaaactcgcacaagatggagattgctcaacttaacgagtgttttttgaaccaggtagctgtcttagcagttgtcaatgaccgaaagcgttcaaatgaatcttagacacaaaaatgcgtcatcgtaagagagactgctgaattctgcatgcgcccgttttgctgtcaattttgcagtgtcctagctgctgagattcgtttgaggcgggtagcaccgctcgccgtcagtgagcttttttgtgccaccttgcgtaatatccttctgaccagaaatgggcagccctccaattactacagcacaggtaaagcttgtcagaaagaatccagcagctttacagagagcgtgaaaggtgtgctaaacagtgactgtggtaggggcctccagccacgcaccctatgaaataggccagttttgctccccccacagaagctctgtttagtagttttcttttcggtcaaaccaagacatatcttaactagtagctcatctaccatttctgcggtagattgtaacttcttccgcgtccgccgtccctttcatcttctgtatttcctgcggagctgcaccgccgctcaaggacgactcaatccctgtctcagacagttgtagcatcgatatcgcttcactgaaacagattgctatacccattacatgcgcagaaggagttcatgaacgcagagagagcgaatgcttgcggtgtgctattccactccgccaacgtcgatagccacacacgtactgcccacgtttgcatacgcaacggagggcggcgtcggacatcgagccaatatacttcagatatgtatcactgaaccttccacctcgttctgccaacaacgagcctcaataaagaccaagctctcacattatgtgacgagcttctgtcttgaacaatgctttttttgcgtgggggagtaaagattttttttgagacgaacgaaaggtcattgagtcacatgaaggcacattatagccgtatgtccttgacaggacagcaagacgcgtttgccattgcatgcatggattccactttgctggcctttctgagaatgaaatggagtaggaaactgtctacctgcaggctaggagagttcccgacgacacatcgttgcgtggcagaaccggacgcatccgtaagcacacgactcaataaaaaccaactagcaacatgggtgtaatttgctgagccaaatatgcaatgcatattcttggttaatgacaacagtacaagtgaaaaaagtgtccaggccaagcggattttctcagcatgcgttcacttctgctttttcctggatgtttctgattctgatgctgacgcaaatctgttggcgccattagcgaggatataccatttaatgacgcaaacacggtgagattcaattacatgttcattttcctgcaggatcttcttgcccgtgacacgtttttctgacacggttgccgaaacgtggtgtacataacatcccttcgcggatatctgagtgtctggatcaactccgggtgtacatacaaaccaaaggcaaacgttcgtgttcagcacgatcgtgacggcactgcagttacacaaactccaggtaccttgaattaaggcgcctttctgccgacactttccttcagttttctgatttagacacatttccaa

SEQ ID NO: 3117 - DNA, 3718 bp, Toxoplasma gondii
tccacgagatgtctttgacaggcgaagcgaagccagccagagagaggacttgtgtcttctcagaaatgcaactatctcccccctgctgtccacccagacgcgcttctgcgttcccctccctcgaagcctcgcccgcgctcttcgaacacgagggtcctccacacccgcctagctggacgagcttcacctggcagtcgacggccaccgcgagaaatcgcgcgtccggactgaggagcaggagagaaggaaacgcatctttcgtctcgccttccttcgacgcatgcaggggaagacggccgcgagaaatcggcgatccgcaagcggcttccgttgcgtcgaccgccaggatgctgtcgaggcccggcagcagcagcacgccgcaacagtgcagaagacacaggctgtcagtacacctcgcagccagcagacgctcgggaagaggagcgggagacgaagaagcgtcgaaaagcagtggagagagaggcaacttggaagctaaaaaagcgaaagagcggggaagacgcacagcaacgagaagtcaggaagaaagactacactcgagcgtagacagagatgctatgaaaaaagagcagagaaactccagggggggacaagaggagatatacgcgcatgcatgcatgcgatagagagtttcgaatcctaaggttctctctccaccgcaacataatgtccttctacatgcatatacatgcatatctacatataggggtacgtatgtatatttgtagaagtgcacacaagtagtatcagtgcacgacgagggaacgcgttcctcgtcatggtgacgaaacgtttttcgtctcgacctttcgttgccgaatcgctcctccggtgacagcacacctcatagacaccatataaacaggtggatgtttcgcctgcgcatgcacaagcggcattgcaatcgaactgagtaggcgcgagcgtctgcgtctgcatctccagagctcggaaagacttttctgcttctgcgtagaggaccgcctctgactcaccgtgttggaatttgatgtatggacattcgtcaacgcactccacttcgtatccttcttcgaaagagttcgtcggcgcgcggggaaccgagcaagcgatcgaatcctgaagatcttcttccccttcgcccagaggtgcctccgcacccacgagtccttctctcgtccttgcgctcgtcattttttgcaagctccgcgattcagagagaggggggccttttctgtctctcgacagccaagaacactacagcgatctacagctcgggaaacagcgaaacagcgaatacatatgcatacatctatgtgtgtagctgtgtgtacgttgacgtgtactgatgggtttctataggcagttacgaggcgagagacagcggaggcaagcagagaggagcggaagcgacggaagctcgacgcagcgagaacgggagttcaagacagagtcccgtcggtctctctgcgctctcacattgttggtcatcgtctgggggggcgaatatcctctgtcttgtctttttaaaaaaatccttttccccagacccacgatagaaaacgactacacgcgcggtcgcaggggagagaaccgccagcgctggcctcgcgtccgtccgagcgatctggggcctgcagaaagaggactctttaaatgcgacttagagaaaaaacgaaggcagaacgccacgaaacacgtatcacataggcgtgcaagcagacaagagcgcgaagccaacggagggggagccgcgtttcccggtgtcgattctgaatctgagacgaaggaaagagccagctgatcacgaaaggcagactggccggcagtcgcgtctctggcgtatgtgcagcgtgcagagtctcttcttactgcgttccaacagaacaaagtggaggctgtgtgtgtcctctacctcggcaagcgcgttcgagagttgcgcgatttttcggcgttgcacccgaatatacgccgaatcgcggatccggacgtgtaaagaagcggccagtcggagagaccccacaaaactggacgagtgaggttcccgtccttggagggagatgactgggagacgagtccatgtgcagaaaagggagaattgaacaagaatagcgggaaggaaggtggtgaaaaggcggtaggcgaagcggcctgcgaaccgacagtcaatcgacccctcagatgtacgtacacctggtgcagcaaggcgaagcgctcgccgcgacgccgctgctggcaacggaagcagagcggacggagacgcagaagcgagcagagaggagtcagtgtcggaatgtgcaagaaggcgcgggtggcgagtctcgcaggacgcttccgttcagcggtcgtgcggcgggtcgagtaggattttttgcaggaggaaacgcaagtccagcgtcgaggcgaaagagacagcggcctggtgaccgaggccactgccggcgctccagagaggaagcacgccacgagacagacaagcgaacagctcccggttttgcgctttgcgggtgcgcgtctcgcttccccagaaggtcgccgtcgaccgcctgcacccctggtgtatgtacaccgaagcttgacgcgccagcacccgcccgtgacctgtgcggcactgagggacgggggggaccaggaagcttttcaaatcaaattcttttgagaccaaagccagcaacgccctgcgtttaagcagcaattgcttgacgtttttatcgagctccacgctccttgacttccagtcttttcccccgcgacccggcctgcttccagttgcgtcgccttcgcctgtttgtcctctcgcaaacggatttcctgcattccaacacgcagaagcttcagcttcgctccgaacctcaaactccaccgtaggcgtcaactcggatctgcggaaaagcgaaactcgtagaaagacgtttagcgccagtctcccttccgagcacctgtgccggctcgacctttcttccccaggggccctctgtctctcctgtctctccacttggtcctcgtccacttgtctccatccgttatctttgtctcgtctcttgtctctctggggaaaatccagtcagtcgtcttctctcttgttttcttttgtcgtcgctcctccccggtgtcgcctgtcaccgtttgattgccaatggtggtccctctgtctgcggttcgacgcccaacagtgtctgtgacggctcttcgcaagagagtgcacatcccggcaaacgatttctctgtttcgtgaacttctttccgcgtctcgcgaaggtcgacgctgtctcgtgacagatgctggcccgacccacacactgtcaccacaccgcagccgagcgtccttctccttcgcgtcgtcgtcggaagaagcgcttctctctctctctcgctgtctgtacagccgtgggagaatctctgcatgtgcagtcatgtaaatgcaccgcatgtgtagagctggatgcatgcaggctggggagaccggcgtaggcaagttgaaaacaggtgcagaggtgcagctgcgactgcaggcttcgtcttctcgcactcaaaaggccttgtcttctcctcgcatcactctgctctttcatctggtagcagatcgctgaatctgtctgtgtggggcgtctctgtaaatctcgctgtcgaccgtccgcttgctggagcgctcacctctgtctgtacactcggtctctctgtgtgtgtctgcagaatcgcttttgtccgcagttcaaga

SEQ ID NO: 3118 - DNA, 2676 bp, Toxoplasma gondii
caggtaccttctctccacttacccgaagagaccaaaatgggttgtccggcgtagaactggagcgagcgaatcggcccctcgtgggcattgtcgagagagccgaggaacctgcctccgtcgaggctccagacgaccaggtcaccgttttttgctccactcacaagcacggcgcgcatgtctgcagcgtccacagaggcctgtgaggcaaatgcgtcgttccggaacgcgagggcgaggacggggccttgcgcaggcgagtgagcgaactcgaggaggagttcgtcgcgccgcaggtccacgacagcgattcgcccggacaagaaaccgaccgcgacgacgtcgggctccggactgagagcggcaactgtcaccgcgccccatgcagaagaagccgaggaagcgagggaagcgaaaacgcgggcggcagatgagttgtcctcctccgaatctgacacatcggaaccagtgccggctctgcgcgcctgcacaccttcccccgcatccggcgccgaggtgtctaggcatttgagctggtggacgacttgcccagtgcgcaggttgaggaggagcagggcggccgagtcgaatccgacgagcactttgttcaggtatgtgggggggtgcacgagcgcggtgaaaagcggcaggcgccttttcgcggccgcggcggaagcgaagaaatcccggttttcacaacggcgaacgagctccccagatagccggttccacacgcagagctccactccggagaaggtgagaagccactcgccgaggacgagcaggccacgcagtttgaactcgggggcgtccggaacggcgcgatgcgcgtgcttcgccggtagaaactccgccactttctccagcttctcccatccaaacacttcgtacttccccgcggtgtacaccgtcgagtggtgcacggccatgtgccggatcttgtggccgaggggcggactcgaaaataccagtcgcagtttctcgccctcaaacacctggaacgcccgcccggtgctgcacgtaataaagtgctccgtgcccagcctcgccaaaccgaacggcacagcctccgtcactttcccgagcatgcgcacgggatgaaacaaaacgctgccctcgcgagccgagcgattgccagccgccgcaggggtcggagccggcgcaaaagcagaggcgtgcgcgtcttcgcgcttgacggattttcgggacttcttcgctgcgtccgaagtggcgtctcgacttccggaacgccccttggcagcagaggaagacgcgatttcgtctgcgctctgttgagtgcatgggagggcggctcgcgacctccggccttcccacggggagaccccgccggccaccaacccgcgcggctgctccatggccactccaggaggcattctggggggcccagttttatggagagaatcgatgtggggtctaccgaactgagaagcgaagaaggacgcaaagcgagagaagcagatcagccccgctctttgggatacgaaaggcagaggccgtgcgccacaaaaatcaagaaaatcagtgagagacggctggaggaagtgacagccggatgccgggacgtcaaagaaaatgaggaagaaggacgacagatacggttttacaaaacgcagttggagctccacgttgctctggggatctcggagcaacgggacccgcacagttggtcaaatcagcgtttctgaaagcacagagaactttggtggaaaaacggtgtctccactcccatctttttctcctcttccccagcgggctgactcaaccacggaacggcccctgacctgcggtctgcacgtttcgtgtcccctttgtttttcaggcagggaagtcggcgacagcgcgttcacttcttcaaatcgcctttcgagaaaaacaccgaggaaacattcatcggagataacagggtttttttaaggaatgagagccgcggtgtctcgattgtttcggcggcgtacatgcgcgcatgcaagcgaagtggaagagcgactcctgtggtctacctaggaatctgcaagggcatccactgccttccgcctgaagaaagagccgtacaaaaagttatagcaagacaaaagcggatgaaaagaacgaagaactcgcctcgtgcgagggccccactctgcaaatcacgctgaccccaaagccgcaagcgcatgtaaggagaatgccgctccccccttgggggctagcgcggcttctactctcaagcttgacggtcgaaaacggttcctctcgtgagaaaagaaggcaattttggcagtgagagaaggaaattggagaatgaacgatgggctctgctttctgcttgtgcaaccaaggcagcagacgcctactccatttctgtctactatgaaagcctcgtcaacagagtacctctagtctagtacaaatcgcgcgccaggcgtgcgctgcgcgaaaagtcgatgggaagctttcttaccgaaaacaccgtgcctgtgtgtactccattgtccgcagctagcgaagatggagctaactcacgcacaaactccaagacgaaagaaacagacactcatgtgtgccggttaacacggctcttctagtcttttaagggagggctgccgaacgaacgtcgtgggctttgttgtgccgcaagatggcgacgtccggcgttagctgcaagacggtcgggcgtga

SEQ ID NO: 3119 - DNA, 2378 bp, Toxoplasma gondii
tggttcaccattagagcgaaggtcactggagagagttagcattcaggtgccggcagcggtactccgtgtgaatcttttgaaaatacatcgagtagtgaggtgtcctgcatgaaaatgaacaatttgttgtgcgcgtatctttactaagcggcagcttacagcgactgtcgatgatgaggtccagtggcggactttcagcgatgtctacagcagcggatctcttctgtcaaaggcacgccatctcgtagaggctcgacgtcgcgtgagtgatcaaatattgtgtataagtttttaattttccaactgacttcattattgcgcctttctgttcgcttacgcatgctcttctgacgaaggaaacggtcgtactctccccacctacagggagcaaccgtacccacctttgtcgtgaagacccaacgacctcttggaacggggtagtgtcagtgtgtttttgtgaattggtagacagtaaacacggcggaggcaactgcttgctgtctccacagggatggaaacgcgtttgagagctttgtactgcaagcttgctcaaacggaactcccgtacccagaagacactgtcaccccttggccgtacaggaaacaccccactctccaatgttgtttttcgctgggaatatgaagaacaaaaactcataagtgaccccaagcgcatatgtcggacactacattcgagattcaacgatcccaagaatgtttcgggcgcgccgattcggcacagggcgaagaagctacccatctcactgcactcggaatacgttgaaacctcatttcctctgctctagtactcatctgcgagcgtctaaacaaagacggtggccgacggccgtctaatgtagaatcctacctaagcatttgcagtgggggcgagtcagtttgctatttaggctgttctacacaatcccatctcaggggagatcctgagtttcctttacaccccggaaaatcacaacgaaaggttagacaggaggaagtacgtacacccttgccgtgccacagagaacggggtcactgttttgggccgcaactagttttttacttccgtttctcgggaaatgaggggtcgtttgccgcgtgagtcactgggttgcggcaagtccgttcgggtagctgccggccaccactctaccgcagctgaatttgaagcgatcctatttcggtttgcttgcacatcttttcagaagttggcatttactaggattttcacaggaaagatttggctttcagcctgtgttccaatcctccgcccccgttgtgctggcgaggacgatcttcggcggcagacgagtaacgtccccttgaaaaagagtaccaagactgtttgccgtctgttcgactcccgtctcaattttactcgtctggacagaacagacatcacaaacgttgctccgctgcggtttaattctttcgttccagcgaagaacagagaacgcaggaggcacgtaccgggaacgtgtatgtctttgccggagtttcaaaacccgtgcgcgaagccgagtcctgttgctgccctcaaagccgcttctctgtaagacacggcacgcggacgggggctactatggtgaacctgcctctcgagtatcatgcgcgtttcctcttttttcctgcgaggaactccgtggcgggcgctaaagaccgcaaaaagccgtatttctctggtttttttctcggctatatgtgctctttctgaacttgttctctagccgagtgacggctctcctagccacccgcgggtctcgaagaacgcgccacttgcgcgtctgccggcttctacgtccgtttcccggggaaacaaaggcacagttttcggtcttttgcggcagtttaaggagaaacgtttctccgtgtagagttccctttcttttgcccgccttctgtggctccccgttttgcgactgccggtcgagtcctcatattataaccgtacaatcgttgttttcctctcctcagaacgcgttctcttcgtccgcctccggttttaccggccttcacagtctctcctcgagtttttcgcgaatctctttccgcagttgtttcggtgcgttccgcctctttcccctccgttctgcaagtccacagccacgagctacctcgtccgcggagcagcctcgggtcgctggtggctgcggattccgccgttgcgggtttacttttttccctcgatgttttcccgggattttcggctgcaacctccgtcctccgtccccccggagcggttctgtctaagttttgcggcgcgtactcgcccagaaagatccacacactctccgcaaacacccagaagctgcgagactgccaactcgcgaggccgggagagtgtgacagtggctgactgtacacccgaacttttgttgcga

SEQ ID NO: 3120 - DNA, 2239 bp, Toxoplasma gondii
tttccactctccggcattgagcaaaaggccaagcctgaacttgaagcgagagggtgacaggaacgtcacgaggggcgacagaggccgctcgtttctcgaaatcagcgcggtcaaaccgtaaaaccgtcgcgccgtggtgtccaggagtgctgcgactagacgcgcctgagaagcccccgagggcaggatgcgtcaaatgcgatgaactcggggaaaaaaactcaccgataggtcttcgtttcctcgccacgggggtacttctcatacgccggagctccaaatcccccggaggggtcaccaatgccggcatacatcgtggagaagcagcggcagggcggagaagcagcagagagggagagaatcaagaagaggggaaatcctggaacagcagacggaagccgagaggaaagtccgcagaaagcgtcgaacgaaagaaaactggcagacgagagaggcgacagaacggcatgccaagaaggcattgcagagacacaggaagactggagctgcgaacgtcggcaaccgtcgaggggacagacgcaaaagatgacaagaagaggagagagagaggagagggggaagaggagaggagaaagaggacagggagaacaggaaagggggaacaggagaggagaaagagtcgcacctgaggaaaagagattacggggagttatccagaaggaaccgtcgccaaggtgtgtcgaaggacagcgaagaagagaagagggaggtgacgatacagcgaggcgctcaaagggaagcgagaacgaaagaggaggaaaaagaagagaaaagcacgagggtgaagcagagacagcagagagtcccgcagacccagctcagagaaagaaagaagcgggtcggtacggaaggtcgatgtttttattgacggcacccgttaccttcagaagcataccgttctattcttagttgtcctcattcgtacaagttaaatcgagtaaagcgctgtgaggaaagaatcttgcttgccgccgcgagggccgcgagtggaggagttgttcccgccgtagttggcgagagcaacttgctgcgtctctcaatcacctacaggtgttgtttacaacggtggcagtgaagccgttgtgtgagaaaaaggagatcaggcggaagtcacgaaaacacaaccgagcggtgctggcctgttcgagagtcaagaacgcgagagaacgagggcgccgtgcacaaaaagggacgaacgagagaagttgtcacatctgtggtcgatgtcgccaagataccgacgtccctgaggtgtatgtacaccggaggtagagcgagagtccacgtcaggggatatcgatcctctgacgataatacggcgcacaggctgtcggggtacattcaacgcctacacgcttcttctttcatgaaatctgcgttcaagctaagcagtccgagaacggagacacagacagaacacaggcgacaccctcctgcactttttttcgacgaaccctctccagtggaccgagaagtgactccgcttgtcccttgtgcaactggaacagtttttccactgcgaaaccgcaactccatctccacgcgcctccaccgggtcgaccaacttgtgtgcttcctctcttttccccgaaatctgtgggaaaataccggagacaacctggcaagttcgttgtcctttttcaacagttagcttgcgtgcatgtgcagcatgtgcacggttgctggagaaacggagagaagggtgacgcgggtaaacctgcatcggtttgcgccttctgctcccctgtgccacttctcgttgcgttctttatcgccgaaaaaacggcctttcccgtgtacgtacacagcagagtcgcttctgctcgcgcgtttggtttccggcattgtctgtcgtccccccgttggaattttcccttctcttgtcctggagagtggccgctgttcgtggtgtctaatcgagggcgacttcgcgtctgtttttcttgtatctgcatctgcgagagcatctctcccgcgctgcgccgagaagcgtggagacgcagagaaccaaaagcagctgaggaagctccggtcgctctctttgtcggcgcctacgtgctcctctacgtctttttacgaatcgtcctcttccaggcatcgccccgatcagctcgacattcacatgcgcataaatatgcgcacatatatgtgagcttctgtacacccacgagtgtatgagcgttagtagctttgtcacttttcccctctcgtgtggcca

SEQ ID NO: 3121 - DNA, 4446 bp, Toxoplasma gondii
ttttccaacaaaggcgcgtggcaggcgggttgcatgtagctccgaagaaaggacggcgcgttcgccactggagagagcgtcttgcgcctggtacgtgtggacaagacttgactcttcgagagtccagccgctactgcgaggagtgaatactacgtactccctgtagacctgtaaaggctctttttccagtatttcggggtgtctcggatcgagaaaagcggaacgagtgaaaacacgcgtcaggcgttttgacaggtgtccccgattaacatactcttttctgcaaagcgagcgaaggcaacgaaaggggaaagaagtacgtgtcggtcgttccgagcttgtgccgaaagggtttagagaagtacaagcacgtagacccagcagtttggaatcaacgagctcacggggtctctgacgcatagaggcggcgtggcagtaaagacgtctgcacgcggcgaattcttggctaggaacagacagtgcagagctgtgtgtttctcttatgaagaagggtttagacatcgaggaatccacgcattttcccaaagtgcggacaggcacagaaacaaagaggttccggttcaacccaagaactgtaaggggacgatctccgtgtgatggcatacaccggaaaagtctatacagataaaaacgtagcagaatggattttctacacgcgccggacgtttctttccttccaagttttccgtcttcggtcgctgtcgaaaatggttgtttttgtgccgacttgaagtgtctcgtcattgttcggcacacattccgcaggaatacttgttcgttcatggtgcactcacgttcatttgaagagcagctcagctgcagacagattcggttccacgaacagggcggggaatgccacactccagtacggcgaacccgtgtgcatgctgatccatgaggtattccactgaatcggcagtggaggggctcatgcctcgaaggtagggatgggcgacaactcacattgaggttctgcgtttatatggatgtatatgaatgtgtatgtggacacctctagtatgtgaaaggctggcgttcgaatgtacagaagcacagtggtatctgtggtgtgcatgcctttgtttgggtttgggtatgtttgtatatgcaaaagaatgtaaatgtagacatgttgacctaaccgtcgcagtctccctgttagggaattccgttattcagggtcgagtacgacaactgcctttcaacaaagtgcgtaaaatgcgtttgccttaaatccagtcgcacgtcattttctaaatcgtttgcatcgcccttgctccccacggtatggttctgtttcttttcgctgcaaacgtcccggtagttgaagacgctcgctttcacaagaaacacagtagttttgcccaagtactcgaaagaacatcaacaccaaagaaggagaatggtattcgtgttcgacttcggacgtgtttggctgccccgagcctctcgcgcactcgggatgaacgtgcttcttgtactgggcaaaacgggacaaccagcggtcgccgaactgaggtcggagtactagcgacaattaggaaaacgggtggggcatgacatgtctgccttctcagtacccatagacacacggcgaaacgatcatggtgcgcgtccatgtttcccgaggcccccacccggaggcgatgaagattcagcgttgtacttgcgtgtgtttggtgtacttggggtcacttgaacgtcaaaagcacattcttgtaggcaggtagaacagtctgcacccacagccgaaatgctttccggtatcttcctcgaggacggccgaacgaccgcgtcaagtcttaccgcttttcactgcgtgtatacactctccatgtttcctaaatttacaaatggtcatagtatcatttgcttccgtttcatgtgccgcgagaagatcgcgagaggggcagttgcaagttagcaagtggctaccgactgacgaacaccgggctgtgtgtagcgggggacctattcggtaccacgacgacacttcgtcgcgtctccggcgctcgaatttcaggcaccgtcaacgtgtgtgcggtcctccgagcacaggctgtctactgtgtaaaagctgcttgcatcaaacacggacatcttaaccctccacatcgacagctcctccgcgttttgagagatcggtcgaaaacgaagccgcgattcacggccacgagctttggttcgtacagctcactggagcgaggacaggacttcggaacagagacccgccttgttggtgggcactccgtctcttatctgcgatgctggcaacccgtgtggagagcacaaagtcccggcgtgtgttcgtggtgccggggtgattcctgcttacgccgtcagcgtccagcgggacctgagcgtggccagaggctcctcacgttgccgcctagagacctcagactcgactggtaccactacacaggcgggggaattgcgacacaacagccaatacaggaacccatttggttgtgtctccatttgctggtgcgtcgctgaatcgcgctgaacgccatgtgcccgccagagcagtctccgtcgtctgcgtcgcgttgtcgctcgttggcgccgtttcctcggtttttttcgaataccggattttacaaccactggcacgcggaaattgagaaacgggcactcatgaactcgaagcggcgtcaggtccgtttgctggagtgtcgtattcgagtcgtctgttcgtctcctctcccgtcgctacgagtgcacagtggtgtgtacacgctgggttcttcaaacatagatcttcgggcaactcacagacacttccagctctagctggtctgctttcttctgtgtacacacacggcgcgagatgcctcccgacgaacggacgggagtttacgtattttgagagaccgttgaatctccttttgcgtacccgaagcagcctgcaggcgctccttcccacgtgtaccagtcggacagatgccagtctccttccgcaggaactgcacctacgcgccacttgcagtttggggaggggggaactggtgctgtttcgcctgcatgccaactgcgggtttgtctacagcgctgttctgaaacttcagtggtctttttgcgtttcgacgcgtcttggttggcaggcagctgtcggctccctcgtaaaaaatgcgttttaactcggagagggggtttccgccgcccggcagtgcgccttgctgcgccgtgtgttctggcttctgtgtgagtaacttttcttctcccaggtttctctgagatttttgggagttttccctcttttccttttcccgtgctgtcgaggctctgccgaaaaatcaacggctttctcgtgccagtgcgaggacacctgcgcggtgcggcaaccaagaggcacgacattgagcttgactggaggcggtttccacgcgcgttcgttttccagctccctcagtcgttgccgttcttcccagatatcagttttttcgatctcgtgtgttttccctggcgcggagatgcctttttcgagtttttcaccaccagggtcttgccactgcgctacacactgcggtatactggtgatcgtctgtttccttgtccctgtctcgtgcgtcgcgggcgcgtccgggaccctgtgtaggttgcatcgattctgtggctattttcgaaagctggaggcgactcgaatctaacttatcgttgcagtgatcacgcaatgcgggcaagatgaacgaacgaaacttcccctgacccttctgcctttctagttttctgagcgatgctgcgttgccatctcgtaccacaatgttgtcccatggaagattctgcagacctctgtgttcatcttcatctaacagaacgagagtgcaacctgctgtgtatcttcagtccctcgtggcaatcacagcagcacgggcatctgacctggtcaacaagcgccttcaccatttaatctgcgtttaccggaccatgtagatcccggtctcgggcgtccacaagacgtcgtcctgtatgtctgatccgcgtaatttcttggggcgttcgtctttttccccatacactcttttctgcgtttctctgcgaacggacgtgcgtgaatttctgatgacgagtaggcggtccggggcacaaggtcaccggggagttgtttcgtatgtgtctccgagtttgtgcccctgcaccttatgtggggtggaacccgcgtgcgtctgcgttctgcgactccctttaactttccaggtggggtgccttcctctgttttccagtcgattctgtagagcacgtggcccgcctcgtctgtcactgacgagcaaagtcgccccagggagctcgagcgactggacacacccgttcttgttggcggctgtctcgtcctgtgttttcttctgtttttgaacttcgctcgtagaaagtcaccgacaactgtgcccgaacggctgcagcagagcccgttgcattccgaaa

SEQ ID NO: 3122 - DNA, 4963 bp, Toxoplasma gondii
gcgaagagcagaaacgtcgtcgggtggtccggaatgcaaatcaagcctgcgttgtctcccccatccccgcctccacaaagagcagaagaacaaaaggaagaagaggaagaagagctgtcgagacgagcgcggtagagggtaggtgcgctgtgtttttcgcgtagctccggtaggaacggtacagcatcttcgtcgttgtcgtcgccgtcttcttcagggtcggcttcagtgtctccatggtccgcagaaaaacctccgtcggaccgtgcgcaggccagcgctgagacctttgcacgcttgtgatttgactccaacggtgacacctcgtcgctctgctcggcgctcacgccctctccaccctcagcccgccgcaggtcgacttcccaccctggaaacgaagctgggggcgggaccttgacggcaaaggcccgcgaacccatgaggccttgtccccaaatgaatttctgcaggtccagggccccgagaaacgccgagatctcctcccattgtctccgtttctccgcatccgtcggttcacctctcgcgcccgcgccggccgcggcggcctgctcgccgccgtcagggaagcagagtgcgaggaatttttcgtacgacgagaaggtgtctctgaggaccgggaggagacggcgaaagaggttgaaggccttcagctggctctcgtcgatggtccgcaccaacggggtgtcgccgaggaactcggggatctctggcggtcctaagaggagcggctgctgcctctcgtcgcgtggcggcgggaccatctcctgaaagaagaagcggaaccgggaagcgtctccacgctcgacttcgaagagaaaatacagtaacgtgactgtgtcagtgtcgaccaggggtaccgcagaggcggccgagtcgctcgcggctggacgcgcatccgcgggcgcgccttcgtccgcttcattgggtggatgcgcgggccgcaaggtgaggagaaacttgacaacgtgtgcaaacgccgggtcccgcaggcctccataaacgttgaccatcgcagtctccggcacgtcgacgacagtcgtcccggcgggcactgaagtcgaacacatcagcccgcggcccgcgccggggatcttcacgacctggatcgccgggtgtacgtacaccccgagtttcttggcttcttcgtggtacttcttcgtgaatgcttcgtcgacttccgcgcgtgcatcgacgggggcattcgccggggcgcagaagcgatttatcaggtgctgcatgtgggacacgaacggccgcagcagagctcgtctgtcctcgcttgacacaggcatcgacgcagactctggggaggcgcccgaggtcgcgccttcagcccccgtccgcgactctagcaccacgagctcgctctcgtcaaagagcgggaccgctgcgtccacctcgcccttcttgagagccaggaagcgtaggcgattctgaatttcaaagagcgcgcgacgaaggttcgaaggcgactcacaggcggccagcaaaccccactcttgaaagcgctccggtgtgatggcgacgactggcatgcccattgtctcccttgttttttctcgtccctcgcctgaggccacggcgcaaaagttctttggagcttcttcggcgtccttcttctttccggaaacaccctggtcctccggcgtcactgcgagggcatccaccttcccgcctcggcgcctctgcgcccggcggccgcgggcttcgcgctcgagttcgcgcgccaccgcgtcggcaaagtagagatcctggtcgctcatgtagcagatccgaaaggcgtcgaccagctgtgcacagagacagcgaattgcaaaaggagacacgtctctcgacggcagatacgccaccgaggtgggaagacccaggcgctccagcagccgctggcgaaacgctaaacgtgacgggcacgccgtctgtgccgtcagaggcagagccagacccaaggctcccggagaaggacatgcgagacatggcgaacagagagaacagcagagagaaggcggcgaggaagaaggggaagaggccgaagaagaggaagaagaagaggaagagagcgaggaagaagaaagaggagacatcttggtgttagagggtgtaaggtgacggggcaacccaggacgaaggacggaggtcatagagaggagagaagaatgaggaaagggtgtgagcacggcctagacaatctgtggtgggagaagaagaagcagcggttagagagagaaatgcatcggtgaaatacgcttgacagggcgccggatcgtgtccagtgctcctcgcccggaggtcgttagcgcaaacaagcggtgaactccgctcgaacacgaatccacagaggcactcgccttgtcgtgtgcatgcgaaaatgcgcacatacttctgaggggaagaactagcccgacatcgtccggttgaatctggttcctctctcccacacggcgttgagccgctggcgccggcgggaacgacaagcggaagggaaggctctccccagagagtgttctcaacaacaatcttcgttgactcagagaagaacacgaaacgaaacacacacggggaaaaaagagaactgggagtcgttccgttatttttcatttctcgatgctgctatgcgaggaggcaagatcgcgactgcgcctgtgcgtacactgcagaagcgcgcatgcagcagaaaccacgtgctcaattccttctgttgaactacattttctttgctgcaaggagaggaatgaaaaacgttgaggcgcctctccctgtccgatgcgtttccacacacttatgagaggctaactttgctggacacagtttgccgaggtctctacatgcgacgtcgatgctccgcgacacgcgtgtgcgctttgaaagcgtcctccaaggcagccgccacattgcctaggcacggcgtgagcgaaacctcacactcattaagatcttagtgtctttgcagactgtgtcaggccaccagggcctttcctcgttgcagatgggaacgacacgatcgcatcacttctctccgaaagccacgaaagccacgaccaatgtagatagagatcttctggcagaaggtaaaggtcgacatatgcgtctttctgtacgtacgtacatttccgaagtagtactgttgaaggcactttacacacaccgggtgtgtgtgtgtgtgtgtgtgtgtgaagccttccatctatgtatgtcaacttaggcgtacctacatgtatatatattttttgtacgtatatcgtgggtttttgtgagattgcgcattatttggagaggacttgctcgctcagacacactgttgtacgtgtgtgtcgcgttttcggtatcatttctgtctcttaattttagtgatccgtttgcagaaaaaaagcctgagtgtctgcgccgcttggtctaggccttcctcactgcagccgtggcaggacagcacaaccactggactattcgctgggaaccgatcgcatggggctcacccacagatcctgaaggccgcgtgtctctgttggaaatagacaactgtctcatcgtttgcatgcgcacaaaaaactcaagaacgtgtgtagccgctctggtctgctttggtagagcaggccgggagcgagcggctggctccactcggggttacgggtttacctatagaggcacttaagatctatagtttttcgcttgtgcgaactgatatttcgccttgtatcaccgtcgtgatttctggcggtcgggccgaggactggaaaacgcttctccttcgtctgccgattgcgcgtctcgtgtctccgctccggcctctctccgtgccgtgtgccgcgtcggctgtttcaatccgaggctcacgggggtgttttattctcctttgttttggctttgctgagcacatcctcggacgagagtttcgttggtagtctcgcttcgagttctccaatttttttcgcttgcgtctgaacatcttgcgtctgtgatgattcgctcatttgcgtccccacaaaaagtgccttggctcggctagaactagggaacacgcgacatccacttcgagacgcggcactttatggggtacttgctcttcgcttcgtttttttaaccacaatggaagacaaggtgtctttctttctcctcgattttgtcgccttgtgtcgaggccggtctcgcatggagggggggttttccgcgtattttcgcgtctctcttttttgtagtggcagaggtgtttgacgtaacccagaaaggctttttcacagagaaatacacatgtgcgcaatttttgcgagagatagtgctctaaagggttagccatcgcacggcaaaaaaaagcgatataggtacatacgtggggatgcgctcacgtggtttcgtccctggtttcttgtagaccttttttatttcgtctcgtcgcgtcacgagaagcccagcggctgtccagtctttcatccgttccacgctctctaggggagaaagaagctagagaaatagttccacacaagggaacctgccgacaggtgccgcgaccgacagccgtttagggaattagtaataatccggttatgcacagctacgcgtgcttctgcatagatctttctagtcgctgttctttgttaggctaccaggtgcgcgaccgaagtggtttgacccggtcgcaaagaacggagaaagtagtagtctgcgtctttgagattcttgtgtgtcggccggtgtccccttctccgttttgtcggcgcggtttctcacaagatctcgcagcgcagcgtagggacacttctggcgtgaacactacactggcatgtggccgtatacgtgtgcagttgacgggttcgggtgtcgtccgatcggtgtatttccatagatctgtatatttgtgcggaaccctgtggtcgtattgccagtagtctgccgtcagatcccaagtttttcggtgcagacttgtttcgcgctcgtttgtaagtcgtaaaga

SEQ ID NO: 3123 - DNA, 4059 bp, Toxoplasma gondii
agtcttcatgtagttgatattctttctcccgctatgacggccctcgcacgcttcgaggcatgcaagcggctcgacttttgtacagctgtaagtcggtatagattagcaagtgcttttgtgaaacgtttttcagtggttaagtttttgtttccttttgaaaattttaaacaggttgcgacgacagccgctagcaggtttttcgagggcgtaatctctctcaaggcgtcgtctgtgttgttcggggtgttctgtgcgtgctgttttttctggttgtatgtttttttagtgggcggacaactcttttcagtttgtttcctcccgttttcaagcgtgcggctgagaatatatatgcgggacctcttcaccattggaactctaattggataactggacaaaaagtaatagtcttgaaaggatcagttgtgtataccacaggctatgtcagtgacgtgtgcgctgcagacttcgctaggtaccggtgcaaaagctcgtagtatacacaagactcaattctaagtatctagtttttgactttcgaagtgcatgtccaccaaagtggtaaacgtgttatgaagaacaactctgaccgtttgttctacagaatatttttttccgtcgtcgttgtagcccgtgaagcggtcagaccaatgactggagcgttcgcggcgctagtcagtagtgtgtgctcgtctgttctctgttggtagaagccattctttgtaagcagcgcgccttctgggacgaagtgatgcaactgcgaagggatgtatcaaactggaaacctagtgagagtctctggattcttgacaaggcgaagcagcgccgctacacctgcgaatcaacgtttggttgtaactccctcatgagaagagagaagaaataaatccccttctatcgtctcgagtaacactagtggtaatatttacagtattggaaacggttgagaaaacaatgtcagaagtgggattcgaacccacgccctcgcggactacgacctgaacgtagcgtcttagaccactcgaccatcctgacgagagccctacctgggaccgctttcgccatccgcgaccccgtcagagtcgatgcagaagatagttttgcaaaagaaccggaaactgttggtggctaaagttcccgttgaaacctctgctgatacgaaattcctcagtgttgcaactactcgatctcgatacgccaactggtggactttccgctctcagttactgccgtccatccatacatgtctcagtacaatattgtctgaacgaacgatacagtacagctagggaaagcccagggaagatacgagattgagtcgttctcgacgtgatatgcgatattctttcatggtattgagaagtgcaggaagtgggcccgtgattctgtgtagctacattgccagcgtcacgagaaaagtggaaatacctctggcacgaggagggttggaaactcctctcaaaccctggaggtcacattcaccacggctccgcctgcaacgcacaaatataggaaacggcagcagtagaaaaggaatctctagcctcccttcaaaaaaacgctcaggaaaagcgaaagtggaagtggatagaaatgtcagaagtgggattcgaacccacgccctcgcggactacgacctgaacgtagcgtcttagaccactcgaccatcctgacattcgctctcggtccccctcttgccatccacgtttaggatcgagggttgaaaccggcgtggagaagcttttcgaggtttggtggaattcatcggagtctgtaacgtcaccctgtatttctctcatccttctcaaagcatcatttcctccgtctggtgatgttccagggaaatttccggctgcttccttttgtctatgtgcatgcggagatttcgcgcccccgctggttacgtgcagtatcgagcacaagcgagggggcttctggtagggggcttgttgtagtcagagtggcattatcggtgaatcgctaagtttcggctagccacatctcaaatggatcggtttcaccatgtgtcttttgttttctttacgagatgcaaaaggtcacgggtttgtggagtttcgtcaaagtgtgtcgttgctctgtgacggcagtcacaaactgggtagggcagacaacaacggacgtggctgaaaagttgcacatgcagtcaagtaatggtttctttctctgaaccaaacactgcgttgcaacagcaagttgagaagcctagcgggttgcaccacacttctaaaagctcgggtttcggctgcagccccaggataccgtgcatctacgtctggagcccctggtctggcagtaccaacggggtgcacaggttcttccagtcgaacaaccagagctcagagacgcaagggggctgtgggaatctccgtcagttctgtcttcactgacatgagcacagggatcttttgaggcctacactccaccgtttgcctctagagaattcgctgtgtatcgcatagataagttaccgcttcggcggcgctcaggcgcagcgttgtacgaagccatagagttgtgtggttagaaaggtagccaagtactaggctgttgacaaaaaagcttgtttctcgaagacgtttatagggagtgccgctgtggacaacacttcggccctctagaccagcagcagtgctaatactcgtactcgcttaggttctttcgaacggtatatggagacagcctgtcgtggagcagagacgtcgcttgagattgctgcggtacatagtttacagagttctcgcaagtggcctagggtctgtcagatgaatatgccacggagggtttcccctcggaaatagaagtataccgaatttgtcgaatccgattcttctgaaattcgcggtaggccctttcccgacgtgtttgactgttaccgagggcataaaaacacacgggaggactggcattcagttcccatcattttaattttcttcaccatgggtcgtcgccctcgttccggtcacggccgtcgtgccagaccaccaggtaactctcggagtgctgggccgaacactccccgggttcagcctaggtcggaggagacgagtattcgagattcagtggctgtctcacagccttttatccgtcgtaactcgacggagacatctctagtgaatgcattaagtcggctgcacttgagtgacgacagtcgtcagagcccccttcacctgaacacgtcgaatgagcacttgcttcgaacagcgtctcgaattcaagagggtaatttgtcgaaagatccaggtatctccaccacgtcgaagcagaaaactgaccaggatggaaaaaaccaaaagcaggatgattcagaaacccgcgattccaaccctacacccccgctccataaggtggattgttgtggcaatatggagctgctgaagttggataaccaagaacgagaacctggtccatctacgcctgcagtggcacaaatccctcctcgttcaccgttgggctacccttcacctggcgtagtgggtgtgtctcgatttcttggtttaggtcaagctccgcttctccaggggtcaagcaggttgttgtcactcgagacgcacggccacgtggcaaagcgttcgccagtgctgcagttcagtcttgttccacacgaagaagtctggggagattttgcaactgcgggggatgttgggcgtcatccgctcctgcgatcaggctttggtgatttgtcctcctcagatctcgggacgcggctgccacaatttcatgctgagaacgaattcgccagatacttgcacctgctttctgcaggcagctctcacaacgaaaggaagtcaaggggagtgaccgagaacgcgggtctggcacttcgacggtccccagctgctaccccaaggagcacactgttgccaagaagcacgctgcggtgcagccctcggaacactttgttgattttcgactgggacgacacgctctttccttctagctggttgcgttgcgcaggcatcgacccgctgaaccaagtgcagttcgggtcgttcagcgacttacccttgcacgtgcaagaagcgttatcagcatgtgaagaca

SEQ ID NO: 3124 - DNA, 2131 bp, Toxoplasma gondii
ctatggacttgccgcctaatgcataaaggatgacgcggactgtctcgggcacctccgggaagccgaagaaagcaatgagacttgaccatgaagaagtgttgcaagcgaaacggaagatacgtacagaaaggggagagagaggccgatgagggtcaatgcgccaaaggtgataatctttccagcggatcgtcaaacttgcgagtcagccataactatgcagaagggtttttacaaggcacatccggcgcatatcgtggatggtctacgatgatgaacactcgtatcccatgtgctggtgcaacgaaatcacttctttcagctcatcgtcagaatccatcgtggtgttgctgttgttaagcttagaagaacagtataataagcatctagcctatagcggtaacagcacaagttttactgtaccgaatgtacagggatgagacaaagttcgagcgagcattatagctaactgattgcagaatgagccaaagctgtaaggcacagtttcagaaagggcaacggacacaggtgtagcatgaggaaaatgtcggccgcagctggggagtacaatatgctttgcagacatatgtgatttttcatcgtcacaactcatcactctccccttatgaaagctaaaaatgtcttgcgctttgtcggtttccactgatttattgtactttctgcgcttcatacgagttccagtgggcacttcattgcgtcagccgtgcaatcagaggccactgcaatgctggcggggccgacatgttatatgaatatgaatcaaaattgacaacagccgctatagcggctgctcttagtacgcgtaagacaggaaagcatgggtggtgttatttatactgttacctgtgtaatcaccagcagcgttggatctgagcctcgccacgcacattttttgcagagtgacagtccacccgtacaaaagcatcgcttttacttttcgagtgttagattccacggtctgacggttcgtaagtagtcatcaggtcacactgaaaaaacgtacgaccacacatcctctgtcggtcccgctattagtgtcccggcatgccctctgtcatgtcgctcttgcatggatggatcgccaacgcagttgtgagtgcgccaaacatgatcactagatcaagttgacaccgcggccactggttctgaaggagtccttacaatccagttcggtgttcgctagttcatagagaagcagcatcatgtcttcgccttgtcgactcgttgatcccatgttcttactgtatgcaatgaagcgtacgactgtccgctaactatagctgtgtttaatcgcaggttcctcttgtgtgcaaatcagccactttcatgttcaggtgagctcaatccggaaaagctttccctaaagacagaaatacacggtgaaacaaaaatgtgatgataccccttcgtacccggcagttttgtgtgtcgctcgcctgtcgcattccggttcatgctaactcatgttcttgtaccatcagcgtttattattacttatacctctcatgtgcccagggctatcaggtggtgcgctgcatagcccgtcggcactcagtactacggcgtgacttctgtataagcgatgggccgatcgtcctttttgctttacggtagcgctcgccttgtgcgcgcatgcatgcatgcatgtctttccgtctctcagagatgcgtcgtcgtcgacatagttcacttcacagcttccgttaaacgagtgaagaaaatccctttttctgtctcgaggcagctcgtgtgacgtgtatgccgctgcgaaccgacaatctgattgtcggcttcgtcgtagaaggataagagttccccgagtcaagtcttcaggagggtttactgccgaaacaattacaacaatgagaagtgccctccagcctggctaccggtacggaatgttcctgaatatctggatctttcgactggaagcgtttttttgcccaggataagactttttggcgaggcggtctgcgcagcaagtcgtcactcgagcgcggttttctattcattggggtgtgaccgcttatcactgtcccaggtattcttgttcgtgtacagcggattcttttgtgtatacaggtgcttcgctgaagaacagtgtcttcagaga

SEQ ID NO: 3125 - DNA, 2609 bp, Toxoplasma gondii
acgaatacatccttgcctcggacctcgtcaaggatttgaatgacgacctctccgtctgcgtagcggcccagcacggccctgcccagcgtcacgttcagatgcgctgcgatctcacgcgcaagctcgggatgggccgtacctgtgaagatctgcagcgacgagtctgcgcagagttcctgatagatcgagtccggggcggaggctgcatcggacggggctgagtcggcagcctcagctacgacaggcaagggaacagacggtgcgtctggcaccgaaggcggcaactcgggggcgacgctcttctccacacagagagccggcgaggaggcgggtgacgaggcgagaagagtcacgagctctggaggtgtggggggcgcaaggcgcgctgcgggagccgaagccgaggaggagagtgatgcgtccgcgcgcactttgctggggcgatttgtgcctccgtaaaggaacgaggaggcaacaaccgcgaacgccaccgccagggcgaacgggctcttgatctccgttccgttcccgtccagggcacctgtgtccctcaggtctctgtcgaggcgcgccccggcgctggggtccacgggcgccacgggcgcgccgcgctctgtgccgcgggccccgagggcgggcctgtctggggggcggatccgttcgggcgccgcggagtgccacagcggagtgtcggcgggggcgaatctccgaggccggtggcggggcctgcacactgtcgtggaggagagcagccgacactgtgaggtttgagaccgagacgtctgaccgtcccggaggagaaacgacgaggcagcaaaggcgacgcacgacggcgaggcagaggaggaagggccgcggtgctcggtgttcgcaaaaacgcggggcgaagagacacccgacgaagacaaacggctacacgagagagagaatgaagacaaaggtgtcatgatggagaaggaagcggaggaggaagaaaggaaagaaaggctgaacgccgatttcgcacgccagacactcaccattttgcgatcgaaaacaatgaaacgctgggaaacaacatagaagaagcataccctttcgagacacagacgacgccgaacgagacaatccacgtgtaacgcatactcagaatacttgacctgggttcatatatacatgcaaactggatccatgaatcggggcatgtatgcatatcagtgagccagcacgctaccctgtctatggacctctacaagctttgtggaccatctatgcgtgacgaccagcagctgtcgcgagtagacccctgcagccgcgatcggggacagagcgccacagaaaagaacagagcgcgatagaatcgacgcaagaccggagtgtgctcgtgggggccagggaaagaaaaaagcttcttcaccctccaacggaggtcgacagaaacgctttgtcaaggactgcttcggcgccgcgcgactcaaattgaaaacgcgaaatctcgtgcgccaagcccagaaaaaatcaaagtcccccctggcggtcccgcccgcggttggactcgaagcgagagagcggagaagaaagagcgacgcagaggaaaaaccgccgaggaagggaaaacggaaatgcgcagtcaaccgccccaccgggaaaaaacgcttctgtgaagaagtaggagaaaaccgtacgagcctactcgtctctcggtcgtctgtgcagtcccggcggcgacgcgcaagcaggatgcatgcagtctatgttgcaaacgcaaacgcgcgttctctggcaaagaaggaacgacgaaccctccccttgttccagatcttctccttctcttttctcttatttttcctgttccgcggctaaaggcactgaggctctgctgaggtgacttgctctggaagcgctggattggaaacagaagagccgcaggccaggaagcggctgagtgtgcgtgtctcgcatcgtgcctgtcttgtctctctccttcaccttccctccctttctacgaaacacctggcgtttcttcttcatcttttctattcactcttccctcgcttggtggaattagtacgattcgttgctgtgcttccgagccgcctttctggggatacaacgctcatgaaatgctacagggagcagacggcggggaaaggatgcgacagaagaaaactacagaagggaaggtggactaaagaaggactaggaaactagtgaatgcaaggagacgaaggaagagaggaaagaccgctgcctctgttaggagggtacacgtctctgtcttaaaagtgggcatgcttcccaagaaggtcaaatgaggaccagtcccaaagtcttagcattccataattggatcctcttttgtccccccctctcttccttttcctttctgtgttgggtcactcttccctccttcgttttattcgcctactcttttgtttcctttctcgtcgctcttctcccctttctctttttcgcatatcccttctgtatttcgcttcgtcctgctttctgatttctcgacgcctgtcttgcgcgccggggctcggctcgcgcaaggagctgtgagacacgaaagcgagtcactcgcaggtgcctttgacggcctcttccgcttcagccagtgacaagca

SEQ ID NO: 3126 - DNA, 1565 bp, Toxoplasma gondii
caccatctaagccctgagtcctgctacatttcactgaagatcagtatcactttttctgtcgaaaagcaacttaaatgctgacagaatcgagtctcacagagaaaaccttcacctccttgcttttccggcgacaacgcgaacaagcaaggccggataaggctcgaccatatgatgctcacagcgacggactgtctactggtgaacattccagcggagccgtttccactacgcttaccttctctctggttcctaggtctgcttccttgacgatgtctgcctgtggaatagcgtacgatttctccaagccctcggtcagcagtccgctgcaaacgcaggcaaggatggtgtcgcaggcaagaagagtgttgcacccgtgtgtcggaaacatggactaaaaagcgattctcaaaaccacctggtcgcttacccttcttcctcaaaaagcatgagctcagtagtccgtagtcgccgcgtagcctcatcgttcagcttctgctgtgttcgcagccgtcccttgagttttttgttccacagaccctgtcgatatcagccgacacgcacacgggagaggaatgcaaatgactcttcacacccaaggtccgcgcaaatctagcgaagacaagcgggctatcaaccgttccccccgcttagtgtagtcgactgttccccagcttactttgagtgatgcgattttctcatgtcgttggaatgacgtcgacgttgaaggagaactggtcgctctgcgggaacgcttcccgatgggcttccgttgcttctttccggatacaacttgttcctcatcgccatcccataccgttacttcgatctccggttggctgagttgacgcgaagaggcaaccccctcgttgccggaagcttttgctgtccccatattcactcacgaaggtcgcgaggcctactagagcagtagcagcatatacgaggacgaagaggaactcgaaaagatatccgtcacttgacaatgtcgtacttttgtgaagagatcctcgattggaacgcacagtagcataacagcatcgagtgaaattcgctcgtgccaaaatcgcatgttttcttgcatgcacgcttgggagcaaacacgggaaaatcgcttcaagctgcttgcgagcacggaaggctggctacttgctcggttttgaaggccgctgcggggatcccagtaagatttgaatgtcccgaatatgtgtgaagttactcactgccggcgctcgtgggagctaatgcgcgggaatgtaaaatagagtgtaccaagctgcaccccccccccgagtcgattgaggccgagatatgcggctgtgcttcgtttcgaggcacagtcggtcaagtttgataagtatccctttttctggttgcaattgacaagccctaacgtgtcacttggtggttcgtaaggaggtgaagacaacaagtgcgtgccatacttatttttggagctgcgacttcgaaacaagccggccagcgaaatagaacaagtgacgaatccttacatgtcacgtgttttctgttccgtgagtaagaaagagacataacagcgctcggcatca

SEQ ID NO: 3127 - DNA, 2727 bp, Toxoplasma gondii
gtgccttgaggtaggtgttgcatccgatattcaccagtgcgtcaacgggcaccggaggctggtccgccttcttcttggacttggccgagcgctccgccgtcttcccttgctttccgtctcccttggcgtcgctgccttctccccccccttcgtcttcagaatccgaggacgcctgccgaggccctgtgaggagccgaagctcacgcaacgccttgcggtgccgccgcagagcactcagctgctctttctgctgatgttcaagcaggggaagatagtccagcaggcgttgtctgcgacatatgcagaaatccacatgtcacggaatggcgcacgcgccttatggcgaaccagccgtccggtcggcaactgcctccattagacgcgggggttttccactgtagaaagccaatcaaattcacactcaacaacgctgtggctccctcacgttgctgtgacaacgccaggcgtacacacacagttgaacaccaccagcgcgcagcctgtccgcagctggagaaggccgggataggcgagaaaggcaggaaactaagcgaagagggaggaacaagggcactccggaaatttccacaagaggagaacctgcacacggagagacaaagccgtcgaatcgacggcttttccttgcaccacaaccgtctggacggccatgtattcgcgatcttcccatgccttcctgaattcgtttgcagatatacgcagacagcgtggccatctccgtttgaggaaaacgcacggagtttcctcgggaaaaagtcttttttccacgggagaaggtcgaacttacacactcagaagctcgtgaaagactttatcctgttgtcgctgcacttccttgagttgctgccgcagcacatcgtcgacgacgctctcgctccgcagcacgagctgctggagatccatcccttctctgtcagccgtcgcagtcatcctgccggtctagacagtcctgtacgattcacgcacacctggacttccctggaaattcccgacttgcatgcgtgtcagtgtgatcgctgagtacggcaaaaacggggagtgagatagaggcctcccgactgggccaaacgcgcaggtctggcgtcctggaagtgacgcggcacgcagatttacttgtgtcataggtgaacggatccgacctttgtaaaagagagtggctcatggaatctgtgaagaccactatgtgaaggtaacaagagacggtggtattgcggactgaaagatacgagacgagatacagacggagaaattcgctgccgtactgggaacaaacagcggcgttctcagctgcagaaaagtaaaagtgaagcctgcacagttcgagtcacgcgtcaaacacctggtcaggtgtacgtacaacgtcaaggtgaactacgatctaccagcgcgtcagaacggcgcgacagatctgccgacagaggccgcagacggcggctccaaagacgttgcaagtggaatctaacgggagagaaacatgcgggatatccgacatcgacacaggtgaacagaagcctgcatcatcagtctcgctgaaagaatcagctttagagcagccgagagcgtttgccgtcctcgtacgtcaagcagaaaagacgcgtcggtcagcaagagagccgactctacagcaaagctacgtcgttttcagttccttctttagaggagcggcgagaggaggccgatgatgtgaaattccttgcttttctctgctcctctgcgagagcacctgaaggatttcgagggactcatccgtccagccttctcttgcacatgcaaaaacgtctgcgcgaaaaacctttccaggcaacccgccggcactctgctgtcgagcggggcttcttttctctccccgtcgatattcacgtcacgcctctgagcactaggaaacccgctacttctgtgtcgtctctttgtctgtactgcatctgtttcttaagttaccatctccgctttccagacacacagaggaaggctttcgcttcaactgccgcaggcggggagcagcgaactcgtttcgtgggcgggtcctgctctgtttttcctcgacatccagacgttgtgggacgggcatagggacgttgccttggccgatgatacccggcggttcagcgaaccttttctgctccgaaaattgtcaatggggggtaaaggtacattgccgaactccacgaagggaaagaagggatctttacagcaagttgctcccctgttcacccgcgaccctctttgctggccccacacgcgtgtaagccgaattggtcaacggaggatttcttgaggcatctggggttatgtccgtagaatcgctttcattcattctcacattttctctttcttccgtctgaaagggacatccggcgcatcagcaaatgctcttgtccgacttccgttgttcccgcccgcgcgtttgccactttgaccgctgcctgcgcgaagttagttcgtctcacggctcttttccgtcacgttctgggcacaacgccgtcgatttccgaatttccgatacactgtctcgaacgctttgctatgcctgtgcctcgcgccatgaatgtgctcgtacttctttgttgaagcgtgggccttcacgtcaccacttggttcttccgattctgtcgatgagtgtagagacgtcgatatccgtctagtcctctcgcctgccctcgctctccctccatttgtttcatttttcccttgtccatgcactgttgaaaa

SEQ ID NO: 3128 - DNA, 2373 bp, Toxoplasma gondii
gtgagcgacgcagcttaagcaaaaacagtgtcggtaaccttaaagataaacgacaaaaatggtaagcaacaccgacaaaaacactgactgcacgtcacacgcctgcattcacgtgcaccgtagcaggggaaagagaacaaccgcgggttctgtaaaaacacggaaaatttggaaaaaggtagctggctagggtgtagtatgtagaaaactgtggatggcattaactactttttcacagcttcgaattaggcccaatatcaattaaccgctgtctgttccacgcccccatgacactcgcaaagcatcactttttgactctctcacaccatgccctgcgccagtttcgggtgttcaggcgattgtcgagaggaagctttcaaactgccgttatcgcgagcccttcccatgtcactgcttcatgtacttggcttttgccagggtctatccgattatatgtttctaataatttgcaagagacgtgcccccaaaagtccttactttagcagcgtgaacgatttcatgagacccacatcgtcaggcacttcacttttagtttgtgaaatgatctactctatcatgacagccactgaacacaaggaacgaacactgacgcagttggtacattggagctatctggggaccccgcattaaagatcctgatgtgactaccccatgcacgctagtttgggttccgcatcgtctgcgcttcattctctgtgaggcgcatgtatggccatctcgaggtgactcctaaggcctcggtcacgagatagggacgggtttcacaacgagcttgaggggtacaacgcacgtgagcagcatacagtgaacacggctgattcccctagtctcgagacgcaatcctgcaaagacgggagatataacattttcttctctacgacgtgtttcacggcctgtagctatacacactgctctagtggctttcctccagtcccatgaagcaactagaggtatccaaagaccgtcaaaaattccgtaggacctgatatgttggcgggaaaaaacacgtcacactgttacaatatgtctgacgatccggcagcacatgcctcttttttagggacaaaaatattctgactcctcaatgcttccaggggcaacgacggaaacaagacaccaacggagtttttgtaaggtgatgctgtaacacaaacgggtaaagccttgacccgttgacgcacctgcaacagcggtctctcgaccatccatgcacatttaaagcttcattagtgttttattacaaaggggtggcaggcccaagcagtacagcaggcaaatcctggcacatatgtggaattgtgatgcttttcgagattcttcggggacattaacgacatgacaaccccaaaaatattgagatgtccgcggcgaatagaaatctttcaggctcgtgaggtggtgcattccgggaagatgtgcagtttgtatcaagctggcgcatagaaaagcagaaagcctttcgtttttcacatgccgagattatcatgaagtgccggcggtacatgcgtggcagtgacctatataggtctgttcttcttccgttgagctgagaccagcccttgaccttggagggagatagtgacagtatgactcattatgactggcttttattgcttttagttaattcacgtctcaggcagacaattgtcttcaatagtacaaaaatctcgacaaaacaaccactaattggcgtctggcttccgacgccccgtttggactcgcatcctgttacaggttctctagcacacgcgaagtagcaaggacgctagctgcatgcgtctatacgcggcgcgcgtgttgagactgccctcattgctggccgacaacagtaattcctaatcgcaagagcgtgccacgaaaagtggttgtatccttcttctgtttcgatcactgacgcgtcagaattaatgtggctctgaattttggttgagacctgaccgtttgccactgttccccgagcgtgcggagggtgagcacggtaatcatgctccactcgatttcggccgacgaccgattttaccggattaagccgcgaggctctggagaaatagagattgttcattctttcagtgagcatgcttatgtgcggttggtggccatctctcaagccgaaggaaaacgaaccgggaacaaagcgactagagaagcgacatccaggggttgcgtctgtcacattggctgcaatcgtcaacgcactggcctggcatttcttcgtttatgttggagcttccgttaacccaccatacttctcctaagatacgatgtgtacctgagtttcctctgctacgaggagaaccatcttcaccaaatgcctgaggtgtagcgtgggtggtaccctaactgccgtaccga

SEQ ID NO: 3129 - DNA, 4617 bp, Toxoplasma gondii
ctttttctgaagacggaggcgattcctcctgggaacgagaagaagagcttccgtcgagagaatcgaaagacggaggcgcaagatgagagcctggcgaagaagatcgcgcagacgagctttctgttctctggagtccgtctgcagggagagacgacacagaccccacacgagaagaagacgcgggaggcccgactagagagttcgaggaaaggagagaagaagaagaggaggaagaagacgaagaggaagaagacgaagaggaagaagacgaagaggaagaagaagagagagaagaagaagcagggaaagacgcggtttgtacgggagacgactgagaggccgagggagaaggcgaagaggcatctccaccggcagtgccttctccttcacggaggccctgagacaaagagtcggttggtcgtctctcgttgtctcccgagagagaccgacgcaatctctcttctgtggccatgctgtctcgactttattcaaggtctcctcagtagccagtctctacctgcaggagtttctccgatcctcgaccgcctgttctctctcttgcacgatggctaggcgagtttctgccattttctgcactgcccgctaaaatttcttttcctgcgatgcctcctccctgttgtgtggtgttcgtctgaagtcgcagagcagttgaacttgccgagaggaaacccaagacaccgcaaagcgccagtggctgcaaggaatgaggggaaccgctggagcagcacagaggcaaatgcctgtgtgactgcgaaaaatgaacgcgacagacggcgacagagagttgaacagacacgaatcaactaatcagttctttgtagcgcagatgacgctcgatctttacaatgtcatagctcctacagagcgtcggtgggcgtatgtcatagacagagccacagattgtatcctgagaacgccagtgtcagaactcctacggaatgacggtggatgtacctcgtaactggagtcctgttcagaatccaggtcctctaatgtctccggttattctcgatttcaattgcttggtcctgggtcgcggacgatgtcgagcgcgtgtgtgtcgattactcagaagacgcagggcatctgtcaaacacaaaaaggaacgattcacgtagatggtttattctcctccaggacagacgcatgcagttccggcgcctctggaaaaaaagaggcgcgcgcgttgtcgggcactaaagtccaccattctttcctccccatggaaaaaaacttccaactacgaaggggtgcaacgcaatttgcaaccttcacagaaatgaaacgaaatcgagaaagaaaacgcaggatgtgtggccgcggtggcttctcgcaaacaaaggtcaccatcaccagcgctcgctcgggtgtgctctgccggtctcaggcgagagacgaacatgaggacttcaaggaatcgacgaacgcaaagatgcacactgcagcagaaaggctgacaccaaaagtttcaagatttgagaagcgctccctcttctgctgcgttgcatgttttgtgagaatcggtttctgtgtatcctgttggttgagcaagctgcctaccggtttgtacgcaccagggaaaaacagctgtggagaagggtaccccgacagaagtcaacagtcaggcacaacgaggagagagaaaggaagaatccaagaagtttgaacggcgagaggcgccgagataaagtgacctctggagtctcaagcgatttccgactcgatggcttctcggcatgcgtagcgagacgcgccagaacgaggccccatcaaggtctgcgaagggcttagtccacttggaagcagaaataacaaatgggcagaagaaacgggagtccaaatgcgtttcaagggggcttactccctccagaacgcagagcgaaatgttttaaacctggtgatgggaagaaaaattccaaaaagatggaagtctagagatgacaattagagcgtagactgggtttggggggaggaacaacctaggcagcttccgggagaaaagcgtttggcatatcgacgtaaaacaaatggaactgtggatgttctcagaagcgaagaagcgaaggaaatgctcgaatgctggtagaatggcataggtacatggattactccgatgggttgcagctgataatccagtgacgcctgtccttttttgtgtcataggcactcagtgaagtgaactggagcttctgtgctgtgtgttttagagtgtgaaaacgccgcgcgaaaaaagtaggtgtgggcccacttcctggcggagcctgctgtcagcttcagcgggtgatttttttttctgtggatgtgcaaacctcacgctccagaaacctcgagaggctgcgtctgggcactgcaaacgatgcgggaaacggacgtcattttggccattccgcttacaaatccagcttgcggtcgtacacaagtcagagaacatggaaactttcgaaggaaaggctaacctgtttgtagatgtcatctgggctcctcaccaaaacgtggaattgcgtctgtcgcgggtttgccgtgtttttccgttacccgacgcggagagtctgttgagcaaagctggtttgattcctcgcaagcttctttttgctgcctctgggaagattgctgatgtagcgcaagcaccttgtggcatttgctttccccaagatgcagagacaagtcgacttccactttgttcgtctgatcttccgacgtggaggtgccgatgcaaggcacagaaagcagctttctgttctgcggagaccgtggaaagtcccgcaggacgcgtgcgtccgttttccgcagaatattcccatatgaggaagaaggcaagcgagcgaacaaacgttctgcactggacacttgagtcgcatccagggaaaatgtctaatcaagccaggcttaggactaccggttctctgcgaaagagtctgtggcgcgaaagtgatggaactccctcgtttgtggctgtactgcgataactctcgaagaatcgagctcctctgtcgaacgacaacaacaggctacgacgatgtatagaatccgaaatactcatctttatccgagataatttccaaggcagtcatggctgtcaagcttcctgatgggataaggaagctgggactcgaagacgtttgagattacctcgcctgcgcgcatgttgtccaaagaatacgtcttagtgccttggccactgctctcaacaagagaagggtattttctttggctgagaggtttccttgatcggcgatttctcaccacaaaaaactattttcttgtccaaagtggagaacctatgaggtcaccgcctgaaaatggcgccttcctagacttcctcctgcctccactgtgtcgcagagaatctcatcaacttgcgtttcgtgggtttttctagcaagactcgagttctgcaacagcccttcttttctcagtgtccattctttctaccaaagagagaatctcaactatcggttctgtgccggcttcctctgttcccatgttcccgcttcacgtggacatctactgtgcagaggaacttcaccgatacacgaagaattgtatgtgatctcagagaagctttcgccccgaaagatgaactcttgaagcaatggattcgtatccgtttcagtttcttcacatacccgatgttcctcggcaagacctgactgacgcgtcaacacagataatacacgcacacacacctccccttttgcgtagagtgaaccactctgaagaaggtaccgcctcgcaggagaggagagcgcggagaagctcgactaaagatgaaagacgaatccacaaagatgcaccttcgagaaccgtgtgactctgcctcaaaggtttcacacgctttttaactgtgtgctgcccctgtctctctgcgcctgtctcgctctccttcgctctgtggggtggcatagccagcctcggcttatattcggggcgtcaggccgccttcttccttttttgtgggaagcagctcagttctcccgtttcgtgcctttcgaaggctgggagaagagcccgttgagtgtgtaggagaggagggaaactggagcaggaaacatgaaagtccaggacgaggcagcgcgagaatctcttccgcatctttctgtgaggaatcgcaggcgttgtctctagctccacgccacccccccccctctttgcggcttcttccctctcgtcgaaaaaacgcgtagatctcgtcgtcttccttgcccgtgctggtgtggagggactccgttctgattgcggcgattccggcctcctttttcctcgttccactgcttcttgctctctttttttgtactccgtcgtcggttcctttccagcgctgtggtgtctgggcactttgcactgtgggaggttcccttcccaccctgtctctgagcacagtttctctttcttcgctggcctgtttgtctctctttctccacgtcttgcgttcgaagaaactcttttgtttttcggagaattctctcagacactccagaacccccctcgccgtctcccatttctttcgccgaagcgcgtttcctccggtctctgtgcaccttttggacagggggaacgagaagaggctgcttctcgcgatttctgccgtttccaaga

SEQ ID NO: 3130 - DNA, 3941 bp, Toxoplasma gondii
tctggacggccgttcgaactgttccgtaactcctcgcatcctactagcaaaatgcccgctaaggaaggaacattcatgacgatacggaaacggatctccataagtcgggaatgcccagccataacctgcgtctcctgggtatttcagtaaggtgctccgatccctgttgaatagcgatggttgacttaggtggagctccatctcgcagcaacacttccctcccctgggcggagctctgctggccacctggtgagcctctgacttgatgcgaaatccgctgatacccaaattgttcgcctgtcgcgcgctttcggtttgaatattcctcacctgtgcaacagcggagggtttgaccctccgctgagaaaacggtccgctccatccgtgcattcgtatgcatttctcaatgtgcacatctggttctttgtatcccagagatacacttccattactggatgtgccctccgggttaatgggtgtcatgattgacactggcaccgaaagagatgttcattctacaaaaattaattatgggactggatatgcgcatgttgtaggagtcatcgtatgccgtgtttcgtggtgcgtctgcgtcagagctgcgagcaagcaaaagcgagtaaaccgccagcggtcatgttctctgtcgcctcagcttgatttttttttggtgtcgaaggcggcgggcgtcagaacagctactggggcaccttcatgaaaagagacgcttcagcctgcactgctatgcagatgcgtcaactgtctcatacatttttcgtcctctccaggctttagaatagttctgacacgaggtaaacagccaaggtcactgactctaaaggcaccacttctctgcgcaacgaagattgtgtcttcgaaagtagagtcgcaaacagaaggcaagcaaatgtacggaaaaacacagaagatagcagaaagcaagcagattctgtgtgccaggcgttcttggaagacaaggagaaagatatcaattaattggagcagagacctattgttgacacggtagtccacgtcctcagaatgcacagtttacgactccagcgggacaacacatttcttaactcacacaatcggaacagaaagtattattgatgtagcaggaatggagtatattattcacctgcgatcaagatctcctgctgttgcagtatttcagccgcgatgttcgtgcatgctcctcgcagtgggtgaccgcaaagctgcggatgggcagcgtagagcaacgcagaataaaatttggacagtttttttctccattgcgcattatttttgtggaaattcggcggttcgttcacgagcattttccctacttatttcacacgaatatgttcctgaatcatcctcatgaaggggccgtgtgtgcatgcgtgggtaagacacagccctacggcttcgaaaacttggtaagagtgctgattaatctgcaagcatcgccaaacagagatcgatcaaaaatgatacatttagatccttttttctttgggctgccttccattctcagtcgttatccccaggattgtttcgtgagtggtgctagtgcccaaaagcgtagaagtgttcctgcaactgcttagcgagtgccgggccaacaagaaaccgatccgtgtattctttaccgacaaaagttaggaatgagactacgaaagtgaatatcatggtgtctgtacaggagcgggtgctgaaagcagtcctgcaccacagacgcacatatctgtcggtacggtgcgatgcctgttttcgtgctcacacgacgtgcacaccattgttaagctcctgattagtttttcgtgtctgaaagtgcacccatcagtgtaccattgtctgtttgtaatagactgcagggaagttttgtgaagggtcgttttcgcggggtgaaggcacgaacgattgcaaaaagcagagatatcgccatggtttcagcgtgagaatgcatgtcgcgacgccttcacacggacagcttttggggtgtaagccatcttcggtctcacatatcaggaaagtgaatataaaggattgatatgcataggtagcatgggcattccttacttgtaacttcgaacacggcagacctctggaggtatgcagtgtcagcaggtttagaaggatctggcggacagctcgagtagacacgtccgataatcgagagccataatactagatctctcaaggaagtcttctgtgcattggtgcaacatcgaagtctaagactgacgcccactggctccatgtgactgcattcatgccccatacataccgctttgttcctccgtggggcgtttttatcaacaggcatcatataaagctagagaccctttcacactctcgccgttcaacccccaagcagacacttcatttgcagctgtttgcagctcagaatgcttttgaaatggggtagatcgaaggggttccatgcgggtccgatggcagcatttctgtttcccctcggggatggctgagcctagcgttcgacaacgttgggtgcgactgccgttggaatgattgaaatcaactgcggctgtcgcttcacggaaatggcaccggctgttagaacatgtgtttcactctcgaagcaagaatcaagaatggtgtggaaactctgcagtgcgttcttgaatgcgcggcaagccaagctgggagctttcaacaacactgtgactgtgcaggcggccttctttccaagagatttggggagttccataagaattgaaactctaaggaagatcctccaggtcgagagctgcgtcatagtgaaccttctgccgtggaaaaagatgcattagggaagcgagccttaacgaggaattgattggtttggtagtgggtcggcgattctaaggcacaattagcgaagccatagtaggcagtcagacggggtaacagtgtacatgcaacaccctggcaagccatggtaccccattagcattcagagacagccaatgcttaggctttcattctggtcaataccttactgctggagctgggctttattttgtgaacgttaagaaagcccgtgcacggtgggcgggcgacagtagtcaccactgccattgacaggttatcaggtttgccgctaaaaaaacataaactgtcagagcgaaatattcccccatggaacgcggggctgttcctttctaccactcattttcttgggaaatcttcggcacgaaacgcacgaatgtgtgtaagaggaagttccagagagtcagaatggctcggatcgatcccagagagttgccgtcaatccatggcggacgaaggcgaggtgagtttgcagtccgaactaccctaatgtgaagcagaatgagggtaattgtcgaactcattcgactcatgtttcctccttttccacaagaatttatggcaaacagttgcatgactcgcgttatcggatcgagtctttccagcgaaagctgtgtagtaggcatgcaaaatccgcattaccgcagttacttttcgcaagccggccgcaaggggggcagacatcccttttttttgcttttgtctctaaactgaagacgcaaaaatttccgggtatgacagcctggccggctgctgtatacctttttcaggtttcttctccgttcaatgtagaccttgtgtctaccacgcattctcgtctgttgtgctcgggctgtagctttttttagtatcgacccagttcttcgcaggtcaattttgccctcaggacaatccggcacctttatctgcaacatcctcaatcttttacctcgtgcgcatgacgtacacgagcgttctgacggagctctccgccgctttatttgagcagacgaactgaaattgactcagtaccgcagagcaggaaccagttcttgcaagattttgtaaggatgcgaacgaatgctgcgtgattcactccaattctgttgacaccggacgccgcatacatctttcctctgcca

SEQ ID NO: 3131 - DNA, 4012 bp, Toxoplasma gondii
ttgtatttgaaaaagacaaggaggacccgatacgcggcccagtgtcggagttcagagaaaagccttgatcttgtgaaggaccatctggggaagacgatagacaatctctgtttcctcgacctggaggagcctcagacgctctgcgagagtagaagaagccgcttccagagtccagcgcgagagccaccgcttcctcaaggtcttcgtttgcctcttggctctctgcatttctgccgctgggctctttttcgggagacagttcgaagctgctttcttcagtgtctacctcctccccttctcgggatctgctgtggcggttcgcaggcagattcgccgcggatctcgtttctcccaagcgttcgcgctgggaggccccgctgtctctggaatggagacatgacgtcgcgtccgacggatctgcgccgaaaagctgttgcggaagagaagacatggtcgggtgtcgagttctgcgcagttcggaaaaaggaagccgcagaggcgcgctccgaggtgcatgcgagctacatcgcggccttcgcgaccaccggcgagacgccaattggaagagggaagagacgagacagaagaagagagaaaacgggggaagacgagaacagccgagggagagaaaaaggaaaatgagagaaggaaaatgagaggaggacggggcttcgaggagaaaaggaagaacgcgaagaacgcgatggtggaccgaatgaaggaagagatcttcttttttttcgcgtgaagaccggagaaagtggagacgcggcaactttgaggcaccggcctgtgtggcgccgaaacttacgaaaaatggactttctgttttcgcagaaggaagggtaaacagaagggatatcgagaatgcagccagagaaaaggagaaacgcgaaaaagtagagagcgtctccttttttgagacagtcaagcgcgtcggcaaccacgcaccagctgtttgacaccgacgattggaagtggaaatcgcggcgttttccagatcgcgttggagcgcaggaaaaagagacccttgagagcagaacgattctgctccctaaatctcccgaacgagtctgtcgctctgcgtcgccagactctccctcgcggtcgccgcctttcctgcagctcgaaagagaaaagagagagacagcacagaggtttgcgcttctgggagaaagaaaaacgcgacagaagaaggagacgaagaaaggggtgcgccggcagatacccatcggagggaaaccgccgtcctctgtcacggcaggactccgaattctgcaggaaaaaaatgttttcgcatggaagaaagacggctttcaaaaggagagctcgtccagaagcagccgccttcggccgccgcacttgcctttgttcgcgaggcggtccagagtctcagcgttctgcctgcactttgatcgcggagggtcgacagagaaattgcttgcttccccgcagaaaaaaccagacaaggaaaactggaaaaagtgactcggcaaagaccgagagggccagagagccgccgtgcaagcgaaaggcgaaaaaacagcgttcctgcgccttctcacctcgcgactctcgcagcgggcgccgcacgggagactctggtagcctttgcgttttttcttaggaacagccgaattttcgaaagaagacgactgaggaaaatcgagagaactctgggaacctcgccttgcgtgaaagtagaaacttgcactctctcttgtcccggtgcaaccgaacccccccaaaaaaaaccaagacaagacgcgaatgaagaatgccgtcggagggctcgctacaaagaaagaaacgttctttcttcttttcgcttcaacgcaaacaaacacttgcaggagggagggagaccacgaccaatcttcgtgagacccaccccaagacagaaaaagtcgattggtgccatttccttcgtccagcccggcgcagacggctgagcagacgacggggaaaagcgaagaaccgcttctcgtttgctgtcgattttctcaacgtttgtctttcactcggatcgctcgccttcacgtgagttgccctcgagtcgtacgaatcggatgcaacgctgcctcgacgccgggtccccaggaacttcagcaaccagacgcgagagaggacttcgctgcacactgttgtattcttgtcaaaagttcccaccgtttgcgacagtctccttctttcggtgcggagagcgtgatctgctctctttccaagttagattcagtgttgttccacgacgcaaaaaggtcgaggaaaagaaacgtcgtaggtgacaacactctacgcggaacaccctgaaagcacacggacctctccgacagtttctcaggggtggaagcggtcaactgatagtgaagcgagtgtaaatgctcgggcgttattccggatctacacagcctaaattgctttggagaactcactcgaaaagcggtgtgaaagccgagagcgaagccgtgtgctcaccgtgaagctaccagctgcgcttcttcttctgacgaaagactctgcggcagtggcaactcccccgcaggagaaaagactcgccttttttcctttcgtgcatttctcgaaaggaataccccgagaaaccttgcctttccttcctgaacagggagccaccggcacacctggctcgcctctcatgcctgtggtcctcggtgcgacccccctgcagtacaacgcctgtttccgtctcgtgcaacgtccttttgcaggcgaaaatcgttttctaacattctcctcggctgcccacctcttccttgcagtgtgcgtgtattgcgaatcaaaaaagacaaagttttcttcacttgcctttctgcctggcgctgctgccgctcccagagtagacaagcgggggaaagagtaaagagtcgagacagcgacttcatgagagacacgcaccttgttcgctgcatttctttgtcttctctggtgttattgcggcgcttctcagtttctttttcttggactgcggaaaatttcgttccgctcccccccgctgctgtgcatgtgtgggaggcgagagcagcagccgacgcgcgaggctgaggggggagacctcgagttcctttcgagtttttctccggagaaatctctcttttttcggtgggaactggcgtcgaaagcgtttctttgttgcgtccttctctagtcgttgtgctcggcctcgagaattggtgccagactcggcgcgggggcctctgggagcgtgacgaaggaagagtatatttcttccttgatctttcgctctgaaaagtcgccacgctcctattcttttctcccatcaaatccgcggcgatctgtccgagccactcggtaggaaaacggatttccagaggaaaccccgctgttaaagaactcccgtccgcgccgcgcgcccagtgcgatttttctccggagctcttcgcctgcaagagtctccgcgtatctctctcgccttgcaccctctgttttgtttttcttcatcgcggtttcgatgtttttcttcagttgaagtgaactcttcgtctccgttcctttctccttgcagcaagccgtttttcgcctcccgctgaacgccccgtcgtccccccaagaatctgcactttctggccgatgcttctcctcttgtcttccctcgcgcgcccactctcttctcttcgtctgtctgttgtttcttcctcatctgtctgtctttgtcctccgtcgtcaaaaaaatcgcgaagcctgtacatgcacacgaagaaggtcttgcgtttttcgcgtctccgctccctctctcgagtccagtcccgcgtcgtgcctccacgttttctctgtctctctcgctcctttttttgccgctgttcttctctccgccttctcttccctccgtgagtttgttgccttcgtctcgcttcgcgcttccctcgaccccgccgcgtccttctccctcgacctgcttcgtctttcgtctctgctgaagagcttccccttgcttgtccgctctcttttgaccaagtgtccgcggccgctctgaaaa

SEQ ID NO: 3132 - DNA, 1347 bp, Toxoplasma gondii
actccggcagctatagaaaagtgaatagatctaaacagatagtagatggataaagtggagatgaaggatgtatgaagaaaattatatatatatatatatatatatatacctttgaatttatggagaggctaatcacagcaccacgttcaacgttgctggcttttcttcaaagtaaatctgtgtagaggatatctgaatcggattgttacctcagtccactttgtcttcgtcatctgtctaggagttttcggatgggagaagaaacttcgaggtatgagtgagagatactctgtacacgatgtggattttctgagtttgaacatcacgaaacagaaaaggaaagaagcaacagggcgtagcgatggtcgtctttcgacattatatgagcacatttgcatatacaggtatgcaagtatgtacaaatgcgtgtccagggttgtgttttgtcgtgtatgcaggaggacgtttctctctgttgatttcgcggacagtctcctgtgttttgttctgaaggacgggggaacctcgtcttgacattcctggcttgtttcagctgaacgcctgcttttttgtctcggggaagtagagagagatatgcggataagaaaggatgtttgtcccgcagtgcgttcatttctcattggcaactttcgtttaccgattccaggaagttcccaaccacgtgcaagttcgagtttcttgtagtttcaccgccctcgcgcctcgcatccgccagcgcctgcttctgccgctcgcccacgtttccagttggtcgtttttcgtttctccctttgttgggatgccagcagaatccaccttctctgctcgttcgctcggaaacgtttgtttcggtatcacggaagtgaaaaaccatctcgtgattgcgcacgttacatctttgttgtgcggtgcgtggtttggggtaaatggtactccagcggcaagtcaagagacgaaaaaaatgtgactgcatttgtctttccggcgcttgtttttgcttttttggcttcgcaacaggctctcgcacaccactcgcgaccgtccagtttatgatttcgcttttccttttcgtctagagtcgctgcagttaggtttcggtggatgcatttgcctcttgtcatcatcttagagacacgcgatctgcgttccctccttggaaacgaggacacacgaacgaagctagtcaagtctatcgcacaaaacgctctttctgtgctttcttcgattctgttttggggtttgcatcccttaaaactcggaacttggagagccggagtcccgacgtcccccaatttttttttctcgaacgccgcgtttcccccctcaagaaatacatactccgttgga

SEQ ID NO: 3133 - DNA, 659 bp, Toxoplasma gondii
aaaagaagagaacgatctctgctggaagaaggagagaaaagaaacctctctgtgtctccctgcaaatcttgttgccacactgatcccctcgacgaagaaaggagacaaggaaaacgagagaaaaggggagagacctcaggtcaaaaaggaagcgaaccgacagagaaaagaagcgaacaactcgacagcatagccagatcagcaagtagcagagcagaggacgagagagactgaagagaataggagggaagaatgaagaagaaaaggtggaaacgccgaggagggtagagacctctacggtgtcgtgaggcaactgatacgtcgagaagaacattaatttttcgacaggatttcttcagatctccgcagatcgttttccctgtctttctcgctcaacgacaactggaagaaccgtcaagaaacgtccaaagcacacgacaacagccttcctcgtttttgtcctcttcggtaatctgaggcatcaagacgtacacccggtggtgaccctcttcttcttctttccgtgtcttcgccttcattccttgtgccccctgttgccttttctcttcttctcttttccctcctgtctgtctggccgctggagagcgcgttcgcggttctcgagaacgcgttttttctcctcttcgcggcctttcgga

SEQ ID NO: 3134 - DNA, 4451 bp, Toxoplasma gondii
tcttcgttcgctgcaagtttggctggcacgacaaacgcgccgtggctgagacttccagagggcttgctcgtcccggaagtcgccgcgttgtcgcgcttggccgccgaggcgccccatgctctcttctgagaagcgcctgcggctcgcccacgcccggagcctccgcccgcagagctcgcgggcgcggtctggagagcgttggcgacctctgatagggcagtcggtgaagccaggtttccgtggtcatcacgcgcctgaggagcatcgccggaagttggcgactcacgcgcgtcgtcagtgacttctctggagtgtctccccactccacctgccggcgagaggagaccgttactcccgtccgcgccgggagatgacgagagcgaagaggcgcagctggcggggggaagaagatcgaggaaactctgggaggggtctgaggcgtgtgatgcagcgctcgtagttgagacccgctctgcggactggcttctgcgtctgcgggaagaaggcaaggcactgagttcttttgccgtctttccagaaagctcgcctgggtcatccccaggtgccgtggtggtgactgcggcggcccaatggtcgtccggaagcaggggttctccaaacggctctgccacccgcatgtcttctttgcaaggtttctcgtcgtgagagctggagactgaaggaaaagcatcgttgaactcggcaacagcagaagggccagcccccccgcagtcggccctacgttcgtcccgaggagcggctgctgcccgcgccatcgtttcactgggtgagacgactctgggcagaaaaatggacacagaacctcgcggggagggacgcccttcgtcgtgagaaaacgtttaggaaaagcaagcgttgtgctggacactcgtctcgacgcgaaccttcggtgcggctgtgctccccccgtacggcatttccactccggagagacgaacttgaggaacactagagcgcgcgcctgcaacccgccccacgcacgcgcgcctgcccacggacaggtttcgaatctcagagaattcaggtgtttccgacgacgacagtgacgttttttctcgactgcctcgcgtttcagttgcgactgagatccgaaccgggggctctacgcatcggctacgcaggcaccacttttttcctcaagcctgtccaccgtctcttcttcgttcaggggagtgtcgctttctaggcgacatgtcgcgcacgacccgggctggctgggctggctgggctggctgaaacgcaatatctaaacagtggacgctggacttggaacaaaagtgccctgcgcgagaatcggaaagcataacgcagacgaattccgagaagcgaaaaatgtctcccggagaaaggcacggatttgcggcggatggaaaactggtggataccggtggtggagagagtccccggcgtgcgacgctcggcagataagagagccggtctgccgtgctcgtccttctactactctcccacccaccgagttacgcgcactgaacctgacggttggaccacgaaaccgcttgctaccttctgccagtccggcgggatgacatgcgacgagaaaacccgtctcggctatcgtcaactttggtcggccaatagtgtttgcccgatcgtcgagcgtcgctgcaggcggcccgccaaaacctaacgcagcaagctgcctccgttttttcgcgcacgaaatgagagttttcaccaggctgtctttcgtcaccaaactctcgacaccttctgcggatcggccgctcctgggggtagcggcttcgaggcgcgctttgctgtcttcacttcgtgacaaacgcacaaaatgctgtctgccctcgtctttcgggcaaatgcacgcgagaggaagcggccgtgcggcggcgctgccagttgcctccaggtctggctacgtctcaccatagaagatgcatctccggagaaattttttccccatcacacacgtcatttttgcgcacgcatgtctccagacaagcgaatctcagactttcttagtttctcgtgtctgaactcttaccctcctcacgacccagccgcgcgagaaacatcgtgcgcggtgtgatgctgagaagccacaacgaagtacaaaacatgaagacccggtcccaggggcgcctcgagtttctcacaacgtgatgttatacaagtctcgaacgccgcagacggaagagtgagaaggcgcatcaaaaaacattcaaccgaacgttcgttttatccacagtgcagatgcaagtggacgacgtctgtgcggcacgaaacaggtgatcaatgtttctggtgtccccggctgactgcacgagaaacaccgcgaggagtgttgtgctacagcttgcttcaccgccacatacgggaataccagccatctggggtctgcctggggcagactcacacacacacaaagttcgttggaacggggcgttctaaagtgcccgcacacacatcccgagttccttatctttttgtcgaagccaccagtggggagagttcttggaaaaggttgtgcgcaacggacagattcagtgatcttagggggaagtcgccttttcggaacgcattgattgattgttttgccgtgtttttttttgagcaatcgtagatacggttgttagtcatacgttgcgagcgaaagtcgaaacaacactcaaaaagaacatctcaaacatttcgcacggtgtcgttttaagtccagtgagagttcctagtactctactcagatgcccgacaaagggggaatgtgtcgaaagcgcagggtggtgctaaaaatcgcgtcacacgctcacacgaacatttgtgtaattagagaatgtaggaatatcgaaagaaatcaaacgaattgtggtaacgcgtgtgcaaagtccacaaatggatcatgctccgttagtggtactgttcgacgaaccccgaaacgccatgagctgttgtcatcttcgctgagaactataccgctcggaaagacgtaatggtctcgtgaggcgaaatgcgacatccacttttgttgtctgttacgtgaggctgtttcccgatggctcacagaaaaagtgatacaggtagtcaacaccaccgcgcagcagaaatcaacgaaaaaaattcgctcatttagaatgtcttttctgcggtatcctgcccagagtagggaaatgagattcatggtgtcgtcgtgtaggatgatcagactgtgttccgctgacgatgaatatgaagagcacgtgagacaccgccggaatgtccagtcgtccacagggcggtgaagatgaatttcgtttatcctgcgatatttcatcacgtcgctgtgtgtcgcttttctgatatgcccaagtggtggcacggtgctttcacctaggtaacaggttcctgtgacaggtagctcatctaaacacatcattccgataggtgaaaatgaaacatcctgctggttgcttgagcttttggcgaaacacgattccagggtgtctcgccaacatgtttcacatttctgcccgcttgtctacttttgcttcttacacatctgtcactttaaacgaatagaagactgggggacgcctgtacagttaaataaaaaaaaacggtgtcgtacttacttcagcatcataggcgtcgcgttcaaaagaaaacaacacctgttttgtgtggccaaccacatgggaactttttaggctttaaccgagtgaactacatcagattcggccatggctcgtaataaacgtggatgtgtagaggactggggacgcatgagatacgacgactcatccctcccctacaaacgcgaaatgccgtgacttcgcgccgcaaaggtaagtgcagtatggtaggggtaactgcattatcgtcatttagacgacggagtatcttgggaagatttacgtggcaatcacaactctcaccgttccgacaagcagccgaaattcttccggtaactggatctatgcagtggagccaccgtgagcgtggtcgcctgcttacgtggacgtgtagcatccgaaaattcctgcactctgtgagtgtcgttcggctttggaacagtatacagcttctccaaactttacatttgcaaaaagaatttcggggctacacgtgtcctaacctaaaattccgtttcgatctcggaaggtacttaacgtatctctggacaccggctgcaatgccatcggcgacgggaaatccggcttacggaatacggcaccactaatactttctatgacctgaaggattatcagtggttctggagaaacgtttctccgaagaaaacaggtttcgacgcaggtcacaatcggtgctctgtctcctgtgctgttgacgtgtgccccttctcgaacctggagcaacaactgctaggcaaacaagacgccaaaagtggaaaaatgatacacagcggtcaacacaggaaagtgaagagcgaccgcccgctcgaaagcgctaggccagaataa

SEQ ID NO: 3135 - DNA, 699 bp, Toxoplasma gondii
tatatatatgaaggcgtcagggtcaagtcgcatgcatgcgtgctgcggctatttcgtttttgcaccatttggcgagacaatgactcagcttaccacactgagcgtggcttgagaatcggttttattgccatcgactgcaagcgctgttgtgctccgtcgaatggtgtttcgtgtgcgccgtgtttcgcggggtcctttagttttcgctcccgatgaagaacccagaaattctgctgacagacgcagatcgtcttccgcttctttcgtggtctctctgaactcagtgattgtcgagaccgaagacactggagaaacgggggttcgccgtcgcctcgacggaatggtgcgtcgcttcagaaattgcatctcattccgtctggaaggaagggagcgacaggaccgccgaagtgaagcaagcggtgaaatcggcgcgggaacagcagggacgacgagtatgggccggctaacgctagagaaagtgccgagacaaaaacggaacaacgactacggaatggacgtagaaggcggttcggcaaaaactcagacaagtccaggttttacggctggcaatcatgaacacgcggacggactgtctcgaggtagttatcgagtcagttccagaattcggaccgggtgcggatagggttttggttgtacgtacacccggagagaaacgggaaactccggacggttcgcaaa

SEQ ID NO: 3136 - DNA, 1825 bp, Toxoplasma gondii
ttccactcctgtactcctgtccttccttgtctttttccgttgtcggcttgctccgtcagtgtgccttcctcgtcctgagtgtcggcttcttcctctcgctccggtcgatcctctgtcgttgtcgtcgacgccttcgctcgttggagacttccttcttcgtctgtcggagccagttcctccgctgtcgatgtcctgtcctctccttccgatgccgcaccctgaactgcttcggaaggaggagctgcagagaggctagattttgcaggcagcgacgaggaggatgaggaccggtctccgaggagaggtaactcggtgagaaaggatcgcaaagaagaggagaacgacgaagacggactagaggcagaaaagagtggagaaaaggtggacttcgctgcgaatcttctcaggctgcgtcgctcgtcgccccctcgttcgcctcgaatagcgatgcttctccgtccaggcacacgaagaggaagactggggagaaaggaaggcgcgacattcgatcgcggcgaagacctcgactcgcgagtgcagacgtcgggggcgggagctggcggcgacaacgacaaagaggggaaggcgttcgttcctgtctttcgaacgaggagggcagcggcgacggaagaggcgggacgcgtcaacagcaagaggagcggaagcagacgaaacgcagaaggtccgcgcatgaagaagacgagaaaaggtcaaagagcgaaggaaagaggcagcgtccggcgaggaaaacgttcaaacttgaatttcccctcggacttgagtgcgacgaccagccacccgggtccaccgccgaatgcatgcggtttcgccgaactcccttgagaaaaaaacacggcgcattctaggacgacagactcggcgacggttccctatgaagacgggaaggcagaacgaagagggtgaaagaaaaccaacggttttttcggacaggaaacatcgaggtgtcttctgttttcacaccgtaggcgcggttgagaacgtctgtgtcgggcaacaacgcggagagagaaaagtcagggagaacggcggaaaagagcgagaaatcagaaaaaatggcagacgcgagagagaaaggaaatcacggcgatcgttgaagaagaagaaaaggaagaagagaactggcgaaaagcttcgattttctccatcgagccccgagtgttttcctttttgtgcatgcgttcgcttcgcaaaaaagcgacatgcccacccccctctcgacgctggccggcgcgtgctcggcgacagcgttgcttctttgtcttgtcatttttcttctgtttttgggatcgaagctttcctctttttctgagcaacagacgagaactcgagcgcctcggctgggtccatccggactctcactctccgcagaagacctcgttcgccgggcgcgtcttcctttttgtggctttcggttgcagagagacgctgccgaagcggtcaacagggacctctggagaaagccgatggtaaaaacctccttctcctcgccttgcttcactccctagcacccaaagtcgcgtgagacgctcgcggccatccgttcccttcaaacggttcttctccagcggcttgtttttgtgtcattttcttctgtcttgcctccatcgtcttcgccttcgtcctccgttcctttccctttcatcttcttctttggagttttccaagcgtccttcgtcattccttcttcctcgtcttacctccggccttccgacccccctctgtctgctccaggtccgttctctctcttcctcgctattcctcgccttttctctcttttctcggctccgcggagagcctgaagcaa

SEQ ID NO: 3137 - DNA, 4841 bp, Toxoplasma gondii
gatgaagacacagtctaccacttaaacccgagtgggaagttcgtgataggaggtccccacggcgacgctggtctcaccggcagaaagatcatcatcgacacgtacggaggtgagaatttagcgattcgctggaaacctcggggctttcggcgtgcagaacccgagagagaagagcgcagcgaaccggggtgactgtcacttggtacgccttttaccatgagagtacaggtgaaaggacaggtgtaccggaagtgaggacgctgcggctccaaggattggtctgagttcctgtttcgtaaacgttcttctcatgttgtgtcacgggagggagaacgagggaaaccgtcacacgcctttctgtgctgtcattcttttgtgtgttttctctaggctggggagctcacggaggaggcgcattcagcgggaaggacagcacgaaggtggatcggtctgcggcgtacgcggcgcggcgcgcggccaagtcgctggtggcgaacggcttttgcaagcggtgtttggtgcaagtgtcgtattccattggcgtttctcaccctctctcgctgtttgtgaactcgtacaacactgcggcggagaactacacggacgaaatgctgctcaagatcgtcatggagaacttcgacttcaggccgggtgtcattttgcgggagctccgcctcaaagaaccgggcttcaagcgcttcgctgcgtacggccacttcggccgcaccgaggaagagtgtgcgtgggagaaagttgtggacctctcgcactgcaaagtgccgagcaagtctgcgtaatcgcagaggaaagccggagcgggaagggtagcacgcggttcctgttccgccctcgatgtgaagccgagacaaatagagccccaaacggaacgagaagcgtgcgtcgcccgtgcctgtgcgtcggccttcgatcctgcatgtgcttgcaatgtgcgtggtgtcaatgtgggggcggtccacagtttgcagtgcttttcgacgcagaaaccgatgttcgaatccagtgttctctgtgccactcgagcaacaatgggtcttggagaccgacacaagcaaacaattttttccacaggatttatcaaaaagttgcctgttcgcaaaaacgcttcgagctcgaaatccaaccgcaagcgagtgccctaggcgacagaggccaagccggcatgatgtgttggtacacttacgtcacctgttgtccctggtgtttgttacggtgctttccgtttgctgaatcgattatcggagcagtcaccgggtttcatcccacacagatatgcacttcgtttgctccgcctgctcgctagagagcgatccggctcaataacccgaatgcaaagacaacgcacggtgaaagaaatacttcaatcgaagcgttatgccaaactgttttgttgcgagttgagaactcacaattttgccttcgttttccggagccctttgcaagttaacttaatctacgagccgcacaggaactttgaagagcatcagtgggcaataaagaggaagattacggtttccttttttcgcgacaacggcagcgaactcttccgtattggaagctaagcagttcgccgtagccacagaaaatggggttctttacttataatagcaaaaagcgcactctggtttcttgaatactgttcagcagaagggatggcagtgaggttgccttctgcatcgacgctgagctccgatctatttgttcgtggtgcgatttcccgccataaaagcgcaaaatgacggttcttcttgaaattgtcagctgtcgtttcaatcatagtagatggtagcagaagtgccttaccctgacagtcgatccttggcaggacaggcatccagcggcctttccgctggggaaaggcccacgatgttcgctgcaaatgttagtaaaataatagtgcgaccttttcaagcagcatgaagactgtcgttttgattgtccgtacgtcgatttcgatcggcagttaaccggggctgtaccacagtagacggagttgtgcgttttatgctgacgttagaagcgataagctaggcttctgcttaaactgcggaatcaactaggcccagcatgatagaatgattcgcgacagttcaatgctccaagcaaatcgctgcaccgatgtctcaacaaaaagggttcagaatgcaaggagcgatatccagtctatctgctgcagttgaatgacatgcagtgaatcatacacataacatcagtttccaacagtccttcagttcttttgtgttatattttgcaacgagacggtctagcaaacacaggatgctgtcgactttttcccgcttctccggtcagggactttaagagaagcattcactcgcgacagccatccgtgtgactacagacacgactgtacgtgcatcaatcagagctcgcaacgccaaaaatctccaagcctgtatcatcacagcataaatcttccaacgacgcagctgtcacggcagacaccagaagcaagtcgcggcagtacggagaccaagtgacaaatctggtagaccaaagaacgacaggcacttcgagttttccaccccatctcaaaagagagggtcttgatttgcgtacccgcatctagttacccagcgcctctttgagtttctggcgtactacttcttgttgctctttgttggcatgcaggaagccctgcttctttgtcttctttgaatgcaccagcttcccattgattcttatctcgaaatttccggtcgtaccaggatcctcatggcctgtcaaccaagtccgcaaaaagacgttttgcttgtgcatgagccggagttgacttgcacaacgcgaaaatttggtaaacacgattatcgctctttctctcgtggtacctgaaggactgggaggggagttggtgctacgtcaacaagaataatattcctgtagttgcctgactgttcgtggccatcgcacacgattgtctcgacctcgtgacagagcacctccgttatatgcgtcatcaatacgctagtgcatgtctgactaatagggggttcttggtatgtgaaaggtcacgcataataacaccagctcaagatctcgtacgtcttttacgatagaaatacgctgcgtccccgtaacgtatcacgctctaacagcttacacacctagattctgacgattccccatgcagagttaacaactctgaatgcacgtaaaacgcacaaaatttgaaatgctaatgccttctcaccttcgatcgacacacggcgcagctccgcatcgctaagccatgaccgtataagagcttcagcccgatcgaagtagggccgatagcctcagccaccacaaaactggatggtaatttcgaccgtctgctccatcttggctactgcacaaggccatcaccgcagatcaacacaaaacatattaatttccaagaaaacaaggaaagaatcgagcgggaaaagtggaagcgttacattcaggacagattcaattctgcgcggaaagacgccccctctacagccgggcagcgatgccttaccttctatgggcgtattcatccgcagatatacacggggtgggttttcaaaaagttcttctcatagaaaaatgaaagtgttcgaccaatgaagcttgtgctgcgaaaccgcatgtgcggtgggagcactggctactgaaggttacttttggcccgctggtttagcgaagcccgcagcgcactcttcgccatcgctctgaccggtccagatgagggattaaagtgatgcagtgtctcgtgcagccgtacaccggcactgctgcacattccttaagtgacagcagataacgtgaactacaagaaaagggtggccttgtgtatgcatgaccagaattgttttcttgctgtaccgtgtggcacgtcgtccacgtgcgtcattttgtgggcgtcatgaacgcatctagtagacgtattgtcttgcgtgctcactcaaaagtgattctttttttcacggttacgtgtaaagaaatggtgggttcggtttgtcaacgtcctgaaactgaggaacgaaggctgttctgaccggactgattggcagcatgggtgacccacttcacgtgagcacacaggaatacgccaacggggaagcaacaccggcaggtgatttggtgtccgcaaattggcagttcgctctcgaattcgcagaagttccctatttcctaaaacaaccagaaaaataccgcatcatgttccacaagtccactctggtggtaaagtgtgctcccgacttctctatgtaatggcccacatacgttatggccggtggcaccgaccacgtaacggttgaagtcggtcagaacgtcacgtccgaaaggtctgaaaaccgtaaacccacagtttgccctcaccatgaaggcaaccagatacaaaaaaagtccagtgtgttcctatttttggtagctgagcctggcagcgttgatgccttcccgggtctagccacggtagatccggttcagcacgagaagtacaccggtgttactatcactggaatcaacaagttagtcaggaaggcgaagtacagtcatgcatttcatcactgctacttgcgattagtttcctcccgcaataatgaaaggctgatccaccgaagtgaaaaaatggcagacggttttgtccgtgtttgtcactgcaaccaacgttgtacgcggaagatgcacctgagatacgaattgctgccgagatgtgcgcgggtctctcgatgcctgagtgaggctgtcaggctctgcatttcctggaagtccacggttgaaccagcagatcgcggtacggtgctcagcggagagcgagctcaacggcacttcaggataagcctgatacttgtgta

SEQ ID NO: 3138 - DNA, 1269 bp, Toxoplasma gondii
ctgaacactgcctggtcgtttgtctgaagcgttccgagttttctcgaggtaaatcgaaatttctcggccgcgactccccgaaagtcctcacattcgctgtaccgcagaatcagctttcgggagcttagcgaaagctgaaatggggaaggggggcatggaaaaagcttcagttccagacaggagcagagcactcggaaggcatcgttctccctcaatcaccgcgaagggaggccgacagagaccattctgtggatggaagcctcaagctaattccgaaaaaaaagaagaggtgacaagcgatgtgtgcatgtagatagacgtcaatatgcacacatcagaaatatgtgaatatatatatatatatatccatacagatcatcgaatacgtatatatatatatatatttgtataataggtatttatatatgtataatagatatatatatatatatatgtatattgggtatttatatatgtataatatatatatatatatatatattgggtatttatatgtatatatgaatatacatgcgcgtggcagagtgtctcagcctgcagagggcctttgagtgtttgtgggtctccggctgaagtcgcctaaagaaagtttttccacgcagagacttgtggcgtccgtgggccgagagggtcgttgacgtcgtctgcctttttttttctgcgatggttcgcgcctcgaacctctcgtttcgcgagaagaagaacagaaggtgagaaagagcgaaaaaaagcggagtttccgagatgcgtcgccgcttcgaaaagtcgcggcgggtgtgcaaaacgccttccggggggccagttcgctttctgttgggtcgaacaagctagtcagtgaacttgcggcagaccttcctttgccttttctgcttctttgtcctccgctttcgcgctcttcttttccactttcatctggtcgggatccatttttttattttcggagacgcgctggcgaaggcgagacgcgcgcaaggggaggcgacacaagatattgcctctcggcccggcactgctgaacgcggccggcagagaattggacgcgactcaccgagcagaaaatgccccagacaagtcaggtttctgcggtctgtttttgacacacgaggagtttctacacctccacagttttctcgagaaacagcgccttttttgcagcgtctgtcgcgcttcatttcgcctcgtccgtctctccctgtctccagtccgccgttcacccgtccagtctttgtcctctccgttcctcgtgga

SEQ ID NO: 3139 - DNA, 2129 bp, Toxoplasma gondii
atcgctcgacacaacacagaaaagaagagacacactcacagatgtattacgaaaacttgggaaatgagatacgggtgtacagctccgtctcctattcacacctggttaacacactggaggagagcggtaggggggacggggaggaggggggtatcgctgcttagagatctctgaactacgtgcacacactgtgataaagctgagaggcggctttttcagcggctcgtccgtagcctttcgtcggatttctgtacacagttgaaagagagtccgtagcttgcagggaggaaaggtggcaagcgtgcatggagtacagacagctttcttgtgtgtctgtctgcgcacagccagaagggcgctttggttttcttcagacatttgggaatgccccgaacgcgggtttgagtaccttaaagcgtgcctcgtacgcgagggaaacgcttttttcttccactcgggggcagcgacgagtggagaaaggtggaattcaagataacgcgaatacgagcctttaaaagcactctttggacctccaaatatcgatcgttggtgacgcctgatccaacatctgagtggttttgtttgtgtgtacgtacactcagtgcagcggctgcgagtgctgccacagaactttttgcgctgcgtgctggaacttcggttgcgctggcttttgtttcgacggcggaaatatcaggtttcccttgggagcttccgtgttctcaactgaagttctgtcctgtccttgctcctcccccgttcttccaagtggtgcctctgtgagcatcctgtctatctcgtgattctggaagagtaaccctctctcgttgcgggtaacgtaactttgcacgaggatgccgcctttctcatgtttgttcctctatgtacggcattcccatctgctaacagcaaccctggtatccgtataatcatatgtacacttgcattaatgttcggcatccatataagcataaatacacttgtataatcagttggctccgaacttcaagcacggccaattgctgctggaacaagacttatgcgctgtgaaaaacagatctctcagaacatccttggacgctcgtctagaaacccagcaatcgagcaacatacacggtctttttagggttcgtccagtggcagcaaatgctttcccgatttgagttacacagtttcggacggtaaattattctatttttcacagaaacattgtggggtcgaaaacccgcaccgctgtaagcaggtgcttccattccagtgttcgcctgtcacccttctatacgattcctaagcgatcgaatcgtatacacgcagattcctctgtatttcgaggtactcgaagtgtaggagttgcttctcctgttgaacacacgaacacatgcgcaacaaaaatcgccacaaacaggagccttccacagtgagctctgtgctgcctacatggtgtgtgcgcgtggacctttgtgccacggtatttgctttcatgtgatttttttcgcatggcaatgtaaaccgactcgagagagcagacacaatcaggctgtcaccgtggctcagtttccacgatctttgagagagacagaagcacggaagccaggcactgtgcgcgcatgcatgaaacgtgtgtctgcctcgaaatctaaaggcacgtagaagtggaagtatcgtctcagtgcgtgaaaatggaccctattcaaaagaagatttcccgtacagctccctcggcgctccccgtttgatggtcacttttctctatgcatcgctgagagaggcgagcgtggcagcctgcatgcgcaacgacgggttgcttcacagtcccaggtggcgttggaatgccgacaatgtcctgcagattccacggaaacatcgaaaatctttgtcgtctttgcaggcgtttcaggtgcacaagaacagagaggcaggaaaaccagacgccgctcttttcccgtaacccacttcgcctttgtcactctcgttagacttcacccaatgactggccgaggaagacgagaaacaacaaacaacctaagccgtttccgttttccccgttttcttgcccgccgtccagttgccttttctacttttctcttttttttcctggagagacgaacgtagcgtccactctcgctacagga

SEQ ID NO: 3140 - DNA, 1555 bp, Toxoplasma gondii
tcgctggtggtggtgaaagcagtaaaatacgatgccagaagaaacgcatgctttgcatactcctctttgaccgtcacatgatttcggttgtgaactgtggcgcatgtcaaattgtattcgtccacttgagggacggagaagagttctgtactctctggacggtaatgccgtcggagcgtctgcgtttccaggcttgaaaatacgaacatagtttcccttggcgcagcattatttttctcatagatctgtgcacacacaaatttgaggctagggagacagaaaaaagtccacgtcttcggaggagggcgggcacaggaggacatagacagagatgcaagtgctctcgctactaagtttattctatttcttgaggagaaatccgctgcgaaaaggcgacaaacggaagtgcgtgttctcgaagcgttgttcgagtgcagtcatgagaagcagcacgaaacgttacacgcagaagctgaagccagtcagagcgttttacgtgtctaaatgactgtcacatatgtttagtacgccaaggaagaagcgtcacaaagtgtacaggcctccattgttctacaggtgcgtccttgtggaaagacacggaccgtactgacaggaagttcagctgaaaaacacaaaaagagtgttcgcatagcatagaatgcgtcaggctacacggaactctcctttgggtagttttccggtgaaagccgcaaagacgtgtcgacatcgtgactgctgtcgtggtgttcataataagcggagatttactgcaggaaaattatataggggattcgtgcagatagttctctcccgtgacgatctcaggtggcagttaaaggactcaaaaagttcagaacgcgcggcaagagttttgtggcaaatgggagaacaatgaatcggcgtctttcatggaaggttttttcttcccgagaattcgggataaaccaggattcagtaagcacgctttggttgtaagcgtatgtcgcaaaagacaaccgtggttagctagatcactacggtgcagcaagatcggctcatgattgcctctctgcgcaacagtcagtaactttggtcaaaaggctctaggggaagagaccaaaacacgtgacttgggtccctttctcggaactccacctgtctccgcgcttttctccggcttattcccagttacctgacgaaagagacaggtagtatctcatgcaccaagccgtacgaaagtggcaaggagacaccgccccgacactgggcccaccttacaccgaaacgaggagatacggacggaagtgcctcttgggcaatctgcgctctctctacgatcgccgtgttctgtcccaaattttgtttttctcgtcacccgaaatcgtccaatttattttctttgacgacagaacttgattatttctcaaagaccgagcccccttgtgctttcacggcggctcgtcgccttcgtgatctgcgcattgtgtgttctggtttccttgggagaccactaaagaataattttggtttcgatttctccaagttcatagcttttaccatcacgtggtggaaaaga

SEQ ID NO: 3141 - DNA, 2796 bp, Toxoplasma gondii
tgattctggtcgatgaaccgccagccgagactctcgatcagctccacgctggagacgatgagaacgaagagtccccgtccgacccagcgagtgccggggagaatggcgagcatccggtggcgaccttgcgccggcaatccacttgttcgcatgcgccgtttgttcctattccgcagctgattcgccgagtctttgcacactgtacggtgtttatcgtcgcgcaccacgccgcgtcgctgatgacttgcgacacagtgtggctgatgtggaagggccggaaaatcggcgagtgcagcccggcagaaatccgaacagacaaacagctaggagaagtgatgatgagacaggtgaatgagtggaaacgtcaatgtgcagatcagtgactggaatggtggatacgcgcgctgttgcggtgggggaagctggccgaccaccggcgctcgatgtcaggcgcgtttcgcggagactccggcccttcggtggtcagtcggcgcgaatttagaaggacgcaagtgacaagcagaggatctgtgcagcagagacgctcgacgaatcctcgtgatgtaaatgtcgcggggatggagagcaggtgtgtgttcatgtgggtacgcggtttggaggctcttggatgtaacagacatgtcgcagtgaattagcgaagcgtcgcctttggggtgacactttctcgtaacggtacatgaggcggcgggattcgtgcgatgggttgagaacgcgaggcggctccgtcgttaggccaaatcggtttcgagaagttggtgcgtacacaggatgggtcagacatccaaacaaggtaccttgtcttttcttcacggtccgtttgttcggttgttttgtggtgcacgctgctagtgacgatgcacagctcttttgtcgcgcgtggaaccctcattttgctgtctttgtcgaaactacggaacgaagaactcgtcatctgatctcagactcaatcgtgcggaaccttcttttgatccaaaccgcttacaccgtggtactggcacggggatcagccagaacgttccacgttggcagttgaagcaatcttgggaactctgtgtggatttgtcttctgtagttgagatatgttccagaaactctaaatttattcgtatcaatacgcattcttcaccatttccaagcagctggcgtgctgtactcttgactagtagaatgtcatcttacatgcagtcacgatggcaaatcaagggcggtacggtggttttgtgctactaaccatctcgccagctcggctacccgaatgacgatgtcgtggggttcggaacaccccaaattcgcagaattgctttcttgctgcgggagaatcgaagctcgcgaaccacaacttcaaatcggatttcagattacaggcaacggcccgcgcaggggctgctcagtgtttcgtttggaccagaacgagcaccttaggcagattttcgagcattgtacacatttccttgaggtggcagctgtaggttatgagcagaagaatgcacgttcctgacattacgctcgactgctcggtttcaaactgtggcacgaactgtatagatcgcaaatgatcgagggtccttgtatgggaacgaggtaatgtaagtctaaattcaccttaaaattccccctctgaagagcttgctgtgtcctcttgctcaggcaaaaatcaatacatcaaagagagctgaggatttcctcgttcaatctccgtattactccgaataaccacatctctcgtcgttcaacggtgtccattcagcaatgcattatcgagaccaaagggctctgttgtgtgctgcagaacaactgctgcggcagcaatgctggtttcgaaacaccaagttcagaaatgccatctgcttataaggcaaaggaaaaacacggaatgagcgttgacaaaccgtttagaagacgtcggaacgcgctcccacctgcgcagttccggcctcgaccttctatcgattcgtttccaaagcgcttttaggcatcccagtcggaagtttcgttgaagaacgcaagtggcaatgcagggaacttgcgttgaaacttggcacacacgtggcttttcttctcgagtgacggcattgcagcgtttttacgcgcgagtcggccacgctgatacgaaaagaatcacgaacgaggcgcttgcttagtgaaactgttcttgtcctctacgtgaaagcatgaattaagtctgggttttccgcaaattcgcttgttgattctctgtttgccttctgactgccgcgagctgtgatccggaaccgtttaactcagcggccgttctagtgtgtttctgtcgtttcttttcgctggcgcggatttcagcgactcgactcccgcttttgtcggcatttctgagcctttacgtcgctctccgttgtttcggatctcgatttcgtcttcgtcgtccttgtccgacggaaaagttgcaacggaattgcctgtccacgtgtcctacggtgtatcgcgtcattccacagcggaagaatcgtccagttctctgttcctcccatcctcgtttctcatcccgaaagaaatccagtgcttcagggcttttttcggcctcaggttcttctgtcgaacactcgtgtcttcgcagcgaaaaggtgcatgctttcaccaaccctccagccgcagttcagcatccacattttgcacgttgttctttcatcgacaatttttctcgactttactcgccgatccacagcccacgtcggtcttgccgaaagccgcggacctttcttttcctgacgttcttgtcccaccaaatcccagtttccgcga

SEQ ID NO: 3142 - DNA, 1951 bp, Toxoplasma gondii
tatctcctggtgtgtgagtgacatggtctgtacgactctgtttgacttctctgtctcctgcctcgcgggcgttcgtccgtctctcctgcctctctcgcactccgatcgggatgtcttgattctctttcaaagctcgtctgtccttcgtccttctcttcgtctcggatcgaaacgtcgtttcactgtcgctggcaacttgcgtcgggggctcccgtttcacctccttcttccttgactccggttctgcgtctcgctcttttccgagttgttcgtcctcgccaacttctgccttgtgttctcctccagcctctgctccctgctctctgagtctgtctgtctccgcagcagtcacgaagaaaagagacagcgacagcgcgcagaagcagatcaagagaagacggggagacggagagacaacgcctggggacagcgaggcagcgaaagaactccgacaggtggagaaaggcgccgcagacaggtgcagagtcgaggacgctcgctgcctgtcgccagccgctgcgaccagagaccctgaagacgcccgaggagaagcgatggacaaagagagaggaggcgagagaagagaagaagaaacagaagacgagagaagaccagaagagcgagaattcgagcgagaagaggacagagactcgagagcggaaggaggagcggccagggaggaggacgaagggcaccaaggcgtgagggcggagagcaggaaaggagaggacaaggagcaagacgaactaccagacagaagagcagtgggaaggcgaggagagacgacaaaaggagagagccaagcagaagcttgtgagagagaaaacgatcgaaaggatctcacagaatccgagagagacgcgcgcgaacgggaccacgagagccgcgccttcgccaagaacaggctgcgtccctgcatcgctggcgttgactcgcgcgacaatttattcgacggtgttttgtgaccgtagtggtacagctcagatcgagcaaacaggcacctgcggggacgtcggacgctgaggaagcgtggatcgatctctgttgtctgcgtcgatgctccgcgaattccgaccgacaacgggggcgtctccggttagcgccggttccctgagttcaagaaggccgggcgtcagcgagaagaggatgcgctctcgatcgatccactcatgaaaagcaaacaaaaggcagacgacggagaagaggctgatgaaccgtcgaccggaggcgcacgcgagtcagccgaggcgtgatgacagagcaatggcagtcgcagccggaggaagcgaaacaagacggtggacttttgagtgcaaagaagtcgcagatccgggtgtcttgacattggatagccttgagtcgcgcgttaacgaaaaacgtcttctctgtctcgtcgcactcctttcgttcggcgtctgaaggcgccctgaaccaaagatggatagaaagccagctgcatgcatttggaaggacttttcgtctccagacttgcgcttcagctgtgtcgggagaagcgggctgcgacgcatcacaaccatattttcgcacagaggacggagaagaggaaagcacgcgtttcgccggttttttcttgtccacctgaagttcttctctgtccggtggtcgcgtgtatttcggtgtttcccccctctctctcgttctctgcttgtctggccactgcactcgagagaggctaggaacttgtcctaccgtcgttcgccatcctttttccaccctgctggccctgcctcgctgggaaatggcttctcgtgttgctgccgacctcttttttcctccaacgtcgcgcagtgtctttgcgcggccttgcttcgtctccaggacaacgaagcacacagcagaaagccgagtttgatacgccttctctccactctcgactcgcgttaagttctctttctgtttctccccttcgtctaagcgcgccttgtcaaga

SEQ ID NO: 3143 - DNA, 1279 bp, Toxoplasma gondii
ggtctgcatcatttgacatacaggaggaaggtggagttgaccagacaggcaagctgcagagtcaaaagggatgtgaggccgccgatgactccagctgtgacagcagccatgcccgcacagaaaaagagagtttggtacttgcagttcagacgcacgagcgtttcctcgacgcgcgcaccaccactctccatttgctcagcaatgtgggcagctgacgtgggaatggcagggtagccattttgtccaccgaccagtgcctctgcggaacaacacacacacacacacaaacggcataaaggctcacacgtgatatggaactagagaaacgaattgaatattgtcactatgtgacagccactaaaattgtatgccaacattcgaaacccaagtactacatcttacttctaccctgattaagatgttatgtggccgaaacaatttttagggcgcagcatggtggatgagcagcaacccacccgggagatcatccatgacagtatacaagtgagcctttgattacaacaacgtgcacagatacacacagatttaccaaaataaaaaaacgcaagaaacaactgaacttgcataatgagggcgtaactcgcgcatacagatactggtgagttcgcatcccagcacggcgcgaaccctgcgtgcgcagatgagagaatgctcaggacggccaaaatatgattttcacattatccgtttgtagcctttgccaacacgattagttatagagctgcgcctttggagggcctcagcagtgaccgttctggagaggtaaaggtaccgccacgaacgaagcaccacagcgtttcctaagccacgatagactggatcgtgacagaaaaaaaaacgtttcgtgatacagttcccagctttcgcgtatccaaaagaactaagaacagagcatccgtgatgaagactatccacttcacttccatgctgttgtataaaaagggacagcccccgtccgcccccgtcgtcagttaccagtagggtcttcaagaaaggagcgaatgtctcggatgtacgtacacctcaatacaggagaccacgacgggtatggaaggctgatggaatttactgcgcaagaggtaacagacagcctgagaaaagatcgcctttcttacctgttgggtgtcccgcgattggcgcgtctgcgtacattgtgcctaaaagatgtttgaaaaacaccaggtgagtaagcgccggcacagtaaagagagcaagcggtcgcgacgatcctcgaccagcagaacgagtgaccggaaaa

SEQ ID NO: 3144 - DNA, 4522 bp, Toxoplasma gondii
catgcatatttgtgtagactcttttgcatgcatgttgatggtcgcctcaccgcgcttcggtgtgctcatcagacagagtggcatccttgaaagggtcttggagacgtgcgagaaaataaattgtctccttctgcttccctcgagcgacgtaatgaagcctctgcggaaaacgggaaaagaaagttgtttcccatgagtcgctttttgcgtagtattaattccactccagacagctacccacataggcctacacatataaatatatatatatatatgtatatgtatacatatatttatacgtacaaagggacaatgcaagaagtacacaataggtacacctctacaaaaggatatgactgatatttatgtatagttgtatatgtatatatatatatatatataaacttttcttgggagtgtaagggattggccgagacgcatgcgaatacatgaaaatagatgcattgggtattgactggatgaaaacctactcttctggtcatttacgcttgtattggtggataggatgcaatttctccgcgttttggtcgaacctggatctaggaaccaaagaccgtggatgagtaaacccgcgcgtaagaagtattatacactctgcaaagaagcgtggagccctatctcagagagtatcgttaccaatatgctgggtgttcaccttccacgtcgaacgtgagtattccttcgatacgcgtcacctgacttcgaagaatagagagtacttggaattgcttcggaaactaacgaaagaattcaacatctgtttccacccttcgtacacacccagcgaaatctgggaatctgtcaaacgaagcacctatcgaaggaaagctcggacgtttacttgacggccttcttgtttttttctgggacactctgaaacctactctttcgaactgggagtcgacgacgagatcacattcggcaaatcccgtttcttcttctgtctctcgcaacgctgtctctagtggtttctcggtgccatccacatggcctgcaacgaccatcaaaccgacgaggcatggaaaaccagcctaagagttgtgtcttctcctctctgtttttcagtacctcctacgcaacgcaaggcagaaagttccctggttttctcgtctctagattcaaacatctaattttgtctccgcgggtgttccagcgagttctgtacatccacatttcgttttgtatgttcaatatatttgctagagaacttgaggtatagtttttttcctgaccgtctcgcgttgcaatgtccactgcgccttttcgtctaaacgtaacggcctggagaggctacagtgagtgtgtctgcacgtgcattcccgacttcttctgcccatgaagagcagccggctaggacacagaagctttgcatgcaacgctgtatcggaaacggcgaccgcgaaaagagaaaatgtgcctgaaacgccaccataaagtgcttggtggtttggaatcctgacactcccgactggttaactgcagtctgctggtctgggaatcagggtgtccttggtggtgctccaacgctcgtctacgcctctggctagcatcccgtttaccggccactgtacggaatgcatcaaacatgagtgagcaaaagagtggtcttctgttcctatttgcagtctcatgcactcgaggtaaaaccccgaaagctccgagtcgttaggcaggcgaaggcgtaaacaagttctgaaagagtccaatttgaatctcacctttcggcggagtccagtggaacggttcgtaggacgctctcatcatgagaaactgaactttgttagcttcgtttgccttggcattctcgtcgatcttgtaaacgagaaaccctgcggctcgggcctcgacggctggcttcggctcttctctgaagaaaaaaatccgattatcttcagagccctacgcagtgtcagcctactcaccaggatattaacagtataaaagctttgcaaaaaatcagacaaatactataatacaattgtcggacgtacacattctaaagtattgtttagaggggcacgaccggtcggggggctggaggggaaggcctatgtcgagacacaagaaggagagttctttgcagtcaacacagcatcaagagaaaggaagctgtcagacaaaccaagcgctcatgaagaactctatcattcatgtgaaactttatctcactcgtgtaaaaaactcttgacacgaacagcaaggaagatccagcatcccctccctgcttctgctcccctacatataaacgtattcctggtgtcttcttctttcatttctctgctactttccctttgccttatccgcggctcgtccctttcctcttcgttctcacgcggtaagtgacatttggaacatgcgtttggagaggaacccgggggcttgtatatgtggaaaataccacgtttttcgcacgagaggcggtgacagaggacgactacagacgaggtggtggagctcgacgagagggataagaaaacacccgatatgtcgtctcaacatcgcctgaacaggtgtgcacgaatgtggtctccgaatgcggcctcggatccgtggaaccctgaaacgcagtcctgttccctgccttccgacagaaagacaagccgcttctctagcacgacgatttccctcagagtatcaagagctttcaaaaaaactcaacgagaaaataacagggtgaaatgcacgcgttgagaaaagggagacgtttcatgaagacgcaatggcgttgaggaatgcaacgttgcaggtgctagcagcaggcggcaggagcgtgtgccgtgtagacggtgtcaagacgaagcagatttccgaggtgtttcaccggaaacaaaacgtggacacttttctgttcccatctcatcagttgcacttaatcgtgcgtggaacgtgaaaaatccacagaaaatgcctgaaaaaagcgactcctcaatgcgctcttgtcgttttgtctcagctccatatacagccgaaattaacgctgagcccaggtttctctcgcgtctaatcccgcctgcagatcagactctttctaccgaatcttgcatggggaagtcgaaaataaatgccccttttgtgatatcgtggatcttccttctctgccagtacctttccgctctcgccccgcccccgccgtccccgccgctgcgcgtttgtagcgctctggctcttcgcgcggctccactgaaaggcggctgggggggggggcatgaggaagacattttctccttttctctcgtttccgcagctcttcagctttgaaacgaaattccgtcaacacaaactacaaaaggcttactgtaacctacgtatacctgtatctctatgattacatccccacgggttgttgtacacggacacacgcaatacataccggcgttcacgtggaaagctcgcacacttcatgcttagcttgaaatgctgccaaagatatctcttttcttctgacgaccattgctccagaacagtttccggatctgcctctttacatctacacataagcgtccgtagttccgcgtatggatatgctccaaatctagccgtgttcctgtgcacacacctctctcgtcaccgacgacacagatcagacacaagaatgcggagtatatgatgttagctggcatatacgcctcgcctaagatgtgcgctcgaaaaatcttccttcattcatgtgcttttttcctcgctcccgtatctgtgtctctgcgctcgccctgagctcagctgcctccgtggttccggcagtcccgctcttcctctcttggttcctgcaaaaacgttttttttgactctgcagtaagatacacacctcctgcttcttgtatccgattgctggtttagattttgaaggtcggtgtttaccggatccgcgttcgattgtgttctacacacgaccgtcacattaactgtatcgagcggcagaaggcgtctattggaaaccctgaacaggtacctaccagctgtgcaaatgcgacggtctccatgttggtgtcgtctccttttctgtgcacatttaaagacatctgcaatccagcttccgtcgaaacggggctggagtctgggggacaacaagttggcaggtctcgagtgtgcctttggcgtgtctctcgagagacacgactgtggggttcgctacgacaccactgttaacgggcaataggaatttttcttgttggtgcctggccgacatcgtgtttgtctcctctttccctcgctctttttcccgtaattccggaagtcttcttgcacgcacacgccgcctgtgcttccacttttctcgtcgtaaagttgcggggtctctctcagcgtttcaccgcccctgtttcgcgctttcttcatagagctgcttgtgcgggagaaatctctccggtcgccgagtcgcaggagtccctttcttctcgcgccgtcgttttttccgctcgagttttgttcttcttgcctgtcgtctgcttctcgccttcccgcctttcccgtgcgtttttgctgtctccccgcctcatcacca

SEQ ID NO: 3145 - DNA, 2282 bp, Toxoplasma gondii
gtggtaaacaaactcggaagcttgtctcgctccaatcagaggtgaaacataggaactgtctcaattccgcatgtgcgtaaatggcggataaacgtcttttttccgcaattgtaacagtagtcccatctcaaaccagtaaggggtgagcacgaaattcggtatccagcgatcccaggtagtttacgcttgcgccaggtgtcaggaaagttccgacttccgttcgagtgccgagcgtagactctggagaaattggtaccaaagagccttctcggggcccctaacacttgggcatgacagcagtagtgcgcgcgtagtttggtagcggactcatgaagcgtggttgcgtccatgttctcgagactgtcgccagtaactcggttcagttcctccaggcttcgaccggcagcatgatcatgtggctgtaaaaaagtccgccatctttttttcagattgacagtggaagttcccgcgcggtgcaaattgtgtcactgacatgggaatgtttttctattgcgacacagctgaagctattggagcattttaggtggaaatcgaagtggaaagtagaagtgatgtactttgccgttcttgcagggctgcagatttcgccggtgattgtcgatgcagatgacctgagggtacatcaaatttcgggtctgaaatgattgaatgaggcaaacaggcatcgaattttctcaagaatttgtcttaaacgtagatctctaacgttcttatacactgggctcatcacaacttccccgaattcctaaagaacctgtaatcgaccgccggtatcatcctggtgtgtcgtgtgatgtttctgacgagcgtgcttaaacgtctcaagaaaccagtttggcattcgaagaagtgatcggaaaatacgatgaacagtgctgcagcttctcttgcgcaaatgggagagcctctacatcatggcttctttatgcaacgcgcaccaagcttcgaatccttaagacacacaactcttcttgcccgtactctgattgaaatattcagcacacatttccgctcacagcatctcaagtaacatttctcaaagtccagcttcgattcacattttctaactgtatcgtcgtcataactcgcgcggcagacacttgcttttctttctgattacgtcgggagtctcgttcgtgtgcacacatgtggcaagccgctgaacgtgttgaaaacttcaacttgttccattgcaaaggacagccaaaaacgcagatggcagaagacaggacttgaaaacagtgaaggggaaaagtcggtgcaactgatggcagctccacggggggacagtatgctagccccatgtggggccctcaactgtgtgcctaaacgcatacttgtgtccggaacagttgcttggctgactggcaaaatggccaggaaaaagacacaaactgagttacttcctgacacaaagtgttctctagtacgcgaatacggcctgaggcactctgtactgtgtaaaacacaacaggtgtcggacagggatgagagtcctgatcaagctcatccaatgacgcctcagctccagcaattcagatacagcattgttgcgcgtgtagattaaagaagtttaacagtttttctcagttttctgactgagtgaagccactctgttcaggttcgtggaagctcttcgctaattcagatgcattgggtgtcgcaatattcactatccgccacaaaggagaataagcatgctgactgcccctggattttgtggggtgttaccgtttttgtcagatccggaagtgtctttagttttcctctggataaatgttcgtcttactggtgtagcctccttcattacaggtgctcttgttgtgtgcgagcgctaaagccaaacaggtcctggatgcagtgtgtgtttgctcaagccgctaggttggttcttatcggggatatcgttgtctagcctagcaacagtcaactccctctgttctgaagcgtgtcacgcgggcattaaacgccgcccggtttatacgcagctttcctgtacctcggtcacatccttaggtcaacggtgttctacgatccaaagcaacagtctggaaccggtagttttgtgaatctgtggaaggcagttttgaatcgtttcgtctcagccgttcatcgatcaaaggacgactgcgtttttcatgaccatgttaagtgcactgagtctagcggtatcggtgctactcccgcttgcccttgtttcataatttcaacggtcaccatgcggcgcaaacacagacactgtttcgtctccttgtaaaaca

SEQ ID NO: 3146 - DNA, 1624 bp, Toxoplasma gondii
gtcgatgacagcacagacacgggacgtacctgcttcggaaaaccccatcgcaaggttgttggtgaacagcttaattgtagtgggcacctctccggctgcagcgcttccgggcggtgattttatcatcagagacgacagttttacagggctagtgaagccgagctgcaccagtggacgcacgatgacaaacgccagcaagccgttgacatatggacggaaagcacgtctgagagcatcgtatgtggcatgccacccagaagacaaacgcgatttgctacccagagaaacaagaacacgctgttgaaacactgaccttgatgagcaactgcgggtcttcatttgatgaactgaggtaggcggatttcgatgtctgttcgatgatgtcgcggatggagtgctgggcatcctcgttgagacactcgaccttcgacttgtcaataagggacattaagctgggaaacgcagactcacaacgggtgcttgtcatgttttgcagttctaatacagtccgtacggcctactttttacagtgtctgagaggcctatttacgctggcaagggagtgaatgcgatacagacgcggacagggtacaccgacagaaaaatgcgccgtcgccaataattcccgcatcacgtatatttgcgctggaaacagaaagaactgcaccaaggtgcactttagcacaaagaacactttcgtcacctctatcggagaggcctctgtccaccaagaaggccataagccgcgacggacagtcgatatttcttcagaataacatttgctttgcatgcttccacacacagcgcagcttacaggcacgttcgagagtgaatgggggaacttgagagctacgaaccctccttcatacctggtgccctccatgatgccgatgtgaatatccaccactttttcgcgctgcgtatcaatgctgccgtatcttttaagtagccgggccgaagacacacggcgaagcccgtggaaaatcaaaattgtgtctcctaagtttctgttgacggaacatgcaaaacgttgtcttccaccccagcatgccgtgattgctgagaagcccctcgagagacccaggcggtcgaaggctgaatcagctgccttattcacgtgcgagatgaatgcagatgagcgttttatgttggggacctcgcaaagagactctcgagaagttgcaagggaaactcgccacacctgttccggacacagacgtccttgcgcttctcgaagccactgcatgcacactgcctctgtgtagtatttctgttggctcgctgcgtgacctgtcccgaccacgcgcatctgtctccgtattgggagacacaaaaagacaacgccgcgacccgctgcgccactgtgcacgtcccttgcttgcgacatgaaagtcttttcgttgcctgcttttgcacagggcagaatgttcgtccccgtgacaactcgaatctatttgtcctcgatttaatgggtaacttctgaaatccggagaattcgcgaccttcgtggcacgtcaggtggagccgtgctgtcgcgcacatctgctgcgaccaagttttcgagtgacactagcagaatatcctctcttcttatttacaaacacttttttgtgttaccgaacta

SEQ ID NO: 3147 - DNA, 2970 bp, Toxoplasma gondii
tgcgaccgatgactcgagtcacttcctgaaacggtagtgaagtggggcgaaggaacttcagtgagcacggaggcatcatggatcaagattgagggccagagacagacggatgaaacagagtaaaagaaagcgttggcagccaagctcaggaaagcacattccgcagaaagccctgttttttgaggaaagagaggagaaaaacgagcgagtgaaccagactgaccacgcggacggtgtcacttgaactctgagtaacctggatcccctccgcgacagccatctcggtaaccagggctctttcccctccggcaggaagaatttcggcctcggatttccctgattcctcaaccactgccttgaccaattcttgctggacaacagaacagaaacaggacacaaaagtccacagttgtatttagaagctcggccttcgacgcattcctcccgtgtacggtaagtcttatgcccccccgaaggcaaagaaacaggacgtgtacgcacgagagaccctgtcccttttctacaggatctaaaacaggagctgcagcatgaagttagtccaaatcaaacggcttctgacggcaaaacatggcggatcaggtgcgggtgaaacttccgaaggcctttggataattgtggtggcttcctgagaaggcaagtcgcgattctttgtttcagccgtaggtttttcggcagacgaacgggctgcatttgcactcagttggcgtttgcggtccactaccgctggccgcttgtcgcacggccatcaccagaggaacaagggtgatgccttatagaggcactggaaatcttcgcggtccattcctgtgatccagcctcgcaaatgggatcaagctgttgaagcaagagccctaaaatgtgtatgccccccatgtaaagccagccacgaacctagacagagaatcgatacaaacacgctttccgccgaccgtatttgtaaagcagtgcctcatggccggtgttgtacaaacaagcttacgccgagctctgagaccttcaccgcctccgcactctgttttagttttctgcgtgctcgacgagcgcgaacgtttgccccgcccagagatggtggagtcgccgcggcaagtgtcgggcggatccagtcctcgccgctgaggaggacggcgaagaacaacaggaggagacatctcctcgaaagaaaagcgaacagccccatgttgctcgatcccactgcattctacttgctgggccgttcccttgacctgatggtgcgcatcgtgtctgtcgtggcagaggttctcgcgtcgatttgtgcggggtgccgcgtgaagccgggaagtccgacctaaaacattcggtgctgttctttggaagcttagcggaagctcaagatcacttaaatggcgtaacacagaaaagcaagcggttcggaaatgctatggaacgaatgtcggaacgggcgaagctccgagagagggatttgagtcatcgttgccggcggtcctgctacggagtgtcttgacacccgagcggctgcctggaatcttgcacaacaaccggggttctttcgtaggagcaaaacaatcgacaataaaatgggcctcaactgcagagtgccctgaacgaaaatatatttccgcggggttttacacagagacaccgaaaccttaccctaccctctgcctctacggccgcacaagacagacgactctgctgtccggcacgggaccgacgtcaattcattttcctacgtcgctttgcgcctccgtatagtgagggcccgaaatggaaacagccgtttccccgcgtttttgcagaaaaacagaagcggtccaaccactcctcgcggcacgtgtcttgctccgctgaatgcgagccttgctcatctaggcaatccagcgatccggtctactcagcgcgtcaagtgcgctggccagtcacgagaccgctcgaggtctagggcacccgccgtttcaaagataccatgagacgtacaaaaaatcggatcaaacgctagcctcgagaaatgaatttcttttctctcgccggtaagactcttgagaacacgatttaggtgctttgtctccgttgtcagctacatcatggctgcctctgccaccgacgagagtccctgcgatttcaaatgctgtcctggcaccagaatttttttcggtttcgtgaacgccgccgctatatcggagtcgagggaagagagtaaaagtaagcaaactggaggtcctatcattgccgtgtctgcatggctcgtgcccgttttcagcccttctggcgctgcagcgctacacttttacactttgttgggtcgtcgctgtcggcagcatagcttcgccagccctgcgtcctgctgtgccgtccagtccttgtgaacgtccatgttcttggtggagacacacggtttccgaattgtttttcctctgtattcagcagacgtgccgtggttttcagtcgctggtcaaacggtttcaacttgcgcgacgagctcagactgccagagtcgccacacgaaagacgcatcgtcgcatcgtgtcccctctgctgtgccttgccccccgccggttgctgaccgcgcaggtgcatgcagccggacagaagcgtcccgtagaagaagtcgcctgcctctagcttcttcttagccttttattcgtcaatgcagtctttttcaattcgaattatgttcacttccagaccccgtcggcttctgccacagcgatctgagccgccacacgcgaccgcctcggatggacccaactgggagcgcggtcggttgcaccgcaacgttgactctgttttccgctcccttcttcgactggctccgcgccagggcgtccaatgttaattcctcgttgtcattccccccaaggcgtgttctcgtttctatcgagaccccgtgcactgtccgactgcgattctaggctctaccatttgtaagagggtggagaagtccgggcaagtgcagcgtcgccaccacaa

SEQ ID NO: 3148 - DNA, 2587 bp, Toxoplasma gondii
ttctaggttcgtttgcttctgtcgggcgttctgatggttctgcagtccgtccgaacactcgcccaatcggggttggatgtgtacgcgcataacatcgagacagttcggaggttgacgccctatgttcgcgacaagagagcgaagtacgaccagtccctgcgtgtccttcacctagcgaaacagttcaacccgtcgctgttcacaaagtcatccataatggttggcctgggtgaaacctcagaagaggtggttcggactctccgggatcttcgagatcacgacgtcgacgttgttaccctcggacagtatctccgaccaacaaaacaacagcttggggttgtggagtatgtcactccagaaaccttcaaaaaatatcaagacatagcggaggagatgggattcaagtatgtggctagtggcccgctggtgcgctcatcttacaaggcaggggagtactacatgaagcaccttattgatgatgcaaggaagcacggccgacgtgaaacagtgaaacaggttaagctggaagctgatgtcggcacactgaaagggacaacaacaacatttcaagtaaacgagaaagaggcgtgaccggaaacttgattggggagaaggaatcgaacgagcacaccacggtgtgcgggccgggttccctgttccaagtgtgtagagggaaggcaagggggaatataaaacggttggtcgctgctggacgcatggaaccagtttcaaccaagcaagagagcatcgttcttattgtattgtgtagccgatagttagcacctatttagtcctcttaaaaatgtgcctgatattccccttctcgcgccgagcgtagttcctcctttgccaatctacgttttgctcaagggtgttgacttagaagcgtactttacggtatggcacctttgcacaaccgcatcgaatgaaatgcaatgcattttatgcggagcatgcttttactgcgatttgctgacaaatttgtttttgcatctcacgtgcaagtcaaggaagatggaaagacgctcaatggtgcatgctcctgtcttacataccactttgtgacggtacttacgtgtgcatttgttataaacgatgaattccctaccgcacgtaccaccaattatttcatgtgcacctagaacagagggatactgtaagaaacgttgtcgctcacgtgattacaaccacgagggagacccaggtaacctctggggaagcagcaagtaccagcaaagggtgagccgcaagcaccagcaatgggttaacactccatgatccacgggccgaatgttgtgtctggaaactggatcccaacaccaatgttacttcccagagggagagggagaggctctgtggccttgaccaggattctgatctagtttccagggggaaccacagtttgcactcattggaagatgttccattagcaacgacgagcaaatggtagatgggattcgataaacaccgaactcacccgacagcaatatttatcagtaacaccgatacaatgacaacggaagctcgttagcagctgcaacatagaagaatccaactctgtcacaagagatgtggcctcttataggccacggtcagagaatgctgcaggggtatcctcggagggcaacggcaaaaaaaaattgttccccatgcatcctacacttttctccaacacagttttcgtctggggatagctggtttcgccacacgagaaggcgggcttttgccttgtaatagcatcacgctaacaacagcagttaggtgctccgcttccacatcctcgggactatgagagctgcagctaaatcatgtaagtcgaagacgcaagctcgtgttgcattgatcgccttcagccttaagtagcaggcagtatacggacggcgtctttaccaccagacgcctctacaatcatgcgtttgggaggatcaattactcgtggatatcaatcgtggcagtgcgcgagattgagtaaaatttcgaatgtatctggagcagtttcccgaatttctttgccagtggcaaagtttttcaacatgatatcttcctccatcggcgaagactgcgtagaggtatggtggagtggctcagcactgcgttcaagcgcgggtgtatgtccacgggcaccataaaaaaggtaaccccggagcgcgggggggggggcacggaacccattccttctcgtcacaacagcctatgttgtgtctggttgtctgatacaattgattctaattatgagttaccacgttggagataaagaagtaccccagaaaagactggacatgcaatctatcgagaagaaatgtccccgaggcaacgcaaatcgaggagctctcaggtcatcaccccacatggtcgagatttgtggctgttgaatcgagttaaaagacagacacagcgcccggctcctttgactagctatattttactttgcagaaatgcgcggtgattcaactgggtgccgaaatatatgctgagagcttccacgtgtatcgtgttgctgactcgttgctggccaccgttttctctctcgactgtctggcggcagtgccgtctcgctggtcctccgtccgtctccgctgcgaaaaga

SEQ ID NO: 3149 - DNA, 4317 bp, Toxoplasma gondii
agtcctgagtgacggcaacagcagcaggagatgagacaccgacagaggaggcaggatccacgccgaagtggacggaagtgacgggagaggaggcatctcgagcagcgttgcggggagacctgctgaggccgttcttgcaccccagaagaacgtcggtgtctgcagcttcataaagaggagaccgtcccgaggcaggcagagacacattcggcggctctgcttcttttccctcagtttccgagggggctgagtcagctgatgcgggcaaaggagatgtggggacggccacactgcatgcgttgccgtagggttcgtcactggagagagatgggtgcggggacgaagcctggacagacccagagtacgaggaagcatcgagaagccctggagcggaagccgacagctcctccgctacagactgactgcgcctttctccgcgatcatccagcagctgtggagacgactccgcctcggcttcgcgagagccctgtaaaagagcctcgctctcctccatggtttgtgtgaaaccctgcggccatggacgtctccccgaagcattcagggacgagttaaactgcaggtttatagatgtccacggtctctaccaggtccaagttcgatagtgctggcaataaagcgccgcggggtgtggagacactccgcggttgacgcacaccgttccttgaaggacgcctcttacaacgtgacacaaaaaacagcgaacctacgcatgcttctttcaggtgaacaggcttctgagaagtcggtcagaaacgcagacacaaacaccaccagagtgcaaagcgaggaggcgcacttgggggttttcggtggagaaacttgaagcgatctgcatgcacgattgcggacgcagggaaggtagtcgtggcttccccagatctcctttaacgaattcaggagggtgagaactgtaatccctccgagaaacttgggtggaagacgagaaccgtgaagggccgcaggactacacgagtccctcagtgaaatgtgcagcagggcggctgcctcagctggcttctgactggcactgcatgcgccgaggacatccggctcctcactccttttgtggtgaagagaaaacagtcagaaaacatgaggtcaactgtgttggtcgtacgcgccggcgctgcggacagtgtgaggggacggcccagaacactgcgcgagagaatttagagcgctttcccggggattccaagaaagcagaagcaagcaatcccctcctgtgcggaagctgcggctggcacgaactgcaatcactgcctgttggttacgcggaatcgtgaggcacgaccaattgtgcggaacccgggccgttagactcggcaaaagtgagactcggacgagaaaacactccaacgcttcacgagtaactgaggcacagaaaataaactccaacagaagaaccgtgaagccccagtagtggacctcaaatgtaactcgtgcgtcgaggtgtgcgaggaactcactcgtgtaagcaaatcctagagctgcctctccaacaagaaaaggctacggcggttcgcctgggcgcttctccgggagagaccagcgtgagtacgcagaaatgtcagactggagtagatcgacaaagttctacgcggaaaaaatggatttgtgtccactcagctggctccagggccctttgaacagttaatgcgacttcgaggtgacctggttcgaaaagcagagagcgacggcggaggcaagcgacctattgggaagaaacagaggaaagaaggtgttaaaggggagaaattcgtcgaaaaagccccgggaacccagcgacaagcggtgtcaccctcattttttccagggctgacggcggctgcatgcaggcgtctgcagaggaaaaggagagctggaacaagcgaggtgttctctcgaaaggacgcaaagatcagcctcaaaacacagaccgcagcgaccgaacggtgccaaagatttgaaaaacacaggaaactcgagggtggaagatgaacttcgcagaaaaaaaaggggtagatatctcaaattccaacacgcttgtcgagctgctggcttcgacttgtacgaacaaaaagtgtgtccctcacaaagggcttgtgtgctagccgagttgcgtggattcttctatcttttttctaggaccttttatgcactcatagacgcagatacacccaaaacgaatggattgttggtgattatgtcactcctggtcaatctaagatttccttccgagattcgagctttgaagacccgaatgctcagtcgtcgacagtgcatgactcgacgcgcagtggatcagtaattgtttgcgtatataatgtgatcgttttgatggtggttggcagtgccgtttctggcctttctaatcactatcgctagtgcttctcctactcttcttgcccaatctcgaccatgttattccgtttgtcctcgctcattctcgacagtgctcttcctgctctcccgtcttctcagtattcctagtcctggtcgtcttgctttttcgagatggcccttctccacaggcaccaccgaggagacatatagacgaaagattgcctaggacaacggcacccccaatgggaaacaccactttcgctggccgtgcacacaagcgccacttggagtcacgttggagtacggactggatgcacgaacatgaagcaagacactgtcgcattcactgcacacaaaatgcccaaagtgaaaatatatatgtaccaatgaatatatatatatatatatgtgtatatatgcagcagtgaagaagaatagaaaacgaatttcgcaagggagggctaccagttgcaccatgagcgacctaaaggagtttggcctgtggcgaaaagcgtccacaggagcctcttgtcgactgtatgtagactgttttcccgctgttttcaattgtcaaagccgcatcaaatcctgaactgttttaaatctcttctcaacgggaggatctgaacaaagtgggtcgaatgaaacgctgacgaaatgtctgtttctcgaagtggtctgcaaacgaatttgttggcaggcgctcggcgttctcgtgagacctggtgaacgatgttgtttctgtgcggaaaccacaactagaagcagatgagtgtcttggtatatcttcgactttttccctccattctgattcacctctgacccaacggaagctggacggatcaaggtatgacgctctctgagcgaagtggacgatgccccacggaacctcgatgtactccaacgaatatatatatatatatatattccaatgaatacgtaaatatatatgtataatccgtgcttatgtgctccagtgaagatagatggaaagtgaacgttgaaaggaaagagcgtcaggtgaacagtgtccggatctacaggcaggcgttctccttcaccgactctacatcagcacaaggctgcgcgaacagttgcgttttctcatggttgcatgcaccgcgtttgggttgaccgccagaccagtccctacgcgaccgaaaagcccgagagaagttcgatttgcttcctcagaagagaagtttaaacgccagaagcaagttgggtccgcgtgtgttgccggcgcttccctccaaggacgttcgagttgagtctcctgcgcaattcgcacagcgctgtgcaaggctccggcaaggctgcagtttttcttgagagcgcctcaggcctcagacaactcttttaccggagcatagaactgcttgctgtttcattttccgttgtttgcttctccaggaaagagaaccaggcacccaggcggccgctggcgccgtcgagctgggggtttaagctgcacgaaaaaggacggactccgtaaaacgccgcgggactgtctttggtttgatcacgcttacacttgttttgttgggcctgtcgcatgacacagcacttttttttcgtctgaaggctttcctagcgactcatgggtggaatcctgcaagggtatccgtgctaagctttccgtccgttccgcggctgaaatctgtccagtttttcggtgaaacaagccacagaaagactggagagcttcgtcgtcttcagtttacaggcacctctgctgagaaggcaaacgcgcactcgcgtaccgccctcgatcttgttttctgaagagaagtttcccgttgccgctcggctgaaacttgcaaacaacctcccatgttcctcgcgtcgctgcataaatttcgtcaccatcgatgttcctttgcttctcctccggtcgctactcaccaaatctgatcctccaccgttcgttcaaccacaagaagccccgcgaccgttttctttaagtctgca

SEQ ID NO: 3150 - DNA, 4336 bp, Toxoplasma gondii
gtctcttcgacggcgtctcctttgttgccgagtccaggtccgaaagaggcgttgctctgccggcctgccaccgcttctgaagttccgcgagcggaggctcagggtctaggtttgcttcccagtccggtcgccaatggcggaggccgaggagtacccgcgggcatttcctctggaggcgactcgcgtctgtcgttttcttcgagtcagagccagcctttgctgcagattcttcgccgaggccctcaagcggcggggcagacggcactgagaacggaggcaggtaagagcgcctctgttggggtcgcgtccgcagactcacacgagaggagtggattctccgccgcgcagccagcggctcagcagcacgcaacgcagcatgtgaagcagcttttaggcttgaagacaggcgcgtcttctggagggccttggcaggcgatgccgcagtccaggcttcctgacgggatcgcaccgaccgtacctttgggtggacagggtggaaaccgcgtcggcgcggcgcactgtacgagggacgaaccagacaaggttcctcagaacaacgtctcgcagaacgcaaacatcacttcgctcatcaagcagttgatgactcgagacactccacagttgcagcgtgctacggaagaaaccgcggctcagtctctcgtgcactcgcagccacaccgaacaccggtagaaagcttgcatgtcagtcagacgccgagggtggacgtcgcacccgctcctcaacacaattctgaaacctcaaccgatcccgcgacgaaaacgttcgcctcgagaattcttgtcgagtcgcgagcgccgagcgcgtcgccagtcacgccagtcaccgctggcccgaccggcggagcatcgcctgccatggcgcaacaaggtcgaaatttgctcgagttgctgaagggacgggagcttttgcaagcaaatctgccacggagttcgcgagacaatcgagaggaacagacagcaggcggatgcgcgcgtagcgaaagccacagaaatctgtgtttggacgatgatgacgatgaagaagttttgctgcgcacaagtgtgctgccgcgtcgtcccgccgtttcgggagtacgcagacccggcgtagggaacggcgcggaaacgagtggttcgcgcagtgcagcgaaatccgaaactggcggtcgaaacagtgcggtttccacggggaaagaacgcggttctgctggtcggggagcaaatgacttccgcggatcgcagagacgctaaagagttgcggaccgcaactgcccacagaagtctgttgatagtttggagatgcgcgggaccggcttgctcgggatctggcgagttccaggctgcagaggtccacaggaaagaacttttgtcctgtcaagcagtggatgtgccatttcaaggagctggagctgaaagggtggaggggaacgagcgaaacaagagggagagggaagtgccgcgtgttggaagcgtttgtgacgatttcagtatccggaaacgtagaatttctcaagatggaatatgcgttcccagtgcgggtcagattacactcttctgtctccaatttttaagctgcatgtgcgtgatttgagggaacagaccctgtatttcgcatttcactttgtgtgtgttgaaatccacctttccccaagaagaaaagtatcggcgatgactggcgttgctgcaaccacagacagctaatcttggtttgattcctgccttttctctggtagtacctgacacgcagagcattacatgtctagacgagtcactgcttcagaacgtactccttttttgcacgggctgttttggtgcgacagaaaaacacagtcggtttgaagtcggaacaactcgacggtgaatctgtgggtcggcttccgcattcttgtgtatttcaactcgcgtgggtcgaggattttcagggaattagggcagcatatcataatctcttcctggagatttcctacgttccgtgaggactgtacaactggagttttcgtttgggaaatgccacgcggttgtctgttttacttccatcagcgaagaaccctccatgattcagtcacacgtcgcgatgccggcacggacctgttagctgcccatctgctatgatgctagtttcaccgtgcaaataagggaggtaaagtggtgtcttgtctgcatggcttcgccacgttaacatcagctgcgggagtcgccagtccacaaacgggagcattcagctgtggatcgctcccgtgggtggcttaaaaaagcaatttgtgtagttctcgaacaagagaaagatgccagattatctaccttcccttgtatcaatgatacacacttgaacacatgtaccctgccgatgtagcctctgtcgtcgtccctggttcccatgaagcgccccagataccttttggacacgacacagcatgtcaacaaccgtcgaccagagcagatgccaacgctcaccatatgtagtgtattgtggggactgctgtttcgttttatgacagatatcccttgacgacaaaatgccgagacaccgagagttgtcacgaatgctgagtgtttgtgagggggctgagccaacaagatgtaccacaaggaatcattttgttcggaacgatggttcaccatctgctgtactacgtgagctggcttacggatgtccggtgacactttctctcccagccgcctttcgaatggtgtgaatgtgtgcactgggactctaacgttgatggccatggattcagtgttcgcgcctatgtggcgcttatttgcgattcggccttccagcgtcaacctcagattcgagttctgcatacccgaatctcagattgccattcttcaacacttcatgactcagagtgcatccgtagatggtttatcacttggatgaacttcttcccaattcaggatgcactctgtagacctcactgccgcttcaccataacgaatcattcgactaatcaaaaaaactacgtgcacgtgtcaatgtatcatggcgacaaaacaggaaaaactcgtgcgatcgaagccgtgcagtacggtgcctcgccaaagcgctacacaagcaactgaagtttctatctgcgaaccgttttagatcggttggtccagactatcagaactaatcttgattaattttgccaaagaacacgaggttgaactgtgggatagtgtcagtgcccacgatagagcaccgggttggatacccagggaattgtgcattcattgattagaatcatagttcaatatcttacgcatgcagtaccaatcagaccacagctgaatctatacgccgtcttccacactgtaaaaagtggaacatcgctaggctgttattcagtcactcaccaacactttggtagagacaccccgatgcagagcctgatgacggttgcgagtgcgacattaaggaaatgccgcttcacaggcgagatctaacccttcatgttatcacttccctgaaaacgtacaaatctctcacactagaaccatagaaaaaaatcaaagcagaaagaaactggtcctctgaaaggcccacggggcgctctgagagcaaccgcgacgaagggggaccgggcgggagtgacagttccttttgaaaacggttggcaaaagcctgcttctcccattaattggtaagcacggaagccgcacatcaactttttcaattgggtgtctaccattaaaaaccagaacatcctttagtttccgcctatcatggtgctttaatacgagacatcaaactagacagctggccgacgagctactcgcgctaggcattgacactttgagaaaagttggtgctatttccaccgtggttctgtttccaagcaaaactattgaaatccaagtgttgaagattttctgtctgagaaaattttgaatcgtgcttctctgtcagatccctgcattcaacgcctgctgtgctaggtcgacacctcgcgctgcgtagcaatgctaggacgctagttgttggtcgcgtttctgttccttgcgaatttgtgtgagtctcgctctgtccgacagagcgcacagaaaaatccccgatttaacagtgttctgcagccacgaatccccagtcgttgagggagactactggaaagaaggcctaccggtgacgagaaacagccttccgtcagtaaggtcactatggagtagacagttgccgactttgtgtgtgatccttgaacaaagggagtttgtagtatcctgtaaaccgagagaaagcgtatgataccttacagagagagtgtgttacccttcaatccgcgaaagtgtgtcttgtcgtttaacccccgatgatgcgtattatcttttgaaccgagagtgcgtattattacaa

SEQ ID NO: 3151 - DNA, 1523 bp, Toxoplasma gondii
gagtagatccggtgttttgggtttgaaaacagcgaacgagagtttttcttatcgtttttttaaaacgctctcgcctgtcgtcagcgacgccgttggtacgcttttttttgagtcgattgtgtcttcggagtggaaagcaaggggaagcaagagggaaacgcgtcgccatcccccccccgtcaccgagacagactgccagccagtgcaccctttccgtgaaggtttttctgcctcttcagacggtccttctgtacgatcaaatgaagcgttctcgtccacacagtcacacggcttccgtgaactcatgtatctttttgaggaactcgacaaccggagtgctccacatcgcgaaagggccgcggatgtgttgagtcacaatgaagttaagaagagtgccagttcctctccgtatcgcgggttttcatcccgttggactgtttcgtcgaatggagtaaaacagtgccacaaggagtcttgtgttgcgtgaatgctgcagtggttgaaggtttctcgaaaaaggcttcgacgcaatccagtcccgctagcactgcggtcccgcctttctctcggaaagcatgcgggagcggagaaacgcagaattctacttcgtttgcgagttcactcttcaattcagtctgcagagagtttcgccgctcctcctgcgctccacggtgtgtctcggtgtttgccactgccgactcgcaacgcagcgttcgagacagtgcgcggttgaaggcagtttctcggttcctttcttttggctcgtttcaacgagagagacagggagttccacaccgagcgagagaggagcgctgacaaatggaaaaaacctctttccgcgggagagctatggaagtcgagaaagtccactgctctacggaacttgtctctcagctagccctctcgctgtgcgagactcgccgtggtcgagcgtcctgcacagaggagagacgcggcgctcttgcagcgagaaacgtacgaagttcgccaggccgcggaaaaaaacgtttggagagccgcgaagcgtttttccaattagaaaaagtgcgttttgtgcctggcgcccctgttgagcctgaagacgaaatcgtgtgaggaggaggcggtgccggaagaatagcaaaatctgcgggggaaaaagagaaaaaccactgaagggaaaagagaaacactgctgagaaaggggaaaggcatttctcaaatgtgcaaagggtgccgtcacaagtctcaacaacgagtccttttttgcatgcaccgccaaccaggcactttttcctctcgggtcttgtcgcttgttcagctctagcgttctttcgagttgaagaagactgaagcttctgtcgagactttgttttctgcatgcgtggaggagaagaaagacctgagagaaaaatccagaggcgggcaaagagcgagaacgggaggccacagctggtacctcccatgtctccaagaaggtgtgtgccgtttcagcggttgtgcgcccagagagggagatttgttcttccttttcgtctctcaga

SEQ ID NO: 3152 - DNA, 2405 bp, Toxoplasma gondii
cactcgactgatctgaagaagacacctcagcggcggttcctgagggtccgtcgtgacatgagagctgacccatcttgccaaacagcagcaagccatcaaagtagtggtgctgccgtccacgagattaagacaactgccgcaccaaaccacaacactctaaatacagtagcaatgccaaaggaaaggcaaacaacggcaacacaggtggtccgttctcccaccggcgaatgtgcagcagaagcgcacaaatccacccggatgacgggaagacgaaatggaggggtgactataccaagaatggagatcagcggtacatacacgttgctgcatttgaaaaaaaagggagaacgcttgaaaaacaggggagtttcaccatagaagatgcacgagatgacggaatcggcacaggacaaatagacactctcgcagtgtatgtacacctcacaatacgcctgttttgctgacgctagctccacaaacagccgccgccggcactgtcagccctctagagtcacttaagagggacgtggaaattgatacagaatcccgatgcttttgctcataatgggagacataaaacagggcacccaatgacggaaaaaagtagggggtagtggcatgtaatgacaaagtccggaaaaaaaacgacagttcaagggttgcaactccgatccttcctcataaaaaggggtgcaggtttttcaaatatgatcgaggaaaacaacagatgtaacggtgggaaacaagaccaggtgagcgtcgactacacgaactcgccgatttcctaattttttgtaaccgcgtccgcgaagaaggggaatggttcggaacaggtaggaaaggtggttagaaacgattatcagagcacccgtaaagaagtggagaagacaaaacaaagactatagcagagaaataagagaagacgaatacgacggagctaaagaatcaagaaaaaacagtctgaatgccttgctctcctggccttgattgaggcaccgctacattcgtggtcccgcacggagcgctccgggaaaccggacgcagcaggtcgaattccatccctgacttagaaataggaaacccttcgtcttccaaagtaaaggcatggagactctggaattttacaggcgaaatgaacagcggtccctgttatcctgaaccgtcgcacgagatgcgagacgccggacggtgaccccacccctcgggaagtcccgtagaaaaagcggcatcaaacgagggagctactgcaaacgaagttcctatggctagcaggaaagtaaacggaagagtaaaagatggcagagagaagcaaaagtcaccaaaagatcacgtgccgtccgcatcactgagaggttgtcgcgccccccaactgagcacgagcacgtcagccgcccagtcaggcgagatctggaagccgatggaagggaaacaggtagcggaacaggcctgaactaagaacgataagaacgccagacagtgcatctttctgcttttcttccaccttcgtgaaagttcattccgactcctagccaaagtcgtcgctttcctggaaaacctaagcatataagatcgactacagacggacctgccttgccgcgcctgcttcagactcgacgcgttctcttgctgcttgcaaatgtgcgagaaacgtgttccggctgaggagaaacaccgagacaggctggagaaaaaaaacacagaggtccagaacaagaagattgttcggactgagaagcagaaatctaccaggtcaccccgtttcggatttgcagtctctcctcattttcagcgaacccggacacaatacgctgctcgagtgagcgtcaagagcgtcagccgtttctccctgtgctgtccgcggaagtcttctcccaagcatgcacggagaaatccagcgcctgatgacgggggcaacagtgaaaaaaggcgaactggtgtaagagagggggcggactccaggactaaatattctcgaaacaaggaacagtatctcggtagaagccgtcacgaaggaggatttgagcatcggagccagacactccttgcctaaagtggaagggaaatcaggccttgcagtgtgcagtcgcagtgttcccaaattcaactcattctttcccggattttgcctgttaggatctcgttgtttgctttctgtgcactcgctgtcagcatcttccctccctttcctgctgccaccaaacactcgccactctgcatcctccctgtctcgttcctgcctccgtctctgtcgttacggcgacagtcgtttctcattttgagcgaaaatctccgattccacccctttcttttcgttgttttgtcgttcgtttccaaattctcaagggtccgctgactgttttaacgctaccgcttttgcgtgtttccttcgtcttttccccccatca

SEQ ID NO: 3153 - DNA, 1501 bp, Toxoplasma gondii
gactgtcagagcgacttcccggaattcttgaggctccatcgccctctcgtcgcgccgcaccgtggtcgttcgcgctttgctccctcgggacaattctgcacggcgacaagctgcgtttttctgaaggcttcgatgcgatttctttttctccacacaccttcgcatccgattccctcacatcgtcacgtccgggagatctctccgcgtctcgagctcccttctgcttcttcttcttcgacggagttttgtcgaaccgcaacccggccagcattgtggcgaaagcgtagcgtcgagggctaacgtcgcaatgtgtcagaaggcgctgtgaaaaactacgcaaatgcttaggtgtttccaagtctgcagaggaaaactgttagacgtctcgaccggcgagggattcatgcgatgcaagtgccgcaggagagaggcagtgcgtcaggcggcgacggacatccagaaagagcatggctcggcaacaccgtgtccctgccctcttcacttgccatttcaggactggacaaggaaaaggaagcaatggtggtaaactggaaaactcgcgacgcaaactcggtcggtttacactaaaccttgtaccggcgcttgagcagcaggtcacaagtaaggagcgccagggctcaggagctgcaagtacggtcgggaagacggcgaagttgcaaacaaccggcaatcctacatgcggttaaagatgttcagacgagcttgcctcaccttcggtgaagaaacgcagcaaacctgggttcctggcggtttcggtccgtctgtgagacgcaccgcgttgaaagaaagacaaacaaattccatccaggcgcggcacgcgccggtttcactgaaagaaggtgacaagaaacgacacgacttggtctttttctacggaataacaagggaacttctgaaggcttgtcaatactacggagaagcgcgtttttgcatgcatgcatgcatcgctgagtcgctctcacggagaaagtctgaccgggaatcaatcttgaaaacgtctaacaggggagcgtatcttgctgaaaatcagaatgaagtttcgtttaaatgtccgtgtgagaacatctatagtagcgtcaaggaacaccaaaaggacagttccttttttcctcagctgcatttgccagaagtaacggggagtaacgaaataccactgtgcatgaacgggtactactaagagcgaacgtccgttgtaaacgcagcgggagcgcggtaaaaatcgtactttccagggcggtgttttccaccaaacagatttctctcttctctgtttccccattctttccgtcttctgtctcgtggcgtcatcacttttgtttgcgcccttctgtgtgggcagcggaacgcagcaactgaatatagtccttgcaagatacccaacgtttacgttgcaaaacaaaggtgtttgtcaccccagtttgccaaggagatcaaggcaagattttcctttacagtccgtctacgttttcgcgttcttata

SEQ ID NO: 3154 - DNA, 1243 bp, Toxoplasma gondii
atgaagagaaggaacaggaagaggaccaagactggaagagacgaaaccgagaaggaaacgggtgacgcgaggagcgggaagcgcgcgcaggtcgcttcaggcctctccccgaagccgtcaggtgtacattcttctgagggaaggcgaggccttgactggaataagatcggcgctggctgacatgccgagggtggacgcctgaggctggcaaagcaaacccaacgcgggtctgctggagaaggcagagagcaggaagagaactcacacgaggggcgcggacgacgccgaaacagaggaaaaggctgatctggaaaacgggtggaggacgaactggtagaacgcttcgacaaagcgcgggccggcgaagagatgcagctacatgttgacagtgtgccttgcggttcagatgagagagagtcagagcacgctgcaatggggacagctgtcgcagttgaagaagaggacgaagatggagaagaggaaaactcagatgacgagaaagttgcaggtgagaaaacacatgagcagacagcgcgagttcccgctacccgcgaaagaaaccgcttgcctgctgccattgcatgcgagaagccaaaagaaaagctacgttccctacggtgcatgcgttttgacaaactcctcagattcaaagtcacgagcggccacagccctgagtttgtacacctgctgaacaaccgagcaggcgctgttcgagacctttgctcgcagtggatacggaaaacgactgcggatggcagaaaacggtggtggggattcacaatggaagtcaaatgcgcttgatgtggctaagaacaaaggtcctggcggacaggatctgagaccctactgtagtgtcagacaccacaggacacgcgcaagtcgagcggttccggttggagtgagagggtcttctttgcaacatctggaacatgaaaagcgacgaaacgaggagatccagggaacagaccgacggaaaactgttattccaggttattggctagacacgaaaccgcttctctgcaagccaggctctcctgtcaggagcagcgcactggaaaagaacgccatatcgcgagacggccgaacagcttttcacggcccgatttgtggcggtggaatcggaagcaagtggagaacccagaatctcgggaacgcagaaaactaccgcctggagaaattggcccagaaactcgctcgaagaatcagctcgtgcagacgttcctgcgttttcaggaatcggcga

SEQ ID NO: 3155 - DNA, 2862 bp, Toxoplasma gondii
tcgttctggatttcgatttgacccttgacgatcttggtggcgatgccgagcgcctggaagaaggaggtgctgccagggtccatgcccgtcggacccgcggggatgaagacgtcgataggcgcgaagacaccctggcgtgcgggggccgggaccttgttttccgcgacgattctgcggacttctgcggggtcttcgatgcagaagatgaagccgacgttcagccggacgagaggcaggagcttttccagctgcggcatctcgctcatcttctgcttgagcgcagttcgaatcatcgtgttcttccccatgagcaccacggccttgccgcgcagagccagacggatgtcggccatctgcttgctgccgacgtggtctgcctcgacgacgaggacgcgcgggtacttctcgaggagcgcgaacagacgcgagaagtacgtcttgcgcttgtcagactttcccttgggacccgccatggtgacaacgaaaagggagagaaaagggagcagaaaggtgctggaacggagggcaaaaaagccgtggaacgagcaggaaaacgcagagacaccgaggggaagctgtggagactgtcagtgcgacgaggcctgccaatcactttaacctgcacgcaaaaaacaagaagagagagcgatgaagcctttcgacgtgaaacgagaagtggtgagcggaaaggatgacgcgcggccatccgcaaagaacacataggcacacacggattcccggtgtcgttagaaacacagagaaacctctcctcctcggtgggggggagaaacgaacgaggtcttcaaccgatacgacaggacaaccagcgttctcctctccaaaacttcacttttttgtcagactcctgtgttcagcgaggagatagagaatgccaaaaactcagcaacaggcgactcccattcgaccctgaagaaaccgcctggaaagactcggagtgcctcgcataaagagaggctccacagagtacacctcctctctactccgtttttctttcgcttcttcccgctgcagaatgaagtcgatgaacacatacagcgaagacgagggaaagacttaagaggcgtggtgtcagctgcgcgaggcagcaaagagaggagcgtctctactgagaaacgcgctatctcgatttttacttcattgaagcgttgaagacgtgagcaataccacagaccaccagctaccagtgacttcgaacgaagtcccagacggctgaaggtagattcttctcccggacgagctgtgtctgtctcctcgggaggctatcatgtacgcgggaggcgcagccgcaaggaaacaacgcgctgtcactgcagcttcagaagtgggtttccagcgattaatacgaaggaaaaggactaaagacctctgaacttggctggagatgagacagtctgtgtctgctggtaaggatgtctcttctctcgcggcgctcgactcttccccacagccgaggcgccgcgcgcggaaccgggagggtgtgatgtgcacaaaagcagagtttccctccttttctgccctgaaagaagaaccagagaaagccagacttaccacaagcttcgaggaattcaacacccggaaaacaaaccagaaataatggataaaagacgcgggaacactcgcagggtcgacccgctgagtacatgcgcgtactctgtacatacatacacccgagaaaacatgcactgctccctcacgcggtgaggcgcccccgggttttctacacccgtccggctcctcaatctccgactataagccgatccaaatacagagcggtatttttcttgggtgccgtgaatgcatgtagaatgctaaagcctacagtgtgagacgctctgtacgttgtcgcctcctcctatttctcgaaaaacggcctgtggagaggggcgagcagaaaccccgggagagctggaagcgaaaaacggagtctcagcgtcgattccccgcagtttctgcctttctggtacccggaactcgggtgtacatacacctgaagactcgctgttccgcacattgtgttctggcgtcgtgaacgcagctggggcagcttttcttgtgcttcgttctcgcttttcgaggactttttttcacgaactggcgaagccctttttcgcggcttcgcggaggggacgaaatgcgtgtctccgcgtcgttctttccgtggtgagaggagcgtgacggcggcaaagagtgaagaagactgcgcgagagccgacggagacagggaggggaggatctttcagatgtctcagtttttttcccgtcctccggtgcctgcccccagagcgagaaccgcgttctctggcgcatgcatgacaaaaccaatagtttttccacgttgctggtctctcttctttcctgtcattgcgcgttcgtcttttctccgtgctttcttcctggtactgcgcgttcgcttcggctactaaatcagtttcttcggtcggtcgcctctctcgttgtcctcgctcctgcctcgtcgagtctttcgtcttcagagttctgtcttctctcttcgtaaagattgtcgtcttttcccttctttttgtgccagtttccctctgctttctgcctcttcgtctctcgccgcctctcttgctgcagcaccctcttgtgtgcccatctcttcggagcgtagctcttttcgccgtcttcgatctctgctgatccacccattcgtcctttctgtctcttccgtctcctcgaccttcctctcttcgcctcctgtgccgccttccttttctgtccctgttctccgcccaactgtctcacatcgccgcctcgcggctgtttcgtccgcctcgtccgtggcttgtcgtttcgtagtcttgtcgccatccaccagca

SEQ ID NO: 3156 - DNA, 2476 bp, Toxoplasma gondii
gtacattctgaccgtgcttcacgccgttcatctgggtgcagagaaaaagtcactacggaggcggcgaccgatgtgaagcagtttctcatcattgacgccgttgccttcttcggtgtggaattgccagtgcctctctgtcgtgacgcattatgccaaacactctcaatgtaaatctagcaccatcggaaatatcaggcgccgccaacatccgtcctcgtactgccaaagggacaaccacgatttcctttttcctcgtatcagtgaactcttctggtgtgatcctaagtatgcagtcagataaatatatacaaggaacttgacaagcattactcgatttatctaaacgacaaagatacatcatgagcaaggcaggcgacacctcagcagctctgttcccacgttcgaagatctctgctgacagtgcgattgcagtgtagcgcattcgacgttgtattccggtgcacacagaatcatgaacaatattaacaagaattgcgtgctcttgtgctaagtagcttattcgtggagaaagttgaaacctgaaacggggtgggaaaaacataaaggcactgctccaaatggtgcatctgcgtacagtggccacgaagctttattttctgagacgagtcgtttcttcacctacaccattacggtctcttgcttgcgccttatccacgcgcatttttccgtacacgtacagatctacaaagttaaccgtgaaggtatttagagcattgtgctaccttgctgttagcgtacttggagcggagagtgactgcttcagaactaccgactacctcaagtccgtttcatgtaaagctgaagagccatgatcagtctgatgtgatcaagatacacggtcctgttcccctctgcatgctcattcatgttctttctggtgggtaactgccctgccaatttcccggtgtggggtcatagggttctgtcagacgaaagattgaggcttgtatctcgtcgtctctgaaacggattgttttgttttgtctgtgtacacagatcaagcgtcgaactgtgtccttgttgaaggcttgtgaggcaaagggaaaagacgggcccctctctgtcttgcactactcgggaatgctccgcgaaatatcgaagcccctatgtggcgtatgcttcctgagggtttgttcgtccgatcattcctggggcatacatggcatgacattagcgacatattcaacctacagtcgagaggttctaatcgcggacagtccagtttttcacatctgtcggaagagagattgctatttctgttgtctagcgtgtgttccacgacccgcgagtctctgtcattcgcctcaaaggcaaacatcttggaaaatgcttccgagtgccttacaaatttcttgcgggcctcaatattgcaaaagaaagttccgatcccaggaaataactggcgccactccagcgtcattcctcgatccgctttcgggttttccaaggtcagtgcgatgccccgtgcgctccctgggtgcgtgctagcggttttcacaccggcgctagcgcgagaccgaactctcgcgcagcggcctctcgaacccgtttcttgaccagagtaaattgcaaattttaaaggcgggaaaagttggtcagtgacaagtgcaaaaggacgattttcggtgtctgtacagaaacgctgctgtgcttgcgtcgttaacgtgaagaagggctgatgtctcatacctccttggatactcgtgtctgcgctcgcgccatcatttactgcacccagcagtgcaccgagacaaactcgaaggacttcgggactggtgttcttcacagacccacactcgaaagttcaagacgacgaccagctgaagaatttctcgtcttttttgagagtagggtggaagttcctgtgtggcggaatacagctcaaatgaatcaatcgactgtgcaggcctgctgctggcgaccgtctgtgtttcgacaaggtcacggctggccagccggtttgacaacattggttggagggatgcacggtttttcatcatgacgttgaaacgcttgatgtctgcgcataaaaaacacgagccttgagtgagattcaaggctctgttgccccgttcgtgacaagctgcccctgtggaacgataatcgagtccgtccttcggattccgcgctgaatcgagagctatcgacagcgcaggaaactgacaagaatcgcggcaacataccgcacggctcaaaattccgtttttgattagtactcaaatttcgttcaagcgctactgcgtgttcacccgcattccggttgtcaaataccgtgtcagttatgggtagcgcaacagctgcgcccgagtcgcgttccataggttaattcgtcctgtgccggccaaccaccctgcatctatcgtttaatctgtttcgtaccgtcacatcgtgttacgctcacttcctgcgtatcgtcaacggaacgcatccctctacacgtagccgcgtccaacca

SEQ ID NO: 3157 - DNA, 3283 bp, Toxoplasma gondii
agaagagttttccagcgttcagctcgacttcagaagggtcttcttcactccttcggcgttaaacgtcgagtagaaggtgcagcgcagggtggcagttcagagtttgacattcggaacgacagcgctggtttttttgactggagggagtctccgacgttgtgtttgtcaactcgacccgcacaacggagtcgcaagaagcaatctccctttgcagtgaaaactccccaaaaatgctagaaaggcttgctcgtgttagtcaacagtaaagagataagtgaactttctgtgagcagaggaccgatctgaggacggaatcgcgaattcgcaacagcgaaagatccacgcgggagacgattcgcggcttctctctcttacctgcacgggtccggcactccgaacaagagttttttccagcaaccagtccccagagaagacggttgaaatggtttccagaatctcttctttcaggaacccccatgggaccgatccgagtcacgtttgcgttcgagacttgtgcgtccgtttgtggcattccacgtttggtggcgggtctgccgagtctggacgcaccctgccgtcgcgagagatgcggaacggattcttctgcagcaggagtaactgtcttcgccgcggtctgttaccgggctcgtcttcgcttcatcgagaagtggagctccacggtcctgttgccacacgcgtcagggcgtcttcgctagagtgtcgcaacaaagctgggggctggcacaacttccgaacgcccaggagagaatggcactggagacaggccgcatcccccgaagaaacggcgaccaaggccggctcgttggactgcgaaggatcctttaaaagacgcgtcgaacccacccaagagtcgctgaaagatccagcgaacatttctacaaccagcatttcaagctgtccaaataccatgaaattcccttcagtctgtacggagtagacgccgatgtaaaaaaccagtcttgagaacacgcccgtcgtcacggaaaaaaacatcacgatttagatcggttgatacagaatgtcagcctggtcgtaaagtaggcgagggccaacaggtcagatggaattgcgagacctagtcctcagaggctgttcccgcttctgaagtcgactcattcctcggttcgtttccaagcagagcatggaaaacacaaaggaacctgggtcaaatccagcagaaaagtccatctcgcactttcaaggtccccgatctacgtcttccatctgacttctataacggataggaggcaactaaaggcggggtatctgtgtgcctgagggttgagaagaaatggaaaggaaagacgcgtgcagagactgggggatccggtgagggacttggtcacggtataatttccttgccggttttcatcttagtcacgtttcttgccgggcgattcctcggccaccaaacgtacacctctctaatctgaatgccgtcgctctatctatctgtacacgctcattccacgcgcacctattatatttgtatacatgcatgttattgaaggtctgtttatacctgcaagtacacacttcagatgtgtgtgtcgctgcttccttgaaatcgagtgttcttcagacacacagtaccaaacaagacagagtaacagcccttgtgatttccaggaacgcagcaatgtttcgacgctgacatagacactcttgcggggtgtgtgggttcgcgaaaccttgccgcacccttctctctgtgggttaggtcatctctgccgtctacactgagttccccacgcgtatcaatgggagctctaccagacgcgaatccagagaaagaaggctacgagctcagctggaaagcaactttaccgtggtttattcttgcttgttttcgctgccactacgaggaaactggatgtcgagcgttctttgactgtgggttttgtggcgtacgtgtgtctctatgcgccgctcgacttctcccccttccccccctgcgtttcctttgtttgaacagctgctgttctacaaacattatagggacacctgagtcgcggttcctccacagacagatgcggtgggcgcctctcgattgtggctccttcttcttcaacagaggaaaggtacccggcgccgttcgttcctgctgagtgtacatgcacatctccaggtgcatgaagcacttttcctctgctggaacacttctgcctttgtcagtttctcttcctcctcttgggctgcctccgccgttcgcctcgctcttcgcggcgaatgctgctctctcgcggtctggactgacctggtgctcactgtggagtcgaaggactcagggaacggcgtttttcgaggtgtgttccttttttgacggaatatcttgcgtctagtcggacacaacgctcgcgcgcgcacagcatgtgtttactcccagcacacccatcgtgttctcgtgctgttttctctatatgggtccattcgacgcggagacataggagagtcaaacgcgattctgaaagcgacgcaagcgtcgacatccagcggcagtcctcgtgttggtgttggggattctcagcacggtttttgaagacgcgtctttccccctttttcctcttgtctcaccgcaagactgaaatggggacttctccgccgcgctggtccacggcggaaacgacgctttcaaaaaggcgaagagtgaaccgcggcggatttttctgcactgagttctggaacctaaaggcgtcaccgggtagaagctggtggattttctgaccaactgtttcctcgttcctctcacgcgcgtcccgtctgtctaggcgtctcgctccatatttgcccggacgctcgggcaggaacgcgtgtttttgaatttctctcatttctcagagacggcctaaacgccctcacctcgtcactagacgcgagcaggctctgtggtttgcaggtatcttcctgctttggtgcgtcttatttttttggggtgtcggtgtctcgttccggaatgtcgagaaaagatgtccgggtgtttctgagcccccaaaacgcggacactggtgtgtattgttgaacagcgcgtcttcggttacaggcgtttgcagaaaagccgcgaaaagactcggactctttcgctgtctctcgcgtgcctggcgaggaggtttttgagtttttctgtctcagaactcaggctgcagtttgcgtttttcctcctagctgtctcgcgcgcgctgcggtttccccaccggaccgtcatcagaattagagaactcgactttctcgacttttgcgacgcgtgcatcctgcgctctctcga

SEQ ID NO: 3158 - DNA, 2026 bp, Toxoplasma gondii
agggaatcttcaattccgcctttgatttactcagaaaggtgaagaacattgagatggacagggaacgcaaagcccagcggcgcaagcagcgaagagcaaacgagaggggagaagcagactcagacgaatcaaatatggagaatgacgcaaagagcagtcaatcaggagaagacgaagaaggtaattctgacgcaggctccaaggaagatggaagtggcaacacttccgatgaggaaggtggcgaagatgggcgaggaaacgattctgatgaatagcagggaaacgtgcatctgcaacagacttagtcattgagtgagcactgcggttttctttagtgggagaattttagatgaaagacgatgttttagtcgggtcagtcggtctgtgttccccaatgactttcgccaacctcttctatgatccgctttcttttaaatttaacggacagattttttactgatggcgcacacatagtggtgtccagagccctgccgttcttggtattcgcgaatctccgggaggtagtgctattccacaagcatgcatcttttatggtagattagttactatcttgtaacttactaccggattggttctatgcttatactaaactgcatctggtaatgtatgctacagttcgccacgcagacggaaaaaaatagtaacaaatagacaggcaaacacctcagcgtcgaaacaattcatacaagccggcaaaaattttcatgtgtccgcagcagctctggcatgagatggtaacatcacgcttcgacaatcatgctccatttgccaatctatccatcgtctatctaagatctcctgccaccgtgaggttactgacagtgatcgccgtacacatgagcgatttcttagtcaatgtcgcgatatacgtcttggaaagacgttaactatttcgtaggcattccctctgtttagcaccgatcactacgccagcggggtagtaaatacaaagaagcttaatcgaatgtgattgcggatgaatcgcttctatatttctttgttcgtatcgactttcctaatgcatctatgcctgaagtcgtgcgttaccatcttcgggcggcagcagcatatcgatggcacagattagtacgacacaagtgtgcatcgttttctcctgcctgagcgtcatcacctcagtttcgggttaacagatctcggttcccgacgcgaatctgcatactttcctcagttttgatggtagcaggatggcgttctaccgccacttcacgcgtagccccctaactcaggctggtgacttccgtgagcaggccagtcgtgaaaaaatcttgttcccagaagttttgctttgtacgtaaaagtgaatagtctccacgctttcgctggtccaggatgcgaccaacacgagagtaggttccacaccgcgtcatttcaagacggccgggtagaagtgttgaccattttaaaaaacgacttcccccgtctcttcaccttcaaagaaacagaaaacttcatgagattatcgttatgtggactctcggtgtggacagccggcttgatcctcgtcgttgggttgctgcttctacaaaaagcagctttgtgtgcagcagctacgcagaagcggggcgcatgcagtagagggcaagcagggcttcgactcctgtaactattcgcatgattttcgcacgtcagccgagaaaacgcaaggtcaagacatcactgtggactcatgccaagccgcaaacacaattactgaagtgaagaaggcatatttgaatgcgtacgggaattggcaacgtgcgccctgtactagggaagggtctttggccgtcgtccatcttcttgaggacggtgcagaatgtgtctgtcttgtttcacacagtcgcgttgtgaagaacttctaaaataatgcgtatatgctagggtaaagatctgttcctccatctgaaaggaggattcgttaactgccgcctaccttgtgcctgtgctcctcaatgccgctgtgccaaccactttctttacgattctgaaagcatctcaaacacga

SEQ ID NO: 3159 - DNA, 1859 bp, Toxoplasma gondii
gaggtttcgagagtcggtcgcctccgacatttcgtcgttcctctcttggcggaggttcgcgcggacgaggaagggcgtcagaactcggctgagcaaaatcaacaagagatgaaggagagaaaggaccaagaatgacgtcagagtgcctcgtttttccgatgaaaatcgtttgccacatgaaacttcacttgttcatacagctgtgctgcggcaactgcactcacagtcaaaaactctccaagatcgctctgtcaccgtcaacttactgtggagtggctgaggcgaccattttcttgcattttattccagcaagaaaacgctttctctctatctgttgggtcgcccacggaagaagcgctcgttccgtttctgaaaatagggaaaaaagccctagaattccttcactcattgaacagcctctggtgaagagcctcgcgaacacgaaacctcttgtcgccttcgttcttgggcgaaaggaatggtggtcctgcttttagcaagttgtctgcatgcagttctcgattgttcagcctccgaaaaagcctttggggtgtacagacagcaggaatgagcctcagttggagctgttttttcttcgcactgagcctgcatctctttcgccgcgggtcttcttctaccgcatctagcgctttctccgtttctgtgcacttttccttttctcttcaatgaagtcgaaatactccacacgctaagtctccagatttcctctgtttaccgagaactggctggtccatttctccaaggagactgggtgtccgagaacatcgggtctcttcaccgaagacgaaaatctcaaacttgttgactaccgctctctcgctgcgacgacgcgttctgcgtcgttctgctttcctcaccaacttctgccgcacgcaaaacaagacggatagttgtgaccacaacatcttactcaaaaatgcacactgcaacgcgctacaaaatgtatgcgtgtctgtgtctacacctagcatgtatagtggataaaactgtactttcgaagtcagaaaatatctatcaatctatatatatatatatatacgtatttatatatcgttcatatgtgtgtgtcgcagcgaatcggttcacttgtgcgtcttgaatctgctgtggccgcgcgccaatttgtaagttccccctctgcaactcccgatacaaaaatctctgcagaggggttgatgtttgtgtcaacgtagtttgagttcgagacaattttccaatttttttagcagagtgtcaactttgagggtggaacggcgatacgagggtgacttttccccgagtttcctgcgtttcacgctgagggcttgtgtctgcttgtgcgcccggcggctcttcttcgcctctcttgccgcgcgcatgcagtgcgtctgctcctctctcaggtctcgccgtttcttgctgcccatctgaacggtttcctttttttctggatgttctccgaagcgaaccgggtcgcactcgactcgagcgaaatccgcaacacgaaggcagcagagacgtttttcttttccccgttccaccctgacgctgcatgcaccctgtgcgtggtgttcgaacctcacgccgtttcggttccgcgcttcttcgtttttcctctcgctttccctgttctttctgttctgccgctcgcagctgtcaagcgccgtcttgcgcctttcctcgcggagaccaaggcgctgactcctctctgcagcaggcgcgaaagctctccggcgtcgctgctccgcgttcgcctgcgagtccccgtcgagcgcgccgtttctctggaggccccgcagcttctttgtctccgtagcttccggtccgcgtcgtcgcacagtcttcagtcgcgcggaaaa

SEQ ID NO: 3160 - DNA, 3809 bp, Toxoplasma gondii
ttttatgagacttctctctgtgctgccgcctcgatggaggaggacaacactttttttctccggcggaactgcggttcatccacgcagagacaccggctcttgggcggacgttgttttcgccgttttcgctggtttcccattcatttgtcgacaatgtgtttcgaccgcattcaccgataccatttgtgcatggagcaaagcgactaggcgcctccgcgtctccagagaaccttgtgtgtagtgatcgtgaacacagaggttcggtttccagctgtccgacatctgttgggtgactgacttcatgctgtgcaataatgcattcagcgacatagtgttggttcgctggtaacatctaagtccttcattgtggcggaaaatattcatatcgcgtcggcatgacacgtccagaacaaggtgcatacatgcagactgacacagaagaattttgcagatcgattccttgtcgacacacggcaggcactgcatacctcgagacgatggcactgagaagcgcctcttgggatcacggaaaagtcctagtggagatagaccgtctgcagactgtggtgttcccttcatgctacgcagacctgcgtcacaacgcttcaggaatactgttggcctgagtcgaagaccgtcactgtactggatatagagaggctgagcaaattatttgcgtgcataacagcctgacgatggtttattgcagtatatctgcggtcgctggtcagcccgacatttgtataggaaagtcctttatcaggctggaacgcttttcctgttttcgtcatccgtgaccggaccgggcagctgaacagggagtgaaagaattttatggcagattatccttcagatctacctaccttgtccacactgtcatgaaagccgacgtcgtcagcattttactagttcatatccgatcgcttggtagctgagggtttgaaatgtgtgcatttagactatacaacacagtttgccgtgttcgtccactctcaatactggaaacggatagtggtcggatttcatgtgtcattcgtacttgtaacacatcggaataaaatttagtcgattcatgctccaggacattatcggagctcttcaaaggggctggcccacacgctgcctcagccccacatgtggaagacgttcatttttcgagtatttcgttgaggcggaaagcgagtcccgcccacaccgcttgtcgaaaagaggcctgccggagttgtcatcgctatcgaggaactccgatatcgttgttatccgcccttattctcttcaccccactcaacacagctggagaggaggcaaaaatggaccttgcatcgaaagaaaaagcccttgaaaagcaaacgacacggcacgacgccattcgcgtagagaacattagaaaggagagacactatgcaaaggagtggctcaaacggtggggtttcctgactcaaggagagcagcgagaggatgctctacaggcattctgcaaaggtgaggaacaatttgcttcggtgttattcggaagcgtccccgcacgccaacagaggctcacctatcaaggatagaacttcctgaaaacacaagttcgaatgctcgaacatattctaccaacgtgtcatgcgttcatctccactgaatatcatgaacagttttataaaatcccgaccgaaatgtttgccggcgctactgactccatggtgagaataatttggcctgcacgcagtttacattgctccagaaaaacacggttttctttcactgactgtgagacatgtctatttgtgagcctcgtacaacctgctgcgtaattggggtacagaggggggacctgtggtgtgttcagaatcagtgtggcggttgtgtgcagtcgcgttcatccttgccgagtttcttgctcggattgtgggttatctcagagaccgtgtggggtacggtttggatgcgctttcgtttcaggacgttcttatgaggaaacaaagcgccagctttctgtaagtgtgggatctcttcagtcgcgtaaccgcttctggtcagcctaggggtggtcaatatcagatgtatgataccgcaaagaaggggatcttttgatgcacaataagagtcaattgttgactagaaagtgaaaattgcaaatgcactttgttttcgatgcggcagattgcatctattgatggcctgaagcttatgcccttgcaaaaagcaaaatcatctacgcgagatttgcactcgagtgattgctgtgcctcatcattcagaaaatcatgaaagacggagtcatgtacgacgcagagaagtgctttcacgatcccaatcagtggtaccgagatgtgaaagacataggaccacagaataaataccttcatccagcgacggcaagccaagaagtcggctggaggtaagccatgacctgcccgcgaaatgtacggggggaacggagacacgggtttagtacaattttgtatgcgtgaaacgcgaggaattaccctgtataggcatatccataacctgccttgaaatgcccagttcactagctggcagcctcccgccttttccctgtcgtactggatctcaggaccaatgaatcactcgagaagtttggtgtgaatcactacggttacaaaaagaagacggctgatattcagccggcaagactcaagaacgcacagccaaatgcatcgggattgtgacactgacatcctaatagtccaacagtgtgtaatatatccgttgcagcagtttagagtgactctcccgagtctgcggtgatccggtatgtttgttcgtttgaatcgtcgtttgtacgttacatcgtttgagggtagtcagtcgccggtgtttatatcgcagaattctacaggacagtgccattgacacagcaacgcgtccgtggtcaaattttgaacaaagttcgttttagaagttgtattgtttgaacttcctgtatgagctgccatggacagtccatatggggagtcttcatcatccgctttcgttcgctccactggcaacgaagctccaaacgaacagtgccgcgacgaatggacacgtgaaatcagatcccgcagcaacacagaaactcagcagcgtccttgggaataattgtttggtgcctccggctctgagaatacggattagtccatgacactagcaaaacaaattggatgaataccaccgttgtcttgtagactgcagcaggaatcaacctaaaggcagaaagctggaattcctaggtaaacatagtatttcagtcgatacggagaacttcaaaaaatgcgcgtctgttcgggtgcatgcgtgatcaactacagtcattcgcatcgccctttgtcccatgctgcacgtgggtatttatgtggcgatcgtaacctttgttaaagcggaaagcatattgatcgcaaccatttgtccatatgacacctctcctagtcgtgttgcatcatgtgaaatagaacaagtattcatttgagttcgcgtgtgttcaagctcatccgtgacgttcagtttccagcggctgtgccgcagagcagctcaggggaaaaacggcgggtttttacccaaggttgaatactgcgcaaacgcaccacttcatagaacggctttctcaacggcatgcgtgttagcctaagtaaaacggtgtcagagtattcaaagggtgtctagtttcgtgatgctcagaagtatgatgagtcggactaactctatcgcggaggtttctgacatagtgtacgagtaactaaatagatgaaacctgcgcttttggtcttgtcacgagagtgacgaagtgcgattccgccacaagccaatcaatgctgacacaa

SEQ ID NO: 3161 - DNA, 2770 bp, Toxoplasma gondii
ttgtcgtcacggcgcagacagtttgtgtgtggccattgtcggaaataccagatgtgtcaaaaccatgtgaccatgtgatctaccggatctactccatgtctcatggtaaactgcccgtcatgtcgcgcgctttacctgcagggactgtcaccacggcctctccacaggagggagttgaagcaaaggaagagcccccggcagccacaggtgtcccctctgccccctcatcaccagctagaagacgtgccttcttccgttcccgaggttagttttcagccttctatcttcagttgtgaagtacttttcttcgaaacataccgcagcgaagtgactcaaaaaggtaacacacccaaaactgcggacggcaggaatctcttgcaagccagaggtttccgcttaccaaggaatacgagactttctggtcactttagttttcatgtaagcgagtgcgctcttccatggtgatatgcgtcttccgcaacagcggggtggtggaagaagcacgctgctcatgaggggggcggggaaaaggcaccagacgaacacgaagcatttgccgtgtttgatgcctgtcatgttccttttcagggacaaggacgattactgtgaacgtgaggcacttctttcctaacggtgtgccaatcgtcgttgtacgccctcagcggcgtagttttctcttgaggcggttctgaaggatcccaataaaatgacacgtatttacgagtcggctattctgaatgcctaagtcaacaagaaggtgcagcaagaacctagaagagacgaacttcagttggaggggcaacatttttttccaccttcctcgtcccgccccggtgaaaaccagccttcagcagtgagctgccacgtcctgtgctgcagcgaaagcaaacgtaactgttgccgccaagcaatgtttttttttctcctgagtaatgcgtgttcatttctactgccccatcgtgctcattcacacaactcgaacactttgtgtgcccatttacaatcggcttcattttcttttaacttggacgacaggaacagacacagcatttcgacacgaagcgtgcctggctgcggctgccctcactgttgttcgcagtgggactacgaaaataaacagatttgcaacactcccatatgtcatgtcacatctttttggctcgatcgtctctccctcatctctccccgcatgtaggtgctttcgctaatagcatcagtgttttcgtgatagtgcagcttacttttcacttgttagcttcttcccaactgcctccaggaacgtgctaaatgtgagaaaggaaactgacataatagttttggaagacttgcggtctcacaagaactcaccttacgtgagcgtgtcagtatcttgaaatttcgccatcattggaaaattcgacacgacttccctgcggagctaactattccagagtcaggccgtagaggcgattaattcgcgattcgccatcaccaaatacgttggggtattacgtcgacaacaaacgagactgatccatctgatatgctggcaaatgctgctctattctaacccaaagcggatagtcagagacagcccatcaaatttccacaattttctgcagcgttggccgtatccgatgtgaagccgcaagccgggctgccataatgtcaactgaccaatttgcggcaaaaatagagaggtcagaggcgacagaatctctgttacaggatctggagccacagtgggatggttttttcctatcatcggaatgagagcttgtaatctgcatatcaaggtcactcaactctcgctttcttgcgacccgcaccgtgcgccaaaagccggcggtgggctgcgcattttcaggttttgttacaaagtcaatctccttatcattctcaggaaaccaacagagaggggtgacaacgttttaagaaaggggcccgtgctttgccatagtctggtccgggtcaagcccgaagcgtccgggctgagctcggtgtcgcctgtagacattctccgtggccggcctctgtgcagtggagacggttccttttgtttcaacctgttacgaatatttttgcttggtgatttccaaaaacagagtgtgacgtggtgtgcggcttgtgtctccgactcggccagatgggttccattagaagtctctgtgacggaacgcgtacgagactgtttcgttggaatcgttcctcgagtgcgagcagtccgatgttacggctcccacgaggcaacagaggggccaggcctccaactgttgccgtcccgacccaccaccccgtcctgctgatataaacgcgggaaaatgacgcattcacctatctacgtgtgagtcgcttagacaaaaagtggcctgcagcacaaagaacaaacggtgagtcgctttgctgtttcccactttcgtgctccactgggagtggtatgacgggttctgccccgtagcaatcgttcagtttcagcgctcccggcgtcagtgcctttctttcggaaaactttcttcacatcctgctgtccaaccactttgaagttctgcccagagagtgtcgaactatggggctgcggcggaatctttagccactgcgtggcgactccgctgttttcctcgcggtgagtgattgtatggtggagcttcgtaactcgtgaattcttgcgttcttcatttgttgtttccaacgcgctccactctgcaccttaccttcatgctcagcttttcctcttcgccttccatccgcttcttccttctgcgttagaaccggtgggcgccagaagctaaaa

SEQ ID NO: 3162 - DNA, 1668 bp, Toxoplasma gondii
attccatacgacagtctttatgatgagttacagaaagcggcgtacctgcactgtctcgatggctacggtagggacctcgcttatgaggattcgccgcaatgcattaggaatcgcggcatctacacccttcagctcaaagacgactcgttctggagagaccgacaggaacttcaaagaagttctctcacagaatttgtcaatcgagaacacatcgtcaacgtatgaagaactcaagaaggcacccgcgtatccaccgctgttggtgtgccgagggccctcagctgcacaaacaagacggttactatgcaacgggatagaggcggaaggtcgcccctcgtgccctggcagtgacatttaggattcgaggaagaaaacaagcgcctttgagcagcacacaacctcgcagcgagaagcttcaatcatccctttacacccggtgtcgatcgacgcgtgtcgggcatgactggcaaatggtatcaagagtgaaagaagatgatgggcatactgtgaatcacgctctaatgagtccagaattgatgcttagtaagaaccctgtcagtaacaccgcacattgaccacaacgaaacgagtggtacgctgcactgctgaggtcgcagtgactgaaagagtaagttttagacaacggcaagactggacaactttgcatgacggcgaaacttccagcttggcgggccaacctcaacaacagcaagctcttgcgcgcgaccgctgtccagatgtagccgggagtagggagggaagcactgacgaggaagaattgaaaacaacccgtcggtaacggggaaaagaattgaatgagtttgagaagtcttcagtctgatacaaattcgagcgtgctgaaaaagctcgttcccttgtctatctctttgctacgtaaccccacacaaaagtgctggggtgcatgcaaattcgcttatcgaggcatggagaatagttgcaacgtagagaagccggttccaacacaggatgcgcgcatgcgggaccacggccctacatcggaggtatccacgctctcgccttccgatgtttttgcgggtttgtgtaggtgatgcggacagggttccagttgagcatgtaaagtgtggttgagcctatttttatcaccacttttctgccgattcttggcattctctggttcaggcgcccacaccttcagcaacctccttattcacagtaaggcactccccagcatgagtcgttttaattttgtgggggctgttgttcgaatgttcagggtgacgctttcttcgatgttatcgagaaacttgtttgttttaagaagctgcgtttgtcgggggtgctttgcggtcgatagctgatgtgaaactgcaacaggcgtccgatgccctgctctgcgggtgggaccggtcgtcgttcattctctggcgcgccggcgggacagcgatcgcatgaaagccgttggttttgtctcggagagggacccaccatattaacgtataacagatgtagtaggctgcttttctttggagcgtggtggagaagcggcacaaacgtcccttgaaaacaggacggacgagagcgtggtgcttctgggaggcgataaacggtaattagttctcgccgtctataataaatggagaaaccatttctgttcaactctattcgtatgtgaatgttatttccaga

SEQ ID NO: 3163 - DNA, 5016 bp, Toxoplasma gondii
gacgaagtctcatggaaagatggtgaggctagagacctggagaatttggcatctggacacatacaagatctgtttgaagtactacaaactcgactttatacagactacagcatgtaagtgaattagcataatgaaacaaatggatcattgaggtttgcattttacagaagcatgctacacgagccttacgcctagcccaccgggaacttcctccccgcccagctttagctctggccaagtagctgtaaaaccaatatctgtggatgtaaaaactgcgactccttatatgaatatacgagtcacatgaatatgctggcattcaaaaaagtaaaaagtaatcagcaggtcgatatcctggtcagaatggcaaaaaacaaaacggtgaaatctgaaatctccacgtactcacaggtgttttgacgcacacaaaacactggtcttatagcaacgccggaactaccaaacgtctgaaagctctgtatagtgcacgtgggtagtaaaccgatttgtggttcgttccaaagcaagaacttttctgtagctacagcgacacgcatccctatgaaaagcttcatggaacacgtgaacccgctttagataaacacgttggcacatgaaaaccacaatacggagcaccgcatgcatacgcgcacacaatgaaccggcttcgcgtgagagcggtagccgactacggttttagttcgtgttaggctactgcgatatcgtacaattcggagtattttgtagtcaacaagcctcagtaagcattggacgcggcaaagctccatggcatatacaacggttaccctaaacgggcatcacaccctcttgcagcggtccctgtacactcactgattgaaagacaagcgacggaatgccacctggaaacagagccgtacagctgattctagtccaggtccgtttaaccgcacaaccaaggaccaacagaagaccacagactacttgcaccggattctgtcttcactggagtgtggttgctcgttcagaaaaatggatacctacgaaggtttcctatacgcctcgggaactcactcaattcacacacgtgaacctcccatcacgatgacgtcgatcagttgcatgcggtgggctggattcatcgcgtgtagcggcgttggtcgcgagcggaggtttgagctagttgcttgtttacccagcagcgccagtcgtagcttgattacctcggcgcatgggatttgcatgcgatgaaaaaacgaacgctggcaaaaaaggcagaccagcattaagtctagtacaacaaacagcaagccccgaggcagacaaggcggcggtaatgaacagacgatcctcccaacacttcagccccaattgttcgacagtagataccatgccactccgcatctatatgcatattttcgcagggacgaaaacgccgaggcgaaaatacacacaaaattccactctttaaattccgatgcaacagtcgtgccgccgatcgacagagaggccgtcttgcccttgtcacatggaaaacagaatcttcccgtccaaaaaagcgcgtgtgctctcttttctgtgcgatacatcctctcattcaacctgtattttttttccaatgcgagggtgttcccttgtgcgacaccgagcggtgctcatcacagccgtatcggggtgcgcgttatgcgcaccggtggataggaccatcggacagctaaggaaaccagcggcctgccttccctactgggttttccgcagcccacgaatcgcagagtggtgcggtgaggagacgcggtgtcctaaaacacagtctaccacggattagtcacgacggtcttacgcgatgtgtgcagatggtaagggttgaacgctgggtagcggaattgataccatgctccatttgatacagagtctgtggcgaactagcggaggtgtctgataggcatggcagatagcgtggaaacggatgttcactgacgatgttgcggcgagcatacggtgttactaagttgcagggtgctgtgtcagcgggcgttgaaatagtgaattcaagagttttcattaaaacatggcatggaagagcgaccggaggtcgacagttcgtcagggggcaaatttctaaagcgggaaaaaaagtggcggcatttctccatgaactcttagtcctcccgtttttgtcgttcgttgaacgagcaacacgaaggtgacccgcatcattttaggggttcactatcacgtggcgttttgctggaacgggcaccagcgagcgtgttctggctgtcgaagtcggatgcccgtcgacattgtactagagagtgtgcaagcgtgacgaatagtggcgtctcgccattgtatccgggcagcacacggggctttgttccgaggtgccacttgattcggttaagattcttcgtgtatgcatgttgtgtacggagctggaatatatttaaagtatttttccctgactcacccgcctgcacatacatgtgcctcggaaaagtgtattctacgagttgaggacgctgtcggaaacgatttttggcgtagaatggactcagcgactgataatggggaggaacattcgcatcgctgaatatcgttgtattatctagaaacgcacaggcacggcacacaaaagtgtttgggtatggcgactcattacgactcgctgcacaaagaaggtattcgaaaatatggatacccgttacgactccgttgatcatctgatcgagagcagacaacttcgacatttctaacacgacgcggtgttggtgtcttggtggcccgaagtacttctgaacgagccatcagcggtgccttccaatctgatgtattttctcgctcgtttttctacttgaaccgattcactgacccgccatatccgtcgtgtcatgtgagaaagagggtgccaaatttgcgggtggtgtcgaagtgatgtagtcgggtaacgtgagtgtgaattgcccctgtttcatagacacacggcgttgtaatgcagcaacattgtttggcgcaatgttgtggctccccttaagtctgcgccctatcaagaaagggagaggctagttacagattttgacactgtcaagcctcagctctaaactccacgacggtctttgggttttctcgctaggtgcagtatcggtaccacgtctctaacaagctggttgtatacaaaggcgttgcagatttaagtggtcctcgcgggagaatgataaaccacaaatggagactcgaaaagggtcatgccttgtcaccaaatcagtggtttctaatcgcgagccaaatgttctgatacgggagagtcaatagcttaatatgagccgggggaggccttcaatatcttctcaatgttgtcctcatgctcatgacaaaattgtagaataacaacccaaatgtttgcaaggacaacggcaaaccttggatcgatcgagtgggtaattgacactgactcggaagcgttgtctaaacggaggagaggcaatgaagggacgcacccagtctatttggtagggaaggaagaacgcttgacaacaaacgactgacggagcacacaacttacatgcatcatcaatgtcgactgattttgccgtgctgcaggggcacgctgctcgggtgaatcgcaatggagcatccccctaaagacatgagcggaaataatccttcacttagtagtaatacatgcaaccgctaagctcttgtgagccgccctcttattcaacgaagtacatgcttggcaattcctttttttaacacaactggtcagaacacacagcaagcacgcgctgcttactcactgcgcttagggcagcagaactaccggcgactgcatcgcattgtccattttgacttgtccgtttgttgttttaccaggaagacgaaatgacagacgattatccaagattgcttctcctgcctctcggcctctgctgctcactttgtggatgtggaccgcaggaactcccgctaaaggacatgtgcttcttgacaagccgcgtcgtgtctcgctttttgctcgcatgcgctcagtggctcggaccacgcctttaacctgttacggcttggcactttgagagccccacacacctctttctattaataatacggtctccatcagctttcgccattccccttcctttgtaatgaataccttgtcctttgcttccgctaatactctgtcgggaaagtccatgaagatacaacggttagcggtcgcaagtgaggcggtttcgaagagagagactcgttaaacggccgaaagcaacagtaaactttgtctggaaacggttgaaagcttggagctgtgttattgactctgtcagtagccgtatttttgtgcagggactgaaggcgtgcagcttttatgacaattagattcgaaacaagaggcgtaggaaagattgttgtgaaggcaaaacgggcctctctccgtctgcattcaccagtccacgaatatcccttatgtggcctacaatttctatcttgttgaggttatgtactacattggtgccctgcctgtccgtcacagcccatcggtgttccgaccttacagtctggtatcgttcgtatggcgcctttcagctccatgaaagccaacccatgtccatctatgttgtacttaggatccaccagtgttgagtttgcgtgctgctgtctgctgctcgctgtgcatccgcgtatctccatttattttctcgcttctacgtcggccggcctgcacgtcgcctgcgttttctgcgagccacgctgcatcagtgccctgggaaactgttcttccgaactccgtcggatggtttggcatatatgggtccttttgttattcgtccctctctgatttccgaaagagaccgggggatagcaaccatgatgtcgcgcgttcctttccactctcctctctttgtccttcttcaggcgctcatcgaagccagaaaaccctcgtagatgcctcatattgctcgcgtccttttcgttcctttgtagagagtggacgtggtctgtgcctttaattcagactgtcttctcgacaaaaggcattca

SEQ ID NO: 3164 - DNA, 2796 bp, Toxoplasma gondii
tggaaaaagtcgtcgatctctgcggcgacttccacgcctgtcggacccgctccaacgacaacgaagtgaagaagtttcttcttctcttcctcggagacgccggggacagaagctgtctcgatgacgtcgaacagcgcgcttcgcaggcgtcttgcgtcctccaactccttgacgaaaaacgcgttttccttcactccagggactccaaaagtgttcacatcggcacccgcggcgaccacgaggtagtcgtagctctcctcccattcgcgcgcgtcctgcgccttcccgtgagtcgactgacagcgaactttcttctctgtagggcagatctccgcgacgcggccttcgtagaaacttccgcagggcactccgccgcgaaccagcaactccctcacacccgtcatgcatgcactcgcaggcaaagtccccacacagacggacggcagcagcggtgtgaaggtgaagtagtcgcgcggagagatgacgacaggctcgtagcgagtcatgtccaggtccgcgaggaaggagacagctgcccagcctgaccccacaaccaccaccttctgtctcctcgcaggcgcctcgcgagcagccggagacgcagacgcgaccgcagaggcggcgaccgccgcgggagagaggaggcctgttcggaggcgaaagctggtccacttggtggacatccaggtggagacaggggagaaggcggagaacggacgcgggggctgagccagcagagcagacacgcgctctttcggagacgaaggagacgacggagacgctggagagtcgcagcgcgccggcaggctaagcataggcacagaggcccccgccagcagccgcagccactgccctgccatggtgtgcggggatccagagatctcttcagcagagaagagagagagcgaaaaacggggagagaagcgagaaaagagagaaaagaagaacgagacaggcgcgcgacgagatgggcgagtgcgtgagggcagacgaggagaggattgacggagtcgttcggagaagaaagccgcaacgaaccggtgggagggagagttcgagaagggaggtgggtaggagggaagagggactttccggcgagtcggcaaaaagaagcgactccaggaaactgagtcctttgacttcttcctggatacgtttggccaacaaagaaatgaaaaaattgaaggaaaggaaacgactctctgttcttgtcgcgctgccggaacctcgcgccttctgccacgacgggtgttctgtcttccctcctctctccagttcagaggaaaagagacatccgcagggaagcgaaaggcgaaaggcgaaagacgagagaaaaccacaagagaaatgaagacaaacagaagaaaagagccccccttgtgtaagcatatacctacaccagcgcgcgcgcgtatatatacgcggtgcggcaccacccggcctccttcttccggcgcgagccgtcttgttcgctcgctcttccttcgcctggctgccttcttctcgccctccctctttctgtacacttgagtggagaaaactggggggaagtagaggaaatcgaggaaagaaaaatctctctgcagtggcgtctcacgttgcggaccgcgcaagcaaagcagcgcgttgccgcgcgcgatttgtcagatgccgcacagcacccagatggaccagaaggtggagtcttctttcgtggagaaggagattgaataggactttcctcgagcaagaccaggctttttgaagtgtgtctgacagtggaaaatgctacagcgagagcgcaaaggcagtcgatccttctgcctttcttcctggccctgcgcggcgcgagagaggttgcggcgtctgccttccgagcaagaaaacagcgcgcgacagggcaggtgtgtgtctgctagcgcgtctgtagagaggggcagagaggagggagaaaagcgcgtttttccttcgggatgccttgcgtttcgcctgcaccagcgaatggttcggagaccgagtgtgcattgttctacccatttcgcctgaaaggagagaaaaagctgaacgagtctcctgtcggagaaaacgtccgcgccccccaggacgagagacggactctcgcaggtgctgcctccgccctggtctctgaaaacgcagaacgtaggcgctacacacgcatctgccgggcctgcctctgccatctctctctccttctctctccttctctctccttctctcggctcgcaagcgttcgaggaagaaccctgcaagaggagagagacagcctcccccgagaggcgtctgcgtcgatttctttccagggagacagtcgacgaagaagtttctctgccagttgtgtgcagaagaactgcgcaaggctgggtgaagatgtcttgggactctccgtcgtgcgctgtcctcccttctccttcttccttttttctcggtcatcgcgcctgttctctctgttcgtagggagcttggtctgttttctctcttgacctcgaatcgctcgacgtctctcttcttcggcgcggtgtgtgaagcgtacgcaacgaccagagagcctctggtgtgtcttgcttttagcctgcttctcttctctcttctcgccgcgttctctccagctctttcctctgcgattcttctccgctcgcgcgccgccctcaaaccgccgtcaagttctcgcagtctgcgtctccgtccgcctctcctctctcttcgcgttcctctcccctccatcctccatacgtctctgctctcgcttctcttcttctcccctctcttcttctcccctctcttcttctcctggcgcca

SEQ ID NO: 3165 - DNA, 1859 bp, Toxoplasma gondii
cgcttcgagtcaggatgggagaaagcgttcggtgttttctttcgcgagagcgcgagacggcacttgctgccgagcactctggtctctctgtcagcttctgcgcctccagggcgacgccacgcgtccacgagcgagagaggctcgctcgaatagaaccgcaaaggaagaaagagcaaaaaccgggggaggaaaagccagcaggccccgccgtgctgagaggccgagaaaaggtctccggtgttaggtggagaactggggaatcggacgcagaaggaaatgaagagcgctgtcaaaggagaaggaagcagttgagaaatcgggacattcagcaacgcagaggaaggcgagaaagaagactagggcgaagcggacggtagacgagaaggttcaagagtggcgggagactgggagagactggagggcgactggagatgcaacgagtcgagaaacgaagccatcagagcgaaggatgaacgaggaccggagagaagaagaggaaccaggggacggcagtcagaggctctcaagcgccttttgacttttgtgcgctaatttcctcaacggcttgcgcagaacgcatcgaggtctcggctctcgcgtgactttgcccaccctctcttctatctggcagcccgcaggacggcgagagaaagcggagggaagagacctccctcagactcagccgagaagcctagcggcgcagagcggcaaatcgtggagacagaacctgagagttccaagtgtcacagcgctcccagcggagccagggtggctcagcgagcgaggccagggacgcagcgaggaggagagcagacagggaaggaaagaagacggacgcgagggagaagacgctcgttcaggtgtgttgccagctgacggaatgaagcgctttggggcgctgtgaaggcagaagacaccggcgttggtcggcgagtgtctcgttctctcttttctcgctcttcgtccaggtgtgagacatctttgcaccgacgactcagctacctgcgtatctccagccggttccaaggcctctcggtctctgcgcgtcttctgcccaagctcacattgtcgcagagaaaagaagcgcaaaagagagtgaacagaagttttcctcggttctcttaactcttcgagaaatagaaaagaaccgcgcccgccgaacaaaagcgaacgctgcatcgctttccacgcgcgcgcgtgcaaacgagcaaaatcgcgctgatacagttcggtcccgttcggcttatatagcggaagaagtatagggccaccatacttcggtgagagcgcgggagacagcgagaacggcaccgcgagaagagcaaagagacaaggaaaagaaggcctcgcgcctgcgtttttgtggggcagcagtcagcaagttcttctctcgggcgttttttgctttaccgtcaaatttttctcttcgttttctctctgagagaaaccggaaacgtagcagagaacgagcgaagcgtggcctgtcttcctgtgtccatacgccgccgccttcgcgtggatgtagcggagatctcgccggggcagggagagaagaaaacctcacgctttctcttccatttcgacacgcgttttccaagaacgcaaaggcgacgcgtgcctcagtctcaacgtcgtgttcgctctccgaggagcaccgcgtcttgtcggttgttttcccctcacctgtgtttttctcctctctctccctctctgttcgtcgtttgttctccctgttttcccttcttttctcggcctcatctctcgtccttccccgttcgccactcttgcttctcccccccccctgcctctccaccagacttctcgttctgtctcatagtttgcctgtgcctctgccaaga

SEQ ID NO: 3166 - DNA, 1323 bp, Toxoplasma gondii
gtaaggaacagagggacaagctgaggagcggtgaagacgaaactacaacgggagcgaactcaatggagagggaaaagctcctttcctccaacgggttagttcacgtaaagaggggtacacagactcacatacacttgtaacgtctgctgggtatgtggctgtatagacgcgggtgtatcttcgaccagcgaggcactcgtctcacatttcttcgtaaacacatgtatttgcgtgtctgcgaacgcaaagctggagtggggacagcagcgttttcaggtgtcttgtttgcgccgtgagttctacgtgatctattacgttgtattaacgtacacaaatttgcatctcacagcagacgaaacgtctggcctcacgagggctgcagacagttggctgtagtattatggacgtttcttggagcggcacacatgacccaaattgccactgtagaacagctcactgccgctcgctagacaagcatagcttttccatgtttttgcgcatcttcgtgtcaacctttaagcactctccgttcctcgaggtcttcttgtctccgttttttatggttcctctattatgtttccaactctcttttgacctccgcggtcgtctcctacctcctttctctaccctgacacacctcgctcacttcttaatgccgttttttgcagcaggaaattttctgcttcgctgatcccacctcttccgtgtctcctttctctatggacagacagtgcgtgtgtttatctaactgcgcgtgcgtcaagacggggaaaacgttcgcgacgcagtagcgagactgttcagggacagataccacggtttcgcctttgggcttcccgccgcaacctgtaagatattatctgctacaacgctaagctgtgctgaatcggcaacaaataaccctggggagcaatccacctggaaggttccgctggagcttgacttatgcgcgcgcttattattggcatcattgtgggcaacctagctttctgacatgtcccgttgttcctgaaacaccgatgctttgtcgcttaactttcgtaaatcagtgtaagaatcgaccccatgcaatgccttcgctgacaattcgtaactgtgcatcttagttgcctgcgtgtgccaattcttgtgctggctcttctcgtaccacttgggttcttatgcgggatatcgtccagccaagctggaagtcaaactgtacgtcaacacctgatggataggattttgagttgtctgtggttccacttcattccgtggagacgaaactggtgattggagaagggcgcagatttacgacgccaatatagtggctggaaaactgta

SEQ ID NO: 3167 - DNA, 4221 bp, Toxoplasma gondii
gaactttttctccttctctgtcaactcatggtgatcagggaacgctggctctcgggaggcctcggaagcagaggaggcagaagaacagaaagaagaggaagaagcagaggtggaggctgcgctcttcttttctccctttcccgagagatctcgcgcgcctgcctcttttttcgaggctgctcgcttcttctgagacagcttctgaatcgtcgtgtagagcgagacggcgagagacgtggagaccgctgctccattctcctgaagttgctcgcgaaactcgtccagcgaagaagcctcttctcccagatgcacaacgaactcggccaaatcgcggtcgttcactccccagtggttgtggagctctgtggtaatgcgggagatgacgctcaggcgttcaaggacatccatttctcaagcgtgtggtttacgaaaaaggaataaagggaaacgagagtctgacccccagtgacggagaaaacagggtgcgtcgagactcacagacgctcgaatcgtcagattattgaagcaaaacatttactggaatgtcggacggtgagtaggtaggagcagacccagaagggaaaaacgaagcggtaagttccaagttcctgaaagatatcgagtgtaacttttgaagaaacggcttccgaactgccaagaaccggtggtaccaagacgttaatcgctgcgttcagcgatggactctgtcggcaaagggaagaagccgagaaccaacggagagtccggaaacctgcgtagaaaaaacaccgagttcaccgtctacgggggacagcgaaaacatgcgtctcaacgatcgaagcggaaagggtgcgtactgttggagtctttacagtcaaaaagaaaagaccggggagaaaccggaaacctgagacaggagcaaagacgagacgctcggcgtcaacgtctcaccggggagtctgccatggtcttctgtttacagaggaaagcgacgagatggctttctttgttacggtggacaagggaaaatcgaacatgagaaaaaacggtcgtcgaattaaaaggtttttccttctaatttcaacaaaaacacggaaaatcgacgcgggaaacgcccgtgtcgactgcatgcagtctaatgaatgacggagacttcgacgaatatctgatggcgtctagcctgaagaagactgctgaaacgacatacataaaacacaggctggtcgtacagttcgtctctaagaaataaccggccatgtggcgttgtgttcattcagcaaaaagctcctggaaaaacggagacggaaaagtcggcacgcgccacggcggtgaagaagtcgcaaaagccacccgagaaaaagagaaagacgaaaacgcaggaatccgtggcgcctaaaagcagaaacactttcaagtagaatgctgcatactctgaattgaaaccctctgaagtcgacaagctcgaacttcttcccgtctgcgatgagcaccgtcagctaagcaggcgctttggggcagaacggacaaaacgaagacacccgttgagacagaagcgcgtgaagagttcaagtgaaaaacgagacagctgaagaacggagacgtgcgaggaaaccgaaggcgaaacttcataaacatccctcgttcaaagagagaaactgtcgacaccgagcgcatgcgtccgtctttcaagaaaacccccgaaaggcgggcgttctgtgtgtcgcacggtcggtcgagagtgacccacagctaagctccaagaggaaaggacgtcttgaaattctgttctgctcgtctttaggatgacttacaaaagaattactgtctgaagccactgactgccgtaaatagagggaagtctataaagggcaggtagcaacgtatacctgtcagccggtagcgttcttccgtcgacaagcacgatttcccgttctgagtactgtcagcgtatttttttgtttcctcggggctttcagaaagaaaaggatcagtcggaaagaacccacaaacggaacggtcaatcgtaggagtagcccgcatgtagctgccccgctccaaggaagactccacacagcatcgcagatctctgatgtcggcttcctttgagcacttcgtttccatttgtttcccttcaaaagagcaaaggtgcagtgaagccactaagtatcgcaagatgatctgaattctccggtggtgcgagcagggcaaccgtagagctcgacgccgggcaaatatccagttgacagtagcgctagcgttgctagtaaagtggggttttaggcgctgaaaaaaggcctgctgacttcgattatttcgatgaaaagaattacattttcgcccgtctcctccgtttttcctgaggaggatggagaaagcacaggattgctggtttagatcgtgagtgtctgcgtctacaggatactctacccctggagcgctgtgtggtttcaggagagtcgacggttaccttccagagataaaatcgatgaacctactgttttgctacttgacgatatgctcccaagatctactttaactttcactgctctgaaaagattcctgctgctctgtgttggtgtttcttccggcaagccagagaccctttattttgcagcaagagctcaaaaaacgagtcggactcggaaacgaaaagtaaatgaattgtgtagacgagtgtgtcctgcaggataccaaacgtacagactcgctactttcttctttctgctccatgtccaattgaagaaaaaatagcatagtaggaagcgcagtgtgttccacgccactacgggcagtagacagggtgcagcccgttacttcactattgcccgtcctgtttatccagagcagaatcgatcgacaagacggcatcgcaatccagaaaaaagcgagaaaaaccacgaaacacagcgagacggcacaactggccgcagcagggcagcagacctagaaaacgcatgcacaagagcgaccaggtgcgacaacatgtctacttgcagtctacttagttgtatatcacgcctcttctgagctcctttaatgggaaaggacaaggcgactccaacgcgtgactccggctgtcgacgcccaaagtgcgacacacaggaaaacaacaagaatccctccacccttttttgactcccctaggaatatcaagtctgtcatgaacattctgactggatcttgctggcatttgttcgcaagggcgcagcccgactctgcggcaagaatactcaaatggtcacagtgcggcttcttcgtaccgcatacaatgatgacggctgtaagctctctccgtgttgaacatggcagaatggcaccagaagcgagaagttggatggcaagagacacgcaacagaaagaacatcagtgagcaggaaagagcatcggcaacgtagccgcgcgaagttcgcagataatcactgcacgaatgaacgacaggcagtaaacctagcggagatgagctttcatctagcgctgttcgatcgccgccgacggtctcatctcaagtggcgctttctcatcgctatagccgctctcacaaaagcaagatctaggacgctgggaaaaagtcgtaggaagctgtccgtaggtagatcactttccgtcgttgctagcggtgtctacgcatcatggcggtcacgttcattcagacgatcgagagacgcaaagctgggccgcgatatgtatttcgccagcgagctgagtgattgtgtctgcgtcttgaaatgttcatagttgatagaaacgtgcatcacgcctggtaaagctgagaatacgaagcgacgaagagggtgtcgccctccccacatgctacgcgagccgagctgtcttgcgcagatccagacaggcgcgttgagttcacagtcacgtccacgtttgacacaaggttgtttcacatttcatttctcgcaagagccgcaactggttctgcgagcgtgtcatcttgactcaatcttcgacttagacatgctttctttgtgcgggggggccctccaacggcggcaccgcggtctatcgcaataaaatcagctagctgtttcgccgccttccagcggaaggccgcgtgactcttgaccaatttcttttcagcaaaaaagattttttgcctacccttgcatagatgtttagcaacttctgccgtcgcggtgacagcttttttagcggcgtactctccggaagttgcctggcgcccaacgcggtctttgctcagtgtacccccgctgtctcgttcttcgcttagga

SEQ ID NO: 3168 - DNA, 1803 bp, Toxoplasma gondii
tccagagtttgacatgtctttaacggaatctgcgcctgctttgaaggtatctctttctgctcccgctctttgctcggagctgcatgagctcttgtgctctcgggccttggctgcatcgcacgcacagttcttttctcgaggagactcgaaagcggcctgcggacctgaagtcctcgacgcctcctcttcgccccgacacgcgcccaggcctcgctgcctggtgcacgattgacccatggtggaggcggccagacgagagacagaatgctgtgaaaagggagatatgcgacgacgaacgtctggagagaaagcggcagaagcgacggagccgcgagcacagctgcaccggagaagtgcggatccagactcgcggtttcagtctgagaaaacagacatcggcgagcagttcccaaggtgctgagcaggactccagatccttgatgcccgcggctgtcgatcagcgagacggcaagaaggactcaaagagacaaaaatccgaaaggaagaaaaggcgaaacgtctctttcaacctgcaaagacaccaggaaagatcttcccgtgtcgttgatcaaaagcgctgcaaggcgtcggatggcgtatacgcaacggaaagaacgaacctcggaatgccttaaaatgacgaagaatcctgccgtaacaataggggggagtatcaaagacggcaacgaaaaaacgtggacggtgtgaagattggtggaaaatctgtccgttgaagtccgagaagcactgaaaggtctccgacacacgaaagcagataaagttgccactgctgccatgaagtgtatggggagaaaccgctacgtgctgctctggtggccaggggaggaacgagaatcagtcgagcattggggcgaggatgaagagacgagaaaagcatagcccgatccaccggctctgaggaaaagtatttccgttgaataaacgtcgagggcatcgaaccgcatgggagcaggaagccagcaagcatgctgcagctctcatgaaacctgttgaactacctgttgaaagctctgtcgctcccagtccacgagaaaccgaagctttcggcgcaaaagagccggcagagcgggagcagagaacgaccgaagagtgggaaagaaaagtcgacgcacaaataatatgaaatagaagctggaggagagacggcaccgatggtccgctggctggtctgcagcagcaacgcctcaatcctcaaggcgaaactttgaaggcgtgatggtgcgtaggcgacgactcacccagcggtctaggcacaccttcttctttgaaggacctgctatctatgcagacaaaaactccagggaaaggtcaacgtttcttactgcggctgtgccacaggtcgggtgctccgcgatctccgctattcggagagaaagcggccaacaaccgcaaaggaaccgtcggaaagcgcaaccctggagagcaacttgcacgccaaagacgtgaaaaactggaaattcgagagagcttgacaaacggccgatgaagtctcgggcgcgcgactcgagagctaccggtatgccacgacggcggccgcgaggcagatcttcaggacgctccgaggcgcacacactttccggcgtgttttcgcgtttcgagacgcagcgggaatccgaagtcacaaaacagttagactacgcttgacgcaaccagggcctgcaaaggggacgagaagcacaaattccgcttgcgctgttaaagcccagttatttcgtttgtcatgggcaaccgacagagaaaaaggatcacgtgggttcctgacatccgttccgcagcaaaaaa

SEQ ID NO: 3169 - DNA, 1993 bp, Toxoplasma gondii
agttcctacaggtagaaactgcctggcgatctgtgaaactaacaggtacccgagagcgatccgacagggtctcttggttggtcatcgccttagcagtgaacgcgtatcaacgaaagacaatataaaagaacgggtcacgtaaagtgtcgagtggagagtcaaagcgtaagcccttttcccgccagtcctttgctgtgcttacaacgcggaattagaacagtgtttcaatttctttgcctagaggttgcttcgttcgatacagttgtaggtgaaaggtatgctaacgacactttcacgaagatgaatttttcacctgtaggcaggagttccgatgttttcgacgtggctgcgttgttgcgtttggcttaccgtttactaattgtttagactaaacagtaggaaatcgtaaaggcgctgctgaagaggtacagctgccggacagaaaggatagactgccgtaaatcccttctgtggatagaaatgattttaaattttgcagtcaaccagccccttttggaatcgtactaatattgcttttgacgcggaaaagccttggctgtaaaataatccagggacgtttcgtcgcttccgtgcagatcttcggttgtgttcgtagtccatgggccttccttggagacttacagaagtaccaaatgactgcgtagattccgtgtgtcaactgtagatcgaatcggtgccaggatactataggctgacccaccgctctgacacgagtttccaacgttctacgactgcgcagctaccgaggaataatgtgagcatgtttgttacattagcagcgtttgcaacatggaagtttacagaagccatctacaacttccaaccaaagcattgcaggcgggctacgcgactgtgtcacaaagaaacatcccgcagaggccctgcgagatcaagtttgtccagctgtcgttatgagatccacacaacgacatacagtgtgggacaggggatatttatctctgacacaacattacttacatgctttttctgaagagtacatgctacgacttgggcttccgcgttgtgagatcatttacatcttgatgtcattttcagcacacggagatctttacagaagtataccatgatacgggaaaagttgtgggtgcacacacacatggagagatggacgatttgaggactagaactgccagaattccccgttccctgtctcttgacatgacagttgcgaacgtgacccgacggcactgcagacgtcgaatacattgtaatacactgcgtattgaatagagagaccccagaaatctgagtgacggctgtgccgaaagtcgttaccaggtgattccgttcgtggatgcacaacaattcccctgttcagcaggcctttgccaatttcggatgaaatcgtgctatcagacgcggaaaagaaaagttccaggctgagaatgagtttttgcttcccttgctgcttctgtgccggttttctgtcacctttcagatcctctagagagacaggcgtgtgatgcgggacagcagaactgtgtgcgagaaggggcaggccggaactacggacgctcagagggaaaacccttttttgccacggtatgccgttttttcttttcgtaaaaacttcccacggacgccaagtcgcggaacacacttttcaaatacggaacaaaggcgacgggctcgagacggtgcaacgggtttcagccgtttttttgcaagcagcccgtgtcactgcaggcgccttcccagatcttggctcgacatggccgccaagccgccaggcgggcgctttttcctgaggtcatcttgccttctctcgtctccttttgcacgagcagatgctataacttttacagacttctgtgtcccacatgcccccctgagaaggtcgaaaccactgtctctctgcttctctgcttattcgctgactgtctgttcgcacccggcgtagaatctgttgagccgccaacccgtccgcagtgtttcactgcctcccttccga

SEQ ID NO: 3170 - DNA, 1963 bp, Toxoplasma gondii
cagtttcatcttgcgagttgtcagccgcatacgcggctttattcatgatactgcacagggctgcgagacccgggacaagccaaccgcaggattctaaattgggatccacatacacgtcgatataaatgtcaagcaacgcgatgcactgcttgacgacctcactccatcgaactggatggcgcgcttgaagttgacgtagacgcaggaactcctgaagtagttttttgtacagtgaatctcctttcaaaagacctgcctcccgcagcttgttgtgaggaattgcactcatgaccgtctgagtccatcacatcacaggaacagcttagtcatgtttttggcacccgcaaggtgatgttgccagctgtcgtcatgctggagtaagaacaggcacaaacgttgccgcatagagttcacagatatattcatgcaaacatatatgcgtacagctgctgtgcggttccgctggctccttacttctggcatgctccgtatctcgtggtctggtatcagtctttctcgttcacgaatcaggtcggagaacagctctccattattctgcactatggcagtaaccatatcactgatccactcagcagtggaaccgttacgttcgcctcctcctgaagaaacccagggtgccgccaccaacctagggccaccgccctgcccacctctccgccccccgcggcgccctctcgagggaagtccatcagccagcatgactgtttcttattcagtcaggttccatttccactagataagctcctgacgagtcttcgattcgccaggattgttgaacagagtctcagattctacggactccgagggtctctgcttgcccgccctgtgcacaggcgtcagcacgtggttctcagagaaaaagttggtaagtggaagtggtggagccaagaaaactcaactcttcttgtttccggagagtttcctggtgtcaattccacggttctggatagtctttgttgtattaaaacacatctagaggactgagacgttgtcggtagttgaattacagacgcttcgttttccagcgtcagcttgcatgcccgtcccctgtttctggaacacaagctttgagaaggaaacgagacagagaacgacgaggagtgaagcaaatcctctgacggatttccattcgataagcaaaagagtgtttctccccatgtttcaagagcgcggacttcttgcctgcccttcgtccgttccgctaggcctctgcctgaacggctgcatgcgttgcgagcaatccgatgttgcgcatgaaacgcaacgcgctgccgtgtcgtttttcgcgagagtgagccatgaaaagctagtatggatcctcaacaaggaaggaaactgcatcgaatgagcctctattctcgaactgaactttctcgtcgctccattccttcgatgacactaccaggaatatgtgtaactcgttagtaactcgttagatcctcgtcgtgcaaacatcgtctagcttgttctcgtcaggcagccgcgctcatcgtttgtaaaattgtttgtctcacctaacccactgtatacgctcttttctagctgtctgtcacgcgtactcttcaacagaggaaaggcatgtgcctgtaagttgttagatgtacatctggcgcgtgtagcttaggtacgaagtttttttaacgctgccgcaaacggcttctgctgaatgctgtcggagtagcgagtcactagtatcctagcggatttgattgttgcaaggaaaagccgctcatcctgtgtattcaacgtcctctcactactgggttttggagactgtcgtgccatgcgggacaggcacgacgttttttagttctcttcttcgcctaaatatattcttcacgccagaaaaggggagacgccacaggaaaggcagggtcttgcccgtccgccgaaggcaaccgctttcgccctttcgtcttccaagaaaactggttggtcacga

SEQ ID NO: 3171 - DNA, 2365 bp, Toxoplasma gondii
ctggaaatcctcttcagtgcctttcgcctgccgttcgcgcttcttcgccggagcgaaacgctggtgggagtggaagcggcttcttcacgacagaagacatttttcacggccacagtcttctttcgctctcctctttcgcgagtctctgagcgacgaagaggagcagcgcaaagaagaagtggaggccgcagacaggaggagacagtcctcagagacagctcgtaagtaacgctgtcgcagacgcgcctcctcctgaaacgaggcctttttgtctttacaacgtccacctctgcactcagaagcactcgagtttccttttcgcggccacggtgaaagaagagagctacatctgctgtctgcgctacgccgcatatctcagtttcgacgccttgacgaaaagacatgtgagtgctcttcgctcctcagagagcggaggaggcgaagtgaagcgagagaagacgggaagtgcgagacgaaagtcgagcagacaaaatggcgagaaactcacaagggacctgcacagaagaagacagaaaacgcagtggaagacagtagggaaagcaacgagcaaagcggtgaacaaagcagtgagggaatcaatggcagaaggaggaacgaacagagacaagaagagcgttctgacaagcacagacgagagcgcagctccttcgagaaactcagacgccgagagaaacgaagaagttgtcaatcgaggaaaggcgaccttggaaaggagatcgagggaagatcaaagcgaaacgcgatttcgagacccgcgagagccgtcgttcctcctgtgtggctaccgcctccactctgcctgaagaatgtccattgtggatgcttgtaccctcagatgcgaaacagagcagttcgccgtgtaggacgtcgagaagcgctgaagaccaagaggatgaagcatcctactctcattgacttcctgtctgaacaggtctggtcaattcctctgtaccagcagcgtagacgcgtccttcttcttcccctttgaatgcagaggaaaagacccagatccagaacttcagtgatcccctcgtcgaatccaagcgtcctttcacatttctgcccatctccactcttcttctgtctgccttctcccgttctttccccggtgtacatacactgcgctcggcgtccgggcttccagcttttcgctggctctgtctcgaagcgcggggaggaacgagacacggcacccaggaccgggaaggaatgccggaaaccggggcgttctctcgcgggtgtttgttttttcctcttcgcaagaccgccaacagaaacgacatccttctggaaaagcaacgcatctacgccgccggctcacgctttcgaggagagaacgagaaacccactgagagaagacgaccgcgcggaaaggggtcgcgcgcacccgcagaccagcaagcgagataagagtggatcgctgcgcaaactcgtttctttctcatgcctcctcatgtcttttccgcggatatttttctcttcgcttccgcagtctgctttcttctacgtccgtccgccgcgtctttgcttgctagatctgcgaacgagaaacacaagcgtgtttgggtgcctccacctggttcttctcttttccctccaggccgagagcgagcgctcgcctcctcgcctcacgaatctcctctttctgtctcgacctgcagcaagggcggcggacagaaaagatgtatttctctcgctcaacgcccacgagaacgcagctgtctgctgttttcatcctgtcgcaaggctagctggaggccggggcggacggtctcccgttttccctccgcgccccgaggtgtacatacacccgagtcttcgtcgagctctgatgtgtacatacacctgaggtcttccccggcagagacggggcacctgctctggagcggaagtttttttcctcgattttttcgacgccgcgttcacctctgctggcgccgcagcgaagggccgtgagagacggagagagttgagtctttcctttttagtcgttcgagacgagagaagggcaattggagagaagccgatttcttcacggtgccgtcgcgtttcttgatcatggaagaagactgcggacgacgtgcgtctgctctgcatgtcgttcgggcgacagcgccacctcgttcgtctgcgcatctcgaaagggaccgaaggaaccgagagtagcagagtctctctcctcctctcacgcttttccactccttcgtcctctcctctgtgttgctcttcatcggtccgacctgcgtcgccgccggcttgctcgtcgcctccgtccctctttttgtttttctccttcgccttcaactcggagggtcacactcttctctcttctgcgttggaacca

SEQ ID NO: 3172 - DNA, 2325 bp, Toxoplasma gondii
caacaaacgttttgcagacctgccaaagaaaggatacgggcataccgttgctatcaccctgagggatcacatcatcaacgctttgttcacccggttgacgagtgattaggcaggaagagagataatgccttgggggaaagattcaactcgattgttggtccgagactgccagctgtcaattttcactagctagagaggaagaagcaggcgctggaacttgctggaaggcacgagaccatccaaactcaactcggttgcactattaatcgcaattagcagtagtttggtaagaggccgactgctctgcctatatcggaacccgaaggcatcttcacaacacccatctcaagcgagtgacagactacgagcagcaagaatagcagatactgctgcatctgtcatcctggaacgctattgtgtacacagacaaaacctttcgtgattgctcagctagtcttcaagtacctgccggtttgtccggctatctgtctgctaaggcagagcaactgcgcggaaccatggcgctattaaagcgtccagatctgcctggctgccttcgagaatgcatttgtgtgcttggtgtcgaggtctggtgaccatccacgtcagtattttaatggattatcaccggaggtttcctcttgtcgaggaacggtgccaccccagcatacagtattacggtgtcgacaaccaagaacccgtggtttaagactctcatcccacctccatcttcccttcctttacagcgtgagagctactgaagacaagcaaagactggtgatgcactggctaaaccgtggaaaagtagaggaatcaacggtggcagatgccgcttctggaacgtccaggttcacaggcagtcacagtggaaatgtcactttatcaggattagtcttcacagcttgcgcctactcagtctgggcggtcagcaggctgtggtgagacgaaaagcaagaaacactcaacccatttcgctggcggaaacaccaccgctcccggctgcatctgcgtttcctcttcttcacgctgcttgcccacacgttaaccatactacaccatttcgcataatagaatgcggacccgtgtgtcggctgtgcgtctcacttctactcttccccttaagtctgttactgcgaccggcgcctgtgatcgattgccgaccttctgcgtaccagcaaatatattgaaccaggctatgactaccacggagaaaaacgtattctcagtagatgtgattgtatccgtgtttatcgtgttcgtagtgcagccgtggtacccgacagccaagagtttgggttgacaggcagtactccacggtcggactggagccactaacaaaccgccggtttcggacagatttgattttgacacctcacaggacgctagaaaacagaactcagggaccaaatgaaatggtattacgaaccagttaaccgatagtgagttatctggtgtggttgtcccatcaaaccaaaagccgctggtaagaaaattaatccaagcatcgactgggtctacctagtggaatccacccgtctgctatttggacaacctaatcgccccacagtccctcttcttttccgaggcttccgacgatatgtctccttgataaaacaatttccacggcgtttcttctgtgtgaccttgagtagttttctcgctcgtctgacaagccggacggtgatgatctagttaaaagagcttcagctttctcagttcacaggttcgatgccctcgtcagtaccgttgcacgcatctcattcaggtttttggagcgcggtcacacagtggagtatgtgcttgacaaagtttggagatcatgcggggagtggaaactgattttatttctttgctgttgttgaacctcccgacggcgtttcgtctcctcacgcagacgcatgcggtactgtctctgcatgccctgcttttccttagacgaattattttctctcctcctcattcctccacgtaaaggcggccgattcgtttgcgaggtagacgcctccttcgcgtgtctaggcgcgttccacttcttctgtcttctctgccttgcaacaagtgtgcacattccacgttttttttctgttttctcctcgctgcgaccgtggtcgtggctcctcgttgacccgacgtttcgcttttttactggccgtgggagcttttccgcctctgcgacgtctttttttttctcgaatctttctagtcaagtactcacaggtttgttccttcccgacggtcgttaggggaaactggcctccgacaccgacaggcgattcgtagcctctcacgttctttgtgtctcgcgtcgtctcgccgtccgcaaga

SEQ ID NO: 3173 - DNA, 2491 bp, Toxoplasma gondii
ctctactatcggaggtccacccgtatgttcaactagtgtcagctctgcaccaagctaggtcaagaatgtcaatatggtacagtgtggtttccaagtagcgcagtatactattcgccggcaagatccagacacctcaatgctcatacggcgctgaatttaccttcattagtttgggctcggagattgtgccttcctcaggcaaatcttcgtcatcatccgtggtacttggtttcctccagtcgaagtttgcaggtggtgctgtcgaacgtatggccatcgaggtaatctgaagtacaagaatgcaatacggcatttggtaacttctctatgttactgaaacggctaaaccgtgggacgtctgagtctgaaaacggaagaacatgctgataaacaaggccccacggcagtcgctgtgcaaccgaattccggctatgcgagctcgaaacggccttccgagcgtttaatacaggactggaactttacaaaatatccgtcgaaatctaaagcttactcgaactggggaattgaagaagacattgatgagcaactgctcatcgacgtcggacactaaacatttatcagtgggattcgccagcaagacatcttgtagagttgcaagcacgacggagttgcgactgtcgatcgcccctgatgagttggaaggagaagttccagagcccgaagacgcttcaggcctgctgtaggcttccgcctctggtgcagcagaagtgtcggcgcacggcttcgcttgatgtgtagtttcactctcagcgctgccttcacagagtgaccctgcgccttccgcggaggggggttgactggttcctgattcctcctctgtctgacaggggacttgtttagtaggttccagttgattgaggcagacggagagcttgaagttgaccacgttatagcacatgcaaaggtcctcttcttgctcctgctgctttccagcttgcatctgcttcattgacatatgctcgcgcatacggttggtgttggcagcagtagagtctatgttcgccattttgacaaacagatgtgataatccttaggatatcagctactgacttcagtcctctgtaccaacggatcgcgcacaccagggaaacgggtatttcgcaacgcaagtggagcatgcttgctccagaaacttccaattcctgctgagttaataagccagaaaacgttggcttcctagccacttctgatacacgtcatgactcgcagacagtcgtggcaaatgcgtacaattccgtggttgacagtcaaacaccggcacgtcctgcttggaattggatgccgggcaggaaccacccggaaaggagaatgtcagagttccgccaaaacgtagacgcaccgataaagtgtagagccccaaaatgtacaagagatcgaaatgctagtgtagctcgtgtgtgttgcactagcatagtttcatttctgcaaaactttgagcagccgtgatcctggacccattccttatataggatataatcggtgtcgtaaagttgcacggggtcttcgactgataagcggcgggacaaatcctcagcaaacgattactccataacaccacgtttttctctctctttttgtaacagatagagactttcttggacccccctcaaggggccgtggggtgctatatcatatgaaccggtggtgtctattaggattgcaagctgcggaggccaggcttgttccctcgctcgtagttgtacggcccttgtcctgacgttctgcgatagtcgactcggggaaaaatgatgcaccgctggtggtgctttcatgttttcacctgattggctttcgcaggagacgttggtaactgtcgtaactgtacgaagctgcattaagcttcgctgcagcggggagccaaatgggtcctcgctgctctatactgggctagggtcttctgtcactgaagcctttctgactcttaccatatagtatctgttgatgtcatataaagacacaagcccagtcctgagtgatttgcgttttcttgaagtgatcgttgcacattctcgcgtatcgtcatccgtgtgtagtaccggtattgccttcccggacatgggtggaatttgccctcttacctcgcaggtcttgccaatcaaacacgtgtggacgttaacgaagggaacatccgtatgcctgacattgcccgcgctcggtatgttccagtggaacttctcttcaatttttatcagcatctacccgttcgtccgagtaagtcactgattcttgggtgctccaaacgtaattccatcccaaatagtattccttcaccagtcaccgactgtcagctcaccgctgcacggtcgtatggtgtcacttatgtgaagtggataaggataatttggctgggaatgacaggatattgctgaagcttgcatcgcagtgtcttggcttggttgagtcccaagcacgccagagacgcatggtgaactgtggatggtaatggtttctttagtgcccccttagcgga

SEQ ID NO: 3174 - DNA, 2156 bp, Toxoplasma gondii
gtcgcggagcagccagcacatggaagcaagagagaaacgaaaagaagcaccaggaaacctggagaagcgaggaaaacgacagggtcaagcgcgggcggacgacggaagcgaaggaaggaggcgaggcgggccagcgggaagaggaagaagagtcagaagaggaagaagagtcagaagaggagagggaggagcagtcgagagaggccgagaggagccagcggcgcctcgttcgcccttgaggtgtggtgccggtcgtcagagaggagactccgtcatcttgacaggtcgggatcgaaaggtcgagatcacgcgagacacggaccgaggagggacaggtggagggcaggattgggccttcctcgtccgccatggaaaaactgagaaacacaaagagccttctcccccgacgtcgacgttctgcagacgcagcagtgggactggactggttggcggttgaaacgcggcttcgcgagggggatcgagtggcgcgatcagactgcgacggaaagctcgtaaagcgggtggaagcaggagagaacactgtctacgtatgggtcgttcgtgagcagtgcagggaaggcagtttgccgcgatgtggagcgggcagaccgcaggcgcagagagagggggaaagcgagaaacatgagcgacgcaagaagcagctaggagagaagaacgcaaggggaaagcagaagcgcggggaaagaggaatgaagaaaactcgacaacacagcaggtggaggcccgaaacgaaagtgagagatggaaagggcgcttgtcgacgccggaggtgtctgcagaggcgaaggcctatcggctatgcgaaatggtggatggcgtttactcgaagtcccggagaggcgctcgacagcacagccgtcttcgattaacggaccagtccgcgcagcctccagtctccagagaccgcgcaggcacaccaacggagaggaaaagcgactgagaaagcgcactggcgagggagcagaagaggggggaagggaacgggtgagagagagagaggaacctagaaagagagcgcgagaaagactgaaggaaagagagcggagagcgcccattgagaggtcggggccagcgggcgcgcgccaaagagatgtttagagtctagagtttaatgtgactggaaagaaaacatctcttgcctttttcgtctacacaccagtcaagtccgcgaaacaaggaacgagaagagccgcacggcgccgcgctccgacgccgcgttatcgacggttctgtatccctccttcgcattggctcttcaccgttcgaacgacacaaagaggaagagagacgaagcgagggtgacggagaggagctaacccatgaaaggacaaagagaagaagaaatgaggaagaaagaaggcacggagacagcagaaaacgggacgaaggtgtcttcgtcacagaagcgcatgcggttgaggtggagggcgcaaagaaaaaggccccgcttaacgtccgtgcatatccagggttgcaatccccagcttttgtatccgctttttctctttctctcttttccacatctgagagagtcttccatttttttctccttctcttgttgtctttttttcctcctcgtccgacacagggcccctgcgagcaaggagaccagagtcattgccgggcgccgtctcgcccatctcgcccttgtcttcttgtcttttttcttccttttgaatctctttgtttccaactttttcttactcaccggtttcttcgcttttgtctcccctcatttcgtctctcctttctctgtctttgttggacttcgatcctccgtcttctttccggactctccgttgttctcgccgccctcacttcccctttcatacctattcgtttcgtctctcgtgtgctttctttctccttctctttccttccctttctacctccttccctctcactctctttccacctccttcttacgccttgcatctcgttcttttcctgtcaattctcctcacctttctcttccgtctcttgctcctcgtcgccttcgcctctctcgtcttcgccgccgccttcttcccttcttctgtttttcttctctttgctcactgtgtctcttccctctctcttgtccgtttttctctctcttccgtcctcctccacgtacgccggttctcctctcacca

SEQ ID NO: 3175 - DNA, 2177 bp, Toxoplasma gondii
cagcgaacgctcacctgaaaagatccggatgattctctcttttccccagtgacatatccgtatctctatcggcatatatatatatatatatatatatatgacgatgtatgtctgagtatgggcatacgtgccactgggtagtaccccgtgttgctgttctatccctcgaccttgtatatcaatgtcgagtcgtaaagcataaacctgaacatcggacaacacaactccccgtttttctttcccacctgtggaatccaacttcactgaggccctgtcatctgcttggggggactccgcctgcaggacttcgatcctactgttctcagtccggtttcagaagccagacgacgtttggggtcactttgtgcagcacggaggccgagctcacactgcaccggggaccgagtctccccagatgcacagatggaaaaaaacatccttggacggttcgtacctatttaactcctcagtttcagttgaggacccctttctttacagcttgtcgcgttacactgggagcataccgatatattcgatgtgcgaagcagagttccagagagctgactaaagaatcccaagacgagcgacaataacactgctgaaatgcataccagtgcgtgtcactagaacgttaccagatgttctccactccctaccgaattgataaagacagctaaatgcgtcggatttcaatattctaccccattacggttattgctcgctggccgcgtttgactcccaacatatatcgcttgcttcttttgtggcacggtggggtccaatgtgctctcatgaacaaggtgggaggattttgtgtaccttccgagttggaatcagaacccctggtgctttttggtgcagcacaacttcgaacttcacagcttttcgccgtggtcgagagtccaaaaaccacccgttaactgccggctccctgcactgtcccagctccttgcttatccattctttcagctcgtccacataaacctcagaggacaatatgaatggcacgttccgcatatcacagaagatgtatcgatgtgtctaatggccagcagagattttgacagtgtccattggtgtgacagttcagggttaacggtttagcgtgcagacgttgcggtcactaggctcacggcaagtgaccacgaggtcgcatgcgtcgttccgcaggggggagaaactgaaaccacgttgctttgtttggcggagtgtgcgcactcacttttaaacagatctcaactggaagattggggtctctactctcgcagttcctggcactcaccgtcagaatcttctggagggaagcgcatgcgcttcggttttttccgactccgcatgtggtccaacgggaaacaccgtgaactgagagattgctctgcaacgtcgcgcgcaaatcggcgcgcggcttttccttcattgttctgctagcgcggttagggtattccttgccacggcgctgtcctttatcggaagcgctttctcttctagttgtagaacgaactgctgcttttattttacactgcacctcagtttcgatgtgagacgtcggtttcttgaacccgcctcttgcgtctgtgcccggttgacggctgtcctgaatacgcgagagagaagggctgaactctctttgttctttagtgaagttcccggcttttctttttttccgagcgttccactttggaaaccgtgcgcctcatcgtttccctgggagctccaagttcagcacaggtcgccctccatccctttttccagccccggatactgtcccgttgtcttgttcatttctcgtcctttcgtccgcgctttcttctctccgattccaggtttatctgcggcttttccctctcccgacgaggcttgagacgcctctgtccgctctgcccgccttcccggccttccgtcctgaaccacggtttcgtgccttctgaggagcgagtggtcgtcgttccgcgtttgctgactgttccctccccccccgtccgtgcaccctcggcctcttcttcctcgatgccgaggaaataatcgcctccagtgccctttctcaccaccgacgttttcgtgctcagggaaccctgcgattttttggacgcgcgcgcgccgcgaacgccactctgggcctcagagtgtacatacacctggttccccagcttgttgcggcgcgccccggcctaccgaaa

SEQ ID NO: 3176 - DNA, 3714 bp, Toxoplasma gondii
tatatgtatttgtgtataaggcgcaaaatcgattgtatgagccgatcgatcaacaatgtgaataaaagaagactggtatctggattgagcagcacagaaagtcgagacttctatacactatccacagcactaaagctgttgaatccggtatcgacgtcccgccgcatagttccatcagctccgcgaaccattatcgatctcacaaccctttaaggactagcctaaatgccgcctgaaaatctcaataaaagagacctgactctgacctacacagaggtacctcagaaaaatggacttaagcagtcagcttttgagagtattagctatcttggacgggaaacagtcacgcaaagactgaaggataggtcgagccttcgtttctgtgtaactccagccaatagtgaccgacgaaaactctatcagagtcgccttactatgagcggcgtcgatgtggtctgtcagctccttgagaactttggcgacaccggccatattgttgttcgccaaatccatgtgcatgtctttgctcatcatctggagcaaagattcaaagtcggctctatgatcatcgtcatcgtcttcttcgtgttcgtcggtggcttcatccacttccgcggccccctgttcggtcgcagcaacgacggcctctgtttcttcaggcgtttctcctgcgagcacgcagatggagtcgagtgaatgtaacatgtggggagagggagaacacgaaattacctgaaaccccgagaaaaagtcgttcccgagctgcagcccactgcacacaagcgagtggcatgttgagaggaggcgtcgggagtgtgttttgagaggaaatcggcgacttatccggcagaaaatgcacttacccgcttcgatcgagtgaggtgcgacggagaagagcccgaaaagggcgagaaaaagaagacagaaagcaaacccgcgagtcatcttgccagttgatgacgcggaaaaggcgacagagggcagctgcgcgtgcggggttccacagaagaagcggtgcctcttgcagcgtatccacttacagtaacagaagaataaaaaaggcggaccgatgtatctgggaaaatctgggagatccttaaatcaacggcaaacgcgcagttctgttagcgccgcgccctcacgaagaagtcaggggacaagcgcatcgacgcgcaacacgcgacgcgcacaacgagtgaataaagtggaagggcatgtttgtttccgtggcttcagcccctcgtccactgcagcctttcgaagggatagccaacgcgacaaacggctgcccgcgtagcttctttttcaagcaactggctgcttctaaggccgtttcgctcgtagagaggagttgcgatgtcctttctagtgacgtcagagtgatccgacccgtgggtcatcgacggtgttacggctttttcgcggtcgggcgcttgaaatacggaaatacgaacaagtgcagaacgttatcttgtcaactctggaagttcgaacgtcatgcgttaaggatccatgaactaaagggtttctgctgacatccttgtcgaggagaggcatagtcaatgcggccaaatgtgcagcgggaggtgcgcaggcctggctcgggttacgtggagaatcaattctctgaatgtgcagcttgatcggagaaagcctagtcacttaacgacagtgcgttgcaaaagcctctatgctgtggcaatttctgcgctcgcttcgatgcctcgtttaatgcgtcatcaaaggctatcgctgactatctggacagagggaaggtgttgtcagaatgtgaaaggtcgcagcacgggcaagctgtgatggctgtgttatgaatacgggttggttcagaagtcgtttacccaagaactaacgcgattccgtctttccacattgcgtcagaaaggcgtgcaagtagagtggtcaatcgacccctgcaaaggcagtcgtgtacgatgctgtacgttctgcaaatcaggtaatttttccagtggtacgtttgagcaagtgctaggcagcgtgacgtcgttatggcttctattcactacactgagtaatatcgatagtaagcaggtgggatagccaatgcttgagagcaacagcgtcaaaaccaacaggtgatatgagggggtggctcgcgaggaatagggaagtagccatgaaagaagagaataaaccctgacaggtcaagcaggtgcactgattctgcgatctaccgtacaggaaagctgagatccccgcatcatggctgctgggatagggcataccagtgacgcgacggatcgaaccgtctagtaccgtttattgtaccgtaccctcgctttttagtcgacctcagcggttatcctaacgtccaacatattccttgtaatggcagtcatcggcgggaggatggtcttcatcccaaagttttgtttgcttaaagcatcaaatcataaaaggtgccagattcatggaagacacaacatcctacactactgtcagtgttagggactaccatgattctgcagattcttccctcgccaacgccaatttcgttgggctgtggaaacaaatgccaaaggcacaggacgtcaggaatacaggactcgtggaagcgacgctgactgctagagcaaaagaatctgacggcggctgctatacctgtgttcttgtcccttttctaccgttcctttctcaactactcattgctaaagacgactgttcacagtattagctgttacagacaactacaacggctgtgcacacgccgaagacgctccacgctcgtctaagcgattctgcgtccacacactggcaaccacctgccgcgtacacattgtcaacagcgaagagctcttgtcagaacagatgtaaggtgcctcagggttctagacgcggttccagattgtgaagaattgtctgacggccagaagtcagccacatacactgctctaccttgtcgatgcgatgtttacccaccgtcaactgcatagatctcgacactacggctggttcacacatgttccatgagcaaacgtctaaatggcaatggcaactgccacggattcgagctgttcttaccatttcggatttcccgtgtatatcgttgcttttgaatcacccaccccgccgtctggaaacgggcgtatacgcgcacgggaaaacaggagcctcatgaagaggtatttcgagcgaaaggctacggtacttgtatgtttcagttggcgtttctgcatgaggattatcaaccgtgggaaactctttcttgtggcctccagggtctctgcgaatcgattcccccccaaaagggtgctgcaccgttgtccacttcgcgaaacgtgtactttccctcgaagctgccaagcactcaggttttttcgtagctagcattctctaatcatcgcggccgggactcccaagagcgcgactaaattttacgtaggcaaacctttctccacgcaagcaggtacagatgttttattgtgccaaccggaagttgggcggtttgtgtcgcgtctcttccacggggacagagacgcgaatccgtgtctgcatttagtgacacgcaaagttccctgtttttcacaaccaacgcatacccggagtttcgtcagagcaaaccccagtctatttttttgttgccgttgaaaaatgtactcacgccgtggaacgtgtagcgtccactgtttttagacagacatcagacaagaagatcctgaactccgttttctacaa

SEQ ID NO: 3177 - DNA, 2413 bp, Toxoplasma gondii
atgtaccacaccaccgacaagatgcatctcagtgcaccacaagccgacatgatggagtgcctgattcgaaggaaaatttcgtccggaacagtcgaaaccgagaggccttcatgtgccagaaaacgtttcctccacggaacaagtttttcagcctacacatccacgttcttcagcgctgaagaatgtgatctgctgcatgagttttctatatatcagagaagggctctccgaaatcccagtgtcatcagtgtacagaattgtgtcatttacgtgaggttgagttggtatataatgcagcgtaaaaatggtcgctcatcgcgtgaacgagaatctcgcaaatagtacagatcacacgtattcacaccctggcaacacatgacgcgcgatgaggcatacaacagcaaaaataacgttgaccatatacactttcgcccgtatagcagtcttcaggtttccccacaaacgaccgtcgattaattgagatgatgtgcctcaaaaagaacagatcctcaagagatgacggcaagcgatccatcaaggacaaaaaaggcaccatctttttttcccgaggaccacttaagaacgcgataaaatctaaaagcaccagtgttctagctcgaccaagaaattgctcgtgacccgaaagccaacaaggctcctgtcggttcccagagaacgtgagaatacttttcagacaacgtgagaactctacgttttgctttttggcccgctcgaaacaggctgcgctgtccatatattggccgttaatgagtagatgttgacagaatcgttaaattgacacggccgcacactctttcatcaggtacatggaaagaaacgacaccacaagcaagcagatattcactccatgagaaatatagcgacggccagctggctggaaaaacgactgccgtggcacacttaagacgaagatgttctgtctcattcggttgcctctcgcagagatactgcttctttttcgctgttgccaacatttctagcaatctgctgatctgtaggagaatgcgctgatcggttttcgtgaaaacggcgttgagatatctggatggttcatgatactcacaaacttgtagatttgctttttacgctttttggcctcggtgtcccctcatctacattttcaacactggcgttgttggtaaccagaatcagctgcgaaagtttttgaagaccgggcagcaaagaatcctaccactggtgacacagtacttgcatttccattgcaacatgtgtaactgagcgtagtacgtcccaaaagcgactggggggaaaattctttagtccgccagctggcttaacgagccttgcaactgcacactcttccttcaggttctctagtgccttctgctttagacaatgtctgcacccccaaaggttcgtctacaaagacgtcaactttggtgggcctgcggtgagacacgtgctctactacagcagactcttggccagctcaggtcaatcaggcagcaaaccggtaccttttctttctttctcccacaggaaagatggtgatgttttgattcccacttcagcgatgcgcacgctgtcaacggatcgttaagaattctagcaacagtagacgatgacacacatgctgatactaatgacctctggcacccagcacttcgctgcattcctgttgtcacctgttaagtgcgatggaattatcgctggtcgccgcaaattagcgcacgccttcataaggatggcaccgtactggcttcgcttctctcgtgtcaatcttgctcagcttatccaaaaggaacgaaaaaaagcgtttcaaacaaattccattaagcgctgagcccttcaaatgacattcagtttacttgatgaacggtccgtgcaacggcaagtgtgtcggtggaaaaaatatacagctaaaggcgactctctatataccttcgcacccgccacaaaactttgttccatttcaaaaggcgtagaagaacatcatttctatggcgacctcgtcgggggagccagcacgacaatatgcatgttcttgtcgctttacgatgttgcgggcggactctctgtcatcgggtccaagaggagtcggaagacatcagtcgctcgccagggaacgcacgtctcgtgagcctgctaccgtgctttcctgtactccgtaaaaccaccacttgctgagggttcgtgaatcctagttttggcgttgtgctgaagtggaatccccttttggttcgctgtttcggcggcgttgattggctgactctccgttacgggaattcatatccgcgtctcaggaggccgcagtgtgctcagcgctccggtgaccagtagagtctacgctgaaggtctgtgcacacgttctcttgcggacaccagtcttcaacgattttgcgtgttgccattctgctcagaatcgtcacca

SEQ ID NO: 3178 - DNA, 2000 bp, Toxoplasma gondii
acagagtacgacaacatgtgcatcccgcttacttgtgttttcctctaagcagccgctttcttcggctgctggacaaaatgacaggtttacgtctccccgctgccatctcgctctcgtcagccccctccagcgcgctgccttctctcagctctgctaccgcctccgtcgccgaagcagaagccgctgcctgggaagggttagacgaatcgccgtgtttccgtatgcctgcatgagtcgctggttgctcgtcatcgtcacttgcgtcctccccagatacctcggacgagccagcagaaccagcgtagtcttcgtcatcttcctcgctgtcactcccgaatgtcatgtccagcaaagacgccatcttgacacggaagtcacgtttgaggcgcattcaacgtgcacaagtccaacgcaggtgctgcaggggtgtcgtacgactcttgacttggctgtcccctggaatgaaacggacttcccgactccatatgctcctcaaaataaacagccgttcgttgccggcttaaccacttcgcccagaaaggttacgttggacgaaaaatcgcgagtcagccttttacaatgccagtccgtgaagcaaaaacgagaggaagttgcaagtctctggtgtacacggcaagcgcttcttaaacgtttgaccgacggtcctacatacacgcaaaagagaaagtgctgagaacagagcccgtgtacgtccagatcatgaagacgaaagatcccccactgcataatagcgttttccgcatctctcaacatacacaaaactcgaaaacaaacatgcgaaacgtgtctcgatggcgaaaacgaagaaaaactcgtgaagcaggagtcgcgggccaccaacggcgaagacggccttttgaacgagtggcgataattacggcaaggaagagagcaaagttctggcacgatacagaggaaaatataatttcacaccgttctagaatgaagaaaaagggcgggtcacagctgtctcaaatcccaatagctctgctggctgccaaggcttgcctccgtgtctggagacagttaggaggggcaaggtccaagcctagaaagcaagcatcaatcgaagaccttgctctatatgcatgctgcttgtcatgccgatctaaacgcgaagttcaaaaaacatttcttttcgcgatggtaatgtagaaactttgttttcctggctggcagttgtcagttgtcttcgcgaggaagcatgtcgcatgcagatccgcatgcagccatactcaacgaacagaccgtccgacagcttggcggaacggtgtactgaacatcgagatgtagaaaagaaactacgagtctgccggtctgctcagcgccaagatcctccaagtgcttttctgtggtgcccgttacgcgttttcgtacaggccttggttacagtgtgcacgaggaggcgcacatgtcccttttccttcaaatgtggttgggcgtttctggtctctcctacaggagaattctcggctaaaatttgtgctcgtattgtggtaggacacatctgcaagattaagactatggaatcgactgcagagaagaacgaggagcgcgccgaagccttgtcggactctatcacagggcccttgaaagtcgccgacggtatccagaaactcaggcaaattgggaaagcctcatgcccactttgaggaccgcttccctgaaaggatggccgtcttcaccttcctgtcatatccgagactgcatgcactcttcccagtgaaaaagttatggaccccaggcagtaagtgatggccaaacacccggtcgctttcccttctttctaccctgtcataaccttgtctgcttgtcatctcacaactctttgttgccttcaccaggttctctcggacgttaagaacttattgacgtcttaatttttttcgttgttcctttcctccttgttctcgaagcccctggtgacagcctctggactgcgactccggttccgcgcctcgccagatccgccgccagca

SEQ ID NO: 3179 - DNA, 1800 bp, Toxoplasma gondii
ctgcggttaaaactcgtgccacatcttcgggaatggaaaagcggtgcccgtcgaccaacgttgccttttctgacaccaataaccacagtttcgtacgcaaggttacagtttgtcagcaatggtggctgtgtgccggtgtgtctggccgcgtgtcgcaccatctgttcgaggcattgacagaaagaagtggccgtgtttaagcgtttttgctctctgtttgaccggttgtgaatgcgtggaaattcccgtgttggccattgtcacgattcaaacatccagatcagagaacttttcaatgaattgtctaggcttttctgaatcggggaagacgctgatgagccccttttgggccatttatcttgactatggaaatacatgtatcgcctctccgctagtagtctgcaagatgccagtttacccttgccagaatgaaaccgcccattcctctctctgcttcgctgaaaaaaatacctatttcatgttcccttgtttgcaaagaacgcaacagatctttcagcaccagcactctccattcaaggcggttagttaacggaatgctacgtgactgctgcctaccggatttcattgtctacggaggcgcagcttactcctcttacagtttccatggttttcagaggcactctggggactgtccgacgaagaaattctcgttacaaacacctggccaccgtgaaaatgcacgattgcccccgtccattcccttttgaggatcgttcgttttttgtttcgcattgcttgtcagtgaagggctgagtctggcgcgtcacacgctttttcacaagagcaacatggcacgacgaaagacattccccgtgtgcatgtttccttgaaagctccacactgcagatatgagaatagatcgaaacacggctcttcgcctttgtcgcgcaagttgaggacatgtttaggctcttaaattggcctcttaccaccgtgatggaattgagtggaacaatgtaacggaagccattatcccctctgcttcgacgaaatagccactcactcaccatcagctgccttgttgcgtaacgactgtgttactgtactatatgtttcacccttgaaaagaaattgatcccaaagaacctgtgtcagccaagtggaaacgaaaaaccacgtttcctacatacactcagtgaacattccagatgagagagcggcccgttagcccttggacggttttcgttcctttttcgtcagttttccagctcgacatcgttgccgttctcatatgagctcctaaccggaacatgagaaaatgggggagggacgagagggtgttgtcaagaatccaatgcttttcggttttgctgggcaggctgtcttcgggaaatgcgcctgttgaggagctctttcccatgaagcaaacgaggaagaccctggaaattacagccacagctttgcttgtcttcgtcccctcgtggctttcgcagaatctcctcgtcggcagtgccagcgctgtccaccgcgaaactcgctacgcaaagtgtacctttgaacgaactcgagctgagagaagagagcgcgaaagcgacagaaagagaaaaagtggaaagcacgaagtcccgacttctttgcctttctcagttttctctttttgctgaaggagtgccgtcgagtgcgggaacaaagacattttcgcgttcctgaggcactttttttttcaccaggtctcgaactctttgtggggctgagtttctcccgtcgcacaaatcgattgtgtctctcccgtctcctccctctctttcttcaaccttttgatttttcttttctccacaa

SEQ ID NO: 3180 - DNA, 4727 bp, Toxoplasma gondii
tagcatcgatcatcgcatctaacaccgcttggaggctacatgcatgtagccaccagacgaaatatcggacgaagcttcacaaagtgaacctttccatggtgtatagtggtaaccggtgtatatttgggaaaaaacacctctgtacctgctgtgcaaaagccattcattttggtagtctcctttttgattttagtctgcgcataatagttaggtctgtctctgacggtcggtttgtttcgaacactcgcatcgacggaatccagttaaggtcgaagcggagtatgaggcattatcttctctcgcgagaaagggggatctacgatcacctcttaattcgctagctagtcttcgcgtgtcagagtgctcctgtgtacggataaattttggtacgtagaaagagcgaatgagcaaacacgaagccatccacagagcggaaaactggtaacgacgtttatggaaccgttttcaagatgtcctcgctgtcatccaatacggctgttcatcccagaagaatcagacacctcgcacaaggtcgtgggcttcctcctcgtcctacgtactgaaaaacgtctgtcaacatattgtcggtgctatcttgaaacttcttaatcgatgtttgcatacattaccagttagataaccaatggagctagattccctgctacagagagcatcttccttctaattataggtgctggcttctccggtcccttaggagcaatggagcaacaaatcggaagaaaagaaggcagcgacaacaagcaaattgcattgtctcagcagaaacgcacaacgcgctgtctgtagacgttgcttactcagctcacacgttacgtctgacggtcaactatctttcctaactgaatcttgctcaatgaagagggaggaaggagccgacatggaagtgctgatacaaaccgacgactgtaagtcccagttatatgacaggatgtgagactcctgagatgtacctgttcttgttaggagggtggctctcccgaagtgtaagcataacacaaaaatgtctagagaagacaaaacggatggaaatgaaacaaacaacaagcttccaaaaggggagaacgcggtctgttatgttgtgttcttttaggcgaaagcgcctgggtggcaccggacctgttgattacacgtagtgttctcagctcataaatgtggaaataagaaagggaagttgcggttttcgcttttgttttgaaggatacgagctccagactgccattgaaaagcactgagggctctccagtttttcgctgggtctcggggggttttcattggcatccgtttactgtagaacgggatagaatctgtcaactcatttacgctctggaagcacgcttacaagagtcgggtgccgattcacgctgacctcacgaacaccaccggcatttgcatcgtatgtgtgtctgtacgctttcttgttcgttttttccatctgattcagccacctttcttgcggagttcgcgtcgtccagtttctgctgagaaaacgtgcagacgttagacgcctggcagtgagctaatctcactacgggtcaagaagtctgttcgctcctcttgctctgtttcatcgatccttcttgagcaaatcaactgtattcgtttttgtgtgtcggctgaggatcacggaaaacaaccccggtcctctgaggacatttgtttgtccgtcgttcccgtgcttctggttttgacagctgagatcgcaatcctagacaccaggtttcttcgcacagttcacattcgttgctttttttgattcattaaactcctctaccacctttccgactcctgtagtactcgtcctcccggtatgtcgtgctcttgggttttttccgtttttttcctccgaaggcagcgttcaggcttttgaacacttcaagaggactggcgacgatcttgtccccccgcctgctttcctttttctgttcgagttttttccttgtcatctcggaaaagctgctcgacaggcgtccgctttcctcgccatcagaacgctgaacggtcttttcaacgccacagactcgctttccacaggatatcttgcgctctgtcgggtctacgtgcatcgctgcattgtgcactgcggtttccttcaccttgctcacaaccttctccctaggttgcattctgtcttgctcccccttccttttcccggtttcatttgtctagttttccgcgtctgtcggcagctttctccacggtgtccgttgtggcacaaaatcggcagacctctagggaagatgacattgcgtgcagaacgccaggtggaatcaaggaaggagagaaaccgtttcctgagattgactaccgagccggtttttcagaaccgaagaaaggcggctttcctcttgtaccgagtagacgcaaacgccacaggcgcgtttggcttctgcgagtcttggccgcatataccagaacacagaaagagtgaatttttgtcgcagaatggcaaggcaagagagaaaaaaaaagccttcatctccgcttgtggaggtcagaacagctgacagcggcgacaagtggagaaaaggaagcccgtccgggaaggaaaatctcacaaatgcttgttccgtttggtttctagcacggatgaggcgactgctcgttttaccgccgtgctcggtgatccggcagaaacgagctgcgtttctgagactttcttctttcttgtttctctctcatgctgtcattatctcctgctctctatgtgctctcccgtttcgcttctcacccttttcgtgcagctctccctcctatttttcgttttcttccctaggtgtcatacccggtcttgccaatccgacacctgtgtttcagcaatccgcctcgtctgcagagtctgccgggcaggcttcacggcttggtccgaaggcacaaagcttcagttccctttcacgtcttgaagaaactccctttttctctactccttcagcctcgaactcctcagctgcccccttcctctctgccctgtctgtggaaggacacacttctccctctcccgagatgcaatcgcccgtctctccctctcattccctttctcgttctgcctcttctgaatctcctcttttcttattatcttcggtttcgcctcaagagcctctctctcccagcttttttattcaaacccctgagcatggacggactccaagttttgcccggaaggcggtcgggccgccgcgctcggctccaggtggcgcctatcgcaccagccatacaggcgctactcgaccttggatgtggtaaagagagaacacaaaaaccgtataaatgcaaataaatgcgcgcgaggccacgggaaggtcttgtgtgcacatacactcgcattccctttcactgtcccgctttcttcacatgtggtccagtgtcatcgggcctgtctctctgtaaaaagaaccttgatatttttctataactgtggatttccaccgccttttcgattcgcgcttcctccccgcatgcctgggtacccccaaagaatacctccatcaatccacatgccttaccccgcctacccaatggtcttctctgaagagtgcctgtgttttctgtagacatccagcgaggaaagggcgggacgagttcgtgtcgtacccgttctgcattcatggctcaaaagatgtgttctgaatcgggcagtggtatgagctaaacagctccatcaacaaaagccgcgttgaagatgatgaatccaattgagtgtggtatagatttacaatcttgcaaaactgacgagaattgaacgcaacattagccggacgctgacgcttctttgactaacataacatcatagaagatctagctgcattacgtttaaactgccccccgcaggcaagatagaatgccgtgcacagagccattttactgcgacatcagaggcgtagtatcattcaagaaccggcaagaaaggcacacccgaattgcgtgagacagagcgacgacagagtgctttgtcaccctttttcccgcttcctccacaaatctccaaccggcaacgatttgcttgtctatcgcaggatctgtctcatgtcctgttgtgcaatatagagactgccttggcttcctgtgctttgagatcagtctaacagagaggaggaaagttccccgctttacccacttgccttgttgctcctcgctgtctcagggccgcggcatctctcttttgcttggcaagtctcgtcgtctgggtccttcatcgtctgaggcttcggcgtgtggcccatcgcctgaagcagcgagtgggcagctgctttccgcctcctgtcgtctacgcctacggccgtctcttcactttctttcctctcttcgcttcctgctgctggtcagcaccactgcatacacagaaattcaatctttaccagataccccccttaaacaagtggcgtgttctgcgtattccgacccttaccacagacgttctggttgccactctctcgacctcttttccatcgcatacatccgcccccgtctgcactgcgcgttccgttcgcttccctctggatgcgttctaccttgtgttccagtcttcgtttcctcatttcttagtcaatatgccttacaggcttcttttccccccctttgccgcgcaaatttccgcaaagtttttctgtgtcttcacagggtctcgttgctcttccctcaacttgcgctgctcagccgtgtgttgctgcacttgtacgaagtggcttgtctccactggttctgggctctca

SEQ ID NO: 3181 - DNA, 2118 bp, Toxoplasma gondii
atgatagaatagactgagctcaaccatgacagacgtgttatcagtgtggttctctcgtcgaaacattccacgttacagcgcctgacaatctatggcggcaccgagcgtctcagcgatgtgacatgtttgtgatttgaagaaaaatatgtgtactcagcgatgtgacatgtttgtgatttgaagaaaagtatgtgtactcagcgatgtgacatgtttgtgatttgaagaaaaatatgtgtactcgtagacacccttttttggaaatcttccccatctctcctgctgtacgtatatataattggattcaccggtgtatcaatctacgagcactaacggagctgcacgcaaatggaagtaatcaattcttgtacggtttgtaagtactgaagcgcttttgtatattcggtttgagtttcggacatgctcattccttggacggctattcgtacttcacaggtcaatgcattcgccattcacggtaccatcacttggccaccggggagtgacggaactcctgtcgtgaaaaacatcatcgcagaaggtgctgcaaatgcagcgaacatgatatgtttgttccgtggggttgctgggacgccacctcgaaatagataaactttcaccggcgtcacgacatagacggagaacacgcgcagtcgcgcacgaaggaattcgcgtgcggctgaagtgattcgtgaacaagcccagggtgtcgtgatccagaagatgaagcgcggctctactcgcgtggtggatcgatgacaccgtcggaacgcccgacacttctgtgacacaaggtgccgatccaagaaggagaaccttctgaaacgagacggtcttcaactcgcgaagggaaatatgtccacggacgaaacaagaggaaaatgagtgcatgcaaccggctttctgtttacctttgtgattttcccacccgtgagagttcgtctccgttgccgacaagaagagaaacggcgcttccagtctctgaaaaccttgatgtgacgatgcgtcactcttgcttttcgtgctggggttctccgtttcttttttcgtattctagactttgttctgcgtcgtgttttccaagcgagactgccgatggaaggaaaggtcacctttgcggcaagcgtacctactttgtcgatttcctcgtcttcttgctacgtgcgtagccctgtccagcctcctgtctcccccacccccctagaaaaaacaaacacgcttggccttcgacggtctcgtgctccaatcaaccaggttaatatgttccttagacagaccacctcgaaaacaccaaaaaaacactcagtcaaccgtctattctccggcctctttcgtgttttatggcataaacagaagtgtaagcctgcctcactcaaggttctacatcaaaacgcgacgttttctgaccgcctggtgcgccttaacagcaacaccagtttctggtgatactctatagagtcatttgaaacaacgacgccttcatcccgaaaattgaatcataaggaatcacggtcgctgctgttatagagcaccaaagcttgtccaccttggacacattcggggttgtcattccctccacctctaaccacaaaccaattggaacgcacttcgtgatccatttgaggtggaaggataccgaaccttgtgctcttcataaaaaacaccaggaacgtgctgcattttcaagaagtcgcacacctaaacagcttccagatctcttgaaacacacgaagaacaagatgtcttcttcagcttcttcgaaggtcatggccatacaacaaagactgtcggcctttgttgtctttatgttccgtcgagacgtagatcggtggcagtttcgtggtgtctgtatggggcatctggagccagagtcggcatcctaggtcctgcagcttctgtatccgtgttgaggcaacgtgaaaaaggcggatcgactaggctgttgtgtcaaggctcgtcatgggtctcacaatcagtccaaaagaagttgggtgtcagtaccgtataacataactgaagccagactccgcgtcgtaggcattgtccgaagtcgtaggtaatttgaattttcttcggaatagcctgtccgtgcaggggctgagagaagcccagaaaaga

SEQ ID NO: 3182 - DNA, 1567 bp, Toxoplasma gondii
atttctccacacctctggataccttgatataacctgttagatgttggtaggacgccgcgtaggatattgaaatccaaaactgtcagctctcttaagaagcagtccaggcggctggtggtgtgcttgctgtagtcatcaagaacttgactgtcggtatttcataactggagccgccgactggaggtggtttctgttatcgtcccgcctgcgcagattggaagcaatgcgcactctagctcgtgatttctacaattgctctgaaacagtgctatcagggatcatttctgcacacagggaacacgaaagaaacagagaatacagctagttcgtggcaagtgtagcaggcatgccaaaagacctctaggttcgacgccgagcagcatccacgataaaatttactggtagattttttgtgttggtggaaacagctttctggcgcggtcgtgagtgtataattggcgtccaagatttccacgtcatactaccagccttctattctcacgtgaacacacgagaaaaaccagggaagtatcattcgcagatgttgtcacaccatgccctgttcgttagtctgtcagcggagacagcgatgggcgtgttacgccgagtttcaggatcctaggcgacagtatgctatatcaagatatattattgtttttcggaccagaagcgtatattcgaatcttacgtggcttctgcctctgttcccatttcaccagatgcgcttcagaaaagctgaagagagccgattttgtgtttaaaccgtgaatcaacatcacggtgcagcccttccgagctcatactcagatccaatttttgcaatggggagtctgcgaatgccggtctagcggttttctgaggacggacggacagtgaagcaaacgacttgtgagcttcacctggtctgcttctagcaacagaagtgttctgttagactgaaacgaaggtgtcgcttgtcccccgtttacttgcacatattatcgatagatatcagtgtccgtccctcggctccatgtttgcaacaccaaacccgcagggtgtcgggcgaagaaaaactccgttctcagccgggggttgttgcgccgcgtctttctgctttttggttttgcagacaataggaaacaagaaacttacttgcagcgataacactttctacgcacactgctacgcaggagccgggtggtggcgaatccatccctacggcagctctcttggaagcagctgctcccttgttgtcttgattttcttctctgttgcagtcagcatctaggtatgccacatttacctctctacagttttctaaaaaaacgcttgcctcactaggacaaaaacttttaatggtttgcggcatcttttgaaaacgtgctcgtgatgtgcatgcgtccgttcgagagaaacgttgcgacacggaggaagagtcctgtgcgcctttccagcttgtggttccgcattcagacagggtgagaaagtcgcttcctctcgtgcattgtttgaacttttccattgccgtctctttgtttgtcttttctgcgacctctgttaccatttcctagcctcgacttcgcca

SEQ ID NO: 3183 - DNA, 3656 bp, Toxoplasma gondii
ttttaccaagcctcagtgtactcgagaagtgacagcaagtctgaacgactcgaatcggagctgcaagcgtcattccatgaagagggaaatatgtatatatatgtatatatatacatgctcatgtggttgtctggggagtgtgcggcttagggaaggcagagtaaactctcctaagtaaaagaggctggaagactcgtggactttttgcgtttcttcgttgcccctcgtctgcgtactgctgtatcgcgactaagtaacttggccacgttaccgtctatctcgcaggcgacccgagaactttctgacagtagactacccgaacaaggaagggtttgtttccgaccctttttcctcagcaagaaacagagaatcagccgaacgtttgtgctcacagataagacaaatgcgtttcattggatcccggcgaagataccggttctgagttgagattttcggtacagaccctgatccaattaccctcaccttcgatgaagggaaatgccacttgacgcgaacagtagtttctcgtttatgtttcttgtattctgtctgaaactgtaagaggagagctgttaatgatatggtggcaccgtgcctagtatgtccaaaacagtatcgtgagaagaatctgacacgcgggttgaccccagaggacccgaactcgatcactatcgtccccgatccctacatcgctggccaacagtgtgagccacaaccgcctggctcttgaaagcgaacgtcccaaattagtgacaagccacgacaaatttctaaaacaccctctctgtagcaactccagtgtggcaccccgtaccccttcggggattccgcactcgtgatctgagaaacatgcttacgtggaaaccactcacaaaagctgacacacgcacattcctctcggcgccaaacgcgtctacccattctttccagctggctacggccaaaactcctggtaggagaaatcgctactaggcaattgctggtgcgcggctctaacgcaacactactgtcaaacgcataaaacgccgaacaacagcgtggaaaccaaaacatgatgtgcatttcgaatggcagaaatgctgtctcgagaactctagcaccttcgcactcgtgccgcggcaaaaacgccagaaacgagatttctgtacaggcctactcagcgcctttctctgtcgacccgttctgctgagcgtgtcgtcttagtgcctccgcggaaagtgcaaacagctaaatttccgctttgggtgtccatacaccgcgcggctgcagttgtttgctaagaaaaatagcaaggtgcatcatagtttcatctgtctttgcaactgcctattcggtgcacccacgcggacgaccaccgtaatatgcaggtgtcttccgtggttttgtccggggttcgtcctggacgggggtgacggctaaaagaccccgtttcgcggtgaagccgcgatccaaccggcgaatcgtgaggaaaaaaatgcaccgtttttccagtcggccagaaacaagagcggcttggtttctcggtgcgatcacgccccacctccagtgggttttgccggggcatgcgttttggtggcggtggtgggaggaactagccagaaaacaggaggaactagccaggacgggggtgtggaggaaacgggttacgacgacgtgttcccctacggtgtcgcttgcagcgcgctgcgccaaggtggggaagacgcgattggtcggtcgacacaccctccactacaatcgttcttctggatttctgcccattttacgcaaagcaagaccgacctgtgcttttttgcacgcacgcgtgttttcgcatttcagagtctctggagagagtgtttcctccgtgtgtcgacaaaatggtggccaagaagtccgcgaaatccgccaagcctaaggcttccggcaagtctggcaagggcaagaagaagcgcgctgagtcgtacagctcgtacatcttcaaggttttgaagcaggtgcaccctgagactggcatcagcaagaagtccatgatgatcatgacttccttcattgctgataccttcgacaagatcgcctcggaggctggcaagctctgcaagtacaacaaaaaggacactctgtcctcccgggaaatccagaccgccgttcgtctggttctccccggagaactcgcaaagcacgctgtgtctgagggcaccaaggccgtcaccaagtacaccggcaagtaaattgcgaaaaaacgccctccacgtcatctagacggggcaaatggcgcagacgccgctgaatgattctctcaagtagtctcggcagtttacacttcgtttttcatggctcgattttgcatcctgtgcagtcctgtcataaccaacttaggcttcactagaagccaccaaacaattttcccacaggggtccaatgctctgtcggtgtcagcaccgatgagcaccaatgagtgaaaaccagtgcgctgtgtcgtttgtctttggcgacacaacactgtcttagcggggtaaccaatcgcaaggccgagaaacagtgttcgggaggaggaggtggtgacgtctttttctgacatgaatccggagcagggagtgacctaatcctgtcagaccttgccgggtatttgacagtgctctcagagtttaccctttctctccccattcgctgggattgcgtgtgagtggtacgattccccataggcgtgcgctgcaaaattcagtgcagctgtttcctaatttttttatcgtcgggtcttgcgaattcttctgtgtagctcttgcggcgtgtgaggggtccggattttttttcttgccgtaagcacctacacacattgttgcagggcagatggtaggccgttttttgattcgtcacagggcttttcgctgagtgctccgtcgcttcagtaattttcacaggggacagacaccgccggaatcagagatggcactgaatcttctgaaacttgtcggaactccatggtgtgtagggtctggggtgctcatgtcaattcatccctcttctgtaatttgcttcatgtttataatgtatcgactgaggtgaaagacctcacacaccaaatgtttacgttgttccgttccgccgagttattctcaagcgtaggtcttggttcatatgttgtgtgagtcttattggaatgcatcggtagagtgagtgttgaatgcaggttcgtaggagttagagtgtcttttctcaccctccacaaagtcgtcagaacgcaccacagggttgcctaagtagtggatgattctgcaggattccgcagtagcgtcgctgttcacgggctatcataacgtgcataactttatgtgaacccgttttggtatgcttcggtttgaaggctgatacatcacgaaagtctcgtatttgcgccacttgcgctgctgaccgctgctgcgcaacagctcttccagttttctgtgccaccatacggtagagcactgacaccgtgttacgcaggtggcgcgggttcatggaagatataaagtgcgtcacgcatgcgcattgactttggctctgcgaggttacgtgatgctagaacacttggaacctaacggcggccctactcttttccaagaacagcaaaggtcatgcttctctccaagaattctgacggtgaaatcagaaaagctggcagtaccacgtcggctctt

SEQ ID NO: 3184 - DNA, 2619 bp, Toxoplasma gondii
catccagcacttctatggcctccatcatgtcccgtttcgagaagaagctcaccttccccatgactgaatcaggcgcatccggatccttcctgacctctgcgaaaccgacatcgccaatgccccgaaaatggtccttcaggtcttgccaacttccagacggcgggagcccccgaacttccagcacgaaacggccgcggcgaccagccagacctcgcggcaacgcttcttccccaaaaccatcagggcggcttgaacgcgctaggggaatttccacgcgcagaggcgctgcgccgcgcatgcctgggggcggccgaccgtgcagctgagcaattgcgtctctcgcgtcccgcggatccgcgtactctaagaaacagtacccggcacctgacacctgaaaaaacatgaagtataaacggagtgtgaaacagtgcccggcacccgacgcctgaaaaacacaaagtataaagtgtgacacatggcttgtcccgtggtagctggagttgcaaaaacaaacgcaccctgcaacggctaacttttccgcggcttgcgctccagtgggatgaacaccttggattccacgagggctgcaggtgcggactgggagggagaaatccaactaagcacgggtgtatgtactgaaccccgacgcacggacacagattccagcagtgtccagtcctctagagaagcacgtggaagttcgctgttcttgcagacgttactcgggtgtgaaacatacgatcttggccacggatccccattggtcctgggtactcccacttgtgggctcagacgactattcccctccatcgttgtcaaaggttcgggaacgaatctcgagtttcctctcgcaaaaacaccggcttcacagccgctccgggcacacattcatccgtttccgttaagatacgtggcactccgcatgttgcctacacattcgctcactgctgcagtgtagagcaaatgtcctttccgatcacggcaacattccaaccgaacatcaacagcgccttccctttcacgggatccaacacggtatgcgtcgacctctctcagcttgtgggggcacaaggggaagcacagcagtagcaaaaaacacgttgcaaacaagtgtctgtccaataaacagagtctcgtttttgttcgcttcccgtctggcccgaagcatgagctagagggcatgctttggagtcactagggttcgacgctcctatggggaagacaccgttggcgaatttgatatgcagcgtaccgttcgtttgaattcaagtttgatgatctttccgaacttttcgaactcgcgctccacatctttgtccgtatactctccgggtaagcttccgatgtatattcgtccgctgccaccacctccggcggcgcttctgtctccgccgaacattgtctcacgttctggaccgtgtaagatacaattatcagactttcctgagtcctcacccgcattaaaacattacgtttgtttggcactacctttccaaaaaggtgacctcggccgccgccgtctgattcgacaccatccgcagcaattaatcagcacggcagtggcgtcattcgtgcgttcattgaacggtagaactgcatgtgactcaaaaagactgccgcagaagtgctcgtgaggatcgtggcgaaaacagggatatcactgccgacacgaacatgccgtacaaccaggcgtcagcgcgttcccccgtgtaagccgctgtcacacagaggtaacgaattggctacaatggacctgtacaattcccgctacctcgtttctcgtgctcgtttgagcaatgcatgaagactgaacaatgcacggaagacaggaactgcaccggcctacggacgcgcaacgggtgtaaggttcaaatgaactccggacggagaggtcgaccgcaagtagcacacggctctcgtcttcgaagcgcttttctgcagccaccaagtgagtagtggaaagcaaaagtgacgccaaaaagagcgagtgagtgtggaagtagcgaagatgccacacacggcctctccggaacacaaaaaccgttacacgtgactggtggatgcggtgtgtgcgggtgtcaaagggtaggagacgcgcctttatacggtgagtcaaagaatgcagtgattggacagtcggtcaaccaaacacacactgaatattcgttagataacttcctctttactcgatttgttggagatagcacagaagataggaaaagcacctcaggacgggggggcggaacctcatccgagctagcatttcgaatatacaccgccggtctatctctttacagcggtccagtcaaagcgtgctgttgggtgacatcatcaaggtcaggggggcgcggctttttttttgcgccagacactgaggcgcgcctgctgttgccgaatttgttttcacgtgcgaacgtaccaattcaggatcagctgagtgacgcgcagcgtaagtcatcgtcaccacgaacaactctgatttcctggtcgatacagccccgccttgccgcgagagctcactgcgccccgttgtcccgttgaaaaaaacattcaaatcaactgcggacggatggttctcttttctctatgtttgttttccaggacacacaggcactttta

SEQ ID NO: 3185 - DNA, 1875 bp, Toxoplasma gondii
tatctcctcaatcacacgtatacgcccgaatccatgttgccaaatgtaagagcttctcatactcgaaaagcatctgcatatatacgtatacatacatatacatatatttacatatacatatatttacatatatatatatatatatatccgtatggaaagatagagacttgtagatgtaggtggtggcattttgcacaggaggaacggaacctgtaggtgcatgggtgtcagttttcgtgtacttgtggttcttttcacacgcaccgagacgcaagcttttgcgcagagttctgcacttacggaacggagagacgttctccacaggtttcacgggcatggtctccgagtttcgcccaaaagcagtcggccgcctcgagttccttgcggaggtcactgacaacgcgcattcgcgttgaagggtcctcgagctgtgcaaggacgtcgacagtcgacgcattccccttcttttcgaaagcagttctctcgggaagaagcggtgttgtgtatcctctcgaagcgggagaccttccggacgctggcgctacggagctcccggggtggcctggctgctccatggttgccgaaaccaactgggtggaaataaagaaaaggcagaagtagaaggagaaagaagagggatgaggggaacgagggaaagggagcagaacggaagaggaggaagacagaagaagagaagaggaacggagagagaccagaaataaaagacacgggaagcttttctcggagggtgaccggaaacgacagtggaggaggactcaccgcgagacacgaaaggcgcccaggtgcccctttttctcttgacgaacggaagaagcgacgaacgaggtacaaaaacgacaaccgggaggaacacggtcgaataaaaactaagattgcacggtttgtgtgcggcttctccgctactgcttcgcaagctaccctcaaacaacgcacgacactggccagcgcagctccggttcgcaggtcgcttttcagacgtagagagaaaaaagaagcaggagtaaaaaggaagaggcacgcaagtcaaaacgcctggcagctgtttgcgtttcgaggtgtgtcgcaaaatcaacgagaaacccaagcagcacatgtgcacttgaaagaggttcgattcaggaccgcctccctagcagatagagaggtgactattgacaggaagggtaccgcagacttctcttgtttactggactcgtctaccaacgcaatgcggcacaccgttccagtcaaaacggtgttcacgaggtccgtcagacgactccgaaaaagaatgtgtagacagggtcctcgggtcttttcttgtttccaaaacgcggtggcgtcttgttggctgttccgtggcgcggcgagtgcctgtctgaggaacgagatccgcctgccatttcgctgccggaagttcagcgtttacaagagatcggcgctctggcgcatgcaggccgcccgcagacaacttttcgcggaagagctccggcttcacgaaatgatgcaactccctcgaccggggacgccccgcgtttttccggcggtcactttgcagcgacggttgccacaatttccgtttcttttccggttatttttcgtccgttcgaatttggtgaggacgcttctgcggaactctccccacacccgtctgtcgagacagcacctccttcgccttcgcgtcactcccgcattttgttcccacccgccgttctcggtgtgtcgggagttccgagttgtgcgctcctgcagcattcaactgcagagaatcctttcttccgggcgacgcaggtctggttccgcagcgcgcagcgttcgtctctgtttttttgcccttttctgtcggccctttctcctccgtttctccactcaaga

SEQ ID NO: 3186 - DNA, 1457 bp, Toxoplasma gondii
gattttctcaaagatcattgggtgcaacgcgatatggcagtcgttgcgggccaagaaaacgaattctacaaacagggtgtacaggggaaactgctcgcacgcgataatttttgaaatggaagttacccttggggcagtgctgcttcatcttgcgcaggcatagggatgtttagtatccgacacgatgagcctccgggtgtctgtttatctgctcttcagctccagtgtcggatccccatccgcggagatagagtacgaagcggacgatggggcgaccaaagtggtcatggaagaggagaaggaaacgctggtgcccgtggatgacgatagtgatatgtggatggagtaggagcactgacgctttgagcagattgcgctggtccagatcgcacataccagaacgtgctctgttttctattggtgtaacgaagcagggaaaagcagcactgaggtaatgcagaggaagggcaattcgcccgtcaaacggaacctctacttgcagatctgcatcaaaggtctccggacagcagcacgaatccaccatgttggaaactatgcgcggctttattcggtgtttacacaatttgtttctgttcgtgtgcatcaatttctagcctctcttgtctatcactgtcaagcgaaatgtgtgacaatctgtcacatcgttagcactttgcccatattacgtcatatcgcgcctgcggaactgcgacgactgcccacggtgctgcagctcgtttagtcgttttgaaacgaagcaagacaacactcacgtatgtttttcagatgcagctaaaagcctctacaggtgctacgtgatttgtgttcgtcacagtgtgcgctgtcctgtgttcaataaatcggcatttctgacgcggcggcactccagtttccagactgtttgtttttctcggggaatgagtcggcgtatgccagtgtcgtcagcttcatttctgggagttttccagatgaacgaagtgaatttgtttcagcttgtctgacgaacctctcgcgtggaattcgggacgttcatgcgatgccgaccattgacgcgcgttcgccaatctgctcggtgaaaaaccgggcattcgatcgacggtgccgttcgttacaacttccaacttattcttagtcgatgcagtttgcgaccacgccttggatagcacgctgcttcaagatacgcgagtggcagcttgcgacacacgtttgaacttagtaggagaccggcactacgtgtgcaaagtcctgcgtttagttctacagctaagaattcagttgtacaactggcatgcagcaagcccaggcacctgacatgtttgagcaataaacactccttaagttgcgccgatgcaagtctccacacctcggcggaaccgcagcgtaaggctgtggaacggaccgtgcgggatgtcgtccgcggacacgccagccaaatgtggtagataagaaacacggaa

SEQ ID NO: 3187 - DNA, 3916 bp, Toxoplasma gondii
agtaagacgcgcctggagtctgtttcctctgtttctatttgatatctcgaacggtgacgcgtttgcagcgaaacgctcgtgtgtacacggactttcgaactcaatgttggctcaaatacttcttgtttaactacgtttgtgtctgccggtgatatgccatatcgacggaggggcggagcacccgtcgtgcaaaatactgacactgaccagaagaaaatggcatgcacaggcaaacacacacatggtttttccgagaaatcggcactgcatggtgcaactcatgaaccgccttcagatgtaacaacccctcccgaaggagatcgtactgcgccatgtagcaggacgtccacaatcggaaatattcagaggcgggactggcgacctatacacagagacactgatccaactatgtattcgcgtggatacaggggcgacaaagggatgcgacgcacacacatcagttccaggggaaaatatcgacagccggttcagtaatctggatactccatgcgcctcttgatgtatgactccttacactggaaagcgaaataagtgttcgagttttagttggttcactcatggaaccaccacaggaaggccacgcttcttgccttctgtattgtttactctcgctgttgttgggtcggcgtgtgttttgtcaactgggttgaaggacgccacggacgcttgccttgtgccgactccagaggaaccttttgctcttgaacaccacgccaggggtgtccccatagcctgaagtttttttaactctttgacgctttgctaacgaaataccaagacctctaatcaaccgttctccgaaacccatcctgctcgcccacacggttgccacgacacctcgcggccgacagttcccggatcgttattttcatgcaaataaagcagacatgcctctaccactgagacagaccctatgaatttgccttttgggtgcccaagatatttttaagaggatatgacacctgagaggagtggaagagggtggcccggttcgcggcgttttaggtgccgcgaagaaacagcccagcgagggtagcgttccaagatcatcgcaaaaggcgacttttgttgtttcaccgaccatgttctgcactgtcgtgacaacaggtgttgcaataagaaagcaacacagtagggaacatgtgcccctttcctctgtaggaaagcataactacacgtacacgcaaaggcgtcaactgtttccgacatttgctgagtgcgtgtacaggcaatcaatgctcataacagtggcatgcgtgatgacgcacctcttcgatatatatacatatatatatatatatatgaaggtgtggacgttttgttttcagttccgctcgttgatgggttgaggctgtcttcttgactgggaccatcgattgtagtttgggaatcaagctcagctctaaggttcagccattgcctgcaactcccaaatgtgaagagggtttccttcgttttcaaaaatcatctttggggttcaggattttataggtaactctctgtttctggaatatggaagaaagcaacattcacccacaaactgttcgagcaacagacctttctgccgcctcctttcggctgtagcctaaccgacacggagcgtgcgactgttagtttgctcgtccttccaccagctacacttccagctgtttcccgctctgactgagtgatttcttccatgagccacactgccgatggctgacaaacgattagtgtttcagaaggcctcaactcttctgtgtctttgtgtcacaagggtgtaggaacctcatgcatgaagaaggatgtagctgcgatttgaactgtcgtgacaaggcaagcgtccgtgacagactgagagaagagaaacttccgcaacaagacggattcgagtgtcgctgtgtacagttcttgtttcgtgggcaccgaacaggaggcatattatcaccacagaacgaacgagcgcgttctacagtccgggtttcttaggttcaaagggcgagaacggagtgtgcgcttgccagcaccgattgctcggaactcgacaaagctatggattgcgtctgctatacgcctaacctttctttaagcgacgaacccgcccggtccagatagactttttccacctctgggttaggttcacgcgaaaggcaaagacgcgaaagagaattcaagttcgtccgactcactaaccttccttttcaaatgtgtttgcgcctctccggtttccatttcgtggaagaagccggcgttgctcgctttctttcccagtcgaatgcgacaaaacgaccagagactcgtgtcttttggcgagtttcgtgaggaagacagttccttggtgagtcagttgtgcgtaaacggcgagcacggtgggaccatcaacgtccggcaaaacaaacatcttaccgggaaaagccaagccacagagaggcactcgcttcaccgaagtggcactcgacgtcctctgtttttctgtccacctcaccggtgagcaacggccagcagtgtgccgcgcaactccgatcgcgttgttctcgcagcgttttcgcgggaacgaaaccgaccatctgtgtcgaggccgcttagatgcgttttgcactttttctttgcctctgcgacttaaacgaccgctgcaccgtgctgagcacactgccatttcttttatgactccctgcgcgcggttctgaacgagcagaaaaaggggagcatccacgcaagtgccccgaccgacttccgcgttggggccataatccccccgtgtaaaacgggtgaccggttaccgctactgcgtttttctcgggcggctttctttcgagagacagcggacgacacccaacgaaaagacggcctttacgacacgatgctccatctggaacaaaagttgtgaggccccgcttttgtcgctgaggaaattccttcgcgacaaacaccacatctctcacctagcgccgctctgtccccccagagtgcgcacattcaccgagacgctgcgtgttagacttcctcgttttctcagactttccacttttttcctcttcggttccttgcagacggaaccgcctgcctttttgtggcccgttcgggcggttccacctctgggaaaactacggaccttgctacggtcgctccctgccggctgtcgaaactgtcggtttgtttcggattccttgtctcctcggtgccttcacgcgaatcctgcccacatggccggcgtcaactgtacagaactacatttccgtcgctccccttcgcggccgatcaaagaactggattagcgtatccactgtgcatgttgtatgcgtacggcagcagttctttgtatgtcgcgctccgaataggtttgctaaatgtgactctgatagccaacacacgggctcggccctagagtgtgttttgtgccgcggctcttcagattattttttttgtcacagacactctcctcgcttctcgccgaggcaatgagtcgcctttttgctttgcttttgcgagtttgtttgccgctgcgtcagcatgggaccacagctcaggttgaggacagcgataaagtgttttttgtgagcgcgcctctccccgtctaatagtggcggttttcccggaccttgcctgatttctcactttttcgcgcctaggtctttggagtgcggccgtcgcccagttggggtctagcctcctagatacccaacgctccctttctcctttcgttccgcgcttgtcttcccttttgtctggctggaacacgagggcgcgccgttctcgagagcgaagcgggaggaagcatggaggctctctggatgcctcgtggtcgctgccgccgccttccaagtcttccgcctgtctcagcgcggccgctgtcgcctcgcaccaagaggtaggcagcgactccctgctagcgagaggccgagagcgcaggtctgca

SEQ ID NO: 3188 - DNA, 1492 bp, Toxoplasma gondii
gaacagaacgaagctagcggcattcgtgcaacttttctgcaatgaatgtgtacgagcatttgtctctacagactgtctgcccattggctttagcacgcaaccgcatgttttgcgtataccggttgctggaatgtgcgactcaacagagttcagtctctttcaagctggcacacgtcagggtctcgatgccatgataaacgcaggcgaaggagcggatacagctcataatcctgtgttcccggtagacgccgtagaaaaaccagcataatcgtgtagtcttggactgtgtagactggacctaaactacttaattgttgtcagcatcctgtgacctggttatcgaagcatcattttcttttaccaagcgcaacaacacagcgctgaggacccgtgacctgttgacgaatattagtccaggggtcacttcagccacgtttttgcttagtgcgtacaagcccgcttcctttcgaacctctttaagaagcctcgcgaggagaagaaacaccattggtatcagaagggcagcagtctgaagtcttctggttggcggctctgtcgctgggctaaggcactttgctgaagccctgtcagccttggacattcgacagcacacgcacgtccacatgtcgatttcgtaagctcggtcatcgcgtcgcatagttcttgttctatgcctctacgcaacagctggacatttgggacttattggagacgtggtgtttccgtcttcagcttgtgcggatccttggacaaatcctgcttgcactggttgagccacgtaaacggcacagcctcaccactgttgcaagtgtacaaccgcagaacaatagtgcccgaactgctatcgtaccacgagagaacagaggatgcagaataagcgatcaactatcacattttcggaaaactaggtatcttagtcaaagagtttttaccaccattcttcctggagctgcgtcgaatgacgagagcaccttcgccttcagaagtccacggctgcttctgcaagcgattgaacgtatggtgtttcgtgcaaattttcatcagtttgccgaatgattacaatttcagctctcacaacctggtgtcataattaatttcagtcagatgagactagattttgcaagtgatgcttttcacagtgtgtgcacttgcacaccagattgattgtgtattacaagatagagtggcgtatgtgtccaagccactgaatccctcattctggctctgtattgtctaattaaggagctgtgaaccgatattttcggataagtgagactcgtggcgaccgagccaacactacagtgcaactcttgggacacaagcatggcagaggggctttgcagtgatcgaaatccaaaagaccaacatccgagccctcgcttttgggagcttttaaaatgatatttggaattgctgaaggcagaaatttgctgcagctgttcacccagacaacgaactcgacaaggcggatccgtgtccgaggctcgacgag

SEQ ID NO: 3189 - DNA, 2182 bp, Toxoplasma gondii
aagtctctcgtgtttagacgatgggcaccaaactcagtacatttccttttacattttttgtaaaggcaacacgaatgcacggcagccaccacaatgtgtactcacccgaaaatacgcccagaatacctggtatcagtgcagaacacagtaatgggacgttcgccgtgactcgcacagttgatggtgcagtggctgccggcagtgggttattcgtgacagttcaagagcggggtgaaagcaataggataaaaacagcggaaaatttacggcactcatcagcctcccttaccggcgcctgagcaagccgcacgcctcctgagaatgtgggtacccacggggtcaccggacgaaatgccgagctttggcggtcgacggatggtgacgccatctggcatgagcaaagagcctacgactggctccgcaagcattggagaggaatccgatttcttcccttctgcggaccgactataaactgaagacagtgaaccgaagatgcctcgcgttgtgcagcctctgcccagctgcggagtgggtgcggaacgtgtagaggaaggcgttcctctgggcgctgaggaaatggttgatgtggcaccacgccggcgatgtatgccactgctcagcaaagaaaccgagatatctgcgtggtcatccagtgacgagtcgtacggagacgtgtcgggcggctgaagtttgatgctgagctgctgtttgggttcctcagagttactaacaggtgagcacgccgcggtggaagaatttttacaaacctcacgagctgcacgcggccccggagtgggcgccgtgtgctgctctactttgctagccatgtgaaaataaaagtgagcgacaccaggaaaagaaaacgtaccactctacttcgacacattcggttcgtgcgataagttactcggtcggggagcctacgcgtaacaacagagaaatgcaatgtccccgactaaaggaaattcacaatgacgttatgtggaaagaacgacaacgggaaaaggttttcgaactcatggaacgtaagatggcggcgatccccctctgcctataaaccgctgctttgattcaggcgggtagcagaccactgacgagtgccaaccacgaccgatgttgtttaggcttaattagtgcttgtggtgcactccctaatgacgacgagctcaaacatgacagacagcatgtgcatacgcaccacagcagcaatacacctgacatggagagtcaacgaatatgatgacgccttttgctccaccagcggattctagtacctcggccagttattcgggaaagttatgcagcattataaaggatagtgtgtgcgttggaaagtgctcgtcaagcattgtagatatcaatgtgcacacacagtcaaactgagcctcgccctttgttggcgagtacgcatgcccgccgctgcagttgcatgccctttcccaacgatgcatgtctggctttcccgtgtttcctcgtgttcgagcttgaaaatcagcgagtatcgcgaccgggacggccccttctgtgttcgcccgtagccaaatacgttatgccggaagtcaaaagtacaacaaagtggacccttagtaatttcactcagttggctttatggtttataagcaccctaaggtcgtgggcgaggtgctcgccgcaacactgctcagcatccacagtttctgcgcacttcctttttggatcgataacatccagataaccatgacaacaacgccgtgtttcgtaaaaaagctgaagtccagtctcatttgtaccaaaaagttgactcatcttacaccgcagcacctgattttgccaatgacaacagtcattttcggcagctgttttcagacgtgagtgctttgtagacacgatcgttgctgtgacgcatccctctcagctcagactttccatttctacacgaatccctcatcactgggaagcaaaggaacacctggtcccagtgagcgtggggatgagtcgtcctctgagtcagcctacgtgtctctgtacgtttcaccaagcagtcaaacacggcagcgtctggtgcgtcacaggtaggtcacctgtatgtacaccggatgcaacggtcccccgacaaaacactggataggtatggtttgagagtgttgctgcacagttcccggggtagaaaacggaagtacagtggagcactgcaggactgcaa

SEQ ID NO: 3190 - DNA, 3053 bp, Toxoplasma gondii
gcaacctacctgtagatccctgtactctgctcggaacactgtggttagcggtgcaggcaactgacaaattgaaggtcttgcacctgtaggaagagttgcgcgaccttggggttgcgaaccaaggtttcgcggaacagagtgccagatttgggagatttgacgaatttgaatatttcgtatcgtggtgctggtagtcttctcctccctcatatgttagtctacgcggcactgttaggactacctatatggacgatggtcgattcggtaatggctaatctatacccagtggtatacaacatttcactcttttgttgctttaccagtgctatcgtggggccctttagtcaggataggtatagctctcttgctttttcttgccagtcttatggagggaaaaagcagtctgttccctgtccctggctctcgcgcgattcagaagaacccgccgcagactcccgcttctgtagttaaaaaacaatgctcgaggaatttccgatcgagggggagggggccagtgaaataaagagcgaccgagagttctgtgaatggttgcttcttcgaagttgggaaaaagttcagaaggatgcgtttcaaaatcctacaccattaacgttggtccacatcggttgtgtgtatctcggcgtggtgggttgattccaaactcggaggctcttgattgtgggtcgccaggaggacctctggaagtttatttttctaggcatattggatgtttcgtccaaagtgaagaagtagaacaaacttgagatgttacagcaatctgaagttgcgtttttacttggattgcatagcactttattagaaaaatctggtacctattaaaagaggtggatcggtaattcacgcgcaggccaaactttggacatgactttcctcacagtcaagtccactcgacacagagacggtttagtgtttctgcatctctgattcctcctgaaagaacgttagttgtttcaccagaaaagcaattctcatcttgaaggggggtccgccacagatacaacgtatttgaccgcatgtgccgagaaagacaccttgtgtcaagtttcgtagaagctctttgccaatgaggaaaaagggacttttctgaaactaactcgcgatttggaggttcgcaggtgtatcctggaaacgtctgagcgtgtaccggcagacttttctggggaaaacactcgaggtcggtggacgctttcgagtgtcgcgttcgacttccgttttcttctgattctctgacacaaacctgcgacctactaaagtgttgtctcaaacaaagaatgacagagaaaccgctgtcactgaagttcagaggtgaacgcctgcattcgacagtcccatggcacatttgaactcatgaagagcacgaaaatacactcttttggaacccattcgatctttaaaaaatatggaaatctaacacacccaatctgtcttgaccagtccagtggcgtcgtggtgtacacagcagtcataaagaacttgattgtctgtgtctcacagtaactggagtcctattgggcgtctcaggaactctggtgtctctgttgaaatgttgtgcagtccacgcaccggaccccatttttcggcccgcggagcgtttacacaaattcacgatctcctggaagtgagaagagtacaacgtattgtagcgatgatgtctgtcgtctattcatccgtgaacatgaagacacaccgcagcgaggtcgagtggatttcaaacgcctgacaaagaaggcgtgaacagaacttgaatccggtaaaaacatttttttccagatctacaccagtcgtacagacgcagtctatgaaactccccagaagaagcctccttctacggtttggacctagtggctttctcacagttcaagttaagaagtcctctgcccatagcttcgtcaacaaaggtgaaaacgaggttcccttgtctcggccacgaggcttgcatggaaaagaagatgcaccccctcccctctctctagcgtcgtccggagtctaccatcaactcggccttgacaaagaagattccccttttctcttcttctgcatttcatttatgccacagcgcttgcctgtgtgtgcacgcaactttctcctttggtgtcgagatttaaaacatgcaaaaagaagacagaaggagacacgctgggctccaatatctgggctgaatagccgtccatctccacagcgcctctcgctgggtttcccaacaagtttcgccatccgctaaaaactttgttggccgttctccacgggaagaataaactcgaaaaaaagagttcgcttgcgtgcttccaacctgtcttttcgcttttgaaaaccgtgtctcgtctgtctctcagtgtctctgatttgtgtctcctcggtcgggtgcgcaaaatcgaattcaagcggtctcgcacaaccatcgaagccgttttttcgggacttttcccttctccttcgttaaactgcagaaaaccgacactggcgttcattttttcactttttctgcctcggcctgtcctgtcgagttgccgcttccacacgttgaaacatcgagacactttcctttcacaagacagagaggagactttgcgcttcgtcttctctcgctttcttctcttcttccctcctcttttcttctcccttttgtttctccctctttctccatccccttccacgcactcagctgtctctgaagcgttgttctccgccacaaacagccctctgtcgtccttcccctgtctcctgaattcccccttccccgtccgtctctgctggggctcttcttgtctgctttttggaaaggcggacagcgtcggtttcacgaacatgcgtgctctctctccgtttccaccttttccctgtcgccttcgctcgctcgcgtctcggatttcttctctcgcacaaacggaccagcaggagcaggagagcagagggcctcggggcgcttgagacagctgaggttcacggcagagcacgactggacggacttatcagagagaactgtccttgaaaaagaaagcaaagcgccatacgcccagagtcgagatggcaaa

SEQ ID NO: 3191 - DNA, 2629 bp, Toxoplasma gondii
caagtctctatcctccgccagggtggatgtttcaatactccgctttgttcgacaggaaagaggtggactcctcacggccgcgccgctaccgtgtacgcgaagagacaacttagaaaagcgtactgcagtccataagggataccgttctgaaaagagagacccagccttgttgctttgtttgtacgtttttcctcggcctactgcggcagtcctttcgaagagaagaaagttcagatccgaatgtctctcagctaaagtattcatatttataatggagtttcactcgaatgaagaaactctcctcttttcttcttgaagtcgactggacgttctgcgccgacccttcctcgtagcgccagctgtctcattttgtgaaatccaggatcaccacaagcagcgcgatacgcatttctcgagactccttcgtgaatccactctatagagttgacgtaggtagataaagactgaggtattcctcacaggcgactgcacacacacatgtctgtctgtagaattttcagtctgtttgtccgggagctttccgctatttggacggtgtgggggtttcgtgtacgttcttcgctgagtgaaacactctttgaaaacttcctgaaatggaatttcgattctttttctcggttcctcagagtgtcttcatccgcatgtctcgctttagcaagcgtgctgaaaggcacgtccagttgagaacacgaatcgaatttctcttcccgcacacaaggcgtcaaccccagtacagcctttccgcacacatgtagcccttttccactttttgtggggggaaatctcctgagaaatgttcttcctctgaagaggagaagcgagaccctacgtgaggagaacggcacaggaactctggcaatggcagggccgaggctatcgaaggcgcagctggaacaattcttttacggcttctacctacccggctttccagtttaaggtcagaagtccttcgataattatacagtcttagcgtccaacgcaaatgacggagtatcgactgagtagtacagatgcaagaatcagcttttctatgggtgtgtgcccgctagacggtctattcagtttgaactgagtcgagcggtgtcgcgacatgcaaagtttgtcgagaaaatcaggagttacgtgtcaagtgacgtctaaaagacgagacgcgcggaaggcgtccgtgtcgcagccgtttttaagttcttgtgtccacgctttgtcactcctttccgcaattctcaactctagccagatacttcgcgtgtccccagtgaacaaccccacccgagggtacacgatctctggttcggatgctgcttctgtcggctgaaaaggccggcaaatgcagaaagtgtggagaaaacaaagcaaacgggttgtaagctgcacttcacggaaaagggtcgcaaggcagcaccgtcctcaacacggaaaatgcgaggaatgtaaatcgaccattgccagtatctgcacaaaacacgcgactcacctgtcaactgcaacggttgacgagacaggttttgcctcggtaacatcacaagacagaagtcatttgactcggtaaactttctgaatccccttttacgcacttgctcgcgacttcctttgcaggaatacgaatttaagcaaacgttccaccattaagaaacgaagctgcacatctcgatcatgtcaaaagacagaagttgtttgactcggtacattttctgagtctcctaactttgttgctcgcgacctgctgtgcaagaaagcgctagcaagcgcacctacaggttgaaggtgaccgcagtcgttgcaagacgagaggacactgagtgttgcgtaaaaaccgttttctcgcggtagctagctgagggagggccctaagctttggatgggaggcagacggaggcgtccgaccaggaactgaagaggaatttctaaaaggtgtctgagatatcctcgcgaagcagttggccgagcgttttcgtgcggttcctatacgtcgcggcaagcgtcccgagcgctggcttgtccgccagggttttgctgaagcaccgtccgggcgcgactctgcagtcgcggtcgtcgatatttctgcggcgttttccgacagaccatcttcttcagccttgtgacttgttgtacactgcggagaaaggaaagagactctagaagttcgtctttccccgacggtttttcgtaccccgcgaccgggtgtctttgctgcgttgactcgcgagcgacgctgtaggcgcgaccagccacgacaagggcgccggtcgcgcaatttgcagcggtttcgatttcgccgtcctgtcattggcaagaacgcttttgtttccacaggatttctttcttcccggctgaccctttcttgctcgtttctaccgcgacatttacactgcgtcctcaaaccctctgtttcccccgaaggaaaaaacgatctggagaaagccgcgctagttgccttgccgcgatatctttgcgtgggttgaacgcgtagcggagagcggggccggcaacttgtgcttttcttttcttgcatgtctcaacgcctcgcgaaacccaagtttcccgggggttttctgcccttgcagctcgtgccgcggcgctgccaccttgccaactcgcgtgagaaaga

SEQ ID NO: 3192 - DNA, 2422 bp, Toxoplasma gondii
aaagcttttctccagagacacgcgagcagcagggaaacaaagtagcgtgagtgcgaaaaaggacgtccatagcagtctcggctcagtaccactgatggaactcggaattgttcgatatggagtggaaggagtcgaaaaggtggtttgttttccaaaaaactcttgtgtgcagactgcgggcaagtcgcacgccggctcggggttcacgtagacgggtccggtcgtttctgagcagagcagctgagtaatattggttttcgttcgacccaccaagaaggtgtggccgggctgctgagttccggttcgtgttttcgcttggggtctgccaacgcagaaaggtcgaagcgttcgtagcgaaaaggcgtgtctgccgaaatcgactggaacgccgttgacgctctgtccagatttttgaacatgcgcgacgccctccggcaaaagttccagtctttgctctgttcgtggatccgagtcgctgcttttattgcgtgtagaagtcgagtgttgtgtgctccggagaattcgaccagaacagttttgtttcactcggaagcacctgtcgtggcactctacgttttgactcggcgtgctgggtgtggcagttcaacgcgttattcagaccactgggtccatcacaaagtccaaacgactggcgcgtccatgtgcctgtgcgacgagtcgcaaaacgcgactttgttagtggtatctcctgcagaaaggccgatcacggtgtgctagactgtgtccgcgccggccttttcagagtgcccgaccgtcggggagctacgcaggagcaacgtagagatttgcgaggcgtgtctagactggctagaagcgaacctgctggttgtgtacggaacaccacagttttagttttttcgccgcgttatcatccatatatatatatatagtcggagttgttgcccctcctcacgcaaaacaattcgcgatgtgctgaagccgcaacacgacagacgaatcttgcattgcagtccgccccagtttttttgcagtgaagtccctattgacgaagacgtcccattctcctgttctctcacacaggcatccgccgcccgagcacacggacgttgcggtgttcgtcggctccttcacactatacgcaccgtgtcgctgacgtaacctattggccatcttcagttatagttgcgttcaaaagaaggggaaaacggttctgaacgcttccgtctgctggttgcgtcagtaggtccgctcggccttcttggcatgcgcgtgttaatggacgcccaccaacctcctgcgaatatttgtgacagcagatttaggaggttttctcgagtttggaagtctttttgttctttctcgtggtcctctatttgccagagtctgcagaaggggacgggtaaggctctttttgagttcctgtctctccgcagccggttttcacacgccaatttacgtctgtgattttgcgcgccgagggttgtcgcgtcttgctctgtctttgcccgattctagattctcgtgccgccgcgcttgcttggtctgccgctctctcttccgaatttctgctgctgtaaatcggttgctaagaagcggtgcatttccttcttttctccgcggccgcacgacagtacgagacggcaccgtttccgtctgactgctcgcacagaagagtctcggtgcggtccggaagttcacttcggagtaggcgggacgcccagagtgagattgagattgagtctcttttctccaaggaatttttctacttcgcatggcacacgctgctgactaaggcctcgtcgccttagactgagaagtgaaacaagcaccacccgtgcaagggttgatcgtgtccatctgcgtgtttgcgttgataaaagccgctcgttccgaaaggttttcctagcatccactttccaggggaaattcgcagaaagcagagctgctggaatgtaagcagagataatatgtatctgatgtaacattgaagcgattcttcgttttccatcttagggatggaaaacgtcggcaaaaagggcacctgtctctttccagccgacccctttcggcggttcagcgtgttggccttttgttctgatttgcaagccaaagaccgccgttctctggggcggctgctccaacctcgagaggtggagcaccagggttccgtatttagatttgatttgagttctaagagtaccctggcggaaatagagctacgcgtgtgtttcagtacttgcaggagcaaaagggaacccttgtgcgtttttttcgctgcaaaggaagccttgctttcgtcagagtacaagggtcctgtttctttgagaaaaccgcacgcgttacgcgggcgaagaacccctgtccgcctcagtgtccgttccacttccgttattatttttttcctttttcgagcgtcctacacttttgcgagacgaggaga

SEQ ID NO: 3193 - DNA, 1081 bp, Toxoplasma gondii
cagtgaacacactgcaagacagacgtacgcagcttatctgcaacctcacacaaccttgacgaagccagacagatatttacacacaacaagaaacgcaaacacacttataatacacacactcctgtacgaatagacatacaccgccacacacacacaaatatatatagccaagcacagatccatatatatatatatatatatatatagatagatagatagatagatatgtgtaagtgtttatatttacaagcgtatctatacaaagagggcttgggtatttcgaagagagacggccctttctgggccgacatataggaggtgcggaaaaggatgtttacgaattttttctggaatccaagcacgttcccttctcgatgagagtgaaatttcgaagaccagcgtcgtgaagagggagaaagggaggctgttcgaaggaggactagaaacggagacagttttaggagacacctgccggccagaggaagaggggattcggaaccttttttttctgctccctctcaagaacagataagcaggcagcacatctcggctgcttcgtcgctcttccctctgccgttccagaacacagagagagagcaggagaggcctagaaagaagagaggaggagacataatgaaaccagaaagaaaagggaagcacgaccggagacaggagaaagcaattggttctgtttctgttgtggagaatacagcttgctttgtcgaggtcttctttgctcacgtcgatgcatgcgcgcatgcagtgtgacaaagaagctttttcccggttcttctcaactctctcttttgcgctctgcaggtccttctctctttttaaaatttcttcttctctcttcttctttgctgaattcttcttcctgcttttcctgtcttcttctctggtgtgttctttcgctgcgctctctctcctgttgcctttctcgtttctccggccgtcgtttttccctcgcctttcttcttcgttgtcgccattatttctttcttcgtcattctctgctctttcttatccgtctctccttttcttgtctcgccctagtccctctccactccttccgcggcaa

SEQ ID NO: 3194 - DNA, 1755 bp, Toxoplasma gondii
gttgcatgcagagttcagcctacactttcaatatacatattcgtcgaatgatcctaggacagtgttccagagttgtgttactttcttcgaagagctagagtaacctccatcgtctggaagacgacgtttcaatgcgtcgcgccctaccgccgcatatgactttatctcaatggttgacaagcctcctgtcgatcgcgacgtatttttgcgatcgttggggtgtccgggcatgcattttggcttctagaatggcctgtttcgatgtgagattagtgtagtgtaaagcgtgtcagtatccgccagtcattaccgttgctacactgtccaaattacttgcggaggtcacaagagctgtcattcctggggaaaacatagatgtaggtacttgtaaataggtagtgaagctcaacctctctggcaatttttgagatttagagtcgcagtccattataggaaaggctgaccggccacgtcccgtcccgaaaaaagcgagactggtgcacgcagcagatgggtatgtgggacgcggtgttcgttgttctccactgcattcaagcacactgttgtccgctactttgacttataggacaggtttcgagtcgtcctctgagaagtgaaatgagagaatggatcttcaaaattataacacattgccagtacagagtgaaggcagtcgaatccaaatgcgtcatatctaaaaggtaggaagtgttcttgagccttctttgagcagttgaatcacttgcgggccagactaaagaaaataactaacaaaacgggttcgcttgtgttgatgttctggtcattgtctggacgtgggcattctggctgccccggcggaaccgattatttattttccaacagctagtatgctatcgctgaaacctaaagaagccagtcgttcatgccgttcacgtgtgttgtcagagtggaatatgtcaatcgcggtaaactggaaattacctctctaaacgatacactagatacgcagtatttccacacttgcgtgatgagcggtgcagtcccacctacagtgcttagttcccctgggataacaagaagtatacgagggctgaagatgtcactacgtcatcaataaacgttaggatgactatgtagtatatgcgcttagtctaaactgtgaagaggactctctgtgagggcagacacgttggtgacacacacacacacacacaggtactacaccgacgcgttctgagagttttggtgttccttgctttaggcagtgtgcctcttatttgcaagtgaagtgggaaaatctggatgccactggaatggactgaagaaaaaacaagagactaaatcttcacaactcacaatttcagtcttggcgtatgcctgcctccgtgcaagtctcctcttcacgttactgacattacagtcgttgtctttttcccgtttcattttttttctacatgaatgacctctgatacctcctttctcaatatttacttgaatcttcgcctttttttatgttgatctgcgtcgtgcagtcgagtcgcggatgtcggcattggtgacagttttttctatgtgatgctctttgagcaggattggcttcgtgtcggtgtcagtttatatatccgtccgtgtagcactcaataatagaaattatgcgccgatagctgtatatactttcacccatcgtcttaggtagctttctcctgtcgtttcattccgtcacatagtcagtcggcaatttaaaccactttcgcgagagtaccccaagaagca

SEQ ID NO: 3195 - DNA, 4928 bp, Toxoplasma gondii
ggttgtgtgtaagcggacgagacagtttaccgttttcttcttagccgcacaactgagggccttcgccgacaaataaaggataccagatcccgctggacaagggagtaacgtcagggtgaaggagagaatgacggaaagaaagaatttgttggacgtttctttccatgtatgcagtctccacagggctacaggggcatcgttcacgcaattacaaatgaggtagcagcaagctacacggagttccctccctctctaccggaatgtacaggctttgaaaacttgaagaacagttatagcggcggtgatgcgctcacccctaaataagtatcgaccgccaacagggaaagatgacgtggtggactctaaaagagcgacagttttggcggatcctacccgtatcctttttgacctgtccttccgcgtaggtggccagtaaagtgtgcgcctctgaatgcagatcgttgccgtaggctcccacgctgctgatggcgctttgttctgtacacacactcccgcagtccgttcatcgaagggtggctgccaccaccggatctgtggtgccccaactgtagacagactagattgagaccggaacggtaggacctccgaaacagtttttggaaaagaaaggctggtcacgccgatagcaatcttcgtgagtctttcgcgggtttgatggagtccgagagggccaggtgaaatcaaacccctcacgaggaaagacattgctgcaccgcaccgcttgtcatacgggccctttgaaggcaaacatttagagctttcacaccacgtgtcccgtgaaaagaagatatttgggcaatgcaactggtgtgccggctgccaacatgccaacacaacgacagtagttcaagtggcagctgctatttttccacatgaagtggacagtgcccgtcacgcacaggagcaggtatttttaaagtgagttacccaacgaacactgcggaggaaaagaacttgcattaatgtgaggcccgagcacattgcttggtagtatcgatttctgtaacgggcgtcttatgcgcatgctgcatgcggccgctgccagcgcacggcagacgaaaaaactgcgtctccacatccgcaacacggctctgaacaccatcgaggccctcagtccctttctttctctgtgctttgcagtgttgttcaggagaccgaccggagtgtctcctctttaaaaaattagtgaggaatgcacaaccacgaaaactgtaagctccagcggggtggtagatgcgatttcgaggaaaagcgaacgtctggcgagctgctgtctgtacatcgcagttctcaacaacctatgcccctaggtggctacattgctgcacgtagcacgccgtgtacgtgcatcgccaatagagtcattccagaagagttgacgtgagccactactgatcacgcagactggagctgctggagtgctaactggattagataacgcggaaccacagtttcagtctcaatggcttcgtctgatggatcagatgtggagactcaaagcctcctgaacagcggtgacagaaccctcagaagctggaaagacacaggtgagtgaagtgcagctgccatctcgtatttgctggtggtcatatgccggtggtcgcagtattccctggaatttcatgggacaagtcagtcttttaccttcggtactgaattcctctactgcagcccatgtttgtaggtccattgtatggattacagttgcacagatcatcatgtatattatatcatgcgtgctatcgaggagctacgaggtcaggttgtacacaggcagtgcgcgtatgacacttacatagaaatgagaccggttcagccgaacgaacggacgctcatgctcctgggtgccgcttacgcacctgctttcaggtttgtacactcttcgccactgcctaacggatcatggtaatcgatgccgccatcagcaattttcagctctggagagttgttacccctctgttcctacatgccacaattttgcacttagtgcttaacttggtatttatcttggtgggtccttcgatttggtggatggcaataggtatctaatctctactctctacagcatatcagccttcgtctggaggaacgatacgggacaaaaaagttcctggtgacctactttctttccggtgagtttccgaaaagagcgtggaattagtgatgtgcacacttccttgccaacagctattgtcggaaacctgctgtctatgttgatgcaaccgtgggccttagtaagctggtcagttaaagtaacgtacacgatccggatgaagctgatttcgtgtgttgcttgacagtcggtgggtgctagcactgcaggcttcggtaagacttgtttccgctgaaaaagaatggcgtttccatcacaggacatgccacaggtatcattggtggcatggcggcagaggtcagcgtggtctggtgcaagctttccgaagaactgaaacgaatctattctatggacatttgcattctcgctgtgttgatatactttttgtcgtttgggcgaacaggtagaaggttcagtacttctgttgagcgaagttttgctgcactaaatttttgcagtggatacctttggccatctaggagggttcctggctggcgtagctttggtctgctactataataaagaaatagaggacctgccgaagtaagatgcgtgataccgtattccgccaaggatttcataattgctgttgatatacaggtggttccgtgtgttgttctacggatgttccgctctctgtgccacgatacttgttgtatcacccccccttttgctcctacgctacccataccgtgtagtaaggcttgttgtattgcgagtttctgcccgttgtccacatttcttcaatcaggcggctaccccgtgacatttctcggatgtccgactacctcccttggccactaaccgactacctgaactacgcgcgtgagcacttctgcaagtttctaattcactacagctgcctagctgcggaaagcagtagctcgtatcgaatcagaggtcgtgccaatatgactgttgtgcagcaagcctaagttgtcggcgctctggtgtattctcgtcgcaactggccctgccccgatgccgctggggagtgccttcggcaaaaactatcgtttcccaaaagtaacaattgccatacgaaactaactatgaacagctcgctaagagagcgtctcttcaatagaggagtctgcgcacctgagagcactgcagtgttgttcccttagcaaactatgacgcttcttgtaccagctcggcactgttgcgctggctgcaatcattttatttgcatgagcaattctcgcgtatgaagagtattcgttctggcctactgcagcagacatgcacgtgccctcctcaactgacaactacagcaaaaacgatatcttgaatgccatgcattgtgccccacttcacgccctctgtcgacccttgtcgactggacagctgtgactcccaggcatgccaatgcgataccgagcgcttgcgcagaactggtgacggttcgggccttccaccgaggagaaggggggggctccacgttacaaaaggcactcccttgggctctccagtaaggactccggtaggaaccacttgaaaagttaccggcaagaccgtccaccaggagctgaaaagcttcagctgggtgttgctgaactgtgggaatgcaccacaacagtggaacctctcagtttgaacgccggtagagtcctgctcggcgcgacgcatctcctgttggccgctagcgctgccaactcgtgccaccacaccgaatgaccgaatgtgaaactgtacggaccctcccagctccatccactgcacgacgacacccttgcctgactgcgtagtcgatccaagtacaaagcgacacgcgagcaacatgagataaacgtatctgaccactctagtttgccttggcgagtatttttttgacgacatgtgaggtgtctacttttggaacgtttccagcaagcggttcaattgaagagacgcattggcgttatttcgtgcagcttccgtagctcgtcgagcgtcttgatcctcagtcgcagacagcatctcagtttccttgtggcatgtgagcgaccgattcagtcaccgaacgggtttttttgtcgatacgctgcgtgccaacaaattcaggcttcattgctaggtcgaatgagccactggatgccagtcaagccccgattcgtgacaactgcgagtaacaccattcgttcataggaagagccagcctttcaaaagtatctatcgtcactcccccccaggaatggatgcgtgacatcggcagaaagtgctggaaaagtactcgtgtcactgttagtggatttaacattttcgcgtccatcgacgatgctggaccttcattttccgtttgctgccgtcacggcttctgtaccgtttgctgcagttgctgcctgcgtgtttacgcagtgttcctcgctgagagcttttcagtttttccattccgaggctcagcctctgttgttcagagctccaattcagaccctcagcgactaccaaacgcatgctcattcgtgtggctgaaggcccgtaggtcgccgcgacgctagctcgtcggacaaggcaacagcgatattaacttactgactttaggaaccgtgacccgcgttcagggggatcctcacaacggccgtttcaccttttggtgcgtccgacagcgcagacgggcgttcctgtatgaatttgaccagaacttaccgggcggactggcctgagtgtgcattggcagtttctcatcgtgcggtgaaaccgccgagcatgctaacgttcttcttggaagctgatgccggtttgtcgaatttggttttttttttcgtttcgcttcttctgccaactgacagcgtgttctgatgccccgccggta

SEQ ID NO: 3196 - DNA, 2111 bp, Toxoplasma gondii
gacgcagagtagtggacccttttcgtttcagatttcaggtgtacagacactcggacccgaatggtgcgcttggcccccctgtggctgacgttttcctttcacagcatttgccaggcagaagaggcagtcaaaaaaccatgcagacatctcaggggtctttacttgcatgaagcagtacatgggaaattgagggatcaaatttttcgagactctcgcactttttgacagacggcacttgagtccactggcagccagatacacggggagggcgcgcctcgtttgagtgagtgcagaagccaggtgccatgttggaaagaggcaaagcagccgtcagactcacggggtcgggcggaagatgaattttcatcagtccgtaatatgctttgcgtacatgtcccttatgagaggtgcttgttttacggcgagcaaactaccgacactctcgtaattcttcatggctcaggtacagcgtatttcattgggcaaacacggtggcgttgctgcgcttactcttttccgaaaaaacacccgtgattcggaaattgtctatttctacttactagtataaatttgcctctgagcagcaagcacagactgctttcgcatgtgtagcctgcgcaacctatgacgccggtgatgaaacttttcacgatcgcggaaacggctcccgtactcccgcgttcgtttaagaacgtaagagctcgggtaccgttatgtctagggagaggccgagactctcgctggagggagtatgtcgagaaaaacgctgatggtacactttttcccagtgtcacttcgtgacagctttctcctcagtccacggttggccttttctctgcgcgagtgcattgcgaacgatcttcagaacacacctgtgtccgcgatgcataaacctttcagcagcgggtctgtcacggaaagaaagcagtgggtcttgcgccgataggctgcaatttatttagatccgccgcgccggacacacaggtcgcttcttacttggtcacggttgctttatgcgttaaattctatggttttcgctgttcgaataactgcatgaaagttcgcagaaaaactcgtggcaaacgaatgtgaaattcttccgaacacagaaccaccgggcaggattaggctacaactttctatctgtatgttggcactgaattgtcgactgctgtgtccgccctgaacgcacttcggtcggaacttgtccgccggattttggtacctgcagtgttcgattccatagcgcgcttacgacagacaagaagaaacagcatccactcagagccagcaacggtttactgcttcggtgttcctcagtgttaccattctaacatctgctgttgtacacttacagctgaaaagctggctgtcaacgggggagcatcggcgcgcggacagcacccggtgccgaaagacgagtggttgaaaacggtatttctactaaagaccctctcaccgacgcaaccatcgttgttgtggccttggtctctttgaaagaaacaataaaaaactgcatattggcaagtcagaaatttctacgtggcatttgactgattccacgcacgttacctgtcagcagcgattgacaatgtactgaaacgcatgatttcttcgtcctttcgcggtcacagtttgcgacatagagacagagagttccggagcagattttgctgacaattctggtgctcagtctcgaaaacgagtgtcgctggcatccggtgaaagccagctcccaacgcgcgggacgaaactacgagttagacacggttcgagcgacagtgcacgatgaagacgcgagtggccccacgctcgccatccggaacgcaaagtcgagccggcccgttttcgggctcccgtccacaatttcgccgcgagtccgaagaagagctagttgtgtctgacgcagggggacgccgccgagcgttgcggaaaaacagggaacccgaatccaacgtgtcttgcgcgacaacttttcctgcaatgcgtcctgtcggtcttttcattcttgtgccacagttcgtttttctttaaagagtggagtgtctacgttttcgggatacccattaacactgcggtgtcattgtttgacgaagttgacacaggaacca

SEQ ID NO: 3197 - DNA, 2007 bp, Toxoplasma gondii
gagtttccgagaacgtcctttctgtctgcacctgggacttctcgagtgactcaccggaggcaacgctggggtggagcgtaaagcgttgcttctgcgggggcggagaagaagcgccgtccccacaatggaggcacagtccatacgcatacacactaatataaaaaatgtcctcgagtctatggagtcatacaatactcttaaatccaatatatatatatatatatatgtatatgtagttgtatcttgtgggtgcaggcgtggacggtgagagggaaccaatcgcttcaaaggttacacacatggattgcgttcaataggatagagttgaactgtgtaaaggtcgcgcgttgtggtttcagtttttgatcgcaagcgactgaggtgacacaaagttgcggttctcgcctctgtttcccagtgcatcgcgaagagcattgtatggatgcagctgggtctcctcagctacctttcagtgaaggcattgcagtctctgcacctcttctcctctcctgggaaattgttcgatcacgttgtttttcagcaagactctaaaaacagatccaccttctctatttttcgacacaaacacaaatgcaggcagatacctacagagacatgagtgtctgtcggtgtgtacttgcatggggactctcggccatccccgctcctctccatgtgattcgaactggttctgggcgtatgaatacctatctctgcatgcaacgactcatcaaatgcccgcgcgtatttgttgaaccattgctgctggcgctcgctgcatccgtatgcattgacatgtacgaacaagtttaatgcctgtcaagaatgcaatgacgaagctcctcccagggtacacacacacagccagttgccgatgtgcacacaaccccatatatatatatatatatatttatatgtatttaaataaatatccatgtgtataaacaatatccatgtatatgagcaagagtcgcggaacgtttgtgtcaggcaccgtgtttagaagctcagaggcgagagcgacaagtgaagagagaggtaagacactgaagccatggtggcgaagaaacgcagcagaacggcatccggcgagcaaagacgacgtctgcggtggaggaagtgcattgcatgcggcggactgaaaatcctccgttttcagagcgagggagttgatttctccggtgaaaatgagaatggagacggagaagaaagcagacaagggagcgggtgtgcccaagcgtctctcgcttctctcgggcaagagaaaagacaggctgctgcatgcaggaaaggctgcgacaggttttttgcgatttccagcctcgcttggagcattttctgcacaaataagggaggatactccgttctgacatcacgggtggcttcctttcttctatctcctcggagacctgaggacttccaccagtgccgcggctctctccggcgtccaggagaaagaaagagaagcgacagagggaaaagaacgagagaacgaggaagaagaaagacggaacgacatttttgcgttgttcgtgtttgaatcgcgtctccttttccgtcattttcctgctgaaactcgagggaactggggggacggcttctcttcgtctttctgagaaagcacctcgagaaaagtcggcagttcctgacttctctctttcctctcttttctctcttttctttcttgtctccgttctcttctctcgcctgtctccgttctctttctttttctttcttttcttgtctctgcttttcgttcttttcgttattctctgtccaagtctcccgtcacgctctgaaaacagtctgtttctcctgtgaccgggtgccttctcactcttcgttcctggtgttcgcgtctccccttcgttctgacctttccccctcgtcctgctttccttctccgaccaaggcgtctgcggactgcatgagactctggagtccgcgtcgctcttctgcctcgacttcgttgccgcgagcctcccaagaaacgcgtcgctctgaaga

SEQ ID NO: 3198 - DNA, 1539 bp, Toxoplasma gondii
gagaagagaaactggcttcgtcgaagagggaaagaaccaagtcagacaccaagcgcgcagccgaaagaatcgcagaaaacaaaggcaggagacatttttttcgcagattctcaaaccaaaagtatgcaacacaagatgtgtgaattcaggtttatagcgtagaatttccaacgtttgacctggtgtacagacactggccggagtctggaaaagcgtcgaaagagagtttttcctgggtgtctaataaaaggagagatccatctcgagcaacacagagatgactctgagatattttccagagagaggccgcaagcaaaccgtagaaagtgaattctttggacgaaccgctcgaacacggtcgagaatcaggagggcatcgcacggtctgaatcttcagtcacggtctatactgaaaatgacaagacagtcagacaaattcagaggtactaaaaaataccacaccatcatatatatgcacataaatgtgtatcttttccgtttcatataaaggtcgaaaagtacagcaaggaacagagatgcgtacagcacatgcatcagataccccagacatacatatatatatatatatatatatatatatatatacatatatatgcagacatgcatgcagacctagatggtatatgtgcatacaaacgagtacagatatatttgccaatttattacattttcttcagttttagaatccgcgtaatgtgtcggaactcttggaaaattcgtagtgtgaagaagacagcgatgaacgcgtttcttggcttttctgtacctttccggctggttcgcggtgaaattccggactttccggatgatctcgatttcgtttgttttctcctctgctagcaaaggagaatttgtgcagatcagtcgatcgcaccctgaaacaaacactctccaaaaactcccacttcttcaccactactcctttttctctggactgaactgtcgatagatatgctggcggcttttctcaacttgaaaatcgcgtgcatgcgtatctgcatgcgctgccggcctctgaggcttcggtttgaacaaacttctctctggacgaacagcgattttttttccgccgtctcttcgccatcagtttttcagacgcaaacgcagaaaggagaaacggaggtatctttctgcagcctcagatttccccgagaggtccacttttttttcttgctaaatctacagaaataaaatgaaggaatttcctcagattcgacggagtgttcttcaggcgaagaagaaggttttttcctctttctcggcgttcaacattcgcgccagaaggcgggggaagagaatgtaaaaacatctgcgccaacgccttttcgcgaccaccgtcgctttctttttctcgtgtctggatactctccatcacgagctctgctgtgttgtggaggtcgaagaaagaaaagcggaaaacaaagccaagcgaatacagagtcggtgaaaaccattttctcattcgtcgcgtacacaacggtcttgaacagctggggaacgcccgagggcgttgtgcga

SEQ ID NO: 3199 - DNA, 1749 bp, Toxoplasma gondii
cgcgagtccgctcgaggtattcatgtcgaggatcttgcgcttcgcgctcttcaacacactgttttgctggacgaccttatcgagcgcactccgcccctgcgagagaatcgcgtcgagcatcgagtgactctccgcgagcttctctcgctcccgcgcaaagctcagctccgacgcccggttctgcaccacactccggccgcgacgcgagtcgagcagcgcctcccgctgtcgcgtctcctccatctggcggcggtggacggctccgagctgcatgttcacggcgctctggaccgcgcagctgtcttccagaagcacagagatgcgccgcttccacagagcgacttgctgcggaggcagagacgccttctccccctcgaaaatgcattccatccgcgcgacgtcgcgaagcagctgctgagtcagagccaccagccgctgctgcacagcgaccggcagcgacgaagaggaggagcgtgagacggctgacggaacagaagagctcaggggggcagaagccgccgaggaagactcgagggacgccagaaccgagtcgatttgcttccgacaggccatgcaaaggggatacagcgtcgacagagacgcctcggaaggtgcggggtccatggcgagaagactgacagacacgcgaaaaagggagaacaagacagagaggaagacagagaggaagacagagaggaagacagagaggagagagaagagaaacgagaagacagaggataagacagagaagaaggcgacgaaggagactcgaaacgcgaggaagggcaagacagagaaggagaatagagccgccagatgagtcgagggcagatgagtcgagggcagatgagtcgaggacagattactgtgagacgaagaagaggtggaatgagcagacagcagagaaaggtagaaaaccggaaagaccaagcagaagaataggaggaagacggacaggagagaaaggaaaagacacaagggaatgaggagagcacggcgactcgtggaagctactcgggaggagaagcgggtggccgagagctggaaggcgctcttggatcgcttttctccaccatcgtcgcggccgtgtagaggcgcggcagagaaatctgtgtttttcagagaagaaagatggaaaagacgaaacaaatatgcggagctcttttgtctggcagcgagacgggaggcctggaagtccgacttttctcagatgcggcgtgaaggctcgtcgtcgttttttctcgctcgcttggtttcttacgttggagcagaaaggaagttaaacgaaatttttctcttcgaaactcacactgcgactggagtcacctccaggaaggcgcaagctcagcacccgcgaaaacggtgcgcagcgacgagaagcgcagcagctgtttcgagtgtttctcgtgagagggaaaaaacaattgggcgcgagagagaaggcaaatcgtggaaagaaaacttcctgtagcgatcgcggatgcatgcaactcgaaagacaggagaaagtgagaacgagaacgacgatgccgtgtctctctgcgaggactgcaggtctgttttcggccggagagacgcacgcgccggaaaagaaagagtcgtccgtttttctttgaaaaatatcacaggccgtctctaatttcctcctctgcgcttctggcctcgcgtttttttctctctcctccttcttgtgtctctccttgcctttcttttcttgtcggtcctcctgaacgccccccagcttgacca

SEQ ID NO: 3200 - DNA, 2085 bp, Toxoplasma gondii
tgcgaccgatgactcgagtcacttcctgaaacggtagtgaagtggggcgaaggaacttcagtgagcacggaggcatcatggatcaagattgagggccagagacagacggatgaaacagagtaaaagaaagcgttggcagccaagctcaggaaagcacattccgcagaaagccctgttttttgaggaaagagaggagaaaaacgagcgagtgaaccagactgaccacgcggacggtgtcacttgaactctgagtaacctggatcccctccgcgacagccatctcggtaaccagggctctttcccctccggcaggaagaatttcggcctcggatttccctgattcctcaaccactgccttgaccaattcttgctggacaacagaacagaaacaggacacaaaagtccacagttgtatttagaagctcggccttcgacgcattcctcccgtgtacggtaagtcttatgcccccccgaaggcaaagaaacaggacgtgtacgcacgagagaccctgtcccttttctacaggatctaaaacaggagctgcagcatgaagttagtccaaatcaaacggcttctgacggcaaaacatggcggatcaggtgcgggtgaaacttccgaaggcctttggataattgtggtggcttcctgagaaggcaagtcgcgattctttgtttcagccgtaggtttttcggcagacgaacgggctgcatttgcactcagttggcgtttgcggtccactaccgctggccgcttgtcgcacggccatcaccagaggaacaagggtgatgccttatagaggcactggaaatcttcgcggtccattcctgtgatccagcctcgcaaatgggatcaagctgttgaagcaagagccctaaaatgtgtatgccccccatgtaaagccagccacgaacctagacagagaatcgatacaaacacgctttccgccgaccgtatttgtaaagcagtgcctcatggccggtgttgtacaaacaagcttacgccgagctctgagaccttcaccgcctccgcactctgttttagttttctgcgtgctcgacgagcgcgaacgtttgccccgcccagagatggtggagtcgccgcggcaagtgtcgggcggatccagtcctcgccgctgaggaggacggcgaagaacaacaggaggagacatctcctcgaaagaaaagcgaacagccccatgttgctcgatcccactgcattctacttgctgggccgttcccttgacctgatggtgcgcatcgtgtctgtcgtggcagaggttctcgcgtcgatttgtgcggggtgccgcgtgaagccgggaagtccgacctaaaacattcggtgctgttctttggaagcttagcggaagctcaagatcacttaaatggcgtaacacagaaaagcaagcggttcggaaatgctatggaacgaatgtcggaacgggcgaagctccgagagagggatttgagtcatcgttgccggcggtcctgctacggagtgtcttgacacccgagcggctgcctggaatcttgcacaacaaccggggttctttcgtaggagcaaaacaatcgacaataaaatgggcctcaactgcagagtgccctgaacgaaaatatatttccgcggggttttacacagagacaccgaaaccttaccctaccctctgcctctacggccgcacaagacagacgactctgctgtccggcacgggaccgacgtcaattcattttcctacgtcgctttgcgcctccgtatagtgagggcccgaaatggaaacagccgtttccccgcgtttttgcagaaaaacagaagcggtccaaccactcctcgcggcacgtgtcttgctccgctgaatgcgagccttgctcatctaggcaatccagcgatccggtctactcagcgcgtcaagtgcgctggccagtcacgagaccgctcgaggtctagggcacccgccgtttcaaagataccatgagacgtacaaaaaatcggatcaaacgctagcctcgagaaatgaatttcttttctctcgccggtaagactcttgagaacacgatttaggtgctttgtctccgttgtcagctacatca

SEQ ID NO: 3201 - DNA, 2262 bp, Toxoplasma gondii
ggtcaaatgtaatacatttgacgctaacgcacaagcgcgacttcgatctcccccaagaagggctacctggaaggtcatgttatagatagaatgcaactgcaaaaaaagacaaaacagacaagaccacctctcagtcggaccggagtggtattccagtgaatgtgcgtgtgctgctgcactgcgcttgtagatcggttccattcatgaaatggttcgacttcgaggtaagcataacccagcatcacaacgcgtagggggcactgtatgtctggtgcaatccctctggagcggcaaccgaagtgcgcggctatcgataccatggttggcagaaagcagtgcaggttctcacctgtagaggatcatcatctcgaggctgaagaacttcgaccggtttgttggcaaaatgaagtccactatttctctcaatgcaaaattgctgtacgagaagttttctcagtcctcgggtgacaagacgatggccatggaaaagagcctgcatcttctgaagaagcagatccctgcttcctctgtcatgtgtctggctgacacaggttttcagaattccgctgaaaataatgtatttgtctggagcgacattctgtattagtgcgcacatggccgcagccgggcttccggcgtcaagaacaattccgtcaggcaagaacagggagaagcacagaaggacctcagggcaatctgaaaagtaatgtcccaccagaaaagcaagttcttcagcccgcaaactttgtgtgccgtaatgagcaacgatactagtgaaggatatgagccgctctggctcgcttatgaacctcttgaccaggaaagtctcaaactgccgccatagaactgggaaatcctgatcctgcttggaggccgctgtcgttctcgggcccactgttgtgcaataaacgctcgagcgcgagccagtcgttccttcgtgacattggcgggggacgccgccatcagaaagccctcccattttgaacgccgagttgagatctcagattagcatgttgtccacggtcgagtctataaccgtaacccgtcgccgtaacacaaggctaccggtgccaaaagaatgtacgcaaccagacgacctagtcactcaagaccgtttccgggattgccgttttaccaccatatcagacgtactattcgacgggccaataaggaaatggaagacggcacggccaccctttagacatcatttctcagttgctgaaaaaaaaacttcgacttaatcgccgtctgcttgtccagtagacgcttttgtccttcggcagttctgcaacgcagtactggtaaaggacactgtctggctcgcattccaagggcagctgtcgaacagccgggctgaaagaagctagaacgacaacgcaactgtcactgaccccgcttcccactctcagaggactcctaaggacgaatttttaagtgcataccagcatcgccaccgttcaacaagaacaaagtggtaatatttagcgtgagtcggaaaaaatggacgtggacccagtgtgaaacggagtcgcatgcatcgacgtcgtccgttccagcatgcgctcgctctcatcggaggtgtcttcaccggggggtgctggattagacagcctacctgtgatgtcgttcaactagctgaattgcttgattttccgcagcgcgaaaaaaggcatgatacggtgaatgtatgatcgatgctcatagataatgacagtggtctcttgacggataccggacgaacaaccatgaatataattcaatttggttgctttgagttgcacaggagacggtgtagtactgacagagcagcaagcggaataacgcattaatcagcatcctccacgttgaaaaacggtttctgtaaccgaggctgcagctggttgttagtagctatccggcacagtattgggaaagattcgttttcaaatagtatggcagataaggaacagtggtgtatttagcagtgtatcaggagcgggcattattgttttgcctcgagagaacctcgtagtcaaaccgctaagcgaagaagcatttcggctcacgacggaaataaagtcttatattaagagagccagagaaatgacgctgtccattttcggtgcaatgctccctatcagccgcatgttcgttctggtgtatggacagacgcttgtggccaagagctccagttaaacaacaaattggatgcctctggtcgacactagacctcccttcgtctcaaccacactgtatactgaggcggtctgtagcatacgacga

SEQ ID NO: 3202 - DNA, 1419 bp, Toxoplasma gondii
cttaagagccatccgtggagacatttcggaagggtgccagatatttataggaaacaggttgcccatgccctctgatgtccgtcgccatgtttccagcatcaagttcttttttcagacccccgtcagaacacacggctctcgcatgcgctggaggaaaaaactgaaacctctcgccttcacggcaaacaataatcgtagttggacacagcgtttggggaggggggtaggaagaggctgaatgagcacaagttacaggggtcactgtgacacacgtttatgtgaatgggtcctcctactgtttaccacctcaggaattaaaggattatgaattcgctgacacctggaactgacgatgcatgttgaacccgactaccatatagtgaaacccctctatcagcacctatactctatcagtgctcttaacatggttataattaccctccatacctacagttaagtattacgtagtagctgaataagcttgcactgacaagcaatggcaaggcatggtcggttcgtgttctgctggttcactatgaagtttatgcgcacacacagagcaaagcattaagcttttcaatgagacatttgtgccggagtaaaggcaaaagccatgcaggcaggagagcttggctgctttttgtagccgacagtcggatgcttcaacacatgcactgtacctacttttaaaacgcgccggccaatcaggcaggtttctgctcgtcctggtaacacaaaagagacgcagcgtctgcctaaaagtgatggaccatgtgcgtgtttgccgccacgtcgctgcatgttttcagtaaatctctgccccaataactggcgcgagcgaaatcgttcttggaacaaccgctgtcggtgtacacacaccaaccatacataccttctgtaatcccggaaaggcggaaacctgggccgagccgcattgctcgcgtccacgtccgcagatgcaataggcgaaaaaacacgtgtttcattcgccgaaatcgaaaagagcactaatccttgttggtttaatttatgcgaagcgtgtgcttagcagccgggggtgctagtcgcagtcgcatgcatgcaagccacattccgcttgcctctgtcgctcgtcgaacttctttgctcggctctcgccaggagacagaaaatacaaccgccatcctcgaaagtgctattcttgatctttctgcacctggtgggttgtgtaacaaccagtgtaaaacactcctgctggaatctgatttccttgcaacggccgacaaatcagggcacctgggtgccgtggaggtacggcccattcatctagatccttctgttcacgtacacgttttctcatctcggcatgcatttccacttctccagcaaacatccctttcttcctctgttgtgatccgtgagtctcggcggtgcacacga

SEQ ID NO: 3203 - DNA, 2272 bp, Toxoplasma gondii
tgtgtctccaggtggaccatctgttgtaattatctattccaagtatctattgtctctgcacaaaggatccgcgatccatgcgtgtgtaccatggcgtgacagcagccacattcgggttacacgtgacaggaaagaaagctgtttcctggtccttcacaagcacgccgttttgcagacgagacacgtttttttcacgacactttagttaggatttacgtaggcggaaacacaaaatcagggagacagagttcacgcagcagggagtcgtggagacagccagaggttctgaaacgtttgaacggaaaattataaaatagtaacagttaggtgagacgccgaggcttggcacctgtcgcgcgtggggtgtatgtacagaggaactccaatgggcagcattttgcgggcagtgtccatggtaccattttagccacagtgcgggccgaactgtggacagatttcgagccttacgattcaatcgaaaacgactctcagcctctgtttcgtgttttagttccacaagccactcggaatttgagaaaactgggcctttgtcacctatgcctcaaagcactttacatagactaggctctggagttcgacgaatcgctggtgctattccattcccgttacttctacgcagaaagctcaaaaacgaagcgaattcacgcttctgtgccttgccgcagaagacagtgtttccgagccggcttctccctttcgaccctggcttgacagaaactgacggctttctactgggttccgtctagaatgctgctaccatggaccgcttcgacctgacttttggcagctcagaaacgtctccagtgatacagaggacgcagacgaaacctttgggtttccttttcttccgtaagcgtccagcgactccaatgatgcggtacaataatcgagtcttttaggactgctctacaccaccaccccacaccccagtggactccttaggagaggcataagtggtggatttcaatatcccacggcattcaggtcattctacatcgtttgtgttctgagctaaacccgttggatctcaataccctacgacattcaggttattccagtagctaccttttacgttagccatgtcccaggctaactcacctgtccatataaattcagaaatgaacagatgtcgagcctttgagtcgatgaggttttttcactgtaacggctgctcctgcaaaagcacgggcacacggctaaaaaaaacagcgatttccacggatatccaacttcaccgaatggaattttgcccgcgtaaagaaagtccatcgaggcttttgtgtatatgaaaagagagtgtcactgatcttttcaagtgttgtgtcggattcaagtctcgagctctacacccgccacatttttgcgactcttcacgcatctttgcggccagcgcgtgcttttcccttggtaagcctagccccacccacaagtttccattttccgaatcgtttattcgcctcttgttccacctttctgtcttttcgtggtgccctctcagccgaggaccttgtttcttaccgatgcagacgacggacttttgtcgacgacagagacttcccgagggcgcgcatgcagacggtttgtcttcaaagtgactcgcgggaaaaggtattttgactttgttttccctccgctaattccgcttgtgaacattgttcttcttcaacaccatcttcacgttttcctgcccccaagactttgtttttgctcccaaagcctggtggcaaaagcacaccaacaccgggcaagataacacagtggccgcttgaaactctgcgtggaagcgtcttccgttgactgtcagaagtttttccctaccgattgtttgttccgatttcttctctctttcgtcctgttgattttttggcagacattttggtgtgccaccctcgacagctctcgtatccataccttgcgcatgcatagcagcttcgagtgctcttcgccgcaacgaccctcaggtctcctcctggtctctctccccatgcaaggttgatactctctctgaaacagccttcgccgtcttgccgttcacgagtcttccctcttggggggggtcccccactctgcccggcgtctgccgtgtcttgtctcctgtctcctgcccttctgtcgagccgtatcgcttccatgtgctgctccttcttcgcccaggagaacagaggggacgtctttccccttctgtgtgtcttccttgtctgcgtcgtgtgagagtgtagctccccctcttccttctcctactcaagcgcga

SEQ ID NO: 3204 - DNA, 2538 bp, Toxoplasma gondii
gaggttcgtccagtcaagcatggacttcctcacacgactcgagtctctctgtcgagttcgagccgcctggaaagaaatggagccaaggcgccgggagaggacagcacagggagagcgtcgcagacggaaggaggcgagcaactggcatcgcgcgccgggacatccaagcgcagggcatccgtctgagcctcgcgcatgcagagaacgcgatcggtctgaagtctcttctgcctggagagtcgatttctctcttttccactgctccttgtcttcttcggcgcctgccctcgaagtatctctcttctccccttccgacattccgaaggcctgcgagaagtctcgaactgtgttcgacctcaacaacgtttccgtggagacgcttgtcgctcgcgaaaactcgatgctgacctttggtcgagactggagagtacaggtgaagtgcacgtttcgcgacgctgagggcaaagcagcgccgcgagtctggaaggaggctcagacgagcctttttcgtctcgaacgcaagcgtccatccactctccaaagaacaggcctcgagcggggggagggaggggagggaggggagggagggcaacaccgtcgagacgtcggcgaaccgtccacctcctccaggactcgcgaacgtcaactgaagaaccgaggaggacgagtcaagcagcctgtggggatgtctcgctgtgcggcccgccgcgcgaaactatggcagcaaagacgatccactatgtcacttcggccatctcttctcgttctttcgatgtccagaagaagcctggctggtctctccggcttggctccctttctgcaggcctcctctgagccttgagtcacttttcggaggcgcctgcgtttccgctgcacctggagacgcttcaaagcgctttcgctgcttccttttttcgcggagtctgaacattcgactttcatgcgcctctgaagcctggcggcaccgcctttgctccgtaggaggctcgcgcaagagagagcgcgagaggacggcgcgttgcttctctcaggtttttctcacccgccgctgacgggagggagaagagcgagttccgagtcttcagcaatcgaaacgcgttcttcctgcccagcgaggacgcgatcgaccgcgagcgcacagaccggcaacaacggcaagagagcaggcagttgctcagcaatcaccgacagcaggaaagacactggaaaagaagaagacggagggagattgggcgagcgaagcggcgacgaactggcgtccaggaaacagccgccttcctcttctgaccgacagtcccctgtgtcgcctccatccctgcaggctccagcgtccgcgccgctgtgacgtccggcttgatcctgtcggcgcgccgcctctccatcgggtgtgagatgtccgttcctgggagaaggaagatcgagaaacaccgaggaggcccccaccgcctcgcgcgcgctcgcgaagagaaacaagcgaaccttcatcagcgaaacggagggaagctcgacccagcgagtgacttcctctctcctatttgagcagtctttcttgttctcgctgcttctccctcccttcttctctggtgctctcctgtccttggtagtcttttccagagagtttcctgtttgccgagaggcgacagacactgtgtggaactcggttcaacgtcttggcggccgacgtctcggtcttccagagcgtcgggagtcccctctcgccgtgacgcggagaaggagcggagaaaacgaggttccaggcaggaacgtctccctgcgcgagaagaccaggacgcaggacagagcgaaagctggagagaagaagaagacgaacagacggcacaaaactctcgggaagtcgaaagcgaaaagccgcaggctctcgtggtgagtcgtccggagacgagacctcggctggtgtctcgcgcgcgccgccgttgcgccgttgcgtcgttgcgtcgttgcgctgtctacatacaaacgcgaggctgcagcagggaaagcggtcgcaagacatgcgcagagaagaaaagcgttttctgtttcctctcacacctggcagagaggagacgtaactgctttcaacgacggaaagagatccgcgaaggtcgcagaacagtcctgcgtcttttctccgaaacggatttctcctcagggggtgtctctcttgtgaggacgcggcaaggaggcattattaggggcgcgcgaaagcgcatgcgcgccaggcggcggagagttgtgctttgcgtcgacgcctcagtccttctctcgtctgttccttcttttcgacaagtttcatcgggagagtttttctcgcgcgcgactcctctgcagcggaaagggcagtgtcaggttctctcgcgccgggactgtccggcgccgtcgctcttctgtgtctccccgtcttctgcgcgtctcctctgcttttttcgcgaagccgcgcccggttctcctcggcgcgactcgcagctcttcgcggccttcgcctgtctcgccgccttctcccgcttctggctgtgagtctccgcgccttggtggaga

SEQ ID NO: 3205 - DNA, 1298 bp, Toxoplasma gondii
gcgaattgcattctgcaggaagtccgagtcctctttggacaggctgcgcggcagcgttccgtctgcagaaaaaagtccaagacgaaacgtgcatgcagtcgggagccgccaggcaacctgcgagtgaaccaagcgaacgatcctcgctctccgagatgctgtaccgcgcaagtcgagaggcgcctgtgggggagaaaggggatatggggggagaagcagaagacagcagcaagaaagaaacagcgaacgaagacgaaaccgagacagccaggtgaaggtgaggacgagacggaggcaacgagaaggagaagttgagacattgaaacgcaaccttcttggtgtgtctggagttctttcgcggtcctcaccgtggtactccatggaccatcgatagaggccgggccagttgatgccgctgttcgccatagtggagaaggaatttggacagacggcgtctccgcagacgaaaagaagaaagaagaggaagccgcagaggtggagccagagaaagagagagagagagctacgagcgaatcgaggagagacgatggaagaagaaaaccgaaaaaaacggcaggcgaacgcggagagaagcgaagctgaggacgaggcgcagagggggaggatcgagaaactggcgagagagaggattctgcgaaaaagtcggaaaggtttttccaacacttcgaactcacacaattcacgagtcacggccgcaggaacagcggagagaagcaagagatatacaaggaagagcggagagtgcacgcgtttcgcggtcttgagaagaagagactgagagggcaggaccgaggagcgcggaatcgcgcggaatcgcaaaaagaaaaggaaaaggttcatgcgtctggggcatctccgcgcgcagcccacgggcgcctgcttctcccctcggtcttctgggagccaaggaaggaaagaaggcagaagaggagacgaggaggggtgcggcgagcagggaaaagcggagaaagtcgaatgtgagtgcggtccgcagttctctagcagcagctctccttcctcgtcgctgctggagaaaagaaggccggctcccgagactcaagaaaaacctggcaagatgctgttcggtgcgtttgcagagaggcgcaagcagagagaaagccagagagcagagaagggagaaaagaaaaaaagggagaaacggtaaagagaaaagggagaaaatcgcacaagaacagcatgtgcacgctgtgctcatttgacgagtgcaaaatggactcaacagatccaagcggcgcgcccagctcgagaaaagggga

SEQ ID NO: 3206 - DNA, 3153 bp, Toxoplasma gondii
gaagaacgcatttatgcactccgtcacagtctacgttgtgacagtcttctgctgcaattgatttgttgcacttgcttcagctgcgcctcaggaagaaaaaaaacgcgtcaatttcaccccgacaccgtctgtcgaaaaaacacatccgtcggaaaatggcagactagacggttcgacttctcctgcagtcctgaatgtttccacatgaaccatcttctagctgacacaaaagtagcatgtgtaatacgacgttgaaaaagagctccccgaacaacgcgaacgactcatccgcatcgcttcacgccttcgctggcagtttgcctcctgtgccaacttccacacaaaatccagaagactacggatttcacactgtggaagaagcaaagtcggtcctgcatgcaatgtacatttgtctaagtccggaacaatgcggttagcaacgagaagcaagacttcggacgctactccgggtggaccatgttggttggcccttcatgcccaactgctatgcagtgtatggccgtctagccgttcgcctgttgacacgcgactggagcgaaaatgtcgcaatgggtgtgtcctacgacaatgccgatcgacaaacacggcgcacctttttccatttttgcatgagctgagcgtagccagggatcagaacgacatcggtcgctgcgtacgcgtagatgccgaccagagcgccaatgaaaacgcggcgcacaatgggcatcaacacggttccatttccgtacgacatggtgacgcagtatggtggaaacgaataagtcggtgacgagtgccccctacgcagacggatgccgcagtgaaagcagttttttccgacaggtgggccggccgagaagacgggaacaaggaactcctcctgggggaacgcagaacaggaaacacaatggattcccaaaaagtgtgcgatattcggagatgtgaaatgacaaaaaaaaacaagtgagagagagtcggaaaatttcaacctgcattcgtacgaggacaatacatctatcaactgcatgcaccaggaatcacgtacacctctacacgagtacatcccatcgtgaataaaaccttcggtgaagtgaagctgcagaatatttttcctcgccgaacaacaaaaggaagtgtcgcctcatcaacattgatttttttcggccgtcctgatcagtttttgcgcgggtagtcagcgacttcctcgccacacagctcgtacgggtgctggcaggtttggacagttcatctcagattgcagtgctgagtggcgagaagcggtgtcgcctctctgtttccgtcgacgagtcgaagaagaaatgggtagcaggccacacagctcatgtgaggtgcagagcaaccttcttcagcttatgcgtcgctgatatgcaacaacccggaagatacgataatcgtgataccaaaggcgctgggtagcatcgtgagagcatcgttagtttcaagatatagtgagcaggatctcccataacttttgttggaatgagtggatttctcagtttcgatcaattccaaatggtgtgtggtgatcaaaagggcttagccaaaagaagtctggggaaggaagaacagcagagactcgagacaaacagttaacgaccgcagcggatgctgcccccgagatgccgtggcggaaaacagactgtagaacaaccaccacagtgagttttccgtctgttgactcacctcaaatcgcttctcggattgccgccagattccagatctgagctgcataacattctctgagtcaggggtggtgtcccatcggaaaagtgttgctatagtcggaactcgcgcaaagtgtgcatttctcagatatacttcatcgcgagaaatatgctgcttgggtgctgggctccagaaagtgtgcttagcatacttttgattgccagcgcttaagacacaaactgtgacgccagttgtgttagccagtgacactacacttaccaatccatccgagcgcggaagaagagagacacactctgcgtgggtgggtagaggagaccgcccgagacgttgcaacgggaactgaaacatcgatataggatatgtcagtagaccaaagagaagtacaatatcgcaggcgacgtcaaaacgaaagctccaccactgatgagtcacgagtgtcatattctgccgaaccgcggagtgctcctctgctgctgctagtcggactacaggtaccacaacagtaacttacgcgttgtctacgttttcagttgccgctgggaagcttcccgctacccagtgcattgtgaggaatctatcgaaatcacccctacctcaatcacagaaccctgagcggcccttgacggtaatgcccttctgtaagatgagcgtcacagcgcgttcaccacctcgacgtccaacaatggcactgcgagtgccccgtgaacaaacaccaacagtggaggaacagatgtggacacggtaagttgttggctcagcgacaagtccacaagaaatgaatgaactataggcatgcgtgcgtgtcggacgaacgcttgccgctgcatcttctttgctgatgcatgatggctgccagctcccgttctatttgcgacagctgaaagatttgccttgaacaagcatcaaacgacgtctgcagcactgggccaccacaccgggcggctagccgggccgaggcccatggtccttgtcttgtctcacgtgagtaccactttcgctagtctcaggctgaaaaatcccaagacgacgcggtgtcgcatgataggaccggcatcctatttcaaaatcattttccgatattccccggaaaagaaccaggatatattgtcatttgcgtgcattaatcagtggtgctcttccacgttctttttcgacatgcccccacaattggttgggcgaacgagcagaacaccttgttgaatcagacacgccacagagtatctgtcaaaggtggccagtaggaggtagttcggctgtgacagcttgattctgcatgtttcacctctgcgcagtgtcaatatatgtggtcaatttttcttttctttagtgcagttcaaaatcccgccgtgctgaatttggcttgagggttattgtggtgatttgagacagtcatcagtccttccagtatcgatcgtttgtggtagctctgtgtagtcgacacaaaaa

SEQ ID NO: 3207 - DNA, 3562 bp, Toxoplasma gondii
gctttgtggcagggccgccgtgacactccgtcttcttccgattttgctgcgggtggcgacgcgtgtagtcaggctgtgtccaaaggcagagtccatggaggagagtttttcgccaacccaacgcattgccaggaaatgtagactatgggagacacaatctaggcttgaagtagccttttcatacacattatggtgaaagtgcaatagtagtaaaacgtatagcatttgttctcgtatccgactaccaactggcgtttttatttcgccatggtactggtagttagtcaaattccaggcggcattgtttctgagggtgatgagatcccattctccggcgcacggaaagaaggctttttggtgacagtgggaaaatcatctatatactgtttagttacaccaccgcagatacatcgtgaaactgtcacgcgctccatattgaaacaatgcaagtcggtatatgggtccgaacagaaatcgtatgctcaaggttgatgtaatcacagccatccgatataatcaagaatgcggtggggagaccaatcgtgaccgcgaggaaacgagcttcagaggtatttttacgtttgcaagcacgaacactcggcaaggctcaagcagtctgctgcaacggattcaaagtagtggcacgccgtagtggaatagtgaggctgagagaccatatccttatttgttgtggcgggggagtacgatgcgtttaactttcgatttttcacttacgtgtgcgggctatgggcgaaacagagagagtagacagaggggggcggggaactgcggagaggacgtgaacagcgtgtgctggcggaaaggtacattgcatgtaagccagcgctggttaggaagtattggtcgagcagtatgctggcgttcgtatgctgaaagtgtctttgaagtagttatatgaccctgttcaacaccttttgtggtatccccagctctattatttcgacatacgggatacaattctgcacccatctttacagaaaatactaccgctaacgcgtgttccccccactactcctctgaatgcgttgtcactacagagcatccgtcgttttcgaagacattgcctgctctgctgccctgtacctgtgcgatggtagcggatcccatctgtgaaagtgaagccagcgtttaggaaattgtagaggaatctgttccctgcctgatggcatgatacatatgagatgcagcctttttctccctgccgtacacagctcgattgaacatgccgcatagaaacgatagctacttgtcactgtattgttttgacaacggtgtccccactctcttctatatcggcggcggtggaggcattaccccttcaaccaggtgctctgtaggacttgcatcaccaacgaggaacgctgacttttttggatgcacgccgaagcaagggtagtgttgaaaccccctgttcaggtgcaccgtttgacacatctgattgtgactgcctgcggaggaaataacaatccagtttcaattgttggcgaaggcgctggcttcgatttttcagttgcatcttggaaaacgtgtttcccacaaagtattcgtctggtgaatctatggcacgagctttttactggctattacagacatttccagcgcggcactgcacttccatgtcccggcgggaaggccgtccgcggcgtgtgccgttccatttagaaccatttacatctacggacaaacgatttcagctatcagttgatcaaatatcctgtattcagctatcgtgtatcaatggttctccgtgccttcgtctgcatcgtctataacttgccagaagtgtacacggatactgagctctttcctacacccgacatgcacgtgggaacgtttaaatacgcgttttatgcaaactcactgcatcatgtcacaacgtcggacaaggtagaattgccttaggaaaaggaataaataggatgggcaagcaaggtaccgtcgccgggccgccgcgaaagccttctccttcttgctggcacgatcgggttcgaagtgtacgcgaagtgactctgtctgtcctttttgatcaacctcagaatacactacttttcgtctaccttgtaaagtgcagcgcgcaaggcgtgcttgagctcataactatgagtaagaagtcagagctccgccccaaagtcctgttcccttgcgcgcatgcacaccgtgtgcttccggttcaagtatccgtcggaaagacagggttgtcctcgcttttgcttcgacaaaagcatgacacttcatgagcccttctatctgtaccacgagtcgctgcaactggcgcgttgttagcagcattaagctgattctttcaaacaatatccaagctcagcaacgtcaacgctgagagtctcggacgccccacttcacgctcaccgctagccccctttagcggacgtcgcgaggagaccggaagaatgagcagggagaaggaaaaaggcgctagagatgcaaagagtcaaaggaccggaggcagtctgagcgtttgttccctggttgtgtcttcagcgtaggacaatttttttcatctgtcactcaacccgcgcccgagtcgtctgccactttcttagtgtaccacatccgttcagagtccgttgtcactttccggactttttcttccttcatcgacggcagctcgcttctaacaactctttacacaaggcaggtctccgggtggcatcacttgcttgtttccttgtggcatttctgttcagagggccccgtctcgttaactcgggagcgtgtctcccgcggtggctcttcgtggtgtgcagctgcgctggacccgctcgcgctcccgttgaaaaagcagattacttcttttctctttgactgacttccctcattctccctctctggatttcctgcacagagagccccagaaactggacatcttattccaccgtcgcgagtctctcacagctgtgctagcgcgacttgcttcgcttttttgtgccgtggttgctctctcgctcctttctctgttgtaagtcgtctctttctcggcgaaagagggagaaagcaaaagcggaagaaacgccgcacaactttaatttcttttccgcggtggagacaacgacactgaagtcaaaggtctctcctgcgcatttttccgaagcttgaggtcggcggccgaatccgacgcttttaaaggtaactttacggttcattttgaggtgtcgcgtgtcttttcggggttcaaagtcttgctggcgtgcatcgatgcgttacgcgcgaggtcaggcgatccccgcctccgagaaaaagtattttatggtgaaaccccaccctcggagaactctgcttttctggattccttcttcctccccttctgtgccgccgctctttcgttttccaaccggttcgacgtcttctcttctaggttgcttgcacagactgcttgtgtacctccgtgccaactgctccactgttttgcttcgctgtcgccctacctcctctcctccgctcgccacgcagatttcatagctcctgtctccatcgtctgattcacacagtcattctcgcttcagcgctcgtccagcaaacacca

SEQ ID NO: 3208 - DNA, 2118 bp, Toxoplasma gondii
cactggttccctgtggtgttgttctatgaatgcgaagtattctgtatgctcccttttttccaagtttctccaagaagaactgtccccgtacctatgttaaccgaatccgctaggatcctgggtacacatcgttttccacagaaaagagtccgagttttctccagtgttttcggtagagcttttcgaagtcgatctgttgtgttgacttcaaggggatcgacatggccaccggctttgaccctgagcgcgctggccgccgtcgtgagaggccgcagcgttcctctcgccggatctgtgcgcgttttgtgtttttcacgacccaacatgcaaagcattttggtctcttcttgttctctcacgcgagcttttcattttcaacaagtgggtggcgacggcggggtgccgctctcggtcgtactttgtcattgtttttccgtgttctttgtttggtctgcttgtgtcgagcagcgagaagaaaccgatttctcgttcaaagggaactgctttgttccatctgtgcatgcaggagtgtgagcttgtgaaaagaaaacagatcgtccgaaaagactctccttttcagaaataaattgcctgttcctgcagtccccgggcctcaccaccacgcaaacgcctcagggctcattcgcttcgtgcttgatgacgaagatgaaaaggaatctacatgggagaacagacgtaacaacgaaactaaactcacacagtccaaaacagaagattaagctgcgcgacgtttggaactgaaactggctatttttcaacaagaatggataacaacgcgtttcgccttgtcaaagccttccttcttttgtgtctctcccaaaagcatgcgcccatgcggaggcagtgaagaaggggagcgaaacccccgttccggtctggacctcagcgtttccggtttgtgaggccggctgaaatttcacagttaagatttcgacgactatgagggtgacaagactttcttttctcgaaaaactggtgctgtgtggaaaacagtgaaacgcgcctgcagtcaatcttgttcttctctttgtgggcgttatcctcgatacccccccccccttccccccaatctttgctcttggggaagcacagaggtggagagaatagggaacgcagagaacggggaacaccgcagcagtcaggagcttaagagaaaaaggcagaaagaaggagatacacagcacgctgtagatcgaaatgagagaagaaaataaaagagtgaggagtcgagagaaggagatgagagaatgattggccgaaagagcgagagaacaagagaaagaagaaacgcgagagaatggagagcttcgcgacgacatctgctggttttttcgcgcggtttctctcgtctctgctgttgccttgcaagatcacttgcgcaacggaaacttgcaagttagagcagttgtttgtcaaaaacgcgttcttcgaagaaccgttctcgtcgtggttctctcaaggcctctcagggaccttctgttctcgcaagaatgcgcgctaactcctctcgaggccatcttcagagcgtctccgcgcatgcagagcgcgagacacacttggtttcttggagagacgcgagaagaacattggacgacccccgcgtctgcagttcgctctcccttctgcccggcgcaagggatcctaaataattcagtcgtcagccgctgatgttggaaaagagcgcttttaagattaaagagaggaatgccataaaagttgtgaagacctgcatgccaccgttgcatggctggctgtcctcgcccagtgcgcgcgcatgcactctcgaggctgcgggcgaccgcaaagaatgcggaagcagatttccctgatttccgaaactcgtgtttccggtttcttttagaaacggaagactcatattttttcttcatctccaccctgcactggagactcttggattcgcgatcgtccacactctgtcatgtgccagttgctaccgccctgcatctgtcgttcttgctctatctctgtgcttccccttctctttcttcgtctctctctgccctctcccttccatcttcctctttctctcgttctctacgactttctcctccgtcttccctcgttctccttccaaaa

SEQ ID NO: 3209 - DNA, 4460 bp, Toxoplasma gondii
tctgtatctggacagatccttttctggtgggctctggatgacaagttgcgagggacgtcgaaaacgtttcctcatcgttctttcgtgatggtgaaacgaaactcatggtgccaattgcttcccgcagaccggtttgctcgtcctagaggcggagagggaaccgctggggaatctggaagcgggaagtgcgactaatgcgtcgaatctgcatgcatgtttctgtctacaaaatctaaacgtgaggactgaagtgaggacatcaactgcagcaaaacatccctcccagaaaagagtgtagatactagtatacggacacaaaacatcaagcgaaggtaccttgtgcgttgagtggctgttctccatccgcagagaggagacaaatctgtctactttacgttttcttctcgcatgtggaggtttcgagtgtaatatgagggggtcgagaggaatgaaagagaactggttacaactttttgtgtttgttacgttttccttcacctctgaacaagagtcaggggatctgcctgccgccgcaataaaaagtaaggaggcgtttacgtcgaggtgatcattgcttgcctccaaaggaaatgcgtgtggatggccttttttatgctcccaatttttctctgtgcctcggttttgaagagtactcacacacaccgaagcgctaaatataggtgattttttttgctagactgcgagcggcagacgctgcactttgatttttctcgttgatatttgcacttgcttaattttccaattgtcttcgatcaatcgcacacgggttatcatttttgtcctcaagagattcgaacgcattgtgcccgggcggcagaggaaaagatgccatcagctactcgcgatttctcagtagctccatcaaggtggaaacgcagctccttctagtcgtcgtttccgccttgatgcgtcggactcaattgggtattcgttgagcgcatgtgaggactcttcagcacatcgcttgccagaaaacagccacccgtagaaactgtctctcccgagtcgtatgaaattatctctggcgacatcggtcaggcgaaatgcatttctgtgcacccgtgctgtagtatctcgatattcaaaagcgcacaaatgcactgctaccagccttgcacacaaatcagtgccaccagccttgtcaactgctgcggcgcatgtcatgcttaggtaagctccggaattttgggaaagactggcattgcgacccgaccagtagcaagctctgctcgagaggcaatttgtagagatgttttgagcagtttgatggtgtgtgagaagaggacacggttggggtcctctgtcattcgagaacacgatccagcccttagaaagcatgacttatgtcggcggcgccccctttcctcgggtacctgttttgtccccaggatgagcaagcaccgcttgttacactcggcagatttgaagtgggcagtcacgagaaaactgatgtggccagtacgctccaccatgttactgcactctcatcacccgcgattctctgcaagaacagattcagagggtcccacaattccctattccacgacacactctcgcagcagtgccacaagcacaaaagggtttgtttcgacgcatgaaatagaccgcccctccagagaaaacctgtattggtgcagccattcaaagcatagcggggcatgatcaacgactgcctgctgcattttcggagttggggctcttcaaaacaaacgacgtgagatggctttgccacaagatagtgctaaatgcctgtttttccatacgaggttcgttacaccgacttcggtgtcgccctgcaaaatgctgaccgcttcccgcattgtctatgatcctgccagaatggagtcaccctcatgcccccacttcccctcgcgagtgacagggcagctcgaggtttgacatgaatggcagaagagttcactttccgaacgcccactcaagattacgccatccatctgccacaaaatattacgcgcctccgcttccactgaagtgctgcttgcggtgtcgcctaagccctgaagtttgcgttttctggtgcttcttctgtcacgagggtgatgatgtaagactggtcctttgcctttgagtcctctatcgcctcgcatctgaacgagaatgtttttgaaacagggacattttccggcacgttgagtacagcaggttcttttatgccgtcaccccccgtccaccattggtgcgagtccggcacaccaggaaagagggcttggagagtcttcttactcgtgcaactactgccttttccctcacaaaccagctttttgaagtcttcagggacccagttcttggcattgttgcattcgatcgccaccttccatccaggatacacataagcgatgttctcagtgcccgtcccgcggatggaactgaaccacacgatgttgtactgtccaaacggaaactgctgctcctttcgtgcattcttgaaaaactttggggcggtagcttggtctgcgtccattgcagaggcataggcaaatatggaaagaagcattgctaccgaagcgagcttcattttgtcaagcagagccaggaagcctggaacaatgaggttggccagagaagacaacctactgacgttggtagagagagctcaacaacactactgcatgcaagaaaaagatgcacgttcctcccactcaaacatcactggaacttttgtaatgccaggcagcagactcacaagaatcgatgttggtgccccgtgcagggaaagatcagtcacccgcgtatgcgggtaggttggctactaagacagcgaagacgaatgcccatgagagtggattttcccggactcaaggacagcggcttgtctgaaacgaggcacatgaaagaacaaaattcgacggcaactgtgcgtgtccggagagtcagcaaaaagttcgactctccagcgtatacctgcattaccctgcgctcttggtcacctcggctagccgcctttctgcttcgtgtgtggctctccccgttcttgtgccgctgcagtcgttgatccagagaggtgtcacctgtgcttcagcgcgggggtgtacacttggtgtgagtttggaagccttacgtaaaagtggggtccaaagtgcattgatccatggattaccaaacgagtcgtaaaacccccgtctttgccgtgcgttccccgtccgcgcgttttagattcgatgcttctccgcggagtacggaaacaaaacgagctttacaaaactttgggcactactccggcatcctttgcggcgattcgtctccttccactgaacgctgctgtaactaatggcgcggttactgcctgcagagaaataccagcgacacactcccgttcgcttttgaggcgccctgcgagttcattacctctaccgggcgggcactatggtatcgtcacgcgtcacggtgcagtcggcgtgatgtcaccacacgctgccagtggatatatctacggaagctgtaagtagggcaagcgttgtcacctctgtgcacttcatcaagcactccgaatgagagcttgcacctaattcctcaatacgtaggcagaggcgatggaaccgtgtgtgtgcatatactgccccagagggcgtgcgtggaagtcggcggtccaccacggggcggtcagtcgtgtgcgtcgtggattcacttttgcacagttccgcgagactcctgcagaagcaaaaagttaattaaacattgttgttcgttaataatctccgcgcctgaacaagggcatttagcgggcacgaccagacaaactgctctttagctgcagttcttagtgccaccttcacattgcaggatggaaaagaaactagactccgggtaaaagtagaaggatacagggattcccacaaaaaattgaactgtgcaaggaattggtgttttatagatgaagcacggaccagaaaaacagttcgcctctcgttactctaaaccgtagcgttgcatcgccaagcggggcggcacggtctgaacttgtctactccagtcgaccttagtgctgcagagacatgttatctgcggctccgctggcgtgcgttgacatttgccagaaagtctaaagagttactacaccatacagcttcgcagaaatccgcaacagacgggtgtcttcgctctgggaatgcaggacagttgtccgttgccgactgccgtagacaccgcgcagggggaggggggttttctatcggggtggtggagacccagtggatgcatcgacacgaagtggttcatcgatgcttctccagcaatgtcttccgtgtgtacccacaggttcgtcgctatgggttatgggggaacgtcaccgaaacacggtaaacggctagctccacctcccccgcgtgcgatccttccccttgcatccgggcagccatcggtacttgtatttccagtcccgctagacacaacagtttccttgttcttcccaacacaacgca

SEQ ID NO: 3210 - DNA, 1321 bp, Toxoplasma gondii
tactcagcgaatttgacatgcagcgcacttctccatcgacttactatttctgctcccaggcaacaagcccagactgttcccgcaggatcggcaagtgcctgtggacgggaatagcaaaagcgcatgaacattgattttttgactaatgttctttgttacggtagccgagcggagacagtagcgaataccacatgaagttctctgatagaaatgctaattacctcccttgtgaggccgttccacaatattgcttaccctgttctcatgctcagttcgcttcgcttacctcacttctttcccgaatggatgcctgaatatccgctcgcttttgtgcactgcggatcggtttcttctgggtgttgtatctctgtagagacgcacaccgcaaaggcaagcacgacgtttgtctcccctgtgagaggtatgttgtttcatgcattagtgcattcaacatcagaagagccgaaaaccagctcggttctggcccgtgaatgctgtatgcgtgtactgcccctgactcactcctgtgtcagagaagaaacattcacggtcgttgtcgccgacagccacctggttcaatgtgtacgcctttgtgtccgtcatccgctggtaatgcgatccagtagccagatcacgagctttcgccatgatgccgagcgctgttatgtctctttcttactcacggaacagaaaacacgtgacatgtaaggattcgtcacttgttctatttcgctggccggcttgtttcgaagtcgcagctccaaaaataagtatggcacgcacttgttgtcttcacctccttacgaaccaccaagtgacacgttagggcttgtcaattgcaaccagaaaaagggatacttatcaaacttgaccgactgtgcctcgaaacgaagcacagccgcatatctcggcctcaatcgactcggggggggggtgcagcttggtacactctattttacattcccgcgcattagctcccacgagcgccggcagtgagtaacttcacacatattcgggacattcaaatcttactgggatccccgcagcggccttcaaaaccgagcaagtagccagccttccgtgctcgcaagcagcttgaagcgattttcccgtgtttgctcccaagcgtgcatgcaagaaaacatgcgattttggcacgagcgaatttcactcgatgctgttatgctactgtgcgttccaatcgaggatctcttcacaaaagtacgacattgtcaagtgacggatatcttttcgagttcctcttcgtcctcgtatatgctgctactgctctagtaggcctcgcgaccttcgtgagtgaata

SEQ ID NO: 3211 - DNA, 2738 bp, Toxoplasma gondii
gcttgcttctgcgcacggttgattctgagcctcgtttgccgcgctaggcggaggagcactccggcttgttcctttttctagcgcatcccgcgttccatccgatgctggcacggtgtcactgtcggactctataaaattattgagtccggcaagcagatcaatgcaaggcacctcagctgcttcatcccgtctcctcgcctttcgcctcgagagacggccgcctccccaaggtctgttgtgtccgcaggactgtctgccgctagcgttaccgcttaacggtcgtctgtcaccattgtccgtagcatcgtcgagaccgcgctcaccaaacatcaacttttggagtgcctccgagcttccgaaacattcgacagtcttgttgttcgaacacgtacaaccgccggtaaaacaccggccatcctgcagcaccagaagaacatttcgggcgccaagtcttcgaacaatgcgccgacacacgtctccccgatgtcggcgaccctccactccgacaaccatgccgccatacctggcgctaaaaaaattaggttccgagcatttctgctgctgagactcttgtgcgagcctggtcggctgctcactgtcgcccaaaccaccagcgtctactcccggctggcatgacagctgctgcgggtaacacctggcctcacgcgaggggatgggtcggcccgccggaaggcccgcaacagcgttggccaaaagcagcagtttgttcccaggcgcgcaacaaaggtcgcacacgatatcccctggctcgggacgcagagcagccgcagctgcagcagatgctgcatcgagggggtgaatcaggccgagccggaagggagtgcagttgcgaggagacacatgaggcggaagagcaaaaattaacggaaaggacggaaggagcgccgcatttcctgaaaagcttaggctgtcccctctgccgaggcagtttgggagcagccacggcaccggcgaaggtggaagtggtaggttgagttccgtctggatgcaagacaaaagagaagagatgtaccgatcgaaaggaggcaattgccgcctgctctgagttgtttctggtcgctggatggaagaagcttcgaagtctggctcctctcgcgaggtaaccgcttcaatccgggatcggcggcaagcatcaagtgaatgaaacacacagtcttttgctcgtacagcaggtacaaaagactcatgtacaacacagggcacagcgccacggacgactctgtctgaagccaccgccgcagaatacagcagcttcacgagcgaggcggcgggtccgcccccgttccttaagatttcctggactgtcgccactgcagtgcgcgtgagtgcaggcacaggatagaggacagcaaagcagcgggggatttccaaaggggagtcatacgaagaaatatcgacgttgtttcgcttcaggtaggcagcgaaatcttgtggcagctgctgggagaacgggcgactctcaaccgcgacgccacttgacctgtgaggctcacgggaggcctccattggtagccgtcagcgctactttctcaaagctcacagaagccagctacagtccgccgcagtttgcttatgggagtaacttgcagccatctccaacaaccagccagctcccccgacactcgaatcatagacggcgcgaagaaccacaaaccaggagtggggagagttttttcgccacatcctcgcgcacgttgtaggcaggtttccctgccagtaacattaaaggggcaatagcgactgccaagggttgtggcaaccaccgactgagccctttgtttgtgatggggcgggtaaactgcatgcaagcggaactcgtcgacgagttattcaacgtacaagtgctggatgtggcaggtactcctcccatcgcctgcttcagatgcgttattcacgcaccctggccagccgtaacacctggacttacctctacttctagtgagggtctcaggaggtcccaacagatctcgccctggctgtctgtgtccgcccaaggtcgcatgcgggaaaccgctcggcacatcttaccgctgggcccgcggagactctgtccacttccgtgtcgtacaccgttgtcgcagctgctacacacgatccgtgcgttcctaagttccaactgtgtcgctgaaatgtaaatgaacgttctctcgcgttcagcagacattctttttgaacgtgaagccattgaccttctaacggttaacggctaaattcgacgagcaagaaagccaagcacacagcattgcgtgcacggaaccccagtatcggctgggaaagcgggcgcggcgcgcgtgacccggttctccttgctgtcgcttttttggcgttagagtcaaagtcagacgttataggttgccagattttggaatgtttcccgaggaaatctggttttcgccggaaaagtacaacacagtctcttccgcgtatgtttcctctgctgtcctgccgtggtggacgacgacgtgtaagacaacggccttgcgcgaagggccgtacgaaccccagccgcttcctattgatattaggacacgtgcattttcatgtcacaagctgtctggaaaaagaccgtctgggatccgtgtcgtgcttccgtgccaccccccactgagagtgggtctcgcgtttcttgtggtgcgcacacaacacgtacacactttggcccgggccgaggtcactttgaggtgcaggttctttcattgacttaccctcgcggggaa

SEQ ID NO: 3212 - DNA, 2035 bp, Toxoplasma gondii
atgtgtcagcaagtgtgtttttgtgttgggtatgcggagagaagagaacgagtgaatagtcaagagagaagaaccgcaagtcgctgcacctcagattgaagggcagctagttgggtggaggcgcaagttcggggaaacagaaagccccgccgtcagttctttttcgcagtactgctggaaagagcttttgcatggaataggaagatccatttctccacagaagtttcgaaaaacccactttttcacgttcttcttcaccaccggcttcttggccttgagaggagcagcgcgctgcgggagggaaagcgccgcgcaagccactcgcctcagaatcgatgtcggcatctggccacaggtcagtggacaccccgaaagaaaaacacggagaggtcaccgaaagaaacaaatgtgcaacggcaggcaggagagaaaaaaacgtaaacaaaagagacggagccgacagcgcggaaagaggaaaagcgtagcagcagtggaagagaaggacgcgaaacagcaacggaggaagaaaggagagagaagaacgaagagagggagaagagacgaaaacacaccggtaaagatgtagagagcgtcaaacacggaggacaaaagtcgggactggcatgactcaaccgaggagagagaggaggcttgacccttcctcgtcgtcagtcttctctctcacaagctccacaaaaggacggcagagaaatcctggtttaccaagatgtgttttttgacacaccctccacacgaatcgtttctcgagacgcgagcgaggaccacggacccgcgtcgcacttcagacggacgatgtgaaaaaaagggcagaaacgaaaagtcatggaagacaataaagaggcagagacgagagaagaagagagaatagaagcttatagagaggaatatcggtttctcgggtcgtctgtgtcccgccagagtccgcttccgctaccgagagcggcaggtgtctctccacggcagggagcagcgagattgcagatgcgcctttgtcattttcgcgcgtttgatcgcggcagaaaagagcagcagtaggcagagaaagggtgaaaaaaaaccgatcgtcgttctgtcacccccctctctcaaacgctctttctagccagaaggcgctctgcagcgtggagagacgaacagtgggggaaaggcgggcgtctccgcttcgcttttgcttctttccctctgcactgaggcgagagaagagagagaaagaaaaaaagtggaagtgcgtcgccctcaaagtcccgacacgtcagtctctctctctctgcagcatgtgcatgtgcattttatctgcatgcggcaggcagaacgaaaaagccgacgcggacgaagtcgcggagccgcgggcgcgagcgagctttaagggtcgtgtgtccaagaagggtttggggtttagcgttcttggtccttctttgagggtccttgtttcttcttccgcaagaaggaagacagaagaaatttggatcgaaggaaaaagccggaagagaagagaggaaacgaaaacgtgcggcggtgtgcctcgacccgctcttggtcgcaaaggcgagtcgatcttgggcgggtctcgagtcgccaaaaaacgcgaaacttgcggcggggcttccagctcctcgggtgtacatacacctcactcgtgtcagttcctcgcgtcgccaggtgtacgtacacctgacgaagtgtcttgtgtcaggccgttttttggcttctgtcgccacattgggttttcacagctggtgcggcttcgcacggtcttgaacccgcaggcaggaacacttttgttctttcctctcaagaaactctcctttctgcgcgttcgttcctcttgggggttcttcacctttctgcctcgtgcgccggcagtcagtctcctcaaagctgcctcaagaccctgcctcaggcacgagtgacctcgcagactccgcagatcgctttcctttaagttgtccagctcctgacaagcccgggagcccgagaagtgacataaaaggaacctagttctcagaattcacga

SEQ ID NO: 3213 - DNA, 1592 bp, Toxoplasma gondii
ccaagcacagaagcagactctctgatggcttccgttcctaggaactcgagaatgccgtcatctttgcaaacgttctggtggagagcacaggctccagagacggtctctggacacaggtctgcagagtttttcgaaaaaaggggcgtatgtgtttttgcctgccctcgtctctcggctttcattcttacacgagccacttggccccagtacgctgcgtgagaccgactcgccattgtgaaagaggcaagcgcatgtcgagtttctgcggagatttcatatgcgggtcaggacagctgcataaaaaagtcacgcgatttctctggatgtctcggcgaaacgattctcttcccggctgtcgacttcgcgggagtcgacgcccgacgatctcgagcctttcgagcgccctagacggaccggactgccgggtggtgaatgggccaatccgatcaggtttccacgttcgttttaaaagacgggtcgcttgcctgaaacctagccttgtttggcctgtttttcatccatgcctcgatttgcacacggaacgacatcagaaagagagcaccttccttttctgagagccttcttccccgtttacactgaactagatccggagaaaaacagttggatgagcaggcggcaaagaaacttccgctctcggccggtggatggggactctctgccggacgcgaatagcggagatgtgcgacactcggacaagtagaaaacggccacaaaaaaagacaaagacaggacgcgagacaatgagaggaagagagaaactgaaggaaaagatgcaatgacgttctttgaccgttcttcgacggaagaagtcgtcaaagaaaagcacgcgcgggttgactggccaagaactctgcgcaggccccccccccctgcgcttttgcggtggtgaaaaggctttccttctggacgctgtctggctgcatgctgggcctttttaacaacaggagaagctacagaggagaaagagaaacagtctgcgcaagccaggttcttgccagcctcaatgccgagacgaccgaggaagaaaagtcgcgaattcgcgtcttaaagtgatgctgcactgcatgcacctgaaaagtgtgtgtgttcgcctgagaaagaccgagaagacgcttgcctctcagttttctaatccagtttctgagtctgtagatttaactctgaacgcagcgaaagtgtgcaggcgaaggggcagtttgggttttgacgaatctttcgttcctgcgtcagcagccgggatgtgcatgcgcccagaagacaggggaattcggaaatggaaaaagaggcagatctgtgttcgtttgcttcagtcgccaagacacattcttcgcgtttcacgagtcacttcttctgagtgttgtcaagatgccgctgccgagaaatctctgacgaacgctctgccgtctgtctgtcagatcgcctgcacccaccgttcacacactcttcactttcccttgctttcgctaaatcccgctttttctgttctttccttcctgtccacacttctctgttgctggattgccctcctgtctgcccctccgtttttgccttcctgtgcgacggcggtggca

SEQ ID NO: 3214 - DNA, 2488 bp, Toxoplasma gondii
aaatgtcagtagcgcatccaactgtgcccgaacagttgcctgctcttcctccagtgacgccacgtagtcttcttcttgtgacagcgtgccatctcggcgcgtgcttcctgttgatcttttttgtgcggaccctcgcgggggcgcagacgcttgagtgcgaacctgcggaagcggacaccgagagcagcaaaaataaggaaatgcgacggaacgaagcgggaatgtggaaccggaactgaaccgtttttcgcattttctcctctatggtgaaattcacccttcgcgccagaggttgagtgggagtgacaatgagccgacggcacttccaccacagaaagtgaacagagcaagcagaccacgatcagcccacagactaaactattacgaagccgtggttgcactccatacgccctagtgggacacttaagctgaaaagaacagccttacagatgggcgtgacaaccaactttgtcacacaaggcgtcactgtaggtatttcctcggggacaccacacggctgtattgcacacaaaacaccgtctttcttatcgaactcagggcggcgctctcgtcgttacacttgtcgtcacgagggagtaaatgacatacctccgcaccactaatgggggcatcagatgaagcagccgccaaagccgcactctgaagctctgcaagtctctcccttaactggcgtgctgatggccatgtatcccctttctgaaccatcggagagatgacctccgtgtatagacgctcgaactggcgccccccccatgcagatttcggaggagagaatcccgagaccccgcaagtactcgaagatccggaagaagacgaagcagatattccttgttgcccagatagtgcctgcgtagtgccgcttgcagcattggcaggcgcagccggagtagctgtgagcagagaggatcctggtgcagcatgtgcatttgtcatcgccggttttgcggacaagcttcctgttgttgccgagccccctccgaataaattcgaagaggtgggctggcttgaattgccaaacaacccgccaccggagcttgccatccttctgccgacggagcgagggagggcgtccgcccggaatgcgaaaagtgttgtccgaagagagtcagagaaacatatggatcgtgaatgctggaagcaggaaaaaagagtctgagatagagatgattttaaagagtgagaggtggagtgaacgcaagagacagattggaagccactggttttgatgcacacccgttggctgccaagtggggataaacgaaggatcaagatggcacgctgctactgtgtggtctctacctcaagtggcgtcagacgtttatcacggtaaacggttttcaggctgcagttagctataaatcaacgggcattttcgacaaagatcgagacgaaaaatgttgcccccagcccggctgtgcatgtcttggacctgcaagaccggccacgcgcgagggtagaacaggagtaaccgatccgacaagcagtccacttaccgcatacctctccagaaatacaaagaaatattttagggcgtttatttcccacaatgagatcgatggccgccactttactaactcagcatgcacgacctacattcacgacctattttctctccgcagctgcatgcagcagtttcaggcagacctcctactcctgaatcaatccagccccgaaggttactgtcgccaaaagcatctgtgaagaagagtatatttctacagtgtattcgtacacatctacaggcagagtttgtgatgctggcacacgcgcggaggtcgtgctggatattcatgtagggacggcccacgcctagcacaggcctgccacatcggcgagctcaggacactttttcactagtcggtcacttctggaaatggattttggctggtcgcttgtgaatctaccgccgttaatgcttctcctgaagtagcgctcttcgacacaaggtagcgtgtttgctagtcatggcactatagaggcgtcagaacgtcccccggcgcacacgggaggacaggcatcagccgcgacaaagagcgcaaatcgcgttgttctgataggtcctccgtcgatgaaatttatcaaagcaaacgagatgcaactgcggagagcccaggtgtttcctccatgcacacgcccgtatcttccgctgtgcactacagcttcgtgtacacagttccggggctcggccacaatcgcttttggaggaggcccgctctacgtcgactaagtgatcgggagccgcaggtgtatatccagtgaaagcagttatggcgtaaataggccaaacgtccaaagccagctaccaggaatcctctggtgttcacagtgtgacgtcatctgtgttacgttgtgttttgtcgttggctccagtcgagtgatggaaatatctgtgtagccaaaacactaggaacaggcgctgccgcagacgtggcccttttcgcatggttccagtagcctctctgcacga

SEQ ID NO: 3215 - DNA, 5005 bp, Toxoplasma gondii
gacgcagagtagtggacccttttcgtttcagatttcaggtgtacagacactcggacccgaatggtgcgcttggcccccctgtggctgacgttttcctttcacagcatttgccaggcagaagaggcagtcaaaaaaccatgcagacatctcaggggtctttacttgcatgaagcagtacatgggaaattgagggatcaaatttttcgagactctcgcactttttgacagacggcacttgagtccactggcagccagatacacggggagggcgcgcctcgtttgagtgagtgcagaagccaggtgccatgttggaaagaggcaaagcagccgtcagactcacggggtcgggcggaagatgaattttcatcagtccgtaatatgctttgcgtacatgtcccttatgagaggtgcttgttttacggcgagcaaactaccgacactctcgtaattcttcatggctcaggtacagcgtatttcattgggcaaacacggtggcgttgctgcgcttactcttttccgaaaaaacacccgtgattcggaaattgtctatttctacttactagtataaatttgcctctgagcagcaagcacagactgctttcgcatgtgtagcctgcgcaacctatgacgccggtgatgaaacttttcacgatcgcggaaacggctcccgtactcccgcgttcgtttaagaacgtaagagctcgggtaccgttatgtctagggagaggccgagactctcgctggagggagtatgtcgagaaaaacgctgatggtacactttttcccagtgtcacttcgtgacagctttctcctcagtccacggttggccttttctctgcgcgagtgcattgcgaacgatcttcagaacacacctgtgtccgcgatgcataaacctttcagcagcgggtctgtcacggaaagaaagcagtgggtcttgcgccgataggctgcaatttatttagatccgccgcgccggacacacaggtcgcttcttacttggtcacggttgctttatgcgttaaattctatggttttcgctgttcgaataactgcatgaaagttcgcagaaaaactcgtggcaaacgaatgtgaaattcttccgaacacagaaccaccgggcaggattaggctacaactttctatctgtatgttggcactgaattgtcgactgctgtgtccgccctgaacgcacttcggtcggaacttgtccgccggattttggtacctgcagtgttcgattccatagcgcgcttacgacagacaagaagaaacagcatccactcagagccagcaacggtttactgcttcggtgttcctcagtgttaccattctaacatctgctgttgtacacttacagctgaaaagctggctgtcaacgggggagcatcggcgcgcggacagcacccggtgccgaaagacgagtggttgaaaacggtatttctactaaagaccctctcaccgacgcaaccatcgttgttgtggccttggtctctttgaaagaaacaataaaaaactgcatattggcaagtcagaaatttctacgtggcatttgactgattccacgcacgttacctgtcagcagcgattgacaatgtactgaaacgcatgatttcttcgtcctttcgcggtcacagtttgcgacatagagacagagagttccggagcagattttgctgacaattctggtgctcagtctcgaaaacgagtgtcgctggcatccggtgaaagccagctcccaacgcgcgggacgaaactacgagttagacacggttcgagcgacagtgcacgatgaagacgcgagtggccccacgctcgccatccggaacgcaaagtcgagccggcccgttttcgggctcccgtccacaatttcgccgcgagtccgaagaagagctagttgtgtctgacgcagggggacgccgccgagcgttgcggaaaaacagggaacccgaatccaacgtgtcttgcgcgacaacttttcctgcaatgcgtcctgtcggtcttttcattcttgtgccacagttcgtttttctttaaagagtggagtgtctacgttttcgggatacccattaacactgcggtgtcattgtttgacgaagttgacacaggaaccatggagcgagctagcgccgctgcggcaacacgttcgcctatcttcgcgtctgcactgaccaagagaaaacccctcctattgctgcttggattcgcggtcgtcttgacgtttttcacttgcggggttccaactacctctctgcggctgaggggccccaaattcactctgcaggatatgaagaaagccatcaaagacgcgaaagacggtgtgaaaggtgttgaggacgctaagaaaaaacatcagaaggctgaggattccgccaagaaggcatcaggatcaaagaaagacaagctacagaaggaggcagacgaaaagaaagaaacgttgcagagcaagattaaggatatgaagcaaaaatgcgaggagttgcgtcaggtgaaagaaggcaccaagaataacaagggactcagtgataaagaaaaaaaggatttctcgaaggaaggagagaaagccgacgaggttctcaaaagatgcgggacggttgtgtaggtgtagctcttcataaccaacctcttcctctgtggccaggaaacgtgctgcaggagcgagacggcttcgccgaaagaagggatttgcacaaaaagaccgtgacttgtacagatgggagcgcgtcgcggtatcctctgtgcggacaccgggaccaagcgttttgttacacgaatggttttaaagtgtggtgctcgcgttttggaagaaacgttagacgagtgcgtggcactcgcaaaagtttgctgttgctgggaacgtcgctgcaagactcaaaaacagtcaacctatgatttttcgtttgcagtcacgactgtcagtagatacaccacacggcaggtgtctctttcactccaatttgtcatttgaaggcacgcaatgccagtgtagacggaagagatccgtgacaagtgcagtgcaccaggaggtggcggtacgaattcagggaccaggccataagtcacggtcgcaacgccaatgtttcgcgccaacgagcgaccacttacaacacagaagtagtggagttcctttcgtggaactatacacactcgagacactcagtgctatgttgtaaccacaggtggtgggtggacgttctgtggcattgacagccagtaccggattcgcagaaaaagcagaccgaccgcctccattttcatgactgaagaagatacgccggactggaaatgcgttgatatcagtgaggccgccatacagatccgggtgttatgactttagcacgagtgtgcgggatattgcttcgtctggggaatctggaagcgggcctgccgcataatgccttcggcagttctcgcaactggggtgggctgcaagacactgccacgttttgtacgtgtgaacacgctaaggatgtttttgacacacatccatgttctttactaaacaaggttttgcggttgatccgtgcttgacaacgcaatttgaattaggtcactgtatggtcaattgaggaggacagtggatgtcaaccagtattgccgtcaacaatagtttgaggggtgcaccagcaaacaaaatgattgctgagaaaaatggagcgacgatggtagtgtcggcagcagagagtgaactgtgaacaaagcctgaaagaagcaagctgtcaacggaacgcgagacttggtatccagtctctcacctctgagggagaaggttccgtccccgccccccccacaagcttctctcgtcccttttccacaacccactatgcttttggaaacagacgcaccggccttgttgcttgttgttgacacaggaacgctacaaccctaggagagctaactccttgacagtaccactagcgagttattgcattcactggcagaaaatggtggcaaccgagagtcggcgccagttgcgcgctggcacttttccagttttccgcaataggatgtggtcccgagcccgcagtgtgttcagtttccccagcatggggatccggaaactgctggcttttcatcttccttcggtcaggaagaatgtcgcaaattctcttctgatggacacaccggcgaatgcgagcaagaatgacttgccgttgaggaggcggcatgagctagcgagcaccgcgggcacaggaactccctatttgaagacgcgggggattctcgagcagaatgatcgacagccacttccttttttcgtgaattcggaaagcgaagccatggcaaaatagccgggcactggcaaactttccgcggccgggcagaagcacggtggaaaaacagtgctgcgatgtgcttgcgtggacacggcagacaagacattctctcgggaaagagcaggtagttaactgtctgctgagtcggaagaagtgtttctggaacagtcattttccgaaggaaccgcaagtactcatatcgaaagaatccaaagtctttcttcccttgtggcctccattttcgtctcaagcaggggaactgtcatctttttctggcgttgttgcctctggcaagatagcgctaactgctcttccgatgcttctcaactggccaacttcgttcaaccgacaaagcctgctggaaagatgtctatcgagtggggaacggccaacttttgccctttcatctcccagtctttccggctgtgaacacgtcgttttcttgtctcccttagtcttttccagattcagagcgaacccgttgaaaccgggagctcgtcctacgtgccctcgcggggtgcaccctttgattcacatcactagaatccccccacggcgtatgattcacggactatcccaactggtatcgctgaccattcttctttgcatgtcccatcaaaagcagtcgaagctacataaaggtcatacccggcaacggcgtcgccgcctggtctgtaaatagaccgcgttccacgaaagtgttttccatccgcgttcagtcggcagaagaa

SEQ ID NO: 3216 - DNA, 3598 bp, Toxoplasma gondii
ccatgatccagtttacttcgaagcctgttagcggagaagcgagatagagcttctgagcttcctggcccttcgacgcgtcggcgctgtttgtcttgccagaagtttctttcttctggcggtgtaacagaagcgcctcctgctgcagacgcactctgcgtttcatcagtatgatcttgtgacgacgaggaacgggcaaagcggggtcgcggaaaggaaaaatgcacaagaccggtggcggacccaccactgggtcgctcacagcagcgtcggacggcgctgacgaagccatctcgtaaactgtcgagtgagttcagagggcgtggagtgagaaaggaaagaaacagggaaaagaaaaaggaggcgtcagggaaaaaagagacggaagacaagtgacaggaaaacaccgcttctctgtggcggtagagaagggtgtaagtgtcgccgtggaaaaggagcagcagcagacaaaaatgactgcaagcaggcgccggtggatctcccgctgatgcgcagagagcaggaagaggagagaagggcagagatgcgagggaaggaataacgaaaaagtggaagaaaaaacctcggccgacgcgtttcgcaccgaagaaaaaagcgggaacggaaaacgtggcgttttccagtgccgcggacaggctgtggacggtggagaacaaaaatctcgagtgtacagacacaccgccgcggtgtcgactgtctcgtccacttgggttagaggaagatgagagggaagggaagcgtactttaacggaatccgcaaacgaatccaagaagcgaaccgggccaaaacaaaaggagaggcgccacagttccgtaacagaggaggcaaaacggctgctagaaacagagacacgttatgaagaagcgaaggcaggagcgaggaaaaatgtgtaaaaaggggagggcaacccagactaacaccgggtcaaaagtttgatggcgctgcggagagggttatagagatatcgagaagaaaagaactcagcagacagcaatgggtcgaccgcgcaagttctcgacaggaaaaaacggtggcgaagaaaggcacaaagcagcgagagtctgatatccgcgtgttcgtctgcttttctttgaacgaaactttccggaacgcggcggcaaaaatgtgagacccccagacagcgtggcacgaagtcctacaagaccttccagggtcgcgcagctgcttcctccaaagcaacgcagagcgcggtccagcctacggactctgaactttctttcttgctgcctgagtgtacgccgcctcttcaaacggaaaaagcaaaagccgaagggaagaataataccaagcgcagatgtcgcgtgggcgggacagcgagaaaggcaaccaccagataatggagggtggaaacgcgtcggaggcaagcggatcgaccaagtgcgacatggaaacggaaaaacacactctcagtttcggtaagaaacacaaaagaaagagagcgagaactaggttgttgtctgcacatcggcttcccccctagaaaaccaccagacagggcgctgccgcgcgcaccgctaccacagagagcgcccttaattgcgttttgcgctgtgacacgcggggatcagttcgcggcaattcggcttttgcgggttttgcccccccccccttgtgacaaacggctttttcttccagaccaaatgaagcgttttaagccccaatgtgctctcctctagcgttttctgtctcccttcttcaaatgctcggtcgatttccacctgtgttgatagaaacacaacccgcctagctgcaggttctcagaggaacggcggcgggacgtgcgacagcgggtgatcacgccgtgagtggaacgcgctcttccacgtctcctttcctcgccgcgttccccttgccggttttctttcggtgttttcaaactcgggcgcacagcaagaggcttctttccgagagaactctaggaaaacgacgcgtttatcggtgcgagggaaacaagtagtgcgcgctctgacgaggtaacgagacacccaagttacaccaggaaagcagtcggccaccttcgaggaaggcggctgcgcttatcaaccatgaagaataactcgggcaccggtttttctcccagaaaactaaatttccgcccggctgttctgttgggcacacttcctggggcgatctttcggaagtgaattgcgctcgcgtggttcccttctgtgcttgttcgcgtgctggtcaaaacgacgtgcgggtcaatcgctggctcggccagagtgacttttgctaggaaacaagcggtatgctgcggcgtgtctgtgcaagtgtttagaaagtttctttgacgcgtgttcatcaacatttcggatttccgtttccggctccccacctttaaaaagccgcgccacggctgcgaaacccacaccctcgtctacgtcgctgcagtcagtcgagttcgagacgctctggacagtgtgtgtgtgaagaatctgactgcactgttccttctgtgagctgaaaggtctttcgttactagtgcttccgtgtcaaagaagcccaattttctctcgaagaggcgcgagagggagcagtacggctgaagaaggagaaacccgagagtagtgttgcgctatctatctgcagctgccacgcagagttcgcgaggcacagcgaccactctccgtccgttccatgtttgtgccttttaaggagttcaagaaaacgcgttttggtttcgagcctttccagaaaactcggaaagtacgaattcatgctcacgagggacaggcacgattcggaacggggaaccgagccgcctgccaccgctgtttttgcatcttgtggaacatgcgcgctgagcatcagaagtagcaggtggctggcgactgatttgcgatgcgctgtgttttccgcgcgggttctgttcgtttttcgcggagcaagaactctttcttctccttctttgtgtctgcctcatcgggagggaagagaaacgcttccgcggcgggtatctttctcctactccgaaggcacctccccgctccgtaggttccgctgcgcgcacagcgcgctctgcggtgagagcccggcttcctttttccgtttctgtgtttttcttgctttactttcttccttcttatttcatgtcttttgttctttcggcgggtaaacttgcttttgtcggccgaggtctttttcccgtcgttttgtgttctggctcggctcgtctacggaagtcagcgtcagcagcggaaactcgaactcctcacctgtttcccattttcttagcgggtttcctgcggtgcctttttctagacgaaagacactcgcttttctcgagttgaaattctcgagctttcccggcaaatcctggtctgcctcgtgtttcagatccgcagccggccttggaaacccgtgtgcctggacacagaggagtcccgggcagtggagtgcgaatgcgtgtttgtgtatcctcacttgctagttgatattcttttgacatttttgaagggcagcgtcacagccgcggtgcgtctggaggttttactgtcgagtaaaggggccacgttttcctgaaaggtcctccaccacaagttcttggggcggtga

SEQ ID NO: 3217 - DNA, 1977 bp, Toxoplasma gondii
ggagaaaaaggagcgggcgttgtgaacttcgcacaaaaggcctttcaccagaaccccttggatctgctggctgctgcggacacggctgaaatatggaagcaatgaagggtggagactcttctccgcgtagcacaccagccctggacaaaatgatgtcagaactggcaacaagccatcggcaggaacaagcggaatggttgtttcgtcaatcgagtgcccccctgtgggaggtgaagaaaggccctcttccttgtctgtctcgacctgaactgtcgactgaagatgagttcgttcacttgcagtccgttccgctgcctccctgtatcgccgaacaaactctcgctcagcttctaatacggcaattgcgtcactaacttgcgtaccaagaacgtacgtagcaccggctagtcgaaacagcgtggaaatccgccgtaacgtcttggccggtgatgacccaaactcgtgagcaagggctgttatagattgaaaagataatgacaccactgtaattgactttgccgaagagctccgcaccgaccggagaaactgatctacagagtgatggtccaacaaaactgcttctgctgaggtaacacatccgctgcaagccaagcagtcatagagggaaaccttggccacagctgtggacgccgctatggcattacctttctccccgcctgccgcatcttcctgtccttgtgtcatattcgggttcggcgcactgttccccttccgagcagacgtcattgcaacagcctcccttttcctgctgcctgttgcatgcataccacgatcggtaatcgcacgcccagtttcccggccgggcttcaccaaccgaataagatctgcccgcccatattccttgccgtcattaagatttgctccctggttgaatcggtcgctgttgccatagtccccagtccgtatcccacttctcccgagtcctggtactccattccctctcgctcggccactaacggatctggttaccgcctggtcattttggcgctctggtgtcagaatcgggactacgcaactctgagcaggtgccaagtagtcgtccaagtccgccagcttgacagctgcgctgaaggacgggttagcgacgctttctcgcgccatcgacatcagcaaccacaggactgggcgctaataatgcgatgcctatgtctccgtatgactgactagatgcaaaccacaagctacggtggcaaaaactttggaattaattcaaaaggcgcggcggtgaactgcgccgcgggaccgtctccagattcttctcaccatcgtccggagggatgacgtcgctggcgtacgagcaaaaacgtaggggccagaacacgaaaccgacaaaataaggctgtgcctacatactatgacatgttcttggttttataaggaaaaaaccatagtggaaagcagttatggattttgaacgagcagagaagcacgagcacgtcactcaattgcatgcgattcgcaccgcgttgctttgagtatacttcatcgcgtctcgcaacgtgcactgcattccgttttattcactactagcctgctattttgtattcaataatcagttgtcgtgcgcgacgaccatttgtacctctttgaccacatttgtcgaatgtcggaggcgcttgtgtacgcgtcagcagcgtgtagcaggccatgtatgatcgcgtagcacgcgtacagcgtgtgcacgctgcccactgcaaggacgtggagaacgaatagattcagccgcctaaaaatttgcttgtcgtgactgttcgggagacggtgtttagggttatgaaaaaacgaattccggagaaatcatcagtccccttcgggtcgcccatgttcgcctccactgtctgtacagcacaccggtacaactctacaggatatctaaatacccgacaggttgcggcagtattcgaagtggcgcggacaaccattttttctgacggttgacagcatcatttgaaaaaa

SEQ ID NO: 3218 - DNA, 1860 bp, Toxoplasma gondii
gggcaatggataggaacagcacaataggacaacgatgaggacgcttccaaagtgagggaggcaatcacaggcgcacaaagcatggccgaagcgatcatgacataactggaagttaaaccggaggatgcaattttccttgcacagtagagagatatcacggcgaactttctgtcggtggtaactcctattataaggaaccatcccctagttactagtgaaaaccatgaaagcttatgcgtatatgccctgtatactgacgttcatgcgtgtaaatgtatgtatgtcggctgtcctgagtacatggaaagttacaaatctgcgctgctacggtctccaatccagcacgcttgcacgaagcattaaaagtcagcctctcggttgttacggggaatgttgaggtcatccactgtaatgaaaattggcggtttaaaaaccccctgtggtgagagtgccgtagtgagagcctttcctcatgcagcgtacagaagcctcccaagaccatccttctttgtctaaatgacttagccgttcgcgtatggtgttcttcgttaccggcatcagcgctggtctcccactgaagatgctgcagttcgatgcggccctcgaggcaatcgttgaggcagttggaatgagccgactgattgctacgtcaaagaactctagtctctgcgaccatttctgtgcagggtgacaagccgactatgaattgtgttcgtgctggttaatccagctgtcctacagacatcagggcatgtgtctacaaggagtacaaatatcataacaatcgttttggcagtctccttcctagtgctagtctgtacgaagtagtcgggtctatgcatcgagagtacgataatcaacttggtagtggtccatctctacgtaccaggatacatttcagccacgttatggtcagcgctaccttgggattctctgcaaatcaaacaaatgatggacaaactattgacacggggatttaagtgctagctgaacccgaggcacggtatcgttgaaaaacgctgtttcttcagctgtcgtatggctttccactctccctccgcgacaggagtctgatgtcccgaatgacatttttcattgctcgccgctgtttacagtcgtatgctcctggttagcatgtcgctctcggctctgattcgccgaagagcacctcgcctcacactttggcttttttgctgtgctctcaatacgtctgcgcttttgcatggtagccaaccgttgtctccgttcccgtctcagacactgcagcatttcgtttcaggtcttctccgcacttgggttgtatttgtcgcttttatgagcctcgaaagattacccaatccgcatttctgccattcgggcgcgtagattgtatgctgcttccgtcctgtcctcagtgaacaccagatgtgagtctatttcccgccagtgtgcatgcgttgtcacatgcatcttagctggcgctccttctacagccgcacagattcccttttccctcgcgtctgtttgtttggcaagtcgtttcagttcattcctgtcgaagtcactgcacagatttgctctgtgtgtcgctggcctgcagaggatccagtcttggtgaagggtgtcgatgtccctccggacctctgaacggccctcgccagacatgtccagcgcctgttaccttatggaggcgggtcaggggctcgcctcgtgacgatttcgcctcccgaccttttcaatctagattttttcgcattttccacaagataccgacaatggcaggcgtatgcttgcactctgtctgcagcgcgagccgcctgagcagggtagttcaccactgcgttgttttcctgtcctgcgcctgctttctttcccttcgaa

SEQ ID NO: 3219 - DNA, 3994 bp, Toxoplasma gondii
ctttccacgcgtgtttctcccttcgtctgtgctcgacttcgcacaatcgcttcaactgcaacttttcccgatctgcgagcttttcaatggtgtctccgtcgaacgcctcgaactggccacacgagtcgacagccattcgctcgagcagacgcagccgctcatggtggtaggccccgcgaactcgcaacgcaatgattatgtttttttccgccactgcatgcgccagctcgtacgccgcagcttcgcctgggtctgagtgctgtcgattcgccctgaaaatccgtcaggaccggaacaaggaagatcaacgcatgcgaatctcgacacttgcgtgcaacaaagaggtgaaggaggttggtgaacctttgaaaaatccactgtcaggacgtggtactgcagaaacggtccaacacggtcaagaagagagcatcactgtggcaccgagtccttcggaacaaggaatggcccgtactctacttagtgagcacagaaacaaagaaaagggcaaggttgtcgcagaagtcccctcggtagtatgagatcgtagacgcgccacgcttcgtggaagatcatacccacatttctggctcggataaagcattgccctcttgagcgatgagagcctaacaggaagtggagcttaaatcgaataaacagagacagcacacaacctaggatactgaatatgactccactaatgagatgcagacagccgagattcgtgtgagtgctgcaagacaaaaaaggggggtcttacacggcaatgcgtctgcggcactcgtgcgcgtgtctgtagtgcattgaaatctcctcttccacgagacggagaagttgatttggatactccgtgatggcttcagccgttcgggtgaggcgaatttcctcgtgcatgcgatacaaagagctcgtcttttcctgtgccattttgccccgcaacgttttggaaggctgtccttggtttactgctgtgtgtgccgcgggtgactcacacttgcgctgaaaattgtggggaacaagggagagcgaagcgagctcgtgacacggcaggatcgcttactaatgacagaaacgatttcgaaaggtgaatgagagagcgacagaatggagacagacctcaaaagacggcggcgcaccgaggagtacgaaagcgaaattcgcacctggttcgcgagaaagagaaagagggcgagaaaacacaacggactttggtcgaagagaaagcaagggaaagccaatgtgtgaaagtgacaagatgaacgcgacacccggtcgacctgcgacatgaacacattcatcgcatgctcgtgctgtcttgtgcattccgtcggttacggacgcatgactgttcactggaaaaagtctcgtgggcacgcgttataaatgaaacacgaaacatacagatgcaagcgcgtttgccgttgaacctcctggaagtgtgcttctttctgtcggagcggaggccgacggtaggcgaccggggaagcccgtctccgaacagctgaaaatttaaaacgcgcatacctttttaaaggctgaacagagtgtgtaggaagtcgctgtcctcaacaggatatgaaagacaagcagctgagacaataacggaaagtttcaccggttctgttcaggcccggccgaacgcatgcacatgcggcacaccaacccccaagacaaaaataggcgtgccgggaaagaagccatcactcggtgagtccttgcggcaggttttgcacacgttatgaattcacaaaaaaccgttgcctcatgctaaatcagagtgacaagaaagccacaatgcagatggcttgcacgctgtggagccatgtcatgaacaacacgtgcgaaaaagtcaatgaaatatcgatgtccaggccaacgtagcatcagcttcggagtctaggccaaattcgaaaggtatcatttgtctgccaccaggcgtcagatttcctctgttgaggtaggggaggggggacccagacaagaactccctcgtgcgcaagtgtctgcatagctcgatgcggcgggatgactttcgacttccactacaactaaccgcagcaaagggtaaggctgttcgtaacgcagtttccacagtgcgcgaaacttgcatctgagaactacccgaaagcgcaaaagacgaaaaggcaatgtaaacggatttcacttgaactatagataatgccccgtagcaaactacgtgacttgggtacggtagactttctatggtcaggcattccgaatcgtacgtgctttcctaggagcgtatagccttttcgaagttaatgcaccttcatctgattggttggatgaaggcttccagttgtccatctctgggaatatgttcttccttttgattttccacccatccagaattgtagtcagtgcacagaggcatcttgtatacgtcgttactcgggttggacccgtatcgtggaagcgattgcttgtgagcacacccagtcttgacaaaataagatacatgcccgtccaaattattcgctcagagaaaacaaaaggtctacctgcgatgcggcttccaagcgcaggggcctcgccgacaacagcgtgcatcagctctttgttgcccaaagcactgaagaaatccacttattagttcgtcacggtaaaggcgcaacgattgtgtggcgagagcaacgacaaagcattcacgcaggaagcactctcgtcagttggttggcgaaacgcaatcgttaaattccggtacttctttaagtgggggtctgaaaaagcgtcactggtagtaaggctctacccctgtggctagtacctgtgtatgttggcattgtaacgtgaccaggatttcaggggaaacgcgtagagcggacacggacacagtgactgttcttggcaatatcccatattaaacttggtagtgcaccgattagcaggacgccctgtgtgactacaaacaatgtgtttgtgcatggcatagcagctatacggtagttcttgagtcgcatcctggaggagggacacatttgtgtgcattatctcataagtcagcaatgccggaaaacacggaatactgacatctccagagctgaagatactggaggcctagcggagtgaccccgagtgagtgttaagcgcagcaaaaacacggtgacgtcgcgtcgctctctccttccaatgtcggcttagctggcgctttcggtcagttcggcggatcggatttactgagttgaatgtcaatagaacttcgatccggtaaaggaataacatgaatgtctaaacgagtagtccaaagttgtttttgtagtgcgtcgaaaatctcatgaactgctgagcgcactctgcatccgaatatgcgcttctgtcttgtaacaggccacccgcgagttgccaactctgatccttgttgtcagtacaataattgagttggtggatacggttgttaagggtagtagaggtcccgagcaaacccgtcgaaatcctgaaagactgcctgccgccctcgaatcagttgttccccaaaatatactgcgtgcatccctgttcgacgcgaaatcacactctatgggaggaaaatagtagacgtcgcttctcttttaacttaggatgggcatgcggttattagacctcgggacgtttttcagttactcggagttgcagtgccggaaggccaggcagcgaatccacttcgccttaaaacttgcacttgctgtcgcacgcgcatgccacattccgaagcacgtgcagtgtctttcgacaccgttgcccatcaacgggaagtcgcgtctcccttctaccacttgactgatcggaaaactatgcacaattgggaaaatttgacagtgctcaggagaggactgtccagccgcgcacatgcagctgcggaacaccgggtctcgaggacgaggttcgatgatgtagtcctagcaatcgcttgcccgatgccctgtttctctgctaccacgtgcctgtggttgcaagaactggaaatttctggaagaaaagctggcatgtgcctggatca

SEQ ID NO: 3220 - DNA, 2936 bp, Toxoplasma gondii
atctgtgtcggaagtgcgcctttgttatccttgtgtcgggaaacataggccggggtgctaacgtagtcaaccacgcggcggtagccgtggagagagacagcagcgaggtgggtgggcgcaactctcaggtgatgtttgtgtttcgacgaaggtcgcggcatgggatctcctatggttacacagtcgaatgactgttccattaacagtcgagttcataccgcttgttcaaacgaacctcacagtgggcaacactgactttggttagtatgccgtcataaggctgcctgtgcgttatttcctgggtgtttcccgtggacgaagtacagtgttgtattatactacttcggtgtaagtcgctcttcatcatggcttgcccgcaggtgcttatttgtctacaaccaaactcttttgattcattgctgctaccacgaggcatgtgtaggcatatatttcaggcataacaccacgtatagtgcgtcaaacgagagtccgaagccgtcgaaagtatagagtcagctagcactgatcgcgccagatccggcaaaaggatgtagggaactcgaaaatttggagagccctgctgtcccgctacttagttacatcccgcagccggtgagggttgccaatgcgctggctgttagcgggaatccaaagcgtgttgagtaagaaccgaatggtgttgcttcgttgaaccctttgttttgtgccccttgttccacgagattcgcagccgggtacaagtgtaacgatagcatgtggtgggctccctaaagcgtctaggtctaaaaatgctgcacattgcctcctgcctgcacacattacatttggctgtgaaagacctcttggagcagactccttcaggaggaactaatcggtgtcgtggcagccattccaggtgatgcggtcacgcctgaacgagatgctatctgacgatgagcagccacctggctcaccaccgcaagtcctgctgctctcaaaaatcgtggaaattcttgacgaccaaacggatccatctgccaattttgccactagctcttgacctgatgaagattgtcccatctgccgatgtggtgacagtttttggtatctcttgcttctcctgaaatactacgtcaatgtcgtagtgtgatagtgcctcagttgcaattctcagtcatccattgagtcccggcccgttaacagcaggcgtttttaaagcaaaggacaggttcgattctagtcgagtcccgcagtacactctgtttaactcgccatggtagcttctgttatcgtctaatcttcactttattgttattctacatatatacggatcgttctgccgtagtccatatttattgttgcttcatggtgccaaactagaccggtaagtcgcagccatagcctggcgtcggacacctgcttgtgcaatgtcgattttcagtccttcattcagttagaggtctagggcaggctcggaggtgggaaacgctttccttaaacagctgtatgccgttaaaggaaacaataggtacttttgatgcttgacgagcaagtagcttggcggctgaaccagtcgttagcagcgtccctccacttcagttctgcgtaccaccacaccacaaactgagttattatttatctcggcagcaatggagaactactatatctcaacaaaaactcagaataagcgggcatctacaatcacgcacagtcgtcctcaacactcactcaattccggttgtagttggcatatatttgcctttctgattaacgacgctctctctattcgtgatcttcgtgagtggtcacaatagtctaaacatatccggtgtctcacttgtggttcgtctcaggtttccttccaggttctcatcattgagcgaatatggcgtgccttgcactgttcctctctcacccactgcgtgtggtacctcccttcttctttcccaccacacggcggtcccagccgccagcagacatcacgacctaaaactcatcttcgattcaaggcgccgtttgtctatttttcaatatgttagcttggacccccttatatgccctattcaccctaggagtaaacgtctgggctctgctcagatccctggtgaaattcctaaatagtcaactgtgccagaatcgggcgtggatatagttcagttgctttcgattcttagactgcaacgtaatatttagcggtcctaatcctttttctgatttcgtttgttctttacggtatgctgcgagatctaccttgaatagaacaccgacttgacaccagcacagttctgctgagcagtaccagactaccttagcaggcggctgctttttacctgagtggaaacagtgaaataacaactgaactgccaactcgagaggaatgtagaattgattccggaactctcccccaccacacgtacatgcatacgcacatgactgccttccgccccgcatgcaacatcatcttgatgcacccccacaactaagtgaaggttaaacaaaaacgtctcgccaagccccgtccttaattttttgatctggtgaaatagcgaagacggcgggttatttacacctgtcgtctgagtatacgccaactggtgtgtggtcaagtacgctgtggctgcgaatcgttccagcttcggagaatcattcgcaacactagccgagatcggcctctggcagcggcaccgtgctcgctttcaaacagtccttccgctgccctaacactacactcaataattcgtcagtcgtgatctaggcaccgatgtatgactcgtcaagttcgtcaaacttgttgctttcaacccacaactgaaactgtcccagacaaagtcgagcattatttcgtccgtttccagaactctcgtcacgtcgcagtcatctttgatagcccgatctgtcacgaccctcgaccggaggtgtctcagttctacaagcgaggtgtttcaataagggaaaga

SEQ ID NO: 3221 - DNA, 3589 bp, Toxoplasma gondii
ctcgtcctcgatctgcctgtcctgaaccgacaaacgcttctgccagagtcttgtcgcagggacaggccgaagctgtctcggcgctcccctcagacttccatccctccacgtcgtcgattcatgcccgcgcctctcttgcaaccggaggaggagcgggagaagcagcctctttcagcgtctcttctcaacaccgagggcctgcgtcgggggtcaaggaagtcgaaagatccttcgctgccctctccggacccccggagacgtccccgcgggtgtcgccgactgttgccgttcgacgggggtcgaccgaggcgcccagcttctctgcagactcgccaagcggctctggaactcgttgtgattccctggggcttccaagctttccaccgccagcgggaaacgcagaggaaagagggatcgactgtgtttcggtgtcgagggtcggttctgcggtctcacaaccacctggagaaatctacagtggaactcgagagggagaggaaaaggaatgcaagatacgtcggggcttctcgcccacaagcgacctttccgagccttcagacagacgccagcagagtcagcaaacaccttttttcggaattagctgcagtagcgatggttcgcggagcgaacttcttgggtcctccacggggtcgctgtcgaaagcctctcccgaccacccgaaggcaagcgccacgcctgagaaattcgactttctttctctctccaaacagtggctcccgtgcgccggaaaagacgtcgaaggtttcgttgccgctgctgcggcctcggcctggggcagcagtgcacacgagaacatatgatggctctctgattcacctactgttgaacgttcttggcatttttgtcaacggctttatatatatatatatatatatatttatgtatgcgcatgttcatgtgacccttgtagatgggaaaacgtgtctgccttgggagcagaagggatgcttaaagtctggacaagggggctggttggcgaaccggggttgatgagtgtgtttttgcgaaggcagaagcggaggaatgtgtcgctgtcagctggagagttttttcttcaaacggtgcatgtgctaagatgcaaatgaaaggaaggtgagccccgtgggggcgcgaaagggcttgcagggcgctacagaagggtcgagagcaaagcacaatcgttgcattctacgtcaatttggctttttcgctacagaacgaggcactcccagccacgtcgaaagaggacactaaggtattttacgaagacaacaactttccttcacacgcggcaatccccaccgcagacgaatgcaaactggaagcggagcagtccagcttcctcgatggctggccacttactatttttgctttgatcattttcacggacttctccggcaatgcaggaggctggaatactgcgggtaaatccactggagcgtctcggggctgtaacatagtcacggttcctctattttcaaaccccgttggttgttagagcaccagtccgctgtcatgttcaagacgctcgagaaaacgagttctttcgttattcctgcggtgaaaataaattcagctgacagccgcaaggtcagatcggtcgaacgggcacgaacctaacactgagcagaggcgtttattcccctcagacgcaggggatgcaaaagcgcatttgcgtgagacgcgagtgtgatgatcgattaccattggctctgctcggacagacggcatgcggttctttctcaaattcggaaccccagtgttcctcagttgccttttatcctcgtacgtcatcgacggatgcaaaatgtctatcgcatttcgttgaactgaactgcttacaggcggctttcggtttgacggaactttcaaaatgcagtacctgtccgtcggttcgtacctcaaaccgtgtatttaccggatatatacatatatatacgttattgtaggagtagcgaagcttacagaaaagcacatgtttttatcgaaaatcttttcaagacacgtgtgttttgccatgttgaaagaagcgatctggggttttcactcccagtgtacgacttcagcaaaaaatacgtcttgagaggagtcctaggttccttgcggtcaacagttaccacccaattcaaaacagatactttgagtgactaagacagaacctctctgtcgcgccgatcttttttgaacttcggtgcagcggcaaactgaaggttacagcgtccgtgtcggtctttgtcgagacacagattggaagaagaatttgcgtgctgttcaccgatattaatcgcgttaccgcgtggttctaaagtcaaacgagaaagacaaacaaaagcgcggtaccggctgggatcgaaccagcgaccttgtggttaacagccacacgctctaaccggctgagctacggaacctgggactcctctgttgtggtgccccccccaaattctgtggaagcagctgccacggaatcgagtttttccccatcctgcttgccccccctgtccaagtttcattggcacatgcatgcaggattgttctcccggtgttggcaatctcttgtccagtacttttttttcaaagcccctatttttcctctcggagtctgtcccgagtctggacttaacacggtgtgtactcgctgccactccgctggagaccgcgggtggcttttctcctcgctttgtttgtggagaatctgagcctcgcggtgtccactggaagaaacataagcaactgtttccgccagcttgctgtgtattacttttccagtcaatgtttgtttgagatgtgtacaaactgccgtctgacccctcgcgtcaagcaccacatcctttgccgtacctcgttgcttttccttcggccgcggctcttctccggaatgcacctattctactgaatggtctaacatttagcgacaaactggccgtttcagcgaactcttcaaggcagcagtcagcacttcttgggggggtgctgaggaaagagacgacggaacgccacactggcacaccgggacactctctgttgatgtgcctgcagccccgtatttattccaaaaggcatgctcgggtacccgccagctctacatttaattcgcttatgcgggaatctccgttcaaggtcaaattcgacgagtaacggaccgaaacgaatctctcagacgaccgcgagaatctcatctcagaattcgttccggcggtgtctgtacgcccgagccccaggctaggtccgtgatcgttggacaatgtcagtgtggcatttttcgtttggacctccggatggagtagacccgtagaatgcttgtttgttttcgctggttcaccatttctaggcaagaaatgttaacagcaataaggcctgcccgtggtgtgtctcccgtgggtcgcttcgtcgcctgagcgctgcctccgcccgaaggaccccagtacttcacacccctcggaaaagtgggtcaacattctgcactgcggggaacaagattagcgtttcggcttctccccactttttcccgagcaccgcgggagtctctgtttgccttttgcatttccctccaccctctctctccgtctcgcgtcccctccacgtggtgcaa

SEQ ID NO: 3222 - DNA, 2477 bp, Toxoplasma gondii
agctgcttggacggtctccagagtcgtccggtgtttgatcttcttcgcgacggccggtctcaccaattggttgccgtcgaattcctctgcatgtgtggcacgaaggatcaactctcccgccgtcgcgcagactccgtaaggacgcccaggccagacgaaggagacggccctcttcgtcctcaggctcggcgcatgttgcttcttgctgtctcgcctcagacgttcctgtgacaccctttcgccacggatctgtcatgcatcgagaagatgtcaacaaagcgaggcctgcgcgtttctctgacccctgcgtcttccgctctcttcgcgcgtctcgtcttgcttcctcgtctgcactctcacaactttgccctctcttccgtttcccccttcggcgctggccgacagcacctgtttggaaggcagtctgaggggagaaacgcgtcctgaagtctcctccgtcgccgttcttcatcgtcgtgctgtgaacggttccgagaatccgcagcgatacaaattcagggaagacatccttctacggttgcggactgccgcggagctgtcctcgcaggcaggccttccacgaagcacaggaaaacgagagcgcgacaacgagaagctgcaacgaatgaacatgaaagcagactcgaagagaaagaggaacgaggtggcaaggagaaagtgtgaggagcgtcgtgtttacttgtcaacaaagaacaagacggagacgagtctcaggacaacagctactctttcatagctgtctggacgcagaaagatccagagaaggtcctctcacaatttttcaactcagacatcgcaaaggcaattactcgccctggttgcgctgacttttgaccgcgtttcgcttcttccagctgtgcacccgcagtcctcgaaactgagctcctgggcgctccctgtgccttcccagccgcgattggctttgtcgataccgttcaatcgtaggagccgcgtcttcttaccctgttcgcggcatccgccgtcgagtccactttgtttctctccgttccgctctgtctcgcttcccccttttcggctgagagtcctcggacatagagtttaacagctaaaacaacaaccttccaagttaaacttacgagttccaatctcgtaattggctatatcgctgcgcatgaagtgctctcgcgcccgtcgcgcctctctcagtcgtcgacgtcatccctgtttgtgtacaacttttgtagctacgcggatcccccgcttccggcaactcccctttgcgcgtttccgtcgccgttttctcttggagacacgcgcggtcctctctgtttctgggtcgacaccgcacgtcggtcgagcgaaggcggcgacgcggcaaaaagaaaagaactaccttgaaaaccgcgagcaaagaccggccgcgggccggacggaaggctgcgcgtcgacgccgacacgcaaaagcggaatagaaaaaggggaaggagacgcataggcagctcgacagacagagaatgaccatcagatccagcaggacggcaccgcacgcgccgtttacttctttccctggaacatgaatccggttgtgttcgtgagtctggctgttggtttggcgacgagaagtggagagtctgcaaagagagtcgagctgaaaaaaccggaccgcttcttccgagatgaggagggacctcgacgcatgggtgtgtttctgagcgaatctgcgtgtttagatgaataagacgtggcggcaagcgacgaacggacgaaggcggaaagagtctagctgtcgctcccatcgcacgcgaagtcggcgcggccgagagggcttgtgcgtgaagtctcattcagcagaagcgagtatccgagtatctcgcatgcagttttgctctgtcacgtgtctgtctctgtgtctccgtctcccttcctccttctactggtccttttgattttttcagttcagcggagacgctgtacgttcggactcagtctctttcaggcgggttttgcgtttcgctgaatccgctattccgccctctcgagacttcgatggttggcgatcgacacgtttcctgaattgtgctcgcgcgacttttcgccgtgtgtgtccccttttctttgtcgcgccttggcttgaatgatggaaagcaacggaaacaaacacacgctggtgtcgcatatccttcctctctgttcccactttcttgaggaacgcttagttctccttttccgtgattgggcttggatctcctctgcttccgttctgcagtccagcttcggcgtgttgccattcgcaagtgaccgagttacagacgagtaagacacacagattttacacgaggactccaattatgttaacgcagatctcgagaacgcttttcgcgaccgcctggtgctttagttctcctgataacgaagaaacaccctttaacgaaccggcctgtgttgcttgtcagatttcccccttctgcacgccccttggtcccgtcactccacca

SEQ ID NO: 3223 - DNA, 2482 bp, Toxoplasma gondii
ttcaagagcggctcgacttcgacgagggtgtacgggatgttgaggaagtcgaggcaggcccggactttcctgcagaacgggcaactctcgaactgcaggagatacactgagcagttgctttctgagccgtctgccgtttcctgtgttgctgcactttcgacgcgaggcagctggaggtccctgggcagaaagcgcggagacagctgaagcgtctgccggccggaagcctcgtcgtctttgtctccagaagcacccagcgaaggacgagacgaagaagagagaaggaagcgaatgagaggcgcggcatccgaagcagtggagacaacgacaggctcgggtggcttggaggcgctcgggaacgcggcaggtggaggcggaggcaaaccgatgccttctcctctccctcctggagcagcctgcgcactctcacgaggaaaagaagcgacgacaggagaagcgtccgcggacgagacagggggaaaggtttcgcagccttctggctgtgtgcggcaggcggcaatttcatggcgaagggagcagccagaagcgaggtggaggctgcggggctgcggatttctgattgctctgcttttcaagaggacagatgagacactgctgagctggttcctttccgtggagaggactcgtgccgcaaaggtggaggacggtgcggaggaggcgcgatgagaagagaaggaagacgacagacgaggttggggcagaagacgcgagtcgagagaactactcgagagtggagactgaagagagagaacggcaggcctctgtctgtcggtggggcgcgacgaagaggccggcgccagctgcccgccgcatgtatgtgcagcagctgagactgctggaatccacatggcgttccaagagagcagcagagaaaagtcagatctgcagaagaaaagacctgacgtcgcggaggctccgcagcgaagctagtgtgtgcgcgagcaacgcgcgatgaggaagcgaacgagcagaaacgaagtctcgattctttgcactgagaaaaacatgctcaaactgatgtgtgcttggagagagatacatagagacgatgcatgcgcagaaaaatggtagactcatccacatgattcgcgttctcccgtacatctgcatgtccgactgatcaacaacttcgtcttccgttgctgcaacgcgcgtttttccgctaagcagttggaaggagtcttccgcgtaccaatgcgaagactgtttccaacagcgactccatcgttttctagatctttaccgatgcatgcgtttgcttctttggccaagattgtcttgaaaaccaagcaacgtcgcccgccccgtctccgccgtggttttccaagtgagacgggagggaaagctccgcgagtcgttgcattgcatgcgcgagaagcgttccctccttttcggtttttattccaggtttctcggtttctgtcccagcttgcgcttctgcgctctttagcagttgctcctccgtcgagagactgccatttctctcgaaagggcgcgacgcgagaaaaactccgacgcgctccaacgacgaagtcatgacatttgtgtgtttcattgcagtgaccgtgctctgctactttacgtcgctggtctttgctcgttcgtaccttttccgcgagtctgactccgtcaaccacatccgcgcgcgacgccagacttctttgattcttgttttcgcggaaagcatgtgccagtaccttctctccgtcttctgatacttcgagactccgaggcggtcgacaactggagcaacgcgaagaaaacgcgtcgcaggggatcgtccgttgctgccgtgaatgcacactggaacaaaaaagctggcgaaaaattcgagaagatcaggtttcctcggcacacggaagtctcgctcttgagtcgaatttcaattctgcccgcgcatatttgcgtctggaccgagactcgcgattcctggcagcgtcgctcggatgtgcattcacctcagtcctcccgcgttttcgcgctcggtttgttgacacactttagctttgctcagcgcgcattccaggttgttaagtctcggagacttggcgcctccttgtgagaactctttctctgcttccaccacggatgttccccattccctgcctcctgcttctctccatttgcggttgcgtcttcttcgcttcctgaagccgctggcgagactgccttccacgagcgcccccagtctcttttccgcgcctctatcgggatgagctcgcggaatcgacttggtttcatggcctcaagagcctcgtgaggctttgacaacgcgcaggcgggcgtcctctatctttcgaccttcgcaagacatcacggccttgtcatgcaactcagcctcctcgtctcgtctgtttttcgctgccggtcgaagcaatctttctcgccgtcttcagactctccactctcttctctctcggcctctcccctcttttccaaacgtaactcagactgcatgcaa

SEQ ID NO: 3224 - DNA, 1811 bp, Toxoplasma gondii
cgtatcttcgtcatctcaggagtttacgagttccaggagagaacgaggaaacatgtgaaaaacgaacaaggagaaagcgagaggaagcacctgtgcagacctatctgtcttctctgtcaatatcagccctttcgtcgacataaatatataaacatatatgtaaatatatacatgtgtatatatatatatatatgtatgtatatgtgtgcatgtctatatgcgtgcatgcatctaaaaaatgtgcttacataattatatatgtatatatatatatatatgtatgtgtgtgtgtgtgacatccgttgaagccctgaagacctcgaattggatggagacactggtggacttggactcctgactgggactccgtagaatcgatttatggtgaccgccggaaacagctcctcgaactcttgctctccctctcatgggagaagctcggaagagcgatttgagaagagaggactggtggccgccttcctcagcgaagcgattctcggaagccgcgaaaggtcatcctgaaatcttctttcgccacgataagcgcctgtttccctcagtcggtgaacgcagcagagaagtcgcgttcttcagtgtgcagtagtccaacagcggaccaaagtcgtctttgcgacctcgtacgccttaacggtccgaacttctgagcagagtggtttaagtgaatgtgtgtcgatgtggaaagcgtcgcgtcgatttctgagtttgtgctcggaggtccctgtatttcacttgcgtttctctgagtgcgtatctttgaattcctacatgttcacacgtggacacccgcgaataattctttatctacatacaaatatatatatatacatacatatatcgatagatataaacagatgtagctagctacgtatagatagattgatagatatagatacatatagttacagatggatagacatagatatgtgcgtttctgtagatggacgcgtagaactcgcgcaagctgcggagaagcgtttgggtcacaagcaagagacccagcaacaccgaaaggcgttcttcttttcggctctgcacaggcactccacgcgagagggattttgctgtttctacagacgcaaaggtcttcgaccaatgtcgagtttcgctcgaccgttgctgcttcggagatctctgcgtaaacaattgcgcgcacccccgcgaaagctgtcgacgttcacagagaaagacgcagagaaaggcagagagaaagaccgagccgccgagagagagacgcagggagagagaagaaacagagcgagaaagaaagataggtgaagggagatgaattgagagagagggagagagcgagaagcagaaggagacagaaagagaaagcgagagagacagagtaggacgaggcgcagagcggtccgtccaggagagagacggcgagggcggaggaggtcgaagagacatgcagaaaaacgaagacgcgttcattcggcgagatgttgaaagaaacctatttttttgagtttacgaatatgttttgagatccggccatctcagcttcgttgcgccaccgcaaacgcgctatacaccgtctcccgctggacctggcccgcgcgcgttgctgacgccgtctctgatccttctggagtgaagcgcttcgcatcactttccccccgtttttgacaagcggtttgtgtcaaaactttggtttttctcccacagacgttgcaccttcgtctgccctcgctctcttcggtcttcctcccttcgtcgtcgctccacagcgccgtctgctgcctcctcctttttcttcttttcctgtttcgttttctttacca

SEQ ID NO: 3225 - DNA, 2911 bp, Toxoplasma gondii
atttcaaggagcttggcgccggttcgccgctgccttactgaagggtcgctgccgccagcgacggcttcactggatttcccgatctcccacccactgtcatccgtttgcgaaccactttttgttgaaccgtgaggcagatcactgcatgcgccaaagtcactgtcacgtcgtggagacgcggaaactccagtggcgcatgcactcccgacaccgctgctgccgtctgcagctcctggccacggccgggctttcgcaccggttttctgcctttctccagagacgggtcggtcctcatggccttccgtcgcttcgtgaggcgggacccttcgtttgtcgccacgtggtgacttagcgcagtcgtccgcgccagcagtcccagagcagaggccggtggagttgtcttcgtgttgctgacgttttcgaagctggtgctgctgtctcacattgaaagagcgatcctccatctcctctacacgccgcatagcggcagcagaaagaagggcacccttggtgccaggcgcttgcgtcaaagaggtttgcggtgcttcgagtccgccgtcctccatggtacagctactcgcgtcaagaacgggagtgctcaacttgtgcagccacccacgagaggaagtgaatcataaagttcggcgtgcactaggaactcccgagtccgcgatcggacagtctaacggacggcgggatatggcgacgtagaaaacgtttgtaactgatcctgtctcgattcacaggctctacgtttattgaccgacaccggaggaacacggtccacagaaacagaccgaagcttcccgagacgcagatcctcgtgcgctcctgcacatgacggtccgtcctccgctcgagtctgctgtatcgctgacgaaaacgagtgtctgtagagcacgatatgtggggttccaagtacgcgcagaagtcctgacagtaccgtggcgggccctgcggtatttttcatctcaggtttggagagacgcagaggccccggctcttctttgacaggacgcagccgcggatacacaccccctatttcgcagggaaacgtttccttgcagaacaatactcgatggaacgcagtgtgtttcagatgagttgggaatgaccggcagttcagcagcaagggccgcccgccagccagcagtgacccagaaaagagagcccacgatgtggcagaggcgttgttacttctgtccaagaaggagcacaaagtgtgatacgaggagagtatgtggcttggaatccgcgaaacggtggaaaacggccagaaaacggaaaaaaatcgaaacagtaggagggcgtcgtcttctcacagacgtgcgcatctaccacagttgttgcacagacccccctgagaaaagcacgcctcaccacagacatcgacggaaaaaaaacatgccctaatacgcgtgtaactgattgtgtgtgcatggcagagtaagtcgccaacagactaaaagtggccacagagaaggtgcaaatggtagcaaacgaggagatgacaggatagagatttattcttggggcaacccacctccgaattcacacccttcacgtgagggagcagacaagcgcggacagcatgccacccagacgagctgctaagcaaaaaacacacgccacgagaataagacaaaaccattgatatcccattttcctgagagcacactgaacaaatggaggcgtgagctcgcgtgaatacctcgtgaggctgaaaatatatgcgaattaactgttccacacgaggcacgcggtttttcgtcataattttgctgcttcgctcttggtacgcgtctctgaaagacaggataaaactagcgatttcctctgttcacgacgttgccttctcagcactgccggcaggcttgaaggcacttcaagctcatctttcagaggaaacggcctgtgaacttattcgggcgatactgtttgagcgaaaggactgttaattggattttcaaccaggtttgcgatgctggcctattaagccaatgcatgaatgacctcgtgtgttgcctgctgcacccgtgctggtgtaacagaatagtgtagtcgcggcacttgcccgtaactgaatgctgaaagggatttcctgtacagaaagccgtacgaatgtaaggttgttatagtgcggagatatttcgacaaaggcttcctgcctttagtgcaatggttcctacccgacaccgtacacgagtgactgctggaaaactacgacagcgcatcaatccaaaaaaaaaaccgcggccggtcatactaccagtaaaaccgaccgtcaaacaagtagccaaaggacttgcaaatgacgaggaaagagaggggacgtttggaagctcgtgaagaagagctgctcacgaaatgtcgctgcgattgtcttcaattctagccggcggagagcctacgaatcctcggcccgcttggtcgggagctcgatcgcagattcctctattggcagtgtccacggaaaatcgtgaggtggtgcttgtggtaactaagcatggagagacagcagcgcgcattcagaacaccccgtcggcaagggatggcgaagagaatcagagagcgcacgtcagtgcgttgagatggcatcctcgtaagcttgatattccttaaaggggtttggcttgttttgacaatgttagtttatatgcacccgaagtcgctgagcaaggcagaagacatgactgtcctgacacaactatgaaaatgcgaacacgtgcaataactgccccgaagtagtcacttgctttccggacagccgcgattgcactgtttctcaagagaagttcgttttttcctgagctttctgctcgtcgaaattactctcaaaggcttgagaactccggtgcagtggcctgaagtaaatgtcactgatttattttggcgcgtctctgaatcggaa

SEQ ID NO: 3226 - DNA, 4206 bp, Toxoplasma gondii
tgaatcacagtttccttttgcaaacacgagagttgtgggtaattcgaaggatttggatgttatgtatcagcagctcaggacgtttcggttactttacgtagctgtatcgtttctgtcctctcgcagtgggttttcttcgtaatgcgtagtggttcgttggtccacccatcgacgacctactgttctggtgaagaaatgagttttcttcaaagcgtgttgttgtaccagatctgcgcctttgctgtgtgtttatctgccaacaagtgttgggtggcacaaacgatgactcgtttttgctcttgttatcatgtttgtatgttggtaaccatccggtgcgtttccgtcggttgctgtgctccagcgccggatgctatgcggatgtaattgagagtaagaggaaacattatgtagtgtttgtgtcctcttgttgctgtaatcccgggatgtgagagaagaaatatttcttgcctgtgtgccgcgtactctcacaggcgacgccgttgtgtatgaatgaggttgaccgtcggaaccgtctgctatccgaggagaaccgcgtgcaagtgaaagtgaacgttaagtagccaatgtgcatctggcagccggcgtgcgtccaaagactgccgattgctgtggttataagggaactgtccgattggcgagtcgtggtacgcctcctcactagagtaaaaagaagaatgggaatgtatttgtctgtatacagtatgcgcaagagcgtttccacacatgcaacatacaggcccttagtcctgcacgcctgtagtgattgcgacatttttcccagtgtaaatggaacagcttgagcggttcccccggcattgcctgtgcggatattcacgactttgcgagcagtttttcttgttttgtcggctaccgcggaaagcgtctatgccagtcagaactcctggcttgtagccgtcaccggctccctgttcacttgtcctaccatcggacattcaacgctcaaatatctgagtacatgtgactgttgttctgtagtgtcgccaccccctttaagggatcacagtgtcgcttacccatgtatgtttgtgatgcagttatttgcccttctgtcgtgtcgtagatgcttgtatgcgtctctgacaagggactcacgtttttgtttgggagcactgcatggattccctcaatatcagcataccgttgtcatccagcttgctccactgtattgattactgttcttagcgagtcagttcagcaccttcagcactgacagtcaccgtcgttacgtccttacgtttttgtcagtacatttgtaccggagattttgaggcgccgcttcgtctggagcaattgccctgatcttacgcgtatcagcggggaatgtgttttgctgcggatgtcaacaaggcgccgaccgctctcttttctgtgacatcgaccagtcaatgcttgtacgaatatagcttggatgacgtgatagagacaatctacctcatttacgtacatcgagaaacgggtctctcctcactggctgatgtattcatgcgagttcctttctagccagcagttgatgcgtcgtgttacaaacatttggggagagtttctttatcaggaacgcccagcggttgagcgccagaacccttgccatcggcgtaaattctttagcatattctcgcaattcattgttgtaccttgtgtttcttacagtgtccgttgatgagacgcactgccttcgaatgttccgtggtgcaatttagtgccgtgcctcgattgatgccgtcggggccacttcgtgaagatgttacttcgcaggaggcaatacagaactgccccatagacaaataaaaacgattcaataggattgagcgcatgtgttcgggaccagcggtcggtacactgcttcttagttacgttttctcgattgagctgtgtcatcacctaccgtcgtcttgcggctggaatgcagtggtcattcaccacagtgttttcgatggtgccgaggatcttttgcaatgtggccaagtgtacataattgatttttgtattcccttcagagatccatgtgtgataatacattgttagtattccctctcagagcccgaatacgtgtatcattaccgtccgtttttgtaccggtgaaaacaaaacgctgactgcccctgctggaaagctccctgtacgacagtctgaaacggcagtgttttgaaatggcgagtccatcattctggaggacgactcaaggtggagttccttctcagagcgattgtttggtgttttcaggaaaacaagtcatgctctctgatgtgatcgacttcttccttcctcgcagctgtctatcatcgagcgaaaccatgtcgacactgcgttgatgagattttaagatcgaggttaatcatagaatatagtctcaaaccggatgaattgtgtgaactgctccggacaacaataaacatttcgccttcattgcagtttggttgcccgttttacatgcgcacacaccgatgctgtttggatgccaccctagtattttttcagaccatagcgagaagcacactgttcactctgtagaactgcgtggtacgaaagttatacacacaagagcttgcgtaaaattttggaacgctcctcgcgtcggtgttctttgcagcgccccgacgtatgaaaagctgtacattttgcagtagagtttacggttactcaacttaccggcgcagttgccttatagccgatactgaaagaaagatgtcctgcgtgacatccgtgttgcgcgcctttcgtgcccgctaggcaatgctttcggacgcatgcaagtactctgttgtttcctgccatgccgcttacaacaactacgattggaaagacctggatgccggatgtcaaacacctagcggtaccgcgaacgtttaccttcgatggaagatttacaaaagatatgggaagcaagaaacagaggatggtgttcaactactctgagtttcccacatatttgcgaatcgtcaagttctatacttcttatggctatttcggttacctctgtttttgctgacctaccccagagaacacttggcctgtctcacgggtagagtttcagtgaccctgaaagatgaaactcaggggtgaagctattttactcggaagcaaaaaccctggtcaatctggagtggtctacggccacagctgcagtgtaagacctgcaatttctggctgccagttggcaaatgtcttctcagagtatgcgacgctgtcgtcttgacgcgtacttgcgccactgacaacgtgagaaacgcctacacagctgctgacgaaaaatgacaaggccgccggaatgttagaggacagaatagcagtcatattttcattcctttctcctctttatgtgtttagagctataccactagttcacttgcactcgcacgacaagactacgatccacacacactttggtggctatcatgccactcgggaccccacactctgccgtcgtctgcgatgagggtccacgggcctagtcgagcagttacccagtccacgctcgtcgcactgttggatacccacgtcttgttcatggttgtctttccaccttgagacagtgctttgccagagcacggtaacgctggcaacgcgtgaaacacttccacgtgagtgtcggaccagcgttggctgcatgtgaaaagtcgactgcaagccgcaagccacaatcgaacaagaaagagcggtggtcacactcgggaggccacacgggcaccgaattacaaatgccagaacacagaagagggtccgtgtctttttctgtgctttgggccgattcttctgaggctatgcttgcgactttagcagtggccgcaagcgctgtacaaggtcgtccacttgatccggtgaaacgcgtacgaaagagccacgacgcacgacttattcgttcatagaaaaacggaaaatgtgccctcaaatttcgtttcaaatatctgaactgcttctgctgttgcgttacggacagaaattcgttccttccggtctccgcatcggggttcgccgttatctgcgtcttctttttcaggcatctgagcccgtcggcaccacctgtaccaaaatgggacagcgacagctttaaaccttctacgcgggacggaaatctggcgtctcaagggtacattgttttcttctcctgttctcgtactctgtaatttctgtaactctccgttctaaactccagcggtcgatgcacga

SEQ ID NO: 3227 - DNA, 2570 bp, Toxoplasma gondii
aaagacggaacggagaccttcgaagcgccaacagaagtgcgggaacaagagagagaagacagaaacgaggagaccggagactccgggggaagactatgcaggggaaaattcgtagcggggttgatacaggcaggggcatctggaaaggacgaaggaaacgtatacaggggaaacagcggagaacgggaagaggaggaggaaatgtgagctaaagaggaggaaggaatctgctcttccaccgttgaaagatcatcttcctgtttgacagaagctaagaggacgccgcgacctgcgcaaggcggatgaggcgaagagtctgacacgcgcggatgcatggggaaacagtgaaggggcacaagaaacaaaggagggtgaagctggcaagaaagcagtagcagcgaggcgtattccagggaccggaggcggaccagggcgaaatcgagcagagtgaaagccgaaaaagtcgtggagacgcgcgaaacgggacagaaaaggcgcgtatgaggccggatcgagacactctggagacgtcggggcgaagaggcgaggccgaagcaacgtgaatggtaagaatgggcagacaggaggtctagaagaaacagtatgacgaaacgaagaagtgctgcgggcagacgggatcgagaaagaaagaagacactgccgcagagaggcttggagaagtcgcgcgactcacagtgtcgcccgctagaatcgagtcactatgcgacgaaatgttttcgcaaaaaaggctcggtaaacgtagaggtgttcgagccgtttcacagggatgagggagaggcagacctgttttgtgtccccggcacctccgcaggtcccgcgagtgtcgtcatgtggctctggctcgttcgccgcgccgtcctctgtggagaattgcgggtcaatgcccatgtttcctttggagctgaggttcagggtttacacatctgttgtttaacgcatctcagtcttctcggggtaccttacagacgtccgtctgcacggctcacatgtccgacatgtctggagggagacacagttaagcgaatgcagacacctgggactgtcggtaactgtgaaatggaaaaggccgacttatctctgttgagcgcattgactcatttgcggcccaggaaaaactcacgcggcacagatactaactgcgtccggcgctaagttgaggcgcccgcttttctgctcagagccagatgtgcgaactttggcaagatgacagcggaagtgcggaacacacggcgcgaagagctagcggaagaagtcctccggtcgtggtggcgttctccgcggctcgacaaaaatcgatttcagtcgaagaaagtgctgaagcttgaagtcgagcgcaaaaacgcggcggtgagtcgcccgcgagagggcacttttctcaggaaatcgagcggtcgcagttggacccgatacagcgacaaccgtcttgttgcgttcttcgcgattctggaaaaagtggcccgctccaccgacccgatcaaaaaacgattctcctgatgtggccagttttgtccgcggtccgcatcatgagcgggagtggaatccctttcgagtgtacagacaactgaatgtgtacgctgccatctagtcttctggctgcatgcaagcgtgcccggccaaaagaatcccggaacgccgaagaaagggaacttctgaaagcgctttccgctacagagacaaggaaaggcaaccatagttgcacgcttttacggtcgacccgcggcagtaaagattgtttttcggtgataggctcagagccgagagacgccagcttggcgtgcagacaacgatgccgccgtgctgcctgtttccaacttctctctttgcctgaaaaaaataccggaaactgctcatctttgttttcgtatgaagagtcagcaaagaaaggcattgcgcctggggtacgcagaggagaccccgcgccagcttccgggggattcccgtcgctcggataagacgtaccggtgccggagagcgcggctgccgcacacttttacgtctcgagtgacggaaactgcgaagcccgcattctcttccggacacgggatagacagttcgcaggtgtctcattcgtgtgcgctttgccacggaactaacagagagcttttcgcaaaagcgcatcgcctacattaaaacgaagagtccgggaagttgtgaccgtcaccgagggcagcatggcacgcgcactatttgcactcttgggtctgtctcttctcgcttttccctcttactacacgtcagtatctgtcttcggttttcctcggcgttcatgctgtttctactcttttcctgctgtcctcaacccctctgtgttcgcttctgtccacttcaacacccctcttgcttgaacaccagtcacgtctgtctcctatcgcttgctactcctcttctgctacgagctttctcatgctgtcctatcgttgccgctgtttgtcctccagcttctcgactctgactctcatcacgattgatcaaatttctccgtcgtcctcgtcacctggaatcgctcaaacccttccccccacctaaaccaagggcgcccgtccacccca

SEQ ID NO: 3228 - DNA, 3841 bp, Toxoplasma gondii
ccgctgcttccagaaggcaggccctgacgaaagggtagtgtatgtacacccgaagtcgcgtgaagcgcggggctctgcagtcgaccgcggcgtcacttcccttcatttcggcggctccgcagacccgcgatgtggctgaagaacctctttggactgtgccttgcgagtcaccagccgatctccagttgagcgagaagcgttgccagcgctgcagcactgcgatgacgaacgaaaccgcaggaaaaccgacggtgtcgatgaagagcgagggcgccacgcccaggagaagcacctcgatagcggccagcccgcccgcgatgccttgacagagcagcgagcagaacgggtagcagcagggcagcagccacgtggaggatcgaactgggacaaggaccagcggagacggcagggcgcagtcaagagaagagacgttggcctttccttcagaggcttcaagagagagcgacgacgaagggagacccccgcgtgtctcagtgtggcaaggaagggagggcgacttcgagcgctcagccttggtctcgacagtcgccggccgcgctgtccatttacgtgggggtttcggctgttggtcttccggggaaagcagcgggtccagatcgactgaaaaagacgcaaaaaggtcttgcgcaggtctgcttcccgccgtgacagcgtagccaacgcgaggcctgtggaagcgagtgcccagaatgagagaaagaagcacggagaggaagtgcaaaagagcagactcgacgctgaggagccaagaggaaacagagccaccagagaactggaaacccagtctcacatccgggaggtcgacaggttcgagtgactccagccagggggagtcgtggcgtacgtataccgcaacgaagcgtcgcgtcggacaactcgcagcgtcgccgcacacgggaaacgcctgctcgtcctctctgccgccttcagccactgggttgtcttgtccggcttcgcctgtccggccgcggccgtctccctgtggccgaactcttgcttcagctgcgttccttgtctcagcgttctggcgcccttgcgtgcatttccgcaactcgtgagcgaccagactccacaaaacgcgctcgccgccagcccctgcatcgcactgagggtggaagaaagccacgcagttggcgggcggcggcagtctacgcagccagagaagcagcaggaaaaaagtcccgagggaaaaaagagcgaggcacgggagagccaagacgaaccgaagcagcgagaggaaaaggccaatgtgacacgcgaccctccaggggctttcctgcgaaaaggataacgccgccatcatcggcggagccggtgggacccgcggacaacaaaaggagaaccgcggaacggaccgggcgtacggtaggcacaagacaagcgacagaacagcccacgccaaccccttttcggggctgactttcggcgtctaataaatgcagcgtctgacagactgggcagcgcagagactctttcggaaggctcgcagaaaaggcggaagacggcgttcgattgaggcaaaggcacacttaaaacccagtcgcgggaacacgcgaatcttgagcactgtgttccaaacgcccgctgagcagacacggacaaggcgactgctgaaacttggaccaacgattccacgcgaccccttcgccaccaaacgcacccgccaagaaaattcggaaatcaacaatgttgcacggaaactgcagacaaaagccaacacacgcagtggggtgtatgtacatcgggccgcgtggctgcacacgtgggaagctggctagagtgggcgagactccacggcgtaaccttgcacgaaaaacgacgtgattgacgtttgctcccgtgaaagaaggctggcaagcagagaaagtctcgaaggacgcagcatcgccggaagaactgcggtaaccgtaactggctttctcgaaacgatgtcggtgaatgcttcttggcgcacaaaacgggtgaccttctggactgttgctgcgcctcggattctgagtggaactcagttgtgctcgccccggcaaccaagttcttgatgactgctgtaccaacgggttctacaaactggagagtgcggaacctggggatcgcgtttcctcccccgagtacggtgccaagaacgcctgcctgtcctgggtaccggattctctccgtgtctcgtttctctgcttcttttccgcggttctatagagcgatagcctccacagaaccggcaagtctccctgtgttttcttcaggagaacgcacgccggccacaacgtacccgggagaagagaggcgtcagctaacacgttcaaccgttcgtcgagcgcccagcggcttttcgctgaaaagcggaaagtgccatcaacgcacgagctaccagcgctggtttcgtgaacggagcaacttcagtaggatttccgtggtcacaaatgcagcttcgcccggagaagaaaacgggaactgtgtgtttccatcaaagacaacgagcagacgctgagaagacacaccgagactgggagcgagggtcctctggtagcattcaccgcgctacaaaaaaagctggcggagagcctgggaggcgtcgatgttcctccgcttcgcgcttctccaggcattcggttcagaaagacccagggaaacagttgaagaagttttgcagttcaaagacactttcttctctgtccacttggtgcgtcagcctgaaaaagaaaagctcccgcgtgtgaggctggattcttcaacggcacccgtggtttttgggtcgccgttgttcatcgaaatgcgttttctcgccactgaggaggcaacccgagtcgttcaattttttcgggtgctggctccgtacgagactcgtggcggatcttcaccgcttcggcgagaaaatcgggcaaaaccgcctctcttttcgtggttttgcggcgcgtgtagcgcccaagcagacttcgccagttgtacctcgtgacgggagtcgcagtcagtctctctgtagagattgtagtgtgtctgtttattgtgtgagagtactttcggtgtgcagacacgaattcgaatagagcggtgcgttcgtagatcctcttcgctgctgtagggcgacgccttcgtaccccgctcttttctgcgctacaagggtgctgttttgggggggtccctggaccaaagcaagaggctctccttcattttttcaagtccgtccacgtttggactcatacgcgtatagttgctggaacagacttcttgggagtgctatgccgctctctgtttgtcttacaagcagccgcgcttccgggtcgattcctgccgtggaactctctcgcccgctccggggtgtcatcgcctccgagacaagatcgcctgcaagcgtcttctgggtcctgcgtagctgtgcattgaactcctcgttcatgtcgtttaggtttcgtcggcctgtctcggccactggaatgtgtcgatgaagaggatcagatgtaaaaggccgcggctttcaggttgcgagtggttgaccgatcgcggcttctgcaaaatctcggcctccttctggaacctcgactctgtctccacgagcttccttgaccttctcgacgcacctcgctgcgtgtctctggcgttcccgagggtatgtcctgccttctgctctttcggtttcgtttcttttgtttcggccaagctcttcgccactctccctgtttgagagttccgccggccctcggctcctccttcttttctccttttcccgcagccagctgagtgactgactttgtctgccgcctccgccttctcccgcgctcctccgcgtcgcctccgcgtcaaaagcgcattccgcttgtggccgcca

SEQ ID NO: 3229 - DNA, 2602 bp, Toxoplasma gondii
gtgtcagcttcatgtgccgagtctctctaggtcagcagcgagatcggggaaaagtggacggtgctgctcgggaactgcatgcagtgctactctttgtggaaatgccaacccggcagcgcttcggtgttacgtcggagatgtctctaaagatattcgagttttcgaattcccgtgctagacatttggtcatttggcttggcttcttgttatcaataaggtatatcacgtgctgcgtcgaagatgggtttcctctgaccaatcgtatgacagctgtgctcttgttggttgcttgtcactggctgcccgaccgacgatgccgcttatttagagcgtgacagacttttcgcacggtatgcagttaatacggccgttgatgaagcacagaaacacgaaaaaactgacacggattgggctccgtttgttcgattttcgttggcaacacacacgcagatggggcaggaaaacgtgtgaaatgaaagccatcagcagctatggtgtaaacagctcatgtggacgattaaagggcatcatccgtttcaagtacattggggcatcacaggctagatacaaatgaagtcttcacggaaaacgagagaaacacgacgcaacaaacaaagaacagatattatccggaaccgtctgctcaccagttgttggccgttcaagagagagcttttaatgtcaaagggagggttggaagaaacatggaaacacgtaggaagttactccggcattacgacacctgaagtggtgtggcctcaatcgtaagcatcaagggttttccactcttgaagcgaaacacgcagcctcggcggccactaagcctctttttttagggaggggactgtggagatctggaaacgagcacaactatactaatattcatgctttgacgaagtctggctcctgcttcagtcatgtctctcccctcacaaatgcatccaacggcatatcaggactataatcggacggctgacgacgttggtaatagcatcctagttttcacgcgactgctcctctaaataggtggggtgaaaacagttcagagttgcaagttcatcaccccgatatttcatgataagaatgccgagttacagtaattagtcgcagaacgtcgggtgttgatgtaagctttccgccttgcttctgcaacgctacatgtccgcaactgccctgcggtcccgacaagcattcatcgcaggttagtttctctgcttacactgtggttgtctaaatgtcgtgacccctcttgtaggaccctctttgggcgtcatcattctaggaaagaaggcgcataaacgtagttgtaggggacgtaaatatccgagaaggcgttcttttgtgatcgaggaagattatacgcgtgtcggtcggatatgcgttttgtacacacgactaaaaacacctgcccgatgactttttttcagcgtctccttcgctgagcctgtctgaggaaggggaaagaagcaaacagctagggctgaatcgtttgcacagcagaacttccgacgtctgagaaaggtcttgtccaaatgtgaaatacgatacactgagtttgtgcacgaacacccaacgatattgacacacgttactgtcaatgcatcgggaaaatgctagcgaaaccgtctgcaggaaggtgtgccacaaaaaactcagagtggaaggagtgatgaactgtggaaaaaattcaaggcggaagaagaggtgttcattttgtggaggtcgcaggtaattcagcattcaaggaacgacgcatgattcgaggggccacccgtgggccccgaccctgttgtccatccttgtgccaagccccaagttgctatgcgaaagcggaagcaggttcccttcatgaatttgatgtattcgcgtggtcaaaaattcattgtcaagttcgtatttccatggttgaattatttcacacgacggacgcccctccaccccaacccgttatacaagcctctcttgtgttacacgtgaggcaggagcaggcgcccatccaccaagaagcgacaggttgcgatgtcgagcgaaaccgcttctacccgtctgagtgacctcatcgtgtcaatctctggcaccccactttcgagctgttgctgaaactgtgtgggtggccgtatgccgcctacactgtgtatcagctgagcagtcacacttccagcgcctccctgattcttggtaggcctcatcagcttcagaactgcgcatgttctagcccacatgtagactgcagggttgttttggaacctgtcgtaccagaggtggcggaaaaagtcgttcaattgccgtcatgttgacaccataataatagttcggctgaagaaagccagtcattcgttgatctggatgtacagtgtcctgtgaaaagccctacccggtaattcaacgccgtcgctgggttgatgctgatcacatgcctaacgcagtcagccgaagctgttgtaggcacttcttcagcgacatgagcgacagtgtgggcatgttgtggatcagctgccgacgtaggccctttcgtgaagacaacagttcagtggcttcgtgtggcatgtcggtccctcaacgaacagcttctgtacagaatttgcgagcctcatgtcgcata

SEQ ID NO: 3230 - DNA, 4271 bp, Toxoplasma gondii
cttgtaactgtgttctttgccgtgcctttgcgataacaccttctatctatccatcgcatcccgggtccgtagtcagtttactggcttttggaacagaggataccttcttgaatgtgtgacgttgtattcaatggctgaatgctctggttttgaagcatttgatgtgagtatggttcgaccacttgcgaaccttcgacgccctaatgtgcggcacgttccctctttgcatcgtttagttagatggtgaccttgcttctcagagtcatccacaatagagatacacgcgagaataatagcacggcggtggtggaaagactaatcatcacgtgcactctactcgcgaatctatagcttgcgttttagtctcacttttgaacgcagaaacttcggtactgtgtgcacggtggttgactgtcattagatctttgttgaccagactcccaccatttaggcggacgaacttccaacggagctggaacagtttgcataaatgatgatgtgaactgagacgaagctgctagtgactgcatgcttggtcaatgacgcggagggtgccatagtgtctggacacttggtgactggctcgtcgcggtggcggaacaattgcttacctgcgcataccttttgctattaatgctttgaacgcgtgcacatagtacacctggatgcgcagtttgtcgtttctttctagtgctttccctgttccctctgcaaggacgttgaccgagctgtagaaagacatccccactggccagcatgaggacgaaaacgcgtgcactggccttcgttgtgtgcatggcagcaactcgactcggaaacgtgactgccgacgaaccggcaaatcaggagcagcactgctgcgtcccccacgatggttggtttcctaaatcgactttctgtcgagcgtagtgaacgccgcaaactgtttcagcttctggggaaaaagaactcgcaaagggtatggcgatcgccattcccgtgtcttccatgtgatctatgcaccagaggaatatgtacagctatacggactgcagtcgctatgggaagtcatcagttgaatgcggaagcagccttggctcgcgagctggtaaggacgccatgcagccacttaactcttcacctctcaactagtgtcacattaaggcgaatgaagccgatgcgaaactgtataaagatggtacggttctctcgagtgtgccgtctcttctcctcttacattcattgttaatcagaagataagaagttagtagcagcggaaaaggtaaccgttcaccgccacggacctgagagatcaaactacgacgcagtcttcagaaagcggcactcgctaatgaagctgaagaagatgcaaggcatgagtaagaaatactacataaaccaacttcagcagaattcggacttttccctgtcaggttgagagaagaggttcgtggacattagttgcgatacattagacttcagtgcagatgtacttcatttcacttctcttaggaagagaaggataagcacgaggaggcagagatgtcaggcaagtgtgacaaaactatgctgtcaatctacaatacacctgtaacctcctttaaagctgtgagccaggaaagagtggccgctgcaaagaatctcctccagcacgaaggggtcaacctagaaaagcttgttgcggaggaggtgcgtgtataacagaaaccgccacagaaacgagcgagacccagtccacaatactgcaggaagagcttggtagaaaaatcgaagaagccaagtatgaaggtgaaagtggatccacggaggccgagcgagtaagacaagcctgttgaaccctatttctcagaagcattccccttgcaaaaacaggagttgaacgatactcagagctttttcctggctcttcgaaagatcaagggtcctcaccacatgggcatgctagttgcctgacaaatgagacggtggcacactacagaatccctagacgaaccgtgcgtgaaacccgcgggaagacgcggagcctctggctcttagttattcgtgcagagcccgtaatgcagatgttattgcgtgggaccgaagcgcatcaggttcatatatgtaaaacttctcaaccgtgtcgctaattgtcgctcggacccctggaagaggccagcccacagatacaattttcttgagtcgagagttgttgtcattcgcaagtttttcgaggctggggagcagcatagaaagcgcgtccggaagaagatacagaaacctgttgagtgaaaagcatcacagatgtgcattcgcatatgagcggtgatgttccagtgacccacacaaatctaaattgtgtcttgtttcaacgtacaagacggttgcagcagaaaaattaagctgggggtccaagaagtccgcttttgaaaatgtgacgcgacgatggacattatgccgctcagcattcgcgcgcgcacgttgcaccaagcaatcatccagatcgatgccgacgcctgcaccaaaaacgagtttgatcctcgctccggaagaacacggtcaacacggtactcagaagcaccttcactttttttttcagcaaaaatgatcgatgagagactgttttggttcaccggatacttaccagagcagctggttatccgggagcattcaacgagaactcgtccgtcgccgcatcctaaactgatcggccgagatacacgccaattacacaaattccaaacttgatccgtattgattgggcttgcccttcaacgcggtctgatatctccagattcagcagtgcagtcacttactcgtacaccacgtcggcttcgctgaggtttaaatgttgcaagatggaccttattttattctgcagttgtaaatgagtacagcaaagaactcaaggaatgaaggcgttcatgaagcttcgcccgttgaactcacctctggcactcgaggggacctacgtgctaagcctcaccacaggggttgctctgcagcaagacaacaccgcaggccatatcagatacaatatgttcttcagtttgtggctggttcgtggcgctcttttgtgttggttgacagtctcttactggaagggagatacgaagccgccgctgtcccagttttgtgagtgtggctgcatgccacagcagaggaaactcggcacagaatggatgtgcgcatggccacagagaaattgaatgaggtttgtcaccagcgtaggcatacagatctactcatcgttcctcaccaggtctggagttgttcccgtaaaaggcatccagtcggtttctgagtcgctgtcggagtattcagcatcatttcttgccgaagccccacaattatcccccatttcgatctgcacggcactcttgaagtttcactgtttttaagattagtcgttttcttcaatgaagtggccggtgtgtctccgttgagtcatgaacctatcatgcagaggtccagcagcggtgtcgagccgtgttacaatgtttgcgtgctgcgtttgtcctcatgctcaccctcgatagtgtagtgtgcatgcacccggaaacacgacccttctgcccactagccaaagcggatgatgtctgtgcctgggcagacaagttggccgcagtggaaaaactgaatgaatctgtgcgacctcttgaacaagtgcatctacgattgatcatcaagtaactctgtatcatggtgttggcacgtgactggcagcgctggagacgtccttcgtatgttgttgtcggtggtgaagtgatgcatgcacccattgtacgtcttcgtctgatgtccatgcttcagctccccagtttcctcatatgactgcctgtttactgaaaacccaaagcatagtctttgcaaaatagtcgcagataacttttgtcagaaacaggatctgtctgctgggtttctagctgcatccactgcagaccggcaggaggtccgtgtaagacagtgcctcagccttgtcacgagaaggaatgaaataaagtcaattttgtcacgtaggcactaaacgaactaggatctatcgtcgctttgtgcccgcgctcttttttctctccccatctgcttctctttcaatttcgggcttgatccacccatggaggtgagcgtcggtggttgacagttccttcacggcaggtgttacctaatgaatgtggtctcgcatctggttgcattattattaaccaacccagttatcgtggcttgagcaccttgttagctaacgaccgtcgtgattgcttctactcgcgaaccgctacctctatgtcagttgtaaaactgcgtctcttccgcga

SEQ ID NO: 3231 - DNA, 2903 bp, Toxoplasma gondii
ctctgaatccactcaggaaaagtagtccagagggctcatttgcggtgccggatccccgcgtcttttgtagagtcagctgctagccacattgccgccccccaggcttcccttccagcaccggcagactcactttcgtgagtcgaacaatgtgtcgcgctaccgttttccacatgatatccgcgccgttcaaattcaactctcggcatgagacagcaagggcctggagctgagcaggagacaggtctttggcatttgcgtggatgtcgcgcaggagacggaggaatctctcatccaggctcagttggctgaacgtcatgctggtttgagcgagctcttggaggtgaaacaccttgagtgacagcttcgtgtcgtcgtcgtattgttggacagcatgcaaagtcatcagcaccttcttctcctcttcgcgagacgcaaagggtactgtgaatggcggacagattcgcgcgtacgctccgggggtggacgccgacgctggcgaaaacagtggcgttcgcagctgcgaataggaccgcgtcctcacagcagcgtagcgcgagggaaggcaggctgaggagtcagtacactccggcgtcaacgactggccggcaccgccagccacacacgatggtctactctctaaatggcttttccatctttcgagtctgtgtgcgggtcctgttgtctgagctgacgaagaacacggccgtgggggcagatgtggagatgcgctgcaaccaagtctacgagttcgagagacgacgagggaatcccgacgactcacaatcgcggtcggctgctgctcaccactctctgcagctcttgcagcttcggactgcgttcgaagaaactggactcggcggcgcatcagcgtttcccgcatcgagagagcgtcgcgagtcagctcaggcgaaagaggccctcgaccccgacagcccgagaggaagcattccttcgagcaccctttcaagttcaccattctggaagagaaggaaaacaaaggggacgcgcttcccccgaagcctacacaggcaacgaccatccacaataaagtcggacgaccagaaccaaaggaggaagtcggggaaagcacctgtcagaacagggaagggactgtacggagcatttttcaaaagaaaagaaggcgtttttcgtcgtgttgcgtcgaaaggaacggctagttctcttgcgtgccacaaacgcaagagatgctcgccactgtcgctgcgattcgattactttgcattgtttttcggcagcacaaggaatggcgcggcggcagctgctcgaaagatatttcctgagaactaagcggagtttgaatctctaggaaatcaacggtatgcgtccatcgtggagagtttcactggctgcgatggggctgtcgattcaaagcgcatgcacaaaaaagttgagaaactcactccgcttggccgccacgcctgtcgagtggcaacgacgtcgattcatccgactttttgcctcgcaatcgtgcagctaggcttccgcgttcccaattttttctcactctacaacgacataatccatgtggctcgggctgaaggaaacggaggtttccagggaacgcagccaacagttaaagcagcggtatagcgatcagcgaagggctcccgcctcgcctttgtgtgtcttgtaacccagacacgacatgcgattttcggtaaatgccgcctagttgtgagcgacctttgcggttatagatcacccctgggttgaaacactctttgttgtctatcctgttgtccacacgaacgaaactggccagttagaaacaatcgactgattccgagttcggtgttctccccttacgctgcccttctcagagagttgccgctcaccttgaaaggcgcattcgagatttctgcggagagtcacatgtcacgtgtggacagtgtcgcttctttttggaaaatggaagcttcgtgcgattcttggtggagacgtggtatgcatcaaagaaggcgaaggacggcgtgcgagagggttacttgttgagcaccagtggcgcaatggatagcgcgtatccctcctaaggataaggttgtgggttcgagtcccatctggtgtgggttttggatcagtttcaaaagaggctcatcgccttcctttttttcactcttttgatcggtttttgctctcaatgacaacagtggattgtttctccttgacgaagaagtgcctctacaccccttcgcctcttgggctctgctccgtcccccccccttgtggcactcacggcagttcaactcgcgcttggccagttcggtccacatttccgctgcatctctactcgtcagcgctgttgttgatctcacctcgttgaccttctcatttctttctcttccgattctctttttgccccctttccttcttcagactctctcgcccgcctgtcggctcgtggacgttggcgccgcgtcctgccatgtttgttcttcgctgctcacgattgtttcacattccccacgtagtttctcttttccagtgactcgcgagttttcccggggctttttcgtggccttcctcttccagatatcacacgggttccgctgaacacctgcgaaaacagcgaactgcgtttcacgtctctttctctcctgggcctggctgaccgcttctgggggattctctgcccttgatttcgtgtttctctcgtctctctcttctcatccccttccttgcgcccttcttgttgctcgtttcggctctctttgtcgcctcaatctttgctgtccttgcttccgttctctcaccgacccgtcgttgattgcctccacttgaagcttccctctctctgagattttttccctgtgcttccctcgcgagactcaccgtctcgagtctcttctcttctgttgcagagcggatttctttcttccacacca

SEQ ID NO: 3232 - DNA, 4472 bp, Toxoplasma gondii
cgcatctggcgactgagacgtactcgatgtcgacgacgattcgtcgcctggaagaaccaccccagagtccgcccaaccgttctctgcaaacgcgtttttctctcctccctgaggatcctgcgaaccccccgagagccacagaggcgccggcgcagaagacaagacactcggaagaccgccgggaggggagatggaagcgaaggcggacgccgaagaagaggctggtgtcgaggacgaagagctagaggatgaggacgaagagttggaggtcgaggacgaagagttggaggtcgaggacgaagagctcgaggtcgagcagaggttccgattcagggagaaggtctcggcgccgacgcgcggttggccgatgagtcgccctgtcgttgagtgagtcgaggtgggggagagagacgctgcgaaggcggggagagaaggggaaccacccggctgagtgtcaaaggaaccgagaggcaccgggggtaaaggcggcggagagaaggaggggaacggggaagccgccacgccaggctgaggcggcggacgcgcaggagggccgttacggccctggctcggatccatgcggagaaggcagttggagaccagcctgcggaagacagagacgcctcagaaaaactctttcgagaactccgaaggacttcttcatccttccttggaaccgccgcataccccagagacgaggcggggtggcgggccagcagtcttcaccgcaaaagacgacactgaacagagaaggctcgcgctatctgatgcgctattgaaactgcggtgacacgacagaacctgggccggaaacaaacagatcgatgtgactgtggtagcggcaggtttacttggcgcaaagcaccagtccaagaggagaagttagagaggagcgttgctacctccacgcgcggtcgtttgtgagaacctctcggcgccctcggagtctcagaagtcagaagaaataagcgaagaaagagaccagacagacaggcggaagacacaaggaaagacccgcaaaagcgacggaataaacaggaccaacacagaaaacaaagagaggtgtatctgaaaggaaaagtcctctttaacaaagggagttcgatttgacagaggaggttctatttgacgggagaagatttgttcaacacaaggcgttccatttaacggtgaagctttccttgacaagagaggcgagccaggaagtcggagaagccccagaaggccagtgataagaaacccggggtgtatgtcgacggagagtgccggcgagcgaaaacaggtttaagaagtgccgacggagttgctggagattctgtgagacgccaaagacaaggtcttcttcgtagtccaccgaggcggaggagaacacaagccggccaaggcagaacctccaggaggtagcgcatgcagagaagaaaagagagaaagccgttatcgtcgaagctcgagaagaactgagtgactctgtggcacccctgatgcagaagtaccgaaaccgaaaaggaaaagttgaccactgccgctagtcctggttttagcaaaagcgaagtgtgcactgggacacacgaagccattgaggcagaagcaagaaacaggagagaacgagggagaagagactctttttgaatagcagagaaggacagggctcgtggctgtaaacgctcggtgaaaacggttaaagtcgcgtgctgaatcggactggagggtgcatgcaacgccaagctgaagcgcgaaaaagtctcgctttctccagtctcgctcacgactcgcaccctcctcgcaatcctcggtgtgttacgcgggagaaacgcggtcatggcattttcgctccttcttctgtggctccttttagtttgcagcaatcagaaaccaatccgaggaagacctaaccacgtgcattccctccgcgatgtcttgttgtcccgcgtgggaaggacaggaacggagagcgctgcgacgctcccgagatgccatccgtcacatatgtgtcttcgtaggcaggatccactgctaggaaatctcacctagactcgtagtcgatgcacgattgccgtgaaataagtgtgtatcggcattttggtagctttgcttatttgtgccgtcacctttgcgccgccttctcacgtgtgtgccgcttttgcccacttctcggttatcggcgcacccagcatcggtaggacacccagctgttaacgttggactacactcttgtgatgagcacaaaaaaggcatagaaacggcagctttctggactctttgaaacgggctctcgaggagaaagaaaagggggacacgcgaggtttcttctacgaggaaacgactcttgcacttccgcgaaccagccaccgtttgaattcgacggaatcgtatctagcacactcactacaaaggcaacctgaagaacaagacacctgaatgtgcgacgaagtgtgctcatacatctcaagcttactagaccactgcgtgtctccagtctttcaagagaacgacgtttagtgtatcacacgtaaggagactcttgtgaacagttcggtgaaatgcactcgcagaacatgcttgagttctgcagcaaaagatcatacaaagattccgacgcctaagaaacgctccgcagccttaccaacagagtcttcgaactcctgtcgcacacagttctacgcacggagaggatttccactctgccacgaaatcgagggattccttgttcaacaggttcgtattacgagagagagtttcacaccttgtgccacgcacggcatgagatcacttctgaatgtagaaagtgtctggcggaagtgacaaacaaaagccactttcgtcggagcacataggcaacgaacaaggcattgacacggaagtgcctgctttcacaatttccccagagatctgtaatggcatgacacttagggtgaaacgtgtttaaacatacgcttgtgtttgagtccccaactattgctgtgtctcccaactggactttgttttgcttttaagtcgaatattgtttttctagttatcatcattcagcaagcatgagcttagcacattccttccgttttttcagagatcggatcatactcgtcatgtctgtgttaatcgacttgacttctacagttctggaccgcggatccttgtaaagagacagaacttctgagatcattacaagattcaaggaggtgtctctcggattcctgctgctccctcacaattgctcgagctgattcctgcaaggaaaggcttcccttgttgactcgacgccgcaggcgatgctctctacatactttcggtattttgatctcttgcctcccctgagaaaacagaacagcgaatggacacgctagaatgcatgtcagtggaatggtgcggaagacaatgagaagcgcaagtttaacagcgtgagtctgtgtgtacatgcgatctcgagatcgacactaacgggtcaatggctgggttctttgctttcttttccgacagttcacgttccgttttcaccggaaaagacgaagaatcggcctcttcgccgcgtttccctcttgcccatatgcagatcgagtcaaccgtttcacaaatacccgcttgcgaaaaagccacatgctctttgttgttatgccaggggagaaaaatggctgccagaggaatgagggagaaaacgggagatatcgctgataacgaagcctaatcgtatcgaacactgcaatgcgtgcttcacaggacagctgtacttcgtcggtaccacggattttcattgcttctgtcgtaataagaagtaacagcacaaaagaacaggacgactccattcctgcagacgttatgtcagtgtttgtttttcagctcttcccacagatgttgtcactttgcttcggttccacatttccacgacagctgcctcagacttcattccggaatcagagggtcgtttaccgtgtaatacgtacacagagaaaacttcagcgaaacgatcaaggctgctcgtgtggccgtcgtcgtgtgggaagtgtaaagtccctctagcagtttcggtcggcgacccaccagttgtacgtttgaagacgcctttgcttttgctgcggtgtctgaagctgaaactttccggcgccaatgttcgactaagcagagaacggaaaaaaaagagaatcagaggcaagttacacagatgctcttggttttcgatggcggtttccgttaatacggagcaggtttcgttgtaaaatcgcccacctaaatgacagcttctgttgcttgtttccatgatttttttcgtctgaagaatcggccaacctacactgcccctcggcctcggaccgacacccggtcaaagtagccgttcatttttctccgtttctctgtggaaatcgctcttgttctttgccttgttgactttcctgtggcgacgcataccatgcgactcgcattatccgtgtgagtctcgttgtttttcttgtttctgccgcctattactttttcgccgttca
